United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 143

SEQ ID NO: 6068009 - DNA, 14 bp, Homo sapiens
ccgcgggccaggag

SEQ ID NO: 6068010 - DNA, 16 bp, Homo sapiens
ccgcgggcggccaggc

SEQ ID NO: 6068011 - DNA, 15 bp, Homo sapiens
ccgcgggctgactgg

SEQ ID NO: 6068012 - DNA, 22 bp, Homo sapiens
ccgcgggctgactgggccacag

SEQ ID NO: 6068013 - DNA, 20 bp, Homo sapiens
ccgcggggacattgggaagg

SEQ ID NO: 6068014 - DNA, 20 bp, Homo sapiens
ccgcggggaccctgccgagg

SEQ ID NO: 6068015 - DNA, 21 bp, Homo sapiens
ccgcgggtggctggagcccca

SEQ ID NO: 6068016 - DNA, 12 bp, Homo sapiens
ccgcgggtggga

SEQ ID NO: 6068017 - DNA, 19 bp, Homo sapiens
ccgcgggttccgcaggcag

SEQ ID NO: 6068018 - DNA, 21 bp, Homo sapiens
ccgcgggttctagacgcccct

SEQ ID NO: 6068019 - DNA, 20 bp, Homo sapiens
ccgcggtaggtaagggccgc

SEQ ID NO: 6068020 - DNA, 12 bp, Homo sapiens
ccgcggtgctct

SEQ ID NO: 6068021 - DNA, 17 bp, Homo sapiens
ccgcggtgctctggcgg

SEQ ID NO: 6068022 - DNA, 16 bp, Homo sapiens
ccgcggtgctgactga

SEQ ID NO: 6068023 - DNA, 22 bp, Homo sapiens
ccgcggtgctgactgaggcctg

SEQ ID NO: 6068024 - DNA, 17 bp, Homo sapiens
ccgcgtcccagctcccc

SEQ ID NO: 6068025 - DNA, 14 bp, Homo sapiens
ccgcgtccctgccc

SEQ ID NO: 6068026 - DNA, 19 bp, Homo sapiens
ccgcgtcgccctcccaggc

SEQ ID NO: 6068027 - DNA, 17 bp, Homo sapiens
ccgcgtctaccctggga

SEQ ID NO: 6068028 - DNA, 17 bp, Homo sapiens
ccgcgtctggtgacaac

SEQ ID NO: 6068029 - DNA, 21 bp, Homo sapiens
ccgcgtgacggacatccaggc

SEQ ID NO: 6068030 - DNA, 22 bp, Homo sapiens
ccgcgtgatcaaagccacactc

SEQ ID NO: 6068031 - DNA, 18 bp, Homo sapiens
ccgcgtgccgggccccca

SEQ ID NO: 6068032 - DNA, 22 bp, Homo sapiens
ccgcgtgccgggcccccaccgc

SEQ ID NO: 6068033 - DNA, 22 bp, Homo sapiens
ccgcgtgcggaggggacagagc

SEQ ID NO: 6068034 - DNA, 19 bp, Homo sapiens
ccgcgtttagaccaaggaa

SEQ ID NO: 6068035 - DNA, 23 bp, Homo sapiens
ccgctaaatatttaccttgaaaa

SEQ ID NO: 6068036 - DNA, 18 bp, Homo sapiens
ccgctaagttgctgatgg

SEQ ID NO: 6068037 - DNA, 18 bp, Homo sapiens
ccgctacaattctgcaga

SEQ ID NO: 6068038 - DNA, 17 bp, Homo sapiens
ccgctagaggcctgagg

SEQ ID NO: 6068039 - DNA, 21 bp, Homo sapiens
ccgctaggctcgccttccctc

SEQ ID NO: 6068040 - DNA, 20 bp, Homo sapiens
ccgctagtgcttgtggagat

SEQ ID NO: 6068041 - DNA, 16 bp, Homo sapiens
ccgctcaacctctcag

SEQ ID NO: 6068042 - DNA, 19 bp, Homo sapiens
ccgctcacctagagccaga

SEQ ID NO: 6068043 - DNA, 12 bp, Homo sapiens
ccgctcagccct

SEQ ID NO: 6068044 - DNA, 15 bp, Homo sapiens
ccgctcagccctccc

SEQ ID NO: 6068045 - DNA, 19 bp, Homo sapiens
ccgctcaggtagccaccac

SEQ ID NO: 6068046 - DNA, 20 bp, Homo sapiens
ccgctcaggtagccaccacc

SEQ ID NO: 6068047 - DNA, 12 bp, Homo sapiens
ccgctcagtgtc

SEQ ID NO: 6068048 - DNA, 15 bp, Homo sapiens
ccgctccagagtcag

SEQ ID NO: 6068049 - DNA, 22 bp, Homo sapiens
ccgctcccaacccccctcctgc

SEQ ID NO: 6068050 - DNA, 16 bp, Homo sapiens
ccgctcccacacccct

SEQ ID NO: 6068051 - DNA, 23 bp, Homo sapiens
ccgctcccacagcttcctgaggg

SEQ ID NO: 6068052 - DNA, 18 bp, Homo sapiens
ccgctcccaccagcccac

SEQ ID NO: 6068053 - DNA, 16 bp, Homo sapiens
ccgctcccaccgcccc

SEQ ID NO: 6068054 - DNA, 21 bp, Homo sapiens
ccgctcccaccgcccccaccc

SEQ ID NO: 6068055 - DNA, 23 bp, Homo sapiens
ccgctcccaccgcccccacccct

SEQ ID NO: 6068056 - DNA, 14 bp, Homo sapiens
ccgctccccacagc

SEQ ID NO: 6068057 - DNA, 17 bp, Homo sapiens
ccgctccccacctaccc

SEQ ID NO: 6068058 - DNA, 18 bp, Homo sapiens
ccgctccccacctaccca

SEQ ID NO: 6068059 - DNA, 16 bp, Homo sapiens
ccgctccccagcccag

SEQ ID NO: 6068060 - DNA, 13 bp, Homo sapiens
ccgctccccttgg

SEQ ID NO: 6068061 - DNA, 15 bp, Homo sapiens
ccgctcccctttccc

SEQ ID NO: 6068062 - DNA, 15 bp, Homo sapiens
ccgctcccgctccca

SEQ ID NO: 6068063 - DNA, 14 bp, Homo sapiens
ccgctccctggata

SEQ ID NO: 6068064 - DNA, 20 bp, Homo sapiens
ccgctcccttcctgccactg

SEQ ID NO: 6068065 - DNA, 21 bp, Homo sapiens
ccgctccgtctctgtcctcga

SEQ ID NO: 6068066 - DNA, 19 bp, Homo sapiens
ccgctcctcccctcttgag

SEQ ID NO: 6068067 - DNA, 13 bp, Homo sapiens
ccgctcctccctg

SEQ ID NO: 6068068 - DNA, 22 bp, Homo sapiens
ccgctcctgccgcagacgggca

SEQ ID NO: 6068069 - DNA, 14 bp, Homo sapiens
ccgctcctgcttcc

SEQ ID NO: 6068070 - DNA, 17 bp, Homo sapiens
ccgctcctgcttcccct

SEQ ID NO: 6068071 - DNA, 23 bp, Homo sapiens
ccgctcctgcttcccctccctac

SEQ ID NO: 6068072 - DNA, 15 bp, Homo sapiens
ccgctcctgtctgcc

SEQ ID NO: 6068073 - DNA, 17 bp, Homo sapiens
ccgctcctgtctgccag

SEQ ID NO: 6068074 - DNA, 21 bp, Homo sapiens
ccgctcctttacctaccacct

SEQ ID NO: 6068075 - DNA, 22 bp, Homo sapiens
ccgctcctttacctaccacctt

SEQ ID NO: 6068076 - DNA, 21 bp, Homo sapiens
ccgctcggaggccccaaagga

SEQ ID NO: 6068077 - DNA, 18 bp, Homo sapiens
ccgctctacatcttctgc

SEQ ID NO: 6068078 - DNA, 12 bp, Homo sapiens
ccgctctccctg

SEQ ID NO: 6068079 - DNA, 13 bp, Homo sapiens
ccgctctccctgt

SEQ ID NO: 6068080 - DNA, 15 bp, Homo sapiens
ccgctctcctgccac

SEQ ID NO: 6068081 - DNA, 15 bp, Homo sapiens
ccgctctctcatgtg

SEQ ID NO: 6068082 - DNA, 16 bp, Homo sapiens
ccgctctctcatgtgg

SEQ ID NO: 6068083 - DNA, 13 bp, Homo sapiens
ccgctctctctga

SEQ ID NO: 6068084 - DNA, 14 bp, Homo sapiens
ccgctctcttcctg

SEQ ID NO: 6068085 - DNA, 19 bp, Homo sapiens
ccgctctcttcctgcccct

SEQ ID NO: 6068086 - DNA, 13 bp, Homo sapiens
ccgctctgaggca

SEQ ID NO: 6068087 - DNA, 12 bp, Homo sapiens
ccgctctgattt

SEQ ID NO: 6068088 - DNA, 21 bp, Homo sapiens
ccgctctgcatgcggcccagc

SEQ ID NO: 6068089 - DNA, 19 bp, Homo sapiens
ccgctctgccatcagcccc

SEQ ID NO: 6068090 - DNA, 22 bp, Homo sapiens
ccgctctggggggttgcctcga

SEQ ID NO: 6068091 - DNA, 19 bp, Homo sapiens
ccgctcttcccaagtcctc

SEQ ID NO: 6068092 - DNA, 17 bp, Homo sapiens
ccgctgaacccacccgg

SEQ ID NO: 6068093 - DNA, 14 bp, Homo sapiens
ccgctgagaggctg

SEQ ID NO: 6068094 - DNA, 23 bp, Homo sapiens
ccgctgagcccactctactgccc

SEQ ID NO: 6068095 - DNA, 21 bp, Homo sapiens
ccgctgagcgcccccgagccc

SEQ ID NO: 6068096 - DNA, 22 bp, Homo sapiens
ccgctgagcgcccccgagccct

SEQ ID NO: 6068097 - DNA, 23 bp, Homo sapiens
ccgctgagcgcccccgagccctg

SEQ ID NO: 6068098 - DNA, 18 bp, Homo sapiens
ccgctgaggggtctcgga

SEQ ID NO: 6068099 - DNA, 13 bp, Homo sapiens
ccgctgataagca

SEQ ID NO: 6068100 - DNA, 17 bp, Homo sapiens
ccgctgatggagcccca

SEQ ID NO: 6068101 - DNA, 15 bp, Homo sapiens
ccgctgattctcagg

SEQ ID NO: 6068102 - DNA, 18 bp, Homo sapiens
ccgctgcaatgcctagac

SEQ ID NO: 6068103 - DNA, 14 bp, Homo sapiens
ccgctgcacacaga

SEQ ID NO: 6068104 - DNA, 17 bp, Homo sapiens
ccgctgcagggctccca

SEQ ID NO: 6068105 - DNA, 13 bp, Homo sapiens
ccgctgcagggtg

SEQ ID NO: 6068106 - DNA, 21 bp, Homo sapiens
ccgctgcagtcagcacagaga

SEQ ID NO: 6068107 - DNA, 12 bp, Homo sapiens
ccgctgccacca

SEQ ID NO: 6068108 - DNA, 22 bp, Homo sapiens
ccgctgccaccacgtctgccag

SEQ ID NO: 6068109 - DNA, 14 bp, Homo sapiens
ccgctgccacccac

SEQ ID NO: 6068110 - DNA, 17 bp, Homo sapiens
ccgctgccacccacctc

SEQ ID NO: 6068111 - DNA, 16 bp, Homo sapiens
ccgctgccacccgccc

SEQ ID NO: 6068112 - DNA, 18 bp, Homo sapiens
ccgctgccagcacagagc

SEQ ID NO: 6068113 - DNA, 13 bp, Homo sapiens
ccgctgccagcct

SEQ ID NO: 6068114 - DNA, 15 bp, Homo sapiens
ccgctgccagccttg

SEQ ID NO: 6068115 - DNA, 19 bp, Homo sapiens
ccgctgcccacgtcccggg

SEQ ID NO: 6068116 - DNA, 13 bp, Homo sapiens
ccgctgcccagcc

SEQ ID NO: 6068117 - DNA, 15 bp, Homo sapiens
ccgctgcccagccct

SEQ ID NO: 6068118 - DNA, 13 bp, Homo sapiens
ccatatgtagcat

SEQ ID NO: 6068119 - DNA, 20 bp, Homo sapiens
ccatatgtagcattaaatat

SEQ ID NO: 6068120 - DNA, 13 bp, Homo sapiens
ccatatgtccact

SEQ ID NO: 6068121 - DNA, 16 bp, Homo sapiens
ccatatgtctgcttct

SEQ ID NO: 6068122 - DNA, 18 bp, Homo sapiens
ccatatgtctgcttctgt

SEQ ID NO: 6068123 - DNA, 12 bp, Homo sapiens
ccatatgtgctt

SEQ ID NO: 6068124 - DNA, 22 bp, Homo sapiens
ccatatgtgtgaattctgcaac

SEQ ID NO: 6068125 - DNA, 14 bp, Homo sapiens
ccatatgttacact

SEQ ID NO: 6068126 - DNA, 15 bp, Homo sapiens
ccatattaattgcct

SEQ ID NO: 6068127 - DNA, 15 bp, Homo sapiens
ccatattacctggat

SEQ ID NO: 6068128 - DNA, 18 bp, Homo sapiens
ccatattacgttgtttct

SEQ ID NO: 6068129 - DNA, 22 bp, Homo sapiens
ccatattagaaaactttgttag

SEQ ID NO: 6068130 - DNA, 22 bp, Homo sapiens
ccatattcacaatggaaacttt

SEQ ID NO: 6068131 - DNA, 15 bp, Homo sapiens
ccatattcacacctc

SEQ ID NO: 6068132 - DNA, 21 bp, Homo sapiens
ccatattcagcatttgatttc

SEQ ID NO: 6068133 - DNA, 14 bp, Homo sapiens
ccatattccgcact

SEQ ID NO: 6068134 - DNA, 20 bp, Homo sapiens
ccatattctggttcttgaaa

SEQ ID NO: 6068135 - DNA, 22 bp, Homo sapiens
ccatattctgtagtatttttct

SEQ ID NO: 6068136 - DNA, 13 bp, Homo sapiens
ccatattgcacat

SEQ ID NO: 6068137 - DNA, 18 bp, Homo sapiens
ccatattgcacatgtctt

SEQ ID NO: 6068138 - DNA, 21 bp, Homo sapiens
ccatattgcacatgtcttaat

SEQ ID NO: 6068139 - DNA, 21 bp, Homo sapiens
ccatattgtgcttcacagtag

SEQ ID NO: 6068140 - DNA, 12 bp, Homo sapiens
ccatatttacat

SEQ ID NO: 6068141 - DNA, 23 bp, Homo sapiens
ccatatttacattctagttcaga

SEQ ID NO: 6068142 - DNA, 18 bp, Homo sapiens
ccatatttacctcagcct

SEQ ID NO: 6068143 - DNA, 20 bp, Homo sapiens
ccatatttacctcagcctgg

SEQ ID NO: 6068144 - DNA, 21 bp, Homo sapiens
ccatatttacctcagcctggg

SEQ ID NO: 6068145 - DNA, 23 bp, Homo sapiens
ccatatttagtataccagagaag

SEQ ID NO: 6068146 - DNA, 19 bp, Homo sapiens
ccatatttgaattggcctg

SEQ ID NO: 6068147 - DNA, 21 bp, Homo sapiens
ccatatttgaattggcctgaa

SEQ ID NO: 6068148 - DNA, 18 bp, Homo sapiens
ccatatttgatttctaat

SEQ ID NO: 6068149 - DNA, 14 bp, Homo sapiens
ccatatttggaaga

SEQ ID NO: 6068150 - DNA, 15 bp, Homo sapiens
ccatatttgtgttca

SEQ ID NO: 6068151 - DNA, 19 bp, Homo sapiens
ccatattttaaaaaatcaa

SEQ ID NO: 6068152 - DNA, 15 bp, Homo sapiens
ccatattttaaattc

SEQ ID NO: 6068153 - DNA, 13 bp, Homo sapiens
ccatatttttaaa

SEQ ID NO: 6068154 - DNA, 12 bp, Homo sapiens
ccatatttttct

SEQ ID NO: 6068155 - DNA, 15 bp, Homo sapiens
ccatcaaaaatattc

SEQ ID NO: 6068156 - DNA, 22 bp, Homo sapiens
ccatcaaagccctccctgtctg

SEQ ID NO: 6068157 - DNA, 21 bp, Homo sapiens
ccatcaaaggaatataagaaa

SEQ ID NO: 6068158 - DNA, 22 bp, Homo sapiens
ccatcaaaggaatataagaaaa

SEQ ID NO: 6068159 - DNA, 16 bp, Homo sapiens
ccatcaaagtggcaaa

SEQ ID NO: 6068160 - DNA, 16 bp, Homo sapiens
ccatcaagcacttccc

SEQ ID NO: 6068161 - DNA, 20 bp, Homo sapiens
ccatcaagcacttcccagga

SEQ ID NO: 6068162 - DNA, 13 bp, Homo sapiens
ccatcaagccacc

SEQ ID NO: 6068163 - DNA, 14 bp, Homo sapiens
ccatcaagccacca

SEQ ID NO: 6068164 - DNA, 17 bp, Homo sapiens
ccatcaaggtccagtgg

SEQ ID NO: 6068165 - DNA, 11 bp, Homo sapiens
ccatcaataaa

SEQ ID NO: 6068166 - DNA, 19 bp, Homo sapiens
ccatcaataaaaaattatg

SEQ ID NO: 6068167 - DNA, 16 bp, Homo sapiens
ccatcaatggaaacag

SEQ ID NO: 6068168 - DNA, 17 bp, Homo sapiens
ccatcacaggatgccag

SEQ ID NO: 6068169 - DNA, 18 bp, Homo sapiens
ccatcacaggatgccagc

SEQ ID NO: 6068170 - DNA, 21 bp, Homo sapiens
ccatcacaggatgccagcccc

SEQ ID NO: 6068171 - DNA, 22 bp, Homo sapiens
ccatcacaggatgccagcccct

SEQ ID NO: 6068172 - DNA, 16 bp, Homo sapiens
ccatcacatcccttca

SEQ ID NO: 6068173 - DNA, 15 bp, Homo sapiens
ccatcacatgaccac

SEQ ID NO: 6068174 - DNA, 15 bp, Homo sapiens
ccatcaccaccgcct

SEQ ID NO: 6068175 - DNA, 18 bp, Homo sapiens
ccatcaccacgcagagag

SEQ ID NO: 6068176 - DNA, 19 bp, Homo sapiens
ccatcaccataacctctgg

SEQ ID NO: 6068177 - DNA, 16 bp, Homo sapiens
ccatcaccatttggtg

SEQ ID NO: 6068178 - DNA, 15 bp, Homo sapiens
ccatcacccaagcca

SEQ ID NO: 6068179 - DNA, 14 bp, Homo sapiens
ccatcaccctcacc

SEQ ID NO: 6068180 - DNA, 21 bp, Homo sapiens
ccatcaccctctgggcagctg

SEQ ID NO: 6068181 - DNA, 16 bp, Homo sapiens
ccatcaccctcttcct

SEQ ID NO: 6068182 - DNA, 16 bp, Homo sapiens
ccatcaccgctgggtg

SEQ ID NO: 6068183 - DNA, 19 bp, Homo sapiens
ccatcaccgctgggtggtt

SEQ ID NO: 6068184 - DNA, 16 bp, Homo sapiens
ccatcacctcagatgg

SEQ ID NO: 6068185 - DNA, 17 bp, Homo sapiens
ccatcacctgaaacact

SEQ ID NO: 6068186 - DNA, 19 bp, Homo sapiens
ccatcacctgaaacactgg

SEQ ID NO: 6068187 - DNA, 20 bp, Homo sapiens
ccatcacctgaaacactgga

SEQ ID NO: 6068188 - DNA, 23 bp, Homo sapiens
ccatcacctgaaacactggacct

SEQ ID NO: 6068189 - DNA, 19 bp, Homo sapiens
ccatcacgcggccgagaca

SEQ ID NO: 6068190 - DNA, 14 bp, Homo sapiens
ccatcactcactca

SEQ ID NO: 6068191 - DNA, 15 bp, Homo sapiens
ccatcactcgcagga

SEQ ID NO: 6068192 - DNA, 13 bp, Homo sapiens
ccatcactgagtg

SEQ ID NO: 6068193 - DNA, 14 bp, Homo sapiens
ccatcactgcgcca

SEQ ID NO: 6068194 - DNA, 14 bp, Homo sapiens
ccatcactggagca

SEQ ID NO: 6068195 - DNA, 18 bp, Homo sapiens
ccatcactggagcaccag

SEQ ID NO: 6068196 - DNA, 19 bp, Homo sapiens
ccatcactggtccaggtct

SEQ ID NO: 6068197 - DNA, 17 bp, Homo sapiens
ccatcactgtgtctcat

SEQ ID NO: 6068198 - DNA, 12 bp, Homo sapiens
ccatcagaaatt

SEQ ID NO: 6068199 - DNA, 22 bp, Homo sapiens
ccatcagaggacacctgtactg

SEQ ID NO: 6068200 - DNA, 12 bp, Homo sapiens
ccatcagatgac

SEQ ID NO: 6068201 - DNA, 21 bp, Homo sapiens
ccatcagatgatgggagtggg

SEQ ID NO: 6068202 - DNA, 17 bp, Homo sapiens
ccatcagcaacatcatt

SEQ ID NO: 6068203 - DNA, 15 bp, Homo sapiens
ccatcagcagtgatt

SEQ ID NO: 6068204 - DNA, 21 bp, Homo sapiens
ccatcagcccaacgggaagca

SEQ ID NO: 6068205 - DNA, 16 bp, Homo sapiens
ccatcagcccctgctg

SEQ ID NO: 6068206 - DNA, 14 bp, Homo sapiens
ccatcagcccctgg

SEQ ID NO: 6068207 - DNA, 13 bp, Homo sapiens
ccatcagcggcgc

SEQ ID NO: 6068208 - DNA, 22 bp, Homo sapiens
ccatcagcgggtctcctcccag

SEQ ID NO: 6068209 - DNA, 23 bp, Homo sapiens
ccatcagcgggtctcctcccagc

SEQ ID NO: 6068210 - DNA, 12 bp, Homo sapiens
ccatcagctccc

SEQ ID NO: 6068211 - DNA, 13 bp, Homo sapiens
ccatcagctccca

SEQ ID NO: 6068212 - DNA, 14 bp, Homo sapiens
ccatcagctcccaa

SEQ ID NO: 6068213 - DNA, 13 bp, Homo sapiens
ccatcagctccct

SEQ ID NO: 6068214 - DNA, 15 bp, Homo sapiens
ccatcagctttataa

SEQ ID NO: 6068215 - DNA, 23 bp, Homo sapiens
ccatcagctttataataaactgt

SEQ ID NO: 6068216 - DNA, 17 bp, Homo sapiens
ccatcaggactcttgtg

SEQ ID NO: 6068217 - DNA, 15 bp, Homo sapiens
ccatcaggacttggg

SEQ ID NO: 6068218 - DNA, 12 bp, Homo sapiens
ccatcaggcagt

SEQ ID NO: 6068219 - DNA, 21 bp, Homo sapiens
ccatcagggatctcagaggct

SEQ ID NO: 6068220 - DNA, 13 bp, Homo sapiens
ccatcaggggcag

SEQ ID NO: 6068221 - DNA, 19 bp, Homo sapiens
ccatcagtgaaagaaactg

SEQ ID NO: 6068222 - DNA, 15 bp, Homo sapiens
ccatcagtgccagcc

SEQ ID NO: 6068223 - DNA, 17 bp, Homo sapiens
ccatcagtgccagcccc

SEQ ID NO: 6068224 - DNA, 12 bp, Homo sapiens
ccatcagtgctc

SEQ ID NO: 6068225 - DNA, 18 bp, Homo sapiens
ccatcagtgtacccccgc

SEQ ID NO: 6068226 - DNA, 21 bp, Homo sapiens
ccatcagttcccccagtacct

SEQ ID NO: 6068227 - DNA, 14 bp, Homo sapiens
ccatcataattcta

SEQ ID NO: 6068228 - DNA, 15 bp, Homo sapiens
ccatcataggaaggg

SEQ ID NO: 6068229 - DNA, 20 bp, Homo sapiens
ccatcatatcctttgcccca

SEQ ID NO: 6068230 - DNA, 17 bp, Homo sapiens
ccatcatatgacatgcc

SEQ ID NO: 6068231 - DNA, 23 bp, Homo sapiens
ccatcatatgacatgccaccctc

SEQ ID NO: 6068232 - DNA, 14 bp, Homo sapiens
ccatcatcactgta

SEQ ID NO: 6068233 - DNA, 20 bp, Homo sapiens
ccatcatcactgtaaagaca

SEQ ID NO: 6068234 - DNA, 13 bp, Homo sapiens
ccatcatcataga

SEQ ID NO: 6068235 - DNA, 16 bp, Homo sapiens
ccatcatcatgtgtgt

SEQ ID NO: 6068236 - DNA, 13 bp, Homo sapiens
ccatcatcctctg

SEQ ID NO: 6068237 - DNA, 14 bp, Homo sapiens
ccatcatcctctgg

SEQ ID NO: 6068238 - DNA, 15 bp, Homo sapiens
ccatcatcctctggc

SEQ ID NO: 6068239 - DNA, 12 bp, Homo sapiens
ccatcatctctg

SEQ ID NO: 6068240 - DNA, 15 bp, Homo sapiens
ccatcatctctgaag

SEQ ID NO: 6068241 - DNA, 17 bp, Homo sapiens
ccatcatctctgtaaac

SEQ ID NO: 6068242 - DNA, 16 bp, Homo sapiens
ccatcatgccacaccg

SEQ ID NO: 6068243 - DNA, 14 bp, Homo sapiens
ccatcatgcccagc

SEQ ID NO: 6068244 - DNA, 13 bp, Homo sapiens
ccatcatgccttg

SEQ ID NO: 6068245 - DNA, 23 bp, Homo sapiens
ccatcatgcggtgggtgctgcca

SEQ ID NO: 6068246 - DNA, 14 bp, Homo sapiens
ccatcatgtctgta

SEQ ID NO: 6068247 - DNA, 24 bp, Homo sapiens
ccatcatgtttcagtgaagatgct

SEQ ID NO: 6068248 - DNA, 18 bp, Homo sapiens
ccatcattccttctggcc

SEQ ID NO: 6068249 - DNA, 16 bp, Homo sapiens
ccatcattgcacctgc

SEQ ID NO: 6068250 - DNA, 22 bp, Homo sapiens
ccatcattgctgtctgcagcct

SEQ ID NO: 6068251 - DNA, 12 bp, Homo sapiens
ccatcatttctg

SEQ ID NO: 6068252 - DNA, 11 bp, Homo sapiens
ccatcatttta

SEQ ID NO: 6068253 - DNA, 22 bp, Homo sapiens
ccatccaaacactgaggcagcc

SEQ ID NO: 6068254 - DNA, 16 bp, Homo sapiens
ccatccaacagacctg

SEQ ID NO: 6068255 - DNA, 23 bp, Homo sapiens
ccatccaataaaaatcaggagcc

SEQ ID NO: 6068256 - DNA, 17 bp, Homo sapiens
ccatccacccctctggc

SEQ ID NO: 6068257 - DNA, 13 bp, Homo sapiens
ccatccaccctgc

SEQ ID NO: 6068258 - DNA, 16 bp, Homo sapiens
ccatccaccctgcagg

SEQ ID NO: 6068259 - DNA, 21 bp, Homo sapiens
ccatccaccgtcccctcccag

SEQ ID NO: 6068260 - DNA, 16 bp, Homo sapiens
ccatccacgtggcctc

SEQ ID NO: 6068261 - DNA, 21 bp, Homo sapiens
ccatccacgtggcctctctct

SEQ ID NO: 6068262 - DNA, 16 bp, Homo sapiens
ccatccactctaccct

SEQ ID NO: 6068263 - DNA, 19 bp, Homo sapiens
ccatccactctaccctccc

SEQ ID NO: 6068264 - DNA, 13 bp, Homo sapiens
ccatccactgtga

SEQ ID NO: 6068265 - DNA, 18 bp, Homo sapiens
ccatccacttacatatat

SEQ ID NO: 6068266 - DNA, 15 bp, Homo sapiens
ccatccagcatgtgt

SEQ ID NO: 6068267 - DNA, 17 bp, Homo sapiens
ccatccagccacggagg

SEQ ID NO: 6068268 - DNA, 20 bp, Homo sapiens
ccatccagccagaccccacg

SEQ ID NO: 6068269 - DNA, 13 bp, Homo sapiens
ccatccagctccc

SEQ ID NO: 6068270 - DNA, 16 bp, Homo sapiens
ccatccagcttgccag

SEQ ID NO: 6068271 - DNA, 13 bp, Homo sapiens
ccatccaggcagt

SEQ ID NO: 6068272 - DNA, 16 bp, Homo sapiens
ccatccagggtctggc

SEQ ID NO: 6068273 - DNA, 23 bp, Homo sapiens
ccatccagggtctggcagagcct

SEQ ID NO: 6068274 - DNA, 20 bp, Homo sapiens
ccatccaggtcttgactcat

SEQ ID NO: 6068275 - DNA, 15 bp, Homo sapiens
ccatccagtgggccc

SEQ ID NO: 6068276 - DNA, 23 bp, Homo sapiens
ccatccagttttggatcttttta

SEQ ID NO: 6068277 - DNA, 16 bp, Homo sapiens
ccatccatctccaggg

SEQ ID NO: 6068278 - DNA, 16 bp, Homo sapiens
ccatccattaggccag

SEQ ID NO: 6068279 - DNA, 20 bp, Homo sapiens
ccatccattctcctcagtgg

SEQ ID NO: 6068280 - DNA, 14 bp, Homo sapiens
ccatccattctgcc

SEQ ID NO: 6068281 - DNA, 15 bp, Homo sapiens
ccatccattctggaa

SEQ ID NO: 6068282 - DNA, 20 bp, Homo sapiens
ccatcccaaacccttcagtg

SEQ ID NO: 6068283 - DNA, 20 bp, Homo sapiens
ccatcccaaccagtgccaag

SEQ ID NO: 6068284 - DNA, 17 bp, Homo sapiens
ccatcccaagcccagtg

SEQ ID NO: 6068285 - DNA, 13 bp, Homo sapiens
ccatcccacctct

SEQ ID NO: 6068286 - DNA, 15 bp, Homo sapiens
ccatcccactccact

SEQ ID NO: 6068287 - DNA, 14 bp, Homo sapiens
ccatcccactgata

SEQ ID NO: 6068288 - DNA, 12 bp, Homo sapiens
ccatcccagccc

SEQ ID NO: 6068289 - DNA, 13 bp, Homo sapiens
ccatcccagcccc

SEQ ID NO: 6068290 - DNA, 15 bp, Homo sapiens
ccatcccagccttgg

SEQ ID NO: 6068291 - DNA, 14 bp, Homo sapiens
ccatcccaggacac

SEQ ID NO: 6068292 - DNA, 21 bp, Homo sapiens
ccatcccaggacaccacaccc

SEQ ID NO: 6068293 - DNA, 22 bp, Homo sapiens
ccatcccaggacaccacaccca

SEQ ID NO: 6068294 - DNA, 17 bp, Homo sapiens
ccatcccagggtcccac

SEQ ID NO: 6068295 - DNA, 21 bp, Homo sapiens
ccatcccagggtcccaccccc

SEQ ID NO: 6068296 - DNA, 12 bp, Homo sapiens
ccatcccagtcc

SEQ ID NO: 6068297 - DNA, 16 bp, Homo sapiens
ccatcccagtccctcg

SEQ ID NO: 6068298 - DNA, 16 bp, Homo sapiens
ccatcccagtgtccta

SEQ ID NO: 6068299 - DNA, 15 bp, Homo sapiens
ccgctgcccccaccc

SEQ ID NO: 6068300 - DNA, 19 bp, Homo sapiens
ccgctgcccccaccctgct

SEQ ID NO: 6068301 - DNA, 12 bp, Homo sapiens
ccgctgcccctg

SEQ ID NO: 6068302 - DNA, 13 bp, Homo sapiens
ccgctgcccctga

SEQ ID NO: 6068303 - DNA, 22 bp, Homo sapiens
ccgctgcccggcgccctctgtc

SEQ ID NO: 6068304 - DNA, 23 bp, Homo sapiens
ccgctgcccggcgccctctgtcc

SEQ ID NO: 6068305 - DNA, 17 bp, Homo sapiens
ccgctgccctgggtcct

SEQ ID NO: 6068306 - DNA, 16 bp, Homo sapiens
ccgctgccctttggcc

SEQ ID NO: 6068307 - DNA, 17 bp, Homo sapiens
ccgctgccgctgcacca

SEQ ID NO: 6068308 - DNA, 18 bp, Homo sapiens
ccgctgccgctgcaccac

SEQ ID NO: 6068309 - DNA, 20 bp, Homo sapiens
ccgctgcctaagtggctgct

SEQ ID NO: 6068310 - DNA, 22 bp, Homo sapiens
ccgctgcctcttggcttctcag

SEQ ID NO: 6068311 - DNA, 21 bp, Homo sapiens
ccgctgcctggcgggcagccc

SEQ ID NO: 6068312 - DNA, 22 bp, Homo sapiens
ccgctgcctggcgggcagcccc

SEQ ID NO: 6068313 - DNA, 17 bp, Homo sapiens
ccgctgccttttgctgc

SEQ ID NO: 6068314 - DNA, 21 bp, Homo sapiens
ccgctgccttttgctgctgct

SEQ ID NO: 6068315 - DNA, 13 bp, Homo sapiens
ccgctgcgctgcc

SEQ ID NO: 6068316 - DNA, 16 bp, Homo sapiens
ccgctgcgctgccctg

SEQ ID NO: 6068317 - DNA, 18 bp, Homo sapiens
ccgctgctccttggctta

SEQ ID NO: 6068318 - DNA, 16 bp, Homo sapiens
ccgctgctctcccagg

SEQ ID NO: 6068319 - DNA, 11 bp, Homo sapiens
ccgctgctgct

SEQ ID NO: 6068320 - DNA, 14 bp, Homo sapiens
ccgctgcttccagg

SEQ ID NO: 6068321 - DNA, 23 bp, Homo sapiens
ccgctgcttccaggctgggcagc

SEQ ID NO: 6068322 - DNA, 13 bp, Homo sapiens
ccgctggagccca

SEQ ID NO: 6068323 - DNA, 12 bp, Homo sapiens
ccgctggaggat

SEQ ID NO: 6068324 - DNA, 15 bp, Homo sapiens
ccgctggcagccacc

SEQ ID NO: 6068325 - DNA, 17 bp, Homo sapiens
ccgctggcccagggtag

SEQ ID NO: 6068326 - DNA, 15 bp, Homo sapiens
ccgctggccctgccg

SEQ ID NO: 6068327 - DNA, 23 bp, Homo sapiens
ccgctggctcacgcgttctggga

SEQ ID NO: 6068328 - DNA, 12 bp, Homo sapiens
ccgctggctccg

SEQ ID NO: 6068329 - DNA, 19 bp, Homo sapiens
ccgctggctcctccaggca

SEQ ID NO: 6068330 - DNA, 22 bp, Homo sapiens
ccgctggctttgggaaagccca

SEQ ID NO: 6068331 - DNA, 13 bp, Homo sapiens
ccgctgggagagc

SEQ ID NO: 6068332 - DNA, 19 bp, Homo sapiens
ccgctgggagagccaaggc

SEQ ID NO: 6068333 - DNA, 20 bp, Homo sapiens
ccgctgggagagccaaggcc

SEQ ID NO: 6068334 - DNA, 23 bp, Homo sapiens
ccgctgggagagccaaggcctat

SEQ ID NO: 6068335 - DNA, 19 bp, Homo sapiens
ccgctgggctgagccccta

SEQ ID NO: 6068336 - DNA, 12 bp, Homo sapiens
ccgctggggaac

SEQ ID NO: 6068337 - DNA, 11 bp, Homo sapiens
ccgctggggcc

SEQ ID NO: 6068338 - DNA, 14 bp, Homo sapiens
ccgctggggccagt

SEQ ID NO: 6068339 - DNA, 11 bp, Homo sapiens
ccgctggggtc

SEQ ID NO: 6068340 - DNA, 12 bp, Homo sapiens
ccgctggggtcc

SEQ ID NO: 6068341 - DNA, 16 bp, Homo sapiens
ccgctggggtccgtct

SEQ ID NO: 6068342 - DNA, 18 bp, Homo sapiens
ccgctggtccctgccctc

SEQ ID NO: 6068343 - DNA, 16 bp, Homo sapiens
ccgctgtaagctcctt

SEQ ID NO: 6068344 - DNA, 18 bp, Homo sapiens
ccgctgtaagctcctttg

SEQ ID NO: 6068345 - DNA, 20 bp, Homo sapiens
ccgctgtaagctcctttgtg

SEQ ID NO: 6068346 - DNA, 15 bp, Homo sapiens
ccgctgtatgtctta

SEQ ID NO: 6068347 - DNA, 20 bp, Homo sapiens
ccgctgtcacccagcaaggc

SEQ ID NO: 6068348 - DNA, 14 bp, Homo sapiens
ccgctgtcccaggg

SEQ ID NO: 6068349 - DNA, 18 bp, Homo sapiens
ccgctgtgagcccctggt

SEQ ID NO: 6068350 - DNA, 20 bp, Homo sapiens
ccgctgtgagcccctggtcc

SEQ ID NO: 6068351 - DNA, 18 bp, Homo sapiens
ccgctgtgcccccctcct

SEQ ID NO: 6068352 - DNA, 14 bp, Homo sapiens
ccgctgtgggaaac

SEQ ID NO: 6068353 - DNA, 23 bp, Homo sapiens
ccgctgtgtagggaccagtggga

SEQ ID NO: 6068354 - DNA, 19 bp, Homo sapiens
ccgctgtgtcctccctccc

SEQ ID NO: 6068355 - DNA, 19 bp, Homo sapiens
ccgctgttcacccacaggg

SEQ ID NO: 6068356 - DNA, 22 bp, Homo sapiens
ccgctgttgggggtttccctgt

SEQ ID NO: 6068357 - DNA, 17 bp, Homo sapiens
ccgctgttttggggtct

SEQ ID NO: 6068358 - DNA, 15 bp, Homo sapiens
ccgcttagcctgcct

SEQ ID NO: 6068359 - DNA, 16 bp, Homo sapiens
ccgcttagcctgcctc

SEQ ID NO: 6068360 - DNA, 17 bp, Homo sapiens
ccgcttagcctgcctca

SEQ ID NO: 6068361 - DNA, 18 bp, Homo sapiens
ccgcttagcctgcctcac

SEQ ID NO: 6068362 - DNA, 19 bp, Homo sapiens
ccgcttagcctgcctcacc

SEQ ID NO: 6068363 - DNA, 18 bp, Homo sapiens
ccgcttagcgctctggac

SEQ ID NO: 6068364 - DNA, 22 bp, Homo sapiens
ccgcttccagcttcctctgagc

SEQ ID NO: 6068365 - DNA, 12 bp, Homo sapiens
ccgcttcccaga

SEQ ID NO: 6068366 - DNA, 16 bp, Homo sapiens
ccgcttcccagaggcc

SEQ ID NO: 6068367 - DNA, 16 bp, Homo sapiens
ccgcttccccacagaa

SEQ ID NO: 6068368 - DNA, 13 bp, Homo sapiens
ccgcttccctcct

SEQ ID NO: 6068369 - DNA, 16 bp, Homo sapiens
ccgcttccctcctgcc

SEQ ID NO: 6068370 - DNA, 16 bp, Homo sapiens
ccgcttccctccttca

SEQ ID NO: 6068371 - DNA, 15 bp, Homo sapiens
ccgcttcctccggct

SEQ ID NO: 6068372 - DNA, 17 bp, Homo sapiens
ccgcttcctggcctccc

SEQ ID NO: 6068373 - DNA, 12 bp, Homo sapiens
ccgcttccttag

SEQ ID NO: 6068374 - DNA, 12 bp, Homo sapiens
ccgcttcgccat

SEQ ID NO: 6068375 - DNA, 21 bp, Homo sapiens
ccgcttcgccatgtgctgtgc

SEQ ID NO: 6068376 - DNA, 16 bp, Homo sapiens
ccgcttctcctgcagt

SEQ ID NO: 6068377 - DNA, 23 bp, Homo sapiens
ccgcttctcctgcagtctgtgga

SEQ ID NO: 6068378 - DNA, 22 bp, Homo sapiens
ccgcttctgaagctgctgcagc

SEQ ID NO: 6068379 - DNA, 15 bp, Homo sapiens
ccgcttctgcctgca

SEQ ID NO: 6068380 - DNA, 22 bp, Homo sapiens
ccgcttgcctcggctcctgctg

SEQ ID NO: 6068381 - DNA, 19 bp, Homo sapiens
ccgcttgctctcctggagc

SEQ ID NO: 6068382 - DNA, 18 bp, Homo sapiens
ccgcttggagcagagggg

SEQ ID NO: 6068383 - DNA, 13 bp, Homo sapiens
ccgcttggccacc

SEQ ID NO: 6068384 - DNA, 13 bp, Homo sapiens
ccgcttggtggcc

SEQ ID NO: 6068385 - DNA, 17 bp, Homo sapiens
ccgcttgtggggaccca

SEQ ID NO: 6068386 - DNA, 20 bp, Homo sapiens
ccgcttgtggggacccaggc

SEQ ID NO: 6068387 - DNA, 21 bp, Homo sapiens
ccgcttgtggggacccaggct

SEQ ID NO: 6068388 - DNA, 23 bp, Homo sapiens
ccgcttgtggggacccaggctcc

SEQ ID NO: 6068389 - DNA, 17 bp, Homo sapiens
ccgctttcctggagcca

SEQ ID NO: 6068390 - DNA, 12 bp, Homo sapiens
ccgctttctacc

SEQ ID NO: 6068391 - DNA, 19 bp, Homo sapiens
ccgctttctacccagcgag

SEQ ID NO: 6068392 - DNA, 11 bp, Homo sapiens
ccgctttctct

SEQ ID NO: 6068393 - DNA, 22 bp, Homo sapiens
ccgctttggttttttgtttggt

SEQ ID NO: 6068394 - DNA, 18 bp, Homo sapiens
ccgcttttgcagcagagg

SEQ ID NO: 6068395 - DNA, 15 bp, Homo sapiens
ccggaaccacagggc

SEQ ID NO: 6068396 - DNA, 17 bp, Homo sapiens
ccggaactgggctggcg

SEQ ID NO: 6068397 - DNA, 21 bp, Homo sapiens
ccggaagaaccagaagtgcag

SEQ ID NO: 6068398 - DNA, 23 bp, Homo sapiens
ccggaaggggcgctcctcccagc

SEQ ID NO: 6068399 - DNA, 23 bp, Homo sapiens
ccggaagggtgatcatcgacccc

SEQ ID NO: 6068400 - DNA, 22 bp, Homo sapiens
ccggaattgagaggtgggggat

SEQ ID NO: 6068401 - DNA, 15 bp, Homo sapiens
ccggacaagcccagg

SEQ ID NO: 6068402 - DNA, 17 bp, Homo sapiens
ccggacaagcccaggac

SEQ ID NO: 6068403 - DNA, 21 bp, Homo sapiens
ccggacacaagcggccctgac

SEQ ID NO: 6068404 - DNA, 14 bp, Homo sapiens
ccggacagctgccc

SEQ ID NO: 6068405 - DNA, 15 bp, Homo sapiens
ccggacagctgccca

SEQ ID NO: 6068406 - DNA, 21 bp, Homo sapiens
ccggacagctgcccagacaca

SEQ ID NO: 6068407 - DNA, 21 bp, Homo sapiens
ccggacaggtggggcctcagc

SEQ ID NO: 6068408 - DNA, 23 bp, Homo sapiens
ccggacatactctctgcctggtg

SEQ ID NO: 6068409 - DNA, 17 bp, Homo sapiens
ccggaccctctaacctc

SEQ ID NO: 6068410 - DNA, 18 bp, Homo sapiens
ccggacctacctccctcc

SEQ ID NO: 6068411 - DNA, 13 bp, Homo sapiens
ccggacctctgag

SEQ ID NO: 6068412 - DNA, 21 bp, Homo sapiens
ccggacgagttcatggggatc

SEQ ID NO: 6068413 - DNA, 14 bp, Homo sapiens
ccggacgctggctc

SEQ ID NO: 6068414 - DNA, 18 bp, Homo sapiens
ccggactgaccgaaggga

SEQ ID NO: 6068415 - DNA, 20 bp, Homo sapiens
ccggactgcaagcagggctc

SEQ ID NO: 6068416 - DNA, 16 bp, Homo sapiens
ccggactggtgccctc

SEQ ID NO: 6068417 - DNA, 18 bp, Homo sapiens
ccggactggtgccctcct

SEQ ID NO: 6068418 - DNA, 16 bp, Homo sapiens
ccggacttttctgcaa

SEQ ID NO: 6068419 - DNA, 21 bp, Homo sapiens
ccggagaacatctgccttgct

SEQ ID NO: 6068420 - DNA, 15 bp, Homo sapiens
ccggagacccacagc

SEQ ID NO: 6068421 - DNA, 18 bp, Homo sapiens
ccggagacccacagccct

SEQ ID NO: 6068422 - DNA, 19 bp, Homo sapiens
ccggagacccacagccctg

SEQ ID NO: 6068423 - DNA, 14 bp, Homo sapiens
ccggagagccagct

SEQ ID NO: 6068424 - DNA, 20 bp, Homo sapiens
ccggagagctggtgactttg

SEQ ID NO: 6068425 - DNA, 21 bp, Homo sapiens
ccggagagctggtgactttgg

SEQ ID NO: 6068426 - DNA, 22 bp, Homo sapiens
ccggagatagatgactttgcag

SEQ ID NO: 6068427 - DNA, 23 bp, Homo sapiens
ccggagatagatgactttgcaga

SEQ ID NO: 6068428 - DNA, 21 bp, Homo sapiens
ccggagatgcatctgtggcct

SEQ ID NO: 6068429 - DNA, 14 bp, Homo sapiens
ccggagatgtagca

SEQ ID NO: 6068430 - DNA, 17 bp, Homo sapiens
ccggagatgtagcaaaa

SEQ ID NO: 6068431 - DNA, 21 bp, Homo sapiens
ccggagattggacggcctgat

SEQ ID NO: 6068432 - DNA, 13 bp, Homo sapiens
ccggagcacagcc

SEQ ID NO: 6068433 - DNA, 15 bp, Homo sapiens
ccggagcacagccct

SEQ ID NO: 6068434 - DNA, 18 bp, Homo sapiens
ccggagcacagccctggg

SEQ ID NO: 6068435 - DNA, 21 bp, Homo sapiens
ccggagcagttggcctgtgct

SEQ ID NO: 6068436 - DNA, 22 bp, Homo sapiens
ccggagccatcaccctcaccca

SEQ ID NO: 6068437 - DNA, 21 bp, Homo sapiens
ccggagccccaagactctgct

SEQ ID NO: 6068438 - DNA, 23 bp, Homo sapiens
ccggagccccaagactctgctct

SEQ ID NO: 6068439 - DNA, 24 bp, Homo sapiens
ccggagccccaagactctgctctc

SEQ ID NO: 6068440 - DNA, 23 bp, Homo sapiens
ccggagcctcatgttctcttccc

SEQ ID NO: 6068441 - DNA, 18 bp, Homo sapiens
ccggagcgaccctggctc

SEQ ID NO: 6068442 - DNA, 14 bp, Homo sapiens
ccggagcgccctgc

SEQ ID NO: 6068443 - DNA, 15 bp, Homo sapiens
ccggagcgccctgca

SEQ ID NO: 6068444 - DNA, 15 bp, Homo sapiens
ccggagcggctgagg

SEQ ID NO: 6068445 - DNA, 16 bp, Homo sapiens
ccggagcggctgagga

SEQ ID NO: 6068446 - DNA, 20 bp, Homo sapiens
ccggagctaacactggcccc

SEQ ID NO: 6068447 - DNA, 20 bp, Homo sapiens
ccggagctgcccctctctgg

SEQ ID NO: 6068448 - DNA, 23 bp, Homo sapiens
ccggagctgcccctctctgggcc

SEQ ID NO: 6068449 - DNA, 10 bp, Homo sapiens
ccggagctgg

SEQ ID NO: 6068450 - DNA, 23 bp, Homo sapiens
ccggagctggaggatcccctcca

SEQ ID NO: 6068451 - DNA, 21 bp, Homo sapiens
ccggagctttcaaagaaggaa

SEQ ID NO: 6068452 - DNA, 23 bp, Homo sapiens
ccggaggaaccgaggtgttgcca

SEQ ID NO: 6068453 - DNA, 23 bp, Homo sapiens
ccggaggaaggtcccatggcctg

SEQ ID NO: 6068454 - DNA, 19 bp, Homo sapiens
ccggaggactgagccccca

SEQ ID NO: 6068455 - DNA, 20 bp, Homo sapiens
ccggaggactgagcccccac

SEQ ID NO: 6068456 - DNA, 22 bp, Homo sapiens
ccggaggactgagcccccaccg

SEQ ID NO: 6068457 - DNA, 22 bp, Homo sapiens
ccggaggagcatgcgcagaggc

SEQ ID NO: 6068458 - DNA, 15 bp, Homo sapiens
ccggaggaggagatg

SEQ ID NO: 6068459 - DNA, 18 bp, Homo sapiens
ccggaggccagctatctg

SEQ ID NO: 6068460 - DNA, 22 bp, Homo sapiens
ccggaggccagctatctgcctg

SEQ ID NO: 6068461 - DNA, 15 bp, Homo sapiens
ccggaggcgcccacc

SEQ ID NO: 6068462 - DNA, 17 bp, Homo sapiens
ccggaggcgcccacctg

SEQ ID NO: 6068463 - DNA, 21 bp, Homo sapiens
ccggaggcgcccacctgccca

SEQ ID NO: 6068464 - DNA, 20 bp, Homo sapiens
ccggaggcggtgggcctggt

SEQ ID NO: 6068465 - DNA, 19 bp, Homo sapiens
ccggaggctaaataaagtc

SEQ ID NO: 6068466 - DNA, 23 bp, Homo sapiens
ccggagggacgcggaggaggaag

SEQ ID NO: 6068467 - DNA, 17 bp, Homo sapiens
ccggagggaggcactag

SEQ ID NO: 6068468 - DNA, 17 bp, Homo sapiens
ccggagggcaggaccct

SEQ ID NO: 6068469 - DNA, 15 bp, Homo sapiens
ccggaggggacccag

SEQ ID NO: 6068470 - DNA, 19 bp, Homo sapiens
ccggaggggacccagctcc

SEQ ID NO: 6068471 - DNA, 18 bp, Homo sapiens
ccggagtaatcaggcagc

SEQ ID NO: 6068472 - DNA, 17 bp, Homo sapiens
ccggagtccctgcaggt

SEQ ID NO: 6068473 - DNA, 15 bp, Homo sapiens
ccggagtgagaagct

SEQ ID NO: 6068474 - DNA, 20 bp, Homo sapiens
ccggataattttttttaatt

SEQ ID NO: 6068475 - DNA, 17 bp, Homo sapiens
ccggatcagagcaggac

SEQ ID NO: 6068476 - DNA, 20 bp, Homo sapiens
ccatcccatatgcctgggca

SEQ ID NO: 6068477 - DNA, 21 bp, Homo sapiens
ccatcccatatgcctgggcag

SEQ ID NO: 6068478 - DNA, 14 bp, Homo sapiens
ccatcccatcccat

SEQ ID NO: 6068479 - DNA, 13 bp, Homo sapiens
ccatcccatcccg

SEQ ID NO: 6068480 - DNA, 22 bp, Homo sapiens
ccatccccaggtccccaaactt

SEQ ID NO: 6068481 - DNA, 18 bp, Homo sapiens
ccatccccatcggccctg

SEQ ID NO: 6068482 - DNA, 19 bp, Homo sapiens
ccatcccccacctgccagc

SEQ ID NO: 6068483 - DNA, 14 bp, Homo sapiens
ccatcccccctcac

SEQ ID NO: 6068484 - DNA, 16 bp, Homo sapiens
ccatcccccggcacct

SEQ ID NO: 6068485 - DNA, 15 bp, Homo sapiens
ccatccccctctgtc

SEQ ID NO: 6068486 - DNA, 15 bp, Homo sapiens
ccatccccctgccct

SEQ ID NO: 6068487 - DNA, 19 bp, Homo sapiens
ccatccccctgccctcgtg

SEQ ID NO: 6068488 - DNA, 14 bp, Homo sapiens
ccatcccccttctt

SEQ ID NO: 6068489 - DNA, 17 bp, Homo sapiens
ccatcccccttcttcct

SEQ ID NO: 6068490 - DNA, 17 bp, Homo sapiens
ccatccccgcagtgtgc

SEQ ID NO: 6068491 - DNA, 14 bp, Homo sapiens
ccatcccctccccg

SEQ ID NO: 6068492 - DNA, 21 bp, Homo sapiens
ccatcccctccctgcctgctc

SEQ ID NO: 6068493 - DNA, 18 bp, Homo sapiens
ccatcccctcctagcaca

SEQ ID NO: 6068494 - DNA, 16 bp, Homo sapiens
ccatcccctgcctcta

SEQ ID NO: 6068495 - DNA, 16 bp, Homo sapiens
ccatcccctgtagagt

SEQ ID NO: 6068496 - DNA, 22 bp, Homo sapiens
ccatcccctgtagagtgggagc

SEQ ID NO: 6068497 - DNA, 22 bp, Homo sapiens
ccatccccttgaggtctcagcc

SEQ ID NO: 6068498 - DNA, 23 bp, Homo sapiens
ccatccccttgaggtctcagccc

SEQ ID NO: 6068499 - DNA, 18 bp, Homo sapiens
ccatcccgatgaacctgc

SEQ ID NO: 6068500 - DNA, 22 bp, Homo sapiens
ccatcccgcttagcctgcctca

SEQ ID NO: 6068501 - DNA, 23 bp, Homo sapiens
ccatcccggcagcgaggctgggc

SEQ ID NO: 6068502 - DNA, 18 bp, Homo sapiens
ccatcccggcctgtaaca

SEQ ID NO: 6068503 - DNA, 16 bp, Homo sapiens
ccatcccgtaagacca

SEQ ID NO: 6068504 - DNA, 14 bp, Homo sapiens
ccatcccgtttaga

SEQ ID NO: 6068505 - DNA, 18 bp, Homo sapiens
ccatcccgtttccctcca

SEQ ID NO: 6068506 - DNA, 15 bp, Homo sapiens
ccatccctaccactg

SEQ ID NO: 6068507 - DNA, 22 bp, Homo sapiens
ccatccctagaagagcacagag

SEQ ID NO: 6068508 - DNA, 18 bp, Homo sapiens
ccatccctcggacccacc

SEQ ID NO: 6068509 - DNA, 15 bp, Homo sapiens
ccatccctgaaggcc

SEQ ID NO: 6068510 - DNA, 12 bp, Homo sapiens
ccatccctgaga

SEQ ID NO: 6068511 - DNA, 11 bp, Homo sapiens
ccatccctgcc

SEQ ID NO: 6068512 - DNA, 19 bp, Homo sapiens
ccatccctgccacatacag

SEQ ID NO: 6068513 - DNA, 15 bp, Homo sapiens
ccatccctgcctgga

SEQ ID NO: 6068514 - DNA, 17 bp, Homo sapiens
ccatccctgcctggtca

SEQ ID NO: 6068515 - DNA, 22 bp, Homo sapiens
ccatccctgctctggtcccctc

SEQ ID NO: 6068516 - DNA, 13 bp, Homo sapiens
ccatccctggccc

SEQ ID NO: 6068517 - DNA, 16 bp, Homo sapiens
ccatccctggccccct

SEQ ID NO: 6068518 - DNA, 19 bp, Homo sapiens
ccatccctggctgacctgc

SEQ ID NO: 6068519 - DNA, 21 bp, Homo sapiens
ccatccctggctgacctgctg

SEQ ID NO: 6068520 - DNA, 22 bp, Homo sapiens
ccatccctggctgacctgctgt

SEQ ID NO: 6068521 - DNA, 13 bp, Homo sapiens
ccatccctgtcat

SEQ ID NO: 6068522 - DNA, 14 bp, Homo sapiens
ccatcccttcccca

SEQ ID NO: 6068523 - DNA, 19 bp, Homo sapiens
ccatcccttttcctttctg

SEQ ID NO: 6068524 - DNA, 20 bp, Homo sapiens
ccatccgactgcccctgctg

SEQ ID NO: 6068525 - DNA, 14 bp, Homo sapiens
ccatccgcagactg

SEQ ID NO: 6068526 - DNA, 22 bp, Homo sapiens
ccatccgcagactgcttggcca

SEQ ID NO: 6068527 - DNA, 15 bp, Homo sapiens
ccatccggctcctgt

SEQ ID NO: 6068528 - DNA, 20 bp, Homo sapiens
ccatccgggacgcttccaga

SEQ ID NO: 6068529 - DNA, 20 bp, Homo sapiens
ccatccggtttgccatgttg

SEQ ID NO: 6068530 - DNA, 23 bp, Homo sapiens
ccatccggtttgccatgttgcca

SEQ ID NO: 6068531 - DNA, 13 bp, Homo sapiens
ccatccgtccagc

SEQ ID NO: 6068532 - DNA, 18 bp, Homo sapiens
ccatcctaccccctgtgc

SEQ ID NO: 6068533 - DNA, 16 bp, Homo sapiens
ccatcctaccctcggg

SEQ ID NO: 6068534 - DNA, 18 bp, Homo sapiens
ccatcctaccctcgggcc

SEQ ID NO: 6068535 - DNA, 23 bp, Homo sapiens
ccatcctaccctcgggcccacct

SEQ ID NO: 6068536 - DNA, 13 bp, Homo sapiens
ccatcctcaaaca

SEQ ID NO: 6068537 - DNA, 18 bp, Homo sapiens
ccatcctcaaacactgca

SEQ ID NO: 6068538 - DNA, 19 bp, Homo sapiens
ccatcctcaagatcattca

SEQ ID NO: 6068539 - DNA, 12 bp, Homo sapiens
ccatcctcagag

SEQ ID NO: 6068540 - DNA, 22 bp, Homo sapiens
ccatcctcagaggctgagccct

SEQ ID NO: 6068541 - DNA, 15 bp, Homo sapiens
ccatcctccagcagg

SEQ ID NO: 6068542 - DNA, 21 bp, Homo sapiens
ccatcctccccttccctgcaa

SEQ ID NO: 6068543 - DNA, 13 bp, Homo sapiens
ccatcctccctcc

SEQ ID NO: 6068544 - DNA, 16 bp, Homo sapiens
ccatcctcctccttcc

SEQ ID NO: 6068545 - DNA, 18 bp, Homo sapiens
ccatcctcctctccatgc

SEQ ID NO: 6068546 - DNA, 23 bp, Homo sapiens
ccatcctcctctccatgcaagtg

SEQ ID NO: 6068547 - DNA, 21 bp, Homo sapiens
ccatcctcctgtgtcactgaa

SEQ ID NO: 6068548 - DNA, 13 bp, Homo sapiens
ccatcctctccct

SEQ ID NO: 6068549 - DNA, 16 bp, Homo sapiens
ccatcctctgcctcaa

SEQ ID NO: 6068550 - DNA, 19 bp, Homo sapiens
ccatcctctgtacagagcc

SEQ ID NO: 6068551 - DNA, 21 bp, Homo sapiens
ccatcctctgtacagagccca

SEQ ID NO: 6068552 - DNA, 13 bp, Homo sapiens
ccatcctctgtta

SEQ ID NO: 6068553 - DNA, 16 bp, Homo sapiens
ccatcctcttctttta

SEQ ID NO: 6068554 - DNA, 16 bp, Homo sapiens
ccatcctgagccaggg

SEQ ID NO: 6068555 - DNA, 14 bp, Homo sapiens
ccatcctgaggacc

SEQ ID NO: 6068556 - DNA, 18 bp, Homo sapiens
ccatcctgaggctccact

SEQ ID NO: 6068557 - DNA, 21 bp, Homo sapiens
ccatcctgaggtgcctcccag

SEQ ID NO: 6068558 - DNA, 18 bp, Homo sapiens
ccatcctgatggacctgc

SEQ ID NO: 6068559 - DNA, 19 bp, Homo sapiens
ccatcctgatggacctgcc

SEQ ID NO: 6068560 - DNA, 21 bp, Homo sapiens
ccatcctgatggacctgcccc

SEQ ID NO: 6068561 - DNA, 16 bp, Homo sapiens
ccatcctgcaaaggcc

SEQ ID NO: 6068562 - DNA, 20 bp, Homo sapiens
ccatcctgcagatactttga

SEQ ID NO: 6068563 - DNA, 21 bp, Homo sapiens
ccatcctgcagcctcctcctg

SEQ ID NO: 6068564 - DNA, 22 bp, Homo sapiens
ccatcctgcagcctcctcctga

SEQ ID NO: 6068565 - DNA, 16 bp, Homo sapiens
ccatcctgccaggagc

SEQ ID NO: 6068566 - DNA, 21 bp, Homo sapiens
ccatcctgctcttccatttct

SEQ ID NO: 6068567 - DNA, 14 bp, Homo sapiens
ccatcctggagggc

SEQ ID NO: 6068568 - DNA, 16 bp, Homo sapiens
ccatcctggcccagcc

SEQ ID NO: 6068569 - DNA, 20 bp, Homo sapiens
ccatcctggcccagggcatc

SEQ ID NO: 6068570 - DNA, 22 bp, Homo sapiens
ccatcctggcccagggcatctg

SEQ ID NO: 6068571 - DNA, 14 bp, Homo sapiens
ccatcctggcccat

SEQ ID NO: 6068572 - DNA, 16 bp, Homo sapiens
ccatcctggcccctcc

SEQ ID NO: 6068573 - DNA, 18 bp, Homo sapiens
ccatcctggcccctccag

SEQ ID NO: 6068574 - DNA, 19 bp, Homo sapiens
ccatcctggcccctccaga

SEQ ID NO: 6068575 - DNA, 13 bp, Homo sapiens
ccatcctggctgc

SEQ ID NO: 6068576 - DNA, 12 bp, Homo sapiens
ccatcctggggc

SEQ ID NO: 6068577 - DNA, 20 bp, Homo sapiens
ccatcctggggcagcactcc

SEQ ID NO: 6068578 - DNA, 21 bp, Homo sapiens
ccatcctggggcagcactccc

SEQ ID NO: 6068579 - DNA, 19 bp, Homo sapiens
ccatcctggggttgccctg

SEQ ID NO: 6068580 - DNA, 15 bp, Homo sapiens
ccatcctgtcctttg

SEQ ID NO: 6068581 - DNA, 15 bp, Homo sapiens
ccatccttaactgtc

SEQ ID NO: 6068582 - DNA, 18 bp, Homo sapiens
ccatccttaactgtccag

SEQ ID NO: 6068583 - DNA, 19 bp, Homo sapiens
ccatccttagtacatgctc

SEQ ID NO: 6068584 - DNA, 20 bp, Homo sapiens
ccatccttagtacatgctct

SEQ ID NO: 6068585 - DNA, 19 bp, Homo sapiens
ccatccttcaccagagccc

SEQ ID NO: 6068586 - DNA, 13 bp, Homo sapiens
ccatccttccatc

SEQ ID NO: 6068587 - DNA, 19 bp, Homo sapiens
ccatccttcccaagaagag

SEQ ID NO: 6068588 - DNA, 15 bp, Homo sapiens
ccatccttcccatga

SEQ ID NO: 6068589 - DNA, 16 bp, Homo sapiens
ccatccttctgtgtac

SEQ ID NO: 6068590 - DNA, 13 bp, Homo sapiens
ccatccttggcct

SEQ ID NO: 6068591 - DNA, 14 bp, Homo sapiens
ccatcctttgcatt

SEQ ID NO: 6068592 - DNA, 17 bp, Homo sapiens
ccatccttttgcttcat

SEQ ID NO: 6068593 - DNA, 23 bp, Homo sapiens
ccatcgccagctgatgactcaag

SEQ ID NO: 6068594 - DNA, 19 bp, Homo sapiens
ccatcgccatcttcttccc

SEQ ID NO: 6068595 - DNA, 22 bp, Homo sapiens
ccatcgccgggactccagaacc

SEQ ID NO: 6068596 - DNA, 14 bp, Homo sapiens
ccatcgcgccagcg

SEQ ID NO: 6068597 - DNA, 14 bp, Homo sapiens
ccatcgctctgagc

SEQ ID NO: 6068598 - DNA, 13 bp, Homo sapiens
ccatcggactcat

SEQ ID NO: 6068599 - DNA, 15 bp, Homo sapiens
ccatcggccaagaat

SEQ ID NO: 6068600 - DNA, 14 bp, Homo sapiens
ccatcggccctgtc

SEQ ID NO: 6068601 - DNA, 16 bp, Homo sapiens
ccatcggccctgtccc

SEQ ID NO: 6068602 - DNA, 17 bp, Homo sapiens
ccatcgggtgccaaata

SEQ ID NO: 6068603 - DNA, 23 bp, Homo sapiens
ccatcgggtgtaggtgaaaggca

SEQ ID NO: 6068604 - DNA, 18 bp, Homo sapiens
ccatcggtcctgtctccc

SEQ ID NO: 6068605 - DNA, 22 bp, Homo sapiens
ccatcggtgtccatttatagaa

SEQ ID NO: 6068606 - DNA, 17 bp, Homo sapiens
ccatcgtataaggaaat

SEQ ID NO: 6068607 - DNA, 17 bp, Homo sapiens
ccatcgtccagccctcc

SEQ ID NO: 6068608 - DNA, 14 bp, Homo sapiens
ccatcgtcctggga

SEQ ID NO: 6068609 - DNA, 16 bp, Homo sapiens
ccatcgtcctgggact

SEQ ID NO: 6068610 - DNA, 21 bp, Homo sapiens
ccatcgtctcatcctcctttc

SEQ ID NO: 6068611 - DNA, 18 bp, Homo sapiens
ccatcgtgaagaagcctg

SEQ ID NO: 6068612 - DNA, 20 bp, Homo sapiens
ccatcgtgaagaagcctgta

SEQ ID NO: 6068613 - DNA, 23 bp, Homo sapiens
ccatcgtgtgtgccttgggtctc

SEQ ID NO: 6068614 - DNA, 16 bp, Homo sapiens
ccatctaaaccagaag

SEQ ID NO: 6068615 - DNA, 15 bp, Homo sapiens
ccatctaaactgccc

SEQ ID NO: 6068616 - DNA, 16 bp, Homo sapiens
ccatctaaactgcccc

SEQ ID NO: 6068617 - DNA, 20 bp, Homo sapiens
ccatctaaatacctgccctg

SEQ ID NO: 6068618 - DNA, 21 bp, Homo sapiens
ccatctaagcattccacactg

SEQ ID NO: 6068619 - DNA, 15 bp, Homo sapiens
ccatctaagctgcag

SEQ ID NO: 6068620 - DNA, 21 bp, Homo sapiens
ccatctaagctgcagcttcct

SEQ ID NO: 6068621 - DNA, 19 bp, Homo sapiens
ccatctaatgcttgtttat

SEQ ID NO: 6068622 - DNA, 17 bp, Homo sapiens
ccatctaatggcttcag

SEQ ID NO: 6068623 - DNA, 18 bp, Homo sapiens
ccatctaccacatcttca

SEQ ID NO: 6068624 - DNA, 13 bp, Homo sapiens
ccatctaccctcc

SEQ ID NO: 6068625 - DNA, 14 bp, Homo sapiens
ccatctaccttcca

SEQ ID NO: 6068626 - DNA, 21 bp, Homo sapiens
ccatctagactagcaatctct

SEQ ID NO: 6068627 - DNA, 23 bp, Homo sapiens
ccatctagccagcccctcttccc

SEQ ID NO: 6068628 - DNA, 20 bp, Homo sapiens
ccatctaggatgattttccc

SEQ ID NO: 6068629 - DNA, 17 bp, Homo sapiens
ccatctagtacttgaaa

SEQ ID NO: 6068630 - DNA, 14 bp, Homo sapiens
ccatctagtcacaa

SEQ ID NO: 6068631 - DNA, 17 bp, Homo sapiens
ccatctcaaaacaaaac

SEQ ID NO: 6068632 - DNA, 18 bp, Homo sapiens
ccatctcaaaacaaaaca

SEQ ID NO: 6068633 - DNA, 14 bp, Homo sapiens
ccatctcacacatg

SEQ ID NO: 6068634 - DNA, 18 bp, Homo sapiens
ccatctcacacatgagca

SEQ ID NO: 6068635 - DNA, 20 bp, Homo sapiens
ccatctcacacatgagcatc

SEQ ID NO: 6068636 - DNA, 14 bp, Homo sapiens
ccatctcacaccag

SEQ ID NO: 6068637 - DNA, 17 bp, Homo sapiens
ccatctcacctcctgct

SEQ ID NO: 6068638 - DNA, 13 bp, Homo sapiens
ccatctcactctt

SEQ ID NO: 6068639 - DNA, 17 bp, Homo sapiens
ccatctcagcctcctga

SEQ ID NO: 6068640 - DNA, 21 bp, Homo sapiens
ccatctcagcctcctgagcct

SEQ ID NO: 6068641 - DNA, 23 bp, Homo sapiens
ccatctcagcctcctgagcctgt

SEQ ID NO: 6068642 - DNA, 23 bp, Homo sapiens
ccatctcaggagatggagggctt

SEQ ID NO: 6068643 - DNA, 16 bp, Homo sapiens
ccatctcaggccacct

SEQ ID NO: 6068644 - DNA, 18 bp, Homo sapiens
ccatctcaggccagagcc

SEQ ID NO: 6068645 - DNA, 14 bp, Homo sapiens
ccatctcagtcact

SEQ ID NO: 6068646 - DNA, 13 bp, Homo sapiens
ccatctcatccta

SEQ ID NO: 6068647 - DNA, 20 bp, Homo sapiens
ccatctcatgcccctggctg

SEQ ID NO: 6068648 - DNA, 21 bp, Homo sapiens
ccatctcatgcccctggctgg

SEQ ID NO: 6068649 - DNA, 18 bp, Homo sapiens
ccatctccaagaatgctg

SEQ ID NO: 6068650 - DNA, 21 bp, Homo sapiens
ccatctccaagaatgctgaaa

SEQ ID NO: 6068651 - DNA, 22 bp, Homo sapiens
ccatctccaagataagcctgag

SEQ ID NO: 6068652 - DNA, 19 bp, Homo sapiens
ccatctccacaggagagac

SEQ ID NO: 6068653 - DNA, 18 bp, Homo sapiens
ccatctccacccccagct

SEQ ID NO: 6068654 - DNA, 20 bp, Homo sapiens
ccggatcagagcaggacctc

SEQ ID NO: 6068655 - DNA, 21 bp, Homo sapiens
ccggatcagagcaggacctcc

SEQ ID NO: 6068656 - DNA, 13 bp, Homo sapiens
ccggatcctgttg

SEQ ID NO: 6068657 - DNA, 16 bp, Homo sapiens
ccggatcgaggacaag

SEQ ID NO: 6068658 - DNA, 20 bp, Homo sapiens
ccggatctccaggcccagcc

SEQ ID NO: 6068659 - DNA, 16 bp, Homo sapiens
ccggatctgagggaga

SEQ ID NO: 6068660 - DNA, 13 bp, Homo sapiens
ccggatcttggag

SEQ ID NO: 6068661 - DNA, 20 bp, Homo sapiens
ccggatggcggacacctggc

SEQ ID NO: 6068662 - DNA, 12 bp, Homo sapiens
ccggattggccc

SEQ ID NO: 6068663 - DNA, 16 bp, Homo sapiens
ccggattggccctgcc

SEQ ID NO: 6068664 - DNA, 22 bp, Homo sapiens
ccggattggcttgtgtgtttca

SEQ ID NO: 6068665 - DNA, 20 bp, Homo sapiens
ccggcaaccccagttctgct

SEQ ID NO: 6068666 - DNA, 16 bp, Homo sapiens
ccggcaacctgtaact

SEQ ID NO: 6068667 - DNA, 14 bp, Homo sapiens
ccggcaagccacag

SEQ ID NO: 6068668 - DNA, 19 bp, Homo sapiens
ccggcaagccacaggaagg

SEQ ID NO: 6068669 - DNA, 18 bp, Homo sapiens
ccggcaagcgagcacagt

SEQ ID NO: 6068670 - DNA, 19 bp, Homo sapiens
ccggcaataaaagcccagg

SEQ ID NO: 6068671 - DNA, 14 bp, Homo sapiens
ccggcacacaaggc

SEQ ID NO: 6068672 - DNA, 12 bp, Homo sapiens
ccggcacagctg

SEQ ID NO: 6068673 - DNA, 13 bp, Homo sapiens
ccggcacagctgg

SEQ ID NO: 6068674 - DNA, 14 bp, Homo sapiens
ccggcacagctggg

SEQ ID NO: 6068675 - DNA, 14 bp, Homo sapiens
ccggcaccccctgc

SEQ ID NO: 6068676 - DNA, 18 bp, Homo sapiens
ccggcaccccctgcagct

SEQ ID NO: 6068677 - DNA, 19 bp, Homo sapiens
ccggcaccccctgcagctt

SEQ ID NO: 6068678 - DNA, 17 bp, Homo sapiens
ccggcacctcccttggg

SEQ ID NO: 6068679 - DNA, 13 bp, Homo sapiens
ccggcacctgcga

SEQ ID NO: 6068680 - DNA, 15 bp, Homo sapiens
ccggcacctgcgaga

SEQ ID NO: 6068681 - DNA, 16 bp, Homo sapiens
ccggcactcatgacgg

SEQ ID NO: 6068682 - DNA, 15 bp, Homo sapiens
ccggcactccatgct

SEQ ID NO: 6068683 - DNA, 23 bp, Homo sapiens
ccggcactgcatgttcctggaca

SEQ ID NO: 6068684 - DNA, 23 bp, Homo sapiens
ccggcagagctctacaggcctgc

SEQ ID NO: 6068685 - DNA, 17 bp, Homo sapiens
ccggcagaggcagggcc

SEQ ID NO: 6068686 - DNA, 23 bp, Homo sapiens
ccggcagaggcagggccctgggg

SEQ ID NO: 6068687 - DNA, 16 bp, Homo sapiens
ccggcagcagccccca

SEQ ID NO: 6068688 - DNA, 15 bp, Homo sapiens
ccggcagccccagcc

SEQ ID NO: 6068689 - DNA, 17 bp, Homo sapiens
ccggcagccccagcctg

SEQ ID NO: 6068690 - DNA, 21 bp, Homo sapiens
ccggcagccccagcctgctag

SEQ ID NO: 6068691 - DNA, 23 bp, Homo sapiens
ccggcagcctggttccctctttc

SEQ ID NO: 6068692 - DNA, 20 bp, Homo sapiens
ccggcatcatttcccctccc

SEQ ID NO: 6068693 - DNA, 21 bp, Homo sapiens
ccggcatcatttcccctcccg

SEQ ID NO: 6068694 - DNA, 23 bp, Homo sapiens
ccggcatcatttcccctcccgct

SEQ ID NO: 6068695 - DNA, 17 bp, Homo sapiens
ccggcatccttgcctgt

SEQ ID NO: 6068696 - DNA, 20 bp, Homo sapiens
ccggcatccttgcctgtcta

SEQ ID NO: 6068697 - DNA, 19 bp, Homo sapiens
ccggcatctcccctagctc

SEQ ID NO: 6068698 - DNA, 16 bp, Homo sapiens
ccggcatgctggcctg

SEQ ID NO: 6068699 - DNA, 17 bp, Homo sapiens
ccggcatgctggcctgt

SEQ ID NO: 6068700 - DNA, 18 bp, Homo sapiens
ccggcatgctggcctgtg

SEQ ID NO: 6068701 - DNA, 17 bp, Homo sapiens
ccggcattctctgccca

SEQ ID NO: 6068702 - DNA, 15 bp, Homo sapiens
ccggccaagatgctt

SEQ ID NO: 6068703 - DNA, 17 bp, Homo sapiens
ccggccaaggacactga

SEQ ID NO: 6068704 - DNA, 13 bp, Homo sapiens
ccggccaaggacc

SEQ ID NO: 6068705 - DNA, 16 bp, Homo sapiens
ccggccaaggacccag

SEQ ID NO: 6068706 - DNA, 15 bp, Homo sapiens
ccggccaatggaaac

SEQ ID NO: 6068707 - DNA, 16 bp, Homo sapiens
ccggccaatggaaacc

SEQ ID NO: 6068708 - DNA, 15 bp, Homo sapiens
ccggccacagctgct

SEQ ID NO: 6068709 - DNA, 17 bp, Homo sapiens
ccggccaccagatgctg

SEQ ID NO: 6068710 - DNA, 13 bp, Homo sapiens
ccggccacctctg

SEQ ID NO: 6068711 - DNA, 15 bp, Homo sapiens
ccggccacctctgcg

SEQ ID NO: 6068712 - DNA, 16 bp, Homo sapiens
ccggccacctgcggtg

SEQ ID NO: 6068713 - DNA, 18 bp, Homo sapiens
ccggccacctgcggtgct

SEQ ID NO: 6068714 - DNA, 20 bp, Homo sapiens
ccggccactccctgccaact

SEQ ID NO: 6068715 - DNA, 14 bp, Homo sapiens
ccggccactctgtt

SEQ ID NO: 6068716 - DNA, 16 bp, Homo sapiens
ccggccagcgggcaca

SEQ ID NO: 6068717 - DNA, 20 bp, Homo sapiens
ccggccagcgggcacagggc

SEQ ID NO: 6068718 - DNA, 17 bp, Homo sapiens
ccggccagctctggagt

SEQ ID NO: 6068719 - DNA, 16 bp, Homo sapiens
ccggccagctgggtgc

SEQ ID NO: 6068720 - DNA, 22 bp, Homo sapiens
ccggccagctgggtgccccagg

SEQ ID NO: 6068721 - DNA, 22 bp, Homo sapiens
ccggccaggccgcgcccagcag

SEQ ID NO: 6068722 - DNA, 14 bp, Homo sapiens
ccggccagggcctg

SEQ ID NO: 6068723 - DNA, 20 bp, Homo sapiens
ccggccaggtgcctcctgac

SEQ ID NO: 6068724 - DNA, 13 bp, Homo sapiens
ccggccaggtggg

SEQ ID NO: 6068725 - DNA, 14 bp, Homo sapiens
ccggccagtggcgg

SEQ ID NO: 6068726 - DNA, 17 bp, Homo sapiens
ccggcccaacctcgccc

SEQ ID NO: 6068727 - DNA, 20 bp, Homo sapiens
ccggcccaacctcgccctct

SEQ ID NO: 6068728 - DNA, 21 bp, Homo sapiens
ccggcccaacctcgccctctc

SEQ ID NO: 6068729 - DNA, 19 bp, Homo sapiens
ccggcccacgcagagcccc

SEQ ID NO: 6068730 - DNA, 22 bp, Homo sapiens
ccggcccacgcagagccccgga

SEQ ID NO: 6068731 - DNA, 15 bp, Homo sapiens
ccggcccacgtcctg

SEQ ID NO: 6068732 - DNA, 20 bp, Homo sapiens
ccggcccagagaccccttcc

SEQ ID NO: 6068733 - DNA, 14 bp, Homo sapiens
ccggcccaggagcg

SEQ ID NO: 6068734 - DNA, 15 bp, Homo sapiens
ccggcccaggagcgc

SEQ ID NO: 6068735 - DNA, 13 bp, Homo sapiens
ccggcccagtgcc

SEQ ID NO: 6068736 - DNA, 15 bp, Homo sapiens
ccggcccagtgccag

SEQ ID NO: 6068737 - DNA, 19 bp, Homo sapiens
ccggcccagtgccagctcc

SEQ ID NO: 6068738 - DNA, 16 bp, Homo sapiens
ccggcccagtgccccc

SEQ ID NO: 6068739 - DNA, 14 bp, Homo sapiens
ccggcccagttttg

SEQ ID NO: 6068740 - DNA, 21 bp, Homo sapiens
ccggcccatatccctggttgc

SEQ ID NO: 6068741 - DNA, 14 bp, Homo sapiens
ccggccccaccccc

SEQ ID NO: 6068742 - DNA, 20 bp, Homo sapiens
ccggccccaccccctgggca

SEQ ID NO: 6068743 - DNA, 12 bp, Homo sapiens
ccggccccagcc

SEQ ID NO: 6068744 - DNA, 17 bp, Homo sapiens
ccggccccagccagagt

SEQ ID NO: 6068745 - DNA, 18 bp, Homo sapiens
ccggccccagccagagtt

SEQ ID NO: 6068746 - DNA, 14 bp, Homo sapiens
ccggccccaggctc

SEQ ID NO: 6068747 - DNA, 23 bp, Homo sapiens
ccggccccccctcttttggcctt

SEQ ID NO: 6068748 - DNA, 18 bp, Homo sapiens
ccggccccgcgcgtgccc

SEQ ID NO: 6068749 - DNA, 19 bp, Homo sapiens
ccggccccggccccagcca

SEQ ID NO: 6068750 - DNA, 14 bp, Homo sapiens
ccggccccgtctct

SEQ ID NO: 6068751 - DNA, 22 bp, Homo sapiens
ccggccccgtctctcttggacc

SEQ ID NO: 6068752 - DNA, 19 bp, Homo sapiens
ccggcccctcaccctctgt

SEQ ID NO: 6068753 - DNA, 20 bp, Homo sapiens
ccggcccctcaccctctgtc

SEQ ID NO: 6068754 - DNA, 22 bp, Homo sapiens
ccggcccctcaccctctgtccc

SEQ ID NO: 6068755 - DNA, 17 bp, Homo sapiens
ccggcccctccccctga

SEQ ID NO: 6068756 - DNA, 14 bp, Homo sapiens
ccggcccctcctga

SEQ ID NO: 6068757 - DNA, 14 bp, Homo sapiens
ccggcccctgctgg

SEQ ID NO: 6068758 - DNA, 14 bp, Homo sapiens
ccggcccctggcag

SEQ ID NO: 6068759 - DNA, 15 bp, Homo sapiens
ccggcccctggcagc

SEQ ID NO: 6068760 - DNA, 20 bp, Homo sapiens
ccggcccctggcagcacagc

SEQ ID NO: 6068761 - DNA, 18 bp, Homo sapiens
ccggcccgcgccacagga

SEQ ID NO: 6068762 - DNA, 15 bp, Homo sapiens
ccggcccggctgagc

SEQ ID NO: 6068763 - DNA, 19 bp, Homo sapiens
ccggcccggctgagccctg

SEQ ID NO: 6068764 - DNA, 14 bp, Homo sapiens
ccggccctagccca

SEQ ID NO: 6068765 - DNA, 16 bp, Homo sapiens
ccggccctccagagcc

SEQ ID NO: 6068766 - DNA, 12 bp, Homo sapiens
ccggccctgccc

SEQ ID NO: 6068767 - DNA, 16 bp, Homo sapiens
ccggccctgccccaca

SEQ ID NO: 6068768 - DNA, 17 bp, Homo sapiens
ccggccctggctgggga

SEQ ID NO: 6068769 - DNA, 14 bp, Homo sapiens
ccggccctggcttg

SEQ ID NO: 6068770 - DNA, 13 bp, Homo sapiens
ccggccctggggc

SEQ ID NO: 6068771 - DNA, 13 bp, Homo sapiens
ccggccctgtgtg

SEQ ID NO: 6068772 - DNA, 15 bp, Homo sapiens
ccggccctgtgtgca

SEQ ID NO: 6068773 - DNA, 16 bp, Homo sapiens
ccggccgagctgcctg

SEQ ID NO: 6068774 - DNA, 19 bp, Homo sapiens
ccggccgagctgcctggcg

SEQ ID NO: 6068775 - DNA, 14 bp, Homo sapiens
ccggccgatggaga

SEQ ID NO: 6068776 - DNA, 15 bp, Homo sapiens
ccggccgcactggga

SEQ ID NO: 6068777 - DNA, 18 bp, Homo sapiens
ccggccgcactgggagca

SEQ ID NO: 6068778 - DNA, 13 bp, Homo sapiens
ccggccgcagccc

SEQ ID NO: 6068779 - DNA, 22 bp, Homo sapiens
ccggccgcagcccccactgacc

SEQ ID NO: 6068780 - DNA, 20 bp, Homo sapiens
ccggccgccccgccccagag

SEQ ID NO: 6068781 - DNA, 17 bp, Homo sapiens
ccggccgcgcaccgcca

SEQ ID NO: 6068782 - DNA, 17 bp, Homo sapiens
ccggccgcgccgccgcc

SEQ ID NO: 6068783 - DNA, 20 bp, Homo sapiens
ccggccgcggctccccctgg

SEQ ID NO: 6068784 - DNA, 15 bp, Homo sapiens
ccggccgctccacca

SEQ ID NO: 6068785 - DNA, 17 bp, Homo sapiens
ccggccgctccaccagc

SEQ ID NO: 6068786 - DNA, 19 bp, Homo sapiens
ccggccggacctctgagca

SEQ ID NO: 6068787 - DNA, 19 bp, Homo sapiens
ccggccggagaacatctgc

SEQ ID NO: 6068788 - DNA, 21 bp, Homo sapiens
ccggccggagccgcccaccgt

SEQ ID NO: 6068789 - DNA, 16 bp, Homo sapiens
ccggccggccacccag

SEQ ID NO: 6068790 - DNA, 14 bp, Homo sapiens
ccggccggcctggc

SEQ ID NO: 6068791 - DNA, 16 bp, Homo sapiens
ccggccggcctggcac

SEQ ID NO: 6068792 - DNA, 17 bp, Homo sapiens
ccggccggcctggcacc

SEQ ID NO: 6068793 - DNA, 15 bp, Homo sapiens
ccggcctaggcacct

SEQ ID NO: 6068794 - DNA, 22 bp, Homo sapiens
ccggcctaggcacctccccgct

SEQ ID NO: 6068795 - DNA, 23 bp, Homo sapiens
ccggcctcagcacccctgtctct

SEQ ID NO: 6068796 - DNA, 14 bp, Homo sapiens
ccggcctcagggcg

SEQ ID NO: 6068797 - DNA, 23 bp, Homo sapiens
ccggcctccactcccccacctga

SEQ ID NO: 6068798 - DNA, 13 bp, Homo sapiens
ccggcctccaggc

SEQ ID NO: 6068799 - DNA, 11 bp, Homo sapiens
ccggcctccta

SEQ ID NO: 6068800 - DNA, 12 bp, Homo sapiens
ccggcctctcca

SEQ ID NO: 6068801 - DNA, 16 bp, Homo sapiens
ccggcctctccctgcc

SEQ ID NO: 6068802 - DNA, 17 bp, Homo sapiens
ccggcctctccctgcct

SEQ ID NO: 6068803 - DNA, 19 bp, Homo sapiens
ccggcctctccctgcctgt

SEQ ID NO: 6068804 - DNA, 21 bp, Homo sapiens
ccggcctctccctgcctgtgg

SEQ ID NO: 6068805 - DNA, 23 bp, Homo sapiens
ccggcctctccctgcctgtggcc

SEQ ID NO: 6068806 - DNA, 19 bp, Homo sapiens
ccggcctctctgccccacc

SEQ ID NO: 6068807 - DNA, 15 bp, Homo sapiens
ccggcctctgctgcc

SEQ ID NO: 6068808 - DNA, 19 bp, Homo sapiens
ccggcctctgctgccccct

SEQ ID NO: 6068809 - DNA, 16 bp, Homo sapiens
ccggcctcttccaccc

SEQ ID NO: 6068810 - DNA, 18 bp, Homo sapiens
ccggcctcttccacccat

SEQ ID NO: 6068811 - DNA, 15 bp, Homo sapiens
ccggcctgcagccca

SEQ ID NO: 6068812 - DNA, 16 bp, Homo sapiens
ccggcctgccaggagg

SEQ ID NO: 6068813 - DNA, 16 bp, Homo sapiens
ccggcctgctcccagc

SEQ ID NO: 6068814 - DNA, 11 bp, Homo sapiens
ccggcctggac

SEQ ID NO: 6068815 - DNA, 17 bp, Homo sapiens
ccggcctggatgccagc

SEQ ID NO: 6068816 - DNA, 20 bp, Homo sapiens
ccggcctggatgccagctgt

SEQ ID NO: 6068817 - DNA, 17 bp, Homo sapiens
ccggcctggccccctcg

SEQ ID NO: 6068818 - DNA, 16 bp, Homo sapiens
ccggcctggccttttc

SEQ ID NO: 6068819 - DNA, 17 bp, Homo sapiens
ccggcctggctgcagct

SEQ ID NO: 6068820 - DNA, 19 bp, Homo sapiens
ccggcctggctgcagctgg

SEQ ID NO: 6068821 - DNA, 19 bp, Homo sapiens
ccggcctggggccgggctg

SEQ ID NO: 6068822 - DNA, 11 bp, Homo sapiens
ccggcctgtct

SEQ ID NO: 6068823 - DNA, 20 bp, Homo sapiens
ccggcctgtgggtctctgaa

SEQ ID NO: 6068824 - DNA, 15 bp, Homo sapiens
ccggcgagccctgtg

SEQ ID NO: 6068825 - DNA, 23 bp, Homo sapiens
ccggcgaggccggagagctggtg

SEQ ID NO: 6068826 - DNA, 23 bp, Homo sapiens
ccggcgcagcgcagagcgggctc

SEQ ID NO: 6068827 - DNA, 17 bp, Homo sapiens
ccggcgccccgcacccc

SEQ ID NO: 6068828 - DNA, 21 bp, Homo sapiens
ccggcgccccgcacccccgcc

SEQ ID NO: 6068829 - DNA, 15 bp, Homo sapiens
ccggcgccctctgtc

SEQ ID NO: 6068830 - DNA, 15 bp, Homo sapiens
ccggcgcctgccctg

SEQ ID NO: 6068831 - DNA, 20 bp, Homo sapiens
ccggcgcctggcctccaggc

SEQ ID NO: 6068832 - DNA, 21 bp, Homo sapiens
ccggcgcttgccactagggct

SEQ ID NO: 6068833 - DNA, 14 bp, Homo sapiens
ccggcggagctctg

SEQ ID NO: 6068834 - DNA, 13 bp, Homo sapiens
ccatctccaggga

SEQ ID NO: 6068835 - DNA, 12 bp, Homo sapiens
ccatctcccaag

SEQ ID NO: 6068836 - DNA, 19 bp, Homo sapiens
ccatctcccaaggctgcca

SEQ ID NO: 6068837 - DNA, 20 bp, Homo sapiens
ccatctcccaaggctgccag

SEQ ID NO: 6068838 - DNA, 21 bp, Homo sapiens
ccatctcccaaggctgccaga

SEQ ID NO: 6068839 - DNA, 16 bp, Homo sapiens
ccatctcccctcagct

SEQ ID NO: 6068840 - DNA, 15 bp, Homo sapiens
ccatctccctggtgc

SEQ ID NO: 6068841 - DNA, 20 bp, Homo sapiens
ccatctccctggtgcttatg

SEQ ID NO: 6068842 - DNA, 17 bp, Homo sapiens
ccatctccgcctccaca

SEQ ID NO: 6068843 - DNA, 14 bp, Homo sapiens
ccatctccgctgtt

SEQ ID NO: 6068844 - DNA, 18 bp, Homo sapiens
ccatctcctcccatggcc

SEQ ID NO: 6068845 - DNA, 19 bp, Homo sapiens
ccatctccttacctctgga

SEQ ID NO: 6068846 - DNA, 17 bp, Homo sapiens
ccatctccttcccccag

SEQ ID NO: 6068847 - DNA, 21 bp, Homo sapiens
ccatctccttcccccagccca

SEQ ID NO: 6068848 - DNA, 17 bp, Homo sapiens
ccatctcctttcaggga

SEQ ID NO: 6068849 - DNA, 13 bp, Homo sapiens
ccatctcggagca

SEQ ID NO: 6068850 - DNA, 20 bp, Homo sapiens
ccatctcgggcacaggccca

SEQ ID NO: 6068851 - DNA, 18 bp, Homo sapiens
ccatctcggggctgctgt

SEQ ID NO: 6068852 - DNA, 22 bp, Homo sapiens
ccatctcgtagtggtacattcc

SEQ ID NO: 6068853 - DNA, 17 bp, Homo sapiens
ccatctctaccatcatc

SEQ ID NO: 6068854 - DNA, 23 bp, Homo sapiens
ccatctctatataaaaacaaaaa

SEQ ID NO: 6068855 - DNA, 14 bp, Homo sapiens
ccatctctcccact

SEQ ID NO: 6068856 - DNA, 17 bp, Homo sapiens
ccatctctccctcccct

SEQ ID NO: 6068857 - DNA, 22 bp, Homo sapiens
ccatctctccctcctggtgaag

SEQ ID NO: 6068858 - DNA, 21 bp, Homo sapiens
ccatctctctactgctggact

SEQ ID NO: 6068859 - DNA, 18 bp, Homo sapiens
ccatctctctcttgcctg

SEQ ID NO: 6068860 - DNA, 13 bp, Homo sapiens
ccatctctctggc

SEQ ID NO: 6068861 - DNA, 13 bp, Homo sapiens
ccatctctgaaaa

SEQ ID NO: 6068862 - DNA, 14 bp, Homo sapiens
ccatctctgaaaac

SEQ ID NO: 6068863 - DNA, 11 bp, Homo sapiens
ccatctctgcc

SEQ ID NO: 6068864 - DNA, 14 bp, Homo sapiens
ccatctctgcctgt

SEQ ID NO: 6068865 - DNA, 14 bp, Homo sapiens
ccatctctgctgct

SEQ ID NO: 6068866 - DNA, 22 bp, Homo sapiens
ccatctctgctgcttctgggcc

SEQ ID NO: 6068867 - DNA, 22 bp, Homo sapiens
ccatctctggatgcctgattgc

SEQ ID NO: 6068868 - DNA, 22 bp, Homo sapiens
ccatctctggttgacgggctgt

SEQ ID NO: 6068869 - DNA, 16 bp, Homo sapiens
ccatctctgtctgggg

SEQ ID NO: 6068870 - DNA, 12 bp, Homo sapiens
ccatctctgtga

SEQ ID NO: 6068871 - DNA, 12 bp, Homo sapiens
ccatctcttcct

SEQ ID NO: 6068872 - DNA, 13 bp, Homo sapiens
ccatctcttccta

SEQ ID NO: 6068873 - DNA, 14 bp, Homo sapiens
ccatctcttccttg

SEQ ID NO: 6068874 - DNA, 14 bp, Homo sapiens
ccatctcttccttt

SEQ ID NO: 6068875 - DNA, 18 bp, Homo sapiens
ccatctctttaaaaacaa

SEQ ID NO: 6068876 - DNA, 18 bp, Homo sapiens
ccatctgaaccactttgc

SEQ ID NO: 6068877 - DNA, 12 bp, Homo sapiens
ccatctgaagag

SEQ ID NO: 6068878 - DNA, 17 bp, Homo sapiens
ccatctgattaaaacaa

SEQ ID NO: 6068879 - DNA, 18 bp, Homo sapiens
ccatctgcacacacctcc

SEQ ID NO: 6068880 - DNA, 23 bp, Homo sapiens
ccatctgcaccccttctctcctc

SEQ ID NO: 6068881 - DNA, 15 bp, Homo sapiens
ccatctgcattccca

SEQ ID NO: 6068882 - DNA, 12 bp, Homo sapiens
ccatctgcccag

SEQ ID NO: 6068883 - DNA, 13 bp, Homo sapiens
ccatctgcccagg

SEQ ID NO: 6068884 - DNA, 21 bp, Homo sapiens
ccatctgcccaggggtgcccc

SEQ ID NO: 6068885 - DNA, 22 bp, Homo sapiens
ccatctgcccgcctgcccacct

SEQ ID NO: 6068886 - DNA, 13 bp, Homo sapiens
ccatctgccctcc

SEQ ID NO: 6068887 - DNA, 15 bp, Homo sapiens
ccatctgccgcctgg

SEQ ID NO: 6068888 - DNA, 17 bp, Homo sapiens
ccatctgcgcagggtgg

SEQ ID NO: 6068889 - DNA, 20 bp, Homo sapiens
ccatctgcgtgacaataaaa

SEQ ID NO: 6068890 - DNA, 13 bp, Homo sapiens
ccatctgctgagc

SEQ ID NO: 6068891 - DNA, 20 bp, Homo sapiens
ccatctggaaatccagctgg

SEQ ID NO: 6068892 - DNA, 22 bp, Homo sapiens
ccatctggagagcccagagtcc

SEQ ID NO: 6068893 - DNA, 16 bp, Homo sapiens
ccatctggcagggtgg

SEQ ID NO: 6068894 - DNA, 13 bp, Homo sapiens
ccatctggcccag

SEQ ID NO: 6068895 - DNA, 16 bp, Homo sapiens
ccatctggcccaggct

SEQ ID NO: 6068896 - DNA, 19 bp, Homo sapiens
ccatctggcccaggctggc

SEQ ID NO: 6068897 - DNA, 16 bp, Homo sapiens
ccatctgggctcctcc

SEQ ID NO: 6068898 - DNA, 18 bp, Homo sapiens
ccatctgggtccttgcac

SEQ ID NO: 6068899 - DNA, 14 bp, Homo sapiens
ccatctggtgcctt

SEQ ID NO: 6068900 - DNA, 21 bp, Homo sapiens
ccatctggtgcctttccacac

SEQ ID NO: 6068901 - DNA, 23 bp, Homo sapiens
ccatctggttaggatggcaggac

SEQ ID NO: 6068902 - DNA, 15 bp, Homo sapiens
ccatctgtaaatatc

SEQ ID NO: 6068903 - DNA, 14 bp, Homo sapiens
ccatctgtaccctg

SEQ ID NO: 6068904 - DNA, 17 bp, Homo sapiens
ccatctgtaccctgctt

SEQ ID NO: 6068905 - DNA, 20 bp, Homo sapiens
ccatctgtaccctgcttccc

SEQ ID NO: 6068906 - DNA, 13 bp, Homo sapiens
ccatctgtccaca

SEQ ID NO: 6068907 - DNA, 15 bp, Homo sapiens
ccatctgtccagctg

SEQ ID NO: 6068908 - DNA, 17 bp, Homo sapiens
ccatctgtccatcctcc

SEQ ID NO: 6068909 - DNA, 18 bp, Homo sapiens
ccatctgtccatcctcct

SEQ ID NO: 6068910 - DNA, 20 bp, Homo sapiens
ccatctgtccatcctcctct

SEQ ID NO: 6068911 - DNA, 22 bp, Homo sapiens
ccatctgtccatcctcctctcc

SEQ ID NO: 6068912 - DNA, 19 bp, Homo sapiens
ccatctgtccgtccagagc

SEQ ID NO: 6068913 - DNA, 18 bp, Homo sapiens
ccatctgtcttgccagcc

SEQ ID NO: 6068914 - DNA, 22 bp, Homo sapiens
ccatctgtcttgccagccagaa

SEQ ID NO: 6068915 - DNA, 23 bp, Homo sapiens
ccatctgtgactataaagctgtt

SEQ ID NO: 6068916 - DNA, 13 bp, Homo sapiens
ccatctgtgcatt

SEQ ID NO: 6068917 - DNA, 24 bp, Homo sapiens
ccatctgtttgaagattatatgaa

SEQ ID NO: 6068918 - DNA, 21 bp, Homo sapiens
ccatctgtttgagaatatgat

SEQ ID NO: 6068919 - DNA, 16 bp, Homo sapiens
ccatcttaaaaacaac

SEQ ID NO: 6068920 - DNA, 17 bp, Homo sapiens
ccatcttaatctttatt

SEQ ID NO: 6068921 - DNA, 15 bp, Homo sapiens
ccatcttacttgagc

SEQ ID NO: 6068922 - DNA, 15 bp, Homo sapiens
ccatcttagtttgga

SEQ ID NO: 6068923 - DNA, 20 bp, Homo sapiens
ccatcttattcccaattaaa

SEQ ID NO: 6068924 - DNA, 22 bp, Homo sapiens
ccatcttcactcttcacttgag

SEQ ID NO: 6068925 - DNA, 23 bp, Homo sapiens
ccatcttcactggcttccatcag

SEQ ID NO: 6068926 - DNA, 20 bp, Homo sapiens
ccatcttcatcccaacagcc

SEQ ID NO: 6068927 - DNA, 14 bp, Homo sapiens
ccatcttccacctg

SEQ ID NO: 6068928 - DNA, 18 bp, Homo sapiens
ccatcttccacctgtgcc

SEQ ID NO: 6068929 - DNA, 14 bp, Homo sapiens
ccatcttccaggtg

SEQ ID NO: 6068930 - DNA, 16 bp, Homo sapiens
ccatcttccaggtggg

SEQ ID NO: 6068931 - DNA, 22 bp, Homo sapiens
ccatcttccatatccgggtgct

SEQ ID NO: 6068932 - DNA, 17 bp, Homo sapiens
ccatcttcctgctgctg

SEQ ID NO: 6068933 - DNA, 17 bp, Homo sapiens
ccatcttctccccacag

SEQ ID NO: 6068934 - DNA, 22 bp, Homo sapiens
ccatcttctccccacagcctct

SEQ ID NO: 6068935 - DNA, 14 bp, Homo sapiens
ccatcttctttctt

SEQ ID NO: 6068936 - DNA, 23 bp, Homo sapiens
ccatcttctttcttccacccaca

SEQ ID NO: 6068937 - DNA, 13 bp, Homo sapiens
ccatcttgatctt

SEQ ID NO: 6068938 - DNA, 20 bp, Homo sapiens
ccatcttgatctttgagccc

SEQ ID NO: 6068939 - DNA, 21 bp, Homo sapiens
ccatcttgcccgctcaggctg

SEQ ID NO: 6068940 - DNA, 13 bp, Homo sapiens
ccatcttgctaat

SEQ ID NO: 6068941 - DNA, 16 bp, Homo sapiens
ccatcttgctaataaa

SEQ ID NO: 6068942 - DNA, 16 bp, Homo sapiens
ccatcttgctttttcc

SEQ ID NO: 6068943 - DNA, 14 bp, Homo sapiens
ccatcttggccagg

SEQ ID NO: 6068944 - DNA, 17 bp, Homo sapiens
ccatcttggccaggctg

SEQ ID NO: 6068945 - DNA, 13 bp, Homo sapiens
ccatcttggtaaa

SEQ ID NO: 6068946 - DNA, 20 bp, Homo sapiens
ccatcttggtagttctgtgc

SEQ ID NO: 6068947 - DNA, 21 bp, Homo sapiens
ccatcttggtagttctgtgcc

SEQ ID NO: 6068948 - DNA, 18 bp, Homo sapiens
ccatcttgtggggccagg

SEQ ID NO: 6068949 - DNA, 14 bp, Homo sapiens
ccatctttagcagt

SEQ ID NO: 6068950 - DNA, 17 bp, Homo sapiens
ccatctttagcagtttc

SEQ ID NO: 6068951 - DNA, 22 bp, Homo sapiens
ccatctttagcagtttcctcag

SEQ ID NO: 6068952 - DNA, 15 bp, Homo sapiens
ccatctttccatcca

SEQ ID NO: 6068953 - DNA, 23 bp, Homo sapiens
ccatctttgatccttctgagctc

SEQ ID NO: 6068954 - DNA, 14 bp, Homo sapiens
ccatctttgtatat

SEQ ID NO: 6068955 - DNA, 16 bp, Homo sapiens
ccatcttttattcttt

SEQ ID NO: 6068956 - DNA, 21 bp, Homo sapiens
ccatcttttgttaagttcacc

SEQ ID NO: 6068957 - DNA, 16 bp, Homo sapiens
ccatctttttcttggg

SEQ ID NO: 6068958 - DNA, 23 bp, Homo sapiens
ccatgaaaataccataggaagac

SEQ ID NO: 6068959 - DNA, 22 bp, Homo sapiens
ccatgaaaatgcaacaacatgt

SEQ ID NO: 6068960 - DNA, 23 bp, Homo sapiens
ccatgaaaatggcatccagggct

SEQ ID NO: 6068961 - DNA, 19 bp, Homo sapiens
ccatgaaattgacccccaa

SEQ ID NO: 6068962 - DNA, 16 bp, Homo sapiens
ccatgaacaaattctt

SEQ ID NO: 6068963 - DNA, 16 bp, Homo sapiens
ccatgaacacactgtg

SEQ ID NO: 6068964 - DNA, 16 bp, Homo sapiens
ccatgaaccctgccct

SEQ ID NO: 6068965 - DNA, 18 bp, Homo sapiens
ccatgaactggaggccag

SEQ ID NO: 6068966 - DNA, 16 bp, Homo sapiens
ccatgaactgtgtttc

SEQ ID NO: 6068967 - DNA, 16 bp, Homo sapiens
ccatgaagacaggaca

SEQ ID NO: 6068968 - DNA, 17 bp, Homo sapiens
ccatgaagacaggacag

SEQ ID NO: 6068969 - DNA, 13 bp, Homo sapiens
ccatgaagagact

SEQ ID NO: 6068970 - DNA, 21 bp, Homo sapiens
ccatgaagaggagattggcca

SEQ ID NO: 6068971 - DNA, 14 bp, Homo sapiens
ccatgaagatgtag

SEQ ID NO: 6068972 - DNA, 15 bp, Homo sapiens
ccatgaagccacagc

SEQ ID NO: 6068973 - DNA, 14 bp, Homo sapiens
ccatgaagcctttt

SEQ ID NO: 6068974 - DNA, 20 bp, Homo sapiens
ccatgaagctggaagcactg

SEQ ID NO: 6068975 - DNA, 23 bp, Homo sapiens
ccatgaagctggaagcactgctg

SEQ ID NO: 6068976 - DNA, 13 bp, Homo sapiens
ccatgaagctggc

SEQ ID NO: 6068977 - DNA, 16 bp, Homo sapiens
ccatgaaggcacctgc

SEQ ID NO: 6068978 - DNA, 21 bp, Homo sapiens
ccatgaaggctggaaggcagc

SEQ ID NO: 6068979 - DNA, 22 bp, Homo sapiens
ccatgaaggctggaaggcagca

SEQ ID NO: 6068980 - DNA, 17 bp, Homo sapiens
ccatgaatatttattta

SEQ ID NO: 6068981 - DNA, 18 bp, Homo sapiens
ccatgaatctctgcctct

SEQ ID NO: 6068982 - DNA, 20 bp, Homo sapiens
ccatgaatctctgcctctcc

SEQ ID NO: 6068983 - DNA, 19 bp, Homo sapiens
ccatgaatgtatcaggaaa

SEQ ID NO: 6068984 - DNA, 20 bp, Homo sapiens
ccatgacaatgttgtagtgt

SEQ ID NO: 6068985 - DNA, 17 bp, Homo sapiens
ccatgacagaggctgca

SEQ ID NO: 6068986 - DNA, 14 bp, Homo sapiens
ccatgacatcaaga

SEQ ID NO: 6068987 - DNA, 14 bp, Homo sapiens
ccatgacatttcat

SEQ ID NO: 6068988 - DNA, 23 bp, Homo sapiens
ccatgaccagaagggaaacagtc

SEQ ID NO: 6068989 - DNA, 13 bp, Homo sapiens
ccatgaccaggcc

SEQ ID NO: 6068990 - DNA, 14 bp, Homo sapiens
ccatgaccaggcca

SEQ ID NO: 6068991 - DNA, 17 bp, Homo sapiens
ccatgaccaggccacca

SEQ ID NO: 6068992 - DNA, 19 bp, Homo sapiens
ccatgaccaggccaccatc

SEQ ID NO: 6068993 - DNA, 17 bp, Homo sapiens
ccatgacccacccctgt

SEQ ID NO: 6068994 - DNA, 16 bp, Homo sapiens
ccatgacccaggctgg

SEQ ID NO: 6068995 - DNA, 17 bp, Homo sapiens
ccatgacccaggctggg

SEQ ID NO: 6068996 - DNA, 23 bp, Homo sapiens
ccatgaccccttctctctccaga

SEQ ID NO: 6068997 - DNA, 19 bp, Homo sapiens
ccatgaccctgcctctccc

SEQ ID NO: 6068998 - DNA, 21 bp, Homo sapiens
ccatgaccctgcctctcccag

SEQ ID NO: 6068999 - DNA, 14 bp, Homo sapiens
ccatgacctccagc

SEQ ID NO: 6069000 - DNA, 15 bp, Homo sapiens
ccatgacctccagct

SEQ ID NO: 6069001 - DNA, 20 bp, Homo sapiens
ccatgacctccagctttcct

SEQ ID NO: 6069002 - DNA, 13 bp, Homo sapiens
ccatgacctcccc

SEQ ID NO: 6069003 - DNA, 19 bp, Homo sapiens
ccatgacctcccctcccca

SEQ ID NO: 6069004 - DNA, 16 bp, Homo sapiens
ccatgaccttacattt

SEQ ID NO: 6069005 - DNA, 20 bp, Homo sapiens
ccatgaccttgacgtgtgtg

SEQ ID NO: 6069006 - DNA, 21 bp, Homo sapiens
ccatgactagggtcctcaggc

SEQ ID NO: 6069007 - DNA, 14 bp, Homo sapiens
ccatgactctgcct

SEQ ID NO: 6069008 - DNA, 15 bp, Homo sapiens
ccatgactctgccta

SEQ ID NO: 6069009 - DNA, 13 bp, Homo sapiens
ccatgactgcacc

SEQ ID NO: 6069010 - DNA, 16 bp, Homo sapiens
ccatgactgcacccag

SEQ ID NO: 6069011 - DNA, 19 bp, Homo sapiens
ccatgactgcacccagctc

SEQ ID NO: 6069012 - DNA, 19 bp, Homo sapiens
ccatgactgccccttgctt

SEQ ID NO: 6069013 - DNA, 15 bp, Homo sapiens
ccatgactgctcagg

SEQ ID NO: 6069014 - DNA, 20 bp, Homo sapiens
ccatgactgctcaggcctca

SEQ ID NO: 6069015 - DNA, 17 bp, Homo sapiens
ccatgactggctgtctg

SEQ ID NO: 6069016 - DNA, 22 bp, Homo sapiens
ccatgactggctgtctgcctgt

SEQ ID NO: 6069017 - DNA, 21 bp, Homo sapiens
ccatgactgtgaccaccttct

SEQ ID NO: 6069018 - DNA, 20 bp, Homo sapiens
ccatgagaacaaaacctctt

SEQ ID NO: 6069019 - DNA, 21 bp, Homo sapiens
ccatgagaagagggcctgtgg

SEQ ID NO: 6069020 - DNA, 18 bp, Homo sapiens
ccatgagagcgcagcccg

SEQ ID NO: 6069021 - DNA, 20 bp, Homo sapiens
ccatgagatagctattataa

SEQ ID NO: 6069022 - DNA, 21 bp, Homo sapiens
ccatgagcaccccaaggctgc

SEQ ID NO: 6069023 - DNA, 20 bp, Homo sapiens
ccatgagcacctccagctgt

SEQ ID NO: 6069024 - DNA, 17 bp, Homo sapiens
ccatgagcagagaactg

SEQ ID NO: 6069025 - DNA, 14 bp, Homo sapiens
ccatgagcctcagc

SEQ ID NO: 6069026 - DNA, 18 bp, Homo sapiens
ccatgagcctcagcatcc

SEQ ID NO: 6069027 - DNA, 21 bp, Homo sapiens
ccatgagcctcagcatcctgg

SEQ ID NO: 6069028 - DNA, 12 bp, Homo sapiens
ccatgagcctgc

SEQ ID NO: 6069029 - DNA, 18 bp, Homo sapiens
ccatgagcgtccaggtga

SEQ ID NO: 6069030 - DNA, 16 bp, Homo sapiens
ccatgagctgcactga

SEQ ID NO: 6069031 - DNA, 13 bp, Homo sapiens
ccatgagctgctc

SEQ ID NO: 6069032 - DNA, 14 bp, Homo sapiens
ccatgagctgctca

SEQ ID NO: 6069033 - DNA, 16 bp, Homo sapiens
ccatgaggaacaaggc

SEQ ID NO: 6069034 - DNA, 18 bp, Homo sapiens
ccatgaggaacaaggcaa

SEQ ID NO: 6069035 - DNA, 11 bp, Homo sapiens
ccatgaggagc

SEQ ID NO: 6069036 - DNA, 16 bp, Homo sapiens
ccatgaggagcgtgga

SEQ ID NO: 6069037 - DNA, 21 bp, Homo sapiens
ccatgaggagcgtggactctg

SEQ ID NO: 6069038 - DNA, 13 bp, Homo sapiens
ccatgaggaggca

SEQ ID NO: 6069039 - DNA, 19 bp, Homo sapiens
ccatgaggaggcagagagg

SEQ ID NO: 6069040 - DNA, 15 bp, Homo sapiens
ccatgaggcctcagt

SEQ ID NO: 6069041 - DNA, 19 bp, Homo sapiens
ccatgaggcctcctgccat

SEQ ID NO: 6069042 - DNA, 20 bp, Homo sapiens
ccatgaggcctcctgccatg

SEQ ID NO: 6069043 - DNA, 20 bp, Homo sapiens
ccatgagggacagggtcttt

SEQ ID NO: 6069044 - DNA, 17 bp, Homo sapiens
ccatgagggagatgcca

SEQ ID NO: 6069045 - DNA, 13 bp, Homo sapiens
ccatgagggctgg

SEQ ID NO: 6069046 - DNA, 16 bp, Homo sapiens
ccatgagggctggaga

SEQ ID NO: 6069047 - DNA, 21 bp, Homo sapiens
ccatgaggggattcccttcct

SEQ ID NO: 6069048 - DNA, 21 bp, Homo sapiens
ccatgaggtaaaagagccaag

SEQ ID NO: 6069049 - DNA, 23 bp, Homo sapiens
ccatgaggtactggtcccttcct

SEQ ID NO: 6069050 - DNA, 17 bp, Homo sapiens
ccatgagtatgccactg

SEQ ID NO: 6069051 - DNA, 17 bp, Homo sapiens
ccatgagtccatgtcct

SEQ ID NO: 6069052 - DNA, 22 bp, Homo sapiens
ccatgagtccatgtcctatgcc

SEQ ID NO: 6069053 - DNA, 13 bp, Homo sapiens
ccatgagtcccct

SEQ ID NO: 6069054 - DNA, 15 bp, Homo sapiens
ccatgagtcccctgt

SEQ ID NO: 6069055 - DNA, 16 bp, Homo sapiens
ccatgagtcccctgtt

SEQ ID NO: 6069056 - DNA, 20 bp, Homo sapiens
ccatgagtggcatggccacc

SEQ ID NO: 6069057 - DNA, 21 bp, Homo sapiens
ccatgagtggcatggccacca

SEQ ID NO: 6069058 - DNA, 22 bp, Homo sapiens
ccatgagttggggtctggcagc

SEQ ID NO: 6069059 - DNA, 23 bp, Homo sapiens
ccatgatacctattaaaggaaaa

SEQ ID NO: 6069060 - DNA, 18 bp, Homo sapiens
ccatgatagctggggctt

SEQ ID NO: 6069061 - DNA, 14 bp, Homo sapiens
ccatgatccctgtg

SEQ ID NO: 6069062 - DNA, 20 bp, Homo sapiens
ccatgatcgagccactgcac

SEQ ID NO: 6069063 - DNA, 16 bp, Homo sapiens
ccatgatctgcagggg

SEQ ID NO: 6069064 - DNA, 17 bp, Homo sapiens
ccatgatctgcaggggt

SEQ ID NO: 6069065 - DNA, 12 bp, Homo sapiens
ccatgatctgta

SEQ ID NO: 6069066 - DNA, 18 bp, Homo sapiens
ccatgatgcaagccagct

SEQ ID NO: 6069067 - DNA, 15 bp, Homo sapiens
ccatgatgcacagta

SEQ ID NO: 6069068 - DNA, 17 bp, Homo sapiens
ccatgatgcatggagtg

SEQ ID NO: 6069069 - DNA, 14 bp, Homo sapiens
ccatgatgcctctg

SEQ ID NO: 6069070 - DNA, 16 bp, Homo sapiens
ccatgatggcaacaga

SEQ ID NO: 6069071 - DNA, 15 bp, Homo sapiens
ccatgatgtggagtg

SEQ ID NO: 6069072 - DNA, 17 bp, Homo sapiens
ccatgatgtggagtggg

SEQ ID NO: 6069073 - DNA, 21 bp, Homo sapiens
ccatgattaaccacttcagct

SEQ ID NO: 6069074 - DNA, 14 bp, Homo sapiens
ccatgattccaagg

SEQ ID NO: 6069075 - DNA, 16 bp, Homo sapiens
ccatgattccaagggc

SEQ ID NO: 6069076 - DNA, 19 bp, Homo sapiens
ccatgattccaagggccca

SEQ ID NO: 6069077 - DNA, 15 bp, Homo sapiens
ccatgattccctcct

SEQ ID NO: 6069078 - DNA, 17 bp, Homo sapiens
ccatgattccctcctcg

SEQ ID NO: 6069079 - DNA, 14 bp, Homo sapiens
ccatgattcgccca

SEQ ID NO: 6069080 - DNA, 23 bp, Homo sapiens
ccatgattctatttatatgtaca

SEQ ID NO: 6069081 - DNA, 15 bp, Homo sapiens
ccatgattctctgag

SEQ ID NO: 6069082 - DNA, 18 bp, Homo sapiens
ccatgatttcccactgca

SEQ ID NO: 6069083 - DNA, 15 bp, Homo sapiens
ccatgatttgtccca

SEQ ID NO: 6069084 - DNA, 16 bp, Homo sapiens
ccatgatttgtcccag

SEQ ID NO: 6069085 - DNA, 12 bp, Homo sapiens
ccatgattttac

SEQ ID NO: 6069086 - DNA, 14 bp, Homo sapiens
ccatgattttacag

SEQ ID NO: 6069087 - DNA, 15 bp, Homo sapiens
ccatgattttacaga

SEQ ID NO: 6069088 - DNA, 23 bp, Homo sapiens
ccatgattttggccactttgcag

SEQ ID NO: 6069089 - DNA, 21 bp, Homo sapiens
ccatgatttttggtatttatg

SEQ ID NO: 6069090 - DNA, 22 bp, Homo sapiens
ccatgatttttggtatttatgt

SEQ ID NO: 6069091 - DNA, 13 bp, Homo sapiens
ccatgcaaaccat

SEQ ID NO: 6069092 - DNA, 17 bp, Homo sapiens
ccatgcaaattgtgaaa

SEQ ID NO: 6069093 - DNA, 20 bp, Homo sapiens
ccatgcaactccatgcctat

SEQ ID NO: 6069094 - DNA, 15 bp, Homo sapiens
ccatgcaagcagagg

SEQ ID NO: 6069095 - DNA, 17 bp, Homo sapiens
ccatgcaagcagaggac

SEQ ID NO: 6069096 - DNA, 20 bp, Homo sapiens
ccatgcaagcagaggaccag

SEQ ID NO: 6069097 - DNA, 20 bp, Homo sapiens
ccatgcaagtagctggctgt

SEQ ID NO: 6069098 - DNA, 14 bp, Homo sapiens
ccatgcaagtgctg

SEQ ID NO: 6069099 - DNA, 22 bp, Homo sapiens
ccatgcacacaaacacctccta

SEQ ID NO: 6069100 - DNA, 22 bp, Homo sapiens
ccatgcacagtacaataatgta

SEQ ID NO: 6069101 - DNA, 13 bp, Homo sapiens
ccatgcaccaaac

SEQ ID NO: 6069102 - DNA, 19 bp, Homo sapiens
ccatgcaccaacccactgc

SEQ ID NO: 6069103 - DNA, 19 bp, Homo sapiens
ccatgcacccctgatgttc

SEQ ID NO: 6069104 - DNA, 21 bp, Homo sapiens
ccatgcaccctcatacacaga

SEQ ID NO: 6069105 - DNA, 15 bp, Homo sapiens
ccatgcacctcaggg

SEQ ID NO: 6069106 - DNA, 19 bp, Homo sapiens
ccatgcactatatttgtat

SEQ ID NO: 6069107 - DNA, 23 bp, Homo sapiens
ccatgcactcacccctagccctg

SEQ ID NO: 6069108 - DNA, 16 bp, Homo sapiens
ccatgcactgtaaata

SEQ ID NO: 6069109 - DNA, 17 bp, Homo sapiens
ccatgcactgtgaagga

SEQ ID NO: 6069110 - DNA, 19 bp, Homo sapiens
ccatgcactgtgaaggacc

SEQ ID NO: 6069111 - DNA, 20 bp, Homo sapiens
ccatgcactgtgaaggaccc

SEQ ID NO: 6069112 - DNA, 19 bp, Homo sapiens
ccatgcactttaattgaag

SEQ ID NO: 6069113 - DNA, 16 bp, Homo sapiens
ccatgcagatctagcc

SEQ ID NO: 6069114 - DNA, 18 bp, Homo sapiens
ccatgcagcccctgggcc

SEQ ID NO: 6069115 - DNA, 16 bp, Homo sapiens
ccatgcagccttgggg

SEQ ID NO: 6069116 - DNA, 14 bp, Homo sapiens
ccatgcagctgctc

SEQ ID NO: 6069117 - DNA, 16 bp, Homo sapiens
ccatgcagctgctccc

SEQ ID NO: 6069118 - DNA, 23 bp, Homo sapiens
ccatgcagcttcatcaattttta

SEQ ID NO: 6069119 - DNA, 17 bp, Homo sapiens
ccatgcaggaagaggcc

SEQ ID NO: 6069120 - DNA, 20 bp, Homo sapiens
ccatgcaggaagaggcccac

SEQ ID NO: 6069121 - DNA, 18 bp, Homo sapiens
ccatgcaggaaggaaaac

SEQ ID NO: 6069122 - DNA, 12 bp, Homo sapiens
ccatgcaggagg

SEQ ID NO: 6069123 - DNA, 16 bp, Homo sapiens
ccatgcaggcagcctg

SEQ ID NO: 6069124 - DNA, 14 bp, Homo sapiens
ccatgcaggccctt

SEQ ID NO: 6069125 - DNA, 19 bp, Homo sapiens
ccatgcagggggctcctgg

SEQ ID NO: 6069126 - DNA, 18 bp, Homo sapiens
ccatgcatggcctcccag

SEQ ID NO: 6069127 - DNA, 20 bp, Homo sapiens
ccatgcatttcataaactaa

SEQ ID NO: 6069128 - DNA, 14 bp, Homo sapiens
ccatgcatttctcg

SEQ ID NO: 6069129 - DNA, 17 bp, Homo sapiens
ccatgccaatgtccagg

SEQ ID NO: 6069130 - DNA, 18 bp, Homo sapiens
ccatgccacgttccacag

SEQ ID NO: 6069131 - DNA, 12 bp, Homo sapiens
ccatgccactgc

SEQ ID NO: 6069132 - DNA, 20 bp, Homo sapiens
ccatgccagacccactgaaa

SEQ ID NO: 6069133 - DNA, 12 bp, Homo sapiens
ccatgccagctg

SEQ ID NO: 6069134 - DNA, 14 bp, Homo sapiens
ccatgccaggaacc

SEQ ID NO: 6069135 - DNA, 12 bp, Homo sapiens
ccatgcccactg

SEQ ID NO: 6069136 - DNA, 13 bp, Homo sapiens
ccatgcccactgc

SEQ ID NO: 6069137 - DNA, 11 bp, Homo sapiens
ccatgccccac

SEQ ID NO: 6069138 - DNA, 14 bp, Homo sapiens
ccatgccccacccc

SEQ ID NO: 6069139 - DNA, 20 bp, Homo sapiens
ccatgccccactctgctgag

SEQ ID NO: 6069140 - DNA, 16 bp, Homo sapiens
ccatgccccagctctg

SEQ ID NO: 6069141 - DNA, 21 bp, Homo sapiens
ccatgccccagctctggatga

SEQ ID NO: 6069142 - DNA, 19 bp, Homo sapiens
ccatgcccccgccacctcc

SEQ ID NO: 6069143 - DNA, 23 bp, Homo sapiens
ccatgcccccgccacctccccac

SEQ ID NO: 6069144 - DNA, 14 bp, Homo sapiens
ccatgcccccttcg

SEQ ID NO: 6069145 - DNA, 19 bp, Homo sapiens
ccatgcccccttcgctcct

SEQ ID NO: 6069146 - DNA, 20 bp, Homo sapiens
ccatgcccccttcgctcctc

SEQ ID NO: 6069147 - DNA, 11 bp, Homo sapiens
ccatgccctcc

SEQ ID NO: 6069148 - DNA, 18 bp, Homo sapiens
ccatgccctcccaggacc

SEQ ID NO: 6069149 - DNA, 14 bp, Homo sapiens
ccatgccctccctg

SEQ ID NO: 6069150 - DNA, 14 bp, Homo sapiens
ccatgccctggacc

SEQ ID NO: 6069151 - DNA, 13 bp, Homo sapiens
ccatgccctggga

SEQ ID NO: 6069152 - DNA, 22 bp, Homo sapiens
ccatgccctgggatgcctcacc

SEQ ID NO: 6069153 - DNA, 21 bp, Homo sapiens
ccatgcccttacacgtgcgtg

SEQ ID NO: 6069154 - DNA, 20 bp, Homo sapiens
ccatgccggtacacagccag

SEQ ID NO: 6069155 - DNA, 15 bp, Homo sapiens
ccatgcctacagata

SEQ ID NO: 6069156 - DNA, 16 bp, Homo sapiens
ccatgcctaggaacat

SEQ ID NO: 6069157 - DNA, 15 bp, Homo sapiens
ccatgcctatttact

SEQ ID NO: 6069158 - DNA, 17 bp, Homo sapiens
ccatgcctatttactgg

SEQ ID NO: 6069159 - DNA, 21 bp, Homo sapiens
ccatgcctatttactggaaac

SEQ ID NO: 6069160 - DNA, 12 bp, Homo sapiens
ccatgcctcagc

SEQ ID NO: 6069161 - DNA, 20 bp, Homo sapiens
ccatgcctcatgccacacct

SEQ ID NO: 6069162 - DNA, 23 bp, Homo sapiens
ccatgcctccccctagccatttt

SEQ ID NO: 6069163 - DNA, 15 bp, Homo sapiens
ccatgcctccctggg

SEQ ID NO: 6069164 - DNA, 21 bp, Homo sapiens
ccatgcctccctgggccacct

SEQ ID NO: 6069165 - DNA, 17 bp, Homo sapiens
ccatgcctgagggtgga

SEQ ID NO: 6069166 - DNA, 18 bp, Homo sapiens
ccatgcctgagggtggag

SEQ ID NO: 6069167 - DNA, 19 bp, Homo sapiens
ccatgcctgcaaccttgca

SEQ ID NO: 6069168 - DNA, 22 bp, Homo sapiens
ccatgcctgcccccctcatctc

SEQ ID NO: 6069169 - DNA, 15 bp, Homo sapiens
ccatgcctgctccct

SEQ ID NO: 6069170 - DNA, 20 bp, Homo sapiens
ccatgcctgctccctgtctg

SEQ ID NO: 6069171 - DNA, 22 bp, Homo sapiens
ccatgcctgctccctgtctgtg

SEQ ID NO: 6069172 - DNA, 23 bp, Homo sapiens
ccatgcctgctccctgtctgtgt

SEQ ID NO: 6069173 - DNA, 11 bp, Homo sapiens
ccatgcctggc

SEQ ID NO: 6069174 - DNA, 14 bp, Homo sapiens
ccatgcctggtccc

SEQ ID NO: 6069175 - DNA, 14 bp, Homo sapiens
ccatgcctgtccag

SEQ ID NO: 6069176 - DNA, 17 bp, Homo sapiens
ccatgcctgtccagcct

SEQ ID NO: 6069177 - DNA, 14 bp, Homo sapiens
ccatgcctgtggct

SEQ ID NO: 6069178 - DNA, 15 bp, Homo sapiens
ccatgcctgtggctg

SEQ ID NO: 6069179 - DNA, 18 bp, Homo sapiens
ccatgcctgtggctgcgc

SEQ ID NO: 6069180 - DNA, 21 bp, Homo sapiens
ccatgcgacactgggaggcca

SEQ ID NO: 6069181 - DNA, 14 bp, Homo sapiens
ccatgcgaggggcc

SEQ ID NO: 6069182 - DNA, 21 bp, Homo sapiens
ccatgcgaggggccagcagag

SEQ ID NO: 6069183 - DNA, 14 bp, Homo sapiens
ccatgcgccccctc

SEQ ID NO: 6069184 - DNA, 20 bp, Homo sapiens
ccatgcgccccctccgccct

SEQ ID NO: 6069185 - DNA, 22 bp, Homo sapiens
ccatgcgccccctccgccctgc

SEQ ID NO: 6069186 - DNA, 15 bp, Homo sapiens
ccatgcgctcagggc

SEQ ID NO: 6069187 - DNA, 22 bp, Homo sapiens
ccatgcgctcagggccatgctg

SEQ ID NO: 6069188 - DNA, 17 bp, Homo sapiens
ccatgcgtgccgcctgc

SEQ ID NO: 6069189 - DNA, 20 bp, Homo sapiens
ccatgcgtgccgcctgctcc

SEQ ID NO: 6069190 - DNA, 21 bp, Homo sapiens
ccatgcgtgccgcctgctcct

SEQ ID NO: 6069191 - DNA, 20 bp, Homo sapiens
ccatgcgtgtttctgactct

SEQ ID NO: 6069192 - DNA, 18 bp, Homo sapiens
ccggcggagctctggctt

SEQ ID NO: 6069193 - DNA, 18 bp, Homo sapiens
ccggcggccccgccgcag

SEQ ID NO: 6069194 - DNA, 15 bp, Homo sapiens
ccggcggccctgctg

SEQ ID NO: 6069195 - DNA, 19 bp, Homo sapiens
ccggcggctctgagcaggg

SEQ ID NO: 6069196 - DNA, 23 bp, Homo sapiens
ccggcggctctgagcaggggcag

SEQ ID NO: 6069197 - DNA, 16 bp, Homo sapiens
ccggcggggaccttgg

SEQ ID NO: 6069198 - DNA, 20 bp, Homo sapiens
ccggcggggtgcctgctgtc

SEQ ID NO: 6069199 - DNA, 19 bp, Homo sapiens
ccggcgggtgacagctccg

SEQ ID NO: 6069200 - DNA, 15 bp, Homo sapiens
ccggcgtcagcctcc

SEQ ID NO: 6069201 - DNA, 19 bp, Homo sapiens
ccggcgtcagcctccagcc

SEQ ID NO: 6069202 - DNA, 21 bp, Homo sapiens
ccggcgtcagcctccagcctc

SEQ ID NO: 6069203 - DNA, 22 bp, Homo sapiens
ccggcgtcagcctccagcctct

SEQ ID NO: 6069204 - DNA, 22 bp, Homo sapiens
ccggcgtggtggaagaggggac

SEQ ID NO: 6069205 - DNA, 13 bp, Homo sapiens
ccggctaactctg

SEQ ID NO: 6069206 - DNA, 22 bp, Homo sapiens
ccggctaatttttgtattttta

SEQ ID NO: 6069207 - DNA, 19 bp, Homo sapiens
ccggctaatttttttgtat

SEQ ID NO: 6069208 - DNA, 17 bp, Homo sapiens
ccggctatgggggcact

SEQ ID NO: 6069209 - DNA, 22 bp, Homo sapiens
ccggctatgggggcactgagga

SEQ ID NO: 6069210 - DNA, 23 bp, Homo sapiens
ccggctatgggggcactgaggac

SEQ ID NO: 6069211 - DNA, 19 bp, Homo sapiens
ccggctcaggagagggcct

SEQ ID NO: 6069212 - DNA, 21 bp, Homo sapiens
ccggctccaggctcctttagc

SEQ ID NO: 6069213 - DNA, 21 bp, Homo sapiens
ccggctcccaccggtgccaaa

SEQ ID NO: 6069214 - DNA, 13 bp, Homo sapiens
ccggctcccagcc

SEQ ID NO: 6069215 - DNA, 14 bp, Homo sapiens
ccggctcccagcct

SEQ ID NO: 6069216 - DNA, 12 bp, Homo sapiens
ccggctccccct

SEQ ID NO: 6069217 - DNA, 21 bp, Homo sapiens
ccggctccccctccagccaga

SEQ ID NO: 6069218 - DNA, 18 bp, Homo sapiens
ccggctccccctgccagc

SEQ ID NO: 6069219 - DNA, 19 bp, Homo sapiens
ccggctccccctgccagca

SEQ ID NO: 6069220 - DNA, 16 bp, Homo sapiens
ccggctccctcctagt

SEQ ID NO: 6069221 - DNA, 18 bp, Homo sapiens
ccggctcccttctacagc

SEQ ID NO: 6069222 - DNA, 14 bp, Homo sapiens
ccggctcggcccag

SEQ ID NO: 6069223 - DNA, 16 bp, Homo sapiens
ccggctcgtgtattta

SEQ ID NO: 6069224 - DNA, 18 bp, Homo sapiens
ccggctcgtgtatttatt

SEQ ID NO: 6069225 - DNA, 17 bp, Homo sapiens
ccggctctcacctggcc

SEQ ID NO: 6069226 - DNA, 18 bp, Homo sapiens
ccggctctgggcctgagg

SEQ ID NO: 6069227 - DNA, 23 bp, Homo sapiens
ccggctctgggcctgagggtcca

SEQ ID NO: 6069228 - DNA, 14 bp, Homo sapiens
ccggctctgggctg

SEQ ID NO: 6069229 - DNA, 16 bp, Homo sapiens
ccggctctgggctggc

SEQ ID NO: 6069230 - DNA, 20 bp, Homo sapiens
ccggctctgggctggctgct

SEQ ID NO: 6069231 - DNA, 14 bp, Homo sapiens
ccggctctggtggc

SEQ ID NO: 6069232 - DNA, 18 bp, Homo sapiens
ccggctctggtggccact

SEQ ID NO: 6069233 - DNA, 12 bp, Homo sapiens
ccggctctgtgg

SEQ ID NO: 6069234 - DNA, 15 bp, Homo sapiens
ccggctctgtgggtg

SEQ ID NO: 6069235 - DNA, 15 bp, Homo sapiens
ccggctgaccctgtg

SEQ ID NO: 6069236 - DNA, 16 bp, Homo sapiens
ccggctgaccctgtgc

SEQ ID NO: 6069237 - DNA, 21 bp, Homo sapiens
ccggctgaccctgtgccccag

SEQ ID NO: 6069238 - DNA, 14 bp, Homo sapiens
ccggctgactcagt

SEQ ID NO: 6069239 - DNA, 19 bp, Homo sapiens
ccggctgagccccccatgc

SEQ ID NO: 6069240 - DNA, 15 bp, Homo sapiens
ccggctgagctgtgc

SEQ ID NO: 6069241 - DNA, 18 bp, Homo sapiens
ccggctgagctgtgccag

SEQ ID NO: 6069242 - DNA, 19 bp, Homo sapiens
ccggctgagtggcagcagc

SEQ ID NO: 6069243 - DNA, 15 bp, Homo sapiens
ccggctgcagaggcc

SEQ ID NO: 6069244 - DNA, 14 bp, Homo sapiens
ccggctgcctagcc

SEQ ID NO: 6069245 - DNA, 12 bp, Homo sapiens
ccggctgcctgc

SEQ ID NO: 6069246 - DNA, 14 bp, Homo sapiens
ccggctgcctgccg

SEQ ID NO: 6069247 - DNA, 17 bp, Homo sapiens
ccggctgctcctccagc

SEQ ID NO: 6069248 - DNA, 19 bp, Homo sapiens
ccggctgctcctccagccc

SEQ ID NO: 6069249 - DNA, 12 bp, Homo sapiens
ccggctgctgct

SEQ ID NO: 6069250 - DNA, 14 bp, Homo sapiens
ccggctgctgcttg

SEQ ID NO: 6069251 - DNA, 23 bp, Homo sapiens
ccggctgcttccttctgcaccca

SEQ ID NO: 6069252 - DNA, 19 bp, Homo sapiens
ccggctggacctggggtcc

SEQ ID NO: 6069253 - DNA, 16 bp, Homo sapiens
ccggctggccggtcca

SEQ ID NO: 6069254 - DNA, 19 bp, Homo sapiens
ccggctggcctggaggctc

SEQ ID NO: 6069255 - DNA, 15 bp, Homo sapiens
ccggctgggcctcct

SEQ ID NO: 6069256 - DNA, 23 bp, Homo sapiens
ccggctgggtcggccctgcccaa

SEQ ID NO: 6069257 - DNA, 18 bp, Homo sapiens
ccggctgtgattgctgcc

SEQ ID NO: 6069258 - DNA, 16 bp, Homo sapiens
ccggctgtgctgggag

SEQ ID NO: 6069259 - DNA, 14 bp, Homo sapiens
ccggctgtggagca

SEQ ID NO: 6069260 - DNA, 24 bp, Homo sapiens
ccggctgtttcctgacagatgcct

SEQ ID NO: 6069261 - DNA, 14 bp, Homo sapiens
ccggcttctcggct

SEQ ID NO: 6069262 - DNA, 13 bp, Homo sapiens
ccggcttggctag

SEQ ID NO: 6069263 - DNA, 15 bp, Homo sapiens
ccggctttcaggagc

SEQ ID NO: 6069264 - DNA, 22 bp, Homo sapiens
ccggctttcctccggagcctca

SEQ ID NO: 6069265 - DNA, 16 bp, Homo sapiens
ccggctttgcagggag

SEQ ID NO: 6069266 - DNA, 17 bp, Homo sapiens
ccggctttgtggcactg

SEQ ID NO: 6069267 - DNA, 13 bp, Homo sapiens
ccgggaaagctgt

SEQ ID NO: 6069268 - DNA, 13 bp, Homo sapiens
ccgggaaaggccg

SEQ ID NO: 6069269 - DNA, 20 bp, Homo sapiens
ccgggaacctccccagcctg

SEQ ID NO: 6069270 - DNA, 21 bp, Homo sapiens
ccgggaacctccccagcctgc

SEQ ID NO: 6069271 - DNA, 18 bp, Homo sapiens
ccgggaagagccacctgg

SEQ ID NO: 6069272 - DNA, 21 bp, Homo sapiens
ccgggaagcatcctccccacc

SEQ ID NO: 6069273 - DNA, 20 bp, Homo sapiens
ccgggaagggggctgggaca

SEQ ID NO: 6069274 - DNA, 23 bp, Homo sapiens
ccgggaagggtggcctgttccct

SEQ ID NO: 6069275 - DNA, 21 bp, Homo sapiens
ccgggaagttttacagcaagg

SEQ ID NO: 6069276 - DNA, 18 bp, Homo sapiens
ccgggaatgaatggggag

SEQ ID NO: 6069277 - DNA, 20 bp, Homo sapiens
ccgggaccacagctgctggc

SEQ ID NO: 6069278 - DNA, 15 bp, Homo sapiens
ccgggacccacggag

SEQ ID NO: 6069279 - DNA, 22 bp, Homo sapiens
ccgggacccacggagccctccc

SEQ ID NO: 6069280 - DNA, 17 bp, Homo sapiens
ccgggacccccaggaca

SEQ ID NO: 6069281 - DNA, 17 bp, Homo sapiens
ccgggaccccgagcctg

SEQ ID NO: 6069282 - DNA, 13 bp, Homo sapiens
ccgggaccctcag

SEQ ID NO: 6069283 - DNA, 15 bp, Homo sapiens
ccgggaccctcaggt

SEQ ID NO: 6069284 - DNA, 20 bp, Homo sapiens
ccgggaccctcaggtgtagc

SEQ ID NO: 6069285 - DNA, 23 bp, Homo sapiens
ccgggaccctgctcacaggcagg

SEQ ID NO: 6069286 - DNA, 20 bp, Homo sapiens
ccgggaccgcgctagggctc

SEQ ID NO: 6069287 - DNA, 21 bp, Homo sapiens
ccgggaccgcgctagggctcc

SEQ ID NO: 6069288 - DNA, 22 bp, Homo sapiens
ccgggaccgcgctagggctccg

SEQ ID NO: 6069289 - DNA, 14 bp, Homo sapiens
ccgggacgcttcca

SEQ ID NO: 6069290 - DNA, 15 bp, Homo sapiens
ccgggacgcttccag

SEQ ID NO: 6069291 - DNA, 22 bp, Homo sapiens
ccgggactgaccttcggcagtg

SEQ ID NO: 6069292 - DNA, 16 bp, Homo sapiens
ccgggactgctgctct

SEQ ID NO: 6069293 - DNA, 19 bp, Homo sapiens
ccgggactgctgctctccc

SEQ ID NO: 6069294 - DNA, 12 bp, Homo sapiens
ccgggactgggg

SEQ ID NO: 6069295 - DNA, 16 bp, Homo sapiens
ccgggacttcaaagcc

SEQ ID NO: 6069296 - DNA, 17 bp, Homo sapiens
ccgggagactgccagtg

SEQ ID NO: 6069297 - DNA, 23 bp, Homo sapiens
ccgggagactgccagtggagacg

SEQ ID NO: 6069298 - DNA, 17 bp, Homo sapiens
ccgggagaggactctgc

SEQ ID NO: 6069299 - DNA, 20 bp, Homo sapiens
ccgggagaggactctgcctt

SEQ ID NO: 6069300 - DNA, 21 bp, Homo sapiens
ccgggagatccgccctgggct

SEQ ID NO: 6069301 - DNA, 17 bp, Homo sapiens
ccgggagcctaggacca

SEQ ID NO: 6069302 - DNA, 19 bp, Homo sapiens
ccgggagcctaggaccact

SEQ ID NO: 6069303 - DNA, 15 bp, Homo sapiens
ccgggagcctccccc

SEQ ID NO: 6069304 - DNA, 20 bp, Homo sapiens
ccgggagcctgcgtggcctg

SEQ ID NO: 6069305 - DNA, 13 bp, Homo sapiens
ccgggagctcagg

SEQ ID NO: 6069306 - DNA, 23 bp, Homo sapiens
ccgggagctgggccctgcctgca

SEQ ID NO: 6069307 - DNA, 17 bp, Homo sapiens
ccgggaggagcctgggg

SEQ ID NO: 6069308 - DNA, 13 bp, Homo sapiens
ccgggaggaggat

SEQ ID NO: 6069309 - DNA, 12 bp, Homo sapiens
ccgggaggcaga

SEQ ID NO: 6069310 - DNA, 13 bp, Homo sapiens
ccgggaggcagag

SEQ ID NO: 6069311 - DNA, 20 bp, Homo sapiens
ccgggaggcagagaggagtg

SEQ ID NO: 6069312 - DNA, 22 bp, Homo sapiens
ccgggaggcagaggttgcagtg

SEQ ID NO: 6069313 - DNA, 18 bp, Homo sapiens
ccgggaggcagccacagg

SEQ ID NO: 6069314 - DNA, 22 bp, Homo sapiens
ccgggaggtggagcttgcagtg

SEQ ID NO: 6069315 - DNA, 17 bp, Homo sapiens
ccgggatattatagaaa

SEQ ID NO: 6069316 - DNA, 21 bp, Homo sapiens
ccgggatgcgcctgatcacca

SEQ ID NO: 6069317 - DNA, 21 bp, Homo sapiens
ccgggatggtcttgatctcct

SEQ ID NO: 6069318 - DNA, 14 bp, Homo sapiens
ccgggcaaagggtc

SEQ ID NO: 6069319 - DNA, 17 bp, Homo sapiens
ccgggcaaatgccaggg

SEQ ID NO: 6069320 - DNA, 21 bp, Homo sapiens
ccgggcaaatgccagggcccg

SEQ ID NO: 6069321 - DNA, 17 bp, Homo sapiens
ccgggcacagctgtggt

SEQ ID NO: 6069322 - DNA, 13 bp, Homo sapiens
ccgggcacagtgg

SEQ ID NO: 6069323 - DNA, 14 bp, Homo sapiens
ccgggcaccacccc

SEQ ID NO: 6069324 - DNA, 20 bp, Homo sapiens
ccgggcaccacccccagtcc

SEQ ID NO: 6069325 - DNA, 18 bp, Homo sapiens
ccgggcacggtcacacgg

SEQ ID NO: 6069326 - DNA, 20 bp, Homo sapiens
ccgggcactcagaagacact

SEQ ID NO: 6069327 - DNA, 12 bp, Homo sapiens
ccgggcactccc

SEQ ID NO: 6069328 - DNA, 13 bp, Homo sapiens
ccgggcactggca

SEQ ID NO: 6069329 - DNA, 21 bp, Homo sapiens
ccgggcactgtcatgcccagc

SEQ ID NO: 6069330 - DNA, 16 bp, Homo sapiens
ccgggcagagaccacc

SEQ ID NO: 6069331 - DNA, 20 bp, Homo sapiens
ccgggcagagcacagcgggg

SEQ ID NO: 6069332 - DNA, 12 bp, Homo sapiens
ccgggcagaggg

SEQ ID NO: 6069333 - DNA, 15 bp, Homo sapiens
ccgggcagcagagag

SEQ ID NO: 6069334 - DNA, 18 bp, Homo sapiens
ccgggcaggcgtgactca

SEQ ID NO: 6069335 - DNA, 18 bp, Homo sapiens
ccgggcaggggagccagg

SEQ ID NO: 6069336 - DNA, 20 bp, Homo sapiens
ccgggcaggggccgcttcgc

SEQ ID NO: 6069337 - DNA, 22 bp, Homo sapiens
ccgggccaagacagatggacac

SEQ ID NO: 6069338 - DNA, 13 bp, Homo sapiens
ccgggccacagag

SEQ ID NO: 6069339 - DNA, 17 bp, Homo sapiens
ccgggccacgccccagc

SEQ ID NO: 6069340 - DNA, 18 bp, Homo sapiens
ccgggccactccttcctg

SEQ ID NO: 6069341 - DNA, 11 bp, Homo sapiens
ccgggccaggc

SEQ ID NO: 6069342 - DNA, 13 bp, Homo sapiens
ccgggcccagagg

SEQ ID NO: 6069343 - DNA, 16 bp, Homo sapiens
ccgggcccagaggagc

SEQ ID NO: 6069344 - DNA, 13 bp, Homo sapiens
ccgggcccaggca

SEQ ID NO: 6069345 - DNA, 15 bp, Homo sapiens
ccgggcccagggcct

SEQ ID NO: 6069346 - DNA, 19 bp, Homo sapiens
ccgggccccatggtcacag

SEQ ID NO: 6069347 - DNA, 22 bp, Homo sapiens
ccgggccccatggtcacagacc

SEQ ID NO: 6069348 - DNA, 14 bp, Homo sapiens
ccgggcccctgggc

SEQ ID NO: 6069349 - DNA, 16 bp, Homo sapiens
ccgggcccctgggctt

SEQ ID NO: 6069350 - DNA, 14 bp, Homo sapiens
ccgggccctccctt

SEQ ID NO: 6069351 - DNA, 18 bp, Homo sapiens
ccgggccctcccttggaa

SEQ ID NO: 6069352 - DNA, 22 bp, Homo sapiens
ccgggccctctgtagctccctc

SEQ ID NO: 6069353 - DNA, 15 bp, Homo sapiens
ccgggccctgagtaa

SEQ ID NO: 6069354 - DNA, 23 bp, Homo sapiens
ccgggcccttcagtccctgagca

SEQ ID NO: 6069355 - DNA, 23 bp, Homo sapiens
ccgggccgaatcccctccctgtc

SEQ ID NO: 6069356 - DNA, 20 bp, Homo sapiens
ccgggccgaccctgcggcct

SEQ ID NO: 6069357 - DNA, 22 bp, Homo sapiens
ccgggccggacctgagcccgca

SEQ ID NO: 6069358 - DNA, 16 bp, Homo sapiens
ccgggcctcccaccgc

SEQ ID NO: 6069359 - DNA, 17 bp, Homo sapiens
ccgggcctcccaccgca

SEQ ID NO: 6069360 - DNA, 24 bp, Homo sapiens
ccgggcctcccaccgcagcgtccc

SEQ ID NO: 6069361 - DNA, 16 bp, Homo sapiens
ccgggcctcggcctgg

SEQ ID NO: 6069362 - DNA, 15 bp, Homo sapiens
ccgggcctgaaccac

SEQ ID NO: 6069363 - DNA, 13 bp, Homo sapiens
ccgggcctgcctc

SEQ ID NO: 6069364 - DNA, 15 bp, Homo sapiens
ccgggcctgcctctg

SEQ ID NO: 6069365 - DNA, 17 bp, Homo sapiens
ccgggcctttctctggc

SEQ ID NO: 6069366 - DNA, 14 bp, Homo sapiens
ccgggcgcagccct

SEQ ID NO: 6069367 - DNA, 23 bp, Homo sapiens
ccgggcgcatgcctcccaggcca

SEQ ID NO: 6069368 - DNA, 15 bp, Homo sapiens
ccgggcgccaggaca

SEQ ID NO: 6069369 - DNA, 15 bp, Homo sapiens
ccgggcgcggccagc

SEQ ID NO: 6069370 - DNA, 18 bp, Homo sapiens
ccatgctatgtgcacagc

SEQ ID NO: 6069371 - DNA, 17 bp, Homo sapiens
ccatgctcaaccactgt

SEQ ID NO: 6069372 - DNA, 18 bp, Homo sapiens
ccatgctcaaccactgtg

SEQ ID NO: 6069373 - DNA, 19 bp, Homo sapiens
ccatgctcaaccactgtgg

SEQ ID NO: 6069374 - DNA, 20 bp, Homo sapiens
ccatgctcaacccccctccc

SEQ ID NO: 6069375 - DNA, 21 bp, Homo sapiens
ccatgctcaacccccctccca

SEQ ID NO: 6069376 - DNA, 22 bp, Homo sapiens
ccatgctcaacccccctcccag

SEQ ID NO: 6069377 - DNA, 18 bp, Homo sapiens
ccatgctcatctgctggt

SEQ ID NO: 6069378 - DNA, 12 bp, Homo sapiens
ccatgctcccaa

SEQ ID NO: 6069379 - DNA, 16 bp, Homo sapiens
ccatgctcctcactgc

SEQ ID NO: 6069380 - DNA, 17 bp, Homo sapiens
ccatgctcctcactgcc

SEQ ID NO: 6069381 - DNA, 16 bp, Homo sapiens
ccatgctcctcttccc

SEQ ID NO: 6069382 - DNA, 13 bp, Homo sapiens
ccatgctcctggc

SEQ ID NO: 6069383 - DNA, 22 bp, Homo sapiens
ccatgctctctcacctgctccc

SEQ ID NO: 6069384 - DNA, 18 bp, Homo sapiens
ccatgctctgatgcagtg

SEQ ID NO: 6069385 - DNA, 19 bp, Homo sapiens
ccatgctctttcaccctgc

SEQ ID NO: 6069386 - DNA, 22 bp, Homo sapiens
ccatgctctttcaccctgccac

SEQ ID NO: 6069387 - DNA, 18 bp, Homo sapiens
ccatgctgaattattttg

SEQ ID NO: 6069388 - DNA, 19 bp, Homo sapiens
ccatgctgaggcctgggcc

SEQ ID NO: 6069389 - DNA, 20 bp, Homo sapiens
ccatgctgcaaaggagaagc

SEQ ID NO: 6069390 - DNA, 15 bp, Homo sapiens
ccatgctgccttcag

SEQ ID NO: 6069391 - DNA, 23 bp, Homo sapiens
ccatgctgctggggaagacagtg

SEQ ID NO: 6069392 - DNA, 20 bp, Homo sapiens
ccatgctgctttgcacacac

SEQ ID NO: 6069393 - DNA, 13 bp, Homo sapiens
ccatgctggagcc

SEQ ID NO: 6069394 - DNA, 18 bp, Homo sapiens
ccatgctggagcctgtgt

SEQ ID NO: 6069395 - DNA, 20 bp, Homo sapiens
ccatgctggagcctgtgtaa

SEQ ID NO: 6069396 - DNA, 21 bp, Homo sapiens
ccatgctggagcctgtgtaac

SEQ ID NO: 6069397 - DNA, 20 bp, Homo sapiens
ccatgctggatactggacac

SEQ ID NO: 6069398 - DNA, 20 bp, Homo sapiens
ccatgctggcggcgcagagg

SEQ ID NO: 6069399 - DNA, 13 bp, Homo sapiens
ccatgctggctgg

SEQ ID NO: 6069400 - DNA, 17 bp, Homo sapiens
ccatgctggctggggcc

SEQ ID NO: 6069401 - DNA, 12 bp, Homo sapiens
ccatgctgggcc

SEQ ID NO: 6069402 - DNA, 12 bp, Homo sapiens
ccatgctgggct

SEQ ID NO: 6069403 - DNA, 17 bp, Homo sapiens
ccatgctgggctcacta

SEQ ID NO: 6069404 - DNA, 14 bp, Homo sapiens
ccatgctgggtctg

SEQ ID NO: 6069405 - DNA, 23 bp, Homo sapiens
ccatgctggtcagagacggcaga

SEQ ID NO: 6069406 - DNA, 19 bp, Homo sapiens
ccatgctgtccctgcactg

SEQ ID NO: 6069407 - DNA, 23 bp, Homo sapiens
ccatgctgtccctgtgggctcac

SEQ ID NO: 6069408 - DNA, 12 bp, Homo sapiens
ccatgctgtccg

SEQ ID NO: 6069409 - DNA, 18 bp, Homo sapiens
ccatgctgtctggcacag

SEQ ID NO: 6069410 - DNA, 20 bp, Homo sapiens
ccatgctgtctggcacagcc

SEQ ID NO: 6069411 - DNA, 21 bp, Homo sapiens
ccatgctgtctggcacagcct

SEQ ID NO: 6069412 - DNA, 23 bp, Homo sapiens
ccatgctgtctggcacagcctgc

SEQ ID NO: 6069413 - DNA, 20 bp, Homo sapiens
ccatgctgtgcgcccagggc

SEQ ID NO: 6069414 - DNA, 22 bp, Homo sapiens
ccatgcttaacatacccgccta

SEQ ID NO: 6069415 - DNA, 19 bp, Homo sapiens
ccatgcttagtcactgcct

SEQ ID NO: 6069416 - DNA, 20 bp, Homo sapiens
ccatgcttagtcactgcctg

SEQ ID NO: 6069417 - DNA, 21 bp, Homo sapiens
ccatgcttagtcactgcctgc

SEQ ID NO: 6069418 - DNA, 19 bp, Homo sapiens
ccatgcttcagtgaacata

SEQ ID NO: 6069419 - DNA, 15 bp, Homo sapiens
ccatgcttcttgccc

SEQ ID NO: 6069420 - DNA, 17 bp, Homo sapiens
ccatgcttcttgcccct

SEQ ID NO: 6069421 - DNA, 19 bp, Homo sapiens
ccatgcttcttgccccttg

SEQ ID NO: 6069422 - DNA, 20 bp, Homo sapiens
ccatgcttcttgccccttgg

SEQ ID NO: 6069423 - DNA, 17 bp, Homo sapiens
ccatgcttgcctgaagc

SEQ ID NO: 6069424 - DNA, 15 bp, Homo sapiens
ccatgctttgctctc

SEQ ID NO: 6069425 - DNA, 13 bp, Homo sapiens
ccatggaaataaa

SEQ ID NO: 6069426 - DNA, 23 bp, Homo sapiens
ccatggaaataaaaagtatgttg

SEQ ID NO: 6069427 - DNA, 20 bp, Homo sapiens
ccatggaacagccctgcacg

SEQ ID NO: 6069428 - DNA, 17 bp, Homo sapiens
ccatggaactgtttcct

SEQ ID NO: 6069429 - DNA, 15 bp, Homo sapiens
ccatggaagctggca

SEQ ID NO: 6069430 - DNA, 11 bp, Homo sapiens
ccatggaaggt

SEQ ID NO: 6069431 - DNA, 15 bp, Homo sapiens
ccatggaaggtgcca

SEQ ID NO: 6069432 - DNA, 17 bp, Homo sapiens
ccatggaaggtgccaga

SEQ ID NO: 6069433 - DNA, 13 bp, Homo sapiens
ccatggaattccc

SEQ ID NO: 6069434 - DNA, 15 bp, Homo sapiens
ccatggacaacacta

SEQ ID NO: 6069435 - DNA, 21 bp, Homo sapiens
ccatggacaatataaactgaa

SEQ ID NO: 6069436 - DNA, 13 bp, Homo sapiens
ccatggacacatt

SEQ ID NO: 6069437 - DNA, 14 bp, Homo sapiens
ccatggacactcca

SEQ ID NO: 6069438 - DNA, 21 bp, Homo sapiens
ccatggacactccagtgccag

SEQ ID NO: 6069439 - DNA, 19 bp, Homo sapiens
ccatggacaggctggctcc

SEQ ID NO: 6069440 - DNA, 14 bp, Homo sapiens
ccatggacatgggc

SEQ ID NO: 6069441 - DNA, 18 bp, Homo sapiens
ccatggacgaatatgaat

SEQ ID NO: 6069442 - DNA, 15 bp, Homo sapiens
ccatggactctacac

SEQ ID NO: 6069443 - DNA, 15 bp, Homo sapiens
ccatggactctgtcc

SEQ ID NO: 6069444 - DNA, 18 bp, Homo sapiens
ccatggactctgtcctga

SEQ ID NO: 6069445 - DNA, 21 bp, Homo sapiens
ccatggactctgtcctgaagg

SEQ ID NO: 6069446 - DNA, 14 bp, Homo sapiens
ccatggactttata

SEQ ID NO: 6069447 - DNA, 13 bp, Homo sapiens
ccatggagaaagc

SEQ ID NO: 6069448 - DNA, 14 bp, Homo sapiens
ccatggagaaagct

SEQ ID NO: 6069449 - DNA, 23 bp, Homo sapiens
ccatggagaaagctgacttggct

SEQ ID NO: 6069450 - DNA, 18 bp, Homo sapiens
ccatggagacaataaaca

SEQ ID NO: 6069451 - DNA, 15 bp, Homo sapiens
ccatggagagctgga

SEQ ID NO: 6069452 - DNA, 18 bp, Homo sapiens
ccatggagatctgaaggg

SEQ ID NO: 6069453 - DNA, 18 bp, Homo sapiens
ccatggagattgacctgg

SEQ ID NO: 6069454 - DNA, 15 bp, Homo sapiens
ccatggagccccagc

SEQ ID NO: 6069455 - DNA, 16 bp, Homo sapiens
ccatggagccccagcc

SEQ ID NO: 6069456 - DNA, 19 bp, Homo sapiens
ccatggagccccagccccc

SEQ ID NO: 6069457 - DNA, 12 bp, Homo sapiens
ccatggagccta

SEQ ID NO: 6069458 - DNA, 14 bp, Homo sapiens
ccatggagcctacc

SEQ ID NO: 6069459 - DNA, 16 bp, Homo sapiens
ccatggaggagacagg

SEQ ID NO: 6069460 - DNA, 13 bp, Homo sapiens
ccatggaggaggt

SEQ ID NO: 6069461 - DNA, 21 bp, Homo sapiens
ccatggaggaggtgtcccaag

SEQ ID NO: 6069462 - DNA, 13 bp, Homo sapiens
ccatggaggcaca

SEQ ID NO: 6069463 - DNA, 17 bp, Homo sapiens
ccatggaggcacacagc

SEQ ID NO: 6069464 - DNA, 20 bp, Homo sapiens
ccatggaggcacacagctgc

SEQ ID NO: 6069465 - DNA, 21 bp, Homo sapiens
ccatggaggcacacagctgca

SEQ ID NO: 6069466 - DNA, 18 bp, Homo sapiens
ccatggaggcagatgccc

SEQ ID NO: 6069467 - DNA, 14 bp, Homo sapiens
ccatggaggcaggc

SEQ ID NO: 6069468 - DNA, 18 bp, Homo sapiens
ccatggaggcgccttcct

SEQ ID NO: 6069469 - DNA, 20 bp, Homo sapiens
ccatggagtggcagcccagc

SEQ ID NO: 6069470 - DNA, 22 bp, Homo sapiens
ccatggatctgatctgtaccat

SEQ ID NO: 6069471 - DNA, 16 bp, Homo sapiens
ccatggcaccagcccc

SEQ ID NO: 6069472 - DNA, 18 bp, Homo sapiens
ccatggcaccagccccct

SEQ ID NO: 6069473 - DNA, 22 bp, Homo sapiens
ccatggcaccagccccctggat

SEQ ID NO: 6069474 - DNA, 13 bp, Homo sapiens
ccatggcagcagc

SEQ ID NO: 6069475 - DNA, 16 bp, Homo sapiens
ccatggcagctcctga

SEQ ID NO: 6069476 - DNA, 19 bp, Homo sapiens
ccatggcaggacagctcct

SEQ ID NO: 6069477 - DNA, 14 bp, Homo sapiens
ccatggcatgtctt

SEQ ID NO: 6069478 - DNA, 18 bp, Homo sapiens
ccatggccaaggggccag

SEQ ID NO: 6069479 - DNA, 23 bp, Homo sapiens
ccatggccaaggggccagctgcc

SEQ ID NO: 6069480 - DNA, 20 bp, Homo sapiens
ccatggccacatcctcatgg

SEQ ID NO: 6069481 - DNA, 21 bp, Homo sapiens
ccatggccaccccgtgccacc

SEQ ID NO: 6069482 - DNA, 16 bp, Homo sapiens
ccatggccacgaggaa

SEQ ID NO: 6069483 - DNA, 20 bp, Homo sapiens
ccatggccagcagcacctgc

SEQ ID NO: 6069484 - DNA, 13 bp, Homo sapiens
ccatggcccagca

SEQ ID NO: 6069485 - DNA, 14 bp, Homo sapiens
ccatggcccagcag

SEQ ID NO: 6069486 - DNA, 17 bp, Homo sapiens
ccatggcccagcagctt

SEQ ID NO: 6069487 - DNA, 18 bp, Homo sapiens
ccatggccccagctggct

SEQ ID NO: 6069488 - DNA, 21 bp, Homo sapiens
ccatggccccagctggctggg

SEQ ID NO: 6069489 - DNA, 14 bp, Homo sapiens
ccatggccccaggc

SEQ ID NO: 6069490 - DNA, 15 bp, Homo sapiens
ccatggccccaggcc

SEQ ID NO: 6069491 - DNA, 18 bp, Homo sapiens
ccatggcccccaataaag

SEQ ID NO: 6069492 - DNA, 21 bp, Homo sapiens
ccatggcccccaataaaggca

SEQ ID NO: 6069493 - DNA, 22 bp, Homo sapiens
ccatggcccccaataaaggcag

SEQ ID NO: 6069494 - DNA, 24 bp, Homo sapiens
ccatggcccccaataaaggcagct

SEQ ID NO: 6069495 - DNA, 15 bp, Homo sapiens
ccatggccctcccag

SEQ ID NO: 6069496 - DNA, 13 bp, Homo sapiens
ccatggccctgcc

SEQ ID NO: 6069497 - DNA, 18 bp, Homo sapiens
ccatggccggctttcagg

SEQ ID NO: 6069498 - DNA, 11 bp, Homo sapiens
ccatggcctca

SEQ ID NO: 6069499 - DNA, 13 bp, Homo sapiens
ccatggcctcaga

SEQ ID NO: 6069500 - DNA, 16 bp, Homo sapiens
ccatggcctcagccct

SEQ ID NO: 6069501 - DNA, 14 bp, Homo sapiens
ccatggcctgctgg

SEQ ID NO: 6069502 - DNA, 14 bp, Homo sapiens
ccatggccttatga

SEQ ID NO: 6069503 - DNA, 12 bp, Homo sapiens
ccatggccttcc

SEQ ID NO: 6069504 - DNA, 17 bp, Homo sapiens
ccatggccttggcaggc

SEQ ID NO: 6069505 - DNA, 13 bp, Homo sapiens
ccatggcctttct

SEQ ID NO: 6069506 - DNA, 21 bp, Homo sapiens
ccatggcggcccctcagcctg

SEQ ID NO: 6069507 - DNA, 21 bp, Homo sapiens
ccatggcgtgtccctctcgga

SEQ ID NO: 6069508 - DNA, 17 bp, Homo sapiens
ccatggctcaggcaagc

SEQ ID NO: 6069509 - DNA, 19 bp, Homo sapiens
ccatggctctatttcttct

SEQ ID NO: 6069510 - DNA, 17 bp, Homo sapiens
ccatggctgcacagttg

SEQ ID NO: 6069511 - DNA, 14 bp, Homo sapiens
ccatggctggatgt

SEQ ID NO: 6069512 - DNA, 20 bp, Homo sapiens
ccatggctggatgtgcatct

SEQ ID NO: 6069513 - DNA, 23 bp, Homo sapiens
ccatggctggatgtgcatctggc

SEQ ID NO: 6069514 - DNA, 13 bp, Homo sapiens
ccatggctgtgac

SEQ ID NO: 6069515 - DNA, 19 bp, Homo sapiens
ccatggctgtgacacagac

SEQ ID NO: 6069516 - DNA, 20 bp, Homo sapiens
ccatggcttccaaggtggtc

SEQ ID NO: 6069517 - DNA, 14 bp, Homo sapiens
ccatggcttcctcc

SEQ ID NO: 6069518 - DNA, 16 bp, Homo sapiens
ccatggcttcctgaga

SEQ ID NO: 6069519 - DNA, 17 bp, Homo sapiens
ccatggcttcctgagaa

SEQ ID NO: 6069520 - DNA, 22 bp, Homo sapiens
ccatggctttcatcctgtgtcc

SEQ ID NO: 6069521 - DNA, 21 bp, Homo sapiens
ccatggctttgtgctgctgag

SEQ ID NO: 6069522 - DNA, 18 bp, Homo sapiens
ccatgggaaactttccct

SEQ ID NO: 6069523 - DNA, 18 bp, Homo sapiens
ccatgggaaatgagccag

SEQ ID NO: 6069524 - DNA, 21 bp, Homo sapiens
ccatgggaagacgaggccctc

SEQ ID NO: 6069525 - DNA, 15 bp, Homo sapiens
ccatgggaccaaacc

SEQ ID NO: 6069526 - DNA, 12 bp, Homo sapiens
ccatgggacctc

SEQ ID NO: 6069527 - DNA, 15 bp, Homo sapiens
ccatgggagagtcca

SEQ ID NO: 6069528 - DNA, 16 bp, Homo sapiens
ccatgggagagtccag

SEQ ID NO: 6069529 - DNA, 21 bp, Homo sapiens
ccatgggagagtccaggcctg

SEQ ID NO: 6069530 - DNA, 21 bp, Homo sapiens
ccatgggaggcctttccctaa

SEQ ID NO: 6069531 - DNA, 17 bp, Homo sapiens
ccatgggagggagctga

SEQ ID NO: 6069532 - DNA, 13 bp, Homo sapiens
ccatgggataaat

SEQ ID NO: 6069533 - DNA, 15 bp, Homo sapiens
ccatgggatgttaag

SEQ ID NO: 6069534 - DNA, 21 bp, Homo sapiens
ccatgggcacaaagggcccag

SEQ ID NO: 6069535 - DNA, 15 bp, Homo sapiens
ccatgggcactgctg

SEQ ID NO: 6069536 - DNA, 16 bp, Homo sapiens
ccatgggcactgctgg

SEQ ID NO: 6069537 - DNA, 20 bp, Homo sapiens
ccatgggcactgctgggtgg

SEQ ID NO: 6069538 - DNA, 22 bp, Homo sapiens
ccatgggcactgctgggtggcc

SEQ ID NO: 6069539 - DNA, 20 bp, Homo sapiens
ccatgggcagaagatagaga

SEQ ID NO: 6069540 - DNA, 17 bp, Homo sapiens
ccatgggcagagcccaa

SEQ ID NO: 6069541 - DNA, 21 bp, Homo sapiens
ccatgggccaccgcccagctc

SEQ ID NO: 6069542 - DNA, 14 bp, Homo sapiens
ccatgggccagcct

SEQ ID NO: 6069543 - DNA, 13 bp, Homo sapiens
ccatgggcccgct

SEQ ID NO: 6069544 - DNA, 21 bp, Homo sapiens
ccatgggcccgctgcctcttg

SEQ ID NO: 6069545 - DNA, 22 bp, Homo sapiens
ccatgggcctcatgaataaatg

SEQ ID NO: 6069546 - DNA, 14 bp, Homo sapiens
ccatgggcctcctg

SEQ ID NO: 6069547 - DNA, 13 bp, Homo sapiens
ccatgggcctgct

SEQ ID NO: 6069548 - DNA, 14 bp, Homo sapiens
ccgggcgcggtggc

SEQ ID NO: 6069549 - DNA, 20 bp, Homo sapiens
ccgggcgcggtggctcacgc

SEQ ID NO: 6069550 - DNA, 16 bp, Homo sapiens
ccgggcggaaggggac

SEQ ID NO: 6069551 - DNA, 20 bp, Homo sapiens
ccgggctacccgtgagccct

SEQ ID NO: 6069552 - DNA, 12 bp, Homo sapiens
ccgggctccagg

SEQ ID NO: 6069553 - DNA, 13 bp, Homo sapiens
ccgggctccaggg

SEQ ID NO: 6069554 - DNA, 14 bp, Homo sapiens
ccgggctccaggga

SEQ ID NO: 6069555 - DNA, 17 bp, Homo sapiens
ccgggctccagggagtg

SEQ ID NO: 6069556 - DNA, 22 bp, Homo sapiens
ccgggctcccctttcgcccaca

SEQ ID NO: 6069557 - DNA, 12 bp, Homo sapiens
ccgggctctgac

SEQ ID NO: 6069558 - DNA, 13 bp, Homo sapiens
ccgggctctgcct

SEQ ID NO: 6069559 - DNA, 15 bp, Homo sapiens
ccgggctctggccac

SEQ ID NO: 6069560 - DNA, 15 bp, Homo sapiens
ccgggctgagggcct

SEQ ID NO: 6069561 - DNA, 21 bp, Homo sapiens
ccgggctgcccttcgctgcca

SEQ ID NO: 6069562 - DNA, 18 bp, Homo sapiens
ccgggctgcctgggctgt

SEQ ID NO: 6069563 - DNA, 16 bp, Homo sapiens
ccgggctgctgctgat

SEQ ID NO: 6069564 - DNA, 16 bp, Homo sapiens
ccgggctggagaaaga

SEQ ID NO: 6069565 - DNA, 17 bp, Homo sapiens
ccgggctggagaaagag

SEQ ID NO: 6069566 - DNA, 13 bp, Homo sapiens
ccgggctggccct

SEQ ID NO: 6069567 - DNA, 16 bp, Homo sapiens
ccgggctggccctgtg

SEQ ID NO: 6069568 - DNA, 21 bp, Homo sapiens
ccgggctggctgcttgcagcc

SEQ ID NO: 6069569 - DNA, 20 bp, Homo sapiens
ccgggctggcttctccctgg

SEQ ID NO: 6069570 - DNA, 18 bp, Homo sapiens
ccgggctgggagctctgc

SEQ ID NO: 6069571 - DNA, 16 bp, Homo sapiens
ccgggctgggcccctc

SEQ ID NO: 6069572 - DNA, 21 bp, Homo sapiens
ccgggctgtagatcaggtttg

SEQ ID NO: 6069573 - DNA, 12 bp, Homo sapiens
ccgggcttgggc

SEQ ID NO: 6069574 - DNA, 17 bp, Homo sapiens
ccggggaactggccaag

SEQ ID NO: 6069575 - DNA, 19 bp, Homo sapiens
ccggggaactggccaagct

SEQ ID NO: 6069576 - DNA, 22 bp, Homo sapiens
ccggggaagctgccagcccaga

SEQ ID NO: 6069577 - DNA, 15 bp, Homo sapiens
ccggggaccctgtga

SEQ ID NO: 6069578 - DNA, 19 bp, Homo sapiens
ccggggactcccaggctgg

SEQ ID NO: 6069579 - DNA, 19 bp, Homo sapiens
ccggggactggccactgaa

SEQ ID NO: 6069580 - DNA, 15 bp, Homo sapiens
ccggggagctgaggg

SEQ ID NO: 6069581 - DNA, 14 bp, Homo sapiens
ccggggaggagcct

SEQ ID NO: 6069582 - DNA, 11 bp, Homo sapiens
ccggggagggg

SEQ ID NO: 6069583 - DNA, 16 bp, Homo sapiens
ccggggaggggcagag

SEQ ID NO: 6069584 - DNA, 13 bp, Homo sapiens
ccggggaggggcc

SEQ ID NO: 6069585 - DNA, 17 bp, Homo sapiens
ccggggaggggccagag

SEQ ID NO: 6069586 - DNA, 12 bp, Homo sapiens
ccggggaggggg

SEQ ID NO: 6069587 - DNA, 17 bp, Homo sapiens
ccggggagggggcacgg

SEQ ID NO: 6069588 - DNA, 22 bp, Homo sapiens
ccggggagtttctttcctgcct

SEQ ID NO: 6069589 - DNA, 22 bp, Homo sapiens
ccggggcacacgggcctctgct

SEQ ID NO: 6069590 - DNA, 16 bp, Homo sapiens
ccggggcactttcaga

SEQ ID NO: 6069591 - DNA, 18 bp, Homo sapiens
ccggggcagagctcagag

SEQ ID NO: 6069592 - DNA, 20 bp, Homo sapiens
ccggggcagagctcagagga

SEQ ID NO: 6069593 - DNA, 17 bp, Homo sapiens
ccggggcagcagcagcc

SEQ ID NO: 6069594 - DNA, 18 bp, Homo sapiens
ccggggcagcagcagccc

SEQ ID NO: 6069595 - DNA, 18 bp, Homo sapiens
ccggggcagctgccagag

SEQ ID NO: 6069596 - DNA, 13 bp, Homo sapiens
ccggggcagctgg

SEQ ID NO: 6069597 - DNA, 21 bp, Homo sapiens
ccggggcatggacagggccag

SEQ ID NO: 6069598 - DNA, 22 bp, Homo sapiens
ccggggcatggacagggccagg

SEQ ID NO: 6069599 - DNA, 18 bp, Homo sapiens
ccggggccatggaagctg

SEQ ID NO: 6069600 - DNA, 12 bp, Homo sapiens
ccggggcccagg

SEQ ID NO: 6069601 - DNA, 17 bp, Homo sapiens
ccggggccccactggct

SEQ ID NO: 6069602 - DNA, 15 bp, Homo sapiens
ccggggcctctgccc

SEQ ID NO: 6069603 - DNA, 22 bp, Homo sapiens
ccggggcctggactgcacaggc

SEQ ID NO: 6069604 - DNA, 19 bp, Homo sapiens
ccggggccttatcgggctc

SEQ ID NO: 6069605 - DNA, 23 bp, Homo sapiens
ccggggccttccttttgaggagc

SEQ ID NO: 6069606 - DNA, 23 bp, Homo sapiens
ccggggccttggtcccagacagc

SEQ ID NO: 6069607 - DNA, 15 bp, Homo sapiens
ccggggcgcctagag

SEQ ID NO: 6069608 - DNA, 20 bp, Homo sapiens
ccggggcgcctagagcgcgg

SEQ ID NO: 6069609 - DNA, 14 bp, Homo sapiens
ccggggctcagccc

SEQ ID NO: 6069610 - DNA, 14 bp, Homo sapiens
ccggggctcctctc

SEQ ID NO: 6069611 - DNA, 20 bp, Homo sapiens
ccggggctgaagccacacag

SEQ ID NO: 6069612 - DNA, 11 bp, Homo sapiens
ccggggctgag

SEQ ID NO: 6069613 - DNA, 16 bp, Homo sapiens
ccggggctgctggcct

SEQ ID NO: 6069614 - DNA, 12 bp, Homo sapiens
ccggggctggca

SEQ ID NO: 6069615 - DNA, 19 bp, Homo sapiens
ccggggctggcaagcaggg

SEQ ID NO: 6069616 - DNA, 17 bp, Homo sapiens
ccggggctggccctgcc

SEQ ID NO: 6069617 - DNA, 18 bp, Homo sapiens
ccggggctggccctgccc

SEQ ID NO: 6069618 - DNA, 17 bp, Homo sapiens
ccgggggaagctgagcc

SEQ ID NO: 6069619 - DNA, 16 bp, Homo sapiens
ccgggggacagaggtt

SEQ ID NO: 6069620 - DNA, 11 bp, Homo sapiens
ccgggggaggg

SEQ ID NO: 6069621 - DNA, 13 bp, Homo sapiens
ccgggggaggggc

SEQ ID NO: 6069622 - DNA, 16 bp, Homo sapiens
ccgggggaggggccct

SEQ ID NO: 6069623 - DNA, 20 bp, Homo sapiens
ccgggggaggggccctcagg

SEQ ID NO: 6069624 - DNA, 23 bp, Homo sapiens
ccgggggaggggccctcaggcca

SEQ ID NO: 6069625 - DNA, 16 bp, Homo sapiens
ccgggggaggggcgcg

SEQ ID NO: 6069626 - DNA, 22 bp, Homo sapiens
ccgggggcagctctggaggggg

SEQ ID NO: 6069627 - DNA, 10 bp, Homo sapiens
ccggggggaa

SEQ ID NO: 6069628 - DNA, 14 bp, Homo sapiens
ccggggggagggga

SEQ ID NO: 6069629 - DNA, 19 bp, Homo sapiens
ccggggggggtaggagagg

SEQ ID NO: 6069630 - DNA, 20 bp, Homo sapiens
ccggggtccccgccctctct

SEQ ID NO: 6069631 - DNA, 21 bp, Homo sapiens
ccggggtccccgccctctctc

SEQ ID NO: 6069632 - DNA, 14 bp, Homo sapiens
ccggggtcctggga

SEQ ID NO: 6069633 - DNA, 14 bp, Homo sapiens
ccggggtctcctgg

SEQ ID NO: 6069634 - DNA, 18 bp, Homo sapiens
ccggggtgcccgtgtggc

SEQ ID NO: 6069635 - DNA, 21 bp, Homo sapiens
ccggggtggagcatgggcctg

SEQ ID NO: 6069636 - DNA, 22 bp, Homo sapiens
ccggggtggggtgcactcgcca

SEQ ID NO: 6069637 - DNA, 19 bp, Homo sapiens
ccggggtggggtgcctgag

SEQ ID NO: 6069638 - DNA, 21 bp, Homo sapiens
ccggggtggggtgcctgagcc

SEQ ID NO: 6069639 - DNA, 21 bp, Homo sapiens
ccggggtggggtggctgcagc

SEQ ID NO: 6069640 - DNA, 17 bp, Homo sapiens
ccggggtgtaacttcct

SEQ ID NO: 6069641 - DNA, 22 bp, Homo sapiens
ccggggttcccgtgtgcctgag

SEQ ID NO: 6069642 - DNA, 15 bp, Homo sapiens
ccgggtacctcagtt

SEQ ID NO: 6069643 - DNA, 17 bp, Homo sapiens
ccgggtacctcagtttc

SEQ ID NO: 6069644 - DNA, 21 bp, Homo sapiens
ccgggtactcagtcagcccag

SEQ ID NO: 6069645 - DNA, 19 bp, Homo sapiens
ccgggtcacacaaaggcat

SEQ ID NO: 6069646 - DNA, 13 bp, Homo sapiens
ccgggtcactgct

SEQ ID NO: 6069647 - DNA, 14 bp, Homo sapiens
ccgggtcactgctg

SEQ ID NO: 6069648 - DNA, 22 bp, Homo sapiens
ccgggtcatctgtacctctgcc

SEQ ID NO: 6069649 - DNA, 13 bp, Homo sapiens
ccgggtccccagc

SEQ ID NO: 6069650 - DNA, 16 bp, Homo sapiens
ccgggtccccagctcc

SEQ ID NO: 6069651 - DNA, 19 bp, Homo sapiens
ccgggtccggcctctccct

SEQ ID NO: 6069652 - DNA, 18 bp, Homo sapiens
ccgggtccttggccccct

SEQ ID NO: 6069653 - DNA, 18 bp, Homo sapiens
ccgggtctcaggcctcca

SEQ ID NO: 6069654 - DNA, 14 bp, Homo sapiens
ccgggtctccttgg

SEQ ID NO: 6069655 - DNA, 17 bp, Homo sapiens
ccgggtctcgcagcctg

SEQ ID NO: 6069656 - DNA, 20 bp, Homo sapiens
ccgggtctggtgctgaggat

SEQ ID NO: 6069657 - DNA, 13 bp, Homo sapiens
ccgggtcttccta

SEQ ID NO: 6069658 - DNA, 16 bp, Homo sapiens
ccgggtcttgattcag

SEQ ID NO: 6069659 - DNA, 14 bp, Homo sapiens
ccgggtgagatgga

SEQ ID NO: 6069660 - DNA, 16 bp, Homo sapiens
ccgggtgccattccca

SEQ ID NO: 6069661 - DNA, 23 bp, Homo sapiens
ccgggtgccccccatgccctccc

SEQ ID NO: 6069662 - DNA, 22 bp, Homo sapiens
ccgggtgcctcagagcaggctc

SEQ ID NO: 6069663 - DNA, 19 bp, Homo sapiens
ccgggtgcgtgaccggccc

SEQ ID NO: 6069664 - DNA, 17 bp, Homo sapiens
ccgggtggcagcgccca

SEQ ID NO: 6069665 - DNA, 16 bp, Homo sapiens
ccgggtgggcctggcc

SEQ ID NO: 6069666 - DNA, 21 bp, Homo sapiens
ccgggtgggcctggcctgagc

SEQ ID NO: 6069667 - DNA, 14 bp, Homo sapiens
ccgggtgggcggca

SEQ ID NO: 6069668 - DNA, 18 bp, Homo sapiens
ccgggtgtagattccctt

SEQ ID NO: 6069669 - DNA, 21 bp, Homo sapiens
ccgggtgtggcacgcacctgt

SEQ ID NO: 6069670 - DNA, 15 bp, Homo sapiens
ccgggttcagcctgg

SEQ ID NO: 6069671 - DNA, 18 bp, Homo sapiens
ccgggttcagcctggcct

SEQ ID NO: 6069672 - DNA, 20 bp, Homo sapiens
ccgggttcagcctggcctgc

SEQ ID NO: 6069673 - DNA, 17 bp, Homo sapiens
ccgggttctagtctcct

SEQ ID NO: 6069674 - DNA, 22 bp, Homo sapiens
ccgggttctgcagcggcagagc

SEQ ID NO: 6069675 - DNA, 23 bp, Homo sapiens
ccgggttctgcagcggcagagca

SEQ ID NO: 6069676 - DNA, 19 bp, Homo sapiens
ccggtaactgtcctgtcct

SEQ ID NO: 6069677 - DNA, 21 bp, Homo sapiens
ccggtaactgtcctgtcctgc

SEQ ID NO: 6069678 - DNA, 15 bp, Homo sapiens
ccggtacacagccag

SEQ ID NO: 6069679 - DNA, 15 bp, Homo sapiens
ccggtaccagcctga

SEQ ID NO: 6069680 - DNA, 21 bp, Homo sapiens
ccggtagaggctccccagggc

SEQ ID NO: 6069681 - DNA, 22 bp, Homo sapiens
ccggtagaggctccccagggct

SEQ ID NO: 6069682 - DNA, 17 bp, Homo sapiens
ccggtagggaggcagcc

SEQ ID NO: 6069683 - DNA, 14 bp, Homo sapiens
ccggtcacccaggc

SEQ ID NO: 6069684 - DNA, 14 bp, Homo sapiens
ccggtcagcccctg

SEQ ID NO: 6069685 - DNA, 15 bp, Homo sapiens
ccggtcatttgaatg

SEQ ID NO: 6069686 - DNA, 13 bp, Homo sapiens
ccggtccacaggt

SEQ ID NO: 6069687 - DNA, 15 bp, Homo sapiens
ccggtccagctggcc

SEQ ID NO: 6069688 - DNA, 24 bp, Homo sapiens
ccggtcccagcctgggctcctctg

SEQ ID NO: 6069689 - DNA, 18 bp, Homo sapiens
ccggtcccagtccggtgc

SEQ ID NO: 6069690 - DNA, 19 bp, Homo sapiens
ccggtcccagtccggtgcc

SEQ ID NO: 6069691 - DNA, 18 bp, Homo sapiens
ccggtcccctgcctggaa

SEQ ID NO: 6069692 - DNA, 19 bp, Homo sapiens
ccggtcccctgcctggaac

SEQ ID NO: 6069693 - DNA, 15 bp, Homo sapiens
ccggtcccttccatg

SEQ ID NO: 6069694 - DNA, 17 bp, Homo sapiens
ccggtccggcgccccgc

SEQ ID NO: 6069695 - DNA, 18 bp, Homo sapiens
ccggtcgccctttgctgc

SEQ ID NO: 6069696 - DNA, 16 bp, Homo sapiens
ccggtcgggcagccag

SEQ ID NO: 6069697 - DNA, 18 bp, Homo sapiens
ccggtcgggcagccagca

SEQ ID NO: 6069698 - DNA, 21 bp, Homo sapiens
ccggtctgcaagtcagaggat

SEQ ID NO: 6069699 - DNA, 14 bp, Homo sapiens
ccggtgaggccaag

SEQ ID NO: 6069700 - DNA, 14 bp, Homo sapiens
ccggtgaggggagg

SEQ ID NO: 6069701 - DNA, 14 bp, Homo sapiens
ccggtgcagaacag

SEQ ID NO: 6069702 - DNA, 15 bp, Homo sapiens
ccggtgcatctggca

SEQ ID NO: 6069703 - DNA, 16 bp, Homo sapiens
ccggtgcatctggcac

SEQ ID NO: 6069704 - DNA, 22 bp, Homo sapiens
ccggtgcatgcaggtctccatg

SEQ ID NO: 6069705 - DNA, 15 bp, Homo sapiens
ccggtgccagctgcc

SEQ ID NO: 6069706 - DNA, 16 bp, Homo sapiens
ccggtgccatcttcca

SEQ ID NO: 6069707 - DNA, 18 bp, Homo sapiens
ccggtgcctctcccatgg

SEQ ID NO: 6069708 - DNA, 22 bp, Homo sapiens
ccggtgcctgggtggccatcct

SEQ ID NO: 6069709 - DNA, 16 bp, Homo sapiens
ccggtgccttccaccc

SEQ ID NO: 6069710 - DNA, 20 bp, Homo sapiens
ccggtgccttccaccctgcc

SEQ ID NO: 6069711 - DNA, 21 bp, Homo sapiens
ccggtgccttccaccctgccc

SEQ ID NO: 6069712 - DNA, 22 bp, Homo sapiens
ccggtgccttccaccctgccct

SEQ ID NO: 6069713 - DNA, 13 bp, Homo sapiens
ccggtgctctgtg

SEQ ID NO: 6069714 - DNA, 22 bp, Homo sapiens
ccggtgctgggggcacagctgt

SEQ ID NO: 6069715 - DNA, 13 bp, Homo sapiens
ccggtgctgggtt

SEQ ID NO: 6069716 - DNA, 20 bp, Homo sapiens
ccggtgctgggttcccactc

SEQ ID NO: 6069717 - DNA, 20 bp, Homo sapiens
ccggtggcggccccagcacc

SEQ ID NO: 6069718 - DNA, 20 bp, Homo sapiens
ccggtggcttctggcacctg

SEQ ID NO: 6069719 - DNA, 14 bp, Homo sapiens
ccggtgggcagtgg

SEQ ID NO: 6069720 - DNA, 20 bp, Homo sapiens
ccggtggtgggatccacgct

SEQ ID NO: 6069721 - DNA, 12 bp, Homo sapiens
ccggtggttttg

SEQ ID NO: 6069722 - DNA, 12 bp, Homo sapiens
ccggtgtccctg

SEQ ID NO: 6069723 - DNA, 11 bp, Homo sapiens
ccggtgtcctt

SEQ ID NO: 6069724 - DNA, 16 bp, Homo sapiens
ccggtgtgagcccacc

SEQ ID NO: 6069725 - DNA, 17 bp, Homo sapiens
ccggtgtgagcccacct

SEQ ID NO: 6069726 - DNA, 12 bp, Homo sapiens
ccggtgtgagga

SEQ ID NO: 6069727 - DNA, 15 bp, Homo sapiens
ccatgggcctgctgc

SEQ ID NO: 6069728 - DNA, 16 bp, Homo sapiens
ccatgggcctgctgcg

SEQ ID NO: 6069729 - DNA, 14 bp, Homo sapiens
ccatgggcctgggc

SEQ ID NO: 6069730 - DNA, 18 bp, Homo sapiens
ccatgggcctgggcctgc

SEQ ID NO: 6069731 - DNA, 20 bp, Homo sapiens
ccatgggcctgggcctgctt

SEQ ID NO: 6069732 - DNA, 19 bp, Homo sapiens
ccatgggcgaccagggcca

SEQ ID NO: 6069733 - DNA, 23 bp, Homo sapiens
ccatgggcgaccagggccatctc

SEQ ID NO: 6069734 - DNA, 17 bp, Homo sapiens
ccatgggctagtgtgag

SEQ ID NO: 6069735 - DNA, 20 bp, Homo sapiens
ccatgggctagtgtgagtgg

SEQ ID NO: 6069736 - DNA, 14 bp, Homo sapiens
ccatgggctcaggg

SEQ ID NO: 6069737 - DNA, 21 bp, Homo sapiens
ccatgggctcagggccaggtc

SEQ ID NO: 6069738 - DNA, 19 bp, Homo sapiens
ccatgggctcctgcccctt

SEQ ID NO: 6069739 - DNA, 15 bp, Homo sapiens
ccatgggctgtgtcc

SEQ ID NO: 6069740 - DNA, 21 bp, Homo sapiens
ccatgggcttggacttcctgg

SEQ ID NO: 6069741 - DNA, 12 bp, Homo sapiens
ccatggggagga

SEQ ID NO: 6069742 - DNA, 18 bp, Homo sapiens
ccatggggagggattctg

SEQ ID NO: 6069743 - DNA, 14 bp, Homo sapiens
ccatggggcagcct

SEQ ID NO: 6069744 - DNA, 15 bp, Homo sapiens
ccatggggcagcctc

SEQ ID NO: 6069745 - DNA, 20 bp, Homo sapiens
ccatgggggcacttgagttt

SEQ ID NO: 6069746 - DNA, 20 bp, Homo sapiens
ccatgggggctgtctttgca

SEQ ID NO: 6069747 - DNA, 14 bp, Homo sapiens
ccatggggggagaa

SEQ ID NO: 6069748 - DNA, 18 bp, Homo sapiens
ccatgggggtgagaccct

SEQ ID NO: 6069749 - DNA, 15 bp, Homo sapiens
ccatggggtccatcc

SEQ ID NO: 6069750 - DNA, 17 bp, Homo sapiens
ccatggggtccttggag

SEQ ID NO: 6069751 - DNA, 18 bp, Homo sapiens
ccatggggtcggctcctg

SEQ ID NO: 6069752 - DNA, 23 bp, Homo sapiens
ccatggggtctctcacagacagg

SEQ ID NO: 6069753 - DNA, 19 bp, Homo sapiens
ccatggggtggaaggagaa

SEQ ID NO: 6069754 - DNA, 16 bp, Homo sapiens
ccatgggtagcctggg

SEQ ID NO: 6069755 - DNA, 23 bp, Homo sapiens
ccatgggtatgacataggccaag

SEQ ID NO: 6069756 - DNA, 15 bp, Homo sapiens
ccatgggtgcatgga

SEQ ID NO: 6069757 - DNA, 16 bp, Homo sapiens
ccatgggtgtggatgg

SEQ ID NO: 6069758 - DNA, 18 bp, Homo sapiens
ccatgggtgtggatggca

SEQ ID NO: 6069759 - DNA, 14 bp, Homo sapiens
ccatggtaccccct

SEQ ID NO: 6069760 - DNA, 15 bp, Homo sapiens
ccatggtaccccctt

SEQ ID NO: 6069761 - DNA, 18 bp, Homo sapiens
ccatggtacccccttctg

SEQ ID NO: 6069762 - DNA, 19 bp, Homo sapiens
ccatggtacccccttctgg

SEQ ID NO: 6069763 - DNA, 16 bp, Homo sapiens
ccatggtactgtagca

SEQ ID NO: 6069764 - DNA, 20 bp, Homo sapiens
ccatggtactgtagcagggg

SEQ ID NO: 6069765 - DNA, 23 bp, Homo sapiens
ccatggtagaaaatgcaccaaat

SEQ ID NO: 6069766 - DNA, 15 bp, Homo sapiens
ccatggtcacagacc

SEQ ID NO: 6069767 - DNA, 15 bp, Homo sapiens
ccatggtcacagaga

SEQ ID NO: 6069768 - DNA, 13 bp, Homo sapiens
ccatggtcaccct

SEQ ID NO: 6069769 - DNA, 15 bp, Homo sapiens
ccatggtcaccctca

SEQ ID NO: 6069770 - DNA, 18 bp, Homo sapiens
ccatggtcaccctcagga

SEQ ID NO: 6069771 - DNA, 22 bp, Homo sapiens
ccatggtctctcgggcccccca

SEQ ID NO: 6069772 - DNA, 16 bp, Homo sapiens
ccatggtctttccact

SEQ ID NO: 6069773 - DNA, 23 bp, Homo sapiens
ccatggtctttccactttcatct

SEQ ID NO: 6069774 - DNA, 17 bp, Homo sapiens
ccatggtgaaagggttt

SEQ ID NO: 6069775 - DNA, 14 bp, Homo sapiens
ccatggtgaactga

SEQ ID NO: 6069776 - DNA, 18 bp, Homo sapiens
ccatggtgattcctggga

SEQ ID NO: 6069777 - DNA, 16 bp, Homo sapiens
ccatggtgcctctgga

SEQ ID NO: 6069778 - DNA, 15 bp, Homo sapiens
ccatggtggagggca

SEQ ID NO: 6069779 - DNA, 18 bp, Homo sapiens
ccatggtggagggcactt

SEQ ID NO: 6069780 - DNA, 13 bp, Homo sapiens
ccatggtggcctc

SEQ ID NO: 6069781 - DNA, 21 bp, Homo sapiens
ccatggtgggcttgtggtggc

SEQ ID NO: 6069782 - DNA, 22 bp, Homo sapiens
ccatggtggtttcagaaagggc

SEQ ID NO: 6069783 - DNA, 17 bp, Homo sapiens
ccatggtgtgtttgtaa

SEQ ID NO: 6069784 - DNA, 17 bp, Homo sapiens
ccatggtgttggagggg

SEQ ID NO: 6069785 - DNA, 18 bp, Homo sapiens
ccatggtgttggaggggc

SEQ ID NO: 6069786 - DNA, 20 bp, Homo sapiens
ccatggttaagagtccaaga

SEQ ID NO: 6069787 - DNA, 12 bp, Homo sapiens
ccatggttctgc

SEQ ID NO: 6069788 - DNA, 15 bp, Homo sapiens
ccatggttctgcctc

SEQ ID NO: 6069789 - DNA, 19 bp, Homo sapiens
ccatggttttggctctccc

SEQ ID NO: 6069790 - DNA, 20 bp, Homo sapiens
ccatggttttggctctccca

SEQ ID NO: 6069791 - DNA, 23 bp, Homo sapiens
ccatggttttggctctcccaccc

SEQ ID NO: 6069792 - DNA, 14 bp, Homo sapiens
ccatgtaaaacaaa

SEQ ID NO: 6069793 - DNA, 17 bp, Homo sapiens
ccatgtaaataatctgt

SEQ ID NO: 6069794 - DNA, 18 bp, Homo sapiens
ccatgtaaataatctgtg

SEQ ID NO: 6069795 - DNA, 23 bp, Homo sapiens
ccatgtaaataccagactgcagg

SEQ ID NO: 6069796 - DNA, 20 bp, Homo sapiens
ccatgtaaatactttccatg

SEQ ID NO: 6069797 - DNA, 15 bp, Homo sapiens
ccatgtaacagaaag

SEQ ID NO: 6069798 - DNA, 17 bp, Homo sapiens
ccatgtaaccactgcac

SEQ ID NO: 6069799 - DNA, 19 bp, Homo sapiens
ccatgtaaccactgcactt

SEQ ID NO: 6069800 - DNA, 14 bp, Homo sapiens
ccatgtaactgcct

SEQ ID NO: 6069801 - DNA, 20 bp, Homo sapiens
ccatgtaactgcctagaaac

SEQ ID NO: 6069802 - DNA, 15 bp, Homo sapiens
ccatgtaagcactct

SEQ ID NO: 6069803 - DNA, 15 bp, Homo sapiens
ccatgtaatgatctt

SEQ ID NO: 6069804 - DNA, 19 bp, Homo sapiens
ccatgtaatgatcttggac

SEQ ID NO: 6069805 - DNA, 17 bp, Homo sapiens
ccatgtactagttttag

SEQ ID NO: 6069806 - DNA, 19 bp, Homo sapiens
ccatgtagaagagggagaa

SEQ ID NO: 6069807 - DNA, 21 bp, Homo sapiens
ccatgtagaagagggagaagg

SEQ ID NO: 6069808 - DNA, 14 bp, Homo sapiens
ccatgtagaagctg

SEQ ID NO: 6069809 - DNA, 19 bp, Homo sapiens
ccatgtagaataaatgaag

SEQ ID NO: 6069810 - DNA, 15 bp, Homo sapiens
ccatgtagcagacaa

SEQ ID NO: 6069811 - DNA, 14 bp, Homo sapiens
ccatgtagccccct

SEQ ID NO: 6069812 - DNA, 22 bp, Homo sapiens
ccatgtagccccctggcctctg

SEQ ID NO: 6069813 - DNA, 23 bp, Homo sapiens
ccatgtagttttaacagaaccag

SEQ ID NO: 6069814 - DNA, 20 bp, Homo sapiens
ccatgtatgtggtatgtata

SEQ ID NO: 6069815 - DNA, 17 bp, Homo sapiens
ccatgtatgttgcatga

SEQ ID NO: 6069816 - DNA, 15 bp, Homo sapiens
ccatgtattatgaaa

SEQ ID NO: 6069817 - DNA, 19 bp, Homo sapiens
ccatgtattcatccagagt

SEQ ID NO: 6069818 - DNA, 22 bp, Homo sapiens
ccatgtatttatctctatttaa

SEQ ID NO: 6069819 - DNA, 16 bp, Homo sapiens
ccatgtatttcaggga

SEQ ID NO: 6069820 - DNA, 18 bp, Homo sapiens
ccatgtatttcagggacc

SEQ ID NO: 6069821 - DNA, 19 bp, Homo sapiens
ccatgtatttcagggacct

SEQ ID NO: 6069822 - DNA, 20 bp, Homo sapiens
ccatgtcaccggtcagtgcc

SEQ ID NO: 6069823 - DNA, 13 bp, Homo sapiens
ccatgtcacctca

SEQ ID NO: 6069824 - DNA, 21 bp, Homo sapiens
ccatgtcagataagtgtaaat

SEQ ID NO: 6069825 - DNA, 17 bp, Homo sapiens
ccatgtcagcaaaaagc

SEQ ID NO: 6069826 - DNA, 18 bp, Homo sapiens
ccatgtcagcaaaaagca

SEQ ID NO: 6069827 - DNA, 16 bp, Homo sapiens
ccatgtcatgtgccac

SEQ ID NO: 6069828 - DNA, 19 bp, Homo sapiens
ccatgtcatgtgccacgac

SEQ ID NO: 6069829 - DNA, 13 bp, Homo sapiens
ccatgtccaaaga

SEQ ID NO: 6069830 - DNA, 14 bp, Homo sapiens
ccatgtccaaagag

SEQ ID NO: 6069831 - DNA, 18 bp, Homo sapiens
ccatgtccaaagaggctg

SEQ ID NO: 6069832 - DNA, 20 bp, Homo sapiens
ccatgtccaaagaggctgcc

SEQ ID NO: 6069833 - DNA, 23 bp, Homo sapiens
ccatgtccaaagaggctgcccct

SEQ ID NO: 6069834 - DNA, 15 bp, Homo sapiens
ccatgtccaagttct

SEQ ID NO: 6069835 - DNA, 21 bp, Homo sapiens
ccatgtccaagttcttcacct

SEQ ID NO: 6069836 - DNA, 15 bp, Homo sapiens
ccatgtccaatggag

SEQ ID NO: 6069837 - DNA, 16 bp, Homo sapiens
ccatgtcccaccctcc

SEQ ID NO: 6069838 - DNA, 13 bp, Homo sapiens
ccatgtcccctcc

SEQ ID NO: 6069839 - DNA, 16 bp, Homo sapiens
ccatgtcccctcccag

SEQ ID NO: 6069840 - DNA, 15 bp, Homo sapiens
ccatgtcctatgcct

SEQ ID NO: 6069841 - DNA, 18 bp, Homo sapiens
ccatgtcctatgcctcac

SEQ ID NO: 6069842 - DNA, 19 bp, Homo sapiens
ccatgtcctatgtgtgact

SEQ ID NO: 6069843 - DNA, 12 bp, Homo sapiens
ccatgtcgcctc

SEQ ID NO: 6069844 - DNA, 16 bp, Homo sapiens
ccatgtcgcctctgca

SEQ ID NO: 6069845 - DNA, 14 bp, Homo sapiens
ccatgtcgcctgcc

SEQ ID NO: 6069846 - DNA, 18 bp, Homo sapiens
ccatgtcgcctgccccca

SEQ ID NO: 6069847 - DNA, 14 bp, Homo sapiens
ccatgtcggcctct

SEQ ID NO: 6069848 - DNA, 14 bp, Homo sapiens
ccatgtctcgactc

SEQ ID NO: 6069849 - DNA, 15 bp, Homo sapiens
ccatgtctcgactca

SEQ ID NO: 6069850 - DNA, 16 bp, Homo sapiens
ccatgtctctcagaat

SEQ ID NO: 6069851 - DNA, 13 bp, Homo sapiens
ccatgtctgcatt

SEQ ID NO: 6069852 - DNA, 13 bp, Homo sapiens
ccatgtcttctcc

SEQ ID NO: 6069853 - DNA, 22 bp, Homo sapiens
ccatgtctttctggaaaggaaa

SEQ ID NO: 6069854 - DNA, 18 bp, Homo sapiens
ccatgtgaaaataaaata

SEQ ID NO: 6069855 - DNA, 22 bp, Homo sapiens
ccatgtgactctggcttggcct

SEQ ID NO: 6069856 - DNA, 17 bp, Homo sapiens
ccatgtgagccaccgct

SEQ ID NO: 6069857 - DNA, 20 bp, Homo sapiens
ccatgtgagctgctgccatg

SEQ ID NO: 6069858 - DNA, 21 bp, Homo sapiens
ccatgtgagctgctgccatga

SEQ ID NO: 6069859 - DNA, 22 bp, Homo sapiens
ccatgtgagctgctgccatgaa

SEQ ID NO: 6069860 - DNA, 21 bp, Homo sapiens
ccatgtgagggttttcagcat

SEQ ID NO: 6069861 - DNA, 20 bp, Homo sapiens
ccatgtgatggacactccag

SEQ ID NO: 6069862 - DNA, 20 bp, Homo sapiens
ccatgtgcaaacgctgtatt

SEQ ID NO: 6069863 - DNA, 18 bp, Homo sapiens
ccatgtgcacccggcctg

SEQ ID NO: 6069864 - DNA, 19 bp, Homo sapiens
ccatgtgcacccggcctgg

SEQ ID NO: 6069865 - DNA, 20 bp, Homo sapiens
ccatgtgcacccggcctgga

SEQ ID NO: 6069866 - DNA, 21 bp, Homo sapiens
ccatgtgcatagtttctttat

SEQ ID NO: 6069867 - DNA, 12 bp, Homo sapiens
ccatgtgcatat

SEQ ID NO: 6069868 - DNA, 22 bp, Homo sapiens
ccatgtgccatctgtacatatt

SEQ ID NO: 6069869 - DNA, 13 bp, Homo sapiens
ccatgtgcccagt

SEQ ID NO: 6069870 - DNA, 16 bp, Homo sapiens
ccatgtgcctctttgt

SEQ ID NO: 6069871 - DNA, 15 bp, Homo sapiens
ccatgtgcctgcacc

SEQ ID NO: 6069872 - DNA, 17 bp, Homo sapiens
ccatgtgcctgcaccag

SEQ ID NO: 6069873 - DNA, 12 bp, Homo sapiens
ccatgtgcctgt

SEQ ID NO: 6069874 - DNA, 21 bp, Homo sapiens
ccatgtgcctgtcacgctctg

SEQ ID NO: 6069875 - DNA, 17 bp, Homo sapiens
ccatgtgccttgtccag

SEQ ID NO: 6069876 - DNA, 15 bp, Homo sapiens
ccatgtgcctttctt

SEQ ID NO: 6069877 - DNA, 16 bp, Homo sapiens
ccatgtgctgccctgt

SEQ ID NO: 6069878 - DNA, 23 bp, Homo sapiens
ccatgtgctgggaaatgcagaaa

SEQ ID NO: 6069879 - DNA, 15 bp, Homo sapiens
ccatgtggagtggac

SEQ ID NO: 6069880 - DNA, 23 bp, Homo sapiens
ccatgtggatatcagttaccaaa

SEQ ID NO: 6069881 - DNA, 17 bp, Homo sapiens
ccatgtggatgcagcac

SEQ ID NO: 6069882 - DNA, 23 bp, Homo sapiens
ccatgtggcagaagtgctctttg

SEQ ID NO: 6069883 - DNA, 14 bp, Homo sapiens
ccatgtggccacaa

SEQ ID NO: 6069884 - DNA, 22 bp, Homo sapiens
ccatgtggccccaggtgccacc

SEQ ID NO: 6069885 - DNA, 22 bp, Homo sapiens
ccatgtggcctgcccagcctca

SEQ ID NO: 6069886 - DNA, 20 bp, Homo sapiens
ccatgtggccttgagcaagt

SEQ ID NO: 6069887 - DNA, 13 bp, Homo sapiens
ccatgtggctgaa

SEQ ID NO: 6069888 - DNA, 18 bp, Homo sapiens
ccatgtgggcgcccaccc

SEQ ID NO: 6069889 - DNA, 20 bp, Homo sapiens
ccatgtgggcgcccaccctg

SEQ ID NO: 6069890 - DNA, 21 bp, Homo sapiens
ccatgtgggcgcccaccctgg

SEQ ID NO: 6069891 - DNA, 18 bp, Homo sapiens
ccatgtggtgatgatgtg

SEQ ID NO: 6069892 - DNA, 22 bp, Homo sapiens
ccatgtgtacattctgcctaga

SEQ ID NO: 6069893 - DNA, 18 bp, Homo sapiens
ccatgtgtatgcgtgtcc

SEQ ID NO: 6069894 - DNA, 16 bp, Homo sapiens
ccatgtgtcccccctg

SEQ ID NO: 6069895 - DNA, 22 bp, Homo sapiens
ccatgtgtcccccctgtggtct

SEQ ID NO: 6069896 - DNA, 23 bp, Homo sapiens
ccatgtgtcccccctgtggtctg

SEQ ID NO: 6069897 - DNA, 14 bp, Homo sapiens
ccatgtgtcccctc

SEQ ID NO: 6069898 - DNA, 18 bp, Homo sapiens
ccatgtgtcccctcactc

SEQ ID NO: 6069899 - DNA, 20 bp, Homo sapiens
ccatgtgtctttacacctcg

SEQ ID NO: 6069900 - DNA, 19 bp, Homo sapiens
ccatgtgtgagtcacttct

SEQ ID NO: 6069901 - DNA, 13 bp, Homo sapiens
ccatgtgtgctgt

SEQ ID NO: 6069902 - DNA, 15 bp, Homo sapiens
ccatgtgtggactca

SEQ ID NO: 6069903 - DNA, 23 bp, Homo sapiens
ccatgtgtgtgccaagccctggc

SEQ ID NO: 6069904 - DNA, 15 bp, Homo sapiens
ccggtgtgcctgcag

SEQ ID NO: 6069905 - DNA, 17 bp, Homo sapiens
ccggtgtgcctgcagcc

SEQ ID NO: 6069906 - DNA, 14 bp, Homo sapiens
ccggtgttctaaga

SEQ ID NO: 6069907 - DNA, 15 bp, Homo sapiens
ccggtgttctaagat

SEQ ID NO: 6069908 - DNA, 18 bp, Homo sapiens
ccggttattcgcccaccc

SEQ ID NO: 6069909 - DNA, 19 bp, Homo sapiens
ccggttcagacccctgcct

SEQ ID NO: 6069910 - DNA, 14 bp, Homo sapiens
ccggttccacgtgg

SEQ ID NO: 6069911 - DNA, 18 bp, Homo sapiens
ccggttccacgtggggtg

SEQ ID NO: 6069912 - DNA, 21 bp, Homo sapiens
ccggttcccacaagcctgcct

SEQ ID NO: 6069913 - DNA, 17 bp, Homo sapiens
ccggttgcagtcactgt

SEQ ID NO: 6069914 - DNA, 15 bp, Homo sapiens
ccggttgcttctggg

SEQ ID NO: 6069915 - DNA, 19 bp, Homo sapiens
ccggttggccggctggccg

SEQ ID NO: 6069916 - DNA, 21 bp, Homo sapiens
ccggtttagtcatccaacaag

SEQ ID NO: 6069917 - DNA, 19 bp, Homo sapiens
ccggtttccgtagcagttt

SEQ ID NO: 6069918 - DNA, 17 bp, Homo sapiens
ccggtttgggctgtctt

SEQ ID NO: 6069919 - DNA, 23 bp, Homo sapiens
ccgtaaagtgagcatgctttctg

SEQ ID NO: 6069920 - DNA, 23 bp, Homo sapiens
ccgtaaatgtctgcactgaggat

SEQ ID NO: 6069921 - DNA, 20 bp, Homo sapiens
ccgtaagaccaccttccctt

SEQ ID NO: 6069922 - DNA, 22 bp, Homo sapiens
ccgtaagaccaccttcccttcc

SEQ ID NO: 6069923 - DNA, 12 bp, Homo sapiens
ccgtaaggcaag

SEQ ID NO: 6069924 - DNA, 17 bp, Homo sapiens
ccgtaaggctgtacata

SEQ ID NO: 6069925 - DNA, 19 bp, Homo sapiens
ccgtaataacacccttcct

SEQ ID NO: 6069926 - DNA, 14 bp, Homo sapiens
ccgtaatcccagct

SEQ ID NO: 6069927 - DNA, 13 bp, Homo sapiens
ccgtaattatgta

SEQ ID NO: 6069928 - DNA, 18 bp, Homo sapiens
ccgtaattctttctgtct

SEQ ID NO: 6069929 - DNA, 19 bp, Homo sapiens
ccgtaattctttctgtctc

SEQ ID NO: 6069930 - DNA, 14 bp, Homo sapiens
ccgtaatttaactt

SEQ ID NO: 6069931 - DNA, 18 bp, Homo sapiens
ccgtacaacgtgtcctca

SEQ ID NO: 6069932 - DNA, 14 bp, Homo sapiens
ccgtaccccaccct

SEQ ID NO: 6069933 - DNA, 15 bp, Homo sapiens
ccgtaccccaccctc

SEQ ID NO: 6069934 - DNA, 16 bp, Homo sapiens
ccgtaccccaccctca

SEQ ID NO: 6069935 - DNA, 17 bp, Homo sapiens
ccgtaccccaccctcag

SEQ ID NO: 6069936 - DNA, 17 bp, Homo sapiens
ccgtactctcacatgtg

SEQ ID NO: 6069937 - DNA, 20 bp, Homo sapiens
ccgtacttgggtcacatgac

SEQ ID NO: 6069938 - DNA, 24 bp, Homo sapiens
ccgtagacgtgcacgcacactgtc

SEQ ID NO: 6069939 - DNA, 19 bp, Homo sapiens
ccgtagctcccctggctgg

SEQ ID NO: 6069940 - DNA, 17 bp, Homo sapiens
ccgtagcttcagccagg

SEQ ID NO: 6069941 - DNA, 18 bp, Homo sapiens
ccgtagcttcagccaggc

SEQ ID NO: 6069942 - DNA, 17 bp, Homo sapiens
ccgtaggacccaagcag

SEQ ID NO: 6069943 - DNA, 21 bp, Homo sapiens
ccgtaggcagcctctctgcta

SEQ ID NO: 6069944 - DNA, 22 bp, Homo sapiens
ccgtagtatcagagatgtccat

SEQ ID NO: 6069945 - DNA, 15 bp, Homo sapiens
ccgtagtctcctggg

SEQ ID NO: 6069946 - DNA, 22 bp, Homo sapiens
ccgtagttccctgaaaacccag

SEQ ID NO: 6069947 - DNA, 15 bp, Homo sapiens
ccgtatatgtctaca

SEQ ID NO: 6069948 - DNA, 14 bp, Homo sapiens
ccgtatcacagtgt

SEQ ID NO: 6069949 - DNA, 22 bp, Homo sapiens
ccgtatctcaggaagtccagcc

SEQ ID NO: 6069950 - DNA, 20 bp, Homo sapiens
ccgtatctccggctcccagc

SEQ ID NO: 6069951 - DNA, 19 bp, Homo sapiens
ccgtatctgagggctgctc

SEQ ID NO: 6069952 - DNA, 16 bp, Homo sapiens
ccgtattcctctccca

SEQ ID NO: 6069953 - DNA, 22 bp, Homo sapiens
ccgtattggttgggggctcctg

SEQ ID NO: 6069954 - DNA, 12 bp, Homo sapiens
ccgtatttattt

SEQ ID NO: 6069955 - DNA, 14 bp, Homo sapiens
ccgtcaacgttgta

SEQ ID NO: 6069956 - DNA, 17 bp, Homo sapiens
ccgtcaacgttgtactg

SEQ ID NO: 6069957 - DNA, 22 bp, Homo sapiens
ccgtcaagagtgaattccctca

SEQ ID NO: 6069958 - DNA, 12 bp, Homo sapiens
ccgtcacagcct

SEQ ID NO: 6069959 - DNA, 22 bp, Homo sapiens
ccgtcaccaccacccctaccac

SEQ ID NO: 6069960 - DNA, 21 bp, Homo sapiens
ccgtcaccacgactggccagg

SEQ ID NO: 6069961 - DNA, 14 bp, Homo sapiens
ccgtcaccagaatt

SEQ ID NO: 6069962 - DNA, 18 bp, Homo sapiens
ccgtcaccccgccagcct

SEQ ID NO: 6069963 - DNA, 13 bp, Homo sapiens
ccgtcaccccgct

SEQ ID NO: 6069964 - DNA, 20 bp, Homo sapiens
ccgtcaccccgctcttccca

SEQ ID NO: 6069965 - DNA, 16 bp, Homo sapiens
ccgtcaccctgggagc

SEQ ID NO: 6069966 - DNA, 12 bp, Homo sapiens
ccgtcacgcttt

SEQ ID NO: 6069967 - DNA, 19 bp, Homo sapiens
ccgtcacgctttcatgacc

SEQ ID NO: 6069968 - DNA, 20 bp, Homo sapiens
ccgtcacgtgcgctgggcac

SEQ ID NO: 6069969 - DNA, 17 bp, Homo sapiens
ccgtcactacctggctg

SEQ ID NO: 6069970 - DNA, 22 bp, Homo sapiens
ccgtcactccacgcagctggca

SEQ ID NO: 6069971 - DNA, 16 bp, Homo sapiens
ccgtcaggccacagcc

SEQ ID NO: 6069972 - DNA, 21 bp, Homo sapiens
ccgtcagggagaggtcaccag

SEQ ID NO: 6069973 - DNA, 14 bp, Homo sapiens
ccgtcagggcccaa

SEQ ID NO: 6069974 - DNA, 16 bp, Homo sapiens
ccgtcagggcccaagt

SEQ ID NO: 6069975 - DNA, 15 bp, Homo sapiens
ccgtcagggtggctg

SEQ ID NO: 6069976 - DNA, 17 bp, Homo sapiens
ccgtcaggtactcctgc

SEQ ID NO: 6069977 - DNA, 15 bp, Homo sapiens
ccgtcatgttcctca

SEQ ID NO: 6069978 - DNA, 18 bp, Homo sapiens
ccgtcattgatggagcct

SEQ ID NO: 6069979 - DNA, 16 bp, Homo sapiens
ccgtcattgctgctgc

SEQ ID NO: 6069980 - DNA, 12 bp, Homo sapiens
ccgtccacccag

SEQ ID NO: 6069981 - DNA, 16 bp, Homo sapiens
ccgtccacccaggctg

SEQ ID NO: 6069982 - DNA, 17 bp, Homo sapiens
ccgtccacccaggctgc

SEQ ID NO: 6069983 - DNA, 14 bp, Homo sapiens
ccgtccagaccttg

SEQ ID NO: 6069984 - DNA, 12 bp, Homo sapiens
ccgtccagagcc

SEQ ID NO: 6069985 - DNA, 14 bp, Homo sapiens
ccgtccagagccgg

SEQ ID NO: 6069986 - DNA, 16 bp, Homo sapiens
ccgtccagagccggca

SEQ ID NO: 6069987 - DNA, 18 bp, Homo sapiens
ccgtccaggagcctgtgc

SEQ ID NO: 6069988 - DNA, 23 bp, Homo sapiens
ccgtccatatcagaactgtgcca

SEQ ID NO: 6069989 - DNA, 20 bp, Homo sapiens
ccgtccatggcaccagcccc

SEQ ID NO: 6069990 - DNA, 18 bp, Homo sapiens
ccgtcccaaacagagggc

SEQ ID NO: 6069991 - DNA, 17 bp, Homo sapiens
ccgtcccaccagcttca

SEQ ID NO: 6069992 - DNA, 23 bp, Homo sapiens
ccgtcccagaggccgctgcccct

SEQ ID NO: 6069993 - DNA, 12 bp, Homo sapiens
ccgtcccaggcc

SEQ ID NO: 6069994 - DNA, 13 bp, Homo sapiens
ccgtcccccccca

SEQ ID NO: 6069995 - DNA, 18 bp, Homo sapiens
ccgtccccctagagactc

SEQ ID NO: 6069996 - DNA, 11 bp, Homo sapiens
ccgtcccctcc

SEQ ID NO: 6069997 - DNA, 16 bp, Homo sapiens
ccgtcccctcccaggg

SEQ ID NO: 6069998 - DNA, 23 bp, Homo sapiens
ccgtcccctccttccctcacccc

SEQ ID NO: 6069999 - DNA, 15 bp, Homo sapiens
ccgtcccctgcagcc

SEQ ID NO: 6070000 - DNA, 18 bp, Homo sapiens
ccgtcccctgcagcctgg

SEQ ID NO: 6070001 - DNA, 20 bp, Homo sapiens
ccgtcccctgcagcctgggt

SEQ ID NO: 6070002 - DNA, 20 bp, Homo sapiens
ccgtcccctgggccaccctt

SEQ ID NO: 6070003 - DNA, 17 bp, Homo sapiens
ccgtcccgcacagtgga

SEQ ID NO: 6070004 - DNA, 19 bp, Homo sapiens
ccgtcccgcacagtggacg

SEQ ID NO: 6070005 - DNA, 13 bp, Homo sapiens
ccgtcccggcccc

SEQ ID NO: 6070006 - DNA, 14 bp, Homo sapiens
ccgtcccggccccg

SEQ ID NO: 6070007 - DNA, 15 bp, Homo sapiens
ccgtcccggccccgc

SEQ ID NO: 6070008 - DNA, 11 bp, Homo sapiens
ccgtccctccc

SEQ ID NO: 6070009 - DNA, 14 bp, Homo sapiens
ccgtccctcctgtt

SEQ ID NO: 6070010 - DNA, 14 bp, Homo sapiens
ccgtccctctcccc

SEQ ID NO: 6070011 - DNA, 14 bp, Homo sapiens
ccgtccctctgcct

SEQ ID NO: 6070012 - DNA, 15 bp, Homo sapiens
ccgtccctctgtcca

SEQ ID NO: 6070013 - DNA, 10 bp, Homo sapiens
ccgtccctga

SEQ ID NO: 6070014 - DNA, 17 bp, Homo sapiens
ccgtccctgtcccccag

SEQ ID NO: 6070015 - DNA, 21 bp, Homo sapiens
ccgtccctttttctccacact

SEQ ID NO: 6070016 - DNA, 12 bp, Homo sapiens
ccgtccgcccgc

SEQ ID NO: 6070017 - DNA, 13 bp, Homo sapiens
ccgtccgcccgcc

SEQ ID NO: 6070018 - DNA, 13 bp, Homo sapiens
ccgtccgccctgc

SEQ ID NO: 6070019 - DNA, 16 bp, Homo sapiens
ccgtccgtccgcccgc

SEQ ID NO: 6070020 - DNA, 16 bp, Homo sapiens
ccgtcctcacccctgt

SEQ ID NO: 6070021 - DNA, 20 bp, Homo sapiens
ccgtcctcacccctgtcctc

SEQ ID NO: 6070022 - DNA, 23 bp, Homo sapiens
ccgtcctcacccctgtcctcact

SEQ ID NO: 6070023 - DNA, 16 bp, Homo sapiens
ccgtcctccctcagcc

SEQ ID NO: 6070024 - DNA, 18 bp, Homo sapiens
ccgtcctccctcagcctc

SEQ ID NO: 6070025 - DNA, 20 bp, Homo sapiens
ccgtcctgagggggaagtga

SEQ ID NO: 6070026 - DNA, 20 bp, Homo sapiens
ccgtcctgattcgaggtcct

SEQ ID NO: 6070027 - DNA, 15 bp, Homo sapiens
ccgtcctgcctgtgg

SEQ ID NO: 6070028 - DNA, 14 bp, Homo sapiens
ccgtcctgctcgcc

SEQ ID NO: 6070029 - DNA, 20 bp, Homo sapiens
ccgtcctgctcgccctgtgc

SEQ ID NO: 6070030 - DNA, 15 bp, Homo sapiens
ccgtcctgctggagt

SEQ ID NO: 6070031 - DNA, 17 bp, Homo sapiens
ccgtcctgctgtccctg

SEQ ID NO: 6070032 - DNA, 20 bp, Homo sapiens
ccgtcctggaggttccccag

SEQ ID NO: 6070033 - DNA, 17 bp, Homo sapiens
ccgtcctggcagggcag

SEQ ID NO: 6070034 - DNA, 15 bp, Homo sapiens
ccgtcctgtcactga

SEQ ID NO: 6070035 - DNA, 15 bp, Homo sapiens
ccgtcgaccaggaaa

SEQ ID NO: 6070036 - DNA, 18 bp, Homo sapiens
ccgtcggactgcccccag

SEQ ID NO: 6070037 - DNA, 18 bp, Homo sapiens
ccgtcggagctgcctgca

SEQ ID NO: 6070038 - DNA, 13 bp, Homo sapiens
ccgtcggccctgc

SEQ ID NO: 6070039 - DNA, 20 bp, Homo sapiens
ccgtcgggcccctgcctgcc

SEQ ID NO: 6070040 - DNA, 22 bp, Homo sapiens
ccgtctacagctcccccagctc

SEQ ID NO: 6070041 - DNA, 11 bp, Homo sapiens
ccgtctcaggt

SEQ ID NO: 6070042 - DNA, 15 bp, Homo sapiens
ccgtctcccttggcc

SEQ ID NO: 6070043 - DNA, 12 bp, Homo sapiens
ccgtctcctccc

SEQ ID NO: 6070044 - DNA, 13 bp, Homo sapiens
ccgtctcctccct

SEQ ID NO: 6070045 - DNA, 14 bp, Homo sapiens
ccgtctctactaaa

SEQ ID NO: 6070046 - DNA, 19 bp, Homo sapiens
ccgtctctctcccatggag

SEQ ID NO: 6070047 - DNA, 17 bp, Homo sapiens
ccgtctctcttggaccc

SEQ ID NO: 6070048 - DNA, 15 bp, Homo sapiens
ccgtctctgccctgg

SEQ ID NO: 6070049 - DNA, 16 bp, Homo sapiens
ccgtctctgccctggg

SEQ ID NO: 6070050 - DNA, 14 bp, Homo sapiens
ccgtctctgtcccg

SEQ ID NO: 6070051 - DNA, 19 bp, Homo sapiens
ccgtctgaccccagcccag

SEQ ID NO: 6070052 - DNA, 16 bp, Homo sapiens
ccgtctgactccagag

SEQ ID NO: 6070053 - DNA, 19 bp, Homo sapiens
ccgtctgactccagagtct

SEQ ID NO: 6070054 - DNA, 20 bp, Homo sapiens
ccgtctgactccagagtctg

SEQ ID NO: 6070055 - DNA, 17 bp, Homo sapiens
ccgtctgcaggggcctg

SEQ ID NO: 6070056 - DNA, 14 bp, Homo sapiens
ccgtctgcccacca

SEQ ID NO: 6070057 - DNA, 17 bp, Homo sapiens
ccgtctggcccaccagg

SEQ ID NO: 6070058 - DNA, 18 bp, Homo sapiens
ccgtctggcccaccaggg

SEQ ID NO: 6070059 - DNA, 19 bp, Homo sapiens
ccgtctggggttcagcccc

SEQ ID NO: 6070060 - DNA, 16 bp, Homo sapiens
ccgtctgtccatctgc

SEQ ID NO: 6070061 - DNA, 13 bp, Homo sapiens
ccgtctgtcctca

SEQ ID NO: 6070062 - DNA, 12 bp, Homo sapiens
ccgtctgtcctg

SEQ ID NO: 6070063 - DNA, 13 bp, Homo sapiens
ccgtctgtgaatt

SEQ ID NO: 6070064 - DNA, 23 bp, Homo sapiens
ccgtctgtgtgtgacccctcctg

SEQ ID NO: 6070065 - DNA, 23 bp, Homo sapiens
ccgtcttcaatctctgttctgct

SEQ ID NO: 6070066 - DNA, 14 bp, Homo sapiens
ccgtcttcagccta

SEQ ID NO: 6070067 - DNA, 22 bp, Homo sapiens
ccgtcttcctcctcccctggca

SEQ ID NO: 6070068 - DNA, 14 bp, Homo sapiens
ccgtcttctctcca

SEQ ID NO: 6070069 - DNA, 18 bp, Homo sapiens
ccgtgaaaacactcgtgt

SEQ ID NO: 6070070 - DNA, 14 bp, Homo sapiens
ccgtgaaagttgtg

SEQ ID NO: 6070071 - DNA, 18 bp, Homo sapiens
ccgtgaagatactttgta

SEQ ID NO: 6070072 - DNA, 20 bp, Homo sapiens
ccgtgaagatactttgtatt

SEQ ID NO: 6070073 - DNA, 16 bp, Homo sapiens
ccgtgaagcagtgcct

SEQ ID NO: 6070074 - DNA, 17 bp, Homo sapiens
ccgtgaagcagtgcctc

SEQ ID NO: 6070075 - DNA, 23 bp, Homo sapiens
ccgtgaaggcttctctgttctac

SEQ ID NO: 6070076 - DNA, 19 bp, Homo sapiens
ccgtgaagggcaccgagaa

SEQ ID NO: 6070077 - DNA, 20 bp, Homo sapiens
ccgtgaatgcttacctgtga

SEQ ID NO: 6070078 - DNA, 19 bp, Homo sapiens
ccgtgaatggtctctgtca

SEQ ID NO: 6070079 - DNA, 18 bp, Homo sapiens
ccgtgacagactcctgag

SEQ ID NO: 6070080 - DNA, 22 bp, Homo sapiens
ccgtgacagactcctgaggaca

SEQ ID NO: 6070081 - DNA, 13 bp, Homo sapiens
ccgtgacagcccg

SEQ ID NO: 6070082 - DNA, 13 bp, Homo sapiens
ccgtgacagtggc

SEQ ID NO: 6070083 - DNA, 12 bp, Homo sapiens
ccgtgacctatt

SEQ ID NO: 6070084 - DNA, 16 bp, Homo sapiens
ccgtgacgtctgggtg

SEQ ID NO: 6070085 - DNA, 16 bp, Homo sapiens
ccatgtgttatgtttt

SEQ ID NO: 6070086 - DNA, 17 bp, Homo sapiens
ccatgtgttttgctttt

SEQ ID NO: 6070087 - DNA, 23 bp, Homo sapiens
ccatgttaaatgacttgattgta

SEQ ID NO: 6070088 - DNA, 15 bp, Homo sapiens
ccatgttaacatgac

SEQ ID NO: 6070089 - DNA, 20 bp, Homo sapiens
ccatgttaacccctccactc

SEQ ID NO: 6070090 - DNA, 21 bp, Homo sapiens
ccatgttaagtcctccctgac

SEQ ID NO: 6070091 - DNA, 16 bp, Homo sapiens
ccatgttagccaggat

SEQ ID NO: 6070092 - DNA, 20 bp, Homo sapiens
ccatgttagccaggatggtc

SEQ ID NO: 6070093 - DNA, 18 bp, Homo sapiens
ccatgttagccaggctgg

SEQ ID NO: 6070094 - DNA, 21 bp, Homo sapiens
ccatgttagtaatggcagagc

SEQ ID NO: 6070095 - DNA, 21 bp, Homo sapiens
ccatgttatattgcttcctgt

SEQ ID NO: 6070096 - DNA, 19 bp, Homo sapiens
ccatgttatgtgactatct

SEQ ID NO: 6070097 - DNA, 16 bp, Homo sapiens
ccatgttatgtttcta

SEQ ID NO: 6070098 - DNA, 16 bp, Homo sapiens
ccatgttcattataat

SEQ ID NO: 6070099 - DNA, 17 bp, Homo sapiens
ccatgttccaataaaca

SEQ ID NO: 6070100 - DNA, 13 bp, Homo sapiens
ccatgttcccaga

SEQ ID NO: 6070101 - DNA, 14 bp, Homo sapiens
ccatgttcccagaa

SEQ ID NO: 6070102 - DNA, 15 bp, Homo sapiens
ccatgttctgtccct

SEQ ID NO: 6070103 - DNA, 20 bp, Homo sapiens
ccatgttgcactgtttgcat

SEQ ID NO: 6070104 - DNA, 15 bp, Homo sapiens
ccatgttgcatgcct

SEQ ID NO: 6070105 - DNA, 14 bp, Homo sapiens
ccatgttgcccaga

SEQ ID NO: 6070106 - DNA, 13 bp, Homo sapiens
ccatgttgcccct

SEQ ID NO: 6070107 - DNA, 13 bp, Homo sapiens
ccatgttgcgttc

SEQ ID NO: 6070108 - DNA, 14 bp, Homo sapiens
ccatgttgctgact

SEQ ID NO: 6070109 - DNA, 13 bp, Homo sapiens
ccatgttgcttca

SEQ ID NO: 6070110 - DNA, 20 bp, Homo sapiens
ccatgttggtcaggatggtc

SEQ ID NO: 6070111 - DNA, 19 bp, Homo sapiens
ccatgttggtcaggctggt

SEQ ID NO: 6070112 - DNA, 16 bp, Homo sapiens
ccatgttgtaatgctg

SEQ ID NO: 6070113 - DNA, 17 bp, Homo sapiens
ccatgttgtaatgctgc

SEQ ID NO: 6070114 - DNA, 20 bp, Homo sapiens
ccatgttgtgcctccctggt

SEQ ID NO: 6070115 - DNA, 22 bp, Homo sapiens
ccatgttgtgcctccctggtga

SEQ ID NO: 6070116 - DNA, 15 bp, Homo sapiens
ccatgtttaagattt

SEQ ID NO: 6070117 - DNA, 18 bp, Homo sapiens
ccatgtttagattccagg

SEQ ID NO: 6070118 - DNA, 22 bp, Homo sapiens
ccatgtttagattccaggatca

SEQ ID NO: 6070119 - DNA, 22 bp, Homo sapiens
ccatgtttagtgaatgactttt

SEQ ID NO: 6070120 - DNA, 16 bp, Homo sapiens
ccatgtttattaagaa

SEQ ID NO: 6070121 - DNA, 23 bp, Homo sapiens
ccatgtttattgttttttaaaga

SEQ ID NO: 6070122 - DNA, 23 bp, Homo sapiens
ccatgtttatttatttccagtgg

SEQ ID NO: 6070123 - DNA, 22 bp, Homo sapiens
ccatgtttcaaacaagaaacat

SEQ ID NO: 6070124 - DNA, 13 bp, Homo sapiens
ccatgtttcaaat

SEQ ID NO: 6070125 - DNA, 23 bp, Homo sapiens
ccatgtttctcacattgctgtat

SEQ ID NO: 6070126 - DNA, 12 bp, Homo sapiens
ccatgtttctgt

SEQ ID NO: 6070127 - DNA, 16 bp, Homo sapiens
ccatgtttgagctcag

SEQ ID NO: 6070128 - DNA, 21 bp, Homo sapiens
ccatgtttggttgtaaatgct

SEQ ID NO: 6070129 - DNA, 22 bp, Homo sapiens
ccatgtttggttgtaaatgctc

SEQ ID NO: 6070130 - DNA, 17 bp, Homo sapiens
ccatgtttttgccaaaa

SEQ ID NO: 6070131 - DNA, 16 bp, Homo sapiens
ccatgtttttggggac

SEQ ID NO: 6070132 - DNA, 23 bp, Homo sapiens
ccatgtttttggggacactgaca

SEQ ID NO: 6070133 - DNA, 15 bp, Homo sapiens
ccattaaaataaaac

SEQ ID NO: 6070134 - DNA, 18 bp, Homo sapiens
ccattaaaataaaacaag

SEQ ID NO: 6070135 - DNA, 19 bp, Homo sapiens
ccattaaaataaaacaagc

SEQ ID NO: 6070136 - DNA, 22 bp, Homo sapiens
ccattaaaataaaacaagcctt

SEQ ID NO: 6070137 - DNA, 12 bp, Homo sapiens
ccattaaaccat

SEQ ID NO: 6070138 - DNA, 18 bp, Homo sapiens
ccattaaaccatctccct

SEQ ID NO: 6070139 - DNA, 10 bp, Homo sapiens
ccattaaacg

SEQ ID NO: 6070140 - DNA, 20 bp, Homo sapiens
ccattaaacttctactgagc

SEQ ID NO: 6070141 - DNA, 15 bp, Homo sapiens
ccattaaagtctgaa

SEQ ID NO: 6070142 - DNA, 16 bp, Homo sapiens
ccattaaagtctgaat

SEQ ID NO: 6070143 - DNA, 16 bp, Homo sapiens
ccattaaatgaatatt

SEQ ID NO: 6070144 - DNA, 17 bp, Homo sapiens
ccattaaatgaatattt

SEQ ID NO: 6070145 - DNA, 19 bp, Homo sapiens
ccattaaatgaatattttg

SEQ ID NO: 6070146 - DNA, 14 bp, Homo sapiens
ccattaacagcaat

SEQ ID NO: 6070147 - DNA, 20 bp, Homo sapiens
ccattaacaggtctttgaaa

SEQ ID NO: 6070148 - DNA, 21 bp, Homo sapiens
ccattaacaggtctttgaaat

SEQ ID NO: 6070149 - DNA, 18 bp, Homo sapiens
ccattaaccagtggccgg

SEQ ID NO: 6070150 - DNA, 16 bp, Homo sapiens
ccattaactagtttat

SEQ ID NO: 6070151 - DNA, 15 bp, Homo sapiens
ccattaaggggaaga

SEQ ID NO: 6070152 - DNA, 20 bp, Homo sapiens
ccattaaggggaagaatgaa

SEQ ID NO: 6070153 - DNA, 15 bp, Homo sapiens
ccattaagtcatgtg

SEQ ID NO: 6070154 - DNA, 16 bp, Homo sapiens
ccattaagtcatgtgt

SEQ ID NO: 6070155 - DNA, 14 bp, Homo sapiens
ccattaataaagac

SEQ ID NO: 6070156 - DNA, 16 bp, Homo sapiens
ccattaatcatttccc

SEQ ID NO: 6070157 - DNA, 23 bp, Homo sapiens
ccattaatgtagataaagcactg

SEQ ID NO: 6070158 - DNA, 12 bp, Homo sapiens
ccattaattaca

SEQ ID NO: 6070159 - DNA, 14 bp, Homo sapiens
ccattaattacata

SEQ ID NO: 6070160 - DNA, 15 bp, Homo sapiens
ccattaatttaaatg

SEQ ID NO: 6070161 - DNA, 19 bp, Homo sapiens
ccattacaactagatcaag

SEQ ID NO: 6070162 - DNA, 16 bp, Homo sapiens
ccattacaccacagca

SEQ ID NO: 6070163 - DNA, 21 bp, Homo sapiens
ccattacacgatcacctgcat

SEQ ID NO: 6070164 - DNA, 20 bp, Homo sapiens
ccattacaggggcagtgcct

SEQ ID NO: 6070165 - DNA, 13 bp, Homo sapiens
ccattacatgatc

SEQ ID NO: 6070166 - DNA, 14 bp, Homo sapiens
ccattaccatggag

SEQ ID NO: 6070167 - DNA, 13 bp, Homo sapiens
ccattacccagtg

SEQ ID NO: 6070168 - DNA, 13 bp, Homo sapiens
ccattacctccat

SEQ ID NO: 6070169 - DNA, 16 bp, Homo sapiens
ccattacctccatcca

SEQ ID NO: 6070170 - DNA, 13 bp, Homo sapiens
ccattacctgtac

SEQ ID NO: 6070171 - DNA, 14 bp, Homo sapiens
ccattacctgtacc

SEQ ID NO: 6070172 - DNA, 18 bp, Homo sapiens
ccattactaaagacagaa

SEQ ID NO: 6070173 - DNA, 12 bp, Homo sapiens
ccattactactg

SEQ ID NO: 6070174 - DNA, 14 bp, Homo sapiens
ccattactactgta

SEQ ID NO: 6070175 - DNA, 21 bp, Homo sapiens
ccattactgaggggattctct

SEQ ID NO: 6070176 - DNA, 13 bp, Homo sapiens
ccattactgtgat

SEQ ID NO: 6070177 - DNA, 14 bp, Homo sapiens
ccattagaaaattt

SEQ ID NO: 6070178 - DNA, 16 bp, Homo sapiens
ccattagaatgtgatt

SEQ ID NO: 6070179 - DNA, 20 bp, Homo sapiens
ccattagagcacagcttctt

SEQ ID NO: 6070180 - DNA, 18 bp, Homo sapiens
ccattagataaacacagg

SEQ ID NO: 6070181 - DNA, 20 bp, Homo sapiens
ccattagataaacacaggca

SEQ ID NO: 6070182 - DNA, 22 bp, Homo sapiens
ccattaggacaatcagtcccct

SEQ ID NO: 6070183 - DNA, 16 bp, Homo sapiens
ccattaggcatgccta

SEQ ID NO: 6070184 - DNA, 16 bp, Homo sapiens
ccattaggccagcaac

SEQ ID NO: 6070185 - DNA, 20 bp, Homo sapiens
ccattaggccagcaacgctt

SEQ ID NO: 6070186 - DNA, 15 bp, Homo sapiens
ccattagtatcctgt

SEQ ID NO: 6070187 - DNA, 13 bp, Homo sapiens
ccattagttgaga

SEQ ID NO: 6070188 - DNA, 14 bp, Homo sapiens
ccattagttgagaa

SEQ ID NO: 6070189 - DNA, 20 bp, Homo sapiens
ccattagttgagaaagtcac

SEQ ID NO: 6070190 - DNA, 16 bp, Homo sapiens
ccattataaaaacact

SEQ ID NO: 6070191 - DNA, 16 bp, Homo sapiens
ccattataatattcat

SEQ ID NO: 6070192 - DNA, 19 bp, Homo sapiens
ccattatactttatatctg

SEQ ID NO: 6070193 - DNA, 14 bp, Homo sapiens
ccattatagcgcct

SEQ ID NO: 6070194 - DNA, 13 bp, Homo sapiens
ccattatatttat

SEQ ID NO: 6070195 - DNA, 13 bp, Homo sapiens
ccattatatttgc

SEQ ID NO: 6070196 - DNA, 18 bp, Homo sapiens
ccattatatttgcattat

SEQ ID NO: 6070197 - DNA, 23 bp, Homo sapiens
ccattatatttgcattatgtatt

SEQ ID NO: 6070198 - DNA, 15 bp, Homo sapiens
ccattatcatgtgta

SEQ ID NO: 6070199 - DNA, 16 bp, Homo sapiens
ccattatcatgtgtaa

SEQ ID NO: 6070200 - DNA, 18 bp, Homo sapiens
ccattatccattcccaag

SEQ ID NO: 6070201 - DNA, 15 bp, Homo sapiens
ccattatgcctggct

SEQ ID NO: 6070202 - DNA, 15 bp, Homo sapiens
ccattattatgatgt

SEQ ID NO: 6070203 - DNA, 19 bp, Homo sapiens
ccattattatttctgttct

SEQ ID NO: 6070204 - DNA, 17 bp, Homo sapiens
ccattattcaaagttgc

SEQ ID NO: 6070205 - DNA, 22 bp, Homo sapiens
ccattattcaaagttgcctaaa

SEQ ID NO: 6070206 - DNA, 15 bp, Homo sapiens
ccattattcctctca

SEQ ID NO: 6070207 - DNA, 14 bp, Homo sapiens
ccattattctatgt

SEQ ID NO: 6070208 - DNA, 22 bp, Homo sapiens
ccattatttaataagagtaaaa

SEQ ID NO: 6070209 - DNA, 16 bp, Homo sapiens
ccattattttacagtc

SEQ ID NO: 6070210 - DNA, 12 bp, Homo sapiens
ccattattttct

SEQ ID NO: 6070211 - DNA, 14 bp, Homo sapiens
ccattattttctgt

SEQ ID NO: 6070212 - DNA, 16 bp, Homo sapiens
ccattattttctgtca

SEQ ID NO: 6070213 - DNA, 18 bp, Homo sapiens
ccattattttctgtcaga

SEQ ID NO: 6070214 - DNA, 19 bp, Homo sapiens
ccattattttctgtcagat

SEQ ID NO: 6070215 - DNA, 17 bp, Homo sapiens
ccattcacaacacaatc

SEQ ID NO: 6070216 - DNA, 15 bp, Homo sapiens
ccattcacagagcct

SEQ ID NO: 6070217 - DNA, 15 bp, Homo sapiens
ccattcacggcctgg

SEQ ID NO: 6070218 - DNA, 17 bp, Homo sapiens
ccattcacggcctggca

SEQ ID NO: 6070219 - DNA, 22 bp, Homo sapiens
ccattcactagaaaatgagaaa

SEQ ID NO: 6070220 - DNA, 15 bp, Homo sapiens
ccattcactcccagg

SEQ ID NO: 6070221 - DNA, 19 bp, Homo sapiens
ccattcactcttccagaat

SEQ ID NO: 6070222 - DNA, 12 bp, Homo sapiens
ccattcactgat

SEQ ID NO: 6070223 - DNA, 14 bp, Homo sapiens
ccattcacttcccc

SEQ ID NO: 6070224 - DNA, 15 bp, Homo sapiens
ccattcacttctgca

SEQ ID NO: 6070225 - DNA, 21 bp, Homo sapiens
ccattcagaaagcttcaaatt

SEQ ID NO: 6070226 - DNA, 12 bp, Homo sapiens
ccattcagaact

SEQ ID NO: 6070227 - DNA, 15 bp, Homo sapiens
ccattcaggaacctg

SEQ ID NO: 6070228 - DNA, 14 bp, Homo sapiens
ccattcagtctgca

SEQ ID NO: 6070229 - DNA, 15 bp, Homo sapiens
ccattcagtctgcag

SEQ ID NO: 6070230 - DNA, 16 bp, Homo sapiens
ccattcatccttccat

SEQ ID NO: 6070231 - DNA, 19 bp, Homo sapiens
ccattcatccttccatcca

SEQ ID NO: 6070232 - DNA, 20 bp, Homo sapiens
ccattcatccttccatccat

SEQ ID NO: 6070233 - DNA, 16 bp, Homo sapiens
ccattcatctgggctg

SEQ ID NO: 6070234 - DNA, 16 bp, Homo sapiens
ccattcattaattagt

SEQ ID NO: 6070235 - DNA, 14 bp, Homo sapiens
ccattcattctggt

SEQ ID NO: 6070236 - DNA, 13 bp, Homo sapiens
ccattccaaaata

SEQ ID NO: 6070237 - DNA, 19 bp, Homo sapiens
ccattccaaaatacaatgt

SEQ ID NO: 6070238 - DNA, 15 bp, Homo sapiens
ccattccaaaatatt

SEQ ID NO: 6070239 - DNA, 22 bp, Homo sapiens
ccattccaaagctttattacca

SEQ ID NO: 6070240 - DNA, 18 bp, Homo sapiens
ccattccacacagaatgc

SEQ ID NO: 6070241 - DNA, 15 bp, Homo sapiens
ccattccacatcccc

SEQ ID NO: 6070242 - DNA, 17 bp, Homo sapiens
ccattccagagctgcag

SEQ ID NO: 6070243 - DNA, 17 bp, Homo sapiens
ccattccagctctccca

SEQ ID NO: 6070244 - DNA, 13 bp, Homo sapiens
ccattccaggtag

SEQ ID NO: 6070245 - DNA, 22 bp, Homo sapiens
ccattccagtcaaatctgggct

SEQ ID NO: 6070246 - DNA, 20 bp, Homo sapiens
ccattccagtccaattttcc

SEQ ID NO: 6070247 - DNA, 21 bp, Homo sapiens
ccattccatggaaataaaaag

SEQ ID NO: 6070248 - DNA, 21 bp, Homo sapiens
ccattcccaagaaatgctttg

SEQ ID NO: 6070249 - DNA, 19 bp, Homo sapiens
ccattcccaagatgcctga

SEQ ID NO: 6070250 - DNA, 15 bp, Homo sapiens
ccattcccagcctga

SEQ ID NO: 6070251 - DNA, 16 bp, Homo sapiens
ccattccccagcctct

SEQ ID NO: 6070252 - DNA, 19 bp, Homo sapiens
ccattccccagcctctctt

SEQ ID NO: 6070253 - DNA, 15 bp, Homo sapiens
ccattcccccagtgc

SEQ ID NO: 6070254 - DNA, 16 bp, Homo sapiens
ccattcccccagtgcg

SEQ ID NO: 6070255 - DNA, 19 bp, Homo sapiens
ccattccctccatttttct

SEQ ID NO: 6070256 - DNA, 16 bp, Homo sapiens
ccattcccttcggcca

SEQ ID NO: 6070257 - DNA, 22 bp, Homo sapiens
ccattccctttcttttcatgcc

SEQ ID NO: 6070258 - DNA, 17 bp, Homo sapiens
ccattccgaccttcacc

SEQ ID NO: 6070259 - DNA, 19 bp, Homo sapiens
ccattccgggttcactccc

SEQ ID NO: 6070260 - DNA, 22 bp, Homo sapiens
ccattcctcaccttttcccggg

SEQ ID NO: 6070261 - DNA, 16 bp, Homo sapiens
ccattcctgaagaacc

SEQ ID NO: 6070262 - DNA, 11 bp, Homo sapiens
ccattcctgat

SEQ ID NO: 6070263 - DNA, 13 bp, Homo sapiens
ccattcctgcctg

SEQ ID NO: 6070264 - DNA, 14 bp, Homo sapiens
ccattcctgcctgg

SEQ ID NO: 6070265 - DNA, 13 bp, Homo sapiens
ccattcctgcctt

SEQ ID NO: 6070266 - DNA, 13 bp, Homo sapiens
ccgtgagacacaa

SEQ ID NO: 6070267 - DNA, 14 bp, Homo sapiens
ccgtgagcaggctt

SEQ ID NO: 6070268 - DNA, 11 bp, Homo sapiens
ccgtgagccct

SEQ ID NO: 6070269 - DNA, 15 bp, Homo sapiens
ccgtgagcccttggt

SEQ ID NO: 6070270 - DNA, 14 bp, Homo sapiens
ccgtgaggccagag

SEQ ID NO: 6070271 - DNA, 18 bp, Homo sapiens
ccgtgaggccagagacac

SEQ ID NO: 6070272 - DNA, 13 bp, Homo sapiens
ccgtgagggtggg

SEQ ID NO: 6070273 - DNA, 20 bp, Homo sapiens
ccgtgagtgacatagcctca

SEQ ID NO: 6070274 - DNA, 17 bp, Homo sapiens
ccgtgagttctcagggc

SEQ ID NO: 6070275 - DNA, 15 bp, Homo sapiens
ccgtgatagaaaaaa

SEQ ID NO: 6070276 - DNA, 17 bp, Homo sapiens
ccgtgatgctcaggctt

SEQ ID NO: 6070277 - DNA, 16 bp, Homo sapiens
ccgtgatttggaagag

SEQ ID NO: 6070278 - DNA, 14 bp, Homo sapiens
ccgtgcactcccta

SEQ ID NO: 6070279 - DNA, 17 bp, Homo sapiens
ccgtgcagactggaggg

SEQ ID NO: 6070280 - DNA, 18 bp, Homo sapiens
ccgtgcagccacgaacac

SEQ ID NO: 6070281 - DNA, 18 bp, Homo sapiens
ccgtgcagcttctgtcct

SEQ ID NO: 6070282 - DNA, 15 bp, Homo sapiens
ccgtgcatcccagat

SEQ ID NO: 6070283 - DNA, 19 bp, Homo sapiens
ccgtgccaaagtctccctt

SEQ ID NO: 6070284 - DNA, 20 bp, Homo sapiens
ccgtgccaaagtctcccttc

SEQ ID NO: 6070285 - DNA, 19 bp, Homo sapiens
ccgtgccaaatcctgggca

SEQ ID NO: 6070286 - DNA, 21 bp, Homo sapiens
ccgtgccaaccccacccagct

SEQ ID NO: 6070287 - DNA, 14 bp, Homo sapiens
ccgtgccaagtcca

SEQ ID NO: 6070288 - DNA, 18 bp, Homo sapiens
ccgtgccacccccagccc

SEQ ID NO: 6070289 - DNA, 22 bp, Homo sapiens
ccgtgccacccgtaggcagcct

SEQ ID NO: 6070290 - DNA, 19 bp, Homo sapiens
ccgtgccacgcgctctgca

SEQ ID NO: 6070291 - DNA, 11 bp, Homo sapiens
ccgtgccagca

SEQ ID NO: 6070292 - DNA, 14 bp, Homo sapiens
ccgtgccagcagcg

SEQ ID NO: 6070293 - DNA, 14 bp, Homo sapiens
ccgtgccaggagca

SEQ ID NO: 6070294 - DNA, 14 bp, Homo sapiens
ccgtgccaggcatt

SEQ ID NO: 6070295 - DNA, 21 bp, Homo sapiens
ccgtgcccacgagggtctccc

SEQ ID NO: 6070296 - DNA, 20 bp, Homo sapiens
ccgtgccccacctccccaca

SEQ ID NO: 6070297 - DNA, 15 bp, Homo sapiens
ccgtgccccgcctcc

SEQ ID NO: 6070298 - DNA, 16 bp, Homo sapiens
ccgtgcccctgggatc

SEQ ID NO: 6070299 - DNA, 17 bp, Homo sapiens
ccgtgccccttccctgg

SEQ ID NO: 6070300 - DNA, 19 bp, Homo sapiens
ccgtgcccctttccttcac

SEQ ID NO: 6070301 - DNA, 21 bp, Homo sapiens
ccgtgcccgcccacctctgct

SEQ ID NO: 6070302 - DNA, 18 bp, Homo sapiens
ccgtgcccttgcccttgg

SEQ ID NO: 6070303 - DNA, 21 bp, Homo sapiens
ccgtgccgcctgcactcctca

SEQ ID NO: 6070304 - DNA, 17 bp, Homo sapiens
ccgtgcctccaccacca

SEQ ID NO: 6070305 - DNA, 23 bp, Homo sapiens
ccgtgcctccaccaccactggcc

SEQ ID NO: 6070306 - DNA, 13 bp, Homo sapiens
ccgtgcctggcca

SEQ ID NO: 6070307 - DNA, 13 bp, Homo sapiens
ccgtgcctggcta

SEQ ID NO: 6070308 - DNA, 11 bp, Homo sapiens
ccgtgcctggg

SEQ ID NO: 6070309 - DNA, 13 bp, Homo sapiens
ccgtgcctgggag

SEQ ID NO: 6070310 - DNA, 14 bp, Homo sapiens
ccgtgcctgggaga

SEQ ID NO: 6070311 - DNA, 13 bp, Homo sapiens
ccgtgcctggtgg

SEQ ID NO: 6070312 - DNA, 22 bp, Homo sapiens
ccgtgcctttctctggctccag

SEQ ID NO: 6070313 - DNA, 13 bp, Homo sapiens
ccgtgcgcagccg

SEQ ID NO: 6070314 - DNA, 14 bp, Homo sapiens
ccgtgcggcccgtg

SEQ ID NO: 6070315 - DNA, 15 bp, Homo sapiens
ccgtgcggcccgtgc

SEQ ID NO: 6070316 - DNA, 19 bp, Homo sapiens
ccgtgcggcccgtgcgcag

SEQ ID NO: 6070317 - DNA, 20 bp, Homo sapiens
ccgtgcggcccgtgcgcagc

SEQ ID NO: 6070318 - DNA, 23 bp, Homo sapiens
ccgtgcgggaaattcagtcttga

SEQ ID NO: 6070319 - DNA, 14 bp, Homo sapiens
ccgtgctaaggact

SEQ ID NO: 6070320 - DNA, 14 bp, Homo sapiens
ccgtgctcctctgc

SEQ ID NO: 6070321 - DNA, 16 bp, Homo sapiens
ccgtgctcctctgccc

SEQ ID NO: 6070322 - DNA, 17 bp, Homo sapiens
ccgtgctcctctgcccg

SEQ ID NO: 6070323 - DNA, 17 bp, Homo sapiens
ccgtgctcgccccagca

SEQ ID NO: 6070324 - DNA, 19 bp, Homo sapiens
ccgtgctgacagctgctcc

SEQ ID NO: 6070325 - DNA, 11 bp, Homo sapiens
ccgtgctgggc

SEQ ID NO: 6070326 - DNA, 16 bp, Homo sapiens
ccgtgctgggcagccc

SEQ ID NO: 6070327 - DNA, 14 bp, Homo sapiens
ccgtgctgtcttct

SEQ ID NO: 6070328 - DNA, 14 bp, Homo sapiens
ccgtgcttcctcag

SEQ ID NO: 6070329 - DNA, 15 bp, Homo sapiens
ccgtgcttcctcagt

SEQ ID NO: 6070330 - DNA, 12 bp, Homo sapiens
ccgtgcttgctg

SEQ ID NO: 6070331 - DNA, 18 bp, Homo sapiens
ccgtgcttgctggtgcct

SEQ ID NO: 6070332 - DNA, 12 bp, Homo sapiens
ccgtggacaggc

SEQ ID NO: 6070333 - DNA, 21 bp, Homo sapiens
ccgtggacaggcccagcgcgg

SEQ ID NO: 6070334 - DNA, 17 bp, Homo sapiens
ccgtggaccttcctgcc

SEQ ID NO: 6070335 - DNA, 13 bp, Homo sapiens
ccgtggactgcag

SEQ ID NO: 6070336 - DNA, 23 bp, Homo sapiens
ccgtggagatgggatgcttgcct

SEQ ID NO: 6070337 - DNA, 16 bp, Homo sapiens
ccgtggagcttggagc

SEQ ID NO: 6070338 - DNA, 16 bp, Homo sapiens
ccgtggaggaggaagg

SEQ ID NO: 6070339 - DNA, 20 bp, Homo sapiens
ccgtggaggaggttgggagg

SEQ ID NO: 6070340 - DNA, 16 bp, Homo sapiens
ccgtggaggctgctcg

SEQ ID NO: 6070341 - DNA, 22 bp, Homo sapiens
ccgtggaggctgctcggggtgc

SEQ ID NO: 6070342 - DNA, 22 bp, Homo sapiens
ccgtggattgcacgtggcctct

SEQ ID NO: 6070343 - DNA, 14 bp, Homo sapiens
ccgtggatttgtac

SEQ ID NO: 6070344 - DNA, 16 bp, Homo sapiens
ccgtggatttgtactt

SEQ ID NO: 6070345 - DNA, 15 bp, Homo sapiens
ccgtggcacagctgg

SEQ ID NO: 6070346 - DNA, 18 bp, Homo sapiens
ccgtggcacagctgggag

SEQ ID NO: 6070347 - DNA, 18 bp, Homo sapiens
ccgtggcagcttgctggg

SEQ ID NO: 6070348 - DNA, 17 bp, Homo sapiens
ccgtggccatccctgtg

SEQ ID NO: 6070349 - DNA, 13 bp, Homo sapiens
ccgtggccccagc

SEQ ID NO: 6070350 - DNA, 14 bp, Homo sapiens
ccgtggccccagcc

SEQ ID NO: 6070351 - DNA, 20 bp, Homo sapiens
ccgtggccccgccctcaggc

SEQ ID NO: 6070352 - DNA, 16 bp, Homo sapiens
ccgtggccctgccctc

SEQ ID NO: 6070353 - DNA, 21 bp, Homo sapiens
ccgtggcccttcctggacagc

SEQ ID NO: 6070354 - DNA, 13 bp, Homo sapiens
ccgtggcctgggc

SEQ ID NO: 6070355 - DNA, 14 bp, Homo sapiens
ccgtggcctgggct

SEQ ID NO: 6070356 - DNA, 12 bp, Homo sapiens
ccgtggctctgg

SEQ ID NO: 6070357 - DNA, 15 bp, Homo sapiens
ccgtggctctgggag

SEQ ID NO: 6070358 - DNA, 17 bp, Homo sapiens
ccgtggctctgggagag

SEQ ID NO: 6070359 - DNA, 14 bp, Homo sapiens
ccgtggctgcggca

SEQ ID NO: 6070360 - DNA, 16 bp, Homo sapiens
ccgtggctgctgtggg

SEQ ID NO: 6070361 - DNA, 17 bp, Homo sapiens
ccgtggctgctgtggga

SEQ ID NO: 6070362 - DNA, 23 bp, Homo sapiens
ccgtggctgtggcatccagagtc

SEQ ID NO: 6070363 - DNA, 21 bp, Homo sapiens
ccgtggcttcccgctcagccc

SEQ ID NO: 6070364 - DNA, 23 bp, Homo sapiens
ccgtggcttgggctggtcagagt

SEQ ID NO: 6070365 - DNA, 22 bp, Homo sapiens
ccgtggcttggggattgtacac

SEQ ID NO: 6070366 - DNA, 14 bp, Homo sapiens
ccgtgggacccagg

SEQ ID NO: 6070367 - DNA, 20 bp, Homo sapiens
ccgtgggaccctcagcagct

SEQ ID NO: 6070368 - DNA, 17 bp, Homo sapiens
ccgtgggcagaatgact

SEQ ID NO: 6070369 - DNA, 21 bp, Homo sapiens
ccgtgggcgcaaaggtgcctc

SEQ ID NO: 6070370 - DNA, 23 bp, Homo sapiens
ccgtgggcgcaaaggtgcctcat

SEQ ID NO: 6070371 - DNA, 18 bp, Homo sapiens
ccgtgggcggggccttgc

SEQ ID NO: 6070372 - DNA, 13 bp, Homo sapiens
ccgtggggcaggg

SEQ ID NO: 6070373 - DNA, 15 bp, Homo sapiens
ccgtggggcagggag

SEQ ID NO: 6070374 - DNA, 20 bp, Homo sapiens
ccgtggggccccggctccca

SEQ ID NO: 6070375 - DNA, 20 bp, Homo sapiens
ccgtgggggccacatttcac

SEQ ID NO: 6070376 - DNA, 15 bp, Homo sapiens
ccgtggggtgctgcc

SEQ ID NO: 6070377 - DNA, 17 bp, Homo sapiens
ccgtgggtgggcctggc

SEQ ID NO: 6070378 - DNA, 19 bp, Homo sapiens
ccgtgggtgggcctggccc

SEQ ID NO: 6070379 - DNA, 23 bp, Homo sapiens
ccgtgggtgggcctggccctgct

SEQ ID NO: 6070380 - DNA, 18 bp, Homo sapiens
ccgtggtacccccccttt

SEQ ID NO: 6070381 - DNA, 11 bp, Homo sapiens
ccgtggtccaa

SEQ ID NO: 6070382 - DNA, 15 bp, Homo sapiens
ccgtggtccagctct

SEQ ID NO: 6070383 - DNA, 18 bp, Homo sapiens
ccgtggtccagctcttgg

SEQ ID NO: 6070384 - DNA, 13 bp, Homo sapiens
ccgtggtccctga

SEQ ID NO: 6070385 - DNA, 12 bp, Homo sapiens
ccgtggtctttg

SEQ ID NO: 6070386 - DNA, 15 bp, Homo sapiens
ccgtggtctttgaat

SEQ ID NO: 6070387 - DNA, 20 bp, Homo sapiens
ccgtggtctttgaataaagt

SEQ ID NO: 6070388 - DNA, 23 bp, Homo sapiens
ccgtggtctttgaataaagtctg

SEQ ID NO: 6070389 - DNA, 13 bp, Homo sapiens
ccgtggtgacccc

SEQ ID NO: 6070390 - DNA, 21 bp, Homo sapiens
ccgtggtgaggttgtgctgcc

SEQ ID NO: 6070391 - DNA, 15 bp, Homo sapiens
ccgtggtgcctgcac

SEQ ID NO: 6070392 - DNA, 14 bp, Homo sapiens
ccgtggtgtcctct

SEQ ID NO: 6070393 - DNA, 15 bp, Homo sapiens
ccgtggtgtcctctg

SEQ ID NO: 6070394 - DNA, 17 bp, Homo sapiens
ccgtggtgtcctctgtc

SEQ ID NO: 6070395 - DNA, 23 bp, Homo sapiens
ccgtggtgtgaggcccccggagg

SEQ ID NO: 6070396 - DNA, 12 bp, Homo sapiens
ccgtgtaaatat

SEQ ID NO: 6070397 - DNA, 19 bp, Homo sapiens
ccgtgtacatagtgcattg

SEQ ID NO: 6070398 - DNA, 18 bp, Homo sapiens
ccgtgtccacccccatac

SEQ ID NO: 6070399 - DNA, 13 bp, Homo sapiens
ccgtgtccagcac

SEQ ID NO: 6070400 - DNA, 18 bp, Homo sapiens
ccgtgtccagcacagaag

SEQ ID NO: 6070401 - DNA, 19 bp, Homo sapiens
ccgtgtccagcacagaagg

SEQ ID NO: 6070402 - DNA, 18 bp, Homo sapiens
ccgtgtcccaaggagctg

SEQ ID NO: 6070403 - DNA, 14 bp, Homo sapiens
ccgtgtccccccag

SEQ ID NO: 6070404 - DNA, 17 bp, Homo sapiens
ccgtgtccccccaggtg

SEQ ID NO: 6070405 - DNA, 21 bp, Homo sapiens
ccgtgtccccttgttctaatg

SEQ ID NO: 6070406 - DNA, 19 bp, Homo sapiens
ccgtgtcgggcaggtcagc

SEQ ID NO: 6070407 - DNA, 14 bp, Homo sapiens
ccgtgtctcagcct

SEQ ID NO: 6070408 - DNA, 17 bp, Homo sapiens
ccgtgtctcagcctctg

SEQ ID NO: 6070409 - DNA, 21 bp, Homo sapiens
ccgtgtctcgcgcgactgaga

SEQ ID NO: 6070410 - DNA, 16 bp, Homo sapiens
ccgtgtctgtggccct

SEQ ID NO: 6070411 - DNA, 13 bp, Homo sapiens
ccgtgtgaatgta

SEQ ID NO: 6070412 - DNA, 20 bp, Homo sapiens
ccgtgtgaatgtagcttcca

SEQ ID NO: 6070413 - DNA, 20 bp, Homo sapiens
ccgtgtgagtgtgacagggc

SEQ ID NO: 6070414 - DNA, 21 bp, Homo sapiens
ccgtgtgagtgtgacagggcc

SEQ ID NO: 6070415 - DNA, 22 bp, Homo sapiens
ccgtgtgagtgtgacagggcca

SEQ ID NO: 6070416 - DNA, 12 bp, Homo sapiens
ccgtgtgcctcc

SEQ ID NO: 6070417 - DNA, 13 bp, Homo sapiens
ccgtgtgcctcct

SEQ ID NO: 6070418 - DNA, 17 bp, Homo sapiens
ccgtgtgcctcctgtgt

SEQ ID NO: 6070419 - DNA, 13 bp, Homo sapiens
ccgtgtgcctgag

SEQ ID NO: 6070420 - DNA, 14 bp, Homo sapiens
ccgtgtgcctttcc

SEQ ID NO: 6070421 - DNA, 22 bp, Homo sapiens
ccgtgtgcctttcccgggccct

SEQ ID NO: 6070422 - DNA, 18 bp, Homo sapiens
ccgtgtgctccagtgttt

SEQ ID NO: 6070423 - DNA, 17 bp, Homo sapiens
ccgtgtgctcctcggca

SEQ ID NO: 6070424 - DNA, 23 bp, Homo sapiens
ccgtgtgggctttaaaagaaaaa

SEQ ID NO: 6070425 - DNA, 23 bp, Homo sapiens
ccgtgtggtaagcaacatggctt

SEQ ID NO: 6070426 - DNA, 23 bp, Homo sapiens
ccgtgtggtaccttcagccctgg

SEQ ID NO: 6070427 - DNA, 11 bp, Homo sapiens
ccgtgtgtcca

SEQ ID NO: 6070428 - DNA, 12 bp, Homo sapiens
ccgtgtgtttat

SEQ ID NO: 6070429 - DNA, 16 bp, Homo sapiens
ccgtgttcaggacaca

SEQ ID NO: 6070430 - DNA, 14 bp, Homo sapiens
ccgtgttcccctct

SEQ ID NO: 6070431 - DNA, 21 bp, Homo sapiens
ccgtgttgcaggttcatggat

SEQ ID NO: 6070432 - DNA, 19 bp, Homo sapiens
ccgtgttggtctgtactga

SEQ ID NO: 6070433 - DNA, 14 bp, Homo sapiens
ccgtgtttctctaa

SEQ ID NO: 6070434 - DNA, 14 bp, Homo sapiens
ccgtgtttgtctct

SEQ ID NO: 6070435 - DNA, 23 bp, Homo sapiens
ccgtgttttatgactaatcctta

SEQ ID NO: 6070436 - DNA, 14 bp, Homo sapiens
ccgttactctccaa

SEQ ID NO: 6070437 - DNA, 15 bp, Homo sapiens
ccgttagctcctgtg

SEQ ID NO: 6070438 - DNA, 16 bp, Homo sapiens
ccgttaggattcaggc

SEQ ID NO: 6070439 - DNA, 19 bp, Homo sapiens
ccgttaggattcaggcagc

SEQ ID NO: 6070440 - DNA, 19 bp, Homo sapiens
ccgttataaagtgtgccac

SEQ ID NO: 6070441 - DNA, 20 bp, Homo sapiens
ccgttattataattgtatca

SEQ ID NO: 6070442 - DNA, 20 bp, Homo sapiens
ccgttcaaattctcttcttt

SEQ ID NO: 6070443 - DNA, 22 bp, Homo sapiens
ccgttcaagaggcgtgtgcagg

SEQ ID NO: 6070444 - DNA, 13 bp, Homo sapiens
ccgttcagcctgt

SEQ ID NO: 6070445 - DNA, 12 bp, Homo sapiens
ccgttcatctga

SEQ ID NO: 6070446 - DNA, 21 bp, Homo sapiens
ccgttcatctgaggagtccaa

SEQ ID NO: 6070447 - DNA, 22 bp, Homo sapiens
ccattcctgggaaatattccct

SEQ ID NO: 6070448 - DNA, 20 bp, Homo sapiens
ccattcctggtacccagcca

SEQ ID NO: 6070449 - DNA, 23 bp, Homo sapiens
ccattccttagctatttatccct

SEQ ID NO: 6070450 - DNA, 15 bp, Homo sapiens
ccattccttcaaata

SEQ ID NO: 6070451 - DNA, 16 bp, Homo sapiens
ccattccttcccagag

SEQ ID NO: 6070452 - DNA, 18 bp, Homo sapiens
ccattcgacctataagaa

SEQ ID NO: 6070453 - DNA, 18 bp, Homo sapiens
ccattcgcgctctgctca

SEQ ID NO: 6070454 - DNA, 17 bp, Homo sapiens
ccattcggggctgacga

SEQ ID NO: 6070455 - DNA, 20 bp, Homo sapiens
ccattcgtacataatactga

SEQ ID NO: 6070456 - DNA, 17 bp, Homo sapiens
ccattcgtctgtcccag

SEQ ID NO: 6070457 - DNA, 19 bp, Homo sapiens
ccattcgtctgtcccagag

SEQ ID NO: 6070458 - DNA, 15 bp, Homo sapiens
ccattcgtgaaaaca

SEQ ID NO: 6070459 - DNA, 13 bp, Homo sapiens
ccattctaaaaca

SEQ ID NO: 6070460 - DNA, 17 bp, Homo sapiens
ccattctacctgtcctc

SEQ ID NO: 6070461 - DNA, 17 bp, Homo sapiens
ccattctacttgctctg

SEQ ID NO: 6070462 - DNA, 20 bp, Homo sapiens
ccattctacttgctctggac

SEQ ID NO: 6070463 - DNA, 23 bp, Homo sapiens
ccattctagatcctgcaccccag

SEQ ID NO: 6070464 - DNA, 21 bp, Homo sapiens
ccattctcacaggtcccaaat

SEQ ID NO: 6070465 - DNA, 21 bp, Homo sapiens
ccattctcatatgtagccctc

SEQ ID NO: 6070466 - DNA, 15 bp, Homo sapiens
ccattctccacagca

SEQ ID NO: 6070467 - DNA, 16 bp, Homo sapiens
ccattctccacagcaa

SEQ ID NO: 6070468 - DNA, 20 bp, Homo sapiens
ccattctccacctgccaggg

SEQ ID NO: 6070469 - DNA, 22 bp, Homo sapiens
ccattctccagtttcagaagca

SEQ ID NO: 6070470 - DNA, 17 bp, Homo sapiens
ccattctccatttgtta

SEQ ID NO: 6070471 - DNA, 13 bp, Homo sapiens
ccattctcccagg

SEQ ID NO: 6070472 - DNA, 14 bp, Homo sapiens
ccattctcccaggt

SEQ ID NO: 6070473 - DNA, 15 bp, Homo sapiens
ccattctcccaggta

SEQ ID NO: 6070474 - DNA, 14 bp, Homo sapiens
ccattctcccagtc

SEQ ID NO: 6070475 - DNA, 19 bp, Homo sapiens
ccattctcccagtctctgt

SEQ ID NO: 6070476 - DNA, 15 bp, Homo sapiens
ccattctccccctct

SEQ ID NO: 6070477 - DNA, 22 bp, Homo sapiens
ccattctccctccatggcagga

SEQ ID NO: 6070478 - DNA, 16 bp, Homo sapiens
ccattctcctcagtgg

SEQ ID NO: 6070479 - DNA, 19 bp, Homo sapiens
ccattctcctcagtggctt

SEQ ID NO: 6070480 - DNA, 13 bp, Homo sapiens
ccattctcctgcc

SEQ ID NO: 6070481 - DNA, 14 bp, Homo sapiens
ccattctcctgcct

SEQ ID NO: 6070482 - DNA, 17 bp, Homo sapiens
ccattctcctgcctcac

SEQ ID NO: 6070483 - DNA, 12 bp, Homo sapiens
ccattctctaag

SEQ ID NO: 6070484 - DNA, 17 bp, Homo sapiens
ccattctctaagcctgg

SEQ ID NO: 6070485 - DNA, 19 bp, Homo sapiens
ccattctctctcctgtcca

SEQ ID NO: 6070486 - DNA, 12 bp, Homo sapiens
ccattctctctg

SEQ ID NO: 6070487 - DNA, 16 bp, Homo sapiens
ccattctgaccatttc

SEQ ID NO: 6070488 - DNA, 13 bp, Homo sapiens
ccattctgcacca

SEQ ID NO: 6070489 - DNA, 17 bp, Homo sapiens
ccattctgcatgccctc

SEQ ID NO: 6070490 - DNA, 14 bp, Homo sapiens
ccattctgcattta

SEQ ID NO: 6070491 - DNA, 16 bp, Homo sapiens
ccattctgcatttagc

SEQ ID NO: 6070492 - DNA, 19 bp, Homo sapiens
ccattctgccccagagtgg

SEQ ID NO: 6070493 - DNA, 22 bp, Homo sapiens
ccattctgccgccccctcctga

SEQ ID NO: 6070494 - DNA, 12 bp, Homo sapiens
ccattctgcctc

SEQ ID NO: 6070495 - DNA, 22 bp, Homo sapiens
ccattctgcctcagcctcctga

SEQ ID NO: 6070496 - DNA, 20 bp, Homo sapiens
ccattctgcctccattctga

SEQ ID NO: 6070497 - DNA, 16 bp, Homo sapiens
ccattctgcctctcct

SEQ ID NO: 6070498 - DNA, 17 bp, Homo sapiens
ccattctgcctgcccag

SEQ ID NO: 6070499 - DNA, 19 bp, Homo sapiens
ccattctgcctgcccaggc

SEQ ID NO: 6070500 - DNA, 20 bp, Homo sapiens
ccattctgcctgcccaggcc

SEQ ID NO: 6070501 - DNA, 14 bp, Homo sapiens
ccattctgctcctt

SEQ ID NO: 6070502 - DNA, 23 bp, Homo sapiens
ccattctgctttcttgccacaca

SEQ ID NO: 6070503 - DNA, 22 bp, Homo sapiens
ccattctggcactttaatgata

SEQ ID NO: 6070504 - DNA, 19 bp, Homo sapiens
ccattctgtgtcccatgtc

SEQ ID NO: 6070505 - DNA, 17 bp, Homo sapiens
ccattctgttttccccc

SEQ ID NO: 6070506 - DNA, 23 bp, Homo sapiens
ccattcttacttactaaaatata

SEQ ID NO: 6070507 - DNA, 15 bp, Homo sapiens
ccattcttcagtgtc

SEQ ID NO: 6070508 - DNA, 12 bp, Homo sapiens
ccattcttcccg

SEQ ID NO: 6070509 - DNA, 13 bp, Homo sapiens
ccattcttctggg

SEQ ID NO: 6070510 - DNA, 15 bp, Homo sapiens
ccattcttctggtgc

SEQ ID NO: 6070511 - DNA, 16 bp, Homo sapiens
ccattcttggcatcta

SEQ ID NO: 6070512 - DNA, 22 bp, Homo sapiens
ccattcttggtcaagtttttct

SEQ ID NO: 6070513 - DNA, 12 bp, Homo sapiens
ccattctttctg

SEQ ID NO: 6070514 - DNA, 13 bp, Homo sapiens
ccattctttctga

SEQ ID NO: 6070515 - DNA, 16 bp, Homo sapiens
ccattctttcttcctc

SEQ ID NO: 6070516 - DNA, 13 bp, Homo sapiens
ccattcttttccc

SEQ ID NO: 6070517 - DNA, 22 bp, Homo sapiens
ccattcttttgtaatttaaatg

SEQ ID NO: 6070518 - DNA, 19 bp, Homo sapiens
ccattctttttttcttggc

SEQ ID NO: 6070519 - DNA, 17 bp, Homo sapiens
ccattgaaaaaggaaaa

SEQ ID NO: 6070520 - DNA, 19 bp, Homo sapiens
ccattgaaaaaggaaaaat

SEQ ID NO: 6070521 - DNA, 21 bp, Homo sapiens
ccattgaaactaagagctctc

SEQ ID NO: 6070522 - DNA, 21 bp, Homo sapiens
ccattgaacactgcaccctcc

SEQ ID NO: 6070523 - DNA, 19 bp, Homo sapiens
ccattgaacagctgtgagc

SEQ ID NO: 6070524 - DNA, 23 bp, Homo sapiens
ccattgaagaagaaccagcccag

SEQ ID NO: 6070525 - DNA, 24 bp, Homo sapiens
ccattgaagaagaaccagcccagc

SEQ ID NO: 6070526 - DNA, 21 bp, Homo sapiens
ccattgaagggggatgcaggc

SEQ ID NO: 6070527 - DNA, 13 bp, Homo sapiens
ccattgaattctt

SEQ ID NO: 6070528 - DNA, 15 bp, Homo sapiens
ccattgacatgtaca

SEQ ID NO: 6070529 - DNA, 23 bp, Homo sapiens
ccattgaccagctctcttcctgt

SEQ ID NO: 6070530 - DNA, 13 bp, Homo sapiens
ccattgacctcag

SEQ ID NO: 6070531 - DNA, 18 bp, Homo sapiens
ccattgacctcagctgca

SEQ ID NO: 6070532 - DNA, 22 bp, Homo sapiens
ccattgacctcagctgcacatt

SEQ ID NO: 6070533 - DNA, 21 bp, Homo sapiens
ccattgagatcttcctgctga

SEQ ID NO: 6070534 - DNA, 15 bp, Homo sapiens
ccattgatttttaac

SEQ ID NO: 6070535 - DNA, 23 bp, Homo sapiens
ccattgcaaaaggttaagccata

SEQ ID NO: 6070536 - DNA, 19 bp, Homo sapiens
ccattgcaaaatagaagaa

SEQ ID NO: 6070537 - DNA, 13 bp, Homo sapiens
ccattgcacccag

SEQ ID NO: 6070538 - DNA, 20 bp, Homo sapiens
ccattgcatcacctctgtaa

SEQ ID NO: 6070539 - DNA, 13 bp, Homo sapiens
ccattgccaggag

SEQ ID NO: 6070540 - DNA, 14 bp, Homo sapiens
ccattgccaggaga

SEQ ID NO: 6070541 - DNA, 17 bp, Homo sapiens
ccattgccaggagatgg

SEQ ID NO: 6070542 - DNA, 14 bp, Homo sapiens
ccattgcccagtga

SEQ ID NO: 6070543 - DNA, 20 bp, Homo sapiens
ccattgcccagtgagccctg

SEQ ID NO: 6070544 - DNA, 17 bp, Homo sapiens
ccattgccccagacctg

SEQ ID NO: 6070545 - DNA, 17 bp, Homo sapiens
ccattgcctagctcttt

SEQ ID NO: 6070546 - DNA, 13 bp, Homo sapiens
ccattgcctcctc

SEQ ID NO: 6070547 - DNA, 15 bp, Homo sapiens
ccattgcctcctcct

SEQ ID NO: 6070548 - DNA, 15 bp, Homo sapiens
ccattgccttctggg

SEQ ID NO: 6070549 - DNA, 18 bp, Homo sapiens
ccattgcggccccaggag

SEQ ID NO: 6070550 - DNA, 19 bp, Homo sapiens
ccattgcgttattttcttt

SEQ ID NO: 6070551 - DNA, 19 bp, Homo sapiens
ccattgctccattcactcc

SEQ ID NO: 6070552 - DNA, 20 bp, Homo sapiens
ccattgctcccagtgccaaa

SEQ ID NO: 6070553 - DNA, 14 bp, Homo sapiens
ccattgctgctcct

SEQ ID NO: 6070554 - DNA, 12 bp, Homo sapiens
ccattgctggaa

SEQ ID NO: 6070555 - DNA, 20 bp, Homo sapiens
ccattgctgttctacttttt

SEQ ID NO: 6070556 - DNA, 14 bp, Homo sapiens
ccattggaaatttc

SEQ ID NO: 6070557 - DNA, 15 bp, Homo sapiens
ccattggaaatttca

SEQ ID NO: 6070558 - DNA, 21 bp, Homo sapiens
ccattggacagatttcagtaa

SEQ ID NO: 6070559 - DNA, 14 bp, Homo sapiens
ccattggagcacct

SEQ ID NO: 6070560 - DNA, 16 bp, Homo sapiens
ccattggatctgcaag

SEQ ID NO: 6070561 - DNA, 17 bp, Homo sapiens
ccattggatcttttact

SEQ ID NO: 6070562 - DNA, 21 bp, Homo sapiens
ccattggccgagctcctgggg

SEQ ID NO: 6070563 - DNA, 20 bp, Homo sapiens
ccattggcctcttgtccctt

SEQ ID NO: 6070564 - DNA, 20 bp, Homo sapiens
ccattggccttaactggccc

SEQ ID NO: 6070565 - DNA, 21 bp, Homo sapiens
ccattggccttaactggccct

SEQ ID NO: 6070566 - DNA, 17 bp, Homo sapiens
ccattggctagaatcag

SEQ ID NO: 6070567 - DNA, 20 bp, Homo sapiens
ccattggctatttaaaactt

SEQ ID NO: 6070568 - DNA, 20 bp, Homo sapiens
ccattggcttcctcactcca

SEQ ID NO: 6070569 - DNA, 15 bp, Homo sapiens
ccattgggactgatt

SEQ ID NO: 6070570 - DNA, 22 bp, Homo sapiens
ccattggggctcccagccaggc

SEQ ID NO: 6070571 - DNA, 18 bp, Homo sapiens
ccattgggtttggggcca

SEQ ID NO: 6070572 - DNA, 22 bp, Homo sapiens
ccattgggtttggggccatggt

SEQ ID NO: 6070573 - DNA, 20 bp, Homo sapiens
ccattggtctgcatgtcttt

SEQ ID NO: 6070574 - DNA, 13 bp, Homo sapiens
ccattggtgttgt

SEQ ID NO: 6070575 - DNA, 17 bp, Homo sapiens
ccattggttaatctgga

SEQ ID NO: 6070576 - DNA, 19 bp, Homo sapiens
ccattggttcacctgtgac

SEQ ID NO: 6070577 - DNA, 14 bp, Homo sapiens
ccattggttctcct

SEQ ID NO: 6070578 - DNA, 16 bp, Homo sapiens
ccattggttcttcctt

SEQ ID NO: 6070579 - DNA, 22 bp, Homo sapiens
ccattggttggaagctaccaga

SEQ ID NO: 6070580 - DNA, 20 bp, Homo sapiens
ccattgtactccagcctggg

SEQ ID NO: 6070581 - DNA, 19 bp, Homo sapiens
ccattgtccaatcctatgt

SEQ ID NO: 6070582 - DNA, 17 bp, Homo sapiens
ccattgtccaggaaaga

SEQ ID NO: 6070583 - DNA, 19 bp, Homo sapiens
ccattgtccctctgcccca

SEQ ID NO: 6070584 - DNA, 22 bp, Homo sapiens
ccattgtccctctgccccatcc

SEQ ID NO: 6070585 - DNA, 23 bp, Homo sapiens
ccattgtcgtttcattcattttg

SEQ ID NO: 6070586 - DNA, 16 bp, Homo sapiens
ccattgtctcattgcc

SEQ ID NO: 6070587 - DNA, 15 bp, Homo sapiens
ccattgtcttccaac

SEQ ID NO: 6070588 - DNA, 16 bp, Homo sapiens
ccattgtcttccaacc

SEQ ID NO: 6070589 - DNA, 23 bp, Homo sapiens
ccattgtcttccaaccccagctg

SEQ ID NO: 6070590 - DNA, 17 bp, Homo sapiens
ccattgtcttgttctgt

SEQ ID NO: 6070591 - DNA, 23 bp, Homo sapiens
ccattgtctttatatgaacatag

SEQ ID NO: 6070592 - DNA, 20 bp, Homo sapiens
ccattgtgcctaagtccagt

SEQ ID NO: 6070593 - DNA, 21 bp, Homo sapiens
ccattgtgtgatccagccctg

SEQ ID NO: 6070594 - DNA, 21 bp, Homo sapiens
ccattgttcaggattctaata

SEQ ID NO: 6070595 - DNA, 24 bp, Homo sapiens
ccattgttcccttcctcttcctgc

SEQ ID NO: 6070596 - DNA, 12 bp, Homo sapiens
ccattgttctga

SEQ ID NO: 6070597 - DNA, 20 bp, Homo sapiens
ccattgttggcgctgaggtg

SEQ ID NO: 6070598 - DNA, 17 bp, Homo sapiens
ccattgttgtcaaggaa

SEQ ID NO: 6070599 - DNA, 18 bp, Homo sapiens
ccattgttgtcaaggaag

SEQ ID NO: 6070600 - DNA, 21 bp, Homo sapiens
ccattgttgtcaaggaagaag

SEQ ID NO: 6070601 - DNA, 23 bp, Homo sapiens
ccattgtttaaaaatcttaatgt

SEQ ID NO: 6070602 - DNA, 21 bp, Homo sapiens
ccattgtttgaaacaaagaag

SEQ ID NO: 6070603 - DNA, 14 bp, Homo sapiens
ccatttaaaaatga

SEQ ID NO: 6070604 - DNA, 20 bp, Homo sapiens
ccatttaaaacaagctgata

SEQ ID NO: 6070605 - DNA, 13 bp, Homo sapiens
ccatttaaagctt

SEQ ID NO: 6070606 - DNA, 22 bp, Homo sapiens
ccatttaaagcttattaaaact

SEQ ID NO: 6070607 - DNA, 23 bp, Homo sapiens
ccatttaagagactctttatttt

SEQ ID NO: 6070608 - DNA, 20 bp, Homo sapiens
ccatttaataaagaaatatt

SEQ ID NO: 6070609 - DNA, 23 bp, Homo sapiens
ccatttaattcataattagaaca

SEQ ID NO: 6070610 - DNA, 14 bp, Homo sapiens
ccatttacaaataa

SEQ ID NO: 6070611 - DNA, 18 bp, Homo sapiens
ccatttacacttttgaga

SEQ ID NO: 6070612 - DNA, 20 bp, Homo sapiens
ccatttacagtctctttctt

SEQ ID NO: 6070613 - DNA, 15 bp, Homo sapiens
ccatttacctggaaa

SEQ ID NO: 6070614 - DNA, 17 bp, Homo sapiens
ccatttacttaagactt

SEQ ID NO: 6070615 - DNA, 23 bp, Homo sapiens
ccatttacttaagacttaatgag

SEQ ID NO: 6070616 - DNA, 15 bp, Homo sapiens
ccatttacttaggac

SEQ ID NO: 6070617 - DNA, 20 bp, Homo sapiens
ccatttagaatctagaaatg

SEQ ID NO: 6070618 - DNA, 22 bp, Homo sapiens
ccatttagcactatttaaaata

SEQ ID NO: 6070619 - DNA, 14 bp, Homo sapiens
ccatttagccacca

SEQ ID NO: 6070620 - DNA, 18 bp, Homo sapiens
ccatttagtcctcacctt

SEQ ID NO: 6070621 - DNA, 19 bp, Homo sapiens
ccatttagttctttgttat

SEQ ID NO: 6070622 - DNA, 16 bp, Homo sapiens
ccatttatatatgaaa

SEQ ID NO: 6070623 - DNA, 14 bp, Homo sapiens
ccatttatccacct

SEQ ID NO: 6070624 - DNA, 17 bp, Homo sapiens
ccgttccaccccaagag

SEQ ID NO: 6070625 - DNA, 20 bp, Homo sapiens
ccgttccaccccaagagaac

SEQ ID NO: 6070626 - DNA, 13 bp, Homo sapiens
ccgttcccacctc

SEQ ID NO: 6070627 - DNA, 18 bp, Homo sapiens
ccgttcccacctctgagg

SEQ ID NO: 6070628 - DNA, 19 bp, Homo sapiens
ccgttccccgctaggtcaa

SEQ ID NO: 6070629 - DNA, 14 bp, Homo sapiens
ccgttccctgtcag

SEQ ID NO: 6070630 - DNA, 20 bp, Homo sapiens
ccgttcctccccctgctccc

SEQ ID NO: 6070631 - DNA, 18 bp, Homo sapiens
ccgttcctgacatcacag

SEQ ID NO: 6070632 - DNA, 12 bp, Homo sapiens
ccgttcctggca

SEQ ID NO: 6070633 - DNA, 12 bp, Homo sapiens
ccgttcctggga

SEQ ID NO: 6070634 - DNA, 18 bp, Homo sapiens
ccgttcgtacgcccagga

SEQ ID NO: 6070635 - DNA, 20 bp, Homo sapiens
ccgttcgtacgcccaggaca

SEQ ID NO: 6070636 - DNA, 21 bp, Homo sapiens
ccgttctattgtgtggatgac

SEQ ID NO: 6070637 - DNA, 23 bp, Homo sapiens
ccgttctgctggcctggatctcc

SEQ ID NO: 6070638 - DNA, 13 bp, Homo sapiens
ccgttctgttctg

SEQ ID NO: 6070639 - DNA, 18 bp, Homo sapiens
ccgttctgttctgctggg

SEQ ID NO: 6070640 - DNA, 20 bp, Homo sapiens
ccgttctgttctgctgggag

SEQ ID NO: 6070641 - DNA, 13 bp, Homo sapiens
ccgttgccaaccg

SEQ ID NO: 6070642 - DNA, 17 bp, Homo sapiens
ccgttgctgaaaatgat

SEQ ID NO: 6070643 - DNA, 20 bp, Homo sapiens
ccgttgtctccctggccctc

SEQ ID NO: 6070644 - DNA, 16 bp, Homo sapiens
ccgttgttgtccctgc

SEQ ID NO: 6070645 - DNA, 20 bp, Homo sapiens
ccgttgtttacttaaagatt

SEQ ID NO: 6070646 - DNA, 14 bp, Homo sapiens
ccgtttagaaaaaa

SEQ ID NO: 6070647 - DNA, 18 bp, Homo sapiens
ccgtttagaaaaaacaat

SEQ ID NO: 6070648 - DNA, 18 bp, Homo sapiens
ccgtttcagaaggaccaa

SEQ ID NO: 6070649 - DNA, 13 bp, Homo sapiens
ccgtttccaagcc

SEQ ID NO: 6070650 - DNA, 16 bp, Homo sapiens
ccgtttccaagcctgg

SEQ ID NO: 6070651 - DNA, 19 bp, Homo sapiens
ccgtttccaggtgtttata

SEQ ID NO: 6070652 - DNA, 20 bp, Homo sapiens
ccgtttcccggttcaggacc

SEQ ID NO: 6070653 - DNA, 13 bp, Homo sapiens
ccgtttccctcca

SEQ ID NO: 6070654 - DNA, 23 bp, Homo sapiens
ccgtttcctttcatttactgtgg

SEQ ID NO: 6070655 - DNA, 14 bp, Homo sapiens
ccgttttcatcctg

SEQ ID NO: 6070656 - DNA, 15 bp, Homo sapiens
ccgttttggggacgt

SEQ ID NO: 6070657 - DNA, 14 bp, Homo sapiens
ccgtttttcaagaa

SEQ ID NO: 6070658 - DNA, 14 bp, Homo sapiens
cctaaaaagagaag

SEQ ID NO: 6070659 - DNA, 12 bp, Homo sapiens
cctaaaaataaa

SEQ ID NO: 6070660 - DNA, 18 bp, Homo sapiens
cctaaaaattcccttcct

SEQ ID NO: 6070661 - DNA, 20 bp, Homo sapiens
cctaaaaattcccttcctgt

SEQ ID NO: 6070662 - DNA, 13 bp, Homo sapiens
cctaaaaattggt

SEQ ID NO: 6070663 - DNA, 17 bp, Homo sapiens
cctaaaacataagatca

SEQ ID NO: 6070664 - DNA, 23 bp, Homo sapiens
cctaaaacgaatggtctttgctc

SEQ ID NO: 6070665 - DNA, 15 bp, Homo sapiens
cctaaaactctgcca

SEQ ID NO: 6070666 - DNA, 18 bp, Homo sapiens
cctaaaagaaaccctgca

SEQ ID NO: 6070667 - DNA, 19 bp, Homo sapiens
cctaaaagaaaccctgcac

SEQ ID NO: 6070668 - DNA, 13 bp, Homo sapiens
cctaaaagcaaaa

SEQ ID NO: 6070669 - DNA, 22 bp, Homo sapiens
cctaaaagcaaaataaaaacta

SEQ ID NO: 6070670 - DNA, 23 bp, Homo sapiens
cctaaaagcaaaataaaaactat

SEQ ID NO: 6070671 - DNA, 13 bp, Homo sapiens
cctaaaaggccca

SEQ ID NO: 6070672 - DNA, 14 bp, Homo sapiens
cctaaaaggcccag

SEQ ID NO: 6070673 - DNA, 15 bp, Homo sapiens
cctaaaagtaacaat

SEQ ID NO: 6070674 - DNA, 22 bp, Homo sapiens
cctaaaagttcataacagtgcc

SEQ ID NO: 6070675 - DNA, 19 bp, Homo sapiens
cctaaaagttttaacctca

SEQ ID NO: 6070676 - DNA, 12 bp, Homo sapiens
cctaaaataaaa

SEQ ID NO: 6070677 - DNA, 13 bp, Homo sapiens
cctaaaataaaaa

SEQ ID NO: 6070678 - DNA, 12 bp, Homo sapiens
cctaaaatcttg

SEQ ID NO: 6070679 - DNA, 16 bp, Homo sapiens
cctaaaattatggaaa

SEQ ID NO: 6070680 - DNA, 15 bp, Homo sapiens
cctaaaattcagtgg

SEQ ID NO: 6070681 - DNA, 12 bp, Homo sapiens
cctaaacataat

SEQ ID NO: 6070682 - DNA, 22 bp, Homo sapiens
cctaaacatagtggtattttaa

SEQ ID NO: 6070683 - DNA, 14 bp, Homo sapiens
cctaaacccaatga

SEQ ID NO: 6070684 - DNA, 21 bp, Homo sapiens
cctaaaccccaagcttcccaa

SEQ ID NO: 6070685 - DNA, 14 bp, Homo sapiens
cctaaaccctctgt

SEQ ID NO: 6070686 - DNA, 20 bp, Homo sapiens
cctaaactgcagcctctctg

SEQ ID NO: 6070687 - DNA, 16 bp, Homo sapiens
cctaaactttggcctt

SEQ ID NO: 6070688 - DNA, 20 bp, Homo sapiens
cctaaagaaaaatatcttgg

SEQ ID NO: 6070689 - DNA, 22 bp, Homo sapiens
cctaaagaaaaatatcttggcc

SEQ ID NO: 6070690 - DNA, 17 bp, Homo sapiens
cctaaagagcatcctga

SEQ ID NO: 6070691 - DNA, 20 bp, Homo sapiens
cctaaagagcatcctgatac

SEQ ID NO: 6070692 - DNA, 22 bp, Homo sapiens
cctaaagaggaaaagtgcaatg

SEQ ID NO: 6070693 - DNA, 20 bp, Homo sapiens
cctaaagccaaagtttctgt

SEQ ID NO: 6070694 - DNA, 22 bp, Homo sapiens
cctaaagccaaagtttctgttg

SEQ ID NO: 6070695 - DNA, 13 bp, Homo sapiens
cctaaagccagca

SEQ ID NO: 6070696 - DNA, 13 bp, Homo sapiens
cctaaagccaggc

SEQ ID NO: 6070697 - DNA, 15 bp, Homo sapiens
cctaaagccaggctc

SEQ ID NO: 6070698 - DNA, 12 bp, Homo sapiens
cctaaagccctc

SEQ ID NO: 6070699 - DNA, 22 bp, Homo sapiens
cctaaaggactattatgtggaa

SEQ ID NO: 6070700 - DNA, 18 bp, Homo sapiens
cctaaagggaagccctga

SEQ ID NO: 6070701 - DNA, 19 bp, Homo sapiens
cctaaagggaagccctgac

SEQ ID NO: 6070702 - DNA, 13 bp, Homo sapiens
cctaaagggagaa

SEQ ID NO: 6070703 - DNA, 16 bp, Homo sapiens
cctaaagggcagggcc

SEQ ID NO: 6070704 - DNA, 20 bp, Homo sapiens
cctaaagggtatgagctgga

SEQ ID NO: 6070705 - DNA, 23 bp, Homo sapiens
cctaaagggtatgagctggagct

SEQ ID NO: 6070706 - DNA, 20 bp, Homo sapiens
cctaaagtatacaactgcct

SEQ ID NO: 6070707 - DNA, 18 bp, Homo sapiens
cctaaataaatgagctgt

SEQ ID NO: 6070708 - DNA, 14 bp, Homo sapiens
cctaaatatccaaa

SEQ ID NO: 6070709 - DNA, 14 bp, Homo sapiens
cctaaatatttatc

SEQ ID NO: 6070710 - DNA, 17 bp, Homo sapiens
cctaaatattttcaaga

SEQ ID NO: 6070711 - DNA, 21 bp, Homo sapiens
cctaaatccactctgcaggaa

SEQ ID NO: 6070712 - DNA, 17 bp, Homo sapiens
cctaaatccatttggaa

SEQ ID NO: 6070713 - DNA, 21 bp, Homo sapiens
cctaaatccatttggaaatct

SEQ ID NO: 6070714 - DNA, 15 bp, Homo sapiens
cctaaatgacctcag

SEQ ID NO: 6070715 - DNA, 20 bp, Homo sapiens
cctaaatgacctcagcaaat

SEQ ID NO: 6070716 - DNA, 14 bp, Homo sapiens
cctaaatggcctca

SEQ ID NO: 6070717 - DNA, 18 bp, Homo sapiens
cctaaatggcctcatgtg

SEQ ID NO: 6070718 - DNA, 13 bp, Homo sapiens
cctaaatttaaaa

SEQ ID NO: 6070719 - DNA, 19 bp, Homo sapiens
cctaaatttaatgctgcct

SEQ ID NO: 6070720 - DNA, 19 bp, Homo sapiens
cctaacatacctaagcaaa

SEQ ID NO: 6070721 - DNA, 17 bp, Homo sapiens
cctaacatgacagtatt

SEQ ID NO: 6070722 - DNA, 23 bp, Homo sapiens
cctaacatggtttaaaagaaaaa

SEQ ID NO: 6070723 - DNA, 11 bp, Homo sapiens
cctaaccacta

SEQ ID NO: 6070724 - DNA, 13 bp, Homo sapiens
cctaaccaggccc

SEQ ID NO: 6070725 - DNA, 17 bp, Homo sapiens
cctaaccaggcccagcc

SEQ ID NO: 6070726 - DNA, 18 bp, Homo sapiens
cctaaccaggcccagcca

SEQ ID NO: 6070727 - DNA, 19 bp, Homo sapiens
cctaaccaggcccagccag

SEQ ID NO: 6070728 - DNA, 18 bp, Homo sapiens
cctaaccatgggctcagg

SEQ ID NO: 6070729 - DNA, 19 bp, Homo sapiens
cctaaccatgggctcaggg

SEQ ID NO: 6070730 - DNA, 22 bp, Homo sapiens
cctaaccatgggctcagggcca

SEQ ID NO: 6070731 - DNA, 23 bp, Homo sapiens
cctaaccatgggctcagggccag

SEQ ID NO: 6070732 - DNA, 16 bp, Homo sapiens
cctaaccccagggcac

SEQ ID NO: 6070733 - DNA, 15 bp, Homo sapiens
cctaacccccagtcc

SEQ ID NO: 6070734 - DNA, 14 bp, Homo sapiens
cctaaccccttcca

SEQ ID NO: 6070735 - DNA, 15 bp, Homo sapiens
cctaaccccttccag

SEQ ID NO: 6070736 - DNA, 14 bp, Homo sapiens
cctaaccctctgtc

SEQ ID NO: 6070737 - DNA, 12 bp, Homo sapiens
cctaaccctggc

SEQ ID NO: 6070738 - DNA, 20 bp, Homo sapiens
cctaaccctgggctccctgg

SEQ ID NO: 6070739 - DNA, 14 bp, Homo sapiens
cctaacctgtgtct

SEQ ID NO: 6070740 - DNA, 13 bp, Homo sapiens
cctaactcatact

SEQ ID NO: 6070741 - DNA, 15 bp, Homo sapiens
cctaactcatactgt

SEQ ID NO: 6070742 - DNA, 18 bp, Homo sapiens
cctaactcatactgtgct

SEQ ID NO: 6070743 - DNA, 20 bp, Homo sapiens
cctaactcttttctattttg

SEQ ID NO: 6070744 - DNA, 16 bp, Homo sapiens
cctaactgaagagaca

SEQ ID NO: 6070745 - DNA, 13 bp, Homo sapiens
cctaactgagctg

SEQ ID NO: 6070746 - DNA, 15 bp, Homo sapiens
cctaactgagctgcc

SEQ ID NO: 6070747 - DNA, 23 bp, Homo sapiens
cctaactgatttccatccaaacc

SEQ ID NO: 6070748 - DNA, 13 bp, Homo sapiens
cctaacttattgc

SEQ ID NO: 6070749 - DNA, 23 bp, Homo sapiens
cctaacttattgcctgggcagtg

SEQ ID NO: 6070750 - DNA, 20 bp, Homo sapiens
cctaacttcctgtgcctttc

SEQ ID NO: 6070751 - DNA, 14 bp, Homo sapiens
cctaacttccttta

SEQ ID NO: 6070752 - DNA, 21 bp, Homo sapiens
cctaacttgtgaagacaatga

SEQ ID NO: 6070753 - DNA, 15 bp, Homo sapiens
cctaagaaaaaggaa

SEQ ID NO: 6070754 - DNA, 23 bp, Homo sapiens
cctaagaaaccccagggcaggga

SEQ ID NO: 6070755 - DNA, 12 bp, Homo sapiens
cctaagaagaag

SEQ ID NO: 6070756 - DNA, 17 bp, Homo sapiens
cctaagaagaaggccag

SEQ ID NO: 6070757 - DNA, 13 bp, Homo sapiens
cctaagaagctct

SEQ ID NO: 6070758 - DNA, 22 bp, Homo sapiens
cctaagaagctctggccccagg

SEQ ID NO: 6070759 - DNA, 14 bp, Homo sapiens
cctaagaatagact

SEQ ID NO: 6070760 - DNA, 16 bp, Homo sapiens
cctaagaattcccaga

SEQ ID NO: 6070761 - DNA, 14 bp, Homo sapiens
cctaagacatgtga

SEQ ID NO: 6070762 - DNA, 23 bp, Homo sapiens
cctaagacatgtgaggaggaaaa

SEQ ID NO: 6070763 - DNA, 14 bp, Homo sapiens
cctaagacattttt

SEQ ID NO: 6070764 - DNA, 15 bp, Homo sapiens
cctaagacctggggt

SEQ ID NO: 6070765 - DNA, 22 bp, Homo sapiens
cctaagactaacaaaggcagct

SEQ ID NO: 6070766 - DNA, 18 bp, Homo sapiens
cctaagactgccttcagt

SEQ ID NO: 6070767 - DNA, 21 bp, Homo sapiens
cctaagacttcagtcctggtc

SEQ ID NO: 6070768 - DNA, 19 bp, Homo sapiens
cctaagagacacatacaga

SEQ ID NO: 6070769 - DNA, 15 bp, Homo sapiens
cctaagagagcacct

SEQ ID NO: 6070770 - DNA, 12 bp, Homo sapiens
cctaagaggctg

SEQ ID NO: 6070771 - DNA, 14 bp, Homo sapiens
cctaagaggctgcc

SEQ ID NO: 6070772 - DNA, 15 bp, Homo sapiens
cctaagagtggagga

SEQ ID NO: 6070773 - DNA, 12 bp, Homo sapiens
cctaagagtgtt

SEQ ID NO: 6070774 - DNA, 18 bp, Homo sapiens
cctaagagttgagctctc

SEQ ID NO: 6070775 - DNA, 19 bp, Homo sapiens
cctaagatgtgttcttatt

SEQ ID NO: 6070776 - DNA, 23 bp, Homo sapiens
cctaagcaaacccagtgtcagga

SEQ ID NO: 6070777 - DNA, 18 bp, Homo sapiens
cctaagcaatcactgggc

SEQ ID NO: 6070778 - DNA, 20 bp, Homo sapiens
cctaagcaatcactgggccc

SEQ ID NO: 6070779 - DNA, 17 bp, Homo sapiens
cctaagcagaaagtgcc

SEQ ID NO: 6070780 - DNA, 19 bp, Homo sapiens
cctaagcagaaagtgcctt

SEQ ID NO: 6070781 - DNA, 23 bp, Homo sapiens
cctaagcagaaagtgcctttcag

SEQ ID NO: 6070782 - DNA, 16 bp, Homo sapiens
cctaagcattgcctgg

SEQ ID NO: 6070783 - DNA, 17 bp, Homo sapiens
cctaagcattgcctggc

SEQ ID NO: 6070784 - DNA, 16 bp, Homo sapiens
cctaagccacttgaaa

SEQ ID NO: 6070785 - DNA, 13 bp, Homo sapiens
cctaagccagcct

SEQ ID NO: 6070786 - DNA, 15 bp, Homo sapiens
cctaagccagcctgg

SEQ ID NO: 6070787 - DNA, 17 bp, Homo sapiens
cctaagccagctgcccc

SEQ ID NO: 6070788 - DNA, 16 bp, Homo sapiens
cctaagcccccagggc

SEQ ID NO: 6070789 - DNA, 23 bp, Homo sapiens
cctaagcccccagggcctccagg

SEQ ID NO: 6070790 - DNA, 21 bp, Homo sapiens
cctaagccccgtcccctaacc

SEQ ID NO: 6070791 - DNA, 14 bp, Homo sapiens
cctaagccctgccc

SEQ ID NO: 6070792 - DNA, 18 bp, Homo sapiens
cctaagcctgtccccaga

SEQ ID NO: 6070793 - DNA, 19 bp, Homo sapiens
cctaagcctgtccccagac

SEQ ID NO: 6070794 - DNA, 12 bp, Homo sapiens
cctaagcctgtt

SEQ ID NO: 6070795 - DNA, 20 bp, Homo sapiens
cctaagcggctgtttactgc

SEQ ID NO: 6070796 - DNA, 17 bp, Homo sapiens
cctaagctccaggtgcc

SEQ ID NO: 6070797 - DNA, 20 bp, Homo sapiens
cctaagctccaggtgccctg

SEQ ID NO: 6070798 - DNA, 20 bp, Homo sapiens
cctaagcttctagaggctca

SEQ ID NO: 6070799 - DNA, 23 bp, Homo sapiens
cctaagcttctagaggctcatgg

SEQ ID NO: 6070800 - DNA, 12 bp, Homo sapiens
cctaaggaagct

SEQ ID NO: 6070801 - DNA, 16 bp, Homo sapiens
cctaaggacttcttta

SEQ ID NO: 6070802 - DNA, 18 bp, Homo sapiens
cctaaggacttctttaat

SEQ ID NO: 6070803 - DNA, 16 bp, Homo sapiens
cctaaggatctctcag

SEQ ID NO: 6070804 - DNA, 15 bp, Homo sapiens
ccatttatcttgaag

SEQ ID NO: 6070805 - DNA, 14 bp, Homo sapiens
ccatttatggtacc

SEQ ID NO: 6070806 - DNA, 23 bp, Homo sapiens
ccatttatgtgtagaatttgaaa

SEQ ID NO: 6070807 - DNA, 20 bp, Homo sapiens
ccatttattattttaatatt

SEQ ID NO: 6070808 - DNA, 23 bp, Homo sapiens
ccatttattattttaatatttat

SEQ ID NO: 6070809 - DNA, 12 bp, Homo sapiens
ccatttatttat

SEQ ID NO: 6070810 - DNA, 15 bp, Homo sapiens
ccatttatttcctca

SEQ ID NO: 6070811 - DNA, 17 bp, Homo sapiens
ccatttcaactccagaa

SEQ ID NO: 6070812 - DNA, 16 bp, Homo sapiens
ccatttcacacaggtc

SEQ ID NO: 6070813 - DNA, 22 bp, Homo sapiens
ccatttcacacctgaaaatgtt

SEQ ID NO: 6070814 - DNA, 13 bp, Homo sapiens
ccatttcacagaa

SEQ ID NO: 6070815 - DNA, 23 bp, Homo sapiens
ccatttcacattcctgaccctca

SEQ ID NO: 6070816 - DNA, 13 bp, Homo sapiens
ccatttcagagag

SEQ ID NO: 6070817 - DNA, 17 bp, Homo sapiens
ccatttcaggaatttaa

SEQ ID NO: 6070818 - DNA, 19 bp, Homo sapiens
ccatttcatattctttcaa

SEQ ID NO: 6070819 - DNA, 16 bp, Homo sapiens
ccatttcatctatttc

SEQ ID NO: 6070820 - DNA, 21 bp, Homo sapiens
ccatttcatctatttctgaga

SEQ ID NO: 6070821 - DNA, 16 bp, Homo sapiens
ccatttcatgtgatct

SEQ ID NO: 6070822 - DNA, 15 bp, Homo sapiens
ccatttccagttcat

SEQ ID NO: 6070823 - DNA, 15 bp, Homo sapiens
ccatttccattgctt

SEQ ID NO: 6070824 - DNA, 13 bp, Homo sapiens
ccatttcccatct

SEQ ID NO: 6070825 - DNA, 14 bp, Homo sapiens
ccatttcccatctg

SEQ ID NO: 6070826 - DNA, 15 bp, Homo sapiens
ccatttcccatctgc

SEQ ID NO: 6070827 - DNA, 17 bp, Homo sapiens
ccatttcccatctgcac

SEQ ID NO: 6070828 - DNA, 18 bp, Homo sapiens
ccatttcccatctgcacc

SEQ ID NO: 6070829 - DNA, 15 bp, Homo sapiens
ccatttccccagggc

SEQ ID NO: 6070830 - DNA, 11 bp, Homo sapiens
ccatttccctt

SEQ ID NO: 6070831 - DNA, 15 bp, Homo sapiens
ccatttcctcctggg

SEQ ID NO: 6070832 - DNA, 19 bp, Homo sapiens
ccatttcctcttccttctc

SEQ ID NO: 6070833 - DNA, 13 bp, Homo sapiens
ccatttcctgatc

SEQ ID NO: 6070834 - DNA, 15 bp, Homo sapiens
ccatttcctgtctgg

SEQ ID NO: 6070835 - DNA, 18 bp, Homo sapiens
ccatttccttggaggcca

SEQ ID NO: 6070836 - DNA, 22 bp, Homo sapiens
ccatttccttggaggccaccgg

SEQ ID NO: 6070837 - DNA, 20 bp, Homo sapiens
ccatttccttgtctaaagat

SEQ ID NO: 6070838 - DNA, 20 bp, Homo sapiens
ccatttccttttctctgccc

SEQ ID NO: 6070839 - DNA, 19 bp, Homo sapiens
ccatttctaaaggcctctt

SEQ ID NO: 6070840 - DNA, 23 bp, Homo sapiens
ccatttctaattatgtagctctt

SEQ ID NO: 6070841 - DNA, 21 bp, Homo sapiens
ccatttctaccaaggcatatc

SEQ ID NO: 6070842 - DNA, 14 bp, Homo sapiens
ccatttctatttat

SEQ ID NO: 6070843 - DNA, 14 bp, Homo sapiens
ccatttctcaggga

SEQ ID NO: 6070844 - DNA, 15 bp, Homo sapiens
ccatttctctcctca

SEQ ID NO: 6070845 - DNA, 19 bp, Homo sapiens
ccatttctgaactgttaca

SEQ ID NO: 6070846 - DNA, 14 bp, Homo sapiens
ccatttctgccttt

SEQ ID NO: 6070847 - DNA, 14 bp, Homo sapiens
ccatttctgttgct

SEQ ID NO: 6070848 - DNA, 22 bp, Homo sapiens
ccatttctgttgctggaggggc

SEQ ID NO: 6070849 - DNA, 12 bp, Homo sapiens
ccatttcttata

SEQ ID NO: 6070850 - DNA, 16 bp, Homo sapiens
ccatttcttatttaat

SEQ ID NO: 6070851 - DNA, 13 bp, Homo sapiens
ccatttcttcaga

SEQ ID NO: 6070852 - DNA, 18 bp, Homo sapiens
ccatttcttctctctgtt

SEQ ID NO: 6070853 - DNA, 16 bp, Homo sapiens
ccatttcttcttcttc

SEQ ID NO: 6070854 - DNA, 16 bp, Homo sapiens
ccatttcttgctagct

SEQ ID NO: 6070855 - DNA, 16 bp, Homo sapiens
ccatttctttcttcca

SEQ ID NO: 6070856 - DNA, 15 bp, Homo sapiens
ccatttgaaagaaag

SEQ ID NO: 6070857 - DNA, 16 bp, Homo sapiens
ccatttgaacacatta

SEQ ID NO: 6070858 - DNA, 12 bp, Homo sapiens
ccatttgatacc

SEQ ID NO: 6070859 - DNA, 21 bp, Homo sapiens
ccatttgatacccctggggaa

SEQ ID NO: 6070860 - DNA, 19 bp, Homo sapiens
ccatttgcaataacagctg

SEQ ID NO: 6070861 - DNA, 21 bp, Homo sapiens
ccatttgcaataacagctgca

SEQ ID NO: 6070862 - DNA, 22 bp, Homo sapiens
ccatttgcaataacagctgcaa

SEQ ID NO: 6070863 - DNA, 17 bp, Homo sapiens
ccatttgccatgctgct

SEQ ID NO: 6070864 - DNA, 13 bp, Homo sapiens
ccatttgccccaa

SEQ ID NO: 6070865 - DNA, 21 bp, Homo sapiens
ccatttgcgttccatgatgct

SEQ ID NO: 6070866 - DNA, 20 bp, Homo sapiens
ccatttgctagttctgctgc

SEQ ID NO: 6070867 - DNA, 12 bp, Homo sapiens
ccatttgctgcc

SEQ ID NO: 6070868 - DNA, 16 bp, Homo sapiens
ccatttggaatcatat

SEQ ID NO: 6070869 - DNA, 18 bp, Homo sapiens
ccatttggagggcctggg

SEQ ID NO: 6070870 - DNA, 21 bp, Homo sapiens
ccatttggagggcctgggcct

SEQ ID NO: 6070871 - DNA, 23 bp, Homo sapiens
ccatttggatcctgtgtggagag

SEQ ID NO: 6070872 - DNA, 16 bp, Homo sapiens
ccatttggcagaactg

SEQ ID NO: 6070873 - DNA, 20 bp, Homo sapiens
ccatttggcagaactgctgg

SEQ ID NO: 6070874 - DNA, 19 bp, Homo sapiens
ccatttggcagagcttctt

SEQ ID NO: 6070875 - DNA, 19 bp, Homo sapiens
ccatttggccggctctggt

SEQ ID NO: 6070876 - DNA, 13 bp, Homo sapiens
ccatttgggctct

SEQ ID NO: 6070877 - DNA, 16 bp, Homo sapiens
ccatttgggctctggt

SEQ ID NO: 6070878 - DNA, 21 bp, Homo sapiens
ccatttggtgtggattttcta

SEQ ID NO: 6070879 - DNA, 14 bp, Homo sapiens
ccatttgtaatgta

SEQ ID NO: 6070880 - DNA, 14 bp, Homo sapiens
ccatttgtaatttg

SEQ ID NO: 6070881 - DNA, 13 bp, Homo sapiens
ccatttgtactga

SEQ ID NO: 6070882 - DNA, 13 bp, Homo sapiens
ccatttgtattca

SEQ ID NO: 6070883 - DNA, 17 bp, Homo sapiens
ccatttgtatttgtatt

SEQ ID NO: 6070884 - DNA, 22 bp, Homo sapiens
ccatttgtcatcgttccccacc

SEQ ID NO: 6070885 - DNA, 17 bp, Homo sapiens
ccatttgtcccaagtgc

SEQ ID NO: 6070886 - DNA, 14 bp, Homo sapiens
ccatttgtcccaga

SEQ ID NO: 6070887 - DNA, 17 bp, Homo sapiens
ccatttgtcccagacta

SEQ ID NO: 6070888 - DNA, 13 bp, Homo sapiens
ccatttgtctgtg

SEQ ID NO: 6070889 - DNA, 15 bp, Homo sapiens
ccatttgtgccagag

SEQ ID NO: 6070890 - DNA, 21 bp, Homo sapiens
ccatttgtgtacacagtcagc

SEQ ID NO: 6070891 - DNA, 17 bp, Homo sapiens
ccatttgttaatatcac

SEQ ID NO: 6070892 - DNA, 20 bp, Homo sapiens
ccatttgttcctgcttccga

SEQ ID NO: 6070893 - DNA, 15 bp, Homo sapiens
ccatttgttgctgct

SEQ ID NO: 6070894 - DNA, 14 bp, Homo sapiens
ccattttaaagaag

SEQ ID NO: 6070895 - DNA, 13 bp, Homo sapiens
ccattttaaattt

SEQ ID NO: 6070896 - DNA, 17 bp, Homo sapiens
ccattttaacgctgcct

SEQ ID NO: 6070897 - DNA, 12 bp, Homo sapiens
ccattttaactt

SEQ ID NO: 6070898 - DNA, 15 bp, Homo sapiens
ccattttaagaaaac

SEQ ID NO: 6070899 - DNA, 22 bp, Homo sapiens
ccattttaaggtagccctctca

SEQ ID NO: 6070900 - DNA, 15 bp, Homo sapiens
ccattttaagtccct

SEQ ID NO: 6070901 - DNA, 12 bp, Homo sapiens
ccattttaataa

SEQ ID NO: 6070902 - DNA, 19 bp, Homo sapiens
ccattttacgttttagaaa

SEQ ID NO: 6070903 - DNA, 15 bp, Homo sapiens
ccattttataccaaa

SEQ ID NO: 6070904 - DNA, 12 bp, Homo sapiens
ccattttatgca

SEQ ID NO: 6070905 - DNA, 20 bp, Homo sapiens
ccattttattaaacattttc

SEQ ID NO: 6070906 - DNA, 19 bp, Homo sapiens
ccattttattttatatgat

SEQ ID NO: 6070907 - DNA, 18 bp, Homo sapiens
ccattttattttttgggc

SEQ ID NO: 6070908 - DNA, 15 bp, Homo sapiens
ccattttcatcctga

SEQ ID NO: 6070909 - DNA, 14 bp, Homo sapiens
ccattttcctttgg

SEQ ID NO: 6070910 - DNA, 16 bp, Homo sapiens
ccattttctaaactgt

SEQ ID NO: 6070911 - DNA, 18 bp, Homo sapiens
ccattttctaagggtaga

SEQ ID NO: 6070912 - DNA, 22 bp, Homo sapiens
ccattttctctattctttccat

SEQ ID NO: 6070913 - DNA, 13 bp, Homo sapiens
ccattttctgtgg

SEQ ID NO: 6070914 - DNA, 23 bp, Homo sapiens
ccattttcttattgcgctgctac

SEQ ID NO: 6070915 - DNA, 20 bp, Homo sapiens
ccattttcttctctgtgaag

SEQ ID NO: 6070916 - DNA, 21 bp, Homo sapiens
ccattttcttctctgtgaagt

SEQ ID NO: 6070917 - DNA, 19 bp, Homo sapiens
ccattttcttgcctgaggc

SEQ ID NO: 6070918 - DNA, 13 bp, Homo sapiens
ccattttctttac

SEQ ID NO: 6070919 - DNA, 17 bp, Homo sapiens
ccattttgcaaaatttc

SEQ ID NO: 6070920 - DNA, 16 bp, Homo sapiens
ccattttgcccttcca

SEQ ID NO: 6070921 - DNA, 18 bp, Homo sapiens
ccattttgcgatgtgttt

SEQ ID NO: 6070922 - DNA, 12 bp, Homo sapiens
ccattttggaaa

SEQ ID NO: 6070923 - DNA, 14 bp, Homo sapiens
ccattttggaaaat

SEQ ID NO: 6070924 - DNA, 21 bp, Homo sapiens
ccattttggtgtctttctctt

SEQ ID NO: 6070925 - DNA, 13 bp, Homo sapiens
ccattttgtaact

SEQ ID NO: 6070926 - DNA, 21 bp, Homo sapiens
ccattttgtaactgcctacca

SEQ ID NO: 6070927 - DNA, 12 bp, Homo sapiens
ccattttgtcag

SEQ ID NO: 6070928 - DNA, 21 bp, Homo sapiens
ccattttgtctggctgtggcc

SEQ ID NO: 6070929 - DNA, 13 bp, Homo sapiens
ccattttgtgaag

SEQ ID NO: 6070930 - DNA, 19 bp, Homo sapiens
ccattttgtgaagccctgt

SEQ ID NO: 6070931 - DNA, 14 bp, Homo sapiens
ccattttgtgaatg

SEQ ID NO: 6070932 - DNA, 18 bp, Homo sapiens
ccattttgttattgacta

SEQ ID NO: 6070933 - DNA, 16 bp, Homo sapiens
ccatttttaaccactt

SEQ ID NO: 6070934 - DNA, 14 bp, Homo sapiens
ccatttttaatgat

SEQ ID NO: 6070935 - DNA, 18 bp, Homo sapiens
ccatttttactaaagcag

SEQ ID NO: 6070936 - DNA, 20 bp, Homo sapiens
ccatttttactaaagcagtg

SEQ ID NO: 6070937 - DNA, 22 bp, Homo sapiens
ccatttttactaaagcagtgtt

SEQ ID NO: 6070938 - DNA, 20 bp, Homo sapiens
ccatttttagctctgatcag

SEQ ID NO: 6070939 - DNA, 15 bp, Homo sapiens
ccatttttcaaagca

SEQ ID NO: 6070940 - DNA, 17 bp, Homo sapiens
ccatttttcaaagcaat

SEQ ID NO: 6070941 - DNA, 22 bp, Homo sapiens
ccatttttcagtagcaggacct

SEQ ID NO: 6070942 - DNA, 14 bp, Homo sapiens
ccatttttcccagg

SEQ ID NO: 6070943 - DNA, 16 bp, Homo sapiens
ccatttttcccaggac

SEQ ID NO: 6070944 - DNA, 15 bp, Homo sapiens
ccatttttctataaa

SEQ ID NO: 6070945 - DNA, 14 bp, Homo sapiens
ccatttttctgggg

SEQ ID NO: 6070946 - DNA, 19 bp, Homo sapiens
ccatttttcttccaggatg

SEQ ID NO: 6070947 - DNA, 22 bp, Homo sapiens
ccatttttcttccaggatggtg

SEQ ID NO: 6070948 - DNA, 15 bp, Homo sapiens
ccatttttgagccaa

SEQ ID NO: 6070949 - DNA, 18 bp, Homo sapiens
ccatttttgctaattatc

SEQ ID NO: 6070950 - DNA, 20 bp, Homo sapiens
ccatttttgctctatgggaa

SEQ ID NO: 6070951 - DNA, 21 bp, Homo sapiens
ccatttttgctgaattcatct

SEQ ID NO: 6070952 - DNA, 18 bp, Homo sapiens
ccattttttaatttactt

SEQ ID NO: 6070953 - DNA, 17 bp, Homo sapiens
ccattttttatatttca

SEQ ID NO: 6070954 - DNA, 20 bp, Homo sapiens
ccattttttatatttcaagt

SEQ ID NO: 6070955 - DNA, 12 bp, Homo sapiens
ccattttttcct

SEQ ID NO: 6070956 - DNA, 15 bp, Homo sapiens
ccatttttttcttta

SEQ ID NO: 6070957 - DNA, 15 bp, Homo sapiens
ccattttttttttct

SEQ ID NO: 6070958 - DNA, 11 bp, Homo sapiens
cccaaaaaagc

SEQ ID NO: 6070959 - DNA, 21 bp, Homo sapiens
cccaaaacaccgggttccagc

SEQ ID NO: 6070960 - DNA, 11 bp, Homo sapiens
cccaaaacagc

SEQ ID NO: 6070961 - DNA, 16 bp, Homo sapiens
cccaaaacctcatgac

SEQ ID NO: 6070962 - DNA, 23 bp, Homo sapiens
cccaaaacctttccccagacaca

SEQ ID NO: 6070963 - DNA, 18 bp, Homo sapiens
cccaaaactctcctctgc

SEQ ID NO: 6070964 - DNA, 13 bp, Homo sapiens
cccaaaagactcc

SEQ ID NO: 6070965 - DNA, 16 bp, Homo sapiens
cccaaaagagggcaca

SEQ ID NO: 6070966 - DNA, 13 bp, Homo sapiens
cccaaaagccatg

SEQ ID NO: 6070967 - DNA, 15 bp, Homo sapiens
cccaaaaggaaggag

SEQ ID NO: 6070968 - DNA, 13 bp, Homo sapiens
cccaaaaggcaga

SEQ ID NO: 6070969 - DNA, 18 bp, Homo sapiens
cccaaaaggcagaagcaa

SEQ ID NO: 6070970 - DNA, 12 bp, Homo sapiens
cccaaaagtgtc

SEQ ID NO: 6070971 - DNA, 17 bp, Homo sapiens
cccaaacaaatatgcaa

SEQ ID NO: 6070972 - DNA, 20 bp, Homo sapiens
cccaaacaaatatgcaaaag

SEQ ID NO: 6070973 - DNA, 14 bp, Homo sapiens
cccaaacaccctcc

SEQ ID NO: 6070974 - DNA, 16 bp, Homo sapiens
cccaaacacttctgct

SEQ ID NO: 6070975 - DNA, 22 bp, Homo sapiens
cccaaacacttctgctttcact

SEQ ID NO: 6070976 - DNA, 15 bp, Homo sapiens
cccaaacagcatgtg

SEQ ID NO: 6070977 - DNA, 17 bp, Homo sapiens
cccaaaccaccagaagc

SEQ ID NO: 6070978 - DNA, 18 bp, Homo sapiens
cccaaaccaccagaagcc

SEQ ID NO: 6070979 - DNA, 19 bp, Homo sapiens
cccaaaccagcccagagca

SEQ ID NO: 6070980 - DNA, 12 bp, Homo sapiens
cccaaaccaggg

SEQ ID NO: 6070981 - DNA, 21 bp, Homo sapiens
cccaaaccattactgagggga

SEQ ID NO: 6070982 - DNA, 12 bp, Homo sapiens
cccaaaccccag

SEQ ID NO: 6070983 - DNA, 22 bp, Homo sapiens
cccaaaccccctgcagcccagg

SEQ ID NO: 6070984 - DNA, 13 bp, Homo sapiens
cccaaaccctagg

SEQ ID NO: 6070985 - DNA, 22 bp, Homo sapiens
cctaaggatctctcaggagcac

SEQ ID NO: 6070986 - DNA, 23 bp, Homo sapiens
cctaaggcacccacaaataaatg

SEQ ID NO: 6070987 - DNA, 17 bp, Homo sapiens
cctaaggcagacaggaa

SEQ ID NO: 6070988 - DNA, 19 bp, Homo sapiens
cctaaggcagacaggaagg

SEQ ID NO: 6070989 - DNA, 22 bp, Homo sapiens
cctaaggcagacaggaaggaag

SEQ ID NO: 6070990 - DNA, 23 bp, Homo sapiens
cctaaggcatctatctgtgctag

SEQ ID NO: 6070991 - DNA, 11 bp, Homo sapiens
cctaaggcatg

SEQ ID NO: 6070992 - DNA, 22 bp, Homo sapiens
cctaaggcatgtgtgaaacata

SEQ ID NO: 6070993 - DNA, 19 bp, Homo sapiens
cctaaggcccagctgccag

SEQ ID NO: 6070994 - DNA, 11 bp, Homo sapiens
cctaaggctgc

SEQ ID NO: 6070995 - DNA, 12 bp, Homo sapiens
cctaaggctgca

SEQ ID NO: 6070996 - DNA, 14 bp, Homo sapiens
cctaaggctgctgt

SEQ ID NO: 6070997 - DNA, 15 bp, Homo sapiens
cctaagggagtgttt

SEQ ID NO: 6070998 - DNA, 18 bp, Homo sapiens
cctaagggatcctgcctg

SEQ ID NO: 6070999 - DNA, 15 bp, Homo sapiens
cctaagggcagccct

SEQ ID NO: 6071000 - DNA, 19 bp, Homo sapiens
cctaagggctcaccgtggc

SEQ ID NO: 6071001 - DNA, 23 bp, Homo sapiens
cctaagggtcgaaagctctagaa

SEQ ID NO: 6071002 - DNA, 15 bp, Homo sapiens
cctaaggttcttgct

SEQ ID NO: 6071003 - DNA, 16 bp, Homo sapiens
cctaaggttcttgctt

SEQ ID NO: 6071004 - DNA, 20 bp, Homo sapiens
cctaaggttttgttgtgttc

SEQ ID NO: 6071005 - DNA, 19 bp, Homo sapiens
cctaagtaagtttcttcct

SEQ ID NO: 6071006 - DNA, 16 bp, Homo sapiens
cctaagtactgtaata

SEQ ID NO: 6071007 - DNA, 14 bp, Homo sapiens
cctaagtacttaaa

SEQ ID NO: 6071008 - DNA, 16 bp, Homo sapiens
cctaagtattaaaaca

SEQ ID NO: 6071009 - DNA, 18 bp, Homo sapiens
cctaagtattaaaacatt

SEQ ID NO: 6071010 - DNA, 14 bp, Homo sapiens
cctaagtcccttcc

SEQ ID NO: 6071011 - DNA, 16 bp, Homo sapiens
cctaagtcctttatgt

SEQ ID NO: 6071012 - DNA, 18 bp, Homo sapiens
cctaagtcctttatgtgg

SEQ ID NO: 6071013 - DNA, 14 bp, Homo sapiens
cctaagtctctgtg

SEQ ID NO: 6071014 - DNA, 19 bp, Homo sapiens
cctaagtgatttccacagg

SEQ ID NO: 6071015 - DNA, 19 bp, Homo sapiens
cctaagtgcaaacacagca

SEQ ID NO: 6071016 - DNA, 18 bp, Homo sapiens
cctaagtgcccaaagtgg

SEQ ID NO: 6071017 - DNA, 18 bp, Homo sapiens
cctaagtggattggcttt

SEQ ID NO: 6071018 - DNA, 16 bp, Homo sapiens
cctaagtggctgctga

SEQ ID NO: 6071019 - DNA, 18 bp, Homo sapiens
cctaagtgttgaagaaga

SEQ ID NO: 6071020 - DNA, 17 bp, Homo sapiens
cctaagttacctttcta

SEQ ID NO: 6071021 - DNA, 15 bp, Homo sapiens
cctaagttattacct

SEQ ID NO: 6071022 - DNA, 15 bp, Homo sapiens
cctaagttccttccc

SEQ ID NO: 6071023 - DNA, 20 bp, Homo sapiens
cctaagtttcagttgatttt

SEQ ID NO: 6071024 - DNA, 12 bp, Homo sapiens
cctaagtttctt

SEQ ID NO: 6071025 - DNA, 16 bp, Homo sapiens
cctaataaaaaggtga

SEQ ID NO: 6071026 - DNA, 16 bp, Homo sapiens
cctaataaaactgatg

SEQ ID NO: 6071027 - DNA, 21 bp, Homo sapiens
cctaataaaactgatgtgaaa

SEQ ID NO: 6071028 - DNA, 22 bp, Homo sapiens
cctaataaacatccttcaagaa

SEQ ID NO: 6071029 - DNA, 16 bp, Homo sapiens
cctaataaagttctgt

SEQ ID NO: 6071030 - DNA, 15 bp, Homo sapiens
cctaataagtccaca

SEQ ID NO: 6071031 - DNA, 19 bp, Homo sapiens
cctaataatatcccactgg

SEQ ID NO: 6071032 - DNA, 21 bp, Homo sapiens
cctaataattgtatctacatt

SEQ ID NO: 6071033 - DNA, 14 bp, Homo sapiens
cctaatagaaagaa

SEQ ID NO: 6071034 - DNA, 11 bp, Homo sapiens
cctaatatcat

SEQ ID NO: 6071035 - DNA, 14 bp, Homo sapiens
cctaatatcatttt

SEQ ID NO: 6071036 - DNA, 20 bp, Homo sapiens
cctaatattcatgctgcctg

SEQ ID NO: 6071037 - DNA, 21 bp, Homo sapiens
cctaatattgaaaatgtcact

SEQ ID NO: 6071038 - DNA, 20 bp, Homo sapiens
cctaatcaaattctgtctgg

SEQ ID NO: 6071039 - DNA, 22 bp, Homo sapiens
cctaatcagaaatttttatcag

SEQ ID NO: 6071040 - DNA, 17 bp, Homo sapiens
cctaatcaggctgaggt

SEQ ID NO: 6071041 - DNA, 18 bp, Homo sapiens
cctaatcatataccagag

SEQ ID NO: 6071042 - DNA, 21 bp, Homo sapiens
cctaatccaggcagatccagg

SEQ ID NO: 6071043 - DNA, 20 bp, Homo sapiens
cctaatcccttcctctccca

SEQ ID NO: 6071044 - DNA, 14 bp, Homo sapiens
cctaatctcatacc

SEQ ID NO: 6071045 - DNA, 13 bp, Homo sapiens
cctaatctctgta

SEQ ID NO: 6071046 - DNA, 17 bp, Homo sapiens
cctaatctgctgccaga

SEQ ID NO: 6071047 - DNA, 12 bp, Homo sapiens
cctaatgaaagt

SEQ ID NO: 6071048 - DNA, 22 bp, Homo sapiens
cctaatgacatcaccacagttt

SEQ ID NO: 6071049 - DNA, 15 bp, Homo sapiens
cctaatgaggtagct

SEQ ID NO: 6071050 - DNA, 21 bp, Homo sapiens
cctaatgcgcaggctggccct

SEQ ID NO: 6071051 - DNA, 19 bp, Homo sapiens
cctaatggagaagacccac

SEQ ID NO: 6071052 - DNA, 20 bp, Homo sapiens
cctaatggcatggagactct

SEQ ID NO: 6071053 - DNA, 19 bp, Homo sapiens
cctaatgtctcactgttct

SEQ ID NO: 6071054 - DNA, 13 bp, Homo sapiens
cctaatgtgttta

SEQ ID NO: 6071055 - DNA, 18 bp, Homo sapiens
cctaatgtttatgagcca

SEQ ID NO: 6071056 - DNA, 18 bp, Homo sapiens
cctaattaaaaactgtga

SEQ ID NO: 6071057 - DNA, 21 bp, Homo sapiens
cctaattaatatattaaaatt

SEQ ID NO: 6071058 - DNA, 14 bp, Homo sapiens
cctaattagagcag

SEQ ID NO: 6071059 - DNA, 14 bp, Homo sapiens
cctaattcaatcct

SEQ ID NO: 6071060 - DNA, 15 bp, Homo sapiens
cctaattcatctttt

SEQ ID NO: 6071061 - DNA, 16 bp, Homo sapiens
cctaattcatctttta

SEQ ID NO: 6071062 - DNA, 18 bp, Homo sapiens
cctaattcgatgaaggct

SEQ ID NO: 6071063 - DNA, 17 bp, Homo sapiens
cctaattctatgcctgt

SEQ ID NO: 6071064 - DNA, 15 bp, Homo sapiens
cctaattcttcatag

SEQ ID NO: 6071065 - DNA, 15 bp, Homo sapiens
cctaattcttctgtc

SEQ ID NO: 6071066 - DNA, 11 bp, Homo sapiens
cctaattgaaa

SEQ ID NO: 6071067 - DNA, 13 bp, Homo sapiens
cctaattgaaatt

SEQ ID NO: 6071068 - DNA, 19 bp, Homo sapiens
cctaattggaaagtgccag

SEQ ID NO: 6071069 - DNA, 15 bp, Homo sapiens
cctaattgtcacatc

SEQ ID NO: 6071070 - DNA, 21 bp, Homo sapiens
cctaattgtcacatcaagcat

SEQ ID NO: 6071071 - DNA, 14 bp, Homo sapiens
cctaatttatgtgc

SEQ ID NO: 6071072 - DNA, 18 bp, Homo sapiens
cctaatttctcctccctt

SEQ ID NO: 6071073 - DNA, 23 bp, Homo sapiens
cctaatttctcctcccttccttt

SEQ ID NO: 6071074 - DNA, 16 bp, Homo sapiens
cctaatttgcccttca

SEQ ID NO: 6071075 - DNA, 16 bp, Homo sapiens
cctaatttttttcctg

SEQ ID NO: 6071076 - DNA, 22 bp, Homo sapiens
cctacaaaaaaacctttattct

SEQ ID NO: 6071077 - DNA, 13 bp, Homo sapiens
cctacaaaagctt

SEQ ID NO: 6071078 - DNA, 22 bp, Homo sapiens
cctacaaaagcttgtgtatctt

SEQ ID NO: 6071079 - DNA, 13 bp, Homo sapiens
cctacaaaatgga

SEQ ID NO: 6071080 - DNA, 14 bp, Homo sapiens
cctacaaatcagta

SEQ ID NO: 6071081 - DNA, 16 bp, Homo sapiens
cctacaaccccagcct

SEQ ID NO: 6071082 - DNA, 21 bp, Homo sapiens
cctacaagagcagcctgtggc

SEQ ID NO: 6071083 - DNA, 18 bp, Homo sapiens
cctacaaggagataagaa

SEQ ID NO: 6071084 - DNA, 21 bp, Homo sapiens
cctacaagttgatcatgcagg

SEQ ID NO: 6071085 - DNA, 16 bp, Homo sapiens
cctacaataaactggt

SEQ ID NO: 6071086 - DNA, 16 bp, Homo sapiens
cctacaatgggaaaac

SEQ ID NO: 6071087 - DNA, 11 bp, Homo sapiens
cctacacacac

SEQ ID NO: 6071088 - DNA, 12 bp, Homo sapiens
cctacacacaca

SEQ ID NO: 6071089 - DNA, 14 bp, Homo sapiens
cctacacacacact

SEQ ID NO: 6071090 - DNA, 15 bp, Homo sapiens
cctacacacacactc

SEQ ID NO: 6071091 - DNA, 16 bp, Homo sapiens
cctacacacacagcct

SEQ ID NO: 6071092 - DNA, 12 bp, Homo sapiens
cctacacacacc

SEQ ID NO: 6071093 - DNA, 14 bp, Homo sapiens
cctacacacaccca

SEQ ID NO: 6071094 - DNA, 14 bp, Homo sapiens
cctacacacagacc

SEQ ID NO: 6071095 - DNA, 20 bp, Homo sapiens
cctacacacagaccgcgccc

SEQ ID NO: 6071096 - DNA, 21 bp, Homo sapiens
cctacacacgtaccttcatgt

SEQ ID NO: 6071097 - DNA, 14 bp, Homo sapiens
cctacacactgtca

SEQ ID NO: 6071098 - DNA, 15 bp, Homo sapiens
cctacacactgtcat

SEQ ID NO: 6071099 - DNA, 22 bp, Homo sapiens
cctacacactgtcatgcttcat

SEQ ID NO: 6071100 - DNA, 11 bp, Homo sapiens
cctacacagga

SEQ ID NO: 6071101 - DNA, 17 bp, Homo sapiens
cctacacaggacagggg

SEQ ID NO: 6071102 - DNA, 13 bp, Homo sapiens
cctacacaggagt

SEQ ID NO: 6071103 - DNA, 15 bp, Homo sapiens
cctacaccaactgct

SEQ ID NO: 6071104 - DNA, 13 bp, Homo sapiens
cctacacccctgt

SEQ ID NO: 6071105 - DNA, 15 bp, Homo sapiens
cctacacctctgggc

SEQ ID NO: 6071106 - DNA, 16 bp, Homo sapiens
cctacacctctgggcc

SEQ ID NO: 6071107 - DNA, 21 bp, Homo sapiens
cctacacctctgggccctgca

SEQ ID NO: 6071108 - DNA, 18 bp, Homo sapiens
cctacactcacctgcact

SEQ ID NO: 6071109 - DNA, 19 bp, Homo sapiens
cctacagaaaaaccttggg

SEQ ID NO: 6071110 - DNA, 21 bp, Homo sapiens
cctacagaaaaaccttgggtt

SEQ ID NO: 6071111 - DNA, 17 bp, Homo sapiens
cctacagaaatactgct

SEQ ID NO: 6071112 - DNA, 16 bp, Homo sapiens
cctacagacaaggagg

SEQ ID NO: 6071113 - DNA, 20 bp, Homo sapiens
cctacagacagacatacata

SEQ ID NO: 6071114 - DNA, 22 bp, Homo sapiens
cctacagacagtatgtctactc

SEQ ID NO: 6071115 - DNA, 15 bp, Homo sapiens
cctacagaggaggcc

SEQ ID NO: 6071116 - DNA, 15 bp, Homo sapiens
cctacagaggtctct

SEQ ID NO: 6071117 - DNA, 16 bp, Homo sapiens
cctacagatagtcaaa

SEQ ID NO: 6071118 - DNA, 15 bp, Homo sapiens
cctacagcactactg

SEQ ID NO: 6071119 - DNA, 20 bp, Homo sapiens
cctacagcactactgggtgt

SEQ ID NO: 6071120 - DNA, 11 bp, Homo sapiens
cctacagcaga

SEQ ID NO: 6071121 - DNA, 23 bp, Homo sapiens
cctacagcagatccacctgcaca

SEQ ID NO: 6071122 - DNA, 12 bp, Homo sapiens
cctacagcagca

SEQ ID NO: 6071123 - DNA, 20 bp, Homo sapiens
cctacagcctgcacacacct

SEQ ID NO: 6071124 - DNA, 19 bp, Homo sapiens
cctacagcttgaccgtgag

SEQ ID NO: 6071125 - DNA, 12 bp, Homo sapiens
cctacaggactg

SEQ ID NO: 6071126 - DNA, 21 bp, Homo sapiens
cctacaggcagtctctctctt

SEQ ID NO: 6071127 - DNA, 21 bp, Homo sapiens
cctacagggaactgggaagat

SEQ ID NO: 6071128 - DNA, 15 bp, Homo sapiens
cctacagggggtgga

SEQ ID NO: 6071129 - DNA, 13 bp, Homo sapiens
cctacagtacaat

SEQ ID NO: 6071130 - DNA, 22 bp, Homo sapiens
cctacagtgactccctgggagc

SEQ ID NO: 6071131 - DNA, 15 bp, Homo sapiens
cctacagtggaggga

SEQ ID NO: 6071132 - DNA, 17 bp, Homo sapiens
cctacagtggagggaga

SEQ ID NO: 6071133 - DNA, 18 bp, Homo sapiens
cctacagtggagggagac

SEQ ID NO: 6071134 - DNA, 20 bp, Homo sapiens
cctacagtgtacagtcttgt

SEQ ID NO: 6071135 - DNA, 15 bp, Homo sapiens
cctacagttttaact

SEQ ID NO: 6071136 - DNA, 21 bp, Homo sapiens
cctacagttttaactgtggat

SEQ ID NO: 6071137 - DNA, 21 bp, Homo sapiens
cctacatatgctgatctttta

SEQ ID NO: 6071138 - DNA, 15 bp, Homo sapiens
cctacatatttgtat

SEQ ID NO: 6071139 - DNA, 15 bp, Homo sapiens
cctacatccccaggt

SEQ ID NO: 6071140 - DNA, 13 bp, Homo sapiens
cctacatctgaaa

SEQ ID NO: 6071141 - DNA, 21 bp, Homo sapiens
cctacatcttcagctcccata

SEQ ID NO: 6071142 - DNA, 14 bp, Homo sapiens
cctacatgttattc

SEQ ID NO: 6071143 - DNA, 16 bp, Homo sapiens
cctacattccaccctg

SEQ ID NO: 6071144 - DNA, 21 bp, Homo sapiens
cctacattccaccctgttact

SEQ ID NO: 6071145 - DNA, 18 bp, Homo sapiens
cctacattccccagagtg

SEQ ID NO: 6071146 - DNA, 18 bp, Homo sapiens
cctacattccctctcctg

SEQ ID NO: 6071147 - DNA, 15 bp, Homo sapiens
cctacattccctggc

SEQ ID NO: 6071148 - DNA, 19 bp, Homo sapiens
cctacattctttattctgc

SEQ ID NO: 6071149 - DNA, 12 bp, Homo sapiens
cctaccaaaaat

SEQ ID NO: 6071150 - DNA, 16 bp, Homo sapiens
cctaccaatattaggt

SEQ ID NO: 6071151 - DNA, 19 bp, Homo sapiens
cctaccaatctctgctctc

SEQ ID NO: 6071152 - DNA, 22 bp, Homo sapiens
cctaccaatgcatgcagccact

SEQ ID NO: 6071153 - DNA, 13 bp, Homo sapiens
cctaccacagctg

SEQ ID NO: 6071154 - DNA, 13 bp, Homo sapiens
cctaccacctccc

SEQ ID NO: 6071155 - DNA, 18 bp, Homo sapiens
cctaccacctccccagcc

SEQ ID NO: 6071156 - DNA, 19 bp, Homo sapiens
cctaccactgagcccttgc

SEQ ID NO: 6071157 - DNA, 17 bp, Homo sapiens
cctaccactgtggcccc

SEQ ID NO: 6071158 - DNA, 15 bp, Homo sapiens
cctaccagaaggaaa

SEQ ID NO: 6071159 - DNA, 17 bp, Homo sapiens
cctaccagatgccagtc

SEQ ID NO: 6071160 - DNA, 23 bp, Homo sapiens
cctaccagcgcccgctgggctga

SEQ ID NO: 6071161 - DNA, 20 bp, Homo sapiens
cctaccagctcctccagccc

SEQ ID NO: 6071162 - DNA, 21 bp, Homo sapiens
cctaccagtcgccctctgtgc

SEQ ID NO: 6071163 - DNA, 23 bp, Homo sapiens
cctaccagtcgccctctgtgcct

SEQ ID NO: 6071164 - DNA, 16 bp, Homo sapiens
cctaccatcagggaca

SEQ ID NO: 6071165 - DNA, 14 bp, Homo sapiens
cctaccatgctgct

SEQ ID NO: 6071166 - DNA, 19 bp, Homo sapiens
cctacccaatgtctcccac

SEQ ID NO: 6071167 - DNA, 20 bp, Homo sapiens
cctacccaatgtctcccaca

SEQ ID NO: 6071168 - DNA, 22 bp, Homo sapiens
cctacccaatgtctcccacacc

SEQ ID NO: 6071169 - DNA, 13 bp, Homo sapiens
cctacccacacct

SEQ ID NO: 6071170 - DNA, 18 bp, Homo sapiens
cctacccacacctctgcc

SEQ ID NO: 6071171 - DNA, 14 bp, Homo sapiens
cctacccacagggc

SEQ ID NO: 6071172 - DNA, 13 bp, Homo sapiens
cctacccaccctc

SEQ ID NO: 6071173 - DNA, 18 bp, Homo sapiens
cctacccaccctcctttc

SEQ ID NO: 6071174 - DNA, 14 bp, Homo sapiens
cctacccactcttt

SEQ ID NO: 6071175 - DNA, 16 bp, Homo sapiens
cctacccactctttgc

SEQ ID NO: 6071176 - DNA, 19 bp, Homo sapiens
cctacccagcgtggcccag

SEQ ID NO: 6071177 - DNA, 20 bp, Homo sapiens
cctacccagttgcctccagg

SEQ ID NO: 6071178 - DNA, 19 bp, Homo sapiens
cctacccatccccgcagtg

SEQ ID NO: 6071179 - DNA, 21 bp, Homo sapiens
cctaccccacaccaggccgtc

SEQ ID NO: 6071180 - DNA, 13 bp, Homo sapiens
cctaccccaccac

SEQ ID NO: 6071181 - DNA, 14 bp, Homo sapiens
cctaccccaccacg

SEQ ID NO: 6071182 - DNA, 13 bp, Homo sapiens
cctaccccacctc

SEQ ID NO: 6071183 - DNA, 21 bp, Homo sapiens
cctaccccagggccctggcca

SEQ ID NO: 6071184 - DNA, 22 bp, Homo sapiens
cctaccccagggccctggccag

SEQ ID NO: 6071185 - DNA, 22 bp, Homo sapiens
cctaccccagttcatctctgct

SEQ ID NO: 6071186 - DNA, 14 bp, Homo sapiens
cctaccccagttcc

SEQ ID NO: 6071187 - DNA, 22 bp, Homo sapiens
cctaccccatggtgctaggaag

SEQ ID NO: 6071188 - DNA, 14 bp, Homo sapiens
cctacccccacaac

SEQ ID NO: 6071189 - DNA, 17 bp, Homo sapiens
cctaccccctcatcccc

SEQ ID NO: 6071190 - DNA, 17 bp, Homo sapiens
cctaccccctcctctct

SEQ ID NO: 6071191 - DNA, 19 bp, Homo sapiens
cctaccccctcctctctgc

SEQ ID NO: 6071192 - DNA, 20 bp, Homo sapiens
cctaccccgcagacaccttg

SEQ ID NO: 6071193 - DNA, 18 bp, Homo sapiens
cctacccctcttccagct

SEQ ID NO: 6071194 - DNA, 20 bp, Homo sapiens
cctacccctcttccagcttc

SEQ ID NO: 6071195 - DNA, 15 bp, Homo sapiens
cctacccctgccctg

SEQ ID NO: 6071196 - DNA, 15 bp, Homo sapiens
cctacccctgtcctg

SEQ ID NO: 6071197 - DNA, 13 bp, Homo sapiens
cctaccccttcct

SEQ ID NO: 6071198 - DNA, 16 bp, Homo sapiens
cctaccccttcctgtc

SEQ ID NO: 6071199 - DNA, 18 bp, Homo sapiens
cctacccctttctccagc

SEQ ID NO: 6071200 - DNA, 17 bp, Homo sapiens
cctacccgcccgcgtcc

SEQ ID NO: 6071201 - DNA, 17 bp, Homo sapiens
cctacccggctcgttcc

SEQ ID NO: 6071202 - DNA, 16 bp, Homo sapiens
cctaccctacccccac

SEQ ID NO: 6071203 - DNA, 15 bp, Homo sapiens
cctaccctcaaagta

SEQ ID NO: 6071204 - DNA, 13 bp, Homo sapiens
cctaccctcactc

SEQ ID NO: 6071205 - DNA, 13 bp, Homo sapiens
cctaccctcctgc

SEQ ID NO: 6071206 - DNA, 15 bp, Homo sapiens
cctaccctccttcca

SEQ ID NO: 6071207 - DNA, 23 bp, Homo sapiens
cctaccctggcagggacctgaga

SEQ ID NO: 6071208 - DNA, 17 bp, Homo sapiens
cctacccttgtacccca

SEQ ID NO: 6071209 - DNA, 19 bp, Homo sapiens
cctaccgagtctcttctcc

SEQ ID NO: 6071210 - DNA, 16 bp, Homo sapiens
cctaccgatggtccca

SEQ ID NO: 6071211 - DNA, 15 bp, Homo sapiens
cctaccgcatggcag

SEQ ID NO: 6071212 - DNA, 19 bp, Homo sapiens
cctaccgcatggcagctgg

SEQ ID NO: 6071213 - DNA, 21 bp, Homo sapiens
cctaccgcatggcagctgggc

SEQ ID NO: 6071214 - DNA, 20 bp, Homo sapiens
cctaccgggttctcctgatt

SEQ ID NO: 6071215 - DNA, 19 bp, Homo sapiens
cctaccgtactccctgcac

SEQ ID NO: 6071216 - DNA, 18 bp, Homo sapiens
cctacctcaacctgtaaa

SEQ ID NO: 6071217 - DNA, 15 bp, Homo sapiens
cctacctcaagttct

SEQ ID NO: 6071218 - DNA, 12 bp, Homo sapiens
cctacctcagcc

SEQ ID NO: 6071219 - DNA, 12 bp, Homo sapiens
cctacctcaggt

SEQ ID NO: 6071220 - DNA, 12 bp, Homo sapiens
cctacctccctc

SEQ ID NO: 6071221 - DNA, 13 bp, Homo sapiens
cctacctccctcc

SEQ ID NO: 6071222 - DNA, 18 bp, Homo sapiens
cctacctccctcctcagg

SEQ ID NO: 6071223 - DNA, 15 bp, Homo sapiens
cctacctctgtctga

SEQ ID NO: 6071224 - DNA, 21 bp, Homo sapiens
cctacctgattggtgcaaccc

SEQ ID NO: 6071225 - DNA, 16 bp, Homo sapiens
cctacctgcctgttct

SEQ ID NO: 6071226 - DNA, 12 bp, Homo sapiens
cctacctgcctt

SEQ ID NO: 6071227 - DNA, 14 bp, Homo sapiens
cctacctgctgctg

SEQ ID NO: 6071228 - DNA, 18 bp, Homo sapiens
cctacctggggactcctc

SEQ ID NO: 6071229 - DNA, 19 bp, Homo sapiens
cctacctggggactcctca

SEQ ID NO: 6071230 - DNA, 20 bp, Homo sapiens
cctacctggggactcctcaa

SEQ ID NO: 6071231 - DNA, 20 bp, Homo sapiens
cctacctggtcaacccgctg

SEQ ID NO: 6071232 - DNA, 20 bp, Homo sapiens
cctacctgtctgctgccagc

SEQ ID NO: 6071233 - DNA, 21 bp, Homo sapiens
cctacctgtctgctgccagca

SEQ ID NO: 6071234 - DNA, 14 bp, Homo sapiens
cctacctgtgcctg

SEQ ID NO: 6071235 - DNA, 16 bp, Homo sapiens
cctacctgtgcctgac

SEQ ID NO: 6071236 - DNA, 17 bp, Homo sapiens
cctacctgttcagtgtc

SEQ ID NO: 6071237 - DNA, 18 bp, Homo sapiens
cctaccttactatttaaa

SEQ ID NO: 6071238 - DNA, 17 bp, Homo sapiens
cctaccttatagagcac

SEQ ID NO: 6071239 - DNA, 19 bp, Homo sapiens
cctaccttatagagcacaa

SEQ ID NO: 6071240 - DNA, 14 bp, Homo sapiens
cctaccttccccag

SEQ ID NO: 6071241 - DNA, 16 bp, Homo sapiens
cctaccttggtcctgc

SEQ ID NO: 6071242 - DNA, 18 bp, Homo sapiens
cctacgcagatgctgtca

SEQ ID NO: 6071243 - DNA, 14 bp, Homo sapiens
cctacgccaggaga

SEQ ID NO: 6071244 - DNA, 17 bp, Homo sapiens
cctacgctcatctctgg

SEQ ID NO: 6071245 - DNA, 22 bp, Homo sapiens
cctacgggcgctgcagcctccc

SEQ ID NO: 6071246 - DNA, 13 bp, Homo sapiens
cctacgtgctgcc

SEQ ID NO: 6071247 - DNA, 17 bp, Homo sapiens
cctacgttcctggcccc

SEQ ID NO: 6071248 - DNA, 19 bp, Homo sapiens
cctacgttcctggccccct

SEQ ID NO: 6071249 - DNA, 20 bp, Homo sapiens
cctactaaaaaagttattat

SEQ ID NO: 6071250 - DNA, 17 bp, Homo sapiens
cctactaagaagtttaa

SEQ ID NO: 6071251 - DNA, 15 bp, Homo sapiens
cctactaataaacca

SEQ ID NO: 6071252 - DNA, 17 bp, Homo sapiens
cctactacatcgccctc

SEQ ID NO: 6071253 - DNA, 12 bp, Homo sapiens
cctactattggc

SEQ ID NO: 6071254 - DNA, 14 bp, Homo sapiens
cctactcacacagg

SEQ ID NO: 6071255 - DNA, 15 bp, Homo sapiens
cctactcacacaggc

SEQ ID NO: 6071256 - DNA, 16 bp, Homo sapiens
cctactcacacaggca

SEQ ID NO: 6071257 - DNA, 22 bp, Homo sapiens
cctactcacacaggcatttcct

SEQ ID NO: 6071258 - DNA, 15 bp, Homo sapiens
cctactccactgccc

SEQ ID NO: 6071259 - DNA, 17 bp, Homo sapiens
cctactccactgccctg

SEQ ID NO: 6071260 - DNA, 23 bp, Homo sapiens
cctactccctccaattccccctt

SEQ ID NO: 6071261 - DNA, 20 bp, Homo sapiens
cctactccctcttcactgtg

SEQ ID NO: 6071262 - DNA, 18 bp, Homo sapiens
cctactccctcttccaaa

SEQ ID NO: 6071263 - DNA, 17 bp, Homo sapiens
cctactccgctcactga

SEQ ID NO: 6071264 - DNA, 14 bp, Homo sapiens
cctactccgttcct

SEQ ID NO: 6071265 - DNA, 15 bp, Homo sapiens
cctactcctacctgg

SEQ ID NO: 6071266 - DNA, 15 bp, Homo sapiens
cctactcctgtcttc

SEQ ID NO: 6071267 - DNA, 16 bp, Homo sapiens
cctactcctgtcttct

SEQ ID NO: 6071268 - DNA, 20 bp, Homo sapiens
cctactcctgtcttctgctt

SEQ ID NO: 6071269 - DNA, 18 bp, Homo sapiens
cctactcggctctgcagt

SEQ ID NO: 6071270 - DNA, 13 bp, Homo sapiens
cctactctcaggt

SEQ ID NO: 6071271 - DNA, 15 bp, Homo sapiens
cctactctgggaaga

SEQ ID NO: 6071272 - DNA, 13 bp, Homo sapiens
cctactctgtgta

SEQ ID NO: 6071273 - DNA, 22 bp, Homo sapiens
cctactctgtgtaaatattttt

SEQ ID NO: 6071274 - DNA, 19 bp, Homo sapiens
cctactcttctctctgctc

SEQ ID NO: 6071275 - DNA, 22 bp, Homo sapiens
cctactgaaccctgcctcttgt

SEQ ID NO: 6071276 - DNA, 13 bp, Homo sapiens
cctactgaatgct

SEQ ID NO: 6071277 - DNA, 18 bp, Homo sapiens
cctactgagcatttgcac

SEQ ID NO: 6071278 - DNA, 22 bp, Homo sapiens
cctactgagcatttgcacctct

SEQ ID NO: 6071279 - DNA, 21 bp, Homo sapiens
cctactgagtactctttctct

SEQ ID NO: 6071280 - DNA, 19 bp, Homo sapiens
cctactgcactttccccct

SEQ ID NO: 6071281 - DNA, 12 bp, Homo sapiens
cctactgcccac

SEQ ID NO: 6071282 - DNA, 22 bp, Homo sapiens
cctactgcccctgccctgagga

SEQ ID NO: 6071283 - DNA, 17 bp, Homo sapiens
cctactgcttcctctga

SEQ ID NO: 6071284 - DNA, 16 bp, Homo sapiens
cctactggacgctgcc

SEQ ID NO: 6071285 - DNA, 19 bp, Homo sapiens
cctactggacgctgccctg

SEQ ID NO: 6071286 - DNA, 17 bp, Homo sapiens
cctactgggagactggg

SEQ ID NO: 6071287 - DNA, 22 bp, Homo sapiens
cctactgtccctctcagtgcct

SEQ ID NO: 6071288 - DNA, 23 bp, Homo sapiens
cctactgtctccttcccactgtc

SEQ ID NO: 6071289 - DNA, 18 bp, Homo sapiens
cctactgtggggagagat

SEQ ID NO: 6071290 - DNA, 13 bp, Homo sapiens
cctactgtgtctt

SEQ ID NO: 6071291 - DNA, 14 bp, Homo sapiens
cctactgttccttt

SEQ ID NO: 6071292 - DNA, 23 bp, Homo sapiens
cctactgttctaaagctctgaca

SEQ ID NO: 6071293 - DNA, 22 bp, Homo sapiens
cctactgttggatgtatgtgtg

SEQ ID NO: 6071294 - DNA, 13 bp, Homo sapiens
cctacttaaacaa

SEQ ID NO: 6071295 - DNA, 18 bp, Homo sapiens
cctacttaaacaaaaact

SEQ ID NO: 6071296 - DNA, 22 bp, Homo sapiens
cctacttagatatttcatgtgc

SEQ ID NO: 6071297 - DNA, 15 bp, Homo sapiens
cctacttagggaaga

SEQ ID NO: 6071298 - DNA, 16 bp, Homo sapiens
cctacttagggaagaa

SEQ ID NO: 6071299 - DNA, 23 bp, Homo sapiens
cctacttagggaagaaaaagcaa

SEQ ID NO: 6071300 - DNA, 15 bp, Homo sapiens
cctacttcacagagg

SEQ ID NO: 6071301 - DNA, 13 bp, Homo sapiens
cctacttcccctt

SEQ ID NO: 6071302 - DNA, 16 bp, Homo sapiens
cctacttccccttcct

SEQ ID NO: 6071303 - DNA, 15 bp, Homo sapiens
cctacttcctgtgac

SEQ ID NO: 6071304 - DNA, 22 bp, Homo sapiens
cctacttctcagtccccttcaa

SEQ ID NO: 6071305 - DNA, 22 bp, Homo sapiens
cctacttctctgagtcagctga

SEQ ID NO: 6071306 - DNA, 23 bp, Homo sapiens
cctacttctttgctttgcccagc

SEQ ID NO: 6071307 - DNA, 19 bp, Homo sapiens
cctacttgagataatctaa

SEQ ID NO: 6071308 - DNA, 15 bp, Homo sapiens
cctactttagccact

SEQ ID NO: 6071309 - DNA, 20 bp, Homo sapiens
cctactttatgtatggagct

SEQ ID NO: 6071310 - DNA, 14 bp, Homo sapiens
cctactttctattt

SEQ ID NO: 6071311 - DNA, 14 bp, Homo sapiens
cctactttgcttct

SEQ ID NO: 6071312 - DNA, 15 bp, Homo sapiens
cctactttgcttctc

SEQ ID NO: 6071313 - DNA, 13 bp, Homo sapiens
cctacttttcttt

SEQ ID NO: 6071314 - DNA, 23 bp, Homo sapiens
cctactttttctttgattttcga

SEQ ID NO: 6071315 - DNA, 18 bp, Homo sapiens
cctagaaaacccttcccg

SEQ ID NO: 6071316 - DNA, 21 bp, Homo sapiens
cctagaaaacccttcccgccc

SEQ ID NO: 6071317 - DNA, 20 bp, Homo sapiens
cctagaaaagtttgttttac

SEQ ID NO: 6071318 - DNA, 19 bp, Homo sapiens
cctagaaacaacactgtag

SEQ ID NO: 6071319 - DNA, 18 bp, Homo sapiens
cctagaaacccaagctcc

SEQ ID NO: 6071320 - DNA, 13 bp, Homo sapiens
cctagaaagcaat

SEQ ID NO: 6071321 - DNA, 18 bp, Homo sapiens
cctagaaagcaatgtgat

SEQ ID NO: 6071322 - DNA, 20 bp, Homo sapiens
cctagaaagccatattccag

SEQ ID NO: 6071323 - DNA, 22 bp, Homo sapiens
cctagaaatatatcctgtgtac

SEQ ID NO: 6071324 - DNA, 18 bp, Homo sapiens
cctagaacatccctgggc

SEQ ID NO: 6071325 - DNA, 18 bp, Homo sapiens
cctagaaccaagcttcag

SEQ ID NO: 6071326 - DNA, 21 bp, Homo sapiens
cctagaaccaagcttcagagc

SEQ ID NO: 6071327 - DNA, 20 bp, Homo sapiens
cctagaagagcacagagccc

SEQ ID NO: 6071328 - DNA, 20 bp, Homo sapiens
cctagaagagtcaggaaggg

SEQ ID NO: 6071329 - DNA, 21 bp, Homo sapiens
cctagaagagtgtgaaaagga

SEQ ID NO: 6071330 - DNA, 22 bp, Homo sapiens
cctagaagatcacagcagggcc

SEQ ID NO: 6071331 - DNA, 13 bp, Homo sapiens
cctagaagggcta

SEQ ID NO: 6071332 - DNA, 17 bp, Homo sapiens
cctagaagtaagaagag

SEQ ID NO: 6071333 - DNA, 19 bp, Homo sapiens
cctagaagtctccctgcac

SEQ ID NO: 6071334 - DNA, 20 bp, Homo sapiens
cctagaagtctccctgcaca

SEQ ID NO: 6071335 - DNA, 19 bp, Homo sapiens
cctagaagttactgaatgc

SEQ ID NO: 6071336 - DNA, 23 bp, Homo sapiens
cctagaagttactgaatgcacca

SEQ ID NO: 6071337 - DNA, 22 bp, Homo sapiens
cctagaataatctcatcccccc

SEQ ID NO: 6071338 - DNA, 18 bp, Homo sapiens
cctagaatgtttcatttg

SEQ ID NO: 6071339 - DNA, 16 bp, Homo sapiens
cctagacaacctttct

SEQ ID NO: 6071340 - DNA, 21 bp, Homo sapiens
cctagacaataacccgaggga

SEQ ID NO: 6071341 - DNA, 13 bp, Homo sapiens
cctagaccagcag

SEQ ID NO: 6071342 - DNA, 18 bp, Homo sapiens
cctagaccagtttgcatg

SEQ ID NO: 6071343 - DNA, 20 bp, Homo sapiens
cccaaacccttaactgacat

SEQ ID NO: 6071344 - DNA, 12 bp, Homo sapiens
cccaaacctcca

SEQ ID NO: 6071345 - DNA, 12 bp, Homo sapiens
cccaaacctgga

SEQ ID NO: 6071346 - DNA, 13 bp, Homo sapiens
cccaaacctggag

SEQ ID NO: 6071347 - DNA, 13 bp, Homo sapiens
cccaaaccttggg

SEQ ID NO: 6071348 - DNA, 22 bp, Homo sapiens
cccaaacgccctttcctcctca

SEQ ID NO: 6071349 - DNA, 23 bp, Homo sapiens
cccaaacgccctttcctcctcag

SEQ ID NO: 6071350 - DNA, 13 bp, Homo sapiens
cccaaactcccct

SEQ ID NO: 6071351 - DNA, 17 bp, Homo sapiens
cccaaactccccttccc

SEQ ID NO: 6071352 - DNA, 21 bp, Homo sapiens
cccaaactccccttccctggg

SEQ ID NO: 6071353 - DNA, 13 bp, Homo sapiens
cccaaactccttt

SEQ ID NO: 6071354 - DNA, 12 bp, Homo sapiens
cccaaactgtga

SEQ ID NO: 6071355 - DNA, 16 bp, Homo sapiens
cccaaactttaaaatg

SEQ ID NO: 6071356 - DNA, 22 bp, Homo sapiens
cccaaacttttaaaagtaggaa

SEQ ID NO: 6071357 - DNA, 18 bp, Homo sapiens
cccaaagactctggaggt

SEQ ID NO: 6071358 - DNA, 14 bp, Homo sapiens
cccaaagagaaaga

SEQ ID NO: 6071359 - DNA, 21 bp, Homo sapiens
cccaaagagcacaaacatttt

SEQ ID NO: 6071360 - DNA, 18 bp, Homo sapiens
cccaaagagcctggagaa

SEQ ID NO: 6071361 - DNA, 19 bp, Homo sapiens
cccaaagatcccacgggag

SEQ ID NO: 6071362 - DNA, 15 bp, Homo sapiens
cccaaagatgcagcc

SEQ ID NO: 6071363 - DNA, 21 bp, Homo sapiens
cccaaagcaagcaagaggccg

SEQ ID NO: 6071364 - DNA, 22 bp, Homo sapiens
cccaaagcaagcacctgggtgt

SEQ ID NO: 6071365 - DNA, 14 bp, Homo sapiens
cccaaagcaggatg

SEQ ID NO: 6071366 - DNA, 18 bp, Homo sapiens
cccaaagccactggaagg

SEQ ID NO: 6071367 - DNA, 21 bp, Homo sapiens
cccaaagccactggaaggagc

SEQ ID NO: 6071368 - DNA, 17 bp, Homo sapiens
cccaaagcccagcccgg

SEQ ID NO: 6071369 - DNA, 12 bp, Homo sapiens
cccaaagccctg

SEQ ID NO: 6071370 - DNA, 15 bp, Homo sapiens
cccaaagcctgagga

SEQ ID NO: 6071371 - DNA, 15 bp, Homo sapiens
cccaaagctcagact

SEQ ID NO: 6071372 - DNA, 14 bp, Homo sapiens
cccaaagctgagcc

SEQ ID NO: 6071373 - DNA, 17 bp, Homo sapiens
cccaaagcttgtaaata

SEQ ID NO: 6071374 - DNA, 14 bp, Homo sapiens
cccaaagctttcct

SEQ ID NO: 6071375 - DNA, 16 bp, Homo sapiens
cccaaagctttcctgc

SEQ ID NO: 6071376 - DNA, 17 bp, Homo sapiens
cccaaaggaaaaagcac

SEQ ID NO: 6071377 - DNA, 13 bp, Homo sapiens
cccaaaggaaccg

SEQ ID NO: 6071378 - DNA, 23 bp, Homo sapiens
cccaaaggaagctttctctgctt

SEQ ID NO: 6071379 - DNA, 15 bp, Homo sapiens
cccaaaggacgcact

SEQ ID NO: 6071380 - DNA, 23 bp, Homo sapiens
cccaaaggatactgtaacacttt

SEQ ID NO: 6071381 - DNA, 15 bp, Homo sapiens
cccaaaggatgagaa

SEQ ID NO: 6071382 - DNA, 12 bp, Homo sapiens
cccaaaggccca

SEQ ID NO: 6071383 - DNA, 15 bp, Homo sapiens
cccaaaggcccaggg

SEQ ID NO: 6071384 - DNA, 18 bp, Homo sapiens
cccaaaggggacaggcct

SEQ ID NO: 6071385 - DNA, 20 bp, Homo sapiens
cccaaaggggacaggcctca

SEQ ID NO: 6071386 - DNA, 17 bp, Homo sapiens
cccaaaggtaggaaggt

SEQ ID NO: 6071387 - DNA, 18 bp, Homo sapiens
cccaaagtattcttcttt

SEQ ID NO: 6071388 - DNA, 20 bp, Homo sapiens
cccaaagtccccctcctcag

SEQ ID NO: 6071389 - DNA, 21 bp, Homo sapiens
cccaaagtccccctcctcagc

SEQ ID NO: 6071390 - DNA, 21 bp, Homo sapiens
cccaaagtcctctgctccagc

SEQ ID NO: 6071391 - DNA, 20 bp, Homo sapiens
cccaaagtgctgagattgca

SEQ ID NO: 6071392 - DNA, 10 bp, Homo sapiens
cccaaagtgg

SEQ ID NO: 6071393 - DNA, 15 bp, Homo sapiens
cccaaagtggggagg

SEQ ID NO: 6071394 - DNA, 22 bp, Homo sapiens
cccaaagtggggggtggacaca

SEQ ID NO: 6071395 - DNA, 21 bp, Homo sapiens
cccaaagtggtatagaaatgc

SEQ ID NO: 6071396 - DNA, 23 bp, Homo sapiens
cccaaagttgttgtaacctgctg

SEQ ID NO: 6071397 - DNA, 14 bp, Homo sapiens
cccaaataaatgtg

SEQ ID NO: 6071398 - DNA, 19 bp, Homo sapiens
cccaaatatgtattttcct

SEQ ID NO: 6071399 - DNA, 15 bp, Homo sapiens
cccaaatccgaacct

SEQ ID NO: 6071400 - DNA, 19 bp, Homo sapiens
cccaaatccgccagtgttt

SEQ ID NO: 6071401 - DNA, 23 bp, Homo sapiens
cccaaatccgccagtgtttctga

SEQ ID NO: 6071402 - DNA, 15 bp, Homo sapiens
cccaaatcctagact

SEQ ID NO: 6071403 - DNA, 14 bp, Homo sapiens
cccaaatctgccta

SEQ ID NO: 6071404 - DNA, 10 bp, Homo sapiens
cccaaatgat

SEQ ID NO: 6071405 - DNA, 16 bp, Homo sapiens
cccaaatgcagcttca

SEQ ID NO: 6071406 - DNA, 14 bp, Homo sapiens
cccaaatgctctct

SEQ ID NO: 6071407 - DNA, 19 bp, Homo sapiens
cccaaatgctctctcttct

SEQ ID NO: 6071408 - DNA, 22 bp, Homo sapiens
cccaaatggaaatgggcagagc

SEQ ID NO: 6071409 - DNA, 23 bp, Homo sapiens
cccaaatggaaatgggcagagca

SEQ ID NO: 6071410 - DNA, 21 bp, Homo sapiens
cccaaatggctagaacgtgtt

SEQ ID NO: 6071411 - DNA, 11 bp, Homo sapiens
cccaaatgtat

SEQ ID NO: 6071412 - DNA, 23 bp, Homo sapiens
cccaaattagggcaattggaaca

SEQ ID NO: 6071413 - DNA, 21 bp, Homo sapiens
cccaaattatcaagctaataa

SEQ ID NO: 6071414 - DNA, 13 bp, Homo sapiens
cccaaattcaaag

SEQ ID NO: 6071415 - DNA, 21 bp, Homo sapiens
cccaaattccctggacctctg

SEQ ID NO: 6071416 - DNA, 17 bp, Homo sapiens
cccaaattggtgtttct

SEQ ID NO: 6071417 - DNA, 17 bp, Homo sapiens
cccaacaaaccatccag

SEQ ID NO: 6071418 - DNA, 23 bp, Homo sapiens
cccaacaatactttgtgtctttt

SEQ ID NO: 6071419 - DNA, 18 bp, Homo sapiens
cccaacacaaggtgggca

SEQ ID NO: 6071420 - DNA, 15 bp, Homo sapiens
cccaacacctgcctc

SEQ ID NO: 6071421 - DNA, 16 bp, Homo sapiens
cccaacacctgcctct

SEQ ID NO: 6071422 - DNA, 15 bp, Homo sapiens
cccaacacctgctgc

SEQ ID NO: 6071423 - DNA, 18 bp, Homo sapiens
cccaacacgcaggagcac

SEQ ID NO: 6071424 - DNA, 13 bp, Homo sapiens
cccaacactgtgc

SEQ ID NO: 6071425 - DNA, 18 bp, Homo sapiens
cccaacactgtgccctgg

SEQ ID NO: 6071426 - DNA, 18 bp, Homo sapiens
cccaacacttttgggagg

SEQ ID NO: 6071427 - DNA, 18 bp, Homo sapiens
cccaacagaaggaaggag

SEQ ID NO: 6071428 - DNA, 12 bp, Homo sapiens
cccaacagccca

SEQ ID NO: 6071429 - DNA, 21 bp, Homo sapiens
cccaacagccttagctgccag

SEQ ID NO: 6071430 - DNA, 19 bp, Homo sapiens
cccaacaggaatttttaaa

SEQ ID NO: 6071431 - DNA, 19 bp, Homo sapiens
cccaacaggaggacaattc

SEQ ID NO: 6071432 - DNA, 20 bp, Homo sapiens
cccaacaggaggacaattca

SEQ ID NO: 6071433 - DNA, 12 bp, Homo sapiens
cccaacagttta

SEQ ID NO: 6071434 - DNA, 12 bp, Homo sapiens
cccaacatggga

SEQ ID NO: 6071435 - DNA, 19 bp, Homo sapiens
cccaacatgggagggatca

SEQ ID NO: 6071436 - DNA, 21 bp, Homo sapiens
cccaacatgggagggatcagc

SEQ ID NO: 6071437 - DNA, 15 bp, Homo sapiens
cccaacatggtccta

SEQ ID NO: 6071438 - DNA, 15 bp, Homo sapiens
cccaacatgttcaga

SEQ ID NO: 6071439 - DNA, 17 bp, Homo sapiens
cccaacatgttcagaaa

SEQ ID NO: 6071440 - DNA, 20 bp, Homo sapiens
cccaaccaactttcccccca

SEQ ID NO: 6071441 - DNA, 15 bp, Homo sapiens
cccaaccaaggaagg

SEQ ID NO: 6071442 - DNA, 12 bp, Homo sapiens
cccaaccagtgc

SEQ ID NO: 6071443 - DNA, 16 bp, Homo sapiens
cccaaccatcttcact

SEQ ID NO: 6071444 - DNA, 17 bp, Homo sapiens
cccaaccatcttcactg

SEQ ID NO: 6071445 - DNA, 17 bp, Homo sapiens
cccaaccatttcctcag

SEQ ID NO: 6071446 - DNA, 22 bp, Homo sapiens
cccaacccaatccctctccact

SEQ ID NO: 6071447 - DNA, 21 bp, Homo sapiens
cccaacccaattcaggactgg

SEQ ID NO: 6071448 - DNA, 13 bp, Homo sapiens
cccaacccacctc

SEQ ID NO: 6071449 - DNA, 15 bp, Homo sapiens
cccaacccacctctg

SEQ ID NO: 6071450 - DNA, 20 bp, Homo sapiens
cccaacccacctctggccct

SEQ ID NO: 6071451 - DNA, 15 bp, Homo sapiens
cccaaccccagggcc

SEQ ID NO: 6071452 - DNA, 14 bp, Homo sapiens
cccaacccccaccg

SEQ ID NO: 6071453 - DNA, 21 bp, Homo sapiens
cccaacccccaccgaagagcc

SEQ ID NO: 6071454 - DNA, 15 bp, Homo sapiens
cccaacccccacctc

SEQ ID NO: 6071455 - DNA, 19 bp, Homo sapiens
cccaacccccacctcccgg

SEQ ID NO: 6071456 - DNA, 18 bp, Homo sapiens
cccaacccccctcctgct

SEQ ID NO: 6071457 - DNA, 20 bp, Homo sapiens
cccaacccccctcctgctcc

SEQ ID NO: 6071458 - DNA, 21 bp, Homo sapiens
cccaacccccgcaccaagcag

SEQ ID NO: 6071459 - DNA, 22 bp, Homo sapiens
cccaacccccgcaccaagcaga

SEQ ID NO: 6071460 - DNA, 15 bp, Homo sapiens
cccaaccccctgcaa

SEQ ID NO: 6071461 - DNA, 15 bp, Homo sapiens
cccaacccctcctcc

SEQ ID NO: 6071462 - DNA, 19 bp, Homo sapiens
cccaacccctcctccctca

SEQ ID NO: 6071463 - DNA, 20 bp, Homo sapiens
cccaacccctcctccctcag

SEQ ID NO: 6071464 - DNA, 16 bp, Homo sapiens
cccaacccctccttcc

SEQ ID NO: 6071465 - DNA, 15 bp, Homo sapiens
cccaacccctctcca

SEQ ID NO: 6071466 - DNA, 18 bp, Homo sapiens
cccaacccctctccaggc

SEQ ID NO: 6071467 - DNA, 20 bp, Homo sapiens
cccaacccctctccaggcct

SEQ ID NO: 6071468 - DNA, 15 bp, Homo sapiens
cccaaccctcggagc

SEQ ID NO: 6071469 - DNA, 20 bp, Homo sapiens
cccaaccctgcccagcctga

SEQ ID NO: 6071470 - DNA, 15 bp, Homo sapiens
cccaaccctggcacc

SEQ ID NO: 6071471 - DNA, 14 bp, Homo sapiens
cccaaccctgtctg

SEQ ID NO: 6071472 - DNA, 20 bp, Homo sapiens
cccaacccttcttcatgttc

SEQ ID NO: 6071473 - DNA, 17 bp, Homo sapiens
cccaaccgggaaaggca

SEQ ID NO: 6071474 - DNA, 22 bp, Homo sapiens
cccaaccggggagcccccgccc

SEQ ID NO: 6071475 - DNA, 17 bp, Homo sapiens
cccaacctaagattgtg

SEQ ID NO: 6071476 - DNA, 15 bp, Homo sapiens
cccaacctcaatgcc

SEQ ID NO: 6071477 - DNA, 19 bp, Homo sapiens
cccaacctcaatgccctgc

SEQ ID NO: 6071478 - DNA, 12 bp, Homo sapiens
cccaacctcaga

SEQ ID NO: 6071479 - DNA, 12 bp, Homo sapiens
cccaacctcagc

SEQ ID NO: 6071480 - DNA, 21 bp, Homo sapiens
cccaacctcctgtgggcctca

SEQ ID NO: 6071481 - DNA, 19 bp, Homo sapiens
cccaacctcttcctcctga

SEQ ID NO: 6071482 - DNA, 21 bp, Homo sapiens
cccaacctcttcctcctgaca

SEQ ID NO: 6071483 - DNA, 13 bp, Homo sapiens
cccaacctgctct

SEQ ID NO: 6071484 - DNA, 16 bp, Homo sapiens
cccaacctgctctcct

SEQ ID NO: 6071485 - DNA, 21 bp, Homo sapiens
cccaacctgctctcctcttgc

SEQ ID NO: 6071486 - DNA, 19 bp, Homo sapiens
cccaacctggctccctccc

SEQ ID NO: 6071487 - DNA, 16 bp, Homo sapiens
cccaacctttccctca

SEQ ID NO: 6071488 - DNA, 17 bp, Homo sapiens
cccaacctttccctcac

SEQ ID NO: 6071489 - DNA, 20 bp, Homo sapiens
cccaacctttccctcacccc

SEQ ID NO: 6071490 - DNA, 21 bp, Homo sapiens
cccaacgagcctcctcagggg

SEQ ID NO: 6071491 - DNA, 15 bp, Homo sapiens
cccaacgcacaggaa

SEQ ID NO: 6071492 - DNA, 16 bp, Homo sapiens
cccaacgcacaggaaa

SEQ ID NO: 6071493 - DNA, 12 bp, Homo sapiens
cccaacgctcca

SEQ ID NO: 6071494 - DNA, 21 bp, Homo sapiens
cccaacgctgaagcggtcaga

SEQ ID NO: 6071495 - DNA, 24 bp, Homo sapiens
cccaacgctgaagcggtcagactg

SEQ ID NO: 6071496 - DNA, 20 bp, Homo sapiens
cccaacggccctgcagccag

SEQ ID NO: 6071497 - DNA, 14 bp, Homo sapiens
cccaacgggaaagg

SEQ ID NO: 6071498 - DNA, 19 bp, Homo sapiens
cccaacgggaaaggaaacg

SEQ ID NO: 6071499 - DNA, 15 bp, Homo sapiens
cccaacgtcccctcc

SEQ ID NO: 6071500 - DNA, 23 bp, Homo sapiens
cccaactacccccagctgtgctt

SEQ ID NO: 6071501 - DNA, 21 bp, Homo sapiens
cccaactcaagtgtcacctcc

SEQ ID NO: 6071502 - DNA, 20 bp, Homo sapiens
cccaactcaccccagcccca

SEQ ID NO: 6071503 - DNA, 17 bp, Homo sapiens
cccaactcactgtgctc

SEQ ID NO: 6071504 - DNA, 12 bp, Homo sapiens
cccaactcagcc

SEQ ID NO: 6071505 - DNA, 15 bp, Homo sapiens
cccaactccacaggg

SEQ ID NO: 6071506 - DNA, 13 bp, Homo sapiens
cccaactccagaa

SEQ ID NO: 6071507 - DNA, 16 bp, Homo sapiens
cccaactccaggggca

SEQ ID NO: 6071508 - DNA, 19 bp, Homo sapiens
cccaactccaggggcacct

SEQ ID NO: 6071509 - DNA, 17 bp, Homo sapiens
cccaactcccagccacc

SEQ ID NO: 6071510 - DNA, 22 bp, Homo sapiens
cccaactccctgccatttttta

SEQ ID NO: 6071511 - DNA, 22 bp, Homo sapiens
cccaactcccttctgcttgtcc

SEQ ID NO: 6071512 - DNA, 23 bp, Homo sapiens
cccaactcctggaagctgtgtcc

SEQ ID NO: 6071513 - DNA, 16 bp, Homo sapiens
cccaactccttccagc

SEQ ID NO: 6071514 - DNA, 17 bp, Homo sapiens
cccaactcgcctgtgga

SEQ ID NO: 6071515 - DNA, 16 bp, Homo sapiens
cccaactcgggctccc

SEQ ID NO: 6071516 - DNA, 21 bp, Homo sapiens
cccaactctagctgggggtgg

SEQ ID NO: 6071517 - DNA, 14 bp, Homo sapiens
cccaactctcccca

SEQ ID NO: 6071518 - DNA, 16 bp, Homo sapiens
cccaactctccccagt

SEQ ID NO: 6071519 - DNA, 15 bp, Homo sapiens
cccaactctcctgga

SEQ ID NO: 6071520 - DNA, 15 bp, Homo sapiens
cccaactctgagccc

SEQ ID NO: 6071521 - DNA, 19 bp, Homo sapiens
cccaactcttcctcccctc

SEQ ID NO: 6071522 - DNA, 16 bp, Homo sapiens
cctagaccctcctcct

SEQ ID NO: 6071523 - DNA, 19 bp, Homo sapiens
cctagacctaaacggctca

SEQ ID NO: 6071524 - DNA, 14 bp, Homo sapiens
cctagacctgggcc

SEQ ID NO: 6071525 - DNA, 22 bp, Homo sapiens
cctagaccttgcctcccctcct

SEQ ID NO: 6071526 - DNA, 14 bp, Homo sapiens
cctagactctccct

SEQ ID NO: 6071527 - DNA, 14 bp, Homo sapiens
cctagactgcatcc

SEQ ID NO: 6071528 - DNA, 19 bp, Homo sapiens
cctagactggtgctaatgt

SEQ ID NO: 6071529 - DNA, 17 bp, Homo sapiens
cctagacttctgagtaa

SEQ ID NO: 6071530 - DNA, 12 bp, Homo sapiens
cctagactttag

SEQ ID NO: 6071531 - DNA, 20 bp, Homo sapiens
cctagactttaggctttcag

SEQ ID NO: 6071532 - DNA, 23 bp, Homo sapiens
cctagactttaggctttcagctt

SEQ ID NO: 6071533 - DNA, 17 bp, Homo sapiens
cctagagaacgcagccc

SEQ ID NO: 6071534 - DNA, 21 bp, Homo sapiens
cctagagaatgggatgtgtga

SEQ ID NO: 6071535 - DNA, 22 bp, Homo sapiens
cctagagacagtgatgcctgcc

SEQ ID NO: 6071536 - DNA, 21 bp, Homo sapiens
cctagagactcagaggaccca

SEQ ID NO: 6071537 - DNA, 16 bp, Homo sapiens
cctagagagaataaat

SEQ ID NO: 6071538 - DNA, 21 bp, Homo sapiens
cctagagagaataaattggat

SEQ ID NO: 6071539 - DNA, 19 bp, Homo sapiens
cctagagagcagaaataaa

SEQ ID NO: 6071540 - DNA, 23 bp, Homo sapiens
cctagagagcagaaataaaaagc

SEQ ID NO: 6071541 - DNA, 13 bp, Homo sapiens
cctagagaggctg

SEQ ID NO: 6071542 - DNA, 20 bp, Homo sapiens
cctagagattcttagctctt

SEQ ID NO: 6071543 - DNA, 22 bp, Homo sapiens
cctagagcactctcaccccaag

SEQ ID NO: 6071544 - DNA, 13 bp, Homo sapiens
cctagagcctgcc

SEQ ID NO: 6071545 - DNA, 17 bp, Homo sapiens
cctagagcctgcctgga

SEQ ID NO: 6071546 - DNA, 18 bp, Homo sapiens
cctagagcctgcctggag

SEQ ID NO: 6071547 - DNA, 19 bp, Homo sapiens
cctagagcctgcctggagc

SEQ ID NO: 6071548 - DNA, 18 bp, Homo sapiens
cctagagctcctgtccct

SEQ ID NO: 6071549 - DNA, 15 bp, Homo sapiens
cctagaggagacagc

SEQ ID NO: 6071550 - DNA, 11 bp, Homo sapiens
cctagaggagg

SEQ ID NO: 6071551 - DNA, 23 bp, Homo sapiens
cctagaggattgtccaccttctg

SEQ ID NO: 6071552 - DNA, 24 bp, Homo sapiens
cctagaggattgtccaccttctgc

SEQ ID NO: 6071553 - DNA, 17 bp, Homo sapiens
cctagaggcagaggttg

SEQ ID NO: 6071554 - DNA, 18 bp, Homo sapiens
cctagaggcgagccaggc

SEQ ID NO: 6071555 - DNA, 22 bp, Homo sapiens
cctagaggctccagctctggca

SEQ ID NO: 6071556 - DNA, 15 bp, Homo sapiens
cctagagggaggggc

SEQ ID NO: 6071557 - DNA, 17 bp, Homo sapiens
cctagagggaggggcct

SEQ ID NO: 6071558 - DNA, 18 bp, Homo sapiens
cctagagggaggggccta

SEQ ID NO: 6071559 - DNA, 21 bp, Homo sapiens
cctagaggggacaagccaggc

SEQ ID NO: 6071560 - DNA, 15 bp, Homo sapiens
cctagaggtcccctc

SEQ ID NO: 6071561 - DNA, 16 bp, Homo sapiens
cctagaggtcccctca

SEQ ID NO: 6071562 - DNA, 20 bp, Homo sapiens
cctagaggtcccctcacgtg

SEQ ID NO: 6071563 - DNA, 17 bp, Homo sapiens
cctagaggtgggcagct

SEQ ID NO: 6071564 - DNA, 18 bp, Homo sapiens
cctagaggtgggcagctg

SEQ ID NO: 6071565 - DNA, 21 bp, Homo sapiens
cctagaggttctgggttttct

SEQ ID NO: 6071566 - DNA, 12 bp, Homo sapiens
cctagagtccca

SEQ ID NO: 6071567 - DNA, 13 bp, Homo sapiens
cctagagtgcagg

SEQ ID NO: 6071568 - DNA, 15 bp, Homo sapiens
cctagagtgtagcct

SEQ ID NO: 6071569 - DNA, 14 bp, Homo sapiens
cctagatatgaata

SEQ ID NO: 6071570 - DNA, 16 bp, Homo sapiens
cctagatatgaatata

SEQ ID NO: 6071571 - DNA, 21 bp, Homo sapiens
cctagatatgaatatatggca

SEQ ID NO: 6071572 - DNA, 21 bp, Homo sapiens
cctagatccacgtgtggcctc

SEQ ID NO: 6071573 - DNA, 20 bp, Homo sapiens
cctagatccaggcttctccc

SEQ ID NO: 6071574 - DNA, 14 bp, Homo sapiens
cctagatcctaagg

SEQ ID NO: 6071575 - DNA, 14 bp, Homo sapiens
cctagatctgcagg

SEQ ID NO: 6071576 - DNA, 16 bp, Homo sapiens
cctagatgcacgtggg

SEQ ID NO: 6071577 - DNA, 20 bp, Homo sapiens
cctagatgcacgtggggccc

SEQ ID NO: 6071578 - DNA, 15 bp, Homo sapiens
cctagatggttccct

SEQ ID NO: 6071579 - DNA, 22 bp, Homo sapiens
cctagatgtataactaggagct

SEQ ID NO: 6071580 - DNA, 19 bp, Homo sapiens
cctagattacatctgcctt

SEQ ID NO: 6071581 - DNA, 18 bp, Homo sapiens
cctagatttggagacttt

SEQ ID NO: 6071582 - DNA, 20 bp, Homo sapiens
cctagcaacatatctctgcc

SEQ ID NO: 6071583 - DNA, 21 bp, Homo sapiens
cctagcaacatatctctgccg

SEQ ID NO: 6071584 - DNA, 18 bp, Homo sapiens
cctagcaagctggcctct

SEQ ID NO: 6071585 - DNA, 17 bp, Homo sapiens
cctagcaatacagggag

SEQ ID NO: 6071586 - DNA, 18 bp, Homo sapiens
cctagcaatacagggagg

SEQ ID NO: 6071587 - DNA, 13 bp, Homo sapiens
cctagcaattcca

SEQ ID NO: 6071588 - DNA, 20 bp, Homo sapiens
cctagcacaaggagtgcccg

SEQ ID NO: 6071589 - DNA, 21 bp, Homo sapiens
cctagcacaaggagtgcccgc

SEQ ID NO: 6071590 - DNA, 22 bp, Homo sapiens
cctagcacaaggagtgcccgcc

SEQ ID NO: 6071591 - DNA, 14 bp, Homo sapiens
cctagcaccctgga

SEQ ID NO: 6071592 - DNA, 16 bp, Homo sapiens
cctagcaccctggaga

SEQ ID NO: 6071593 - DNA, 14 bp, Homo sapiens
cctagcactgcccc

SEQ ID NO: 6071594 - DNA, 17 bp, Homo sapiens
cctagcactgccccaca

SEQ ID NO: 6071595 - DNA, 19 bp, Homo sapiens
cctagcagacagaaactgg

SEQ ID NO: 6071596 - DNA, 13 bp, Homo sapiens
cctagcagagtgc

SEQ ID NO: 6071597 - DNA, 23 bp, Homo sapiens
cctagcagatatgtattactttt

SEQ ID NO: 6071598 - DNA, 15 bp, Homo sapiens
cctagcagcccaccc

SEQ ID NO: 6071599 - DNA, 17 bp, Homo sapiens
cctagcagcccaccctg

SEQ ID NO: 6071600 - DNA, 21 bp, Homo sapiens
cctagcaggaacttctagctc

SEQ ID NO: 6071601 - DNA, 13 bp, Homo sapiens
cctagcaggcaca

SEQ ID NO: 6071602 - DNA, 16 bp, Homo sapiens
cctagcaggcacagga

SEQ ID NO: 6071603 - DNA, 18 bp, Homo sapiens
cctagcaggcacaggaca

SEQ ID NO: 6071604 - DNA, 13 bp, Homo sapiens
cctagcaggctgt

SEQ ID NO: 6071605 - DNA, 19 bp, Homo sapiens
cctagcatacgtacacatt

SEQ ID NO: 6071606 - DNA, 21 bp, Homo sapiens
cctagcatggggtcagcccca

SEQ ID NO: 6071607 - DNA, 23 bp, Homo sapiens
cctagcatggggtcagccccaag

SEQ ID NO: 6071608 - DNA, 18 bp, Homo sapiens
cctagccacctcccaccc

SEQ ID NO: 6071609 - DNA, 18 bp, Homo sapiens
cctagccaggtctcctgg

SEQ ID NO: 6071610 - DNA, 21 bp, Homo sapiens
cctagccattcctggtaccca

SEQ ID NO: 6071611 - DNA, 15 bp, Homo sapiens
cctagcccaccctgc

SEQ ID NO: 6071612 - DNA, 14 bp, Homo sapiens
cctagcccagcaga

SEQ ID NO: 6071613 - DNA, 20 bp, Homo sapiens
cctagcccagcgctctgcct

SEQ ID NO: 6071614 - DNA, 20 bp, Homo sapiens
cctagcccaggagagagaaa

SEQ ID NO: 6071615 - DNA, 17 bp, Homo sapiens
cctagcccagtgcttct

SEQ ID NO: 6071616 - DNA, 20 bp, Homo sapiens
cctagcccagtgcttctcca

SEQ ID NO: 6071617 - DNA, 13 bp, Homo sapiens
cctagccccaccc

SEQ ID NO: 6071618 - DNA, 22 bp, Homo sapiens
cctagccccacccagaggtggc

SEQ ID NO: 6071619 - DNA, 17 bp, Homo sapiens
cctagccccaggtcttt

SEQ ID NO: 6071620 - DNA, 19 bp, Homo sapiens
cctagccccaggtcttttc

SEQ ID NO: 6071621 - DNA, 17 bp, Homo sapiens
cctagcccctctctcac

SEQ ID NO: 6071622 - DNA, 14 bp, Homo sapiens
cctagccctcagcc

SEQ ID NO: 6071623 - DNA, 13 bp, Homo sapiens
cctagccctctca

SEQ ID NO: 6071624 - DNA, 12 bp, Homo sapiens
cctagccctgct

SEQ ID NO: 6071625 - DNA, 15 bp, Homo sapiens
cctagccctgggaca

SEQ ID NO: 6071626 - DNA, 22 bp, Homo sapiens
cctagccctggttagctgacag

SEQ ID NO: 6071627 - DNA, 12 bp, Homo sapiens
cctagcccttcc

SEQ ID NO: 6071628 - DNA, 17 bp, Homo sapiens
cctagcccttccagcct

SEQ ID NO: 6071629 - DNA, 19 bp, Homo sapiens
cctagcccttccagcctgg

SEQ ID NO: 6071630 - DNA, 23 bp, Homo sapiens
cctagcccttccagcctgggaca

SEQ ID NO: 6071631 - DNA, 17 bp, Homo sapiens
cctagcccttccctgag

SEQ ID NO: 6071632 - DNA, 17 bp, Homo sapiens
cctagccgacctcagcc

SEQ ID NO: 6071633 - DNA, 18 bp, Homo sapiens
cctagccgacctcagcct

SEQ ID NO: 6071634 - DNA, 19 bp, Homo sapiens
cctagccgacctcagcctt

SEQ ID NO: 6071635 - DNA, 20 bp, Homo sapiens
cctagccgacctcagccttc

SEQ ID NO: 6071636 - DNA, 20 bp, Homo sapiens
cctagccggttcctgtccct

SEQ ID NO: 6071637 - DNA, 23 bp, Homo sapiens
cctagccggttcctgtccctgcg

SEQ ID NO: 6071638 - DNA, 14 bp, Homo sapiens
cctagcctatgtct

SEQ ID NO: 6071639 - DNA, 23 bp, Homo sapiens
cctagcctcacgctcctttctga

SEQ ID NO: 6071640 - DNA, 20 bp, Homo sapiens
cctagcctctccgcccacgc

SEQ ID NO: 6071641 - DNA, 14 bp, Homo sapiens
cctagcctgctctg

SEQ ID NO: 6071642 - DNA, 23 bp, Homo sapiens
cctagcctgtgcctctgggactg

SEQ ID NO: 6071643 - DNA, 18 bp, Homo sapiens
cctagccttatcctctga

SEQ ID NO: 6071644 - DNA, 17 bp, Homo sapiens
cctagccttgcactttc

SEQ ID NO: 6071645 - DNA, 22 bp, Homo sapiens
cctagcgatctctcctggccta

SEQ ID NO: 6071646 - DNA, 17 bp, Homo sapiens
cctagcggagcccagcc

SEQ ID NO: 6071647 - DNA, 20 bp, Homo sapiens
cctagcgggatggggctccc

SEQ ID NO: 6071648 - DNA, 18 bp, Homo sapiens
cctagctacactgagcag

SEQ ID NO: 6071649 - DNA, 14 bp, Homo sapiens
cctagctagagaag

SEQ ID NO: 6071650 - DNA, 22 bp, Homo sapiens
cctagctcaccaggcctggcct

SEQ ID NO: 6071651 - DNA, 23 bp, Homo sapiens
cctagctcaccaggcctggcctc

SEQ ID NO: 6071652 - DNA, 22 bp, Homo sapiens
cctagctcctgccacatggagc

SEQ ID NO: 6071653 - DNA, 23 bp, Homo sapiens
cctagctctaagagcaattctgg

SEQ ID NO: 6071654 - DNA, 18 bp, Homo sapiens
cctagctctcccagtgaa

SEQ ID NO: 6071655 - DNA, 22 bp, Homo sapiens
cctagctctcccagtgaactcc

SEQ ID NO: 6071656 - DNA, 23 bp, Homo sapiens
cctagctcttccccatctcactc

SEQ ID NO: 6071657 - DNA, 17 bp, Homo sapiens
cctagctcttgggcctg

SEQ ID NO: 6071658 - DNA, 18 bp, Homo sapiens
cctagctcttgggcctga

SEQ ID NO: 6071659 - DNA, 21 bp, Homo sapiens
cctagctcttgggcctgacct

SEQ ID NO: 6071660 - DNA, 21 bp, Homo sapiens
cctagctgaatgtttttctaa

SEQ ID NO: 6071661 - DNA, 14 bp, Homo sapiens
cctagctgaccccg

SEQ ID NO: 6071662 - DNA, 21 bp, Homo sapiens
cctagctgaccccgagaagtg

SEQ ID NO: 6071663 - DNA, 22 bp, Homo sapiens
cctagctgcacagggcagctgg

SEQ ID NO: 6071664 - DNA, 21 bp, Homo sapiens
cctagctggagaggagccctg

SEQ ID NO: 6071665 - DNA, 16 bp, Homo sapiens
cctagctggagtgcca

SEQ ID NO: 6071666 - DNA, 19 bp, Homo sapiens
cctagctggagtgccatgg

SEQ ID NO: 6071667 - DNA, 12 bp, Homo sapiens
cctagctgtccc

SEQ ID NO: 6071668 - DNA, 13 bp, Homo sapiens
cctagctgtccca

SEQ ID NO: 6071669 - DNA, 13 bp, Homo sapiens
cctagctgtcctt

SEQ ID NO: 6071670 - DNA, 19 bp, Homo sapiens
cctagctgtcctttttcct

SEQ ID NO: 6071671 - DNA, 20 bp, Homo sapiens
cctagctgtcctttttcctc

SEQ ID NO: 6071672 - DNA, 21 bp, Homo sapiens
cctagctgtgacctctcccct

SEQ ID NO: 6071673 - DNA, 11 bp, Homo sapiens
cctagctgtgt

SEQ ID NO: 6071674 - DNA, 15 bp, Homo sapiens
cctagcttagagcct

SEQ ID NO: 6071675 - DNA, 21 bp, Homo sapiens
cctagcttatctccctgcttc

SEQ ID NO: 6071676 - DNA, 19 bp, Homo sapiens
cctagcttattttgtggct

SEQ ID NO: 6071677 - DNA, 15 bp, Homo sapiens
cctagcttcttccat

SEQ ID NO: 6071678 - DNA, 20 bp, Homo sapiens
cctagcttgggaggcttccc

SEQ ID NO: 6071679 - DNA, 22 bp, Homo sapiens
cctagctttatatatggacatg

SEQ ID NO: 6071680 - DNA, 23 bp, Homo sapiens
cctagctttatatatggacatgg

SEQ ID NO: 6071681 - DNA, 14 bp, Homo sapiens
cctagcttttaaaa

SEQ ID NO: 6071682 - DNA, 17 bp, Homo sapiens
cctaggaaaccagctcg

SEQ ID NO: 6071683 - DNA, 22 bp, Homo sapiens
cctaggaaactcacactcccct

SEQ ID NO: 6071684 - DNA, 14 bp, Homo sapiens
cctaggaagtgatt

SEQ ID NO: 6071685 - DNA, 21 bp, Homo sapiens
cctaggaccactcagccccta

SEQ ID NO: 6071686 - DNA, 19 bp, Homo sapiens
cctaggacccgtctccagc

SEQ ID NO: 6071687 - DNA, 20 bp, Homo sapiens
cctaggacccgtctccagct

SEQ ID NO: 6071688 - DNA, 22 bp, Homo sapiens
cctaggacccgtctccagctgc

SEQ ID NO: 6071689 - DNA, 21 bp, Homo sapiens
cctaggacctatgttgtaatt

SEQ ID NO: 6071690 - DNA, 16 bp, Homo sapiens
cctaggacctcaggcg

SEQ ID NO: 6071691 - DNA, 16 bp, Homo sapiens
cctaggaccttttccc

SEQ ID NO: 6071692 - DNA, 15 bp, Homo sapiens
cctaggactgactcg

SEQ ID NO: 6071693 - DNA, 20 bp, Homo sapiens
cctaggagaagcagcctcct

SEQ ID NO: 6071694 - DNA, 12 bp, Homo sapiens
cctaggagacca

SEQ ID NO: 6071695 - DNA, 14 bp, Homo sapiens
cctaggagagccaa

SEQ ID NO: 6071696 - DNA, 22 bp, Homo sapiens
cctaggagagtttactgatgaa

SEQ ID NO: 6071697 - DNA, 20 bp, Homo sapiens
cctaggagatatctgaggga

SEQ ID NO: 6071698 - DNA, 15 bp, Homo sapiens
cccaactcttctcca

SEQ ID NO: 6071699 - DNA, 18 bp, Homo sapiens
cccaactgctccagcctc

SEQ ID NO: 6071700 - DNA, 19 bp, Homo sapiens
cccaactgctccagcctct

SEQ ID NO: 6071701 - DNA, 21 bp, Homo sapiens
cccaactgctccagcctctgc

SEQ ID NO: 6071702 - DNA, 18 bp, Homo sapiens
cccaactgggggcaaagg

SEQ ID NO: 6071703 - DNA, 13 bp, Homo sapiens
cccaactgtcttt

SEQ ID NO: 6071704 - DNA, 15 bp, Homo sapiens
cccaactgtcttttt

SEQ ID NO: 6071705 - DNA, 16 bp, Homo sapiens
cccaactgtgtagcat

SEQ ID NO: 6071706 - DNA, 15 bp, Homo sapiens
cccaacttaagttta

SEQ ID NO: 6071707 - DNA, 12 bp, Homo sapiens
cccaacttcccc

SEQ ID NO: 6071708 - DNA, 14 bp, Homo sapiens
cccaacttccctgt

SEQ ID NO: 6071709 - DNA, 20 bp, Homo sapiens
cccaacttctcttgctttct

SEQ ID NO: 6071710 - DNA, 18 bp, Homo sapiens
cccaacttgcctttgaag

SEQ ID NO: 6071711 - DNA, 20 bp, Homo sapiens
cccaactttctcactgctgt

SEQ ID NO: 6071712 - DNA, 14 bp, Homo sapiens
cccaagaacagcag

SEQ ID NO: 6071713 - DNA, 17 bp, Homo sapiens
cccaagaagagagaact

SEQ ID NO: 6071714 - DNA, 14 bp, Homo sapiens
cccaagaaggctgg

SEQ ID NO: 6071715 - DNA, 14 bp, Homo sapiens
cccaagaatgcaag

SEQ ID NO: 6071716 - DNA, 20 bp, Homo sapiens
cccaagaatgcaagatttca

SEQ ID NO: 6071717 - DNA, 17 bp, Homo sapiens
cccaagacacttcccct

SEQ ID NO: 6071718 - DNA, 17 bp, Homo sapiens
cccaagacctaagggtt

SEQ ID NO: 6071719 - DNA, 17 bp, Homo sapiens
cccaagacctcatctgc

SEQ ID NO: 6071720 - DNA, 16 bp, Homo sapiens
cccaagactctgctct

SEQ ID NO: 6071721 - DNA, 19 bp, Homo sapiens
cccaagactgtcattgccc

SEQ ID NO: 6071722 - DNA, 20 bp, Homo sapiens
cccaagagagacagcacagg

SEQ ID NO: 6071723 - DNA, 22 bp, Homo sapiens
cccaagagagacagcacaggca

SEQ ID NO: 6071724 - DNA, 12 bp, Homo sapiens
cccaagagagga

SEQ ID NO: 6071725 - DNA, 20 bp, Homo sapiens
cccaagagaggaaggacccc

SEQ ID NO: 6071726 - DNA, 21 bp, Homo sapiens
cccaagagaggaaggacccct

SEQ ID NO: 6071727 - DNA, 20 bp, Homo sapiens
cccaagagattatgtaactc

SEQ ID NO: 6071728 - DNA, 23 bp, Homo sapiens
cccaagagcagagtctgggcctc

SEQ ID NO: 6071729 - DNA, 12 bp, Homo sapiens
cccaagagccat

SEQ ID NO: 6071730 - DNA, 16 bp, Homo sapiens
cccaagagccataagg

SEQ ID NO: 6071731 - DNA, 18 bp, Homo sapiens
cccaagaggactgagact

SEQ ID NO: 6071732 - DNA, 23 bp, Homo sapiens
cccaagaggtcaaggctgcagtg

SEQ ID NO: 6071733 - DNA, 16 bp, Homo sapiens
cccaagaggtctgagc

SEQ ID NO: 6071734 - DNA, 20 bp, Homo sapiens
cccaagagtttcttctcata

SEQ ID NO: 6071735 - DNA, 21 bp, Homo sapiens
cccaagataggagttctctga

SEQ ID NO: 6071736 - DNA, 22 bp, Homo sapiens
cccaagataggagttctctgat

SEQ ID NO: 6071737 - DNA, 14 bp, Homo sapiens
cccaagatctgcca

SEQ ID NO: 6071738 - DNA, 19 bp, Homo sapiens
cccaagatgagctgcagcc

SEQ ID NO: 6071739 - DNA, 16 bp, Homo sapiens
cccaagatgcctgatc

SEQ ID NO: 6071740 - DNA, 17 bp, Homo sapiens
cccaagatggagaggaa

SEQ ID NO: 6071741 - DNA, 19 bp, Homo sapiens
cccaagcaaaatcatggaa

SEQ ID NO: 6071742 - DNA, 21 bp, Homo sapiens
cccaagcacaaactgtcgtct

SEQ ID NO: 6071743 - DNA, 20 bp, Homo sapiens
cccaagcacctgggattaca

SEQ ID NO: 6071744 - DNA, 21 bp, Homo sapiens
cccaagcagaagaccagatcc

SEQ ID NO: 6071745 - DNA, 19 bp, Homo sapiens
cccaagcagcattcagcac

SEQ ID NO: 6071746 - DNA, 12 bp, Homo sapiens
cccaagcagcca

SEQ ID NO: 6071747 - DNA, 14 bp, Homo sapiens
cccaagcagccagc

SEQ ID NO: 6071748 - DNA, 15 bp, Homo sapiens
cccaagcagccagcc

SEQ ID NO: 6071749 - DNA, 17 bp, Homo sapiens
cccaagcagccagccag

SEQ ID NO: 6071750 - DNA, 19 bp, Homo sapiens
cccaagcagctgaagggtg

SEQ ID NO: 6071751 - DNA, 16 bp, Homo sapiens
cccaagcatgccccac

SEQ ID NO: 6071752 - DNA, 20 bp, Homo sapiens
cccaagccactagcccactc

SEQ ID NO: 6071753 - DNA, 15 bp, Homo sapiens
cccaagccagaggct

SEQ ID NO: 6071754 - DNA, 22 bp, Homo sapiens
cccaagccatggtgacacacag

SEQ ID NO: 6071755 - DNA, 14 bp, Homo sapiens
cccaagcccaccag

SEQ ID NO: 6071756 - DNA, 12 bp, Homo sapiens
cccaagccccat

SEQ ID NO: 6071757 - DNA, 13 bp, Homo sapiens
cccaagccccatc

SEQ ID NO: 6071758 - DNA, 20 bp, Homo sapiens
cccaagccccctccttgtct

SEQ ID NO: 6071759 - DNA, 23 bp, Homo sapiens
cccaagcccgacttgctgttttg

SEQ ID NO: 6071760 - DNA, 15 bp, Homo sapiens
cccaagcctctgccc

SEQ ID NO: 6071761 - DNA, 18 bp, Homo sapiens
cccaagcctctgccccaa

SEQ ID NO: 6071762 - DNA, 20 bp, Homo sapiens
cccaagcctctgccccaagg

SEQ ID NO: 6071763 - DNA, 15 bp, Homo sapiens
cccaagcctgctggc

SEQ ID NO: 6071764 - DNA, 13 bp, Homo sapiens
cccaagcctggca

SEQ ID NO: 6071765 - DNA, 17 bp, Homo sapiens
cccaagcgccctggccc

SEQ ID NO: 6071766 - DNA, 18 bp, Homo sapiens
cccaagcgccctggcccc

SEQ ID NO: 6071767 - DNA, 17 bp, Homo sapiens
cccaagcggtgtctctc

SEQ ID NO: 6071768 - DNA, 13 bp, Homo sapiens
cccaagctagact

SEQ ID NO: 6071769 - DNA, 16 bp, Homo sapiens
cccaagctagactgtg

SEQ ID NO: 6071770 - DNA, 20 bp, Homo sapiens
cccaagctagactgtgtctg

SEQ ID NO: 6071771 - DNA, 21 bp, Homo sapiens
cccaagctagactgtgtctga

SEQ ID NO: 6071772 - DNA, 15 bp, Homo sapiens
cccaagctctgctcc

SEQ ID NO: 6071773 - DNA, 17 bp, Homo sapiens
cccaagctctgctcctc

SEQ ID NO: 6071774 - DNA, 22 bp, Homo sapiens
cccaagctggagtgcagtggtg

SEQ ID NO: 6071775 - DNA, 16 bp, Homo sapiens
cccaagctggctgggg

SEQ ID NO: 6071776 - DNA, 13 bp, Homo sapiens
cccaagctgggcc

SEQ ID NO: 6071777 - DNA, 14 bp, Homo sapiens
cccaagctgggccc

SEQ ID NO: 6071778 - DNA, 18 bp, Homo sapiens
cccaagctgggccccagc

SEQ ID NO: 6071779 - DNA, 22 bp, Homo sapiens
cccaagctgggccccagcccac

SEQ ID NO: 6071780 - DNA, 13 bp, Homo sapiens
cccaagctgggct

SEQ ID NO: 6071781 - DNA, 14 bp, Homo sapiens
cccaagctgggctc

SEQ ID NO: 6071782 - DNA, 14 bp, Homo sapiens
cccaagctgtgctg

SEQ ID NO: 6071783 - DNA, 13 bp, Homo sapiens
cccaagctgtggc

SEQ ID NO: 6071784 - DNA, 21 bp, Homo sapiens
cccaagctgtggcagccgtcc

SEQ ID NO: 6071785 - DNA, 15 bp, Homo sapiens
cccaagcttcccaac

SEQ ID NO: 6071786 - DNA, 18 bp, Homo sapiens
cccaagcttggcagccga

SEQ ID NO: 6071787 - DNA, 21 bp, Homo sapiens
cccaagctttcccctctgaat

SEQ ID NO: 6071788 - DNA, 22 bp, Homo sapiens
cccaagctttgaatacccccag

SEQ ID NO: 6071789 - DNA, 14 bp, Homo sapiens
cccaaggaaagccc

SEQ ID NO: 6071790 - DNA, 19 bp, Homo sapiens
cccaaggaaagccccagca

SEQ ID NO: 6071791 - DNA, 17 bp, Homo sapiens
cccaaggaacaagagaa

SEQ ID NO: 6071792 - DNA, 12 bp, Homo sapiens
cccaaggaagct

SEQ ID NO: 6071793 - DNA, 12 bp, Homo sapiens
cccaaggacaag

SEQ ID NO: 6071794 - DNA, 23 bp, Homo sapiens
cccaaggacatgagtctgtagga

SEQ ID NO: 6071795 - DNA, 17 bp, Homo sapiens
cccaaggacccagccct

SEQ ID NO: 6071796 - DNA, 20 bp, Homo sapiens
cccaaggacctgcctccccg

SEQ ID NO: 6071797 - DNA, 22 bp, Homo sapiens
cccaaggaccttacaggccctc

SEQ ID NO: 6071798 - DNA, 15 bp, Homo sapiens
cccaaggagcacagg

SEQ ID NO: 6071799 - DNA, 20 bp, Homo sapiens
cccaaggagcacaggtccca

SEQ ID NO: 6071800 - DNA, 12 bp, Homo sapiens
cccaaggagctg

SEQ ID NO: 6071801 - DNA, 23 bp, Homo sapiens
cccaaggagctgatttccaggcc

SEQ ID NO: 6071802 - DNA, 15 bp, Homo sapiens
cccaaggagcttacc

SEQ ID NO: 6071803 - DNA, 22 bp, Homo sapiens
cccaaggaggaaaaacagacaa

SEQ ID NO: 6071804 - DNA, 13 bp, Homo sapiens
cccaaggaggtgg

SEQ ID NO: 6071805 - DNA, 15 bp, Homo sapiens
cccaaggaggtggct

SEQ ID NO: 6071806 - DNA, 18 bp, Homo sapiens
cccaaggatgaccacacc

SEQ ID NO: 6071807 - DNA, 18 bp, Homo sapiens
cccaaggattctgttctg

SEQ ID NO: 6071808 - DNA, 21 bp, Homo sapiens
cccaaggcaaggggtgcctgg

SEQ ID NO: 6071809 - DNA, 13 bp, Homo sapiens
cccaaggcctctc

SEQ ID NO: 6071810 - DNA, 16 bp, Homo sapiens
cccaaggcctctctct

SEQ ID NO: 6071811 - DNA, 19 bp, Homo sapiens
cccaaggctcccggaattc

SEQ ID NO: 6071812 - DNA, 15 bp, Homo sapiens
cccaaggctgccaga

SEQ ID NO: 6071813 - DNA, 18 bp, Homo sapiens
cccaaggctgccagacat

SEQ ID NO: 6071814 - DNA, 22 bp, Homo sapiens
cccaaggctgcgtctggagggg

SEQ ID NO: 6071815 - DNA, 21 bp, Homo sapiens
cccaagggacagcaagtgagc

SEQ ID NO: 6071816 - DNA, 12 bp, Homo sapiens
cccaagggaggc

SEQ ID NO: 6071817 - DNA, 16 bp, Homo sapiens
cccaagggaggctgct

SEQ ID NO: 6071818 - DNA, 22 bp, Homo sapiens
cccaagggatggcaccacttat

SEQ ID NO: 6071819 - DNA, 18 bp, Homo sapiens
cccaagggcccagaccct

SEQ ID NO: 6071820 - DNA, 23 bp, Homo sapiens
cccaagggcccagaccctgggca

SEQ ID NO: 6071821 - DNA, 16 bp, Homo sapiens
cccaagggccctggca

SEQ ID NO: 6071822 - DNA, 12 bp, Homo sapiens
cccaagggcctg

SEQ ID NO: 6071823 - DNA, 18 bp, Homo sapiens
cccaagggcctggcctga

SEQ ID NO: 6071824 - DNA, 19 bp, Homo sapiens
cccaagggcctggcctgag

SEQ ID NO: 6071825 - DNA, 10 bp, Homo sapiens
cccaaggggc

SEQ ID NO: 6071826 - DNA, 16 bp, Homo sapiens
cccaagggggctgctg

SEQ ID NO: 6071827 - DNA, 18 bp, Homo sapiens
cccaagggggctgctgct

SEQ ID NO: 6071828 - DNA, 19 bp, Homo sapiens
cccaagggggctgctgctc

SEQ ID NO: 6071829 - DNA, 22 bp, Homo sapiens
cccaagggggctgctgctcctc

SEQ ID NO: 6071830 - DNA, 23 bp, Homo sapiens
cccaagggggctgctgctcctct

SEQ ID NO: 6071831 - DNA, 21 bp, Homo sapiens
cccaaggggtggccgtcctga

SEQ ID NO: 6071832 - DNA, 23 bp, Homo sapiens
cccaagggtcgcctatttttaaa

SEQ ID NO: 6071833 - DNA, 17 bp, Homo sapiens
cccaaggtcccctccac

SEQ ID NO: 6071834 - DNA, 19 bp, Homo sapiens
cccaaggtcccctccacat

SEQ ID NO: 6071835 - DNA, 23 bp, Homo sapiens
cccaaggtggtcttggagaggag

SEQ ID NO: 6071836 - DNA, 23 bp, Homo sapiens
cccaaggttactcagcagcagag

SEQ ID NO: 6071837 - DNA, 15 bp, Homo sapiens
cccaaggttggagcc

SEQ ID NO: 6071838 - DNA, 16 bp, Homo sapiens
cccaagtagaggggcc

SEQ ID NO: 6071839 - DNA, 14 bp, Homo sapiens
cccaagtagctgag

SEQ ID NO: 6071840 - DNA, 14 bp, Homo sapiens
cccaagtagctggg

SEQ ID NO: 6071841 - DNA, 23 bp, Homo sapiens
cccaagtagctgggattacaggt

SEQ ID NO: 6071842 - DNA, 22 bp, Homo sapiens
cccaagtagggggtctaaaatt

SEQ ID NO: 6071843 - DNA, 19 bp, Homo sapiens
cccaagtagtagtgtcttc

SEQ ID NO: 6071844 - DNA, 19 bp, Homo sapiens
cccaagtagtctgctcaca

SEQ ID NO: 6071845 - DNA, 20 bp, Homo sapiens
cccaagtagtctgctcacag

SEQ ID NO: 6071846 - DNA, 19 bp, Homo sapiens
cccaagtatacaataaagt

SEQ ID NO: 6071847 - DNA, 22 bp, Homo sapiens
cccaagtatgccttaagcagaa

SEQ ID NO: 6071848 - DNA, 21 bp, Homo sapiens
cccaagtattgcgaatgtgca

SEQ ID NO: 6071849 - DNA, 16 bp, Homo sapiens
cccaagtcacacagct

SEQ ID NO: 6071850 - DNA, 17 bp, Homo sapiens
cccaagtcacacagcta

SEQ ID NO: 6071851 - DNA, 16 bp, Homo sapiens
cccaagtcacacccac

SEQ ID NO: 6071852 - DNA, 14 bp, Homo sapiens
cccaagtcagacag

SEQ ID NO: 6071853 - DNA, 15 bp, Homo sapiens
cccaagtcagacaga

SEQ ID NO: 6071854 - DNA, 12 bp, Homo sapiens
cccaagtccacc

SEQ ID NO: 6071855 - DNA, 14 bp, Homo sapiens
cccaagtccacccc

SEQ ID NO: 6071856 - DNA, 21 bp, Homo sapiens
cccaagtcccagagcacctca

SEQ ID NO: 6071857 - DNA, 23 bp, Homo sapiens
cccaagtccctgttttctgagcc

SEQ ID NO: 6071858 - DNA, 12 bp, Homo sapiens
cccaagtcctcc

SEQ ID NO: 6071859 - DNA, 17 bp, Homo sapiens
cccaagtcctgaagagg

SEQ ID NO: 6071860 - DNA, 23 bp, Homo sapiens
cccaagtcctgaagaggcgggcc

SEQ ID NO: 6071861 - DNA, 18 bp, Homo sapiens
cccaagtcctgctccttt

SEQ ID NO: 6071862 - DNA, 14 bp, Homo sapiens
cccaagtctcctag

SEQ ID NO: 6071863 - DNA, 21 bp, Homo sapiens
cccaagtctctgggccccagg

SEQ ID NO: 6071864 - DNA, 16 bp, Homo sapiens
cccaagtctgacagcc

SEQ ID NO: 6071865 - DNA, 14 bp, Homo sapiens
cccaagtcttctcc

SEQ ID NO: 6071866 - DNA, 14 bp, Homo sapiens
cccaagtgaggcag

SEQ ID NO: 6071867 - DNA, 15 bp, Homo sapiens
cccaagtgccaaaga

SEQ ID NO: 6071868 - DNA, 15 bp, Homo sapiens
cccaagtgccagtct

SEQ ID NO: 6071869 - DNA, 12 bp, Homo sapiens
cccaagtgcctc

SEQ ID NO: 6071870 - DNA, 13 bp, Homo sapiens
cccaagtggctct

SEQ ID NO: 6071871 - DNA, 20 bp, Homo sapiens
cccaagtgggcagtcaccac

SEQ ID NO: 6071872 - DNA, 22 bp, Homo sapiens
cccaagtgggcagtcaccaccc

SEQ ID NO: 6071873 - DNA, 14 bp, Homo sapiens
cccaagtgggggca

SEQ ID NO: 6071874 - DNA, 19 bp, Homo sapiens
cccaagtgggggcagaggg

SEQ ID NO: 6071875 - DNA, 15 bp, Homo sapiens
cccaagtggtgccta

SEQ ID NO: 6071876 - DNA, 15 bp, Homo sapiens
cccaagtgtgaacaa

SEQ ID NO: 6071877 - DNA, 20 bp, Homo sapiens
cctaggagcagtgggccctg

SEQ ID NO: 6071878 - DNA, 21 bp, Homo sapiens
cctaggagctggctggcaggt

SEQ ID NO: 6071879 - DNA, 19 bp, Homo sapiens
cctaggaggaaaattccat

SEQ ID NO: 6071880 - DNA, 13 bp, Homo sapiens
cctaggaggcctt

SEQ ID NO: 6071881 - DNA, 15 bp, Homo sapiens
cctaggagggaagga

SEQ ID NO: 6071882 - DNA, 16 bp, Homo sapiens
cctaggagggaaggag

SEQ ID NO: 6071883 - DNA, 18 bp, Homo sapiens
cctaggagggaaggagct

SEQ ID NO: 6071884 - DNA, 19 bp, Homo sapiens
cctaggagggctctgagcc

SEQ ID NO: 6071885 - DNA, 14 bp, Homo sapiens
cctaggagtacaag

SEQ ID NO: 6071886 - DNA, 13 bp, Homo sapiens
cctaggagttgag

SEQ ID NO: 6071887 - DNA, 22 bp, Homo sapiens
cctaggagttgagtacagtgag

SEQ ID NO: 6071888 - DNA, 21 bp, Homo sapiens
cctaggatcccgtcttccaga

SEQ ID NO: 6071889 - DNA, 14 bp, Homo sapiens
cctaggatgctgca

SEQ ID NO: 6071890 - DNA, 20 bp, Homo sapiens
cctaggatgtcatgtctgct

SEQ ID NO: 6071891 - DNA, 19 bp, Homo sapiens
cctaggattcacaccccac

SEQ ID NO: 6071892 - DNA, 20 bp, Homo sapiens
cctaggattcacaccccacc

SEQ ID NO: 6071893 - DNA, 17 bp, Homo sapiens
cctaggattccccctgc

SEQ ID NO: 6071894 - DNA, 23 bp, Homo sapiens
cctaggattccccctgccctgtg

SEQ ID NO: 6071895 - DNA, 16 bp, Homo sapiens
cctaggattgtgcctg

SEQ ID NO: 6071896 - DNA, 16 bp, Homo sapiens
cctaggatttcagcca

SEQ ID NO: 6071897 - DNA, 16 bp, Homo sapiens
cctaggcaatgaagaa

SEQ ID NO: 6071898 - DNA, 14 bp, Homo sapiens
cctaggcacctccc

SEQ ID NO: 6071899 - DNA, 19 bp, Homo sapiens
cctaggcagcctgcaggga

SEQ ID NO: 6071900 - DNA, 18 bp, Homo sapiens
cctaggcaggacatgctg

SEQ ID NO: 6071901 - DNA, 19 bp, Homo sapiens
cctaggcagtaggccggtg

SEQ ID NO: 6071902 - DNA, 16 bp, Homo sapiens
cctaggcagtgggagg

SEQ ID NO: 6071903 - DNA, 18 bp, Homo sapiens
cctaggcatactctccag

SEQ ID NO: 6071904 - DNA, 23 bp, Homo sapiens
cctaggccacaccatctcctttc

SEQ ID NO: 6071905 - DNA, 17 bp, Homo sapiens
cctaggccactcctcca

SEQ ID NO: 6071906 - DNA, 12 bp, Homo sapiens
cctaggccagga

SEQ ID NO: 6071907 - DNA, 14 bp, Homo sapiens
cctaggccaggagt

SEQ ID NO: 6071908 - DNA, 21 bp, Homo sapiens
cctaggccaggagttcccaaa

SEQ ID NO: 6071909 - DNA, 15 bp, Homo sapiens
cctaggcccaggcct

SEQ ID NO: 6071910 - DNA, 11 bp, Homo sapiens
cctaggccctt

SEQ ID NO: 6071911 - DNA, 13 bp, Homo sapiens
cctaggcctgagt

SEQ ID NO: 6071912 - DNA, 22 bp, Homo sapiens
cctaggcctgagttagctgttt

SEQ ID NO: 6071913 - DNA, 16 bp, Homo sapiens
cctaggcgctcagagg

SEQ ID NO: 6071914 - DNA, 18 bp, Homo sapiens
cctaggctacccttgcca

SEQ ID NO: 6071915 - DNA, 18 bp, Homo sapiens
cctaggctccaccccatc

SEQ ID NO: 6071916 - DNA, 13 bp, Homo sapiens
cctaggctccctg

SEQ ID NO: 6071917 - DNA, 23 bp, Homo sapiens
cctaggctcctcttacccccgtc

SEQ ID NO: 6071918 - DNA, 13 bp, Homo sapiens
cctaggctgctgc

SEQ ID NO: 6071919 - DNA, 16 bp, Homo sapiens
cctaggctgctgctgt

SEQ ID NO: 6071920 - DNA, 11 bp, Homo sapiens
cctaggctgga

SEQ ID NO: 6071921 - DNA, 21 bp, Homo sapiens
cctagggaaaacacggccctc

SEQ ID NO: 6071922 - DNA, 15 bp, Homo sapiens
cctagggaattcctg

SEQ ID NO: 6071923 - DNA, 22 bp, Homo sapiens
cctagggactgtcctagccagg

SEQ ID NO: 6071924 - DNA, 21 bp, Homo sapiens
cctagggcgacgtcttcagag

SEQ ID NO: 6071925 - DNA, 12 bp, Homo sapiens
cctagggctctc

SEQ ID NO: 6071926 - DNA, 14 bp, Homo sapiens
cctagggctgggtg

SEQ ID NO: 6071927 - DNA, 15 bp, Homo sapiens
cctagggctgggtgt

SEQ ID NO: 6071928 - DNA, 17 bp, Homo sapiens
cctaggggaacagacca

SEQ ID NO: 6071929 - DNA, 13 bp, Homo sapiens
cctaggggccagg

SEQ ID NO: 6071930 - DNA, 15 bp, Homo sapiens
cctaggggtcaggga

SEQ ID NO: 6071931 - DNA, 18 bp, Homo sapiens
cctaggggtcagggacca

SEQ ID NO: 6071932 - DNA, 20 bp, Homo sapiens
cctaggggtgcgctcacctg

SEQ ID NO: 6071933 - DNA, 23 bp, Homo sapiens
cctaggggtggcgctcagacccc

SEQ ID NO: 6071934 - DNA, 13 bp, Homo sapiens
cctagggtgggaa

SEQ ID NO: 6071935 - DNA, 14 bp, Homo sapiens
cctagggtgggaag

SEQ ID NO: 6071936 - DNA, 17 bp, Homo sapiens
cctaggtaacgagggca

SEQ ID NO: 6071937 - DNA, 23 bp, Homo sapiens
cctaggtagccccctcttccctg

SEQ ID NO: 6071938 - DNA, 20 bp, Homo sapiens
cctaggtcacgttggccctc

SEQ ID NO: 6071939 - DNA, 23 bp, Homo sapiens
cctaggtcatgaaggacactctg

SEQ ID NO: 6071940 - DNA, 14 bp, Homo sapiens
cctaggtccaagcc

SEQ ID NO: 6071941 - DNA, 16 bp, Homo sapiens
cctaggtcgccagtga

SEQ ID NO: 6071942 - DNA, 13 bp, Homo sapiens
cctaggtctattt

SEQ ID NO: 6071943 - DNA, 16 bp, Homo sapiens
cctaggtctccacccc

SEQ ID NO: 6071944 - DNA, 19 bp, Homo sapiens
cctaggtctccacccctca

SEQ ID NO: 6071945 - DNA, 15 bp, Homo sapiens
cctaggtgacagagt

SEQ ID NO: 6071946 - DNA, 19 bp, Homo sapiens
cctaggtgcagctcctcag

SEQ ID NO: 6071947 - DNA, 16 bp, Homo sapiens
cctaggtgcccagggc

SEQ ID NO: 6071948 - DNA, 12 bp, Homo sapiens
cctaggtgctca

SEQ ID NO: 6071949 - DNA, 15 bp, Homo sapiens
cctaggtgctggatg

SEQ ID NO: 6071950 - DNA, 17 bp, Homo sapiens
cctaggtggaggcaagt

SEQ ID NO: 6071951 - DNA, 22 bp, Homo sapiens
cctaggtggggcctggggtagg

SEQ ID NO: 6071952 - DNA, 21 bp, Homo sapiens
cctaggtgttgtcagcaggca

SEQ ID NO: 6071953 - DNA, 17 bp, Homo sapiens
cctaggtgttttgttca

SEQ ID NO: 6071954 - DNA, 19 bp, Homo sapiens
cctaggttcccggtcccga

SEQ ID NO: 6071955 - DNA, 22 bp, Homo sapiens
cctaggttggtttcccctgcac

SEQ ID NO: 6071956 - DNA, 16 bp, Homo sapiens
cctagtaaaaccttgt

SEQ ID NO: 6071957 - DNA, 20 bp, Homo sapiens
cctagtaaaaccttgttcta

SEQ ID NO: 6071958 - DNA, 16 bp, Homo sapiens
cctagtaagtgcctgc

SEQ ID NO: 6071959 - DNA, 18 bp, Homo sapiens
cctagtaagtgccttcca

SEQ ID NO: 6071960 - DNA, 17 bp, Homo sapiens
cctagtactctctgctc

SEQ ID NO: 6071961 - DNA, 19 bp, Homo sapiens
cctagtactctctgctcta

SEQ ID NO: 6071962 - DNA, 18 bp, Homo sapiens
cctagtatacccactgca

SEQ ID NO: 6071963 - DNA, 21 bp, Homo sapiens
cctagtatacccactgcatcc

SEQ ID NO: 6071964 - DNA, 17 bp, Homo sapiens
cctagtatctggctggg

SEQ ID NO: 6071965 - DNA, 23 bp, Homo sapiens
cctagtattcctaacctgtcaga

SEQ ID NO: 6071966 - DNA, 21 bp, Homo sapiens
cctagtcagatggatgtagat

SEQ ID NO: 6071967 - DNA, 16 bp, Homo sapiens
cctagtcagccacatg

SEQ ID NO: 6071968 - DNA, 16 bp, Homo sapiens
cctagtcatcgtttgt

SEQ ID NO: 6071969 - DNA, 16 bp, Homo sapiens
cctagtcccctttcct

SEQ ID NO: 6071970 - DNA, 18 bp, Homo sapiens
cctagtcccttccacacc

SEQ ID NO: 6071971 - DNA, 21 bp, Homo sapiens
cctagtccgctgaagatggag

SEQ ID NO: 6071972 - DNA, 18 bp, Homo sapiens
cctagtccggttcttctt

SEQ ID NO: 6071973 - DNA, 20 bp, Homo sapiens
cctagtcgggcagggcccct

SEQ ID NO: 6071974 - DNA, 16 bp, Homo sapiens
cctagtctctatcatt

SEQ ID NO: 6071975 - DNA, 23 bp, Homo sapiens
cctagtctgtgtggcaaattaaa

SEQ ID NO: 6071976 - DNA, 18 bp, Homo sapiens
cctagtcttgttgttcat

SEQ ID NO: 6071977 - DNA, 12 bp, Homo sapiens
cctagtctttgg

SEQ ID NO: 6071978 - DNA, 14 bp, Homo sapiens
cctagtgaaacttt

SEQ ID NO: 6071979 - DNA, 18 bp, Homo sapiens
cctagtgaacctcacccc

SEQ ID NO: 6071980 - DNA, 22 bp, Homo sapiens
cctagtgaaggcttctctctgt

SEQ ID NO: 6071981 - DNA, 23 bp, Homo sapiens
cctagtgaaggcttctctctgtg

SEQ ID NO: 6071982 - DNA, 15 bp, Homo sapiens
cctagtgatttttgg

SEQ ID NO: 6071983 - DNA, 14 bp, Homo sapiens
cctagtgcagagag

SEQ ID NO: 6071984 - DNA, 15 bp, Homo sapiens
cctagtgccccagac

SEQ ID NO: 6071985 - DNA, 16 bp, Homo sapiens
cctagtgccccagact

SEQ ID NO: 6071986 - DNA, 21 bp, Homo sapiens
cctagtgccccagactgagct

SEQ ID NO: 6071987 - DNA, 18 bp, Homo sapiens
cctagtgctattctgtgt

SEQ ID NO: 6071988 - DNA, 15 bp, Homo sapiens
cctagtgcttccact

SEQ ID NO: 6071989 - DNA, 23 bp, Homo sapiens
cctagtgcttccacttctatgca

SEQ ID NO: 6071990 - DNA, 18 bp, Homo sapiens
cctagtggctgtccagtg

SEQ ID NO: 6071991 - DNA, 21 bp, Homo sapiens
cctagtggctgtccagtgccc

SEQ ID NO: 6071992 - DNA, 23 bp, Homo sapiens
cctagtggctgtccagtgcccat

SEQ ID NO: 6071993 - DNA, 18 bp, Homo sapiens
cctagtggcttcagcccc

SEQ ID NO: 6071994 - DNA, 16 bp, Homo sapiens
cctagtgggagcccag

SEQ ID NO: 6071995 - DNA, 18 bp, Homo sapiens
cctagtgggagcccagca

SEQ ID NO: 6071996 - DNA, 22 bp, Homo sapiens
cctagtggggaggggcctggcc

SEQ ID NO: 6071997 - DNA, 17 bp, Homo sapiens
cctagtggggtctccct

SEQ ID NO: 6071998 - DNA, 17 bp, Homo sapiens
cctagtggtgtcatttt

SEQ ID NO: 6071999 - DNA, 16 bp, Homo sapiens
cctagtgtctttaaat

SEQ ID NO: 6072000 - DNA, 20 bp, Homo sapiens
cctagttaaagaaaggaaaa

SEQ ID NO: 6072001 - DNA, 15 bp, Homo sapiens
cctagttacccaccc

SEQ ID NO: 6072002 - DNA, 17 bp, Homo sapiens
cctagttacccacccta

SEQ ID NO: 6072003 - DNA, 18 bp, Homo sapiens
cctagttcatcccttctc

SEQ ID NO: 6072004 - DNA, 13 bp, Homo sapiens
cctagttccacca

SEQ ID NO: 6072005 - DNA, 18 bp, Homo sapiens
cctagttccctctgctca

SEQ ID NO: 6072006 - DNA, 21 bp, Homo sapiens
cctagttccctctgctcagcc

SEQ ID NO: 6072007 - DNA, 22 bp, Homo sapiens
cctagttccctctgctcagcca

SEQ ID NO: 6072008 - DNA, 18 bp, Homo sapiens
cctagttctagaaaaaca

SEQ ID NO: 6072009 - DNA, 13 bp, Homo sapiens
cctagttctctta

SEQ ID NO: 6072010 - DNA, 14 bp, Homo sapiens
cctagttctcttat

SEQ ID NO: 6072011 - DNA, 15 bp, Homo sapiens
cctagttctcttatc

SEQ ID NO: 6072012 - DNA, 19 bp, Homo sapiens
cctagttctgtagaaatgg

SEQ ID NO: 6072013 - DNA, 13 bp, Homo sapiens
cctagttcttcat

SEQ ID NO: 6072014 - DNA, 13 bp, Homo sapiens
cctagttctttgc

SEQ ID NO: 6072015 - DNA, 22 bp, Homo sapiens
cctagttctttgcattcgtcct

SEQ ID NO: 6072016 - DNA, 16 bp, Homo sapiens
cctagttggtgagaaa

SEQ ID NO: 6072017 - DNA, 14 bp, Homo sapiens
cctagtttcctctc

SEQ ID NO: 6072018 - DNA, 16 bp, Homo sapiens
cctagtttcctctcct

SEQ ID NO: 6072019 - DNA, 17 bp, Homo sapiens
cctagtttcctctcctt

SEQ ID NO: 6072020 - DNA, 13 bp, Homo sapiens
cctagtttgctgt

SEQ ID NO: 6072021 - DNA, 16 bp, Homo sapiens
cctagtttgtgagaaa

SEQ ID NO: 6072022 - DNA, 20 bp, Homo sapiens
cctagttttagacctcatct

SEQ ID NO: 6072023 - DNA, 15 bp, Homo sapiens
cctagttttcctact

SEQ ID NO: 6072024 - DNA, 20 bp, Homo sapiens
cctagttttctttcctcctt

SEQ ID NO: 6072025 - DNA, 23 bp, Homo sapiens
  misc_feature (5)..(5): n is a, c, g or t
  misc_feature (12)..(12): n is a, c, g or t
cctanccccccnacccccagtgt

SEQ ID NO: 6072026 - DNA, 20 bp, Homo sapiens
cctataaaatcaaagaaaac

SEQ ID NO: 6072027 - DNA, 14 bp, Homo sapiens
cctataaaattaaa

SEQ ID NO: 6072028 - DNA, 17 bp, Homo sapiens
cctataaaggaaacacg

SEQ ID NO: 6072029 - DNA, 23 bp, Homo sapiens
cctataaaggaaacacgtttaga

SEQ ID NO: 6072030 - DNA, 16 bp, Homo sapiens
cctataaagggcccac

SEQ ID NO: 6072031 - DNA, 22 bp, Homo sapiens
cctataaagggcccacacctgg

SEQ ID NO: 6072032 - DNA, 17 bp, Homo sapiens
cctataaagtaaagcta

SEQ ID NO: 6072033 - DNA, 14 bp, Homo sapiens
cctataaagtgcct

SEQ ID NO: 6072034 - DNA, 15 bp, Homo sapiens
cctataaatggactt

SEQ ID NO: 6072035 - DNA, 20 bp, Homo sapiens
cctataaatggacttgcttc

SEQ ID NO: 6072036 - DNA, 11 bp, Homo sapiens
cctataaattt

SEQ ID NO: 6072037 - DNA, 21 bp, Homo sapiens
cctataacttcttcctgctgg

SEQ ID NO: 6072038 - DNA, 14 bp, Homo sapiens
cctataacttgatg

SEQ ID NO: 6072039 - DNA, 19 bp, Homo sapiens
cctataacttgatgcatgt

SEQ ID NO: 6072040 - DNA, 22 bp, Homo sapiens
cctataactttttttcaatttt

SEQ ID NO: 6072041 - DNA, 14 bp, Homo sapiens
cctataagaggaat

SEQ ID NO: 6072042 - DNA, 12 bp, Homo sapiens
cctataaggaag

SEQ ID NO: 6072043 - DNA, 20 bp, Homo sapiens
cctataataaaatggcacct

SEQ ID NO: 6072044 - DNA, 21 bp, Homo sapiens
cctataataaaatggcacctt

SEQ ID NO: 6072045 - DNA, 14 bp, Homo sapiens
cctataataaaggc

SEQ ID NO: 6072046 - DNA, 23 bp, Homo sapiens
cctataatacttgcaactaagga

SEQ ID NO: 6072047 - DNA, 17 bp, Homo sapiens
cctataatcccagcatt

SEQ ID NO: 6072048 - DNA, 16 bp, Homo sapiens
cctataatcccagcta

SEQ ID NO: 6072049 - DNA, 18 bp, Homo sapiens
cctataatcttatacaac

SEQ ID NO: 6072050 - DNA, 15 bp, Homo sapiens
cctataatgtgtgta

SEQ ID NO: 6072051 - DNA, 16 bp, Homo sapiens
cctataatgtgtgtat

SEQ ID NO: 6072052 - DNA, 20 bp, Homo sapiens
cctatacaacctaacttatg

SEQ ID NO: 6072053 - DNA, 23 bp, Homo sapiens
cctatacagaacagagggccaga

SEQ ID NO: 6072054 - DNA, 12 bp, Homo sapiens
cctataccattt

SEQ ID NO: 6072055 - DNA, 14 bp, Homo sapiens
cccaagttcaagtg

SEQ ID NO: 6072056 - DNA, 17 bp, Homo sapiens
cccaagttgcagtgagc

SEQ ID NO: 6072057 - DNA, 15 bp, Homo sapiens
cccaagttgctctgt

SEQ ID NO: 6072058 - DNA, 16 bp, Homo sapiens
cccaagttgctctgta

SEQ ID NO: 6072059 - DNA, 19 bp, Homo sapiens
cccaagttggaagggaccc

SEQ ID NO: 6072060 - DNA, 23 bp, Homo sapiens
cccaagttggaagggaccccaga

SEQ ID NO: 6072061 - DNA, 16 bp, Homo sapiens
cccaagtttatttctc

SEQ ID NO: 6072062 - DNA, 20 bp, Homo sapiens
cccaagtttatttctctctt

SEQ ID NO: 6072063 - DNA, 23 bp, Homo sapiens
cccaagtttccatagcaacagga

SEQ ID NO: 6072064 - DNA, 16 bp, Homo sapiens
cccaagtttctaaggg

SEQ ID NO: 6072065 - DNA, 19 bp, Homo sapiens
cccaagttttgtgaaattt

SEQ ID NO: 6072066 - DNA, 21 bp, Homo sapiens
cccaagttttgtgaaattttt

SEQ ID NO: 6072067 - DNA, 16 bp, Homo sapiens
cccaagttttttaatt

SEQ ID NO: 6072068 - DNA, 11 bp, Homo sapiens
cccaataaaag

SEQ ID NO: 6072069 - DNA, 14 bp, Homo sapiens
cccaataaaagtga

SEQ ID NO: 6072070 - DNA, 21 bp, Homo sapiens
cccaataaacattaagattga

SEQ ID NO: 6072071 - DNA, 11 bp, Homo sapiens
cccaataaacc

SEQ ID NO: 6072072 - DNA, 18 bp, Homo sapiens
cccaataaaccagtgtga

SEQ ID NO: 6072073 - DNA, 21 bp, Homo sapiens
cccaataaaccagtgtgaacc

SEQ ID NO: 6072074 - DNA, 21 bp, Homo sapiens
cccaataaagccgcgtccttg

SEQ ID NO: 6072075 - DNA, 22 bp, Homo sapiens
cccaataaagcgaatggaccat

SEQ ID NO: 6072076 - DNA, 14 bp, Homo sapiens
cccaataaagctgg

SEQ ID NO: 6072077 - DNA, 15 bp, Homo sapiens
cccaataaagctgga

SEQ ID NO: 6072078 - DNA, 15 bp, Homo sapiens
cccaataaaggcagc

SEQ ID NO: 6072079 - DNA, 21 bp, Homo sapiens
cccaataaaggcagctgcctc

SEQ ID NO: 6072080 - DNA, 16 bp, Homo sapiens
cccaataaagtcctct

SEQ ID NO: 6072081 - DNA, 22 bp, Homo sapiens
cccaatacctaataaggcatgc

SEQ ID NO: 6072082 - DNA, 19 bp, Homo sapiens
cccaatagctctactgccc

SEQ ID NO: 6072083 - DNA, 20 bp, Homo sapiens
cccaatagctctactgccct

SEQ ID NO: 6072084 - DNA, 22 bp, Homo sapiens
cccaatatggtggccctgggga

SEQ ID NO: 6072085 - DNA, 22 bp, Homo sapiens
cccaatattaagtaaaaaatat

SEQ ID NO: 6072086 - DNA, 11 bp, Homo sapiens
cccaatattat

SEQ ID NO: 6072087 - DNA, 12 bp, Homo sapiens
cccaatattata

SEQ ID NO: 6072088 - DNA, 16 bp, Homo sapiens
cccaatcagcactgaa

SEQ ID NO: 6072089 - DNA, 24 bp, Homo sapiens
cccaatccaggtacgcacagacag

SEQ ID NO: 6072090 - DNA, 16 bp, Homo sapiens
cccaatccatcagtgc

SEQ ID NO: 6072091 - DNA, 21 bp, Homo sapiens
cccaatcccagttcttcctgc

SEQ ID NO: 6072092 - DNA, 12 bp, Homo sapiens
cccaatccctca

SEQ ID NO: 6072093 - DNA, 13 bp, Homo sapiens
cccaatccctcaa

SEQ ID NO: 6072094 - DNA, 12 bp, Homo sapiens
cccaatccctct

SEQ ID NO: 6072095 - DNA, 12 bp, Homo sapiens
cccaatccctga

SEQ ID NO: 6072096 - DNA, 15 bp, Homo sapiens
cccaatccctgccac

SEQ ID NO: 6072097 - DNA, 16 bp, Homo sapiens
cccaatccctgccact

SEQ ID NO: 6072098 - DNA, 23 bp, Homo sapiens
cccaatccctgccactgggctct

SEQ ID NO: 6072099 - DNA, 17 bp, Homo sapiens
cccaatccctttattac

SEQ ID NO: 6072100 - DNA, 17 bp, Homo sapiens
cccaatcctccctggag

SEQ ID NO: 6072101 - DNA, 16 bp, Homo sapiens
cccaatcctctctccc

SEQ ID NO: 6072102 - DNA, 21 bp, Homo sapiens
cccaatcctctctcccctctg

SEQ ID NO: 6072103 - DNA, 13 bp, Homo sapiens
cccaatctgcaca

SEQ ID NO: 6072104 - DNA, 20 bp, Homo sapiens
cccaatctgcacactccagg

SEQ ID NO: 6072105 - DNA, 16 bp, Homo sapiens
cccaatcttgcccact

SEQ ID NO: 6072106 - DNA, 23 bp, Homo sapiens
cccaatgcactttgttctggctc

SEQ ID NO: 6072107 - DNA, 18 bp, Homo sapiens
cccaatgcatagagccct

SEQ ID NO: 6072108 - DNA, 22 bp, Homo sapiens
cccaatgcatagagccctggcc

SEQ ID NO: 6072109 - DNA, 16 bp, Homo sapiens
cccaatgcctataaaa

SEQ ID NO: 6072110 - DNA, 13 bp, Homo sapiens
cccaatgctgctt

SEQ ID NO: 6072111 - DNA, 17 bp, Homo sapiens
cccaatgctgcttttgg

SEQ ID NO: 6072112 - DNA, 22 bp, Homo sapiens
cccaatgctttgggaggccaag

SEQ ID NO: 6072113 - DNA, 18 bp, Homo sapiens
cccaatggagaaatgaag

SEQ ID NO: 6072114 - DNA, 18 bp, Homo sapiens
cccaatggagactttctg

SEQ ID NO: 6072115 - DNA, 17 bp, Homo sapiens
cccaatgtctcccacac

SEQ ID NO: 6072116 - DNA, 11 bp, Homo sapiens
cccaattaaaa

SEQ ID NO: 6072117 - DNA, 14 bp, Homo sapiens
cccaattaaaatac

SEQ ID NO: 6072118 - DNA, 18 bp, Homo sapiens
cccaattaactgaagcaa

SEQ ID NO: 6072119 - DNA, 22 bp, Homo sapiens
cccaattactattccctttgac

SEQ ID NO: 6072120 - DNA, 19 bp, Homo sapiens
cccaattaggaagtgtaac

SEQ ID NO: 6072121 - DNA, 14 bp, Homo sapiens
cccaattcaggact

SEQ ID NO: 6072122 - DNA, 20 bp, Homo sapiens
cccaattcaggactggctca

SEQ ID NO: 6072123 - DNA, 19 bp, Homo sapiens
cccaattcggggcctgctg

SEQ ID NO: 6072124 - DNA, 16 bp, Homo sapiens
cccaattctgcccgct

SEQ ID NO: 6072125 - DNA, 21 bp, Homo sapiens
cccaattcttacaaacatgtg

SEQ ID NO: 6072126 - DNA, 15 bp, Homo sapiens
cccaattgccacatt

SEQ ID NO: 6072127 - DNA, 14 bp, Homo sapiens
cccaattgctggag

SEQ ID NO: 6072128 - DNA, 12 bp, Homo sapiens
cccaatttaatt

SEQ ID NO: 6072129 - DNA, 13 bp, Homo sapiens
cccaatttatttt

SEQ ID NO: 6072130 - DNA, 22 bp, Homo sapiens
cccaatttcggattttttccaa

SEQ ID NO: 6072131 - DNA, 18 bp, Homo sapiens
cccaattttgcagggagc

SEQ ID NO: 6072132 - DNA, 23 bp, Homo sapiens
cccacaaaaaattgctcctaact

SEQ ID NO: 6072133 - DNA, 13 bp, Homo sapiens
cccacaaaaatgt

SEQ ID NO: 6072134 - DNA, 12 bp, Homo sapiens
cccacaaaatat

SEQ ID NO: 6072135 - DNA, 16 bp, Homo sapiens
cccacaaactccaggc

SEQ ID NO: 6072136 - DNA, 23 bp, Homo sapiens
cccacaaactccaggctggaagt

SEQ ID NO: 6072137 - DNA, 13 bp, Homo sapiens
cccacaaagcctt

SEQ ID NO: 6072138 - DNA, 22 bp, Homo sapiens
cccacaaagccttatcaagtgt

SEQ ID NO: 6072139 - DNA, 12 bp, Homo sapiens
cccacaaagggg

SEQ ID NO: 6072140 - DNA, 13 bp, Homo sapiens
cccacaaagggga

SEQ ID NO: 6072141 - DNA, 20 bp, Homo sapiens
cccacaacgtcccctcaagc

SEQ ID NO: 6072142 - DNA, 17 bp, Homo sapiens
cccacaactcctgtcta

SEQ ID NO: 6072143 - DNA, 22 bp, Homo sapiens
cccacaagcctctgcccaggca

SEQ ID NO: 6072144 - DNA, 21 bp, Homo sapiens
cccacaagcctgcctcgcctt

SEQ ID NO: 6072145 - DNA, 21 bp, Homo sapiens
cccacaagccttactcacctc

SEQ ID NO: 6072146 - DNA, 15 bp, Homo sapiens
cccacaagctgcctc

SEQ ID NO: 6072147 - DNA, 16 bp, Homo sapiens
cccacaagctgtccct

SEQ ID NO: 6072148 - DNA, 19 bp, Homo sapiens
cccacaagctgtccctgca

SEQ ID NO: 6072149 - DNA, 15 bp, Homo sapiens
cccacaaggcccagc

SEQ ID NO: 6072150 - DNA, 19 bp, Homo sapiens
cccacaaggcccagccctg

SEQ ID NO: 6072151 - DNA, 16 bp, Homo sapiens
cccacaaggcctggtc

SEQ ID NO: 6072152 - DNA, 17 bp, Homo sapiens
cccacaaggcctggtct

SEQ ID NO: 6072153 - DNA, 21 bp, Homo sapiens
cccacaaggcctggtctggga

SEQ ID NO: 6072154 - DNA, 14 bp, Homo sapiens
cccacaatctgagc

SEQ ID NO: 6072155 - DNA, 15 bp, Homo sapiens
cccacaatctgagca

SEQ ID NO: 6072156 - DNA, 22 bp, Homo sapiens
cccacaatctggcttagtgcca

SEQ ID NO: 6072157 - DNA, 23 bp, Homo sapiens
cccacaatctggcttagtgccac

SEQ ID NO: 6072158 - DNA, 15 bp, Homo sapiens
cccacaatggctggg

SEQ ID NO: 6072159 - DNA, 15 bp, Homo sapiens
cccacaattcttttg

SEQ ID NO: 6072160 - DNA, 13 bp, Homo sapiens
cccacaatttctt

SEQ ID NO: 6072161 - DNA, 17 bp, Homo sapiens
cccacaatttctttaaa

SEQ ID NO: 6072162 - DNA, 23 bp, Homo sapiens
cccacaatttctttaaaaaagaa

SEQ ID NO: 6072163 - DNA, 10 bp, Homo sapiens
cccacacaca

SEQ ID NO: 6072164 - DNA, 15 bp, Homo sapiens
cccacacacactcct

SEQ ID NO: 6072165 - DNA, 18 bp, Homo sapiens
cccacacacactccttcc

SEQ ID NO: 6072166 - DNA, 22 bp, Homo sapiens
cccacacacttagccattgaaa

SEQ ID NO: 6072167 - DNA, 15 bp, Homo sapiens
cccacacagcccgag

SEQ ID NO: 6072168 - DNA, 15 bp, Homo sapiens
cccacacagcctcta

SEQ ID NO: 6072169 - DNA, 13 bp, Homo sapiens
cccacacagctgc

SEQ ID NO: 6072170 - DNA, 14 bp, Homo sapiens
cccacacagctgcc

SEQ ID NO: 6072171 - DNA, 15 bp, Homo sapiens
cccacacagctgccc

SEQ ID NO: 6072172 - DNA, 12 bp, Homo sapiens
cccacacaggcc

SEQ ID NO: 6072173 - DNA, 17 bp, Homo sapiens
cccacacaggcctggcc

SEQ ID NO: 6072174 - DNA, 18 bp, Homo sapiens
cccacacaggcctggccc

SEQ ID NO: 6072175 - DNA, 19 bp, Homo sapiens
cccacacaggcctggccca

SEQ ID NO: 6072176 - DNA, 23 bp, Homo sapiens
cccacacaggcctggcccagcca

SEQ ID NO: 6072177 - DNA, 12 bp, Homo sapiens
cccacacagggc

SEQ ID NO: 6072178 - DNA, 15 bp, Homo sapiens
cccacacagggcact

SEQ ID NO: 6072179 - DNA, 12 bp, Homo sapiens
cccacacatatt

SEQ ID NO: 6072180 - DNA, 17 bp, Homo sapiens
cccacaccataagctac

SEQ ID NO: 6072181 - DNA, 12 bp, Homo sapiens
cccacaccatct

SEQ ID NO: 6072182 - DNA, 17 bp, Homo sapiens
cccacaccatctggccc

SEQ ID NO: 6072183 - DNA, 18 bp, Homo sapiens
cccacaccatctggccca

SEQ ID NO: 6072184 - DNA, 16 bp, Homo sapiens
cccacacccagccagc

SEQ ID NO: 6072185 - DNA, 14 bp, Homo sapiens
cccacacccagcta

SEQ ID NO: 6072186 - DNA, 16 bp, Homo sapiens
cccacacccagggcta

SEQ ID NO: 6072187 - DNA, 17 bp, Homo sapiens
cccacaccccgtctgcc

SEQ ID NO: 6072188 - DNA, 19 bp, Homo sapiens
cccacaccccgtctgcccc

SEQ ID NO: 6072189 - DNA, 15 bp, Homo sapiens
cccacaccctacagc

SEQ ID NO: 6072190 - DNA, 18 bp, Homo sapiens
cccacaccctacagcaga

SEQ ID NO: 6072191 - DNA, 19 bp, Homo sapiens
cccacaccgtcttccttca

SEQ ID NO: 6072192 - DNA, 24 bp, Homo sapiens
cccacacctccacagttcagtggc

SEQ ID NO: 6072193 - DNA, 14 bp, Homo sapiens
cccacacctgcagt

SEQ ID NO: 6072194 - DNA, 15 bp, Homo sapiens
cccacacctgcctgc

SEQ ID NO: 6072195 - DNA, 19 bp, Homo sapiens
cccacaccttccagggccc

SEQ ID NO: 6072196 - DNA, 20 bp, Homo sapiens
cccacaccttccagggccct

SEQ ID NO: 6072197 - DNA, 19 bp, Homo sapiens
cccacacgccggggctggc

SEQ ID NO: 6072198 - DNA, 22 bp, Homo sapiens
cccacacgccggggctggccct

SEQ ID NO: 6072199 - DNA, 21 bp, Homo sapiens
cccacacggactcccgggcca

SEQ ID NO: 6072200 - DNA, 18 bp, Homo sapiens
cccacacgtgctcgcagc

SEQ ID NO: 6072201 - DNA, 22 bp, Homo sapiens
cccacacgtgctcgcagcctgg

SEQ ID NO: 6072202 - DNA, 14 bp, Homo sapiens
cccacactaacctg

SEQ ID NO: 6072203 - DNA, 18 bp, Homo sapiens
cccacactacgcagaaga

SEQ ID NO: 6072204 - DNA, 16 bp, Homo sapiens
cccacactatgcacag

SEQ ID NO: 6072205 - DNA, 20 bp, Homo sapiens
cccacactatgcacagagcc

SEQ ID NO: 6072206 - DNA, 21 bp, Homo sapiens
cccacactatgcacagagccc

SEQ ID NO: 6072207 - DNA, 13 bp, Homo sapiens
cccacactcactc

SEQ ID NO: 6072208 - DNA, 21 bp, Homo sapiens
cccacactgtggccaggcctt

SEQ ID NO: 6072209 - DNA, 15 bp, Homo sapiens
cccacacttccctgg

SEQ ID NO: 6072210 - DNA, 16 bp, Homo sapiens
cccacacttccctggc

SEQ ID NO: 6072211 - DNA, 17 bp, Homo sapiens
cccacacttgttccagc

SEQ ID NO: 6072212 - DNA, 16 bp, Homo sapiens
cccacagaaagagagc

SEQ ID NO: 6072213 - DNA, 17 bp, Homo sapiens
cccacagaaagccagga

SEQ ID NO: 6072214 - DNA, 12 bp, Homo sapiens
cccacagaaatc

SEQ ID NO: 6072215 - DNA, 20 bp, Homo sapiens
cccacagaagggggaacgca

SEQ ID NO: 6072216 - DNA, 15 bp, Homo sapiens
cccacagacctgcag

SEQ ID NO: 6072217 - DNA, 14 bp, Homo sapiens
cccacagactgccc

SEQ ID NO: 6072218 - DNA, 15 bp, Homo sapiens
cccacagactgcccc

SEQ ID NO: 6072219 - DNA, 12 bp, Homo sapiens
cccacagagaca

SEQ ID NO: 6072220 - DNA, 21 bp, Homo sapiens
cccacagagtgccatccctga

SEQ ID NO: 6072221 - DNA, 14 bp, Homo sapiens
cccacagagtgctg

SEQ ID NO: 6072222 - DNA, 14 bp, Homo sapiens
cccacagatccatc

SEQ ID NO: 6072223 - DNA, 16 bp, Homo sapiens
cccacagatccatcct

SEQ ID NO: 6072224 - DNA, 20 bp, Homo sapiens
cccacagatgtctctggggc

SEQ ID NO: 6072225 - DNA, 12 bp, Homo sapiens
cccacagccagt

SEQ ID NO: 6072226 - DNA, 21 bp, Homo sapiens
cccacagcccccaccccagca

SEQ ID NO: 6072227 - DNA, 12 bp, Homo sapiens
cccacagcccta

SEQ ID NO: 6072228 - DNA, 14 bp, Homo sapiens
cccacagccctgaa

SEQ ID NO: 6072229 - DNA, 15 bp, Homo sapiens
cccacagccctgaaa

SEQ ID NO: 6072230 - DNA, 15 bp, Homo sapiens
cccacagccctgaga

SEQ ID NO: 6072231 - DNA, 17 bp, Homo sapiens
cccacagcctctgcctg

SEQ ID NO: 6072232 - DNA, 18 bp, Homo sapiens
cccacagcctctgcctgt

SEQ ID NO: 6072233 - DNA, 19 bp, Homo sapiens
cccacagcctctggctcca

SEQ ID NO: 6072234 - DNA, 16 bp, Homo sapiens
cccacagcctcttcct

SEQ ID NO: 6072235 - DNA, 22 bp, Homo sapiens
cctataccctaggtctccaccc

SEQ ID NO: 6072236 - DNA, 18 bp, Homo sapiens
cctatacctgtgtttctt

SEQ ID NO: 6072237 - DNA, 15 bp, Homo sapiens
cctatagagaggggg

SEQ ID NO: 6072238 - DNA, 18 bp, Homo sapiens
cctatagcactgagctca

SEQ ID NO: 6072239 - DNA, 17 bp, Homo sapiens
cctataggaacagccca

SEQ ID NO: 6072240 - DNA, 21 bp, Homo sapiens
cctataggaacagcccagcac

SEQ ID NO: 6072241 - DNA, 17 bp, Homo sapiens
cctatagtatatgatta

SEQ ID NO: 6072242 - DNA, 22 bp, Homo sapiens
cctatagtttcaccactcctct

SEQ ID NO: 6072243 - DNA, 23 bp, Homo sapiens
cctatagtttcaccactcctctc

SEQ ID NO: 6072244 - DNA, 14 bp, Homo sapiens
cctatagtttgtca

SEQ ID NO: 6072245 - DNA, 12 bp, Homo sapiens
cctatatacctc

SEQ ID NO: 6072246 - DNA, 15 bp, Homo sapiens
cctatatatttctat

SEQ ID NO: 6072247 - DNA, 23 bp, Homo sapiens
cctatatccagaaggggagcttt

SEQ ID NO: 6072248 - DNA, 15 bp, Homo sapiens
cctatatctgagaga

SEQ ID NO: 6072249 - DNA, 12 bp, Homo sapiens
cctatatgccag

SEQ ID NO: 6072250 - DNA, 19 bp, Homo sapiens
cctatattatcataagaat

SEQ ID NO: 6072251 - DNA, 15 bp, Homo sapiens
cctatattgatttaa

SEQ ID NO: 6072252 - DNA, 22 bp, Homo sapiens
cctatattgttttcagtgtaca

SEQ ID NO: 6072253 - DNA, 15 bp, Homo sapiens
cctatatttacagtg

SEQ ID NO: 6072254 - DNA, 14 bp, Homo sapiens
cctatatttcaata

SEQ ID NO: 6072255 - DNA, 17 bp, Homo sapiens
cctatatttcctcttct

SEQ ID NO: 6072256 - DNA, 22 bp, Homo sapiens
cctatcaatccaaattccctct

SEQ ID NO: 6072257 - DNA, 16 bp, Homo sapiens
cctatcaatcctgccc

SEQ ID NO: 6072258 - DNA, 20 bp, Homo sapiens
cctatcacccaacgctccaa

SEQ ID NO: 6072259 - DNA, 16 bp, Homo sapiens
cctatcacctcccctc

SEQ ID NO: 6072260 - DNA, 17 bp, Homo sapiens
cctatcacctcccctcc

SEQ ID NO: 6072261 - DNA, 23 bp, Homo sapiens
cctatcatcagttaggattaggt

SEQ ID NO: 6072262 - DNA, 18 bp, Homo sapiens
cctatcatttattctgct

SEQ ID NO: 6072263 - DNA, 13 bp, Homo sapiens
cctatccaccacc

SEQ ID NO: 6072264 - DNA, 12 bp, Homo sapiens
cctatccaccca

SEQ ID NO: 6072265 - DNA, 21 bp, Homo sapiens
cctatccacccagcccattct

SEQ ID NO: 6072266 - DNA, 13 bp, Homo sapiens
cctatccatcctg

SEQ ID NO: 6072267 - DNA, 15 bp, Homo sapiens
cctatcccaaatgtg

SEQ ID NO: 6072268 - DNA, 22 bp, Homo sapiens
cctatcccaaatgtggaattga

SEQ ID NO: 6072269 - DNA, 13 bp, Homo sapiens
cctatcccatccc

SEQ ID NO: 6072270 - DNA, 14 bp, Homo sapiens
cctatcccatccca

SEQ ID NO: 6072271 - DNA, 15 bp, Homo sapiens
cctatcccatcccat

SEQ ID NO: 6072272 - DNA, 17 bp, Homo sapiens
cctatccccaggccagg

SEQ ID NO: 6072273 - DNA, 13 bp, Homo sapiens
cctatccctggac

SEQ ID NO: 6072274 - DNA, 18 bp, Homo sapiens
cctatccgctgccagcct

SEQ ID NO: 6072275 - DNA, 17 bp, Homo sapiens
cctatcctaattgtcca

SEQ ID NO: 6072276 - DNA, 12 bp, Homo sapiens
cctatcctcccc

SEQ ID NO: 6072277 - DNA, 13 bp, Homo sapiens
cctatcctcccct

SEQ ID NO: 6072278 - DNA, 14 bp, Homo sapiens
cctatcctcccctt

SEQ ID NO: 6072279 - DNA, 14 bp, Homo sapiens
cctatcctctgagt

SEQ ID NO: 6072280 - DNA, 21 bp, Homo sapiens
cctatcctggttagaagaaaa

SEQ ID NO: 6072281 - DNA, 18 bp, Homo sapiens
cctatccttggagagcag

SEQ ID NO: 6072282 - DNA, 16 bp, Homo sapiens
cctatccttggcacca

SEQ ID NO: 6072283 - DNA, 17 bp, Homo sapiens
cctatccttggcaccaa

SEQ ID NO: 6072284 - DNA, 22 bp, Homo sapiens
cctatcgatctggaaagagctg

SEQ ID NO: 6072285 - DNA, 21 bp, Homo sapiens
cctatctattaaagtgacttt

SEQ ID NO: 6072286 - DNA, 16 bp, Homo sapiens
cctatctcagggaggg

SEQ ID NO: 6072287 - DNA, 23 bp, Homo sapiens
cctatctcatagggatgctgtga

SEQ ID NO: 6072288 - DNA, 19 bp, Homo sapiens
cctatctcccccaacccac

SEQ ID NO: 6072289 - DNA, 13 bp, Homo sapiens
cctatctccctgg

SEQ ID NO: 6072290 - DNA, 16 bp, Homo sapiens
cctatctccctggctc

SEQ ID NO: 6072291 - DNA, 14 bp, Homo sapiens
cctatctcctgaca

SEQ ID NO: 6072292 - DNA, 20 bp, Homo sapiens
cctatctcgtgggagagcca

SEQ ID NO: 6072293 - DNA, 13 bp, Homo sapiens
cctatctgacttc

SEQ ID NO: 6072294 - DNA, 23 bp, Homo sapiens
cctatctggaaaaaaaaaaatat

SEQ ID NO: 6072295 - DNA, 16 bp, Homo sapiens
cctatctgggcttcct

SEQ ID NO: 6072296 - DNA, 17 bp, Homo sapiens
cctatctgggcttcctg

SEQ ID NO: 6072297 - DNA, 20 bp, Homo sapiens
cctatctgggcttcctggag

SEQ ID NO: 6072298 - DNA, 17 bp, Homo sapiens
cctatctggggagctcc

SEQ ID NO: 6072299 - DNA, 14 bp, Homo sapiens
cctatctgtaagag

SEQ ID NO: 6072300 - DNA, 14 bp, Homo sapiens
cctatcttgtcctg

SEQ ID NO: 6072301 - DNA, 13 bp, Homo sapiens
cctatcttgtgaa

SEQ ID NO: 6072302 - DNA, 19 bp, Homo sapiens
cctatctttgccaccctca

SEQ ID NO: 6072303 - DNA, 18 bp, Homo sapiens
cctatcttttagttttag

SEQ ID NO: 6072304 - DNA, 19 bp, Homo sapiens
cctatcttttctcccacct

SEQ ID NO: 6072305 - DNA, 15 bp, Homo sapiens
cctatgaacagacca

SEQ ID NO: 6072306 - DNA, 16 bp, Homo sapiens
cctatgaacagaccat

SEQ ID NO: 6072307 - DNA, 21 bp, Homo sapiens
cctatgaagtaaagaactgca

SEQ ID NO: 6072308 - DNA, 22 bp, Homo sapiens
cctatgaagttggcacatttca

SEQ ID NO: 6072309 - DNA, 15 bp, Homo sapiens
cctatgaccctgtgc

SEQ ID NO: 6072310 - DNA, 17 bp, Homo sapiens
cctatgacttgggcacc

SEQ ID NO: 6072311 - DNA, 22 bp, Homo sapiens
cctatgacttgggcacccccag

SEQ ID NO: 6072312 - DNA, 18 bp, Homo sapiens
cctatgagatggccatgc

SEQ ID NO: 6072313 - DNA, 15 bp, Homo sapiens
cctatgagcatcctg

SEQ ID NO: 6072314 - DNA, 17 bp, Homo sapiens
cctatgataaattcaca

SEQ ID NO: 6072315 - DNA, 18 bp, Homo sapiens
cctatgatactgtctctc

SEQ ID NO: 6072316 - DNA, 17 bp, Homo sapiens
cctatgatattttctgt

SEQ ID NO: 6072317 - DNA, 13 bp, Homo sapiens
cctatgatcccag

SEQ ID NO: 6072318 - DNA, 14 bp, Homo sapiens
cctatgatcccagc

SEQ ID NO: 6072319 - DNA, 19 bp, Homo sapiens
cctatgatggatggcagac

SEQ ID NO: 6072320 - DNA, 22 bp, Homo sapiens
cctatgatggatggcagactct

SEQ ID NO: 6072321 - DNA, 21 bp, Homo sapiens
cctatgattgaaaagtaaaca

SEQ ID NO: 6072322 - DNA, 17 bp, Homo sapiens
cctatgcaaaccagctt

SEQ ID NO: 6072323 - DNA, 12 bp, Homo sapiens
cctatgcaataa

SEQ ID NO: 6072324 - DNA, 14 bp, Homo sapiens
cctatgcacatatg

SEQ ID NO: 6072325 - DNA, 20 bp, Homo sapiens
cctatgcacatatggactct

SEQ ID NO: 6072326 - DNA, 16 bp, Homo sapiens
cctatgcactgaagag

SEQ ID NO: 6072327 - DNA, 21 bp, Homo sapiens
cctatgcagacatctctggag

SEQ ID NO: 6072328 - DNA, 23 bp, Homo sapiens
cctatgcagacatctctggagcc

SEQ ID NO: 6072329 - DNA, 14 bp, Homo sapiens
cctatgcagggagg

SEQ ID NO: 6072330 - DNA, 17 bp, Homo sapiens
cctatgcagggaggcca

SEQ ID NO: 6072331 - DNA, 14 bp, Homo sapiens
cctatgcatggttt

SEQ ID NO: 6072332 - DNA, 18 bp, Homo sapiens
cctatgcatggtttcagc

SEQ ID NO: 6072333 - DNA, 21 bp, Homo sapiens
cctatgcatggtttcagcact

SEQ ID NO: 6072334 - DNA, 17 bp, Homo sapiens
cctatgccacctgcagc

SEQ ID NO: 6072335 - DNA, 20 bp, Homo sapiens
cctatgccacctgcagcgtc

SEQ ID NO: 6072336 - DNA, 15 bp, Homo sapiens
cctatgccagtgctc

SEQ ID NO: 6072337 - DNA, 16 bp, Homo sapiens
cctatgcccagcctcc

SEQ ID NO: 6072338 - DNA, 14 bp, Homo sapiens
cctatgcctgtggt

SEQ ID NO: 6072339 - DNA, 20 bp, Homo sapiens
cctatgctgcctaggctgac

SEQ ID NO: 6072340 - DNA, 22 bp, Homo sapiens
cctatgctggtagatgctgagg

SEQ ID NO: 6072341 - DNA, 23 bp, Homo sapiens
cctatgctggtagatgctgaggc

SEQ ID NO: 6072342 - DNA, 20 bp, Homo sapiens
cctatgcttaataaaagaac

SEQ ID NO: 6072343 - DNA, 23 bp, Homo sapiens
cctatgcttctagaaagcccctc

SEQ ID NO: 6072344 - DNA, 22 bp, Homo sapiens
cctatggaaacccgagggttga

SEQ ID NO: 6072345 - DNA, 18 bp, Homo sapiens
cctatggaaagggtgtgg

SEQ ID NO: 6072346 - DNA, 17 bp, Homo sapiens
cctatggaagtggttct

SEQ ID NO: 6072347 - DNA, 13 bp, Homo sapiens
cctatggagagcc

SEQ ID NO: 6072348 - DNA, 14 bp, Homo sapiens
cctatggagagccc

SEQ ID NO: 6072349 - DNA, 16 bp, Homo sapiens
cctatggagagccctg

SEQ ID NO: 6072350 - DNA, 17 bp, Homo sapiens
cctatggagagccctgg

SEQ ID NO: 6072351 - DNA, 20 bp, Homo sapiens
cctatggagcctctgcagac

SEQ ID NO: 6072352 - DNA, 11 bp, Homo sapiens
cctatggccac

SEQ ID NO: 6072353 - DNA, 15 bp, Homo sapiens
cctatggcccagcca

SEQ ID NO: 6072354 - DNA, 22 bp, Homo sapiens
cctatggcccagccactgcagc

SEQ ID NO: 6072355 - DNA, 15 bp, Homo sapiens
cctatggcctcatgt

SEQ ID NO: 6072356 - DNA, 14 bp, Homo sapiens
cctatggctgagcc

SEQ ID NO: 6072357 - DNA, 15 bp, Homo sapiens
cctatggctgcctgc

SEQ ID NO: 6072358 - DNA, 19 bp, Homo sapiens
cctatggctggccactgca

SEQ ID NO: 6072359 - DNA, 21 bp, Homo sapiens
cctatggctggccactgcaca

SEQ ID NO: 6072360 - DNA, 23 bp, Homo sapiens
cctatggctggccactgcacaga

SEQ ID NO: 6072361 - DNA, 17 bp, Homo sapiens
cctatgggcctgccggg

SEQ ID NO: 6072362 - DNA, 20 bp, Homo sapiens
cctatggtcacagacttctg

SEQ ID NO: 6072363 - DNA, 22 bp, Homo sapiens
cctatgtaagaattcagaagac

SEQ ID NO: 6072364 - DNA, 19 bp, Homo sapiens
cctatgtacttaatccttt

SEQ ID NO: 6072365 - DNA, 14 bp, Homo sapiens
cctatgtacttgaa

SEQ ID NO: 6072366 - DNA, 19 bp, Homo sapiens
cctatgtagacaatataag

SEQ ID NO: 6072367 - DNA, 19 bp, Homo sapiens
cctatgtagtgtctttatt

SEQ ID NO: 6072368 - DNA, 17 bp, Homo sapiens
cctatgtattttcctaa

SEQ ID NO: 6072369 - DNA, 15 bp, Homo sapiens
cctatgtcctaagga

SEQ ID NO: 6072370 - DNA, 21 bp, Homo sapiens
cctatgtcctaaggacacact

SEQ ID NO: 6072371 - DNA, 23 bp, Homo sapiens
cctatgtcctaaggacacactaa

SEQ ID NO: 6072372 - DNA, 16 bp, Homo sapiens
cctatgtctaaattca

SEQ ID NO: 6072373 - DNA, 14 bp, Homo sapiens
cctatgtctcagga

SEQ ID NO: 6072374 - DNA, 15 bp, Homo sapiens
cctatgtctcctcta

SEQ ID NO: 6072375 - DNA, 11 bp, Homo sapiens
cctatgtctgg

SEQ ID NO: 6072376 - DNA, 13 bp, Homo sapiens
cctatgtctggca

SEQ ID NO: 6072377 - DNA, 21 bp, Homo sapiens
cctatgtgagtttcagaaatt

SEQ ID NO: 6072378 - DNA, 18 bp, Homo sapiens
cctatgtgcgaagcaaga

SEQ ID NO: 6072379 - DNA, 21 bp, Homo sapiens
cctatgtgcgaagcaagaaga

SEQ ID NO: 6072380 - DNA, 16 bp, Homo sapiens
cctatgtggcagctgg

SEQ ID NO: 6072381 - DNA, 13 bp, Homo sapiens
cctatgtggcatg

SEQ ID NO: 6072382 - DNA, 22 bp, Homo sapiens
cctatgttgatccatccagctt

SEQ ID NO: 6072383 - DNA, 16 bp, Homo sapiens
cctatgttgcccaggc

SEQ ID NO: 6072384 - DNA, 22 bp, Homo sapiens
cctatgttgctataagaaaagt

SEQ ID NO: 6072385 - DNA, 23 bp, Homo sapiens
cctatgttgggggggaccctgcc

SEQ ID NO: 6072386 - DNA, 11 bp, Homo sapiens
cctatgtttgc

SEQ ID NO: 6072387 - DNA, 15 bp, Homo sapiens
cctattaaaggaaaa

SEQ ID NO: 6072388 - DNA, 16 bp, Homo sapiens
cctattaatcttcagc

SEQ ID NO: 6072389 - DNA, 16 bp, Homo sapiens
cctattacttttcatc

SEQ ID NO: 6072390 - DNA, 16 bp, Homo sapiens
cctattagagaagaga

SEQ ID NO: 6072391 - DNA, 20 bp, Homo sapiens
cctattagatacacttctta

SEQ ID NO: 6072392 - DNA, 21 bp, Homo sapiens
cctattagatacacttcttaa

SEQ ID NO: 6072393 - DNA, 22 bp, Homo sapiens
cctattagatacacttcttaaa

SEQ ID NO: 6072394 - DNA, 15 bp, Homo sapiens
cctattagtgttata

SEQ ID NO: 6072395 - DNA, 19 bp, Homo sapiens
cctattagtgttatatgaa

SEQ ID NO: 6072396 - DNA, 19 bp, Homo sapiens
cctattataattgtcatga

SEQ ID NO: 6072397 - DNA, 21 bp, Homo sapiens
cctattcaacacacacatgct

SEQ ID NO: 6072398 - DNA, 20 bp, Homo sapiens
cctattcaccctccacttcc

SEQ ID NO: 6072399 - DNA, 23 bp, Homo sapiens
cctattcaccctccacttcccgt

SEQ ID NO: 6072400 - DNA, 14 bp, Homo sapiens
cctattccttcaga

SEQ ID NO: 6072401 - DNA, 19 bp, Homo sapiens
cctattcgtagccatctcc

SEQ ID NO: 6072402 - DNA, 20 bp, Homo sapiens
cctattctatccatctcctg

SEQ ID NO: 6072403 - DNA, 21 bp, Homo sapiens
cctattctatccatctcctgg

SEQ ID NO: 6072404 - DNA, 22 bp, Homo sapiens
cctattctattgcagttataga

SEQ ID NO: 6072405 - DNA, 16 bp, Homo sapiens
cctattctcaccagga

SEQ ID NO: 6072406 - DNA, 16 bp, Homo sapiens
cctattctcctgccat

SEQ ID NO: 6072407 - DNA, 12 bp, Homo sapiens
cctattctgaaa

SEQ ID NO: 6072408 - DNA, 19 bp, Homo sapiens
cctattctgaaaaagacat

SEQ ID NO: 6072409 - DNA, 20 bp, Homo sapiens
cctattctgaaaaagacata

SEQ ID NO: 6072410 - DNA, 13 bp, Homo sapiens
cctattctgccat

SEQ ID NO: 6072411 - DNA, 17 bp, Homo sapiens
cctattctgtgttttat

SEQ ID NO: 6072412 - DNA, 22 bp, Homo sapiens
cctattggcttactgaaagaca

SEQ ID NO: 6072413 - DNA, 20 bp, Homo sapiens
cccacagcgagcctgtgcct

SEQ ID NO: 6072414 - DNA, 18 bp, Homo sapiens
cccacagcgtccctggcg

SEQ ID NO: 6072415 - DNA, 15 bp, Homo sapiens
cccacagctcagctg

SEQ ID NO: 6072416 - DNA, 19 bp, Homo sapiens
cccacagctcagctgccca

SEQ ID NO: 6072417 - DNA, 12 bp, Homo sapiens
cccacagctccc

SEQ ID NO: 6072418 - DNA, 15 bp, Homo sapiens
cccacagctccttgc

SEQ ID NO: 6072419 - DNA, 16 bp, Homo sapiens
cccacagctctgctgg

SEQ ID NO: 6072420 - DNA, 13 bp, Homo sapiens
cccacagctctgg

SEQ ID NO: 6072421 - DNA, 19 bp, Homo sapiens
cccacagctctgggcctct

SEQ ID NO: 6072422 - DNA, 20 bp, Homo sapiens
cccacagctctgggcctctt

SEQ ID NO: 6072423 - DNA, 12 bp, Homo sapiens
cccacagctggg

SEQ ID NO: 6072424 - DNA, 15 bp, Homo sapiens
cccacagctggggcc

SEQ ID NO: 6072425 - DNA, 17 bp, Homo sapiens
cccacagcttcctgagg

SEQ ID NO: 6072426 - DNA, 18 bp, Homo sapiens
cccacagcttcctgaggg

SEQ ID NO: 6072427 - DNA, 22 bp, Homo sapiens
cccacaggaagcctgcagtcct

SEQ ID NO: 6072428 - DNA, 23 bp, Homo sapiens
cccacaggaagcctgcagtcctg

SEQ ID NO: 6072429 - DNA, 20 bp, Homo sapiens
cccacaggaagctcagcctt

SEQ ID NO: 6072430 - DNA, 21 bp, Homo sapiens
cccacaggaggtggtctggga

SEQ ID NO: 6072431 - DNA, 22 bp, Homo sapiens
cccacaggagttgtgagccctc

SEQ ID NO: 6072432 - DNA, 13 bp, Homo sapiens
cccacaggatcag

SEQ ID NO: 6072433 - DNA, 21 bp, Homo sapiens
cccacaggcacattaactgtt

SEQ ID NO: 6072434 - DNA, 14 bp, Homo sapiens
cccacaggcagctt

SEQ ID NO: 6072435 - DNA, 21 bp, Homo sapiens
cccacaggccacacgctgccc

SEQ ID NO: 6072436 - DNA, 14 bp, Homo sapiens
cccacaggcctgtt

SEQ ID NO: 6072437 - DNA, 15 bp, Homo sapiens
cccacaggggatggt

SEQ ID NO: 6072438 - DNA, 14 bp, Homo sapiens
cccacaggtgaggg

SEQ ID NO: 6072439 - DNA, 21 bp, Homo sapiens
cccacaggtgaggggcaggac

SEQ ID NO: 6072440 - DNA, 16 bp, Homo sapiens
cccacaggttctatga

SEQ ID NO: 6072441 - DNA, 16 bp, Homo sapiens
cccacagtcacacaga

SEQ ID NO: 6072442 - DNA, 17 bp, Homo sapiens
cccacagtcacacagag

SEQ ID NO: 6072443 - DNA, 21 bp, Homo sapiens
cccacagtcctcacagcctct

SEQ ID NO: 6072444 - DNA, 21 bp, Homo sapiens
cccacagtctctccctggggt

SEQ ID NO: 6072445 - DNA, 15 bp, Homo sapiens
cccacagttgtgttc

SEQ ID NO: 6072446 - DNA, 16 bp, Homo sapiens
cccacagttgtgttca

SEQ ID NO: 6072447 - DNA, 15 bp, Homo sapiens
cccacagtttgagac

SEQ ID NO: 6072448 - DNA, 22 bp, Homo sapiens
cccacataaaagccccagcttg

SEQ ID NO: 6072449 - DNA, 15 bp, Homo sapiens
cccacataaacactt

SEQ ID NO: 6072450 - DNA, 22 bp, Homo sapiens
cccacataaacacttctcctta

SEQ ID NO: 6072451 - DNA, 17 bp, Homo sapiens
cccacataagttttctc

SEQ ID NO: 6072452 - DNA, 23 bp, Homo sapiens
cccacatattcacatacgtgtct

SEQ ID NO: 6072453 - DNA, 14 bp, Homo sapiens
cccacatccagtgg

SEQ ID NO: 6072454 - DNA, 15 bp, Homo sapiens
cccacatccagtggg

SEQ ID NO: 6072455 - DNA, 19 bp, Homo sapiens
cccacatccattccagagc

SEQ ID NO: 6072456 - DNA, 16 bp, Homo sapiens
cccacatccccaataa

SEQ ID NO: 6072457 - DNA, 15 bp, Homo sapiens
cccacatccctgggc

SEQ ID NO: 6072458 - DNA, 16 bp, Homo sapiens
cccacatccctgggcc

SEQ ID NO: 6072459 - DNA, 19 bp, Homo sapiens
cccacatccctgggcctgc

SEQ ID NO: 6072460 - DNA, 23 bp, Homo sapiens
cccacatccctgggcctgctgct

SEQ ID NO: 6072461 - DNA, 24 bp, Homo sapiens
cccacatccctgggcctgctgctg

SEQ ID NO: 6072462 - DNA, 17 bp, Homo sapiens
cccacatcgcacactgg

SEQ ID NO: 6072463 - DNA, 11 bp, Homo sapiens
cccacatcttt

SEQ ID NO: 6072464 - DNA, 18 bp, Homo sapiens
cccacatgaggacatgat

SEQ ID NO: 6072465 - DNA, 14 bp, Homo sapiens
cccacatgaggcca

SEQ ID NO: 6072466 - DNA, 18 bp, Homo sapiens
cccacatgaggccatctc

SEQ ID NO: 6072467 - DNA, 14 bp, Homo sapiens
cccacatgcatgtc

SEQ ID NO: 6072468 - DNA, 20 bp, Homo sapiens
cccacatggggttcctggtt

SEQ ID NO: 6072469 - DNA, 18 bp, Homo sapiens
cccacattcggaccctgc

SEQ ID NO: 6072470 - DNA, 20 bp, Homo sapiens
cccacattcggaccctgccc

SEQ ID NO: 6072471 - DNA, 17 bp, Homo sapiens
cccacattgcccacacc

SEQ ID NO: 6072472 - DNA, 20 bp, Homo sapiens
cccacattggaagagcagca

SEQ ID NO: 6072473 - DNA, 14 bp, Homo sapiens
cccacatttgggct

SEQ ID NO: 6072474 - DNA, 17 bp, Homo sapiens
cccacatttgggctcag

SEQ ID NO: 6072475 - DNA, 22 bp, Homo sapiens
cccacatttgtgccgacactgt

SEQ ID NO: 6072476 - DNA, 13 bp, Homo sapiens
cccaccaaatgcc

SEQ ID NO: 6072477 - DNA, 21 bp, Homo sapiens
cccaccaaatgcctctgcctt

SEQ ID NO: 6072478 - DNA, 11 bp, Homo sapiens
cccaccaacaa

SEQ ID NO: 6072479 - DNA, 18 bp, Homo sapiens
cccaccaactctctctgc

SEQ ID NO: 6072480 - DNA, 23 bp, Homo sapiens
cccaccaactctctctgccccca

SEQ ID NO: 6072481 - DNA, 16 bp, Homo sapiens
cccaccaactctgcac

SEQ ID NO: 6072482 - DNA, 21 bp, Homo sapiens
cccaccaaggtctcacactcc

SEQ ID NO: 6072483 - DNA, 11 bp, Homo sapiens
cccaccacaca

SEQ ID NO: 6072484 - DNA, 14 bp, Homo sapiens
cccaccacacaaca

SEQ ID NO: 6072485 - DNA, 17 bp, Homo sapiens
cccaccacacacaccct

SEQ ID NO: 6072486 - DNA, 13 bp, Homo sapiens
cccaccacacatc

SEQ ID NO: 6072487 - DNA, 21 bp, Homo sapiens
cccaccacactccccgcctgt

SEQ ID NO: 6072488 - DNA, 12 bp, Homo sapiens
cccaccacagca

SEQ ID NO: 6072489 - DNA, 13 bp, Homo sapiens
cccaccaccccat

SEQ ID NO: 6072490 - DNA, 20 bp, Homo sapiens
cccaccacctaggccactcc

SEQ ID NO: 6072491 - DNA, 18 bp, Homo sapiens
cccaccaccttggactcc

SEQ ID NO: 6072492 - DNA, 20 bp, Homo sapiens
cccaccacgatgtggccctg

SEQ ID NO: 6072493 - DNA, 23 bp, Homo sapiens
cccaccacgcatgctcagtgcct

SEQ ID NO: 6072494 - DNA, 21 bp, Homo sapiens
cccaccacggccactggccat

SEQ ID NO: 6072495 - DNA, 14 bp, Homo sapiens
cccaccactcaggc

SEQ ID NO: 6072496 - DNA, 15 bp, Homo sapiens
cccaccactctcagg

SEQ ID NO: 6072497 - DNA, 14 bp, Homo sapiens
cccaccagagctgc

SEQ ID NO: 6072498 - DNA, 17 bp, Homo sapiens
cccaccagagctgcctc

SEQ ID NO: 6072499 - DNA, 11 bp, Homo sapiens
cccaccagcag

SEQ ID NO: 6072500 - DNA, 12 bp, Homo sapiens
cccaccagcagc

SEQ ID NO: 6072501 - DNA, 12 bp, Homo sapiens
cccaccagccag

SEQ ID NO: 6072502 - DNA, 11 bp, Homo sapiens
cccaccagcct

SEQ ID NO: 6072503 - DNA, 22 bp, Homo sapiens
cccaccagccttgctctcttca

SEQ ID NO: 6072504 - DNA, 15 bp, Homo sapiens
cccaccagctccaca

SEQ ID NO: 6072505 - DNA, 12 bp, Homo sapiens
cccaccagctcg

SEQ ID NO: 6072506 - DNA, 14 bp, Homo sapiens
cccaccagctgcag

SEQ ID NO: 6072507 - DNA, 21 bp, Homo sapiens
cccaccaggagcacctggacc

SEQ ID NO: 6072508 - DNA, 15 bp, Homo sapiens
cccaccaggccagct

SEQ ID NO: 6072509 - DNA, 16 bp, Homo sapiens
cccaccaggccagctc

SEQ ID NO: 6072510 - DNA, 19 bp, Homo sapiens
cccaccaggccagctcagg

SEQ ID NO: 6072511 - DNA, 13 bp, Homo sapiens
cccaccaggctgc

SEQ ID NO: 6072512 - DNA, 20 bp, Homo sapiens
cccaccagggctcagctcct

SEQ ID NO: 6072513 - DNA, 23 bp, Homo sapiens
cccaccaggggaaggaaggaggg

SEQ ID NO: 6072514 - DNA, 15 bp, Homo sapiens
cccaccaggtgtcag

SEQ ID NO: 6072515 - DNA, 18 bp, Homo sapiens
cccaccagtctcacccac

SEQ ID NO: 6072516 - DNA, 23 bp, Homo sapiens
cccaccagtgcctctccctgctg

SEQ ID NO: 6072517 - DNA, 17 bp, Homo sapiens
cccaccatcaccaccgc

SEQ ID NO: 6072518 - DNA, 16 bp, Homo sapiens
cccaccatctgctgtc

SEQ ID NO: 6072519 - DNA, 17 bp, Homo sapiens
cccaccatggaccagcc

SEQ ID NO: 6072520 - DNA, 18 bp, Homo sapiens
cccaccatgtctgcccca

SEQ ID NO: 6072521 - DNA, 17 bp, Homo sapiens
cccaccattccacatcc

SEQ ID NO: 6072522 - DNA, 18 bp, Homo sapiens
cccaccattccacatccc

SEQ ID NO: 6072523 - DNA, 21 bp, Homo sapiens
cccaccattccacatccccac

SEQ ID NO: 6072524 - DNA, 18 bp, Homo sapiens
cccaccattcctgccttt

SEQ ID NO: 6072525 - DNA, 17 bp, Homo sapiens
cccaccattctacctga

SEQ ID NO: 6072526 - DNA, 18 bp, Homo sapiens
cccaccatttggcatccc

SEQ ID NO: 6072527 - DNA, 13 bp, Homo sapiens
cccacccaaaccc

SEQ ID NO: 6072528 - DNA, 22 bp, Homo sapiens
cccacccaactccacagggctg

SEQ ID NO: 6072529 - DNA, 15 bp, Homo sapiens
cccacccaagggcct

SEQ ID NO: 6072530 - DNA, 18 bp, Homo sapiens
cccacccaagggcctggc

SEQ ID NO: 6072531 - DNA, 21 bp, Homo sapiens
cccacccaagggcctggcctg

SEQ ID NO: 6072532 - DNA, 21 bp, Homo sapiens
cccacccacaccccgtctgcc

SEQ ID NO: 6072533 - DNA, 12 bp, Homo sapiens
cccacccacccc

SEQ ID NO: 6072534 - DNA, 13 bp, Homo sapiens
cccacccaccccc

SEQ ID NO: 6072535 - DNA, 13 bp, Homo sapiens
cccacccacccct

SEQ ID NO: 6072536 - DNA, 12 bp, Homo sapiens
cccacccacctc

SEQ ID NO: 6072537 - DNA, 13 bp, Homo sapiens
cccacccacctcc

SEQ ID NO: 6072538 - DNA, 15 bp, Homo sapiens
cccacccacctccac

SEQ ID NO: 6072539 - DNA, 13 bp, Homo sapiens
cccacccagcaga

SEQ ID NO: 6072540 - DNA, 14 bp, Homo sapiens
cccacccagcagcg

SEQ ID NO: 6072541 - DNA, 13 bp, Homo sapiens
cccacccagcctg

SEQ ID NO: 6072542 - DNA, 12 bp, Homo sapiens
cccacccagctg

SEQ ID NO: 6072543 - DNA, 21 bp, Homo sapiens
cccacccagctggtcctgtgg

SEQ ID NO: 6072544 - DNA, 12 bp, Homo sapiens
cccacccaggag

SEQ ID NO: 6072545 - DNA, 23 bp, Homo sapiens
cccacccaggatgacccctgggc

SEQ ID NO: 6072546 - DNA, 20 bp, Homo sapiens
cccacccaggcaggggcttc

SEQ ID NO: 6072547 - DNA, 13 bp, Homo sapiens
cccacccagggcc

SEQ ID NO: 6072548 - DNA, 13 bp, Homo sapiens
cccacccagtctc

SEQ ID NO: 6072549 - DNA, 13 bp, Homo sapiens
cccacccatcttc

SEQ ID NO: 6072550 - DNA, 15 bp, Homo sapiens
cccacccatcttcct

SEQ ID NO: 6072551 - DNA, 17 bp, Homo sapiens
cccacccatcttcctgc

SEQ ID NO: 6072552 - DNA, 21 bp, Homo sapiens
cccacccatcttcctgctgct

SEQ ID NO: 6072553 - DNA, 12 bp, Homo sapiens
cccacccatgca

SEQ ID NO: 6072554 - DNA, 16 bp, Homo sapiens
cccacccatggggagg

SEQ ID NO: 6072555 - DNA, 15 bp, Homo sapiens
cccaccccaaccact

SEQ ID NO: 6072556 - DNA, 22 bp, Homo sapiens
cccaccccaacctgctctcctc

SEQ ID NO: 6072557 - DNA, 12 bp, Homo sapiens
cccaccccacac

SEQ ID NO: 6072558 - DNA, 15 bp, Homo sapiens
cccaccccaccccct

SEQ ID NO: 6072559 - DNA, 13 bp, Homo sapiens
cccaccccacctc

SEQ ID NO: 6072560 - DNA, 14 bp, Homo sapiens
cccaccccacctct

SEQ ID NO: 6072561 - DNA, 12 bp, Homo sapiens
cccaccccacgc

SEQ ID NO: 6072562 - DNA, 13 bp, Homo sapiens
cccaccccacgcc

SEQ ID NO: 6072563 - DNA, 23 bp, Homo sapiens
cccaccccacgcccgcacccccg

SEQ ID NO: 6072564 - DNA, 16 bp, Homo sapiens
cccaccccactccagc

SEQ ID NO: 6072565 - DNA, 17 bp, Homo sapiens
cccaccccactccagcc

SEQ ID NO: 6072566 - DNA, 21 bp, Homo sapiens
cccaccccagaaatcactgtg

SEQ ID NO: 6072567 - DNA, 14 bp, Homo sapiens
cccaccccagaaga

SEQ ID NO: 6072568 - DNA, 14 bp, Homo sapiens
cccaccccagagtt

SEQ ID NO: 6072569 - DNA, 16 bp, Homo sapiens
cccaccccagcacagc

SEQ ID NO: 6072570 - DNA, 13 bp, Homo sapiens
cccaccccagcct

SEQ ID NO: 6072571 - DNA, 15 bp, Homo sapiens
cccaccccagggcag

SEQ ID NO: 6072572 - DNA, 16 bp, Homo sapiens
cccaccccatccctgg

SEQ ID NO: 6072573 - DNA, 17 bp, Homo sapiens
cccaccccatccctggc

SEQ ID NO: 6072574 - DNA, 14 bp, Homo sapiens
cccaccccatggag

SEQ ID NO: 6072575 - DNA, 19 bp, Homo sapiens
cccacccccaaagacctgc

SEQ ID NO: 6072576 - DNA, 18 bp, Homo sapiens
cccacccccacccccacc

SEQ ID NO: 6072577 - DNA, 13 bp, Homo sapiens
cccacccccagcc

SEQ ID NO: 6072578 - DNA, 14 bp, Homo sapiens
cccacccccagcca

SEQ ID NO: 6072579 - DNA, 15 bp, Homo sapiens
cccacccccagccag

SEQ ID NO: 6072580 - DNA, 13 bp, Homo sapiens
cccacccccagct

SEQ ID NO: 6072581 - DNA, 14 bp, Homo sapiens
cccacccccaggcc

SEQ ID NO: 6072582 - DNA, 12 bp, Homo sapiens
cccacccccagt

SEQ ID NO: 6072583 - DNA, 12 bp, Homo sapiens
cccacccccatc

SEQ ID NO: 6072584 - DNA, 13 bp, Homo sapiens
cccaccccccagc

SEQ ID NO: 6072585 - DNA, 17 bp, Homo sapiens
cccaccccccagcctcc

SEQ ID NO: 6072586 - DNA, 13 bp, Homo sapiens
cccacccccctca

SEQ ID NO: 6072587 - DNA, 16 bp, Homo sapiens
cccacccccctcctcc

SEQ ID NO: 6072588 - DNA, 23 bp, Homo sapiens
cccacccccctctctttctctgg

SEQ ID NO: 6072589 - DNA, 13 bp, Homo sapiens
cccacccccggga

SEQ ID NO: 6072590 - DNA, 15 bp, Homo sapiens
cccaccccctcaagc

SEQ ID NO: 6072591 - DNA, 16 bp, Homo sapiens
cccaccccctgccctg

SEQ ID NO: 6072592 - DNA, 18 bp, Homo sapiens
cccaccccctgccctgca

SEQ ID NO: 6072593 - DNA, 15 bp, Homo sapiens
cccaccccctgcctg

SEQ ID NO: 6072594 - DNA, 23 bp, Homo sapiens
cccaccccctttggtttgacaat

SEQ ID NO: 6072595 - DNA, 13 bp, Homo sapiens
cctattgtaatat

SEQ ID NO: 6072596 - DNA, 21 bp, Homo sapiens
cctattgtaatcgtgtgccat

SEQ ID NO: 6072597 - DNA, 20 bp, Homo sapiens
cctattgtacgctagagcat

SEQ ID NO: 6072598 - DNA, 13 bp, Homo sapiens
cctattgtcatta

SEQ ID NO: 6072599 - DNA, 19 bp, Homo sapiens
cctattgtgacagagccat

SEQ ID NO: 6072600 - DNA, 12 bp, Homo sapiens
cctattgtgatt

SEQ ID NO: 6072601 - DNA, 14 bp, Homo sapiens
cctattgtgatttg

SEQ ID NO: 6072602 - DNA, 15 bp, Homo sapiens
cctattgtgatttga

SEQ ID NO: 6072603 - DNA, 17 bp, Homo sapiens
cctattgtgatttgact

SEQ ID NO: 6072604 - DNA, 18 bp, Homo sapiens
cctatttaaaactgggtc

SEQ ID NO: 6072605 - DNA, 14 bp, Homo sapiens
cctatttaacaaga

SEQ ID NO: 6072606 - DNA, 11 bp, Homo sapiens
cctatttaagc

SEQ ID NO: 6072607 - DNA, 13 bp, Homo sapiens
cctatttaagccc

SEQ ID NO: 6072608 - DNA, 16 bp, Homo sapiens
cctatttacctgcagg

SEQ ID NO: 6072609 - DNA, 14 bp, Homo sapiens
cctatttattgact

SEQ ID NO: 6072610 - DNA, 17 bp, Homo sapiens
cctatttattggggatc

SEQ ID NO: 6072611 - DNA, 15 bp, Homo sapiens
cctatttcagctgct

SEQ ID NO: 6072612 - DNA, 15 bp, Homo sapiens
cctatttcagtactt

SEQ ID NO: 6072613 - DNA, 18 bp, Homo sapiens
cctatttcattgtggcct

SEQ ID NO: 6072614 - DNA, 18 bp, Homo sapiens
cctatttccattcaacaa

SEQ ID NO: 6072615 - DNA, 14 bp, Homo sapiens
cctatttcctcaga

SEQ ID NO: 6072616 - DNA, 12 bp, Homo sapiens
cctatttctctt

SEQ ID NO: 6072617 - DNA, 14 bp, Homo sapiens
cctatttctgatga

SEQ ID NO: 6072618 - DNA, 20 bp, Homo sapiens
cctatttgtgaattctggga

SEQ ID NO: 6072619 - DNA, 12 bp, Homo sapiens
cctatttgtgtg

SEQ ID NO: 6072620 - DNA, 21 bp, Homo sapiens
cctattttaaaaccatgcagc

SEQ ID NO: 6072621 - DNA, 16 bp, Homo sapiens
cctattttcatttgta

SEQ ID NO: 6072622 - DNA, 18 bp, Homo sapiens
cctattttcatttgtaca

SEQ ID NO: 6072623 - DNA, 16 bp, Homo sapiens
cctattttctatcccc

SEQ ID NO: 6072624 - DNA, 19 bp, Homo sapiens
cctattttctatccccctt

SEQ ID NO: 6072625 - DNA, 22 bp, Homo sapiens
cctattttgaaaggtcagaatt

SEQ ID NO: 6072626 - DNA, 12 bp, Homo sapiens
cctatttttcct

SEQ ID NO: 6072627 - DNA, 20 bp, Homo sapiens
cctattttttttctgttata

SEQ ID NO: 6072628 - DNA, 20 bp, Homo sapiens
cctcaaaaacgccctcaaga

SEQ ID NO: 6072629 - DNA, 17 bp, Homo sapiens
cctcaaaaatcatcaaa

SEQ ID NO: 6072630 - DNA, 12 bp, Homo sapiens
cctcaaaacaga

SEQ ID NO: 6072631 - DNA, 23 bp, Homo sapiens
cctcaaaatttaacagttacctg

SEQ ID NO: 6072632 - DNA, 20 bp, Homo sapiens
cctcaaacacacaaactatt

SEQ ID NO: 6072633 - DNA, 18 bp, Homo sapiens
cctcaaacactgcaggca

SEQ ID NO: 6072634 - DNA, 21 bp, Homo sapiens
cctcaaacactgcaggcatca

SEQ ID NO: 6072635 - DNA, 20 bp, Homo sapiens
cctcaaaccaagggtacaga

SEQ ID NO: 6072636 - DNA, 14 bp, Homo sapiens
cctcaaaccctgtg

SEQ ID NO: 6072637 - DNA, 15 bp, Homo sapiens
cctcaaacctcctct

SEQ ID NO: 6072638 - DNA, 18 bp, Homo sapiens
cctcaaactgcacatcta

SEQ ID NO: 6072639 - DNA, 21 bp, Homo sapiens
cctcaaagcaagcattcagaa

SEQ ID NO: 6072640 - DNA, 21 bp, Homo sapiens
cctcaaagcacctgaaccact

SEQ ID NO: 6072641 - DNA, 15 bp, Homo sapiens
cctcaaagcttccat

SEQ ID NO: 6072642 - DNA, 18 bp, Homo sapiens
cctcaaagcttccattcc

SEQ ID NO: 6072643 - DNA, 20 bp, Homo sapiens
cctcaaagcttccattccac

SEQ ID NO: 6072644 - DNA, 20 bp, Homo sapiens
cctcaaagcttggattaaat

SEQ ID NO: 6072645 - DNA, 19 bp, Homo sapiens
cctcaaagtcccttgagac

SEQ ID NO: 6072646 - DNA, 21 bp, Homo sapiens
cctcaaagtcccttgagactc

SEQ ID NO: 6072647 - DNA, 22 bp, Homo sapiens
cctcaaataaaaagtgcttttg

SEQ ID NO: 6072648 - DNA, 20 bp, Homo sapiens
cctcaaataagtcttcctta

SEQ ID NO: 6072649 - DNA, 17 bp, Homo sapiens
cctcaaatacatgcaca

SEQ ID NO: 6072650 - DNA, 22 bp, Homo sapiens
cctcaaatcaaaaacaggcagg

SEQ ID NO: 6072651 - DNA, 14 bp, Homo sapiens
cctcaaatccagga

SEQ ID NO: 6072652 - DNA, 18 bp, Homo sapiens
cctcaaatccaggaccct

SEQ ID NO: 6072653 - DNA, 23 bp, Homo sapiens
cctcaaatccaggaccctgccag

SEQ ID NO: 6072654 - DNA, 11 bp, Homo sapiens
cctcaaatgaa

SEQ ID NO: 6072655 - DNA, 14 bp, Homo sapiens
cctcaaatgtcaga

SEQ ID NO: 6072656 - DNA, 22 bp, Homo sapiens
cctcaaattttttgactttttt

SEQ ID NO: 6072657 - DNA, 21 bp, Homo sapiens
cctcaacaagggagagacctc

SEQ ID NO: 6072658 - DNA, 22 bp, Homo sapiens
cctcaacaagggagagacctca

SEQ ID NO: 6072659 - DNA, 18 bp, Homo sapiens
cctcaacaaggtatacct

SEQ ID NO: 6072660 - DNA, 20 bp, Homo sapiens
cctcaacaaggtatacctca

SEQ ID NO: 6072661 - DNA, 17 bp, Homo sapiens
cctcaacaccctgcttc

SEQ ID NO: 6072662 - DNA, 18 bp, Homo sapiens
cctcaacaccctgcttct

SEQ ID NO: 6072663 - DNA, 16 bp, Homo sapiens
cctcaacacctctgca

SEQ ID NO: 6072664 - DNA, 16 bp, Homo sapiens
cctcaacagcaggagg

SEQ ID NO: 6072665 - DNA, 15 bp, Homo sapiens
cctcaacaggcccag

SEQ ID NO: 6072666 - DNA, 18 bp, Homo sapiens
cctcaacaggcccaggga

SEQ ID NO: 6072667 - DNA, 20 bp, Homo sapiens
cctcaacaggcccagggagg

SEQ ID NO: 6072668 - DNA, 22 bp, Homo sapiens
cctcaacccatatttcatccag

SEQ ID NO: 6072669 - DNA, 23 bp, Homo sapiens
cctcaaccccaaatcccccgact

SEQ ID NO: 6072670 - DNA, 16 bp, Homo sapiens
cctcaaccctccctca

SEQ ID NO: 6072671 - DNA, 19 bp, Homo sapiens
cctcaaccctccctcagcc

SEQ ID NO: 6072672 - DNA, 22 bp, Homo sapiens
cctcaacctccctggctcaagc

SEQ ID NO: 6072673 - DNA, 15 bp, Homo sapiens
cctcaacctcctggg

SEQ ID NO: 6072674 - DNA, 16 bp, Homo sapiens
cctcaacctcctgtgg

SEQ ID NO: 6072675 - DNA, 17 bp, Homo sapiens
cctcaacctcttctggc

SEQ ID NO: 6072676 - DNA, 20 bp, Homo sapiens
cctcaacctgtaaattattt

SEQ ID NO: 6072677 - DNA, 19 bp, Homo sapiens
cctcaacgttgctccccat

SEQ ID NO: 6072678 - DNA, 17 bp, Homo sapiens
cctcaactcctcccata

SEQ ID NO: 6072679 - DNA, 18 bp, Homo sapiens
cctcaactgagaagccaa

SEQ ID NO: 6072680 - DNA, 22 bp, Homo sapiens
cctcaactgagaagccaagcct

SEQ ID NO: 6072681 - DNA, 16 bp, Homo sapiens
cctcaactgagggcca

SEQ ID NO: 6072682 - DNA, 20 bp, Homo sapiens
cctcaactgagggccaggga

SEQ ID NO: 6072683 - DNA, 15 bp, Homo sapiens
cctcaactgcctact

SEQ ID NO: 6072684 - DNA, 12 bp, Homo sapiens
cctcaagaaaaa

SEQ ID NO: 6072685 - DNA, 17 bp, Homo sapiens
cctcaagaacatgatgg

SEQ ID NO: 6072686 - DNA, 18 bp, Homo sapiens
cctcaagactttgatcct

SEQ ID NO: 6072687 - DNA, 12 bp, Homo sapiens
cctcaagcaagg

SEQ ID NO: 6072688 - DNA, 17 bp, Homo sapiens
cctcaagcaataattgt

SEQ ID NO: 6072689 - DNA, 20 bp, Homo sapiens
cctcaagccaatcccctcct

SEQ ID NO: 6072690 - DNA, 16 bp, Homo sapiens
cctcaagccaggagac

SEQ ID NO: 6072691 - DNA, 19 bp, Homo sapiens
cctcaagccaggagaccct

SEQ ID NO: 6072692 - DNA, 13 bp, Homo sapiens
cctcaagccccag

SEQ ID NO: 6072693 - DNA, 16 bp, Homo sapiens
cctcaagccccagcag

SEQ ID NO: 6072694 - DNA, 20 bp, Homo sapiens
cctcaagccccagcagccct

SEQ ID NO: 6072695 - DNA, 18 bp, Homo sapiens
cctcaagccccatttcct

SEQ ID NO: 6072696 - DNA, 19 bp, Homo sapiens
cctcaagccccttctctca

SEQ ID NO: 6072697 - DNA, 20 bp, Homo sapiens
cctcaagcctgtgggcagca

SEQ ID NO: 6072698 - DNA, 13 bp, Homo sapiens
cctcaagcgtgga

SEQ ID NO: 6072699 - DNA, 19 bp, Homo sapiens
cctcaaggaagagccagcc

SEQ ID NO: 6072700 - DNA, 23 bp, Homo sapiens
cctcaaggacaaagtctccagcc

SEQ ID NO: 6072701 - DNA, 15 bp, Homo sapiens
cctcaaggcctccca

SEQ ID NO: 6072702 - DNA, 20 bp, Homo sapiens
cctcaaggcctcccacagtg

SEQ ID NO: 6072703 - DNA, 21 bp, Homo sapiens
cctcaaggcctcccacagtga

SEQ ID NO: 6072704 - DNA, 10 bp, Homo sapiens
cctcaagggc

SEQ ID NO: 6072705 - DNA, 16 bp, Homo sapiens
cctcaagggcagagaa

SEQ ID NO: 6072706 - DNA, 19 bp, Homo sapiens
cctcaagggtagaaacctg

SEQ ID NO: 6072707 - DNA, 20 bp, Homo sapiens
cctcaaggttttaggttcta

SEQ ID NO: 6072708 - DNA, 23 bp, Homo sapiens
cctcaaggttttaggttctaaag

SEQ ID NO: 6072709 - DNA, 15 bp, Homo sapiens
cctcaagtaaaagaa

SEQ ID NO: 6072710 - DNA, 16 bp, Homo sapiens
cctcaagtaaaagaaa

SEQ ID NO: 6072711 - DNA, 19 bp, Homo sapiens
cctcaagtctcttttctgc

SEQ ID NO: 6072712 - DNA, 15 bp, Homo sapiens
cctcaagtctttctc

SEQ ID NO: 6072713 - DNA, 12 bp, Homo sapiens
cctcaagttcaa

SEQ ID NO: 6072714 - DNA, 16 bp, Homo sapiens
cctcaagttccatgct

SEQ ID NO: 6072715 - DNA, 15 bp, Homo sapiens
cctcaagttcttgga

SEQ ID NO: 6072716 - DNA, 16 bp, Homo sapiens
cctcaagttgtgtgct

SEQ ID NO: 6072717 - DNA, 12 bp, Homo sapiens
cctcaataaata

SEQ ID NO: 6072718 - DNA, 18 bp, Homo sapiens
cctcaataagccttgtcg

SEQ ID NO: 6072719 - DNA, 16 bp, Homo sapiens
cctcaatacccctagt

SEQ ID NO: 6072720 - DNA, 18 bp, Homo sapiens
cctcaatagatctccagc

SEQ ID NO: 6072721 - DNA, 21 bp, Homo sapiens
cctcaatccccaagctggcag

SEQ ID NO: 6072722 - DNA, 18 bp, Homo sapiens
cctcaatctcaatcctgc

SEQ ID NO: 6072723 - DNA, 23 bp, Homo sapiens
cctcaatgctgggccctcttatc

SEQ ID NO: 6072724 - DNA, 23 bp, Homo sapiens
cctcaatggggaattttttgatc

SEQ ID NO: 6072725 - DNA, 22 bp, Homo sapiens
cctcaatgtgaatcagacccta

SEQ ID NO: 6072726 - DNA, 21 bp, Homo sapiens
cctcaattatcttggaaaaat

SEQ ID NO: 6072727 - DNA, 20 bp, Homo sapiens
cctcaattccccctggccac

SEQ ID NO: 6072728 - DNA, 14 bp, Homo sapiens
cctcaattgtgaaa

SEQ ID NO: 6072729 - DNA, 21 bp, Homo sapiens
cctcaatttttgtctcagaag

SEQ ID NO: 6072730 - DNA, 14 bp, Homo sapiens
cctcaatttttgtt

SEQ ID NO: 6072731 - DNA, 16 bp, Homo sapiens
cctcacaaatgctgtg

SEQ ID NO: 6072732 - DNA, 13 bp, Homo sapiens
cctcacaactcct

SEQ ID NO: 6072733 - DNA, 15 bp, Homo sapiens
cctcacaactccttc

SEQ ID NO: 6072734 - DNA, 17 bp, Homo sapiens
cctcacaagcgctccca

SEQ ID NO: 6072735 - DNA, 20 bp, Homo sapiens
cctcacaagcgctcccagcc

SEQ ID NO: 6072736 - DNA, 23 bp, Homo sapiens
cctcacaagcgctcccagcctgc

SEQ ID NO: 6072737 - DNA, 16 bp, Homo sapiens
cctcacaatgaggcta

SEQ ID NO: 6072738 - DNA, 17 bp, Homo sapiens
cctcacacaccctgagg

SEQ ID NO: 6072739 - DNA, 15 bp, Homo sapiens
cctcacacacctctg

SEQ ID NO: 6072740 - DNA, 12 bp, Homo sapiens
cctcacacacgg

SEQ ID NO: 6072741 - DNA, 20 bp, Homo sapiens
cctcacacacggaggccaga

SEQ ID NO: 6072742 - DNA, 11 bp, Homo sapiens
cctcacacagc

SEQ ID NO: 6072743 - DNA, 18 bp, Homo sapiens
cctcacacccacctgctg

SEQ ID NO: 6072744 - DNA, 21 bp, Homo sapiens
cctcacacccacctgctgctg

SEQ ID NO: 6072745 - DNA, 23 bp, Homo sapiens
cctcacacccacctgctgctgta

SEQ ID NO: 6072746 - DNA, 13 bp, Homo sapiens
cctcacacccctg

SEQ ID NO: 6072747 - DNA, 20 bp, Homo sapiens
cctcacacccctgtcccacc

SEQ ID NO: 6072748 - DNA, 21 bp, Homo sapiens
cctcacacccctgtcccaccc

SEQ ID NO: 6072749 - DNA, 18 bp, Homo sapiens
cctcacactacagatcag

SEQ ID NO: 6072750 - DNA, 11 bp, Homo sapiens
cctcacactgc

SEQ ID NO: 6072751 - DNA, 14 bp, Homo sapiens
cctcacactgctgt

SEQ ID NO: 6072752 - DNA, 15 bp, Homo sapiens
cctcacactgctgtc

SEQ ID NO: 6072753 - DNA, 20 bp, Homo sapiens
cctcacactgctgtcctctc

SEQ ID NO: 6072754 - DNA, 15 bp, Homo sapiens
cctcacactgggact

SEQ ID NO: 6072755 - DNA, 15 bp, Homo sapiens
cctcacactttgcca

SEQ ID NO: 6072756 - DNA, 20 bp, Homo sapiens
cctcacagacctctgcttgg

SEQ ID NO: 6072757 - DNA, 19 bp, Homo sapiens
cctcacagactcttccacc

SEQ ID NO: 6072758 - DNA, 21 bp, Homo sapiens
cctcacagactcttccaccag

SEQ ID NO: 6072759 - DNA, 21 bp, Homo sapiens
cctcacagagtatgatctcag

SEQ ID NO: 6072760 - DNA, 13 bp, Homo sapiens
cctcacagatgct

SEQ ID NO: 6072761 - DNA, 15 bp, Homo sapiens
cctcacagcacagag

SEQ ID NO: 6072762 - DNA, 15 bp, Homo sapiens
cctcacagcctctcc

SEQ ID NO: 6072763 - DNA, 18 bp, Homo sapiens
cctcacagcctctgaccc

SEQ ID NO: 6072764 - DNA, 20 bp, Homo sapiens
cctcacagcctctgacccct

SEQ ID NO: 6072765 - DNA, 16 bp, Homo sapiens
cctcacaggagcagac

SEQ ID NO: 6072766 - DNA, 15 bp, Homo sapiens
cctcacaggccccag

SEQ ID NO: 6072767 - DNA, 17 bp, Homo sapiens
cctcacagtattgctca

SEQ ID NO: 6072768 - DNA, 20 bp, Homo sapiens
cctcacagtccttaccagca

SEQ ID NO: 6072769 - DNA, 13 bp, Homo sapiens
cctcacagtgaac

SEQ ID NO: 6072770 - DNA, 13 bp, Homo sapiens
cctcacagtgacc

SEQ ID NO: 6072771 - DNA, 15 bp, Homo sapiens
cctcacatcctcctg

SEQ ID NO: 6072772 - DNA, 16 bp, Homo sapiens
cctcacatctttcaca

SEQ ID NO: 6072773 - DNA, 13 bp, Homo sapiens
cctcacatgcaga

SEQ ID NO: 6072774 - DNA, 12 bp, Homo sapiens
cccaccccgcct

SEQ ID NO: 6072775 - DNA, 15 bp, Homo sapiens
cccaccccgcctctg

SEQ ID NO: 6072776 - DNA, 16 bp, Homo sapiens
cccaccccgcctctgg

SEQ ID NO: 6072777 - DNA, 22 bp, Homo sapiens
cccaccccgctgcctggcgggc

SEQ ID NO: 6072778 - DNA, 21 bp, Homo sapiens
cccaccccgggctctcctgcc

SEQ ID NO: 6072779 - DNA, 22 bp, Homo sapiens
cccaccccgggctctcctgccc

SEQ ID NO: 6072780 - DNA, 18 bp, Homo sapiens
cccaccccggggaccctg

SEQ ID NO: 6072781 - DNA, 21 bp, Homo sapiens
cccacccctaacctggcttat

SEQ ID NO: 6072782 - DNA, 17 bp, Homo sapiens
cccacccctacacacac

SEQ ID NO: 6072783 - DNA, 23 bp, Homo sapiens
cccacccctaccgatggtcccag

SEQ ID NO: 6072784 - DNA, 11 bp, Homo sapiens
cccacccctca

SEQ ID NO: 6072785 - DNA, 15 bp, Homo sapiens
cccacccctccacgt

SEQ ID NO: 6072786 - DNA, 16 bp, Homo sapiens
cccacccctccccact

SEQ ID NO: 6072787 - DNA, 13 bp, Homo sapiens
cccacccctccct

SEQ ID NO: 6072788 - DNA, 11 bp, Homo sapiens
cccacccctgc

SEQ ID NO: 6072789 - DNA, 15 bp, Homo sapiens
cccacccctgcacag

SEQ ID NO: 6072790 - DNA, 13 bp, Homo sapiens
cccacccctgctg

SEQ ID NO: 6072791 - DNA, 21 bp, Homo sapiens
cccacccctgctgccgccact

SEQ ID NO: 6072792 - DNA, 22 bp, Homo sapiens
cccacccctgggggctctcatg

SEQ ID NO: 6072793 - DNA, 12 bp, Homo sapiens
cccacccctgtg

SEQ ID NO: 6072794 - DNA, 21 bp, Homo sapiens
cccaccccttaggccccgtgg

SEQ ID NO: 6072795 - DNA, 22 bp, Homo sapiens
cccaccccttccccactgcctg

SEQ ID NO: 6072796 - DNA, 14 bp, Homo sapiens
cccaccccttgctc

SEQ ID NO: 6072797 - DNA, 13 bp, Homo sapiens
cccaccccttggc

SEQ ID NO: 6072798 - DNA, 14 bp, Homo sapiens
cccaccccttggcc

SEQ ID NO: 6072799 - DNA, 17 bp, Homo sapiens
cccacccgagtacctcc

SEQ ID NO: 6072800 - DNA, 15 bp, Homo sapiens
cccacccgatgctgc

SEQ ID NO: 6072801 - DNA, 16 bp, Homo sapiens
cccacccgatgctgct

SEQ ID NO: 6072802 - DNA, 13 bp, Homo sapiens
cccacccgccgcc

SEQ ID NO: 6072803 - DNA, 13 bp, Homo sapiens
cccacccgcctgc

SEQ ID NO: 6072804 - DNA, 16 bp, Homo sapiens
cccacccggccacagc

SEQ ID NO: 6072805 - DNA, 22 bp, Homo sapiens
cccacccgtcttcaatctctgt

SEQ ID NO: 6072806 - DNA, 18 bp, Homo sapiens
cccaccctaagggcagcc

SEQ ID NO: 6072807 - DNA, 12 bp, Homo sapiens
cccaccctaccc

SEQ ID NO: 6072808 - DNA, 17 bp, Homo sapiens
cccaccctagcctccac

SEQ ID NO: 6072809 - DNA, 19 bp, Homo sapiens
cccaccctcaaaccctgtg

SEQ ID NO: 6072810 - DNA, 14 bp, Homo sapiens
cccaccctcagcac

SEQ ID NO: 6072811 - DNA, 17 bp, Homo sapiens
cccaccctcagcacccc

SEQ ID NO: 6072812 - DNA, 16 bp, Homo sapiens
cccaccctcagcccgc

SEQ ID NO: 6072813 - DNA, 13 bp, Homo sapiens
cccaccctcccta

SEQ ID NO: 6072814 - DNA, 14 bp, Homo sapiens
cccaccctccctgg

SEQ ID NO: 6072815 - DNA, 21 bp, Homo sapiens
cccaccctccggcgggtgaca

SEQ ID NO: 6072816 - DNA, 18 bp, Homo sapiens
cccaccctcctcttggaa

SEQ ID NO: 6072817 - DNA, 18 bp, Homo sapiens
cccaccctcctgccccac

SEQ ID NO: 6072818 - DNA, 13 bp, Homo sapiens
cccaccctcctgg

SEQ ID NO: 6072819 - DNA, 14 bp, Homo sapiens
cccaccctcctggc

SEQ ID NO: 6072820 - DNA, 14 bp, Homo sapiens
cccaccctcctgtc

SEQ ID NO: 6072821 - DNA, 15 bp, Homo sapiens
cccaccctcctgtct

SEQ ID NO: 6072822 - DNA, 22 bp, Homo sapiens
cccaccctcgtggacacctgcc

SEQ ID NO: 6072823 - DNA, 14 bp, Homo sapiens
cccaccctctccac

SEQ ID NO: 6072824 - DNA, 19 bp, Homo sapiens
cccaccctgacccccttcc

SEQ ID NO: 6072825 - DNA, 16 bp, Homo sapiens
cccaccctgccccttg

SEQ ID NO: 6072826 - DNA, 17 bp, Homo sapiens
cccaccctgcgggccag

SEQ ID NO: 6072827 - DNA, 21 bp, Homo sapiens
cccaccctgctcctcctgccc

SEQ ID NO: 6072828 - DNA, 16 bp, Homo sapiens
cccaccctgctgcctt

SEQ ID NO: 6072829 - DNA, 17 bp, Homo sapiens
cccaccctgctgctggt

SEQ ID NO: 6072830 - DNA, 23 bp, Homo sapiens
cccaccctgcttctgctgcctgt

SEQ ID NO: 6072831 - DNA, 22 bp, Homo sapiens
cccaccctgggatgggccaccc

SEQ ID NO: 6072832 - DNA, 14 bp, Homo sapiens
cccaccctgggccc

SEQ ID NO: 6072833 - DNA, 19 bp, Homo sapiens
cccaccctgggcctcccgt

SEQ ID NO: 6072834 - DNA, 19 bp, Homo sapiens
cccaccctgggtttggccc

SEQ ID NO: 6072835 - DNA, 17 bp, Homo sapiens
cccaccctgtcccaggc

SEQ ID NO: 6072836 - DNA, 13 bp, Homo sapiens
cccaccctgtggc

SEQ ID NO: 6072837 - DNA, 14 bp, Homo sapiens
cccaccctgttcct

SEQ ID NO: 6072838 - DNA, 16 bp, Homo sapiens
cccaccctgttcctgc

SEQ ID NO: 6072839 - DNA, 17 bp, Homo sapiens
cccaccctgttcctgct

SEQ ID NO: 6072840 - DNA, 18 bp, Homo sapiens
cccaccctgttcctgctg

SEQ ID NO: 6072841 - DNA, 19 bp, Homo sapiens
cccaccctgttcctgctgc

SEQ ID NO: 6072842 - DNA, 21 bp, Homo sapiens
cccaccctgtttggattttta

SEQ ID NO: 6072843 - DNA, 21 bp, Homo sapiens
cccacccttacttcctggcct

SEQ ID NO: 6072844 - DNA, 14 bp, Homo sapiens
cccacccttctccc

SEQ ID NO: 6072845 - DNA, 13 bp, Homo sapiens
cccacccttgggc

SEQ ID NO: 6072846 - DNA, 17 bp, Homo sapiens
cccaccctttctgccag

SEQ ID NO: 6072847 - DNA, 20 bp, Homo sapiens
cccaccgaagagccctgagc

SEQ ID NO: 6072848 - DNA, 22 bp, Homo sapiens
cccaccgaagagccctgagctc

SEQ ID NO: 6072849 - DNA, 17 bp, Homo sapiens
cccaccgagctggagcg

SEQ ID NO: 6072850 - DNA, 18 bp, Homo sapiens
cccaccgaggttcccagg

SEQ ID NO: 6072851 - DNA, 15 bp, Homo sapiens
cccaccgatggagcc

SEQ ID NO: 6072852 - DNA, 18 bp, Homo sapiens
cccaccgcagacaggacc

SEQ ID NO: 6072853 - DNA, 20 bp, Homo sapiens
cccaccgcagacaggaccag

SEQ ID NO: 6072854 - DNA, 18 bp, Homo sapiens
cccaccgcatgccccctc

SEQ ID NO: 6072855 - DNA, 15 bp, Homo sapiens
cccaccgcccactct

SEQ ID NO: 6072856 - DNA, 15 bp, Homo sapiens
cccaccgcccccacc

SEQ ID NO: 6072857 - DNA, 14 bp, Homo sapiens
cccaccgcccctgg

SEQ ID NO: 6072858 - DNA, 19 bp, Homo sapiens
cccaccgccggggtcctgg

SEQ ID NO: 6072859 - DNA, 23 bp, Homo sapiens
cccaccgctgagaggctgcctcc

SEQ ID NO: 6072860 - DNA, 17 bp, Homo sapiens
cccaccggaactgggct

SEQ ID NO: 6072861 - DNA, 13 bp, Homo sapiens
cccaccggccagg

SEQ ID NO: 6072862 - DNA, 16 bp, Homo sapiens
cccaccgggagcctcc

SEQ ID NO: 6072863 - DNA, 21 bp, Homo sapiens
cccaccgggagcctccccctc

SEQ ID NO: 6072864 - DNA, 18 bp, Homo sapiens
cccaccggtccagctggc

SEQ ID NO: 6072865 - DNA, 13 bp, Homo sapiens
cccaccggtgcca

SEQ ID NO: 6072866 - DNA, 16 bp, Homo sapiens
cccaccggtgccaaac

SEQ ID NO: 6072867 - DNA, 17 bp, Homo sapiens
cccaccggttgcttctg

SEQ ID NO: 6072868 - DNA, 23 bp, Homo sapiens
cccaccggttgcttctgggaagg

SEQ ID NO: 6072869 - DNA, 22 bp, Homo sapiens
cccaccgtaaagtgagcatgct

SEQ ID NO: 6072870 - DNA, 24 bp, Homo sapiens
cccaccgtctcggccctgaaccac

SEQ ID NO: 6072871 - DNA, 19 bp, Homo sapiens
cccaccgtggaggaggaag

SEQ ID NO: 6072872 - DNA, 19 bp, Homo sapiens
cccaccgtgggcagggagc

SEQ ID NO: 6072873 - DNA, 16 bp, Homo sapiens
cccaccgttaggattc

SEQ ID NO: 6072874 - DNA, 17 bp, Homo sapiens
cccaccgttgtctcatg

SEQ ID NO: 6072875 - DNA, 22 bp, Homo sapiens
cccacctaaagggaagccctga

SEQ ID NO: 6072876 - DNA, 17 bp, Homo sapiens
cccacctaagcctggtg

SEQ ID NO: 6072877 - DNA, 14 bp, Homo sapiens
cccacctacccagc

SEQ ID NO: 6072878 - DNA, 15 bp, Homo sapiens
cccacctacccagct

SEQ ID NO: 6072879 - DNA, 16 bp, Homo sapiens
cccacctacccagctg

SEQ ID NO: 6072880 - DNA, 15 bp, Homo sapiens
cccacctagtgcccc

SEQ ID NO: 6072881 - DNA, 22 bp, Homo sapiens
cccacctatccgccctgcagca

SEQ ID NO: 6072882 - DNA, 16 bp, Homo sapiens
cccacctatgtgccaa

SEQ ID NO: 6072883 - DNA, 18 bp, Homo sapiens
cccacctcaacccagagg

SEQ ID NO: 6072884 - DNA, 20 bp, Homo sapiens
cccacctcacccggcctctt

SEQ ID NO: 6072885 - DNA, 21 bp, Homo sapiens
cccacctcacccggcctcttc

SEQ ID NO: 6072886 - DNA, 14 bp, Homo sapiens
cccacctcagcctc

SEQ ID NO: 6072887 - DNA, 21 bp, Homo sapiens
cccacctcagcctcccagagt

SEQ ID NO: 6072888 - DNA, 17 bp, Homo sapiens
cccacctcagcctcctg

SEQ ID NO: 6072889 - DNA, 11 bp, Homo sapiens
cccacctccac

SEQ ID NO: 6072890 - DNA, 18 bp, Homo sapiens
cccacctccacccagccc

SEQ ID NO: 6072891 - DNA, 14 bp, Homo sapiens
cccacctccacctg

SEQ ID NO: 6072892 - DNA, 17 bp, Homo sapiens
cccacctccactcccac

SEQ ID NO: 6072893 - DNA, 18 bp, Homo sapiens
cccacctccactcccacc

SEQ ID NO: 6072894 - DNA, 10 bp, Homo sapiens
cccacctccc

SEQ ID NO: 6072895 - DNA, 13 bp, Homo sapiens
cccacctccccac

SEQ ID NO: 6072896 - DNA, 20 bp, Homo sapiens
cccacctccccagagccctg

SEQ ID NO: 6072897 - DNA, 21 bp, Homo sapiens
cccacctccctcaacctcatc

SEQ ID NO: 6072898 - DNA, 16 bp, Homo sapiens
cccacctccctgcgcc

SEQ ID NO: 6072899 - DNA, 16 bp, Homo sapiens
cccacctccgccccag

SEQ ID NO: 6072900 - DNA, 17 bp, Homo sapiens
cccacctccgccccaga

SEQ ID NO: 6072901 - DNA, 19 bp, Homo sapiens
cccacctccgccccagaca

SEQ ID NO: 6072902 - DNA, 15 bp, Homo sapiens
cccacctcctgacac

SEQ ID NO: 6072903 - DNA, 13 bp, Homo sapiens
cccacctcctgca

SEQ ID NO: 6072904 - DNA, 22 bp, Homo sapiens
cccacctcgcggcgcagcccct

SEQ ID NO: 6072905 - DNA, 20 bp, Homo sapiens
cccacctcggcacacactgt

SEQ ID NO: 6072906 - DNA, 17 bp, Homo sapiens
cccacctcggtcactcc

SEQ ID NO: 6072907 - DNA, 14 bp, Homo sapiens
cccacctctcctgc

SEQ ID NO: 6072908 - DNA, 22 bp, Homo sapiens
cccacctctctcactccttgaa

SEQ ID NO: 6072909 - DNA, 14 bp, Homo sapiens
cccacctctgagga

SEQ ID NO: 6072910 - DNA, 16 bp, Homo sapiens
cccacctctgaggact

SEQ ID NO: 6072911 - DNA, 15 bp, Homo sapiens
cccacctctgctgcc

SEQ ID NO: 6072912 - DNA, 23 bp, Homo sapiens
cccacctctgctgcccacggcca

SEQ ID NO: 6072913 - DNA, 11 bp, Homo sapiens
cccacctctgg

SEQ ID NO: 6072914 - DNA, 15 bp, Homo sapiens
cccacctctggccct

SEQ ID NO: 6072915 - DNA, 18 bp, Homo sapiens
cccacctctggccctgtg

SEQ ID NO: 6072916 - DNA, 19 bp, Homo sapiens
cccacctctggccctgtgt

SEQ ID NO: 6072917 - DNA, 12 bp, Homo sapiens
cccacctctggt

SEQ ID NO: 6072918 - DNA, 13 bp, Homo sapiens
cccacctcttcct

SEQ ID NO: 6072919 - DNA, 16 bp, Homo sapiens
cccacctcttccttcc

SEQ ID NO: 6072920 - DNA, 18 bp, Homo sapiens
cccacctcttgtgcaagg

SEQ ID NO: 6072921 - DNA, 18 bp, Homo sapiens
cccacctcttgtttctgg

SEQ ID NO: 6072922 - DNA, 16 bp, Homo sapiens
cccacctctttcttca

SEQ ID NO: 6072923 - DNA, 14 bp, Homo sapiens
cccacctgaaagcc

SEQ ID NO: 6072924 - DNA, 19 bp, Homo sapiens
cccacctgaaagcctgtct

SEQ ID NO: 6072925 - DNA, 21 bp, Homo sapiens
cccacctgaaagcctgtctct

SEQ ID NO: 6072926 - DNA, 16 bp, Homo sapiens
cccacctgaagggtgg

SEQ ID NO: 6072927 - DNA, 13 bp, Homo sapiens
cccacctgacctc

SEQ ID NO: 6072928 - DNA, 15 bp, Homo sapiens
cccacctgacctctg

SEQ ID NO: 6072929 - DNA, 12 bp, Homo sapiens
cccacctgagct

SEQ ID NO: 6072930 - DNA, 15 bp, Homo sapiens
cccacctgagctttg

SEQ ID NO: 6072931 - DNA, 14 bp, Homo sapiens
cccacctgcaccca

SEQ ID NO: 6072932 - DNA, 20 bp, Homo sapiens
cccacctgcacgtgatctgc

SEQ ID NO: 6072933 - DNA, 16 bp, Homo sapiens
cccacctgcagctccc

SEQ ID NO: 6072934 - DNA, 14 bp, Homo sapiens
cccacctgccaggc

SEQ ID NO: 6072935 - DNA, 15 bp, Homo sapiens
cccacctgccaggct

SEQ ID NO: 6072936 - DNA, 14 bp, Homo sapiens
cccacctgcccagt

SEQ ID NO: 6072937 - DNA, 20 bp, Homo sapiens
cccacctgcccatcacaggg

SEQ ID NO: 6072938 - DNA, 14 bp, Homo sapiens
cccacctgccggcc

SEQ ID NO: 6072939 - DNA, 12 bp, Homo sapiens
cccacctgcctg

SEQ ID NO: 6072940 - DNA, 17 bp, Homo sapiens
cccacctgcctggccgg

SEQ ID NO: 6072941 - DNA, 20 bp, Homo sapiens
cccacctgcctggccggcca

SEQ ID NO: 6072942 - DNA, 21 bp, Homo sapiens
cccacctgcctggccggccag

SEQ ID NO: 6072943 - DNA, 21 bp, Homo sapiens
cccacctgcgcttctgctgga

SEQ ID NO: 6072944 - DNA, 10 bp, Homo sapiens
cccacctgct

SEQ ID NO: 6072945 - DNA, 22 bp, Homo sapiens
cccacctgctagtcgcccctca

SEQ ID NO: 6072946 - DNA, 12 bp, Homo sapiens
cccacctgctcc

SEQ ID NO: 6072947 - DNA, 12 bp, Homo sapiens
cccacctgctga

SEQ ID NO: 6072948 - DNA, 14 bp, Homo sapiens
cccacctgctgccc

SEQ ID NO: 6072949 - DNA, 16 bp, Homo sapiens
cccacctgctgcccgt

SEQ ID NO: 6072950 - DNA, 15 bp, Homo sapiens
cccacctgctgctgt

SEQ ID NO: 6072951 - DNA, 17 bp, Homo sapiens
cccacctggacacacac

SEQ ID NO: 6072952 - DNA, 15 bp, Homo sapiens
cccacctggccacct

SEQ ID NO: 6072953 - DNA, 20 bp, Homo sapiens
cccacctggccacctgaggt

SEQ ID NO: 6072954 - DNA, 17 bp, Homo sapiens
cccacctggcctctgca

SEQ ID NO: 6072955 - DNA, 13 bp, Homo sapiens
cctcaccaaacta

SEQ ID NO: 6072956 - DNA, 12 bp, Homo sapiens
cctcaccaataa

SEQ ID NO: 6072957 - DNA, 15 bp, Homo sapiens
cctcaccaataactt

SEQ ID NO: 6072958 - DNA, 24 bp, Homo sapiens
cctcaccaataacttcagagaagt

SEQ ID NO: 6072959 - DNA, 20 bp, Homo sapiens
cctcaccacacccaggtctc

SEQ ID NO: 6072960 - DNA, 15 bp, Homo sapiens
cctcaccaccacact

SEQ ID NO: 6072961 - DNA, 15 bp, Homo sapiens
cctcaccacccaaca

SEQ ID NO: 6072962 - DNA, 12 bp, Homo sapiens
cctcaccacccc

SEQ ID NO: 6072963 - DNA, 13 bp, Homo sapiens
cctcaccaccccc

SEQ ID NO: 6072964 - DNA, 23 bp, Homo sapiens
cctcaccacctctttctacagcc

SEQ ID NO: 6072965 - DNA, 15 bp, Homo sapiens
cctcaccagaaccag

SEQ ID NO: 6072966 - DNA, 13 bp, Homo sapiens
cctcaccaggggc

SEQ ID NO: 6072967 - DNA, 14 bp, Homo sapiens
cctcaccaggggca

SEQ ID NO: 6072968 - DNA, 22 bp, Homo sapiens
cctcaccaggggcaggcacagc

SEQ ID NO: 6072969 - DNA, 13 bp, Homo sapiens
cctcaccatccag

SEQ ID NO: 6072970 - DNA, 19 bp, Homo sapiens
cctcaccatccagtgggcc

SEQ ID NO: 6072971 - DNA, 16 bp, Homo sapiens
cctcaccattgtgaag

SEQ ID NO: 6072972 - DNA, 18 bp, Homo sapiens
cctcacccaaaagaatta

SEQ ID NO: 6072973 - DNA, 13 bp, Homo sapiens
cctcacccacacc

SEQ ID NO: 6072974 - DNA, 16 bp, Homo sapiens
cctcacccaccctgtg

SEQ ID NO: 6072975 - DNA, 13 bp, Homo sapiens
cctcacccacctc

SEQ ID NO: 6072976 - DNA, 14 bp, Homo sapiens
cctcacccagatca

SEQ ID NO: 6072977 - DNA, 21 bp, Homo sapiens
cctcacccagggcccccaaag

SEQ ID NO: 6072978 - DNA, 13 bp, Homo sapiens
cctcaccccaatc

SEQ ID NO: 6072979 - DNA, 15 bp, Homo sapiens
cctcaccccaatccc

SEQ ID NO: 6072980 - DNA, 15 bp, Homo sapiens
cctcaccccactgtg

SEQ ID NO: 6072981 - DNA, 22 bp, Homo sapiens
cctcaccccacttatccctctc

SEQ ID NO: 6072982 - DNA, 13 bp, Homo sapiens
cctcaccccagct

SEQ ID NO: 6072983 - DNA, 15 bp, Homo sapiens
cctcaccccagctcc

SEQ ID NO: 6072984 - DNA, 18 bp, Homo sapiens
cctcaccccagtgcctgt

SEQ ID NO: 6072985 - DNA, 18 bp, Homo sapiens
cctcacccccacccctgt

SEQ ID NO: 6072986 - DNA, 14 bp, Homo sapiens
cctcacccccagca

SEQ ID NO: 6072987 - DNA, 21 bp, Homo sapiens
cctcacccccaggtgttgcca

SEQ ID NO: 6072988 - DNA, 17 bp, Homo sapiens
cctcaccccctccttca

SEQ ID NO: 6072989 - DNA, 18 bp, Homo sapiens
cctcacccctcccctggg

SEQ ID NO: 6072990 - DNA, 19 bp, Homo sapiens
cctcacccctcccctggga

SEQ ID NO: 6072991 - DNA, 14 bp, Homo sapiens
cctcacccctgcag

SEQ ID NO: 6072992 - DNA, 15 bp, Homo sapiens
cctcacccctgcagg

SEQ ID NO: 6072993 - DNA, 19 bp, Homo sapiens
cctcacccctgcccctgtg

SEQ ID NO: 6072994 - DNA, 20 bp, Homo sapiens
cctcacccctggttctcatc

SEQ ID NO: 6072995 - DNA, 22 bp, Homo sapiens
cctcacccctgtcctcactgct

SEQ ID NO: 6072996 - DNA, 19 bp, Homo sapiens
cctcacccgaggctgccca

SEQ ID NO: 6072997 - DNA, 21 bp, Homo sapiens
cctcacccgaggctgcccact

SEQ ID NO: 6072998 - DNA, 15 bp, Homo sapiens
cctcacccgctgccc

SEQ ID NO: 6072999 - DNA, 16 bp, Homo sapiens
cctcacccgctgccca

SEQ ID NO: 6073000 - DNA, 17 bp, Homo sapiens
cctcacccgctgcccag

SEQ ID NO: 6073001 - DNA, 20 bp, Homo sapiens
cctcacccgctgcccagccc

SEQ ID NO: 6073002 - DNA, 21 bp, Homo sapiens
cctcacccgctgcccagccct

SEQ ID NO: 6073003 - DNA, 21 bp, Homo sapiens
cctcacccggcctcttcgcct

SEQ ID NO: 6073004 - DNA, 23 bp, Homo sapiens
cctcacccggtgacctctagccc

SEQ ID NO: 6073005 - DNA, 21 bp, Homo sapiens
cctcaccctcctgacccccat

SEQ ID NO: 6073006 - DNA, 16 bp, Homo sapiens
cctcaccctctgtccc

SEQ ID NO: 6073007 - DNA, 15 bp, Homo sapiens
cctcaccctgagccc

SEQ ID NO: 6073008 - DNA, 22 bp, Homo sapiens
cctcaccctgccttatcttgca

SEQ ID NO: 6073009 - DNA, 13 bp, Homo sapiens
cctcaccctgctt

SEQ ID NO: 6073010 - DNA, 14 bp, Homo sapiens
cctcaccctgtggg

SEQ ID NO: 6073011 - DNA, 19 bp, Homo sapiens
cctcaccctgtgggaccgc

SEQ ID NO: 6073012 - DNA, 14 bp, Homo sapiens
cctcacccttcccg

SEQ ID NO: 6073013 - DNA, 14 bp, Homo sapiens
cctcaccctttacc

SEQ ID NO: 6073014 - DNA, 21 bp, Homo sapiens
cctcaccgagcatgcttccct

SEQ ID NO: 6073015 - DNA, 18 bp, Homo sapiens
cctcaccgcggctggatg

SEQ ID NO: 6073016 - DNA, 15 bp, Homo sapiens
cctcaccgcttccct

SEQ ID NO: 6073017 - DNA, 17 bp, Homo sapiens
cctcaccgcttccctcc

SEQ ID NO: 6073018 - DNA, 17 bp, Homo sapiens
cctcaccggcatgctgg

SEQ ID NO: 6073019 - DNA, 20 bp, Homo sapiens
cctcaccggcatgctggcct

SEQ ID NO: 6073020 - DNA, 22 bp, Homo sapiens
cctcaccggcatgctggcctgt

SEQ ID NO: 6073021 - DNA, 23 bp, Homo sapiens
cctcaccggcatgctggcctgtg

SEQ ID NO: 6073022 - DNA, 14 bp, Homo sapiens
cctcacctcaggac

SEQ ID NO: 6073023 - DNA, 17 bp, Homo sapiens
cctcacctcatgcccac

SEQ ID NO: 6073024 - DNA, 22 bp, Homo sapiens
cctcacctcatgcccaccccct

SEQ ID NO: 6073025 - DNA, 14 bp, Homo sapiens
cctcacctcccagg

SEQ ID NO: 6073026 - DNA, 16 bp, Homo sapiens
cctcacctcccagggc

SEQ ID NO: 6073027 - DNA, 17 bp, Homo sapiens
cctcacctcccagggct

SEQ ID NO: 6073028 - DNA, 14 bp, Homo sapiens
cctcacctcctcta

SEQ ID NO: 6073029 - DNA, 16 bp, Homo sapiens
cctcacctctacccaa

SEQ ID NO: 6073030 - DNA, 15 bp, Homo sapiens
cctcacctctccagg

SEQ ID NO: 6073031 - DNA, 18 bp, Homo sapiens
cctcacctctccaggtgc

SEQ ID NO: 6073032 - DNA, 12 bp, Homo sapiens
cctcacctctga

SEQ ID NO: 6073033 - DNA, 15 bp, Homo sapiens
cctcacctctgagga

SEQ ID NO: 6073034 - DNA, 18 bp, Homo sapiens
cctcacctctgaggacag

SEQ ID NO: 6073035 - DNA, 17 bp, Homo sapiens
cctcacctctgccattt

SEQ ID NO: 6073036 - DNA, 13 bp, Homo sapiens
cctcacctctgga

SEQ ID NO: 6073037 - DNA, 22 bp, Homo sapiens
cctcacctctggactggctaga

SEQ ID NO: 6073038 - DNA, 17 bp, Homo sapiens
cctcacctgcagagaaa

SEQ ID NO: 6073039 - DNA, 17 bp, Homo sapiens
cctcacctgcctgccct

SEQ ID NO: 6073040 - DNA, 14 bp, Homo sapiens
cctcacctgggcac

SEQ ID NO: 6073041 - DNA, 18 bp, Homo sapiens
cctcacctgggcacctgg

SEQ ID NO: 6073042 - DNA, 14 bp, Homo sapiens
cctcacctgggcct

SEQ ID NO: 6073043 - DNA, 15 bp, Homo sapiens
cctcacctgggcctt

SEQ ID NO: 6073044 - DNA, 18 bp, Homo sapiens
cctcacctgggcctttcc

SEQ ID NO: 6073045 - DNA, 20 bp, Homo sapiens
cctcacctgggcctttcctg

SEQ ID NO: 6073046 - DNA, 16 bp, Homo sapiens
cctcacctggtacctg

SEQ ID NO: 6073047 - DNA, 12 bp, Homo sapiens
cctcacctggtc

SEQ ID NO: 6073048 - DNA, 15 bp, Homo sapiens
cctcaccttctgagt

SEQ ID NO: 6073049 - DNA, 16 bp, Homo sapiens
cctcaccttggcacca

SEQ ID NO: 6073050 - DNA, 21 bp, Homo sapiens
cctcaccttggcaccagacac

SEQ ID NO: 6073051 - DNA, 16 bp, Homo sapiens
cctcaccttggggcct

SEQ ID NO: 6073052 - DNA, 19 bp, Homo sapiens
cctcaccttttcccgggga

SEQ ID NO: 6073053 - DNA, 22 bp, Homo sapiens
cctcacgcaactcacacctcct

SEQ ID NO: 6073054 - DNA, 17 bp, Homo sapiens
cctcacgcacctcccat

SEQ ID NO: 6073055 - DNA, 18 bp, Homo sapiens
cctcacgcccagcctcct

SEQ ID NO: 6073056 - DNA, 16 bp, Homo sapiens
cctcacgctctggaca

SEQ ID NO: 6073057 - DNA, 13 bp, Homo sapiens
cctcacgctgggt

SEQ ID NO: 6073058 - DNA, 18 bp, Homo sapiens
cctcacggggttggctgt

SEQ ID NO: 6073059 - DNA, 20 bp, Homo sapiens
cctcacgtatttcacagagc

SEQ ID NO: 6073060 - DNA, 18 bp, Homo sapiens
cctcacgtgaccagcccc

SEQ ID NO: 6073061 - DNA, 19 bp, Homo sapiens
cctcactaaaaaggaaact

SEQ ID NO: 6073062 - DNA, 18 bp, Homo sapiens
cctcactactcgagccca

SEQ ID NO: 6073063 - DNA, 20 bp, Homo sapiens
cctcactactcgagcccacc

SEQ ID NO: 6073064 - DNA, 21 bp, Homo sapiens
cctcactagccatgctttatg

SEQ ID NO: 6073065 - DNA, 20 bp, Homo sapiens
cctcactatgacactgagca

SEQ ID NO: 6073066 - DNA, 22 bp, Homo sapiens
cctcactatggtatgctggcca

SEQ ID NO: 6073067 - DNA, 21 bp, Homo sapiens
cctcactatgttgcctaggct

SEQ ID NO: 6073068 - DNA, 17 bp, Homo sapiens
cctcactattcaagtat

SEQ ID NO: 6073069 - DNA, 23 bp, Homo sapiens
cctcactatttttttgttgctgt

SEQ ID NO: 6073070 - DNA, 15 bp, Homo sapiens
cctcactcaggaacc

SEQ ID NO: 6073071 - DNA, 22 bp, Homo sapiens
cctcactcaggaaccctggaga

SEQ ID NO: 6073072 - DNA, 23 bp, Homo sapiens
cctcactcaggaaccctggagac

SEQ ID NO: 6073073 - DNA, 24 bp, Homo sapiens
cctcactcaggaaccctggagaca

SEQ ID NO: 6073074 - DNA, 13 bp, Homo sapiens
cctcactccacac

SEQ ID NO: 6073075 - DNA, 19 bp, Homo sapiens
cctcactccactcccctca

SEQ ID NO: 6073076 - DNA, 15 bp, Homo sapiens
cctcactccctaggc

SEQ ID NO: 6073077 - DNA, 14 bp, Homo sapiens
cctcactccctctg

SEQ ID NO: 6073078 - DNA, 14 bp, Homo sapiens
cctcactcccttct

SEQ ID NO: 6073079 - DNA, 21 bp, Homo sapiens
cctcactcccttctacctgcc

SEQ ID NO: 6073080 - DNA, 12 bp, Homo sapiens
cctcactcctcc

SEQ ID NO: 6073081 - DNA, 19 bp, Homo sapiens
cctcactcgtctcccccaa

SEQ ID NO: 6073082 - DNA, 13 bp, Homo sapiens
cctcactctgcca

SEQ ID NO: 6073083 - DNA, 14 bp, Homo sapiens
cctcactctgccag

SEQ ID NO: 6073084 - DNA, 18 bp, Homo sapiens
cctcactctgccagggca

SEQ ID NO: 6073085 - DNA, 17 bp, Homo sapiens
cctcactctggcctcag

SEQ ID NO: 6073086 - DNA, 17 bp, Homo sapiens
cctcactctgtcagcca

SEQ ID NO: 6073087 - DNA, 18 bp, Homo sapiens
cctcactctgtcagccag

SEQ ID NO: 6073088 - DNA, 18 bp, Homo sapiens
cctcactctgttgctcag

SEQ ID NO: 6073089 - DNA, 18 bp, Homo sapiens
cctcactgaaaacatctg

SEQ ID NO: 6073090 - DNA, 16 bp, Homo sapiens
cctcactgaaggacct

SEQ ID NO: 6073091 - DNA, 21 bp, Homo sapiens
cctcactgagaaggccccagg

SEQ ID NO: 6073092 - DNA, 13 bp, Homo sapiens
cctcactgagagg

SEQ ID NO: 6073093 - DNA, 13 bp, Homo sapiens
cctcactgccact

SEQ ID NO: 6073094 - DNA, 17 bp, Homo sapiens
cctcactgccccaccag

SEQ ID NO: 6073095 - DNA, 14 bp, Homo sapiens
cctcactgcccgca

SEQ ID NO: 6073096 - DNA, 15 bp, Homo sapiens
cctcactgcccgcac

SEQ ID NO: 6073097 - DNA, 15 bp, Homo sapiens
cctcactgccttcca

SEQ ID NO: 6073098 - DNA, 21 bp, Homo sapiens
cctcactgctggggagtccct

SEQ ID NO: 6073099 - DNA, 15 bp, Homo sapiens
cctcactggaggagc

SEQ ID NO: 6073100 - DNA, 14 bp, Homo sapiens
cctcactggatgaa

SEQ ID NO: 6073101 - DNA, 15 bp, Homo sapiens
cctcactggcctgcc

SEQ ID NO: 6073102 - DNA, 12 bp, Homo sapiens
cctcactggctc

SEQ ID NO: 6073103 - DNA, 16 bp, Homo sapiens
cctcactggctcatgc

SEQ ID NO: 6073104 - DNA, 18 bp, Homo sapiens
cctcactggctcatgccc

SEQ ID NO: 6073105 - DNA, 14 bp, Homo sapiens
cctcactggctggg

SEQ ID NO: 6073106 - DNA, 16 bp, Homo sapiens
cctcactggctggggc

SEQ ID NO: 6073107 - DNA, 14 bp, Homo sapiens
cctcactgggcctt

SEQ ID NO: 6073108 - DNA, 19 bp, Homo sapiens
cctcactgggctcactgca

SEQ ID NO: 6073109 - DNA, 18 bp, Homo sapiens
cctcactgggggctttgg

SEQ ID NO: 6073110 - DNA, 20 bp, Homo sapiens
cctcactggggtcctggggc

SEQ ID NO: 6073111 - DNA, 23 bp, Homo sapiens
cctcactggggtcctggggcctc

SEQ ID NO: 6073112 - DNA, 16 bp, Homo sapiens
cctcactgggtgtggc

SEQ ID NO: 6073113 - DNA, 16 bp, Homo sapiens
cctcactggtgcattt

SEQ ID NO: 6073114 - DNA, 21 bp, Homo sapiens
cctcactggtgcatttaaaat

SEQ ID NO: 6073115 - DNA, 20 bp, Homo sapiens
cctcactgtatccaggttcc

SEQ ID NO: 6073116 - DNA, 22 bp, Homo sapiens
cctcactgtcagcgtttctcca

SEQ ID NO: 6073117 - DNA, 13 bp, Homo sapiens
cctcactgtcagg

SEQ ID NO: 6073118 - DNA, 17 bp, Homo sapiens
cctcactgtcagtccca

SEQ ID NO: 6073119 - DNA, 14 bp, Homo sapiens
cctcactgtcatct

SEQ ID NO: 6073120 - DNA, 12 bp, Homo sapiens
cctcactgtggg

SEQ ID NO: 6073121 - DNA, 22 bp, Homo sapiens
cctcactgtggtaaatgccaca

SEQ ID NO: 6073122 - DNA, 23 bp, Homo sapiens
cctcacttacataaagctccctt

SEQ ID NO: 6073123 - DNA, 19 bp, Homo sapiens
cctcacttccatacagctc

SEQ ID NO: 6073124 - DNA, 21 bp, Homo sapiens
cctcacttccatacagctcta

SEQ ID NO: 6073125 - DNA, 17 bp, Homo sapiens
cctcacttccctgggaa

SEQ ID NO: 6073126 - DNA, 16 bp, Homo sapiens
cctcacttctgtctcc

SEQ ID NO: 6073127 - DNA, 14 bp, Homo sapiens
cctcacttgaatgt

SEQ ID NO: 6073128 - DNA, 21 bp, Homo sapiens
cctcacttgattcatctctgg

SEQ ID NO: 6073129 - DNA, 14 bp, Homo sapiens
cctcacttggggga

SEQ ID NO: 6073130 - DNA, 16 bp, Homo sapiens
cctcagaaaatgagta

SEQ ID NO: 6073131 - DNA, 19 bp, Homo sapiens
cctcagaaacactggggct

SEQ ID NO: 6073132 - DNA, 11 bp, Homo sapiens
cctcagaaagt

SEQ ID NO: 6073133 - DNA, 19 bp, Homo sapiens
cctcagaaagtcaccagga

SEQ ID NO: 6073134 - DNA, 17 bp, Homo sapiens
cctcagaaattgaaagc

SEQ ID NO: 6073135 - DNA, 19 bp, Homo sapiens
cccacctggcctctgcact

SEQ ID NO: 6073136 - DNA, 21 bp, Homo sapiens
cccacctggcctctgcactcc

SEQ ID NO: 6073137 - DNA, 13 bp, Homo sapiens
cccacctggctgc

SEQ ID NO: 6073138 - DNA, 15 bp, Homo sapiens
cccacctggctgcca

SEQ ID NO: 6073139 - DNA, 20 bp, Homo sapiens
cccacctgggccaaggactc

SEQ ID NO: 6073140 - DNA, 22 bp, Homo sapiens
cccacctggggtctctctccct

SEQ ID NO: 6073141 - DNA, 23 bp, Homo sapiens
cccacctggggtctctctcccta

SEQ ID NO: 6073142 - DNA, 23 bp, Homo sapiens
cccacctggtactgacccaggac

SEQ ID NO: 6073143 - DNA, 16 bp, Homo sapiens
cccacctgtagctgaa

SEQ ID NO: 6073144 - DNA, 14 bp, Homo sapiens
cccacctgtcaacc

SEQ ID NO: 6073145 - DNA, 15 bp, Homo sapiens
cccacctgtcaacct

SEQ ID NO: 6073146 - DNA, 19 bp, Homo sapiens
cccacctgtcaacctgaat

SEQ ID NO: 6073147 - DNA, 19 bp, Homo sapiens
cccacctgtgggccagccg

SEQ ID NO: 6073148 - DNA, 20 bp, Homo sapiens
cccacctgttgtcctgaact

SEQ ID NO: 6073149 - DNA, 22 bp, Homo sapiens
cccacctgttgtcctgaactgt

SEQ ID NO: 6073150 - DNA, 16 bp, Homo sapiens
cccacctgtttctgga

SEQ ID NO: 6073151 - DNA, 17 bp, Homo sapiens
cccacctgttttctgaa

SEQ ID NO: 6073152 - DNA, 21 bp, Homo sapiens
cccaccttcaattcctgggcc

SEQ ID NO: 6073153 - DNA, 13 bp, Homo sapiens
cccaccttcccac

SEQ ID NO: 6073154 - DNA, 15 bp, Homo sapiens
cccaccttccccaga

SEQ ID NO: 6073155 - DNA, 17 bp, Homo sapiens
cccaccttccccagact

SEQ ID NO: 6073156 - DNA, 18 bp, Homo sapiens
cccaccttccccagactc

SEQ ID NO: 6073157 - DNA, 19 bp, Homo sapiens
cccaccttgccaaagcact

SEQ ID NO: 6073158 - DNA, 16 bp, Homo sapiens
cccaccttgccaagct

SEQ ID NO: 6073159 - DNA, 15 bp, Homo sapiens
cccaccttgccaggg

SEQ ID NO: 6073160 - DNA, 15 bp, Homo sapiens
cccaccttggcctcc

SEQ ID NO: 6073161 - DNA, 17 bp, Homo sapiens
cccaccttggctgcagg

SEQ ID NO: 6073162 - DNA, 20 bp, Homo sapiens
cccaccttggctgcagggag

SEQ ID NO: 6073163 - DNA, 18 bp, Homo sapiens
cccaccttggtccctctc

SEQ ID NO: 6073164 - DNA, 21 bp, Homo sapiens
cccaccttgttggagcctgca

SEQ ID NO: 6073165 - DNA, 22 bp, Homo sapiens
cccacctttgggatcagcctcc

SEQ ID NO: 6073166 - DNA, 12 bp, Homo sapiens
cccacctttggt

SEQ ID NO: 6073167 - DNA, 20 bp, Homo sapiens
cccacgaaactgccctggct

SEQ ID NO: 6073168 - DNA, 17 bp, Homo sapiens
cccacgagaccccggct

SEQ ID NO: 6073169 - DNA, 17 bp, Homo sapiens
cccacgaggagcagcag

SEQ ID NO: 6073170 - DNA, 19 bp, Homo sapiens
cccacgaggaggaaccagg

SEQ ID NO: 6073171 - DNA, 13 bp, Homo sapiens
cccacgagggctg

SEQ ID NO: 6073172 - DNA, 14 bp, Homo sapiens
cccacgagggtctc

SEQ ID NO: 6073173 - DNA, 17 bp, Homo sapiens
cccacgagggtgccgtg

SEQ ID NO: 6073174 - DNA, 13 bp, Homo sapiens
cccacgagtcacc

SEQ ID NO: 6073175 - DNA, 15 bp, Homo sapiens
cccacgagtcacctg

SEQ ID NO: 6073176 - DNA, 22 bp, Homo sapiens
cccacgagtcacctgcaagccc

SEQ ID NO: 6073177 - DNA, 18 bp, Homo sapiens
cccacgatcggccttggt

SEQ ID NO: 6073178 - DNA, 18 bp, Homo sapiens
cccacgattggccacctg

SEQ ID NO: 6073179 - DNA, 23 bp, Homo sapiens
cccacgattggtatgatgctgcc

SEQ ID NO: 6073180 - DNA, 19 bp, Homo sapiens
cccacgattttctccagct

SEQ ID NO: 6073181 - DNA, 21 bp, Homo sapiens
cccacgattttctccagctca

SEQ ID NO: 6073182 - DNA, 19 bp, Homo sapiens
cccacgcagagccccggag

SEQ ID NO: 6073183 - DNA, 22 bp, Homo sapiens
cccacgcagagccccggagcac

SEQ ID NO: 6073184 - DNA, 14 bp, Homo sapiens
cccacgcagaggac

SEQ ID NO: 6073185 - DNA, 16 bp, Homo sapiens
cccacgccagctggcc

SEQ ID NO: 6073186 - DNA, 17 bp, Homo sapiens
cccacgccagctggccc

SEQ ID NO: 6073187 - DNA, 19 bp, Homo sapiens
cccacgccagctggcccag

SEQ ID NO: 6073188 - DNA, 14 bp, Homo sapiens
cccacgcccccact

SEQ ID NO: 6073189 - DNA, 20 bp, Homo sapiens
cccacgcccctccccagccc

SEQ ID NO: 6073190 - DNA, 17 bp, Homo sapiens
cccacgccctcccctcc

SEQ ID NO: 6073191 - DNA, 19 bp, Homo sapiens
cccacgcccttggagcctt

SEQ ID NO: 6073192 - DNA, 20 bp, Homo sapiens
cccacgccgatataagccat

SEQ ID NO: 6073193 - DNA, 21 bp, Homo sapiens
cccacgccgatataagccata

SEQ ID NO: 6073194 - DNA, 22 bp, Homo sapiens
cccacgccgatataagccatag

SEQ ID NO: 6073195 - DNA, 15 bp, Homo sapiens
cccacgccggcctct

SEQ ID NO: 6073196 - DNA, 14 bp, Homo sapiens
cccacgcctccatc

SEQ ID NO: 6073197 - DNA, 13 bp, Homo sapiens
cccacgcctgctt

SEQ ID NO: 6073198 - DNA, 14 bp, Homo sapiens
cccacgccttatcc

SEQ ID NO: 6073199 - DNA, 16 bp, Homo sapiens
cccacgctcaccccct

SEQ ID NO: 6073200 - DNA, 13 bp, Homo sapiens
cccacgctcctgc

SEQ ID NO: 6073201 - DNA, 24 bp, Homo sapiens
cccacgctgaccatgcgtcagggg

SEQ ID NO: 6073202 - DNA, 12 bp, Homo sapiens
cccacgctggga

SEQ ID NO: 6073203 - DNA, 21 bp, Homo sapiens
cccacgctgggacacagaccg

SEQ ID NO: 6073204 - DNA, 13 bp, Homo sapiens
cccacggagacag

SEQ ID NO: 6073205 - DNA, 14 bp, Homo sapiens
cccacggagacaga

SEQ ID NO: 6073206 - DNA, 17 bp, Homo sapiens
cccacggagacagagga

SEQ ID NO: 6073207 - DNA, 12 bp, Homo sapiens
cccacggccacc

SEQ ID NO: 6073208 - DNA, 20 bp, Homo sapiens
cccacggccactgcagtcac

SEQ ID NO: 6073209 - DNA, 13 bp, Homo sapiens
cccacggccgtcc

SEQ ID NO: 6073210 - DNA, 19 bp, Homo sapiens
cccacggccgtccctgact

SEQ ID NO: 6073211 - DNA, 23 bp, Homo sapiens
cccacggccgtccctgacttccc

SEQ ID NO: 6073212 - DNA, 15 bp, Homo sapiens
cccacggctcctcga

SEQ ID NO: 6073213 - DNA, 15 bp, Homo sapiens
cccacggctctgtgc

SEQ ID NO: 6073214 - DNA, 17 bp, Homo sapiens
cccacggctctgtgccc

SEQ ID NO: 6073215 - DNA, 17 bp, Homo sapiens
cccacgggacctggggc

SEQ ID NO: 6073216 - DNA, 14 bp, Homo sapiens
cccacgggaggaca

SEQ ID NO: 6073217 - DNA, 14 bp, Homo sapiens
cccacgggccggcc

SEQ ID NO: 6073218 - DNA, 17 bp, Homo sapiens
cccacggggaccactgg

SEQ ID NO: 6073219 - DNA, 21 bp, Homo sapiens
cccacggggaccactgggccc

SEQ ID NO: 6073220 - DNA, 15 bp, Homo sapiens
cccacggtctggagg

SEQ ID NO: 6073221 - DNA, 16 bp, Homo sapiens
cccacggtctggaggc

SEQ ID NO: 6073222 - DNA, 21 bp, Homo sapiens
cccacggttcggggcttctgc

SEQ ID NO: 6073223 - DNA, 16 bp, Homo sapiens
cccacggtttcagcta

SEQ ID NO: 6073224 - DNA, 19 bp, Homo sapiens
cccacgtagggggctctgg

SEQ ID NO: 6073225 - DNA, 21 bp, Homo sapiens
cccacgtagggggctctgggc

SEQ ID NO: 6073226 - DNA, 20 bp, Homo sapiens
cccacgtcaggcctggcctc

SEQ ID NO: 6073227 - DNA, 21 bp, Homo sapiens
cccacgtccaatcatgggcca

SEQ ID NO: 6073228 - DNA, 13 bp, Homo sapiens
cccacgtccctgc

SEQ ID NO: 6073229 - DNA, 17 bp, Homo sapiens
cccacgtcctgtcagtg

SEQ ID NO: 6073230 - DNA, 16 bp, Homo sapiens
cccacgtctctctgcc

SEQ ID NO: 6073231 - DNA, 17 bp, Homo sapiens
cccacgtctctctgcct

SEQ ID NO: 6073232 - DNA, 20 bp, Homo sapiens
cccacgtctctctgcctgct

SEQ ID NO: 6073233 - DNA, 21 bp, Homo sapiens
cccacgtctctctgcctgctg

SEQ ID NO: 6073234 - DNA, 14 bp, Homo sapiens
cccacgtctggcca

SEQ ID NO: 6073235 - DNA, 19 bp, Homo sapiens
cccacgtctggccaggcac

SEQ ID NO: 6073236 - DNA, 22 bp, Homo sapiens
cccacgtctggccaggcactgc

SEQ ID NO: 6073237 - DNA, 13 bp, Homo sapiens
cccacgtctgtcc

SEQ ID NO: 6073238 - DNA, 23 bp, Homo sapiens
cccacgtcttcttgctgcagcct

SEQ ID NO: 6073239 - DNA, 18 bp, Homo sapiens
cccacgtgagagaatctg

SEQ ID NO: 6073240 - DNA, 21 bp, Homo sapiens
cccacgtgagagaatctgcct

SEQ ID NO: 6073241 - DNA, 21 bp, Homo sapiens
cccacgtgcacagcttcctga

SEQ ID NO: 6073242 - DNA, 19 bp, Homo sapiens
cccacgtgcagcacctgtc

SEQ ID NO: 6073243 - DNA, 21 bp, Homo sapiens
cccacgtgcagcacctgtcac

SEQ ID NO: 6073244 - DNA, 17 bp, Homo sapiens
cccacgttctctctgcc

SEQ ID NO: 6073245 - DNA, 13 bp, Homo sapiens
cccacgttctttc

SEQ ID NO: 6073246 - DNA, 23 bp, Homo sapiens
cccacgtttgttcgcttcctgag

SEQ ID NO: 6073247 - DNA, 23 bp, Homo sapiens
cccactaactgaggagctagtgt

SEQ ID NO: 6073248 - DNA, 19 bp, Homo sapiens
cccactaagctttctcctt

SEQ ID NO: 6073249 - DNA, 23 bp, Homo sapiens
cccactacccttctcctttcctt

SEQ ID NO: 6073250 - DNA, 15 bp, Homo sapiens
cccactactgcagca

SEQ ID NO: 6073251 - DNA, 18 bp, Homo sapiens
cccactagacccactgga

SEQ ID NO: 6073252 - DNA, 17 bp, Homo sapiens
cccactagagggcccat

SEQ ID NO: 6073253 - DNA, 19 bp, Homo sapiens
cccactagagggcccatca

SEQ ID NO: 6073254 - DNA, 19 bp, Homo sapiens
cccactagccctctttctc

SEQ ID NO: 6073255 - DNA, 17 bp, Homo sapiens
cccactcaagccaagca

SEQ ID NO: 6073256 - DNA, 19 bp, Homo sapiens
cccactcaagccaagcagc

SEQ ID NO: 6073257 - DNA, 12 bp, Homo sapiens
cccactcacaga

SEQ ID NO: 6073258 - DNA, 12 bp, Homo sapiens
cccactcaccag

SEQ ID NO: 6073259 - DNA, 13 bp, Homo sapiens
cccactcaccagc

SEQ ID NO: 6073260 - DNA, 14 bp, Homo sapiens
cccactcaccagcc

SEQ ID NO: 6073261 - DNA, 23 bp, Homo sapiens
cccactcagaactctccagggag

SEQ ID NO: 6073262 - DNA, 12 bp, Homo sapiens
cccactcagcca

SEQ ID NO: 6073263 - DNA, 17 bp, Homo sapiens
cccactcagtgcctcca

SEQ ID NO: 6073264 - DNA, 17 bp, Homo sapiens
cccactcattccttctc

SEQ ID NO: 6073265 - DNA, 21 bp, Homo sapiens
cccactccacaccagtaataa

SEQ ID NO: 6073266 - DNA, 18 bp, Homo sapiens
cccactccaccctgttag

SEQ ID NO: 6073267 - DNA, 13 bp, Homo sapiens
cccactccagcag

SEQ ID NO: 6073268 - DNA, 12 bp, Homo sapiens
cccactccagcc

SEQ ID NO: 6073269 - DNA, 15 bp, Homo sapiens
cccactccagccctg

SEQ ID NO: 6073270 - DNA, 14 bp, Homo sapiens
cccactccagcctg

SEQ ID NO: 6073271 - DNA, 17 bp, Homo sapiens
cccactccagcctgggg

SEQ ID NO: 6073272 - DNA, 12 bp, Homo sapiens
cccactccagct

SEQ ID NO: 6073273 - DNA, 13 bp, Homo sapiens
cccactccagctg

SEQ ID NO: 6073274 - DNA, 14 bp, Homo sapiens
cccactcccatctc

SEQ ID NO: 6073275 - DNA, 21 bp, Homo sapiens
cccactcccccaggagcagct

SEQ ID NO: 6073276 - DNA, 15 bp, Homo sapiens
cccactcccccttcc

SEQ ID NO: 6073277 - DNA, 13 bp, Homo sapiens
cccactcccctca

SEQ ID NO: 6073278 - DNA, 13 bp, Homo sapiens
cccactcccgcct

SEQ ID NO: 6073279 - DNA, 21 bp, Homo sapiens
cccactcccgcctcagggcca

SEQ ID NO: 6073280 - DNA, 20 bp, Homo sapiens
cccactccctatctccttcc

SEQ ID NO: 6073281 - DNA, 13 bp, Homo sapiens
cccactccctcac

SEQ ID NO: 6073282 - DNA, 13 bp, Homo sapiens
cccactccctgcc

SEQ ID NO: 6073283 - DNA, 14 bp, Homo sapiens
cccactcccttggt

SEQ ID NO: 6073284 - DNA, 16 bp, Homo sapiens
cccactccgccagcca

SEQ ID NO: 6073285 - DNA, 19 bp, Homo sapiens
cccactccgccagccacag

SEQ ID NO: 6073286 - DNA, 23 bp, Homo sapiens
cccactccgccagccacaggacc

SEQ ID NO: 6073287 - DNA, 21 bp, Homo sapiens
cccactccggccctccagagc

SEQ ID NO: 6073288 - DNA, 17 bp, Homo sapiens
cccactccggcttgtcc

SEQ ID NO: 6073289 - DNA, 18 bp, Homo sapiens
cccactcctcactgcccc

SEQ ID NO: 6073290 - DNA, 19 bp, Homo sapiens
cccactcctcactgcccca

SEQ ID NO: 6073291 - DNA, 16 bp, Homo sapiens
cccactcctcctcctt

SEQ ID NO: 6073292 - DNA, 20 bp, Homo sapiens
cccactcctcctcctttctt

SEQ ID NO: 6073293 - DNA, 15 bp, Homo sapiens
cccactcctctccac

SEQ ID NO: 6073294 - DNA, 16 bp, Homo sapiens
cccactcctctcccac

SEQ ID NO: 6073295 - DNA, 15 bp, Homo sapiens
cccactcctgctgca

SEQ ID NO: 6073296 - DNA, 11 bp, Homo sapiens
cccactcctgt

SEQ ID NO: 6073297 - DNA, 15 bp, Homo sapiens
cccactctacctcct

SEQ ID NO: 6073298 - DNA, 20 bp, Homo sapiens
cccactctacctccttagct

SEQ ID NO: 6073299 - DNA, 13 bp, Homo sapiens
cccactctcattc

SEQ ID NO: 6073300 - DNA, 14 bp, Homo sapiens
cccactctcattcc

SEQ ID NO: 6073301 - DNA, 18 bp, Homo sapiens
cccactctccacctcact

SEQ ID NO: 6073302 - DNA, 20 bp, Homo sapiens
cccactctccatcagatgtg

SEQ ID NO: 6073303 - DNA, 15 bp, Homo sapiens
cccactctccccaca

SEQ ID NO: 6073304 - DNA, 14 bp, Homo sapiens
cccactctcctagg

SEQ ID NO: 6073305 - DNA, 21 bp, Homo sapiens
cccactctcctaggcattctg

SEQ ID NO: 6073306 - DNA, 20 bp, Homo sapiens
cccactctctcacccaccag

SEQ ID NO: 6073307 - DNA, 14 bp, Homo sapiens
cccactctgcctgc

SEQ ID NO: 6073308 - DNA, 19 bp, Homo sapiens
cccactctgcggcccgggc

SEQ ID NO: 6073309 - DNA, 19 bp, Homo sapiens
cccactctgctcccagccc

SEQ ID NO: 6073310 - DNA, 14 bp, Homo sapiens
cccactctgctctg

SEQ ID NO: 6073311 - DNA, 16 bp, Homo sapiens
cccactctgctctgat

SEQ ID NO: 6073312 - DNA, 19 bp, Homo sapiens
cccactctgctctgatgca

SEQ ID NO: 6073313 - DNA, 21 bp, Homo sapiens
cccactctgctttgactgagc

SEQ ID NO: 6073314 - DNA, 13 bp, Homo sapiens
cctcagaagaaaa

SEQ ID NO: 6073315 - DNA, 15 bp, Homo sapiens
cctcagaagccttct

SEQ ID NO: 6073316 - DNA, 20 bp, Homo sapiens
cctcagaagccttcttgctg

SEQ ID NO: 6073317 - DNA, 19 bp, Homo sapiens
cctcagaaggccccagaga

SEQ ID NO: 6073318 - DNA, 21 bp, Homo sapiens
cctcagaaggccccagagaga

SEQ ID NO: 6073319 - DNA, 23 bp, Homo sapiens
cctcagacaatccactctcagga

SEQ ID NO: 6073320 - DNA, 16 bp, Homo sapiens
cctcagacagccccct

SEQ ID NO: 6073321 - DNA, 15 bp, Homo sapiens
cctcagacatctcca

SEQ ID NO: 6073322 - DNA, 20 bp, Homo sapiens
cctcagacatctccagtgtg

SEQ ID NO: 6073323 - DNA, 13 bp, Homo sapiens
cctcagacccagg

SEQ ID NO: 6073324 - DNA, 15 bp, Homo sapiens
cctcagacccaggag

SEQ ID NO: 6073325 - DNA, 19 bp, Homo sapiens
cctcagacccaggagtcca

SEQ ID NO: 6073326 - DNA, 23 bp, Homo sapiens
cctcagacccaggagtccagacc

SEQ ID NO: 6073327 - DNA, 22 bp, Homo sapiens
cctcagacccaggggtccaggc

SEQ ID NO: 6073328 - DNA, 23 bp, Homo sapiens
cctcagacccaggggtccaggcc

SEQ ID NO: 6073329 - DNA, 15 bp, Homo sapiens
cctcagaccccaggt

SEQ ID NO: 6073330 - DNA, 19 bp, Homo sapiens
cctcagacgttgcctgaga

SEQ ID NO: 6073331 - DNA, 12 bp, Homo sapiens
cctcagactcag

SEQ ID NO: 6073332 - DNA, 22 bp, Homo sapiens
cctcagactcagaggtccaggc

SEQ ID NO: 6073333 - DNA, 20 bp, Homo sapiens
cctcagactctaagaaagaa

SEQ ID NO: 6073334 - DNA, 21 bp, Homo sapiens
cctcagactctaagaaagaac

SEQ ID NO: 6073335 - DNA, 12 bp, Homo sapiens
cctcagactgca

SEQ ID NO: 6073336 - DNA, 16 bp, Homo sapiens
cctcagactgcaccca

SEQ ID NO: 6073337 - DNA, 18 bp, Homo sapiens
cctcagactgcacccagg

SEQ ID NO: 6073338 - DNA, 19 bp, Homo sapiens
cctcagactgcacccagga

SEQ ID NO: 6073339 - DNA, 15 bp, Homo sapiens
cctcagactggggca

SEQ ID NO: 6073340 - DNA, 17 bp, Homo sapiens
cctcagacttaccagga

SEQ ID NO: 6073341 - DNA, 20 bp, Homo sapiens
cctcagagaaatcactgaac

SEQ ID NO: 6073342 - DNA, 11 bp, Homo sapiens
cctcagagaca

SEQ ID NO: 6073343 - DNA, 12 bp, Homo sapiens
cctcagagacag

SEQ ID NO: 6073344 - DNA, 14 bp, Homo sapiens
cctcagagaccagg

SEQ ID NO: 6073345 - DNA, 21 bp, Homo sapiens
cctcagagaccagggctccag

SEQ ID NO: 6073346 - DNA, 18 bp, Homo sapiens
cctcagagatctcccttc

SEQ ID NO: 6073347 - DNA, 18 bp, Homo sapiens
cctcagagcaggggccag

SEQ ID NO: 6073348 - DNA, 21 bp, Homo sapiens
cctcagagcatttaaggaaac

SEQ ID NO: 6073349 - DNA, 16 bp, Homo sapiens
cctcagagccacccct

SEQ ID NO: 6073350 - DNA, 12 bp, Homo sapiens
cctcagagccca

SEQ ID NO: 6073351 - DNA, 15 bp, Homo sapiens
cctcagagcccatgg

SEQ ID NO: 6073352 - DNA, 15 bp, Homo sapiens
cctcagagccccgca

SEQ ID NO: 6073353 - DNA, 13 bp, Homo sapiens
cctcagagcctga

SEQ ID NO: 6073354 - DNA, 15 bp, Homo sapiens
cctcagagcgccagg

SEQ ID NO: 6073355 - DNA, 17 bp, Homo sapiens
cctcagagcgccaggaa

SEQ ID NO: 6073356 - DNA, 17 bp, Homo sapiens
cctcagagctccatgct

SEQ ID NO: 6073357 - DNA, 11 bp, Homo sapiens
cctcagagctt

SEQ ID NO: 6073358 - DNA, 16 bp, Homo sapiens
cctcagagcttcctgg

SEQ ID NO: 6073359 - DNA, 22 bp, Homo sapiens
cctcagaggagctctaccctgc

SEQ ID NO: 6073360 - DNA, 21 bp, Homo sapiens
cctcagaggcagcaggaggct

SEQ ID NO: 6073361 - DNA, 15 bp, Homo sapiens
cctcagaggcagctt

SEQ ID NO: 6073362 - DNA, 23 bp, Homo sapiens
cctcagaggcagcttcaagtgcc

SEQ ID NO: 6073363 - DNA, 19 bp, Homo sapiens
cctcagaggccttgggagc

SEQ ID NO: 6073364 - DNA, 19 bp, Homo sapiens
cctcagaggctgagccctg

SEQ ID NO: 6073365 - DNA, 20 bp, Homo sapiens
cctcagagtcccggcgttta

SEQ ID NO: 6073366 - DNA, 18 bp, Homo sapiens
cctcagagtcctgccgac

SEQ ID NO: 6073367 - DNA, 17 bp, Homo sapiens
cctcagatagacctgtg

SEQ ID NO: 6073368 - DNA, 17 bp, Homo sapiens
cctcagatcccagggta

SEQ ID NO: 6073369 - DNA, 18 bp, Homo sapiens
cctcagatcccagggtac

SEQ ID NO: 6073370 - DNA, 19 bp, Homo sapiens
cctcagatcccagggtaca

SEQ ID NO: 6073371 - DNA, 18 bp, Homo sapiens
cctcagatctttgcacca

SEQ ID NO: 6073372 - DNA, 19 bp, Homo sapiens
cctcagatgatctctccac

SEQ ID NO: 6073373 - DNA, 15 bp, Homo sapiens
cctcagatggcagct

SEQ ID NO: 6073374 - DNA, 16 bp, Homo sapiens
cctcagatggcagctt

SEQ ID NO: 6073375 - DNA, 17 bp, Homo sapiens
cctcagatggcagcttt

SEQ ID NO: 6073376 - DNA, 12 bp, Homo sapiens
cctcagatgggg

SEQ ID NO: 6073377 - DNA, 15 bp, Homo sapiens
cctcagatgtgttga

SEQ ID NO: 6073378 - DNA, 16 bp, Homo sapiens
cctcagattcttcatt

SEQ ID NO: 6073379 - DNA, 14 bp, Homo sapiens
cctcagcaagccct

SEQ ID NO: 6073380 - DNA, 13 bp, Homo sapiens
cctcagcaagctg

SEQ ID NO: 6073381 - DNA, 16 bp, Homo sapiens
cctcagcaagctgccc

SEQ ID NO: 6073382 - DNA, 18 bp, Homo sapiens
cctcagcaagctgcccag

SEQ ID NO: 6073383 - DNA, 19 bp, Homo sapiens
cctcagcaagctgcccagc

SEQ ID NO: 6073384 - DNA, 23 bp, Homo sapiens
cctcagcaagctgcccagccctg

SEQ ID NO: 6073385 - DNA, 24 bp, Homo sapiens
cctcagcaagctgcccagccctgg

SEQ ID NO: 6073386 - DNA, 14 bp, Homo sapiens
cctcagcaccccac

SEQ ID NO: 6073387 - DNA, 16 bp, Homo sapiens
cctcagcaccccactc

SEQ ID NO: 6073388 - DNA, 21 bp, Homo sapiens
cctcagcaccccactcctcag

SEQ ID NO: 6073389 - DNA, 22 bp, Homo sapiens
cctcagcacccctagcatgaac

SEQ ID NO: 6073390 - DNA, 14 bp, Homo sapiens
cctcagcacccctc

SEQ ID NO: 6073391 - DNA, 19 bp, Homo sapiens
cctcagcacccctgtctct

SEQ ID NO: 6073392 - DNA, 15 bp, Homo sapiens
cctcagcaccccttc

SEQ ID NO: 6073393 - DNA, 16 bp, Homo sapiens
cctcagcaccccttcc

SEQ ID NO: 6073394 - DNA, 11 bp, Homo sapiens
cctcagcactg

SEQ ID NO: 6073395 - DNA, 15 bp, Homo sapiens
cctcagcagaaggcc

SEQ ID NO: 6073396 - DNA, 18 bp, Homo sapiens
cctcagcagaaggccttg

SEQ ID NO: 6073397 - DNA, 21 bp, Homo sapiens
cctcagcagcaaatgccactc

SEQ ID NO: 6073398 - DNA, 14 bp, Homo sapiens
cctcagcagctctg

SEQ ID NO: 6073399 - DNA, 15 bp, Homo sapiens
cctcagcagctctgg

SEQ ID NO: 6073400 - DNA, 15 bp, Homo sapiens
cctcagcaggaacct

SEQ ID NO: 6073401 - DNA, 21 bp, Homo sapiens
cctcagcaggaacctgtactg

SEQ ID NO: 6073402 - DNA, 19 bp, Homo sapiens
cctcagcatttccttccag

SEQ ID NO: 6073403 - DNA, 19 bp, Homo sapiens
cctcagccaaacacagagc

SEQ ID NO: 6073404 - DNA, 22 bp, Homo sapiens
cctcagccaaacacagagcggg

SEQ ID NO: 6073405 - DNA, 15 bp, Homo sapiens
cctcagccaaggaaa

SEQ ID NO: 6073406 - DNA, 19 bp, Homo sapiens
cctcagccacacccaggca

SEQ ID NO: 6073407 - DNA, 17 bp, Homo sapiens
cctcagccacccttggt

SEQ ID NO: 6073408 - DNA, 18 bp, Homo sapiens
cctcagccacgcctctct

SEQ ID NO: 6073409 - DNA, 18 bp, Homo sapiens
cctcagccacttgcctgt

SEQ ID NO: 6073410 - DNA, 15 bp, Homo sapiens
cctcagccagagaag

SEQ ID NO: 6073411 - DNA, 12 bp, Homo sapiens
cctcagccagcc

SEQ ID NO: 6073412 - DNA, 16 bp, Homo sapiens
cctcagccagccctgg

SEQ ID NO: 6073413 - DNA, 17 bp, Homo sapiens
cctcagccagccctgga

SEQ ID NO: 6073414 - DNA, 15 bp, Homo sapiens
cctcagccagcctcc

SEQ ID NO: 6073415 - DNA, 14 bp, Homo sapiens
cctcagccagctgc

SEQ ID NO: 6073416 - DNA, 16 bp, Homo sapiens
cctcagccagctgccc

SEQ ID NO: 6073417 - DNA, 11 bp, Homo sapiens
cctcagccagt

SEQ ID NO: 6073418 - DNA, 20 bp, Homo sapiens
cctcagccagtggcacagga

SEQ ID NO: 6073419 - DNA, 21 bp, Homo sapiens
cctcagccatgaggagttgct

SEQ ID NO: 6073420 - DNA, 14 bp, Homo sapiens
cctcagccccagga

SEQ ID NO: 6073421 - DNA, 17 bp, Homo sapiens
cctcagccccaggagaa

SEQ ID NO: 6073422 - DNA, 18 bp, Homo sapiens
cctcagccccagggccct

SEQ ID NO: 6073423 - DNA, 20 bp, Homo sapiens
cctcagccccagggccctgc

SEQ ID NO: 6073424 - DNA, 21 bp, Homo sapiens
cctcagccccagggccctgct

SEQ ID NO: 6073425 - DNA, 11 bp, Homo sapiens
cctcagccccc

SEQ ID NO: 6073426 - DNA, 12 bp, Homo sapiens
cctcagccccca

SEQ ID NO: 6073427 - DNA, 18 bp, Homo sapiens
cctcagcccccaggccag

SEQ ID NO: 6073428 - DNA, 14 bp, Homo sapiens
cctcagcccctctt

SEQ ID NO: 6073429 - DNA, 16 bp, Homo sapiens
cctcagcccctcttgc

SEQ ID NO: 6073430 - DNA, 18 bp, Homo sapiens
cctcagcccctcttgccc

SEQ ID NO: 6073431 - DNA, 19 bp, Homo sapiens
cctcagcccgccaaggtag

SEQ ID NO: 6073432 - DNA, 11 bp, Homo sapiens
cctcagccctc

SEQ ID NO: 6073433 - DNA, 12 bp, Homo sapiens
cctcagccctca

SEQ ID NO: 6073434 - DNA, 16 bp, Homo sapiens
cctcagccctgaccct

SEQ ID NO: 6073435 - DNA, 17 bp, Homo sapiens
cctcagccctgaccctg

SEQ ID NO: 6073436 - DNA, 18 bp, Homo sapiens
cctcagccctgaccctgt

SEQ ID NO: 6073437 - DNA, 14 bp, Homo sapiens
cctcagccctgctc

SEQ ID NO: 6073438 - DNA, 17 bp, Homo sapiens
cctcagccctgctccct

SEQ ID NO: 6073439 - DNA, 19 bp, Homo sapiens
cctcagccctgctccctgc

SEQ ID NO: 6073440 - DNA, 14 bp, Homo sapiens
cctcagccctggcc

SEQ ID NO: 6073441 - DNA, 15 bp, Homo sapiens
cctcagccctggcct

SEQ ID NO: 6073442 - DNA, 13 bp, Homo sapiens
cctcagcccttgc

SEQ ID NO: 6073443 - DNA, 16 bp, Homo sapiens
cctcagcccttgcccc

SEQ ID NO: 6073444 - DNA, 19 bp, Homo sapiens
cctcagcctagaccctcct

SEQ ID NO: 6073445 - DNA, 16 bp, Homo sapiens
cctcagcctcagagga

SEQ ID NO: 6073446 - DNA, 21 bp, Homo sapiens
cctcagcctccaaagtggagc

SEQ ID NO: 6073447 - DNA, 13 bp, Homo sapiens
cctcagcctccag

SEQ ID NO: 6073448 - DNA, 19 bp, Homo sapiens
cctcagcctcccaaagtgc

SEQ ID NO: 6073449 - DNA, 22 bp, Homo sapiens
cctcagcctcccaaagtgctgg

SEQ ID NO: 6073450 - DNA, 23 bp, Homo sapiens
cctcagcctcccaaagtgctggg

SEQ ID NO: 6073451 - DNA, 20 bp, Homo sapiens
cctcagcctcccatagctgg

SEQ ID NO: 6073452 - DNA, 21 bp, Homo sapiens
cctcagcctccctttgccagc

SEQ ID NO: 6073453 - DNA, 23 bp, Homo sapiens
cctcagcctccctttgccagcca

SEQ ID NO: 6073454 - DNA, 22 bp, Homo sapiens
cctcagcctcctgaacagctgg

SEQ ID NO: 6073455 - DNA, 15 bp, Homo sapiens
cctcagcctcctgag

SEQ ID NO: 6073456 - DNA, 22 bp, Homo sapiens
cctcagcctgatcaggcttcct

SEQ ID NO: 6073457 - DNA, 23 bp, Homo sapiens
cctcagcctgatcaggcttcctg

SEQ ID NO: 6073458 - DNA, 16 bp, Homo sapiens
cctcagcctgcaccct

SEQ ID NO: 6073459 - DNA, 20 bp, Homo sapiens
cctcagcctgcctgaagaga

SEQ ID NO: 6073460 - DNA, 23 bp, Homo sapiens
cctcagcctgcctgaagagagga

SEQ ID NO: 6073461 - DNA, 21 bp, Homo sapiens
cctcagcctgctttcctgcag

SEQ ID NO: 6073462 - DNA, 23 bp, Homo sapiens
cctcagcctgctttcctgcagca

SEQ ID NO: 6073463 - DNA, 14 bp, Homo sapiens
cctcagcctggaga

SEQ ID NO: 6073464 - DNA, 19 bp, Homo sapiens
cctcagcctggagaggcct

SEQ ID NO: 6073465 - DNA, 20 bp, Homo sapiens
cctcagcctggagaggcctg

SEQ ID NO: 6073466 - DNA, 17 bp, Homo sapiens
cctcagcctggggctct

SEQ ID NO: 6073467 - DNA, 18 bp, Homo sapiens
cctcagcctggggctctc

SEQ ID NO: 6073468 - DNA, 22 bp, Homo sapiens
cctcagcctggggctctctgac

SEQ ID NO: 6073469 - DNA, 15 bp, Homo sapiens
cctcagcctggggtt

SEQ ID NO: 6073470 - DNA, 11 bp, Homo sapiens
cctcagcctgt

SEQ ID NO: 6073471 - DNA, 16 bp, Homo sapiens
cctcagcctgtgctgc

SEQ ID NO: 6073472 - DNA, 22 bp, Homo sapiens
cctcagccttccccttgcccag

SEQ ID NO: 6073473 - DNA, 18 bp, Homo sapiens
cctcagccttgccagaga

SEQ ID NO: 6073474 - DNA, 21 bp, Homo sapiens
cctcagccttgccagagatcc

SEQ ID NO: 6073475 - DNA, 22 bp, Homo sapiens
cctcagccttgccagagatcca

SEQ ID NO: 6073476 - DNA, 15 bp, Homo sapiens
cctcagcgagaggca

SEQ ID NO: 6073477 - DNA, 17 bp, Homo sapiens
cctcagcgagaggcagc

SEQ ID NO: 6073478 - DNA, 16 bp, Homo sapiens
cctcagcgcaggctgc

SEQ ID NO: 6073479 - DNA, 17 bp, Homo sapiens
cctcagcgcaggctgca

SEQ ID NO: 6073480 - DNA, 19 bp, Homo sapiens
cctcagcgcaggctgcaga

SEQ ID NO: 6073481 - DNA, 19 bp, Homo sapiens
cctcagcgcccccagagcc

SEQ ID NO: 6073482 - DNA, 13 bp, Homo sapiens
cctcagcgctccc

SEQ ID NO: 6073483 - DNA, 14 bp, Homo sapiens
cctcagcgctccct

SEQ ID NO: 6073484 - DNA, 15 bp, Homo sapiens
cctcagcgctccctg

SEQ ID NO: 6073485 - DNA, 18 bp, Homo sapiens
cctcagcgctccctgtcg

SEQ ID NO: 6073486 - DNA, 19 bp, Homo sapiens
cctcagcgctccctgtcgc

SEQ ID NO: 6073487 - DNA, 14 bp, Homo sapiens
cctcagcgctgccc

SEQ ID NO: 6073488 - DNA, 21 bp, Homo sapiens
cctcagcgctgcccacaccac

SEQ ID NO: 6073489 - DNA, 22 bp, Homo sapiens
cctcagcgctgcccacaccacc

SEQ ID NO: 6073490 - DNA, 17 bp, Homo sapiens
cctcagcgtctccccat

SEQ ID NO: 6073491 - DNA, 17 bp, Homo sapiens
cctcagctcagctgggc

SEQ ID NO: 6073492 - DNA, 21 bp, Homo sapiens
cctcagctcagcttcgtgcct

SEQ ID NO: 6073493 - DNA, 12 bp, Homo sapiens
cccactctggtg

SEQ ID NO: 6073494 - DNA, 14 bp, Homo sapiens
cccactctggtggc

SEQ ID NO: 6073495 - DNA, 14 bp, Homo sapiens
cccactcttgaaga

SEQ ID NO: 6073496 - DNA, 21 bp, Homo sapiens
cccactgaattgacatgaccc

SEQ ID NO: 6073497 - DNA, 14 bp, Homo sapiens
cccactgaccagaa

SEQ ID NO: 6073498 - DNA, 17 bp, Homo sapiens
cccactgacctgcccat

SEQ ID NO: 6073499 - DNA, 18 bp, Homo sapiens
cccactgagagctgctcc

SEQ ID NO: 6073500 - DNA, 21 bp, Homo sapiens
cccactgagagctgctccttt

SEQ ID NO: 6073501 - DNA, 23 bp, Homo sapiens
cccactgagagctgctcctttgg

SEQ ID NO: 6073502 - DNA, 15 bp, Homo sapiens
cccactgagaggaca

SEQ ID NO: 6073503 - DNA, 14 bp, Homo sapiens
cccactgaggggcc

SEQ ID NO: 6073504 - DNA, 15 bp, Homo sapiens
cccactgaggggcca

SEQ ID NO: 6073505 - DNA, 15 bp, Homo sapiens
cccactgcaatcctg

SEQ ID NO: 6073506 - DNA, 18 bp, Homo sapiens
cccactgcaatcctgtct

SEQ ID NO: 6073507 - DNA, 20 bp, Homo sapiens
cccactgcaccccctcctgc

SEQ ID NO: 6073508 - DNA, 23 bp, Homo sapiens
cccactgcaccccctcctgctgc

SEQ ID NO: 6073509 - DNA, 16 bp, Homo sapiens
cccactgcaccgcctc

SEQ ID NO: 6073510 - DNA, 17 bp, Homo sapiens
cccactgcactccagcc

SEQ ID NO: 6073511 - DNA, 18 bp, Homo sapiens
cccactgccagatgctgc

SEQ ID NO: 6073512 - DNA, 16 bp, Homo sapiens
cccactgccagcagca

SEQ ID NO: 6073513 - DNA, 17 bp, Homo sapiens
cccactgccagcagcag

SEQ ID NO: 6073514 - DNA, 22 bp, Homo sapiens
cccactgccaggggttcttgag

SEQ ID NO: 6073515 - DNA, 19 bp, Homo sapiens
cccactgcccaccccctca

SEQ ID NO: 6073516 - DNA, 22 bp, Homo sapiens
cccactgcccaccccctcaagc

SEQ ID NO: 6073517 - DNA, 20 bp, Homo sapiens
cccactgccccgtgtgaatg

SEQ ID NO: 6073518 - DNA, 19 bp, Homo sapiens
cccactgcccctgcacctg

SEQ ID NO: 6073519 - DNA, 13 bp, Homo sapiens
cccactgcctcct

SEQ ID NO: 6073520 - DNA, 18 bp, Homo sapiens
cccactgcggggagacag

SEQ ID NO: 6073521 - DNA, 22 bp, Homo sapiens
cccactgctcgtggactgtgct

SEQ ID NO: 6073522 - DNA, 23 bp, Homo sapiens
cccactgctcgtggactgtgctg

SEQ ID NO: 6073523 - DNA, 13 bp, Homo sapiens
cccactgctctgg

SEQ ID NO: 6073524 - DNA, 12 bp, Homo sapiens
cccactgctggc

SEQ ID NO: 6073525 - DNA, 12 bp, Homo sapiens
cccactgctggt

SEQ ID NO: 6073526 - DNA, 15 bp, Homo sapiens
cccactgctggtgcc

SEQ ID NO: 6073527 - DNA, 23 bp, Homo sapiens
cccactgcttgcactgatgtccc

SEQ ID NO: 6073528 - DNA, 13 bp, Homo sapiens
cccactggaagat

SEQ ID NO: 6073529 - DNA, 11 bp, Homo sapiens
cccactggaca

SEQ ID NO: 6073530 - DNA, 23 bp, Homo sapiens
cccactggacaacactgattcct

SEQ ID NO: 6073531 - DNA, 15 bp, Homo sapiens
cccactggcagcatc

SEQ ID NO: 6073532 - DNA, 13 bp, Homo sapiens
cccactggccagt

SEQ ID NO: 6073533 - DNA, 17 bp, Homo sapiens
cccactggccagtccta

SEQ ID NO: 6073534 - DNA, 12 bp, Homo sapiens
cccactggccgc

SEQ ID NO: 6073535 - DNA, 14 bp, Homo sapiens
cccactggctcctc

SEQ ID NO: 6073536 - DNA, 21 bp, Homo sapiens
cccactggctcctcccagcac

SEQ ID NO: 6073537 - DNA, 24 bp, Homo sapiens
cccactggctcctcccagcacagg

SEQ ID NO: 6073538 - DNA, 14 bp, Homo sapiens
cccactggctgaga

SEQ ID NO: 6073539 - DNA, 21 bp, Homo sapiens
cccactggctgtgggctccct

SEQ ID NO: 6073540 - DNA, 18 bp, Homo sapiens
cccactgggactcccagc

SEQ ID NO: 6073541 - DNA, 21 bp, Homo sapiens
cccactgggagagtccttagc

SEQ ID NO: 6073542 - DNA, 22 bp, Homo sapiens
cccactgggagagtccttagcc

SEQ ID NO: 6073543 - DNA, 13 bp, Homo sapiens
cccactgggcaca

SEQ ID NO: 6073544 - DNA, 18 bp, Homo sapiens
cccactgggccagccctg

SEQ ID NO: 6073545 - DNA, 14 bp, Homo sapiens
cccactgggccctg

SEQ ID NO: 6073546 - DNA, 15 bp, Homo sapiens
cccactgggccctgg

SEQ ID NO: 6073547 - DNA, 17 bp, Homo sapiens
cccactgggccctgggg

SEQ ID NO: 6073548 - DNA, 21 bp, Homo sapiens
cccactggggtccagggagca

SEQ ID NO: 6073549 - DNA, 21 bp, Homo sapiens
cccactggttccttcttcctg

SEQ ID NO: 6073550 - DNA, 19 bp, Homo sapiens
cccactgtatctaggcaac

SEQ ID NO: 6073551 - DNA, 17 bp, Homo sapiens
cccactgtatgatttat

SEQ ID NO: 6073552 - DNA, 17 bp, Homo sapiens
cccactgtcaggcctct

SEQ ID NO: 6073553 - DNA, 15 bp, Homo sapiens
cccactgtcctgggc

SEQ ID NO: 6073554 - DNA, 16 bp, Homo sapiens
cccactgtcctgggcg

SEQ ID NO: 6073555 - DNA, 12 bp, Homo sapiens
cccactgtcctt

SEQ ID NO: 6073556 - DNA, 15 bp, Homo sapiens
cccactgtcctttct

SEQ ID NO: 6073557 - DNA, 16 bp, Homo sapiens
cccactgtgcaggtgc

SEQ ID NO: 6073558 - DNA, 16 bp, Homo sapiens
cccactgtgcctcaga

SEQ ID NO: 6073559 - DNA, 22 bp, Homo sapiens
cccactgtgcctcagagaccag

SEQ ID NO: 6073560 - DNA, 19 bp, Homo sapiens
cccactgtgcttacagtga

SEQ ID NO: 6073561 - DNA, 22 bp, Homo sapiens
cccactgtgcttacagtgactg

SEQ ID NO: 6073562 - DNA, 20 bp, Homo sapiens
cccactgttctgaaaggaga

SEQ ID NO: 6073563 - DNA, 23 bp, Homo sapiens
cccactgtttctcttgagctggc

SEQ ID NO: 6073564 - DNA, 14 bp, Homo sapiens
cccacttacattta

SEQ ID NO: 6073565 - DNA, 17 bp, Homo sapiens
cccacttagcagggaca

SEQ ID NO: 6073566 - DNA, 16 bp, Homo sapiens
cccacttagccgcacc

SEQ ID NO: 6073567 - DNA, 15 bp, Homo sapiens
cccacttatgctgct

SEQ ID NO: 6073568 - DNA, 17 bp, Homo sapiens
cccacttatgctgctgt

SEQ ID NO: 6073569 - DNA, 19 bp, Homo sapiens
cccacttcacagctggaga

SEQ ID NO: 6073570 - DNA, 14 bp, Homo sapiens
cccacttcaccccc

SEQ ID NO: 6073571 - DNA, 15 bp, Homo sapiens
cccacttcaccccca

SEQ ID NO: 6073572 - DNA, 19 bp, Homo sapiens
cccacttcagaaggtaggg

SEQ ID NO: 6073573 - DNA, 14 bp, Homo sapiens
cccacttcagccca

SEQ ID NO: 6073574 - DNA, 14 bp, Homo sapiens
cccacttccattgt

SEQ ID NO: 6073575 - DNA, 17 bp, Homo sapiens
cccacttcccaccctgc

SEQ ID NO: 6073576 - DNA, 15 bp, Homo sapiens
cccacttcccacttg

SEQ ID NO: 6073577 - DNA, 18 bp, Homo sapiens
cccacttccccatctgtg

SEQ ID NO: 6073578 - DNA, 13 bp, Homo sapiens
cccacttcccctc

SEQ ID NO: 6073579 - DNA, 14 bp, Homo sapiens
cccacttcccctcc

SEQ ID NO: 6073580 - DNA, 20 bp, Homo sapiens
cccacttccctgacactgcg

SEQ ID NO: 6073581 - DNA, 13 bp, Homo sapiens
cccacttcctcct

SEQ ID NO: 6073582 - DNA, 16 bp, Homo sapiens
cccacttcctcctacc

SEQ ID NO: 6073583 - DNA, 18 bp, Homo sapiens
cccacttcctcctacctg

SEQ ID NO: 6073584 - DNA, 20 bp, Homo sapiens
cccacttcctcctacctggg

SEQ ID NO: 6073585 - DNA, 23 bp, Homo sapiens
cccacttcctcctacctggggac

SEQ ID NO: 6073586 - DNA, 12 bp, Homo sapiens
cccacttctcaa

SEQ ID NO: 6073587 - DNA, 12 bp, Homo sapiens
cccacttctcat

SEQ ID NO: 6073588 - DNA, 20 bp, Homo sapiens
cccacttctctactctggaa

SEQ ID NO: 6073589 - DNA, 15 bp, Homo sapiens
cccacttctggccac

SEQ ID NO: 6073590 - DNA, 20 bp, Homo sapiens
cccacttctggcctccagcc

SEQ ID NO: 6073591 - DNA, 23 bp, Homo sapiens
cccacttctggcctccagccttt

SEQ ID NO: 6073592 - DNA, 12 bp, Homo sapiens
cccacttgacct

SEQ ID NO: 6073593 - DNA, 14 bp, Homo sapiens
cccacttgacctga

SEQ ID NO: 6073594 - DNA, 23 bp, Homo sapiens
cccacttgagaattacccttttg

SEQ ID NO: 6073595 - DNA, 15 bp, Homo sapiens
cccacttgaggctgg

SEQ ID NO: 6073596 - DNA, 18 bp, Homo sapiens
cccacttgattgagaaag

SEQ ID NO: 6073597 - DNA, 19 bp, Homo sapiens
cccacttgggagcttgtat

SEQ ID NO: 6073598 - DNA, 12 bp, Homo sapiens
cccacttggggc

SEQ ID NO: 6073599 - DNA, 14 bp, Homo sapiens
cccacttgtcctta

SEQ ID NO: 6073600 - DNA, 20 bp, Homo sapiens
cccactttcaagacagatga

SEQ ID NO: 6073601 - DNA, 18 bp, Homo sapiens
cccactttcatctacctt

SEQ ID NO: 6073602 - DNA, 14 bp, Homo sapiens
cccactttggggaa

SEQ ID NO: 6073603 - DNA, 12 bp, Homo sapiens
cccactttgtaa

SEQ ID NO: 6073604 - DNA, 22 bp, Homo sapiens
cccagaaaaaaagcccaacaca

SEQ ID NO: 6073605 - DNA, 14 bp, Homo sapiens
cccagaaaaactgg

SEQ ID NO: 6073606 - DNA, 23 bp, Homo sapiens
cccagaaaaactggctctgattg

SEQ ID NO: 6073607 - DNA, 20 bp, Homo sapiens
cccagaaaagaaagctacag

SEQ ID NO: 6073608 - DNA, 17 bp, Homo sapiens
cccagaaaaggacagaa

SEQ ID NO: 6073609 - DNA, 16 bp, Homo sapiens
cccagaaactgaacca

SEQ ID NO: 6073610 - DNA, 14 bp, Homo sapiens
cccagaaagcctca

SEQ ID NO: 6073611 - DNA, 15 bp, Homo sapiens
cccagaaagcctcct

SEQ ID NO: 6073612 - DNA, 17 bp, Homo sapiens
cccagaaagctgccaga

SEQ ID NO: 6073613 - DNA, 21 bp, Homo sapiens
cccagaaagctgcggattggg

SEQ ID NO: 6073614 - DNA, 22 bp, Homo sapiens
cccagaaagtgataagtgcagg

SEQ ID NO: 6073615 - DNA, 18 bp, Homo sapiens
cccagaaagtgggggtgg

SEQ ID NO: 6073616 - DNA, 13 bp, Homo sapiens
cccagaaatcact

SEQ ID NO: 6073617 - DNA, 20 bp, Homo sapiens
cccagaaatgccgctgtgtc

SEQ ID NO: 6073618 - DNA, 20 bp, Homo sapiens
cccagaaattctggcccagc

SEQ ID NO: 6073619 - DNA, 21 bp, Homo sapiens
cccagaaattctggcccagcc

SEQ ID NO: 6073620 - DNA, 14 bp, Homo sapiens
cccagaacacactc

SEQ ID NO: 6073621 - DNA, 18 bp, Homo sapiens
cccagaacacactccatc

SEQ ID NO: 6073622 - DNA, 18 bp, Homo sapiens
cccagaacatgaagaaga

SEQ ID NO: 6073623 - DNA, 17 bp, Homo sapiens
cccagaaccccaactcc

SEQ ID NO: 6073624 - DNA, 21 bp, Homo sapiens
cccagaaccccaactcccagc

SEQ ID NO: 6073625 - DNA, 14 bp, Homo sapiens
cccagaacctgtcc

SEQ ID NO: 6073626 - DNA, 16 bp, Homo sapiens
cccagaacgggcctcc

SEQ ID NO: 6073627 - DNA, 20 bp, Homo sapiens
cccagaacgggcctccccgg

SEQ ID NO: 6073628 - DNA, 14 bp, Homo sapiens
cccagaactgcccc

SEQ ID NO: 6073629 - DNA, 18 bp, Homo sapiens
cccagaactgcccccact

SEQ ID NO: 6073630 - DNA, 19 bp, Homo sapiens
cccagaactggactcagga

SEQ ID NO: 6073631 - DNA, 18 bp, Homo sapiens
cccagaactggctgggcc

SEQ ID NO: 6073632 - DNA, 21 bp, Homo sapiens
cccagaactggctgggcccct

SEQ ID NO: 6073633 - DNA, 18 bp, Homo sapiens
cccagaacttcaagatga

SEQ ID NO: 6073634 - DNA, 20 bp, Homo sapiens
cccagaactttgggaggcca

SEQ ID NO: 6073635 - DNA, 15 bp, Homo sapiens
cccagaagattagca

SEQ ID NO: 6073636 - DNA, 23 bp, Homo sapiens
cccagaaggaacccggtcccagg

SEQ ID NO: 6073637 - DNA, 13 bp, Homo sapiens
cccagaaggcagg

SEQ ID NO: 6073638 - DNA, 23 bp, Homo sapiens
cccagaaggcagggaaaggctct

SEQ ID NO: 6073639 - DNA, 22 bp, Homo sapiens
cccagaaggcatatcagtctct

SEQ ID NO: 6073640 - DNA, 14 bp, Homo sapiens
cccagaaggccaga

SEQ ID NO: 6073641 - DNA, 15 bp, Homo sapiens
cccagaaggccagaa

SEQ ID NO: 6073642 - DNA, 20 bp, Homo sapiens
cccagaagtccacaggacgc

SEQ ID NO: 6073643 - DNA, 14 bp, Homo sapiens
cccagaagtgcaga

SEQ ID NO: 6073644 - DNA, 24 bp, Homo sapiens
cccagaataaactggcagctcagc

SEQ ID NO: 6073645 - DNA, 14 bp, Homo sapiens
cccagaatactgat

SEQ ID NO: 6073646 - DNA, 12 bp, Homo sapiens
cccagaatccca

SEQ ID NO: 6073647 - DNA, 14 bp, Homo sapiens
cccagaatcccagc

SEQ ID NO: 6073648 - DNA, 21 bp, Homo sapiens
cccagaatccccaagtgcctg

SEQ ID NO: 6073649 - DNA, 22 bp, Homo sapiens
cccagaatccccaagtgcctgc

SEQ ID NO: 6073650 - DNA, 15 bp, Homo sapiens
cccagaatctctgag

SEQ ID NO: 6073651 - DNA, 16 bp, Homo sapiens
cccagaatggaaaaaa

SEQ ID NO: 6073652 - DNA, 23 bp, Homo sapiens
cccagaatggaaaaaaaaatcag

SEQ ID NO: 6073653 - DNA, 18 bp, Homo sapiens
cccagaatggagcctgct

SEQ ID NO: 6073654 - DNA, 21 bp, Homo sapiens
cccagaatgtcagattccttt

SEQ ID NO: 6073655 - DNA, 17 bp, Homo sapiens
cccagaattcccagctg

SEQ ID NO: 6073656 - DNA, 21 bp, Homo sapiens
cccagaattcccagctgtctg

SEQ ID NO: 6073657 - DNA, 14 bp, Homo sapiens
cccagaattttctg

SEQ ID NO: 6073658 - DNA, 18 bp, Homo sapiens
cccagacaacagcccagg

SEQ ID NO: 6073659 - DNA, 16 bp, Homo sapiens
cccagacaaccaaaac

SEQ ID NO: 6073660 - DNA, 19 bp, Homo sapiens
cccagacaaccaaaacata

SEQ ID NO: 6073661 - DNA, 23 bp, Homo sapiens
cccagacaacgggcccatggcct

SEQ ID NO: 6073662 - DNA, 18 bp, Homo sapiens
cccagacacagactggca

SEQ ID NO: 6073663 - DNA, 11 bp, Homo sapiens
cccagacacat

SEQ ID NO: 6073664 - DNA, 20 bp, Homo sapiens
cccagacacatcgcactgtg

SEQ ID NO: 6073665 - DNA, 16 bp, Homo sapiens
cccagacaccacagac

SEQ ID NO: 6073666 - DNA, 15 bp, Homo sapiens
cccagacaccatgtg

SEQ ID NO: 6073667 - DNA, 17 bp, Homo sapiens
cccagacaccatgtgca

SEQ ID NO: 6073668 - DNA, 21 bp, Homo sapiens
cccagacaccatgtgcaataa

SEQ ID NO: 6073669 - DNA, 16 bp, Homo sapiens
cccagacactggtttg

SEQ ID NO: 6073670 - DNA, 19 bp, Homo sapiens
cccagacagacatctctgc

SEQ ID NO: 6073671 - DNA, 23 bp, Homo sapiens
cccagacagacatctctgcaccc

SEQ ID NO: 6073672 - DNA, 22 bp, Homo sapiens
cctcagctcagcttcgtgcctg

SEQ ID NO: 6073673 - DNA, 14 bp, Homo sapiens
cctcagctcccaca

SEQ ID NO: 6073674 - DNA, 15 bp, Homo sapiens
cctcagctcccacaa

SEQ ID NO: 6073675 - DNA, 12 bp, Homo sapiens
cctcagctccct

SEQ ID NO: 6073676 - DNA, 17 bp, Homo sapiens
cctcagctccctgcctg

SEQ ID NO: 6073677 - DNA, 19 bp, Homo sapiens
cctcagctccctgcctgtt

SEQ ID NO: 6073678 - DNA, 22 bp, Homo sapiens
cctcagctccctgcctgtttcc

SEQ ID NO: 6073679 - DNA, 17 bp, Homo sapiens
cctcagctcggctcagc

SEQ ID NO: 6073680 - DNA, 19 bp, Homo sapiens
cctcagctcggctcagctc

SEQ ID NO: 6073681 - DNA, 16 bp, Homo sapiens
cctcagctctaggctg

SEQ ID NO: 6073682 - DNA, 14 bp, Homo sapiens
cctcagctctccct

SEQ ID NO: 6073683 - DNA, 18 bp, Homo sapiens
cctcagctctccctcaca

SEQ ID NO: 6073684 - DNA, 15 bp, Homo sapiens
cctcagctctgggag

SEQ ID NO: 6073685 - DNA, 18 bp, Homo sapiens
cctcagctctgggagagg

SEQ ID NO: 6073686 - DNA, 16 bp, Homo sapiens
cctcagctctgtcctg

SEQ ID NO: 6073687 - DNA, 21 bp, Homo sapiens
cctcagctcttggtgggccca

SEQ ID NO: 6073688 - DNA, 22 bp, Homo sapiens
cctcagctcttggtgggcccag

SEQ ID NO: 6073689 - DNA, 13 bp, Homo sapiens
cctcagctgcaca

SEQ ID NO: 6073690 - DNA, 19 bp, Homo sapiens
cctcagctgcatggagcct

SEQ ID NO: 6073691 - DNA, 15 bp, Homo sapiens
cctcagctgccaagc

SEQ ID NO: 6073692 - DNA, 17 bp, Homo sapiens
cctcagctgccaagcac

SEQ ID NO: 6073693 - DNA, 14 bp, Homo sapiens
cctcagctgcctca

SEQ ID NO: 6073694 - DNA, 15 bp, Homo sapiens
cctcagctgcctcac

SEQ ID NO: 6073695 - DNA, 21 bp, Homo sapiens
cctcagctggcggaacctggc

SEQ ID NO: 6073696 - DNA, 14 bp, Homo sapiens
cctcagctggctgt

SEQ ID NO: 6073697 - DNA, 16 bp, Homo sapiens
cctcagctggctgtat

SEQ ID NO: 6073698 - DNA, 17 bp, Homo sapiens
cctcagctggctgtatg

SEQ ID NO: 6073699 - DNA, 18 bp, Homo sapiens
cctcagctggtcctgacc

SEQ ID NO: 6073700 - DNA, 20 bp, Homo sapiens
cctcagctggttactcaggg

SEQ ID NO: 6073701 - DNA, 23 bp, Homo sapiens
cctcagctggttactcagggttc

SEQ ID NO: 6073702 - DNA, 15 bp, Homo sapiens
cctcagctgtacaaa

SEQ ID NO: 6073703 - DNA, 13 bp, Homo sapiens
cctcagctgtcgg

SEQ ID NO: 6073704 - DNA, 17 bp, Homo sapiens
cctcagctgtcgggggc

SEQ ID NO: 6073705 - DNA, 12 bp, Homo sapiens
cctcagcttccc

SEQ ID NO: 6073706 - DNA, 21 bp, Homo sapiens
cctcagcttcccaagtagctg

SEQ ID NO: 6073707 - DNA, 17 bp, Homo sapiens
cctcagcttcccacgga

SEQ ID NO: 6073708 - DNA, 14 bp, Homo sapiens
cctcagcttggcac

SEQ ID NO: 6073709 - DNA, 22 bp, Homo sapiens
cctcagcttgggcttcttcctc

SEQ ID NO: 6073710 - DNA, 16 bp, Homo sapiens
cctcaggaaagaatag

SEQ ID NO: 6073711 - DNA, 19 bp, Homo sapiens
cctcaggaaagaatagaaa

SEQ ID NO: 6073712 - DNA, 10 bp, Homo sapiens
cctcaggaat

SEQ ID NO: 6073713 - DNA, 17 bp, Homo sapiens
cctcaggaatgggctgt

SEQ ID NO: 6073714 - DNA, 15 bp, Homo sapiens
cctcaggaccccaga

SEQ ID NO: 6073715 - DNA, 19 bp, Homo sapiens
cctcaggaccctcagccct

SEQ ID NO: 6073716 - DNA, 14 bp, Homo sapiens
cctcaggactggga

SEQ ID NO: 6073717 - DNA, 15 bp, Homo sapiens
cctcaggactgggag

SEQ ID NO: 6073718 - DNA, 15 bp, Homo sapiens
cctcaggagaagggg

SEQ ID NO: 6073719 - DNA, 13 bp, Homo sapiens
cctcaggaggcag

SEQ ID NO: 6073720 - DNA, 20 bp, Homo sapiens
cctcaggcaaggtctggcct

SEQ ID NO: 6073721 - DNA, 11 bp, Homo sapiens
cctcaggcaca

SEQ ID NO: 6073722 - DNA, 20 bp, Homo sapiens
cctcaggcacacagctactc

SEQ ID NO: 6073723 - DNA, 14 bp, Homo sapiens
cctcaggcacacct

SEQ ID NO: 6073724 - DNA, 18 bp, Homo sapiens
cctcaggcacaccttgca

SEQ ID NO: 6073725 - DNA, 19 bp, Homo sapiens
cctcaggcactagcctttg

SEQ ID NO: 6073726 - DNA, 22 bp, Homo sapiens
cctcaggcagaggatgttctgg

SEQ ID NO: 6073727 - DNA, 13 bp, Homo sapiens
cctcaggcaggaa

SEQ ID NO: 6073728 - DNA, 19 bp, Homo sapiens
cctcaggcaggaagggcag

SEQ ID NO: 6073729 - DNA, 15 bp, Homo sapiens
cctcaggccaaggga

SEQ ID NO: 6073730 - DNA, 14 bp, Homo sapiens
cctcaggccaccct

SEQ ID NO: 6073731 - DNA, 20 bp, Homo sapiens
cctcaggccaccctccacga

SEQ ID NO: 6073732 - DNA, 15 bp, Homo sapiens
cctcaggccagggct

SEQ ID NO: 6073733 - DNA, 16 bp, Homo sapiens
cctcaggccagggctc

SEQ ID NO: 6073734 - DNA, 22 bp, Homo sapiens
cctcaggccagggctcaccagc

SEQ ID NO: 6073735 - DNA, 21 bp, Homo sapiens
cctcaggccaggtgcagtggc

SEQ ID NO: 6073736 - DNA, 15 bp, Homo sapiens
cctcaggccattccc

SEQ ID NO: 6073737 - DNA, 17 bp, Homo sapiens
cctcaggccattcccca

SEQ ID NO: 6073738 - DNA, 21 bp, Homo sapiens
cctcaggccattccccaacgg

SEQ ID NO: 6073739 - DNA, 14 bp, Homo sapiens
cctcaggcctctgt

SEQ ID NO: 6073740 - DNA, 15 bp, Homo sapiens
cctcaggcctggccc

SEQ ID NO: 6073741 - DNA, 20 bp, Homo sapiens
cctcaggcctggccctttca

SEQ ID NO: 6073742 - DNA, 14 bp, Homo sapiens
cctcaggcctgggg

SEQ ID NO: 6073743 - DNA, 20 bp, Homo sapiens
cctcaggcggggaggaggag

SEQ ID NO: 6073744 - DNA, 24 bp, Homo sapiens
cctcaggcggggaggaggagctgc

SEQ ID NO: 6073745 - DNA, 22 bp, Homo sapiens
cctcaggctccccagtgctcct

SEQ ID NO: 6073746 - DNA, 12 bp, Homo sapiens
cctcaggctccg

SEQ ID NO: 6073747 - DNA, 21 bp, Homo sapiens
cctcaggctcctaaagagaca

SEQ ID NO: 6073748 - DNA, 14 bp, Homo sapiens
cctcaggctctgca

SEQ ID NO: 6073749 - DNA, 19 bp, Homo sapiens
cctcaggctctgcacagac

SEQ ID NO: 6073750 - DNA, 18 bp, Homo sapiens
cctcaggctctgtggagg

SEQ ID NO: 6073751 - DNA, 18 bp, Homo sapiens
cctcaggctgctggagga

SEQ ID NO: 6073752 - DNA, 18 bp, Homo sapiens
cctcaggcttgagggagg

SEQ ID NO: 6073753 - DNA, 21 bp, Homo sapiens
cctcaggcttggggatgccct

SEQ ID NO: 6073754 - DNA, 17 bp, Homo sapiens
cctcagggaccaaggag

SEQ ID NO: 6073755 - DNA, 15 bp, Homo sapiens
cctcagggactcagg

SEQ ID NO: 6073756 - DNA, 20 bp, Homo sapiens
cctcagggagcagggaaggc

SEQ ID NO: 6073757 - DNA, 17 bp, Homo sapiens
cctcagggatgtgggaa

SEQ ID NO: 6073758 - DNA, 14 bp, Homo sapiens
cctcagggcaaagc

SEQ ID NO: 6073759 - DNA, 15 bp, Homo sapiens
cctcagggcaaagcc

SEQ ID NO: 6073760 - DNA, 21 bp, Homo sapiens
cctcagggcaaagccaggtcc

SEQ ID NO: 6073761 - DNA, 17 bp, Homo sapiens
cctcagggccaggaagg

SEQ ID NO: 6073762 - DNA, 18 bp, Homo sapiens
cctcagggccaggaagga

SEQ ID NO: 6073763 - DNA, 12 bp, Homo sapiens
cctcagggccca

SEQ ID NO: 6073764 - DNA, 13 bp, Homo sapiens
cctcagggcccag

SEQ ID NO: 6073765 - DNA, 16 bp, Homo sapiens
cctcagggcccctggg

SEQ ID NO: 6073766 - DNA, 19 bp, Homo sapiens
cctcagggctcagtctttt

SEQ ID NO: 6073767 - DNA, 14 bp, Homo sapiens
cctcagggctccca

SEQ ID NO: 6073768 - DNA, 15 bp, Homo sapiens
cctcagggctcccag

SEQ ID NO: 6073769 - DNA, 17 bp, Homo sapiens
cctcagggctcccaggg

SEQ ID NO: 6073770 - DNA, 16 bp, Homo sapiens
cctcagggctccttgt

SEQ ID NO: 6073771 - DNA, 18 bp, Homo sapiens
cctcagggctgtcccagc

SEQ ID NO: 6073772 - DNA, 20 bp, Homo sapiens
cctcaggggaagctgctagg

SEQ ID NO: 6073773 - DNA, 11 bp, Homo sapiens
cctcaggggca

SEQ ID NO: 6073774 - DNA, 13 bp, Homo sapiens
cctcaggggcacc

SEQ ID NO: 6073775 - DNA, 16 bp, Homo sapiens
cctcaggggcacctcc

SEQ ID NO: 6073776 - DNA, 14 bp, Homo sapiens
cctcaggggcaggt

SEQ ID NO: 6073777 - DNA, 16 bp, Homo sapiens
cctcaggggcaggtgg

SEQ ID NO: 6073778 - DNA, 15 bp, Homo sapiens
cctcagggggccagc

SEQ ID NO: 6073779 - DNA, 22 bp, Homo sapiens
cctcagggggccagctggggag

SEQ ID NO: 6073780 - DNA, 23 bp, Homo sapiens
cctcagggggccagctggggaga

SEQ ID NO: 6073781 - DNA, 23 bp, Homo sapiens
cctcagggggtaggagagcactg

SEQ ID NO: 6073782 - DNA, 13 bp, Homo sapiens
cctcaggggtctg

SEQ ID NO: 6073783 - DNA, 22 bp, Homo sapiens
cctcaggggtctgagctccagc

SEQ ID NO: 6073784 - DNA, 23 bp, Homo sapiens
cctcaggggtctgagctccagct

SEQ ID NO: 6073785 - DNA, 18 bp, Homo sapiens
cctcagggtccctcagga

SEQ ID NO: 6073786 - DNA, 16 bp, Homo sapiens
cctcagggtccctggt

SEQ ID NO: 6073787 - DNA, 13 bp, Homo sapiens
cctcaggtcagct

SEQ ID NO: 6073788 - DNA, 21 bp, Homo sapiens
cctcaggtcagctcactgagc

SEQ ID NO: 6073789 - DNA, 14 bp, Homo sapiens
cctcaggtcagctg

SEQ ID NO: 6073790 - DNA, 16 bp, Homo sapiens
cctcaggtcagctggg

SEQ ID NO: 6073791 - DNA, 19 bp, Homo sapiens
cctcaggtcagctgggagc

SEQ ID NO: 6073792 - DNA, 20 bp, Homo sapiens
cctcaggtcctactggggaa

SEQ ID NO: 6073793 - DNA, 15 bp, Homo sapiens
cctcaggtgactttt

SEQ ID NO: 6073794 - DNA, 18 bp, Homo sapiens
cctcaggtgagaagcaga

SEQ ID NO: 6073795 - DNA, 14 bp, Homo sapiens
cctcaggtgcctcc

SEQ ID NO: 6073796 - DNA, 16 bp, Homo sapiens
cctcaggtgctgtcca

SEQ ID NO: 6073797 - DNA, 21 bp, Homo sapiens
cctcaggtggccatgcctcag

SEQ ID NO: 6073798 - DNA, 18 bp, Homo sapiens
cctcaggtgggccgcagg

SEQ ID NO: 6073799 - DNA, 15 bp, Homo sapiens
cctcaggtgtagctg

SEQ ID NO: 6073800 - DNA, 24 bp, Homo sapiens
cctcaggtgttttttatgaagtgc

SEQ ID NO: 6073801 - DNA, 22 bp, Homo sapiens
cctcaggttcctaagacttcag

SEQ ID NO: 6073802 - DNA, 18 bp, Homo sapiens
cctcaggttctattttct

SEQ ID NO: 6073803 - DNA, 20 bp, Homo sapiens
cctcaggttctattttctta

SEQ ID NO: 6073804 - DNA, 17 bp, Homo sapiens
cctcaggttgctggttg

SEQ ID NO: 6073805 - DNA, 18 bp, Homo sapiens
cctcaggttgctggttgc

SEQ ID NO: 6073806 - DNA, 19 bp, Homo sapiens
cctcagtaaaagtcttctc

SEQ ID NO: 6073807 - DNA, 23 bp, Homo sapiens
cctcagtaaaagtcttctcccaa

SEQ ID NO: 6073808 - DNA, 17 bp, Homo sapiens
cctcagtaacatttctg

SEQ ID NO: 6073809 - DNA, 15 bp, Homo sapiens
cctcagtaagacgac

SEQ ID NO: 6073810 - DNA, 21 bp, Homo sapiens
cctcagtaagtatctggagga

SEQ ID NO: 6073811 - DNA, 18 bp, Homo sapiens
cctcagtactattcctta

SEQ ID NO: 6073812 - DNA, 15 bp, Homo sapiens
cctcagtagtccctg

SEQ ID NO: 6073813 - DNA, 19 bp, Homo sapiens
cctcagtcacccccacttc

SEQ ID NO: 6073814 - DNA, 22 bp, Homo sapiens
cctcagtcagttcccggagcac

SEQ ID NO: 6073815 - DNA, 18 bp, Homo sapiens
cctcagtccatttatata

SEQ ID NO: 6073816 - DNA, 20 bp, Homo sapiens
cctcagtccatttatatatg

SEQ ID NO: 6073817 - DNA, 22 bp, Homo sapiens
cctcagtcccaaatccttccca

SEQ ID NO: 6073818 - DNA, 23 bp, Homo sapiens
cctcagtccctccctcctggctc

SEQ ID NO: 6073819 - DNA, 15 bp, Homo sapiens
cctcagtccctcttc

SEQ ID NO: 6073820 - DNA, 16 bp, Homo sapiens
cctcagtccctcttct

SEQ ID NO: 6073821 - DNA, 16 bp, Homo sapiens
cctcagtcctcccctc

SEQ ID NO: 6073822 - DNA, 18 bp, Homo sapiens
cctcagtcctcccctcac

SEQ ID NO: 6073823 - DNA, 22 bp, Homo sapiens
cctcagtcctcccctcacagcc

SEQ ID NO: 6073824 - DNA, 14 bp, Homo sapiens
cctcagtcctggaa

SEQ ID NO: 6073825 - DNA, 15 bp, Homo sapiens
cctcagtcctggaag

SEQ ID NO: 6073826 - DNA, 16 bp, Homo sapiens
cctcagtcggggcagg

SEQ ID NO: 6073827 - DNA, 18 bp, Homo sapiens
cctcagtcggggcaggcc

SEQ ID NO: 6073828 - DNA, 15 bp, Homo sapiens
cctcagtctggccct

SEQ ID NO: 6073829 - DNA, 20 bp, Homo sapiens
cctcagtctggcccttcctt

SEQ ID NO: 6073830 - DNA, 20 bp, Homo sapiens
cctcagtgaccctggctcct

SEQ ID NO: 6073831 - DNA, 21 bp, Homo sapiens
cctcagtgaccctggctcctt

SEQ ID NO: 6073832 - DNA, 23 bp, Homo sapiens
cctcagtgagatcagtcagctcc

SEQ ID NO: 6073833 - DNA, 22 bp, Homo sapiens
cctcagtgatggaatatcatga

SEQ ID NO: 6073834 - DNA, 20 bp, Homo sapiens
cctcagtgcaaaatgtcttg

SEQ ID NO: 6073835 - DNA, 21 bp, Homo sapiens
cctcagtgcaaaatgtcttgt

SEQ ID NO: 6073836 - DNA, 23 bp, Homo sapiens
cctcagtgcaaaatgtcttgtgt

SEQ ID NO: 6073837 - DNA, 23 bp, Homo sapiens
cctcagtgcagccccctcctgac

SEQ ID NO: 6073838 - DNA, 11 bp, Homo sapiens
cctcagtgcca

SEQ ID NO: 6073839 - DNA, 14 bp, Homo sapiens
cctcagtgccactt

SEQ ID NO: 6073840 - DNA, 22 bp, Homo sapiens
cctcagtgccacttgacattcc

SEQ ID NO: 6073841 - DNA, 13 bp, Homo sapiens
cctcagtgctcct

SEQ ID NO: 6073842 - DNA, 18 bp, Homo sapiens
cctcagtgctcctggaaa

SEQ ID NO: 6073843 - DNA, 12 bp, Homo sapiens
cctcagtgctcg

SEQ ID NO: 6073844 - DNA, 16 bp, Homo sapiens
cctcagtgctcggcag

SEQ ID NO: 6073845 - DNA, 13 bp, Homo sapiens
cctcagtgctgca

SEQ ID NO: 6073846 - DNA, 15 bp, Homo sapiens
cctcagtgctgcaat

SEQ ID NO: 6073847 - DNA, 18 bp, Homo sapiens
cctcagtggatcttcaga

SEQ ID NO: 6073848 - DNA, 14 bp, Homo sapiens
cctcagtggcagca

SEQ ID NO: 6073849 - DNA, 19 bp, Homo sapiens
cctcagtggctctgggtac

SEQ ID NO: 6073850 - DNA, 21 bp, Homo sapiens
cctcagtgggctccctggccc

SEQ ID NO: 6073851 - DNA, 13 bp, Homo sapiens
cccagacagagcc

SEQ ID NO: 6073852 - DNA, 12 bp, Homo sapiens
cccagacagctc

SEQ ID NO: 6073853 - DNA, 13 bp, Homo sapiens
cccagacagctcc

SEQ ID NO: 6073854 - DNA, 14 bp, Homo sapiens
cccagacagctccc

SEQ ID NO: 6073855 - DNA, 16 bp, Homo sapiens
cccagacagctccctc

SEQ ID NO: 6073856 - DNA, 13 bp, Homo sapiens
cccagacagctgg

SEQ ID NO: 6073857 - DNA, 16 bp, Homo sapiens
cccagacagggctcca

SEQ ID NO: 6073858 - DNA, 20 bp, Homo sapiens
cccagacagggctccagcct

SEQ ID NO: 6073859 - DNA, 23 bp, Homo sapiens
cccagacagggctccagcctgtc

SEQ ID NO: 6073860 - DNA, 22 bp, Homo sapiens
cccagacagtggatatgaccca

SEQ ID NO: 6073861 - DNA, 21 bp, Homo sapiens
cccagacatgctgcccacccc

SEQ ID NO: 6073862 - DNA, 23 bp, Homo sapiens
cccagacatgctgcccaccccct

SEQ ID NO: 6073863 - DNA, 24 bp, Homo sapiens
cccagaccaggaaaggcttggctg

SEQ ID NO: 6073864 - DNA, 14 bp, Homo sapiens
cccagaccatggga

SEQ ID NO: 6073865 - DNA, 23 bp, Homo sapiens
cccagacccaacccatgcccctg

SEQ ID NO: 6073866 - DNA, 12 bp, Homo sapiens
cccagacccaga

SEQ ID NO: 6073867 - DNA, 23 bp, Homo sapiens
cccagacccagcccagcctgagc

SEQ ID NO: 6073868 - DNA, 17 bp, Homo sapiens
cccagacccatgtgctg

SEQ ID NO: 6073869 - DNA, 18 bp, Homo sapiens
cccagacccatgtgctgg

SEQ ID NO: 6073870 - DNA, 18 bp, Homo sapiens
cccagacccctctggcca

SEQ ID NO: 6073871 - DNA, 19 bp, Homo sapiens
cccagacccctctggccag

SEQ ID NO: 6073872 - DNA, 12 bp, Homo sapiens
cccagaccctcc

SEQ ID NO: 6073873 - DNA, 14 bp, Homo sapiens
cccagaccctgggc

SEQ ID NO: 6073874 - DNA, 15 bp, Homo sapiens
cccagaccctgggca

SEQ ID NO: 6073875 - DNA, 14 bp, Homo sapiens
cccagacctctgaa

SEQ ID NO: 6073876 - DNA, 22 bp, Homo sapiens
cccagacctgaatgcttctgag

SEQ ID NO: 6073877 - DNA, 18 bp, Homo sapiens
cccagacctgcctcttcc

SEQ ID NO: 6073878 - DNA, 14 bp, Homo sapiens
cccagacctgcctg

SEQ ID NO: 6073879 - DNA, 11 bp, Homo sapiens
cccagacctgg

SEQ ID NO: 6073880 - DNA, 19 bp, Homo sapiens
cccagacctggcctctgcc

SEQ ID NO: 6073881 - DNA, 19 bp, Homo sapiens
cccagacctgtcgtctctc

SEQ ID NO: 6073882 - DNA, 21 bp, Homo sapiens
cccagacctgttagcagacag

SEQ ID NO: 6073883 - DNA, 21 bp, Homo sapiens
cccagacggctccactaggac

SEQ ID NO: 6073884 - DNA, 20 bp, Homo sapiens
cccagacgtggtgcttctca

SEQ ID NO: 6073885 - DNA, 13 bp, Homo sapiens
cccagactacagg

SEQ ID NO: 6073886 - DNA, 18 bp, Homo sapiens
cccagactactattttct

SEQ ID NO: 6073887 - DNA, 23 bp, Homo sapiens
cccagactagatgtagtattttt

SEQ ID NO: 6073888 - DNA, 16 bp, Homo sapiens
cccagactcagacatt

SEQ ID NO: 6073889 - DNA, 15 bp, Homo sapiens
cccagactccaggcc

SEQ ID NO: 6073890 - DNA, 16 bp, Homo sapiens
cccagactccaggccc

SEQ ID NO: 6073891 - DNA, 17 bp, Homo sapiens
cccagactccaggcccc

SEQ ID NO: 6073892 - DNA, 15 bp, Homo sapiens
cccagactctgagct

SEQ ID NO: 6073893 - DNA, 17 bp, Homo sapiens
cccagactgagctctcc

SEQ ID NO: 6073894 - DNA, 15 bp, Homo sapiens
cccagactgatgagc

SEQ ID NO: 6073895 - DNA, 18 bp, Homo sapiens
cccagactggagtgcagt

SEQ ID NO: 6073896 - DNA, 15 bp, Homo sapiens
cccagactgggccca

SEQ ID NO: 6073897 - DNA, 19 bp, Homo sapiens
cccagactgggcccaggca

SEQ ID NO: 6073898 - DNA, 20 bp, Homo sapiens
cccagactgtagagattttt

SEQ ID NO: 6073899 - DNA, 18 bp, Homo sapiens
cccagacttctctttctt

SEQ ID NO: 6073900 - DNA, 22 bp, Homo sapiens
cccagacttctctttcttattt

SEQ ID NO: 6073901 - DNA, 16 bp, Homo sapiens
cccagacttgtttcct

SEQ ID NO: 6073902 - DNA, 17 bp, Homo sapiens
cccagacttgtttcctg

SEQ ID NO: 6073903 - DNA, 19 bp, Homo sapiens
cccagactttagtgccctg

SEQ ID NO: 6073904 - DNA, 21 bp, Homo sapiens
cccagagaaagcgcagatgct

SEQ ID NO: 6073905 - DNA, 13 bp, Homo sapiens
cccagagaacaat

SEQ ID NO: 6073906 - DNA, 13 bp, Homo sapiens
cccagagaacagc

SEQ ID NO: 6073907 - DNA, 13 bp, Homo sapiens
cccagagaagcca

SEQ ID NO: 6073908 - DNA, 16 bp, Homo sapiens
cccagagaagcccctt

SEQ ID NO: 6073909 - DNA, 22 bp, Homo sapiens
cccagagaagccccttccccat

SEQ ID NO: 6073910 - DNA, 15 bp, Homo sapiens
cccagagaagcctca

SEQ ID NO: 6073911 - DNA, 22 bp, Homo sapiens
cccagagaagctggaagcctgc

SEQ ID NO: 6073912 - DNA, 22 bp, Homo sapiens
cccagagaaggacggtgccaag

SEQ ID NO: 6073913 - DNA, 20 bp, Homo sapiens
cccagagaatcagggcaggc

SEQ ID NO: 6073914 - DNA, 17 bp, Homo sapiens
cccagagacaggaaaat

SEQ ID NO: 6073915 - DNA, 21 bp, Homo sapiens
cccagagacatacttgaaggg

SEQ ID NO: 6073916 - DNA, 12 bp, Homo sapiens
cccagagacccg

SEQ ID NO: 6073917 - DNA, 23 bp, Homo sapiens
cccagagacctgacccaacaccc

SEQ ID NO: 6073918 - DNA, 12 bp, Homo sapiens
cccagagacctt

SEQ ID NO: 6073919 - DNA, 21 bp, Homo sapiens
cccagagacggagtgtgggag

SEQ ID NO: 6073920 - DNA, 17 bp, Homo sapiens
cccagagactgcccacc

SEQ ID NO: 6073921 - DNA, 22 bp, Homo sapiens
cccagagactgcccaccctggg

SEQ ID NO: 6073922 - DNA, 19 bp, Homo sapiens
cccagagactttgtagatc

SEQ ID NO: 6073923 - DNA, 14 bp, Homo sapiens
cccagagagaaaaa

SEQ ID NO: 6073924 - DNA, 15 bp, Homo sapiens
cccagagagaaaaag

SEQ ID NO: 6073925 - DNA, 17 bp, Homo sapiens
cccagagagaaaaagag

SEQ ID NO: 6073926 - DNA, 22 bp, Homo sapiens
cccagagagaaaaagagagagc

SEQ ID NO: 6073927 - DNA, 21 bp, Homo sapiens
cccagagagaagagccccact

SEQ ID NO: 6073928 - DNA, 22 bp, Homo sapiens
cccagagagaagagccccactc

SEQ ID NO: 6073929 - DNA, 16 bp, Homo sapiens
cccagagagaccctgc

SEQ ID NO: 6073930 - DNA, 19 bp, Homo sapiens
cccagagagaccctgccaa

SEQ ID NO: 6073931 - DNA, 16 bp, Homo sapiens
cccagagagaggaggg

SEQ ID NO: 6073932 - DNA, 14 bp, Homo sapiens
cccagagagaggat

SEQ ID NO: 6073933 - DNA, 23 bp, Homo sapiens
cccagagagaggcgtcctggtga

SEQ ID NO: 6073934 - DNA, 20 bp, Homo sapiens
cccagagagaggggcctgca

SEQ ID NO: 6073935 - DNA, 22 bp, Homo sapiens
cccagagagaggggcctgcagg

SEQ ID NO: 6073936 - DNA, 12 bp, Homo sapiens
cccagagagcag

SEQ ID NO: 6073937 - DNA, 15 bp, Homo sapiens
cccagagagcaggca

SEQ ID NO: 6073938 - DNA, 17 bp, Homo sapiens
cccagagagcaggcagg

SEQ ID NO: 6073939 - DNA, 19 bp, Homo sapiens
cccagagagcaggcagggg

SEQ ID NO: 6073940 - DNA, 13 bp, Homo sapiens
cccagagagcccg

SEQ ID NO: 6073941 - DNA, 12 bp, Homo sapiens
cccagagaggca

SEQ ID NO: 6073942 - DNA, 13 bp, Homo sapiens
cccagagaggcac

SEQ ID NO: 6073943 - DNA, 19 bp, Homo sapiens
cccagagatgccagccctt

SEQ ID NO: 6073944 - DNA, 16 bp, Homo sapiens
cccagagatgcctcca

SEQ ID NO: 6073945 - DNA, 20 bp, Homo sapiens
cccagagatgcctccaccgc

SEQ ID NO: 6073946 - DNA, 21 bp, Homo sapiens
cccagagatgcctccaccgct

SEQ ID NO: 6073947 - DNA, 16 bp, Homo sapiens
cccagagatggctcct

SEQ ID NO: 6073948 - DNA, 20 bp, Homo sapiens
cccagagatgtcatcagagc

SEQ ID NO: 6073949 - DNA, 14 bp, Homo sapiens
cccagagcacaaga

SEQ ID NO: 6073950 - DNA, 23 bp, Homo sapiens
cccagagcacaagaaggccagcc

SEQ ID NO: 6073951 - DNA, 13 bp, Homo sapiens
cccagagcacagg

SEQ ID NO: 6073952 - DNA, 18 bp, Homo sapiens
cccagagcaccccctgct

SEQ ID NO: 6073953 - DNA, 17 bp, Homo sapiens
cccagagcacctcacct

SEQ ID NO: 6073954 - DNA, 14 bp, Homo sapiens
cccagagcacctgc

SEQ ID NO: 6073955 - DNA, 19 bp, Homo sapiens
cccagagcaggaggcccct

SEQ ID NO: 6073956 - DNA, 21 bp, Homo sapiens
cccagagcaggaggcccctgg

SEQ ID NO: 6073957 - DNA, 15 bp, Homo sapiens
cccagagcagggtgt

SEQ ID NO: 6073958 - DNA, 17 bp, Homo sapiens
cccagagcatctgcccc

SEQ ID NO: 6073959 - DNA, 20 bp, Homo sapiens
cccagagcatctgccccagg

SEQ ID NO: 6073960 - DNA, 22 bp, Homo sapiens
cccagagcatctgccccaggta

SEQ ID NO: 6073961 - DNA, 16 bp, Homo sapiens
cccagagccaagctgg

SEQ ID NO: 6073962 - DNA, 13 bp, Homo sapiens
cccagagccacac

SEQ ID NO: 6073963 - DNA, 18 bp, Homo sapiens
cccagagccacctggatc

SEQ ID NO: 6073964 - DNA, 14 bp, Homo sapiens
cccagagccagggc

SEQ ID NO: 6073965 - DNA, 16 bp, Homo sapiens
cccagagccagggctg

SEQ ID NO: 6073966 - DNA, 20 bp, Homo sapiens
cccagagccagggctgtcct

SEQ ID NO: 6073967 - DNA, 15 bp, Homo sapiens
cccagagcccagctc

SEQ ID NO: 6073968 - DNA, 21 bp, Homo sapiens
cccagagcccctcatgccaca

SEQ ID NO: 6073969 - DNA, 11 bp, Homo sapiens
cccagagcccg

SEQ ID NO: 6073970 - DNA, 21 bp, Homo sapiens
cccagagcccgtcagcgtggg

SEQ ID NO: 6073971 - DNA, 17 bp, Homo sapiens
cccagagccctgcagtc

SEQ ID NO: 6073972 - DNA, 14 bp, Homo sapiens
cccagagccttctc

SEQ ID NO: 6073973 - DNA, 22 bp, Homo sapiens
cccagagctcatcccccctgct

SEQ ID NO: 6073974 - DNA, 16 bp, Homo sapiens
cccagagctgcacagg

SEQ ID NO: 6073975 - DNA, 14 bp, Homo sapiens
cccagagctggcct

SEQ ID NO: 6073976 - DNA, 20 bp, Homo sapiens
cccagagctggcctccccca

SEQ ID NO: 6073977 - DNA, 22 bp, Homo sapiens
cccagagctggcctcccccaac

SEQ ID NO: 6073978 - DNA, 22 bp, Homo sapiens
cccagagctggcgctcagcagc

SEQ ID NO: 6073979 - DNA, 11 bp, Homo sapiens
cccagagctgt

SEQ ID NO: 6073980 - DNA, 17 bp, Homo sapiens
cccagagctgtgccagc

SEQ ID NO: 6073981 - DNA, 18 bp, Homo sapiens
cccagagctgtgccagca

SEQ ID NO: 6073982 - DNA, 21 bp, Homo sapiens
cccagagctgtggactttgtt

SEQ ID NO: 6073983 - DNA, 20 bp, Homo sapiens
cccagagctgtttatggcct

SEQ ID NO: 6073984 - DNA, 21 bp, Homo sapiens
cccagaggaaggggccagagg

SEQ ID NO: 6073985 - DNA, 16 bp, Homo sapiens
cccagaggacacaggc

SEQ ID NO: 6073986 - DNA, 18 bp, Homo sapiens
cccagaggacacaggcag

SEQ ID NO: 6073987 - DNA, 22 bp, Homo sapiens
cccagaggacacaggcagcttc

SEQ ID NO: 6073988 - DNA, 12 bp, Homo sapiens
cccagaggagag

SEQ ID NO: 6073989 - DNA, 22 bp, Homo sapiens
cccagaggagaggagacagaca

SEQ ID NO: 6073990 - DNA, 13 bp, Homo sapiens
cccagaggaggca

SEQ ID NO: 6073991 - DNA, 15 bp, Homo sapiens
cccagaggcacagcc

SEQ ID NO: 6073992 - DNA, 18 bp, Homo sapiens
cccagaggcacagccggg

SEQ ID NO: 6073993 - DNA, 12 bp, Homo sapiens
cccagaggcaga

SEQ ID NO: 6073994 - DNA, 13 bp, Homo sapiens
cccagaggccagg

SEQ ID NO: 6073995 - DNA, 14 bp, Homo sapiens
cccagaggccagga

SEQ ID NO: 6073996 - DNA, 19 bp, Homo sapiens
cccagaggccttgtcatcc

SEQ ID NO: 6073997 - DNA, 14 bp, Homo sapiens
cccagaggcgtccc

SEQ ID NO: 6073998 - DNA, 16 bp, Homo sapiens
cccagaggctcccaat

SEQ ID NO: 6073999 - DNA, 16 bp, Homo sapiens
cccagaggctcctgga

SEQ ID NO: 6074000 - DNA, 17 bp, Homo sapiens
cccagaggctcctggag

SEQ ID NO: 6074001 - DNA, 19 bp, Homo sapiens
cccagaggctcctggagcc

SEQ ID NO: 6074002 - DNA, 21 bp, Homo sapiens
cccagagggaccagctggggg

SEQ ID NO: 6074003 - DNA, 17 bp, Homo sapiens
cccagagggccaagaga

SEQ ID NO: 6074004 - DNA, 23 bp, Homo sapiens
cccagagggcccaggcaggccac

SEQ ID NO: 6074005 - DNA, 18 bp, Homo sapiens
cccagagggcctgcaagg

SEQ ID NO: 6074006 - DNA, 14 bp, Homo sapiens
cccagaggggcctg

SEQ ID NO: 6074007 - DNA, 17 bp, Homo sapiens
cccagaggggcggggcc

SEQ ID NO: 6074008 - DNA, 18 bp, Homo sapiens
cccagaggggcggggcca

SEQ ID NO: 6074009 - DNA, 17 bp, Homo sapiens
cccagagggtagggcag

SEQ ID NO: 6074010 - DNA, 18 bp, Homo sapiens
cccagagggtagggcagc

SEQ ID NO: 6074011 - DNA, 19 bp, Homo sapiens
cccagagggtagggcagca

SEQ ID NO: 6074012 - DNA, 15 bp, Homo sapiens
cccagagggtctggg

SEQ ID NO: 6074013 - DNA, 18 bp, Homo sapiens
cccagaggtaacagaaca

SEQ ID NO: 6074014 - DNA, 17 bp, Homo sapiens
cccagaggtcacacagc

SEQ ID NO: 6074015 - DNA, 22 bp, Homo sapiens
cccagaggtgacccaatgctcc

SEQ ID NO: 6074016 - DNA, 12 bp, Homo sapiens
cccagaggtgga

SEQ ID NO: 6074017 - DNA, 12 bp, Homo sapiens
cccagaggtggc

SEQ ID NO: 6074018 - DNA, 13 bp, Homo sapiens
cccagaggtggcc

SEQ ID NO: 6074019 - DNA, 16 bp, Homo sapiens
cccagaggtggccctc

SEQ ID NO: 6074020 - DNA, 20 bp, Homo sapiens
cccagaggtggccctcccag

SEQ ID NO: 6074021 - DNA, 16 bp, Homo sapiens
cccagaggtggccctt

SEQ ID NO: 6074022 - DNA, 20 bp, Homo sapiens
cccagaggtggcccttgttt

SEQ ID NO: 6074023 - DNA, 21 bp, Homo sapiens
cccagaggtgggatcctccct

SEQ ID NO: 6074024 - DNA, 23 bp, Homo sapiens
cccagaggtgggatcctccctca

SEQ ID NO: 6074025 - DNA, 17 bp, Homo sapiens
cccagaggttatctgcc

SEQ ID NO: 6074026 - DNA, 18 bp, Homo sapiens
cccagaggttatctgcct

SEQ ID NO: 6074027 - DNA, 19 bp, Homo sapiens
cccagaggttatctgcctg

SEQ ID NO: 6074028 - DNA, 23 bp, Homo sapiens
cccagaggttatctgcctggcct

SEQ ID NO: 6074029 - DNA, 23 bp, Homo sapiens
cctcagttcaacctggtggcacc

SEQ ID NO: 6074030 - DNA, 16 bp, Homo sapiens
cctcagttcccagctc

SEQ ID NO: 6074031 - DNA, 17 bp, Homo sapiens
cctcagttcccttggcc

SEQ ID NO: 6074032 - DNA, 19 bp, Homo sapiens
cctcagttcccttggcctc

SEQ ID NO: 6074033 - DNA, 20 bp, Homo sapiens
cctcagttcccttggcctca

SEQ ID NO: 6074034 - DNA, 22 bp, Homo sapiens
cctcagttcccttggcctcaga

SEQ ID NO: 6074035 - DNA, 18 bp, Homo sapiens
cctcagttcctcaccatc

SEQ ID NO: 6074036 - DNA, 20 bp, Homo sapiens
cctcagttctcaaatgtgtg

SEQ ID NO: 6074037 - DNA, 22 bp, Homo sapiens
cctcagttctcaaatgtgtgtg

SEQ ID NO: 6074038 - DNA, 16 bp, Homo sapiens
cctcagttggaatcat

SEQ ID NO: 6074039 - DNA, 15 bp, Homo sapiens
cctcagttgtgcagc

SEQ ID NO: 6074040 - DNA, 20 bp, Homo sapiens
cctcagtttccctatctgca

SEQ ID NO: 6074041 - DNA, 19 bp, Homo sapiens
cctcagtttctccatcagc

SEQ ID NO: 6074042 - DNA, 13 bp, Homo sapiens
cctcagtttctgt

SEQ ID NO: 6074043 - DNA, 21 bp, Homo sapiens
cctcagtttctgttgtttctt

SEQ ID NO: 6074044 - DNA, 14 bp, Homo sapiens
cctcagttttcctt

SEQ ID NO: 6074045 - DNA, 22 bp, Homo sapiens
cctcagtttttcggtgggacag

SEQ ID NO: 6074046 - DNA, 23 bp, Homo sapiens
cctcagtttttcggtgggacagc

SEQ ID NO: 6074047 - DNA, 12 bp, Homo sapiens
cctcatacagaa

SEQ ID NO: 6074048 - DNA, 15 bp, Homo sapiens
cctcataccatctgc

SEQ ID NO: 6074049 - DNA, 22 bp, Homo sapiens
cctcatacccatgcacagtaca

SEQ ID NO: 6074050 - DNA, 21 bp, Homo sapiens
cctcatagtatggtggctggg

SEQ ID NO: 6074051 - DNA, 22 bp, Homo sapiens
cctcatagtatggtggctgggt

SEQ ID NO: 6074052 - DNA, 17 bp, Homo sapiens
cctcatatcttcctcat

SEQ ID NO: 6074053 - DNA, 12 bp, Homo sapiens
cctcatatttaa

SEQ ID NO: 6074054 - DNA, 13 bp, Homo sapiens
cctcatatttaaa

SEQ ID NO: 6074055 - DNA, 13 bp, Homo sapiens
cctcatcaccaac

SEQ ID NO: 6074056 - DNA, 13 bp, Homo sapiens
cctcatcactgga

SEQ ID NO: 6074057 - DNA, 15 bp, Homo sapiens
cctcatcagccttgg

SEQ ID NO: 6074058 - DNA, 13 bp, Homo sapiens
cctcatcaggagt

SEQ ID NO: 6074059 - DNA, 15 bp, Homo sapiens
cctcatcaggatgaa

SEQ ID NO: 6074060 - DNA, 23 bp, Homo sapiens
cctcatcaggatgaacccaggac

SEQ ID NO: 6074061 - DNA, 15 bp, Homo sapiens
cctcatccaaagttc

SEQ ID NO: 6074062 - DNA, 12 bp, Homo sapiens
cctcatccaggg

SEQ ID NO: 6074063 - DNA, 14 bp, Homo sapiens
cctcatccagggcc

SEQ ID NO: 6074064 - DNA, 18 bp, Homo sapiens
cctcatccatgcacttta

SEQ ID NO: 6074065 - DNA, 16 bp, Homo sapiens
cctcatccatttcttt

SEQ ID NO: 6074066 - DNA, 13 bp, Homo sapiens
cctcatcccatga

SEQ ID NO: 6074067 - DNA, 12 bp, Homo sapiens
cctcatccccca

SEQ ID NO: 6074068 - DNA, 19 bp, Homo sapiens
cctcatcccgacctcttag

SEQ ID NO: 6074069 - DNA, 14 bp, Homo sapiens
cctcatcccgagca

SEQ ID NO: 6074070 - DNA, 20 bp, Homo sapiens
cctcatcccgagcacctcca

SEQ ID NO: 6074071 - DNA, 20 bp, Homo sapiens
cctcatcccgtgttctcctt

SEQ ID NO: 6074072 - DNA, 15 bp, Homo sapiens
cctcatccgaggcag

SEQ ID NO: 6074073 - DNA, 15 bp, Homo sapiens
cctcatcctccctga

SEQ ID NO: 6074074 - DNA, 13 bp, Homo sapiens
cctcatcctcctc

SEQ ID NO: 6074075 - DNA, 12 bp, Homo sapiens
cctcatcctttc

SEQ ID NO: 6074076 - DNA, 18 bp, Homo sapiens
cctcatcctttccctctc

SEQ ID NO: 6074077 - DNA, 20 bp, Homo sapiens
cctcatcgggattgtctttt

SEQ ID NO: 6074078 - DNA, 22 bp, Homo sapiens
cctcatctagtcttgacctctc

SEQ ID NO: 6074079 - DNA, 18 bp, Homo sapiens
cctcatctatggttctaa

SEQ ID NO: 6074080 - DNA, 12 bp, Homo sapiens
cctcatctcacc

SEQ ID NO: 6074081 - DNA, 17 bp, Homo sapiens
cctcatctcagaccctg

SEQ ID NO: 6074082 - DNA, 14 bp, Homo sapiens
cctcatctccatgc

SEQ ID NO: 6074083 - DNA, 17 bp, Homo sapiens
cctcatctcccgagcaa

SEQ ID NO: 6074084 - DNA, 13 bp, Homo sapiens
cctcatctccttt

SEQ ID NO: 6074085 - DNA, 13 bp, Homo sapiens
cctcatctctgaa

SEQ ID NO: 6074086 - DNA, 16 bp, Homo sapiens
cctcatctgaaaggcc

SEQ ID NO: 6074087 - DNA, 13 bp, Homo sapiens
cctcatctgagag

SEQ ID NO: 6074088 - DNA, 18 bp, Homo sapiens
cctcatctgcctgcagtg

SEQ ID NO: 6074089 - DNA, 20 bp, Homo sapiens
cctcatctgggggagtggaa

SEQ ID NO: 6074090 - DNA, 23 bp, Homo sapiens
cctcatctgggtctcccaggaca

SEQ ID NO: 6074091 - DNA, 14 bp, Homo sapiens
cctcatctgtgcct

SEQ ID NO: 6074092 - DNA, 18 bp, Homo sapiens
cctcatctgtggagctgc

SEQ ID NO: 6074093 - DNA, 22 bp, Homo sapiens
cctcatctgtggagctgccaca

SEQ ID NO: 6074094 - DNA, 17 bp, Homo sapiens
cctcatcttccccagcc

SEQ ID NO: 6074095 - DNA, 22 bp, Homo sapiens
cctcatcttccttctcagcctt

SEQ ID NO: 6074096 - DNA, 21 bp, Homo sapiens
cctcatcttgaagggcccagg

SEQ ID NO: 6074097 - DNA, 18 bp, Homo sapiens
cctcatcttgccccctca

SEQ ID NO: 6074098 - DNA, 22 bp, Homo sapiens
cctcatcttgccccctcatctc

SEQ ID NO: 6074099 - DNA, 24 bp, Homo sapiens
cctcatcttgccccctcatctcac

SEQ ID NO: 6074100 - DNA, 17 bp, Homo sapiens
cctcatctttcatcaat

SEQ ID NO: 6074101 - DNA, 22 bp, Homo sapiens
cctcatgaatgtaaatttgtac

SEQ ID NO: 6074102 - DNA, 16 bp, Homo sapiens
cctcatgaggccatgc

SEQ ID NO: 6074103 - DNA, 16 bp, Homo sapiens
cctcatgagtgtcaaa

SEQ ID NO: 6074104 - DNA, 19 bp, Homo sapiens
cctcatgccaaccctgggc

SEQ ID NO: 6074105 - DNA, 15 bp, Homo sapiens
cctcatgccacacct

SEQ ID NO: 6074106 - DNA, 13 bp, Homo sapiens
cctcatgccacag

SEQ ID NO: 6074107 - DNA, 13 bp, Homo sapiens
cctcatgcccagc

SEQ ID NO: 6074108 - DNA, 16 bp, Homo sapiens
cctcatgcccagctct

SEQ ID NO: 6074109 - DNA, 17 bp, Homo sapiens
cctcatgcccagctctc

SEQ ID NO: 6074110 - DNA, 23 bp, Homo sapiens
cctcatgcctttatttctgtatc

SEQ ID NO: 6074111 - DNA, 16 bp, Homo sapiens
cctcatgctgccaata

SEQ ID NO: 6074112 - DNA, 14 bp, Homo sapiens
cctcatggagacct

SEQ ID NO: 6074113 - DNA, 16 bp, Homo sapiens
cctcatggattgccac

SEQ ID NO: 6074114 - DNA, 20 bp, Homo sapiens
cctcatggcccatcaggggc

SEQ ID NO: 6074115 - DNA, 20 bp, Homo sapiens
cctcatggcccccaggggca

SEQ ID NO: 6074116 - DNA, 23 bp, Homo sapiens
cctcatggcccccaggggcagga

SEQ ID NO: 6074117 - DNA, 18 bp, Homo sapiens
cctcatggcccctctgac

SEQ ID NO: 6074118 - DNA, 15 bp, Homo sapiens
cctcatggcgggact

SEQ ID NO: 6074119 - DNA, 18 bp, Homo sapiens
cctcatggcgggactgga

SEQ ID NO: 6074120 - DNA, 21 bp, Homo sapiens
cctcatggcgggactggagaa

SEQ ID NO: 6074121 - DNA, 19 bp, Homo sapiens
cctcatggctgttatctgt

SEQ ID NO: 6074122 - DNA, 13 bp, Homo sapiens
cctcatgggagtc

SEQ ID NO: 6074123 - DNA, 15 bp, Homo sapiens
cctcatgggagtcag

SEQ ID NO: 6074124 - DNA, 16 bp, Homo sapiens
cctcatgggtcctagc

SEQ ID NO: 6074125 - DNA, 19 bp, Homo sapiens
cctcatggtgggttcaggg

SEQ ID NO: 6074126 - DNA, 17 bp, Homo sapiens
cctcatgtcatttctca

SEQ ID NO: 6074127 - DNA, 15 bp, Homo sapiens
cctcatgtccactgg

SEQ ID NO: 6074128 - DNA, 19 bp, Homo sapiens
cctcatgttcttaattctt

SEQ ID NO: 6074129 - DNA, 12 bp, Homo sapiens
cctcattaaatt

SEQ ID NO: 6074130 - DNA, 17 bp, Homo sapiens
cctcattaatgacactt

SEQ ID NO: 6074131 - DNA, 15 bp, Homo sapiens
cctcattacccaggt

SEQ ID NO: 6074132 - DNA, 23 bp, Homo sapiens
cctcattcagcagaatgactctg

SEQ ID NO: 6074133 - DNA, 15 bp, Homo sapiens
cctcattcaggaaaa

SEQ ID NO: 6074134 - DNA, 14 bp, Homo sapiens
cctcattcagtaag

SEQ ID NO: 6074135 - DNA, 15 bp, Homo sapiens
cctcattcccctcgt

SEQ ID NO: 6074136 - DNA, 22 bp, Homo sapiens
cctcattccctcgtctttccca

SEQ ID NO: 6074137 - DNA, 20 bp, Homo sapiens
cctcattccggccacatcat

SEQ ID NO: 6074138 - DNA, 17 bp, Homo sapiens
cctcattcgcctgtggg

SEQ ID NO: 6074139 - DNA, 18 bp, Homo sapiens
cctcattctgaggcctga

SEQ ID NO: 6074140 - DNA, 13 bp, Homo sapiens
cctcattgaatcc

SEQ ID NO: 6074141 - DNA, 16 bp, Homo sapiens
cctcattgcctcctgt

SEQ ID NO: 6074142 - DNA, 21 bp, Homo sapiens
cctcattgcctcctgttctgc

SEQ ID NO: 6074143 - DNA, 14 bp, Homo sapiens
cctcattgctacca

SEQ ID NO: 6074144 - DNA, 15 bp, Homo sapiens
cctcattgctgtctt

SEQ ID NO: 6074145 - DNA, 16 bp, Homo sapiens
cctcattgctgtcttg

SEQ ID NO: 6074146 - DNA, 22 bp, Homo sapiens
cctcattgctgtcttgccccag

SEQ ID NO: 6074147 - DNA, 13 bp, Homo sapiens
cctcattgtgcca

SEQ ID NO: 6074148 - DNA, 14 bp, Homo sapiens
cctcattgtgccaa

SEQ ID NO: 6074149 - DNA, 17 bp, Homo sapiens
cctcattgtgccaagcc

SEQ ID NO: 6074150 - DNA, 21 bp, Homo sapiens
cctcatttaatatttttcaaa

SEQ ID NO: 6074151 - DNA, 23 bp, Homo sapiens
cctcatttcattatttttcaatt

SEQ ID NO: 6074152 - DNA, 16 bp, Homo sapiens
cctcatttctgccagc

SEQ ID NO: 6074153 - DNA, 20 bp, Homo sapiens
cctcatttgaatgtgtgaat

SEQ ID NO: 6074154 - DNA, 20 bp, Homo sapiens
cctcatttgcaaacctcaga

SEQ ID NO: 6074155 - DNA, 17 bp, Homo sapiens
cctcatttggggtagct

SEQ ID NO: 6074156 - DNA, 16 bp, Homo sapiens
cctcatttgtccatgt

SEQ ID NO: 6074157 - DNA, 16 bp, Homo sapiens
cctcattttgcttccc

SEQ ID NO: 6074158 - DNA, 23 bp, Homo sapiens
cctcattttgcttcccatctgaa

SEQ ID NO: 6074159 - DNA, 21 bp, Homo sapiens
cctcatttttataatgtccct

SEQ ID NO: 6074160 - DNA, 16 bp, Homo sapiens
cctcatttttccttta

SEQ ID NO: 6074161 - DNA, 19 bp, Homo sapiens
cctccaaaactcctgcccc

SEQ ID NO: 6074162 - DNA, 23 bp, Homo sapiens
cctccaaaacttagacccatgct

SEQ ID NO: 6074163 - DNA, 18 bp, Homo sapiens
cctccaaacatgttccca

SEQ ID NO: 6074164 - DNA, 15 bp, Homo sapiens
cctccaaacctccag

SEQ ID NO: 6074165 - DNA, 19 bp, Homo sapiens
cctccaaactcctgcctgt

SEQ ID NO: 6074166 - DNA, 16 bp, Homo sapiens
cctccaaagagccttc

SEQ ID NO: 6074167 - DNA, 18 bp, Homo sapiens
cctccaaagccccacctt

SEQ ID NO: 6074168 - DNA, 14 bp, Homo sapiens
cctccaaagcctgg

SEQ ID NO: 6074169 - DNA, 15 bp, Homo sapiens
cctccaaaggaaggg

SEQ ID NO: 6074170 - DNA, 19 bp, Homo sapiens
cctccaaaggaaggggttt

SEQ ID NO: 6074171 - DNA, 16 bp, Homo sapiens
cctccaaaggccccct

SEQ ID NO: 6074172 - DNA, 15 bp, Homo sapiens
cctccaaatgctgtc

SEQ ID NO: 6074173 - DNA, 21 bp, Homo sapiens
cctccaaatggagaagctgca

SEQ ID NO: 6074174 - DNA, 11 bp, Homo sapiens
cctccaaatgt

SEQ ID NO: 6074175 - DNA, 23 bp, Homo sapiens
cctccaacacaaggctccaagac

SEQ ID NO: 6074176 - DNA, 18 bp, Homo sapiens
cctccaacccacagcctt

SEQ ID NO: 6074177 - DNA, 19 bp, Homo sapiens
cctccaacccacagccttt

SEQ ID NO: 6074178 - DNA, 15 bp, Homo sapiens
cctccaacccagcag

SEQ ID NO: 6074179 - DNA, 20 bp, Homo sapiens
cctccaacccctcgcccagt

SEQ ID NO: 6074180 - DNA, 13 bp, Homo sapiens
cctccaaccctgc

SEQ ID NO: 6074181 - DNA, 14 bp, Homo sapiens
cctccaaccctgcc

SEQ ID NO: 6074182 - DNA, 19 bp, Homo sapiens
cctccaacctggggggcag

SEQ ID NO: 6074183 - DNA, 11 bp, Homo sapiens
cctccaacctt

SEQ ID NO: 6074184 - DNA, 16 bp, Homo sapiens
cctccaacgcccctgt

SEQ ID NO: 6074185 - DNA, 17 bp, Homo sapiens
cctccaacgcccctgtg

SEQ ID NO: 6074186 - DNA, 20 bp, Homo sapiens
cctccaacgcccctgtggcc

SEQ ID NO: 6074187 - DNA, 13 bp, Homo sapiens
cctccaagaaact

SEQ ID NO: 6074188 - DNA, 20 bp, Homo sapiens
cctccaagaagccctccttg

SEQ ID NO: 6074189 - DNA, 22 bp, Homo sapiens
cctccaagaagccctccttgcc

SEQ ID NO: 6074190 - DNA, 17 bp, Homo sapiens
cctccaagaatctatct

SEQ ID NO: 6074191 - DNA, 16 bp, Homo sapiens
cctccaagaccttctc

SEQ ID NO: 6074192 - DNA, 13 bp, Homo sapiens
cctccaagcacag

SEQ ID NO: 6074193 - DNA, 23 bp, Homo sapiens
cctccaagcacagagcctggccc

SEQ ID NO: 6074194 - DNA, 16 bp, Homo sapiens
cctccaagcctgcctc

SEQ ID NO: 6074195 - DNA, 14 bp, Homo sapiens
cctccaagcctggc

SEQ ID NO: 6074196 - DNA, 17 bp, Homo sapiens
cctccaagcctggcacc

SEQ ID NO: 6074197 - DNA, 19 bp, Homo sapiens
cctccaagcctggcaccca

SEQ ID NO: 6074198 - DNA, 16 bp, Homo sapiens
cctccaagcggccctg

SEQ ID NO: 6074199 - DNA, 21 bp, Homo sapiens
cctccaagctccatctccact

SEQ ID NO: 6074200 - DNA, 14 bp, Homo sapiens
cctccaaggaaaga

SEQ ID NO: 6074201 - DNA, 23 bp, Homo sapiens
cctccaaggctgtcttctcccag

SEQ ID NO: 6074202 - DNA, 23 bp, Homo sapiens
cctccaagggtttcgactggtcc

SEQ ID NO: 6074203 - DNA, 14 bp, Homo sapiens
cctccaaggttttg

SEQ ID NO: 6074204 - DNA, 21 bp, Homo sapiens
cctccaagtccacagtggaac

SEQ ID NO: 6074205 - DNA, 19 bp, Homo sapiens
cctccaagtgccccctcac

SEQ ID NO: 6074206 - DNA, 22 bp, Homo sapiens
cctccaagtgccccctcacctc

SEQ ID NO: 6074207 - DNA, 15 bp, Homo sapiens
cctccaagtggtcca

SEQ ID NO: 6074208 - DNA, 13 bp, Homo sapiens
cccagagtagccc

SEQ ID NO: 6074209 - DNA, 17 bp, Homo sapiens
cccagagtcagaggaga

SEQ ID NO: 6074210 - DNA, 13 bp, Homo sapiens
cccagagtcagga

SEQ ID NO: 6074211 - DNA, 15 bp, Homo sapiens
cccagagtcatctga

SEQ ID NO: 6074212 - DNA, 19 bp, Homo sapiens
cccagagtggagtctgagt

SEQ ID NO: 6074213 - DNA, 19 bp, Homo sapiens
cccagagtgtagggggcct

SEQ ID NO: 6074214 - DNA, 23 bp, Homo sapiens
cccagagtgtgggaagggagagc

SEQ ID NO: 6074215 - DNA, 20 bp, Homo sapiens
cccagagttgctgtgccgtg

SEQ ID NO: 6074216 - DNA, 17 bp, Homo sapiens
cccagataatggagaat

SEQ ID NO: 6074217 - DNA, 23 bp, Homo sapiens
cccagatacagcacatccaccca

SEQ ID NO: 6074218 - DNA, 18 bp, Homo sapiens
cccagataccagcccctg

SEQ ID NO: 6074219 - DNA, 18 bp, Homo sapiens
cccagatacctgtgagga

SEQ ID NO: 6074220 - DNA, 22 bp, Homo sapiens
cccagatacctgtgaggactgg

SEQ ID NO: 6074221 - DNA, 23 bp, Homo sapiens
cccagatacgggggctgtgactc

SEQ ID NO: 6074222 - DNA, 20 bp, Homo sapiens
cccagatagagctgggtggc

SEQ ID NO: 6074223 - DNA, 15 bp, Homo sapiens
cccagatagtcccag

SEQ ID NO: 6074224 - DNA, 20 bp, Homo sapiens
cccagatatggaaacagaag

SEQ ID NO: 6074225 - DNA, 19 bp, Homo sapiens
cccagatcaagcctgcctc

SEQ ID NO: 6074226 - DNA, 15 bp, Homo sapiens
cccagatcagccaga

SEQ ID NO: 6074227 - DNA, 19 bp, Homo sapiens
cccagatcagccagaagcc

SEQ ID NO: 6074228 - DNA, 13 bp, Homo sapiens
cccagatcaggaa

SEQ ID NO: 6074229 - DNA, 20 bp, Homo sapiens
cccagatcaggaaccagggc

SEQ ID NO: 6074230 - DNA, 19 bp, Homo sapiens
cccagatcagtcagagccc

SEQ ID NO: 6074231 - DNA, 22 bp, Homo sapiens
cccagatccaggaacacatgca

SEQ ID NO: 6074232 - DNA, 15 bp, Homo sapiens
cccagatcgttctgc

SEQ ID NO: 6074233 - DNA, 22 bp, Homo sapiens
cccagatcgttctgccacttgc

SEQ ID NO: 6074234 - DNA, 19 bp, Homo sapiens
cccagatctgcctgggcct

SEQ ID NO: 6074235 - DNA, 21 bp, Homo sapiens
cccagatctgcctgggcctgt

SEQ ID NO: 6074236 - DNA, 16 bp, Homo sapiens
cccagatctgtcctgg

SEQ ID NO: 6074237 - DNA, 18 bp, Homo sapiens
cccagatgaccttgactg

SEQ ID NO: 6074238 - DNA, 18 bp, Homo sapiens
cccagatgcagggctgca

SEQ ID NO: 6074239 - DNA, 23 bp, Homo sapiens
cccagatgccctttggaaagcca

SEQ ID NO: 6074240 - DNA, 14 bp, Homo sapiens
cccagatgctgggg

SEQ ID NO: 6074241 - DNA, 23 bp, Homo sapiens
cccagatggctggaaggggtcca

SEQ ID NO: 6074242 - DNA, 13 bp, Homo sapiens
cccagatggcttc

SEQ ID NO: 6074243 - DNA, 20 bp, Homo sapiens
cccagatggcttcggagggc

SEQ ID NO: 6074244 - DNA, 18 bp, Homo sapiens
cccagatgggccacggct

SEQ ID NO: 6074245 - DNA, 21 bp, Homo sapiens
cccagatgtgagggcaccacc

SEQ ID NO: 6074246 - DNA, 22 bp, Homo sapiens
cccagatgtgagggcaccacca

SEQ ID NO: 6074247 - DNA, 20 bp, Homo sapiens
cccagatgttgcttttgaaa

SEQ ID NO: 6074248 - DNA, 16 bp, Homo sapiens
cccagattcccctgtg

SEQ ID NO: 6074249 - DNA, 17 bp, Homo sapiens
cccagattcccctgtgt

SEQ ID NO: 6074250 - DNA, 22 bp, Homo sapiens
cccagattgataagtaatgaaa

SEQ ID NO: 6074251 - DNA, 15 bp, Homo sapiens
cccagattgtgtaca

SEQ ID NO: 6074252 - DNA, 15 bp, Homo sapiens
cccagatttcagtct

SEQ ID NO: 6074253 - DNA, 19 bp, Homo sapiens
cccagatttcagtcttttc

SEQ ID NO: 6074254 - DNA, 18 bp, Homo sapiens
cccagattttgctgtata

SEQ ID NO: 6074255 - DNA, 19 bp, Homo sapiens
cccagattttgctgtatat

SEQ ID NO: 6074256 - DNA, 15 bp, Homo sapiens
cccagcaaagccccc

SEQ ID NO: 6074257 - DNA, 17 bp, Homo sapiens
cccagcaaagcccccag

SEQ ID NO: 6074258 - DNA, 16 bp, Homo sapiens
cccagcaaatgggcat

SEQ ID NO: 6074259 - DNA, 17 bp, Homo sapiens
cccagcaaatgggcatt

SEQ ID NO: 6074260 - DNA, 15 bp, Homo sapiens
cccagcaacacaagc

SEQ ID NO: 6074261 - DNA, 20 bp, Homo sapiens
cccagcaacacaagctggaa

SEQ ID NO: 6074262 - DNA, 22 bp, Homo sapiens
cccagcaacactccggtcagcc

SEQ ID NO: 6074263 - DNA, 13 bp, Homo sapiens
cccagcaaccctc

SEQ ID NO: 6074264 - DNA, 17 bp, Homo sapiens
cccagcaaccctcctat

SEQ ID NO: 6074265 - DNA, 19 bp, Homo sapiens
cccagcaaccctcctatca

SEQ ID NO: 6074266 - DNA, 21 bp, Homo sapiens
cccagcaaccctcctatcacc

SEQ ID NO: 6074267 - DNA, 15 bp, Homo sapiens
cccagcaacgcccct

SEQ ID NO: 6074268 - DNA, 19 bp, Homo sapiens
cccagcaagacctcatctg

SEQ ID NO: 6074269 - DNA, 15 bp, Homo sapiens
cccagcaagcgggag

SEQ ID NO: 6074270 - DNA, 22 bp, Homo sapiens
cccagcaagcgggagcccgtgg

SEQ ID NO: 6074271 - DNA, 20 bp, Homo sapiens
cccagcaaggcacaggctcc

SEQ ID NO: 6074272 - DNA, 21 bp, Homo sapiens
cccagcaaggcagaagcttgg

SEQ ID NO: 6074273 - DNA, 18 bp, Homo sapiens
cccagcaagtgagagctg

SEQ ID NO: 6074274 - DNA, 21 bp, Homo sapiens
cccagcaagtgagagctgggt

SEQ ID NO: 6074275 - DNA, 22 bp, Homo sapiens
cccagcaagtggtcctagaggc

SEQ ID NO: 6074276 - DNA, 21 bp, Homo sapiens
cccagcaagtttcaccttggg

SEQ ID NO: 6074277 - DNA, 23 bp, Homo sapiens
cccagcaatcgcatcccggctga

SEQ ID NO: 6074278 - DNA, 16 bp, Homo sapiens
cccagcaattatgaaa

SEQ ID NO: 6074279 - DNA, 18 bp, Homo sapiens
cccagcaattatgaaaat

SEQ ID NO: 6074280 - DNA, 18 bp, Homo sapiens
cccagcacaaagcactgg

SEQ ID NO: 6074281 - DNA, 22 bp, Homo sapiens
cccagcacaaagcactggcctt

SEQ ID NO: 6074282 - DNA, 20 bp, Homo sapiens
cccagcacaaagcagatcct

SEQ ID NO: 6074283 - DNA, 18 bp, Homo sapiens
cccagcacactgcttctc

SEQ ID NO: 6074284 - DNA, 16 bp, Homo sapiens
cccagcacagatgagg

SEQ ID NO: 6074285 - DNA, 15 bp, Homo sapiens
cccagcacagccacc

SEQ ID NO: 6074286 - DNA, 16 bp, Homo sapiens
cccagcacagccacct

SEQ ID NO: 6074287 - DNA, 12 bp, Homo sapiens
cccagcacagct

SEQ ID NO: 6074288 - DNA, 16 bp, Homo sapiens
cccagcacagctcctc

SEQ ID NO: 6074289 - DNA, 17 bp, Homo sapiens
cccagcacagctcctcc

SEQ ID NO: 6074290 - DNA, 12 bp, Homo sapiens
cccagcacaggc

SEQ ID NO: 6074291 - DNA, 19 bp, Homo sapiens
cccagcacatagcttgcct

SEQ ID NO: 6074292 - DNA, 18 bp, Homo sapiens
cccagcacatttcctctc

SEQ ID NO: 6074293 - DNA, 18 bp, Homo sapiens
cccagcaccccctctcct

SEQ ID NO: 6074294 - DNA, 22 bp, Homo sapiens
cccagcaccccctctcctggag

SEQ ID NO: 6074295 - DNA, 22 bp, Homo sapiens
cccagcacccgggctcagggac

SEQ ID NO: 6074296 - DNA, 13 bp, Homo sapiens
cccagcaccctct

SEQ ID NO: 6074297 - DNA, 14 bp, Homo sapiens
cccagcacctcctc

SEQ ID NO: 6074298 - DNA, 17 bp, Homo sapiens
cccagcacctcctccgt

SEQ ID NO: 6074299 - DNA, 22 bp, Homo sapiens
cccagcacctcctccgtgggca

SEQ ID NO: 6074300 - DNA, 16 bp, Homo sapiens
cccagcacctgccagg

SEQ ID NO: 6074301 - DNA, 20 bp, Homo sapiens
cccagcacctgccagggccc

SEQ ID NO: 6074302 - DNA, 16 bp, Homo sapiens
cccagcacctgcctcc

SEQ ID NO: 6074303 - DNA, 12 bp, Homo sapiens
cccagcacgagc

SEQ ID NO: 6074304 - DNA, 14 bp, Homo sapiens
cccagcacgagcct

SEQ ID NO: 6074305 - DNA, 16 bp, Homo sapiens
cccagcactaaagcag

SEQ ID NO: 6074306 - DNA, 21 bp, Homo sapiens
cccagcactgcttgaggaaaa

SEQ ID NO: 6074307 - DNA, 18 bp, Homo sapiens
cccagcacttgtgttgtc

SEQ ID NO: 6074308 - DNA, 12 bp, Homo sapiens
cccagcactttg

SEQ ID NO: 6074309 - DNA, 20 bp, Homo sapiens
cccagcactttgagaggctg

SEQ ID NO: 6074310 - DNA, 24 bp, Homo sapiens
cccagcactttgggaagctgaggc

SEQ ID NO: 6074311 - DNA, 21 bp, Homo sapiens
cccagcactttgggaggcagg

SEQ ID NO: 6074312 - DNA, 22 bp, Homo sapiens
cccagcactttgggaggccaag

SEQ ID NO: 6074313 - DNA, 21 bp, Homo sapiens
cccagcactttgggaggccta

SEQ ID NO: 6074314 - DNA, 20 bp, Homo sapiens
cccagcactttgggaggctg

SEQ ID NO: 6074315 - DNA, 21 bp, Homo sapiens
cccagcactttgggaggctga

SEQ ID NO: 6074316 - DNA, 14 bp, Homo sapiens
cccagcagaaccag

SEQ ID NO: 6074317 - DNA, 17 bp, Homo sapiens
cccagcagaagagggag

SEQ ID NO: 6074318 - DNA, 20 bp, Homo sapiens
cccagcagaatggaggcagg

SEQ ID NO: 6074319 - DNA, 21 bp, Homo sapiens
cccagcagaatggaggcaggg

SEQ ID NO: 6074320 - DNA, 16 bp, Homo sapiens
cccagcagagcccacc

SEQ ID NO: 6074321 - DNA, 19 bp, Homo sapiens
cccagcagagcccaccagc

SEQ ID NO: 6074322 - DNA, 22 bp, Homo sapiens
cccagcagagcccaccagccag

SEQ ID NO: 6074323 - DNA, 22 bp, Homo sapiens
cccagcagagccgttcctggga

SEQ ID NO: 6074324 - DNA, 17 bp, Homo sapiens
cccagcagagggataac

SEQ ID NO: 6074325 - DNA, 13 bp, Homo sapiens
cccagcagcagca

SEQ ID NO: 6074326 - DNA, 14 bp, Homo sapiens
cccagcagccagcc

SEQ ID NO: 6074327 - DNA, 15 bp, Homo sapiens
cccagcagccagcca

SEQ ID NO: 6074328 - DNA, 16 bp, Homo sapiens
cccagcagcccctgag

SEQ ID NO: 6074329 - DNA, 17 bp, Homo sapiens
cccagcagcccctgaga

SEQ ID NO: 6074330 - DNA, 22 bp, Homo sapiens
cccagcagcccctgagagcctg

SEQ ID NO: 6074331 - DNA, 17 bp, Homo sapiens
cccagcagccctaagga

SEQ ID NO: 6074332 - DNA, 21 bp, Homo sapiens
cccagcagccctggcctgtgg

SEQ ID NO: 6074333 - DNA, 17 bp, Homo sapiens
cccagcagcctgccagc

SEQ ID NO: 6074334 - DNA, 18 bp, Homo sapiens
cccagcagcctgccagca

SEQ ID NO: 6074335 - DNA, 13 bp, Homo sapiens
cccagcagcgccc

SEQ ID NO: 6074336 - DNA, 14 bp, Homo sapiens
cccagcagctcacc

SEQ ID NO: 6074337 - DNA, 16 bp, Homo sapiens
cccagcagctgggccg

SEQ ID NO: 6074338 - DNA, 16 bp, Homo sapiens
cccagcagcttggctg

SEQ ID NO: 6074339 - DNA, 21 bp, Homo sapiens
cccagcagcttggctgagccc

SEQ ID NO: 6074340 - DNA, 16 bp, Homo sapiens
cccagcaggaagccag

SEQ ID NO: 6074341 - DNA, 22 bp, Homo sapiens
cccagcaggcaggcactgtggc

SEQ ID NO: 6074342 - DNA, 23 bp, Homo sapiens
cccagcaggcaggcactgtggcc

SEQ ID NO: 6074343 - DNA, 17 bp, Homo sapiens
cccagcaggcccagcat

SEQ ID NO: 6074344 - DNA, 19 bp, Homo sapiens
cccagcaggcccagcatgc

SEQ ID NO: 6074345 - DNA, 19 bp, Homo sapiens
cccagcagggcctcaaagt

SEQ ID NO: 6074346 - DNA, 22 bp, Homo sapiens
cccagcagggtcttttcatctg

SEQ ID NO: 6074347 - DNA, 12 bp, Homo sapiens
cccagcagtcct

SEQ ID NO: 6074348 - DNA, 15 bp, Homo sapiens
cccagcagtcctggg

SEQ ID NO: 6074349 - DNA, 17 bp, Homo sapiens
cccagcagtcctgggcc

SEQ ID NO: 6074350 - DNA, 18 bp, Homo sapiens
cccagcagtcctgggccc

SEQ ID NO: 6074351 - DNA, 21 bp, Homo sapiens
cccagcagtgtggagaccctg

SEQ ID NO: 6074352 - DNA, 17 bp, Homo sapiens
cccagcagttctctgcc

SEQ ID NO: 6074353 - DNA, 18 bp, Homo sapiens
cccagcagttctctgcca

SEQ ID NO: 6074354 - DNA, 18 bp, Homo sapiens
cccagcagtttcccagaa

SEQ ID NO: 6074355 - DNA, 16 bp, Homo sapiens
cccagcatcaccagct

SEQ ID NO: 6074356 - DNA, 18 bp, Homo sapiens
cccagcatcagcctgtag

SEQ ID NO: 6074357 - DNA, 16 bp, Homo sapiens
cccagcatcgggggcc

SEQ ID NO: 6074358 - DNA, 20 bp, Homo sapiens
cccagcatcgggggcctgca

SEQ ID NO: 6074359 - DNA, 20 bp, Homo sapiens
cccagcatctcagagtccag

SEQ ID NO: 6074360 - DNA, 23 bp, Homo sapiens
cccagcatgacataacagtgcag

SEQ ID NO: 6074361 - DNA, 19 bp, Homo sapiens
cccagcattccagctctgc

SEQ ID NO: 6074362 - DNA, 20 bp, Homo sapiens
cccagcattccagctctgcc

SEQ ID NO: 6074363 - DNA, 23 bp, Homo sapiens
cccagcatttggttttacacagg

SEQ ID NO: 6074364 - DNA, 17 bp, Homo sapiens
cccagcatttgtccacc

SEQ ID NO: 6074365 - DNA, 13 bp, Homo sapiens
cccagccaagcct

SEQ ID NO: 6074366 - DNA, 15 bp, Homo sapiens
cccagccaagcctga

SEQ ID NO: 6074367 - DNA, 16 bp, Homo sapiens
cccagccaagcctgac

SEQ ID NO: 6074368 - DNA, 15 bp, Homo sapiens
cccagccacaggcca

SEQ ID NO: 6074369 - DNA, 14 bp, Homo sapiens
cccagccaccacca

SEQ ID NO: 6074370 - DNA, 19 bp, Homo sapiens
cccagccaccaccactgtc

SEQ ID NO: 6074371 - DNA, 22 bp, Homo sapiens
cccagccaccaccactgtccct

SEQ ID NO: 6074372 - DNA, 23 bp, Homo sapiens
cccagccaccaccctcaggtgcc

SEQ ID NO: 6074373 - DNA, 12 bp, Homo sapiens
cccagccacccc

SEQ ID NO: 6074374 - DNA, 14 bp, Homo sapiens
cccagccaccccgg

SEQ ID NO: 6074375 - DNA, 22 bp, Homo sapiens
cccagccaccccgggctctctg

SEQ ID NO: 6074376 - DNA, 12 bp, Homo sapiens
cccagccacctc

SEQ ID NO: 6074377 - DNA, 12 bp, Homo sapiens
cccagccacctt

SEQ ID NO: 6074378 - DNA, 16 bp, Homo sapiens
cccagccaccttcctg

SEQ ID NO: 6074379 - DNA, 15 bp, Homo sapiens
cccagccacgtgtct

SEQ ID NO: 6074380 - DNA, 16 bp, Homo sapiens
cccagccactccccag

SEQ ID NO: 6074381 - DNA, 13 bp, Homo sapiens
cccagccactgca

SEQ ID NO: 6074382 - DNA, 14 bp, Homo sapiens
cccagccactgcag

SEQ ID NO: 6074383 - DNA, 15 bp, Homo sapiens
cccagccactgcagc

SEQ ID NO: 6074384 - DNA, 16 bp, Homo sapiens
aaagttttatatatta

SEQ ID NO: 6074385 - DNA, 20 bp, Homo sapiens
aaagttttatatattatatg

SEQ ID NO: 6074386 - DNA, 23 bp, Homo sapiens
aaagttttatatattatatggaa

SEQ ID NO: 6074387 - DNA, 18 bp, Homo sapiens
aaagttttattataaatt

SEQ ID NO: 6074388 - DNA, 19 bp, Homo sapiens
aaagttttattataaattc

SEQ ID NO: 6074389 - DNA, 15 bp, Homo sapiens
aaagttttcaagcat

SEQ ID NO: 6074390 - DNA, 22 bp, Homo sapiens
aaagttttcagattgtaaaggt

SEQ ID NO: 6074391 - DNA, 18 bp, Homo sapiens
aaagttttccagtattga

SEQ ID NO: 6074392 - DNA, 13 bp, Homo sapiens
aaagttttctaat

SEQ ID NO: 6074393 - DNA, 12 bp, Homo sapiens
aaagttttgaaa

SEQ ID NO: 6074394 - DNA, 21 bp, Homo sapiens
aaagttttgagtagatattac

SEQ ID NO: 6074395 - DNA, 21 bp, Homo sapiens
aaagttttgatgaaattcttg

SEQ ID NO: 6074396 - DNA, 15 bp, Homo sapiens
aaagttttgatttga

SEQ ID NO: 6074397 - DNA, 23 bp, Homo sapiens
aaagttttgatttgaatgtaaaa

SEQ ID NO: 6074398 - DNA, 23 bp, Homo sapiens
aaagttttgccccatgataaaat

SEQ ID NO: 6074399 - DNA, 22 bp, Homo sapiens
aaagttttgttctgtatatttt

SEQ ID NO: 6074400 - DNA, 12 bp, Homo sapiens
aaagttttgttg

SEQ ID NO: 6074401 - DNA, 14 bp, Homo sapiens
aaagttttgttgta

SEQ ID NO: 6074402 - DNA, 19 bp, Homo sapiens
aaagtttttttttataatt

SEQ ID NO: 6074403 - DNA, 22 bp, Homo sapiens
aaagttttttttttgtttgttt

SEQ ID NO: 6074404 - DNA, 22 bp, Homo sapiens
aaataaaaaaaagaaaaaagag

SEQ ID NO: 6074405 - DNA, 17 bp, Homo sapiens
aaataaaaaaagatttt

SEQ ID NO: 6074406 - DNA, 21 bp, Homo sapiens
aaataaaaaagctcttttaat

SEQ ID NO: 6074407 - DNA, 18 bp, Homo sapiens
aaataaaaaagtctctat

SEQ ID NO: 6074408 - DNA, 18 bp, Homo sapiens
aaataaaaaatctgaaga

SEQ ID NO: 6074409 - DNA, 22 bp, Homo sapiens
aaataaaaaccagaatcataat

SEQ ID NO: 6074410 - DNA, 13 bp, Homo sapiens
aaataaaaagaaa

SEQ ID NO: 6074411 - DNA, 19 bp, Homo sapiens
aaataaaaagaaaggctgt

SEQ ID NO: 6074412 - DNA, 14 bp, Homo sapiens
aaataaaaagagaa

SEQ ID NO: 6074413 - DNA, 14 bp, Homo sapiens
aaataaaaagattc

SEQ ID NO: 6074414 - DNA, 12 bp, Homo sapiens
aaataaaaagta

SEQ ID NO: 6074415 - DNA, 19 bp, Homo sapiens
aaataaaaagtaatgactt

SEQ ID NO: 6074416 - DNA, 22 bp, Homo sapiens
aaataaaaagtatgttgtacat

SEQ ID NO: 6074417 - DNA, 12 bp, Homo sapiens
aaataaaaagtt

SEQ ID NO: 6074418 - DNA, 14 bp, Homo sapiens
aaataaaaataaat

SEQ ID NO: 6074419 - DNA, 15 bp, Homo sapiens
aaataaaaataattg

SEQ ID NO: 6074420 - DNA, 17 bp, Homo sapiens
aaataaaaataattggg

SEQ ID NO: 6074421 - DNA, 16 bp, Homo sapiens
aaataaaaatagaaat

SEQ ID NO: 6074422 - DNA, 14 bp, Homo sapiens
aaataaaaatattc

SEQ ID NO: 6074423 - DNA, 18 bp, Homo sapiens
aaataaaaatattctcca

SEQ ID NO: 6074424 - DNA, 13 bp, Homo sapiens
aaataaaacaaag

SEQ ID NO: 6074425 - DNA, 15 bp, Homo sapiens
aaataaaacaaaggg

SEQ ID NO: 6074426 - DNA, 13 bp, Homo sapiens
aaataaaacaagc

SEQ ID NO: 6074427 - DNA, 15 bp, Homo sapiens
aaataaaacaagcct

SEQ ID NO: 6074428 - DNA, 19 bp, Homo sapiens
aaataaaacaagccttaat

SEQ ID NO: 6074429 - DNA, 16 bp, Homo sapiens
aaataaaacatagcaa

SEQ ID NO: 6074430 - DNA, 13 bp, Homo sapiens
aaataaaacattt

SEQ ID NO: 6074431 - DNA, 15 bp, Homo sapiens
aaataaaacatttta

SEQ ID NO: 6074432 - DNA, 23 bp, Homo sapiens
aaataaaacattttaaatggaca

SEQ ID NO: 6074433 - DNA, 20 bp, Homo sapiens
aaataaaacccaatactttt

SEQ ID NO: 6074434 - DNA, 14 bp, Homo sapiens
aaataaaacctcag

SEQ ID NO: 6074435 - DNA, 15 bp, Homo sapiens
aaataaaacctttca

SEQ ID NO: 6074436 - DNA, 12 bp, Homo sapiens
aaataaaactat

SEQ ID NO: 6074437 - DNA, 14 bp, Homo sapiens
aaataaaactattt

SEQ ID NO: 6074438 - DNA, 16 bp, Homo sapiens
aaataaaactttttaa

SEQ ID NO: 6074439 - DNA, 14 bp, Homo sapiens
aaataaaagaaaga

SEQ ID NO: 6074440 - DNA, 14 bp, Homo sapiens
aaataaaagcacaa

SEQ ID NO: 6074441 - DNA, 13 bp, Homo sapiens
aaataaaagcagc

SEQ ID NO: 6074442 - DNA, 19 bp, Homo sapiens
aaataaaagcagcatctgc

SEQ ID NO: 6074443 - DNA, 17 bp, Homo sapiens
aaataaaaggaagccaa

SEQ ID NO: 6074444 - DNA, 16 bp, Homo sapiens
aaataaaaggactctg

SEQ ID NO: 6074445 - DNA, 19 bp, Homo sapiens
aaataaaaggactctggaa

SEQ ID NO: 6074446 - DNA, 19 bp, Homo sapiens
aaataaaaggcttccagag

SEQ ID NO: 6074447 - DNA, 22 bp, Homo sapiens
aaataaaagtgaatgaaagatt

SEQ ID NO: 6074448 - DNA, 16 bp, Homo sapiens
aaataaaagtgatcaa

SEQ ID NO: 6074449 - DNA, 12 bp, Homo sapiens
aaataaaagttg

SEQ ID NO: 6074450 - DNA, 17 bp, Homo sapiens
aaataaaagttttacaa

SEQ ID NO: 6074451 - DNA, 13 bp, Homo sapiens
aaataaaataaac

SEQ ID NO: 6074452 - DNA, 13 bp, Homo sapiens
aaataaaataacc

SEQ ID NO: 6074453 - DNA, 14 bp, Homo sapiens
aaataaaatatatc

SEQ ID NO: 6074454 - DNA, 12 bp, Homo sapiens
aaataaaatcag

SEQ ID NO: 6074455 - DNA, 14 bp, Homo sapiens
aaataaaatgacca

SEQ ID NO: 6074456 - DNA, 23 bp, Homo sapiens
aaataaaatgccatagtttgtga

SEQ ID NO: 6074457 - DNA, 14 bp, Homo sapiens
aaataaaatgcctc

SEQ ID NO: 6074458 - DNA, 17 bp, Homo sapiens
aaataaaatgctaggtt

SEQ ID NO: 6074459 - DNA, 18 bp, Homo sapiens
aaataaaatggtgaaaga

SEQ ID NO: 6074460 - DNA, 17 bp, Homo sapiens
aaataaaatgtgtacag

SEQ ID NO: 6074461 - DNA, 15 bp, Homo sapiens
aaataaaattaagaa

SEQ ID NO: 6074462 - DNA, 12 bp, Homo sapiens
aaataaaattac

SEQ ID NO: 6074463 - DNA, 12 bp, Homo sapiens
aaataaaattat

SEQ ID NO: 6074464 - DNA, 14 bp, Homo sapiens
aaataaaattatat

SEQ ID NO: 6074465 - DNA, 13 bp, Homo sapiens
aaataaaatttac

SEQ ID NO: 6074466 - DNA, 16 bp, Homo sapiens
aaataaaatttgttgc

SEQ ID NO: 6074467 - DNA, 18 bp, Homo sapiens
aaataaaatttgttgcat

SEQ ID NO: 6074468 - DNA, 16 bp, Homo sapiens
aaataaacaaagtgaa

SEQ ID NO: 6074469 - DNA, 17 bp, Homo sapiens
aaataaacaaagtgaag

SEQ ID NO: 6074470 - DNA, 18 bp, Homo sapiens
aaataaacaaataacaat

SEQ ID NO: 6074471 - DNA, 16 bp, Homo sapiens
aaataaacaataagac

SEQ ID NO: 6074472 - DNA, 18 bp, Homo sapiens
aaataaacaataagacat

SEQ ID NO: 6074473 - DNA, 19 bp, Homo sapiens
aaataaacacatagattca

SEQ ID NO: 6074474 - DNA, 21 bp, Homo sapiens
aaataaacacatagattcacc

SEQ ID NO: 6074475 - DNA, 19 bp, Homo sapiens
aaataaacagatgtattat

SEQ ID NO: 6074476 - DNA, 14 bp, Homo sapiens
aaataaacagctat

SEQ ID NO: 6074477 - DNA, 19 bp, Homo sapiens
aaataaacagttgttactt

SEQ ID NO: 6074478 - DNA, 16 bp, Homo sapiens
aaataaacatcagttt

SEQ ID NO: 6074479 - DNA, 22 bp, Homo sapiens
aaataaacctggagatgatgat

SEQ ID NO: 6074480 - DNA, 18 bp, Homo sapiens
aaataaacgaaacattta

SEQ ID NO: 6074481 - DNA, 11 bp, Homo sapiens
aaataaactag

SEQ ID NO: 6074482 - DNA, 17 bp, Homo sapiens
aaataaactagtttcca

SEQ ID NO: 6074483 - DNA, 21 bp, Homo sapiens
aaataaactatttatatcaca

SEQ ID NO: 6074484 - DNA, 12 bp, Homo sapiens
aaataaactcat

SEQ ID NO: 6074485 - DNA, 14 bp, Homo sapiens
aaataaactcttca

SEQ ID NO: 6074486 - DNA, 15 bp, Homo sapiens
aaataaactcttcaa

SEQ ID NO: 6074487 - DNA, 20 bp, Homo sapiens
aaataaactcttcaaggcca

SEQ ID NO: 6074488 - DNA, 13 bp, Homo sapiens
aaataaactgttt

SEQ ID NO: 6074489 - DNA, 15 bp, Homo sapiens
aaataaacttacaga

SEQ ID NO: 6074490 - DNA, 11 bp, Homo sapiens
aaataaacttc

SEQ ID NO: 6074491 - DNA, 15 bp, Homo sapiens
aaataaacttcttaa

SEQ ID NO: 6074492 - DNA, 13 bp, Homo sapiens
aaataaactttct

SEQ ID NO: 6074493 - DNA, 12 bp, Homo sapiens
aaataaactttt

SEQ ID NO: 6074494 - DNA, 13 bp, Homo sapiens
aaataaacttttt

SEQ ID NO: 6074495 - DNA, 10 bp, Homo sapiens
aaataaagaa

SEQ ID NO: 6074496 - DNA, 11 bp, Homo sapiens
aaataaagaaa

SEQ ID NO: 6074497 - DNA, 17 bp, Homo sapiens
aaataaagaaatttggt

SEQ ID NO: 6074498 - DNA, 18 bp, Homo sapiens
aaataaagaaatttggta

SEQ ID NO: 6074499 - DNA, 16 bp, Homo sapiens
aaataaagaagaaaat

SEQ ID NO: 6074500 - DNA, 19 bp, Homo sapiens
aaataaagaagaaaataac

SEQ ID NO: 6074501 - DNA, 14 bp, Homo sapiens
aaataaagaagtat

SEQ ID NO: 6074502 - DNA, 18 bp, Homo sapiens
aaataaagaatagcaatt

SEQ ID NO: 6074503 - DNA, 19 bp, Homo sapiens
aaataaagaatatgccgtt

SEQ ID NO: 6074504 - DNA, 13 bp, Homo sapiens
aaataaagaatgg

SEQ ID NO: 6074505 - DNA, 16 bp, Homo sapiens
aaataaagaatggaaa

SEQ ID NO: 6074506 - DNA, 19 bp, Homo sapiens
aaataaagacaaccatatt

SEQ ID NO: 6074507 - DNA, 23 bp, Homo sapiens
aaataaagagaactccagtgttg

SEQ ID NO: 6074508 - DNA, 17 bp, Homo sapiens
aaataaagataaccctt

SEQ ID NO: 6074509 - DNA, 13 bp, Homo sapiens
aaataaagcaaat

SEQ ID NO: 6074510 - DNA, 14 bp, Homo sapiens
aaataaagcaatga

SEQ ID NO: 6074511 - DNA, 13 bp, Homo sapiens
aaataaagcagaa

SEQ ID NO: 6074512 - DNA, 12 bp, Homo sapiens
aaataaagccct

SEQ ID NO: 6074513 - DNA, 12 bp, Homo sapiens
aaataaagcctt

SEQ ID NO: 6074514 - DNA, 13 bp, Homo sapiens
aaataaagccttt

SEQ ID NO: 6074515 - DNA, 14 bp, Homo sapiens
aaataaagctactg

SEQ ID NO: 6074516 - DNA, 11 bp, Homo sapiens
aaataaagctc

SEQ ID NO: 6074517 - DNA, 17 bp, Homo sapiens
aaataaagctgtgacag

SEQ ID NO: 6074518 - DNA, 18 bp, Homo sapiens
aaataaagcttttgcata

SEQ ID NO: 6074519 - DNA, 18 bp, Homo sapiens
aaataaaggatttctaga

SEQ ID NO: 6074520 - DNA, 15 bp, Homo sapiens
aaataaaggctctgt

SEQ ID NO: 6074521 - DNA, 13 bp, Homo sapiens
aaataaaggtaca

SEQ ID NO: 6074522 - DNA, 21 bp, Homo sapiens
aaataaagtacgtgtttactt

SEQ ID NO: 6074523 - DNA, 15 bp, Homo sapiens
aaataaagtatcatg

SEQ ID NO: 6074524 - DNA, 19 bp, Homo sapiens
aaataaagtatcatgcatt

SEQ ID NO: 6074525 - DNA, 11 bp, Homo sapiens
aaataaagtct

SEQ ID NO: 6074526 - DNA, 13 bp, Homo sapiens
aaataaagtctct

SEQ ID NO: 6074527 - DNA, 15 bp, Homo sapiens
aaataaagtctgtca

SEQ ID NO: 6074528 - DNA, 18 bp, Homo sapiens
aaataaagtctgtcatgc

SEQ ID NO: 6074529 - DNA, 21 bp, Homo sapiens
aaataaagttaaactgattat

SEQ ID NO: 6074530 - DNA, 13 bp, Homo sapiens
aaataaagttgaa

SEQ ID NO: 6074531 - DNA, 15 bp, Homo sapiens
aaataaataatctca

SEQ ID NO: 6074532 - DNA, 19 bp, Homo sapiens
aaataaataatctcatccc

SEQ ID NO: 6074533 - DNA, 13 bp, Homo sapiens
aaataaataattt

SEQ ID NO: 6074534 - DNA, 15 bp, Homo sapiens
aaataaatacaagtt

SEQ ID NO: 6074535 - DNA, 13 bp, Homo sapiens
aaataaatatact

SEQ ID NO: 6074536 - DNA, 15 bp, Homo sapiens
aaataaatatactaa

SEQ ID NO: 6074537 - DNA, 23 bp, Homo sapiens
aaataaatatactaataaaaagg

SEQ ID NO: 6074538 - DNA, 15 bp, Homo sapiens
aaataaatatactca

SEQ ID NO: 6074539 - DNA, 16 bp, Homo sapiens
aaataaatattttaca

SEQ ID NO: 6074540 - DNA, 21 bp, Homo sapiens
aaataaatcatcctcatgtcc

SEQ ID NO: 6074541 - DNA, 16 bp, Homo sapiens
aaataaatccaagact

SEQ ID NO: 6074542 - DNA, 12 bp, Homo sapiens
aaataaatctaa

SEQ ID NO: 6074543 - DNA, 13 bp, Homo sapiens
aaataaatctaaa

SEQ ID NO: 6074544 - DNA, 17 bp, Homo sapiens
aaataaatctactgttt

SEQ ID NO: 6074545 - DNA, 12 bp, Homo sapiens
aaataaatctat

SEQ ID NO: 6074546 - DNA, 12 bp, Homo sapiens
aaataaatgaaa

SEQ ID NO: 6074547 - DNA, 12 bp, Homo sapiens
aaataaatgaat

SEQ ID NO: 6074548 - DNA, 15 bp, Homo sapiens
aaataaatgtatcat

SEQ ID NO: 6074549 - DNA, 16 bp, Homo sapiens
aaataaatgtatcata

SEQ ID NO: 6074550 - DNA, 21 bp, Homo sapiens
aaataaatgtatcatagaaat

SEQ ID NO: 6074551 - DNA, 20 bp, Homo sapiens
aaataaatgtcactgccaac

SEQ ID NO: 6074552 - DNA, 11 bp, Homo sapiens
aaataaatgtg

SEQ ID NO: 6074553 - DNA, 13 bp, Homo sapiens
aaataaatgttca

SEQ ID NO: 6074554 - DNA, 19 bp, Homo sapiens
aaataaatgttcatgattt

SEQ ID NO: 6074555 - DNA, 13 bp, Homo sapiens
aaataaatgtttc

SEQ ID NO: 6074556 - DNA, 17 bp, Homo sapiens
aaataaatgtttcaaat

SEQ ID NO: 6074557 - DNA, 16 bp, Homo sapiens
aaataaatgttttgga

SEQ ID NO: 6074558 - DNA, 13 bp, Homo sapiens
aaataaattaaga

SEQ ID NO: 6074559 - DNA, 17 bp, Homo sapiens
aaataaattaataaatt

SEQ ID NO: 6074560 - DNA, 15 bp, Homo sapiens
aaataaattatggct

SEQ ID NO: 6074561 - DNA, 12 bp, Homo sapiens
aaataaattcaa

SEQ ID NO: 6074562 - DNA, 13 bp, Homo sapiens
aaataaattcaaa

SEQ ID NO: 6074563 - DNA, 21 bp, Homo sapiens
aaataaattcagccaacatgt

SEQ ID NO: 6074564 - DNA, 15 bp, Homo sapiens
aaataaattcctaca

SEQ ID NO: 6074565 - DNA, 14 bp, Homo sapiens
aaataaattctctc

SEQ ID NO: 6074566 - DNA, 16 bp, Homo sapiens
aaataaattgaaatat

SEQ ID NO: 6074567 - DNA, 13 bp, Homo sapiens
aaataaattgtat

SEQ ID NO: 6074568 - DNA, 14 bp, Homo sapiens
aaataaattgtata

SEQ ID NO: 6074569 - DNA, 13 bp, Homo sapiens
cccagccagaaag

SEQ ID NO: 6074570 - DNA, 14 bp, Homo sapiens
cccagccagaaagc

SEQ ID NO: 6074571 - DNA, 13 bp, Homo sapiens
cccagccagaagt

SEQ ID NO: 6074572 - DNA, 20 bp, Homo sapiens
cccagccagagtttgcctcc

SEQ ID NO: 6074573 - DNA, 22 bp, Homo sapiens
cccagccagagtttgcctccct

SEQ ID NO: 6074574 - DNA, 12 bp, Homo sapiens
cccagccagcag

SEQ ID NO: 6074575 - DNA, 16 bp, Homo sapiens
cccagccagcagttca

SEQ ID NO: 6074576 - DNA, 24 bp, Homo sapiens
cccagccagcagttcagagctgcc

SEQ ID NO: 6074577 - DNA, 13 bp, Homo sapiens
cccagccagccac

SEQ ID NO: 6074578 - DNA, 17 bp, Homo sapiens
cccagccagccacccct

SEQ ID NO: 6074579 - DNA, 22 bp, Homo sapiens
cccagccagccacccctgccac

SEQ ID NO: 6074580 - DNA, 21 bp, Homo sapiens
cccagccagccatcggaagag

SEQ ID NO: 6074581 - DNA, 16 bp, Homo sapiens
cccagccagcccttcc

SEQ ID NO: 6074582 - DNA, 22 bp, Homo sapiens
cccagccagcccttcccaggcc

SEQ ID NO: 6074583 - DNA, 19 bp, Homo sapiens
cccagccagctcctttccc

SEQ ID NO: 6074584 - DNA, 19 bp, Homo sapiens
cccagccagctgcagggca

SEQ ID NO: 6074585 - DNA, 17 bp, Homo sapiens
cccagccaggaggggct

SEQ ID NO: 6074586 - DNA, 18 bp, Homo sapiens
cccagccaggccaacagc

SEQ ID NO: 6074587 - DNA, 22 bp, Homo sapiens
cccagccaggccaacagcacct

SEQ ID NO: 6074588 - DNA, 13 bp, Homo sapiens
cccagccaggccc

SEQ ID NO: 6074589 - DNA, 21 bp, Homo sapiens
cccagccaggccccaggcagg

SEQ ID NO: 6074590 - DNA, 14 bp, Homo sapiens
cccagccaggctcc

SEQ ID NO: 6074591 - DNA, 17 bp, Homo sapiens
cccagccaggctcctac

SEQ ID NO: 6074592 - DNA, 23 bp, Homo sapiens
cccagccagttggtggggccagg

SEQ ID NO: 6074593 - DNA, 20 bp, Homo sapiens
cccagccatctgcccagggg

SEQ ID NO: 6074594 - DNA, 22 bp, Homo sapiens
cccagccatgccagctggcctt

SEQ ID NO: 6074595 - DNA, 18 bp, Homo sapiens
cccagccatgcccaggac

SEQ ID NO: 6074596 - DNA, 12 bp, Homo sapiens
cccagccatggc

SEQ ID NO: 6074597 - DNA, 13 bp, Homo sapiens
cccagccatggct

SEQ ID NO: 6074598 - DNA, 23 bp, Homo sapiens
cccagccatgggccctctgagca

SEQ ID NO: 6074599 - DNA, 14 bp, Homo sapiens
cccagccatggggt

SEQ ID NO: 6074600 - DNA, 13 bp, Homo sapiens
cccagccatgtgt

SEQ ID NO: 6074601 - DNA, 13 bp, Homo sapiens
cccagcccaaagg

SEQ ID NO: 6074602 - DNA, 23 bp, Homo sapiens
cccagcccaagagatgaacatct

SEQ ID NO: 6074603 - DNA, 14 bp, Homo sapiens
cccagcccaataaa

SEQ ID NO: 6074604 - DNA, 19 bp, Homo sapiens
cccagcccaatccaggtac

SEQ ID NO: 6074605 - DNA, 12 bp, Homo sapiens
cccagcccacag

SEQ ID NO: 6074606 - DNA, 13 bp, Homo sapiens
cccagcccacaga

SEQ ID NO: 6074607 - DNA, 18 bp, Homo sapiens
cccagcccacagagcctg

SEQ ID NO: 6074608 - DNA, 13 bp, Homo sapiens
cccagcccacccc

SEQ ID NO: 6074609 - DNA, 13 bp, Homo sapiens
cccagcccaccct

SEQ ID NO: 6074610 - DNA, 16 bp, Homo sapiens
cccagcccaccctgct

SEQ ID NO: 6074611 - DNA, 21 bp, Homo sapiens
cccagcccacctcaacccaga

SEQ ID NO: 6074612 - DNA, 13 bp, Homo sapiens
cccagcccacctg

SEQ ID NO: 6074613 - DNA, 17 bp, Homo sapiens
cccagcccacctgctcc

SEQ ID NO: 6074614 - DNA, 14 bp, Homo sapiens
cccagcccacttct

SEQ ID NO: 6074615 - DNA, 17 bp, Homo sapiens
cccagcccacttctgcc

SEQ ID NO: 6074616 - DNA, 11 bp, Homo sapiens
cccagcccaga

SEQ ID NO: 6074617 - DNA, 15 bp, Homo sapiens
cccagcccagagaca

SEQ ID NO: 6074618 - DNA, 13 bp, Homo sapiens
cccagcccagagc

SEQ ID NO: 6074619 - DNA, 19 bp, Homo sapiens
cccagcccagagccacctg

SEQ ID NO: 6074620 - DNA, 21 bp, Homo sapiens
cccagcccagagccacctgga

SEQ ID NO: 6074621 - DNA, 12 bp, Homo sapiens
cccagcccagca

SEQ ID NO: 6074622 - DNA, 15 bp, Homo sapiens
cccagcccagctgct

SEQ ID NO: 6074623 - DNA, 16 bp, Homo sapiens
cccagcccagctggtg

SEQ ID NO: 6074624 - DNA, 13 bp, Homo sapiens
cccagcccatctt

SEQ ID NO: 6074625 - DNA, 15 bp, Homo sapiens
cccagcccattgctg

SEQ ID NO: 6074626 - DNA, 18 bp, Homo sapiens
cccagcccattgctgcca

SEQ ID NO: 6074627 - DNA, 14 bp, Homo sapiens
cccagccccaactc

SEQ ID NO: 6074628 - DNA, 18 bp, Homo sapiens
cccagccccaaggggtgg

SEQ ID NO: 6074629 - DNA, 15 bp, Homo sapiens
cccagccccactgcc

SEQ ID NO: 6074630 - DNA, 15 bp, Homo sapiens
cccagccccagagaa

SEQ ID NO: 6074631 - DNA, 17 bp, Homo sapiens
cccagccccagccaggg

SEQ ID NO: 6074632 - DNA, 14 bp, Homo sapiens
cccagccccagccc

SEQ ID NO: 6074633 - DNA, 14 bp, Homo sapiens
cccagccccagcga

SEQ ID NO: 6074634 - DNA, 12 bp, Homo sapiens
cccagccccagg

SEQ ID NO: 6074635 - DNA, 17 bp, Homo sapiens
cccagccccaggcctgg

SEQ ID NO: 6074636 - DNA, 22 bp, Homo sapiens
cccagccccaggcctggcctcg

SEQ ID NO: 6074637 - DNA, 16 bp, Homo sapiens
cccagccccaggggtg

SEQ ID NO: 6074638 - DNA, 12 bp, Homo sapiens
cccagccccatc

SEQ ID NO: 6074639 - DNA, 14 bp, Homo sapiens
cccagccccatcct

SEQ ID NO: 6074640 - DNA, 14 bp, Homo sapiens
cccagcccccacag

SEQ ID NO: 6074641 - DNA, 18 bp, Homo sapiens
cccagcccccacagccct

SEQ ID NO: 6074642 - DNA, 19 bp, Homo sapiens
cccagcccccacagccctg

SEQ ID NO: 6074643 - DNA, 20 bp, Homo sapiens
cccagcccccacagccctgg

SEQ ID NO: 6074644 - DNA, 21 bp, Homo sapiens
cccagcccccacagccctgga

SEQ ID NO: 6074645 - DNA, 24 bp, Homo sapiens
cccagcccccacagtgctgtctga

SEQ ID NO: 6074646 - DNA, 13 bp, Homo sapiens
cccagcccccacc

SEQ ID NO: 6074647 - DNA, 15 bp, Homo sapiens
cccagcccccacccc

SEQ ID NO: 6074648 - DNA, 18 bp, Homo sapiens
cccagcccccacctccgc

SEQ ID NO: 6074649 - DNA, 23 bp, Homo sapiens
cccagcccccacctccgccccag

SEQ ID NO: 6074650 - DNA, 19 bp, Homo sapiens
cccagccccctcccaccgc

SEQ ID NO: 6074651 - DNA, 21 bp, Homo sapiens
cccagccccctcccaccgctg

SEQ ID NO: 6074652 - DNA, 17 bp, Homo sapiens
cccagccccctggcatg

SEQ ID NO: 6074653 - DNA, 19 bp, Homo sapiens
cccagccccctggcatgtt

SEQ ID NO: 6074654 - DNA, 15 bp, Homo sapiens
cccagccccctttgg

SEQ ID NO: 6074655 - DNA, 16 bp, Homo sapiens
cccagccccgactcca

SEQ ID NO: 6074656 - DNA, 22 bp, Homo sapiens
cccagccccgactccagccagc

SEQ ID NO: 6074657 - DNA, 17 bp, Homo sapiens
cccagccccgctcaggc

SEQ ID NO: 6074658 - DNA, 22 bp, Homo sapiens
cccagccccggtggctgggcag

SEQ ID NO: 6074659 - DNA, 16 bp, Homo sapiens
cccagccccgtcccag

SEQ ID NO: 6074660 - DNA, 19 bp, Homo sapiens
cccagccccgtcccagagg

SEQ ID NO: 6074661 - DNA, 19 bp, Homo sapiens
cccagcccctaccttgaga

SEQ ID NO: 6074662 - DNA, 16 bp, Homo sapiens
cccagcccctagaaac

SEQ ID NO: 6074663 - DNA, 17 bp, Homo sapiens
cccagcccctagcccag

SEQ ID NO: 6074664 - DNA, 19 bp, Homo sapiens
cccagcccctcaaccctcc

SEQ ID NO: 6074665 - DNA, 14 bp, Homo sapiens
cccagcccctccac

SEQ ID NO: 6074666 - DNA, 23 bp, Homo sapiens
cccagcccctcctccccttcctg

SEQ ID NO: 6074667 - DNA, 20 bp, Homo sapiens
cccagcccctcctccctcag

SEQ ID NO: 6074668 - DNA, 21 bp, Homo sapiens
cccagcccctcctccctcaga

SEQ ID NO: 6074669 - DNA, 22 bp, Homo sapiens
cccagcccctcctccctcagac

SEQ ID NO: 6074670 - DNA, 22 bp, Homo sapiens
cccagcccctctcccctctctg

SEQ ID NO: 6074671 - DNA, 15 bp, Homo sapiens
cccagcccctgcccc

SEQ ID NO: 6074672 - DNA, 18 bp, Homo sapiens
cccagcccctgcccctca

SEQ ID NO: 6074673 - DNA, 12 bp, Homo sapiens
cccagcccctgg

SEQ ID NO: 6074674 - DNA, 18 bp, Homo sapiens
cccagcccctggtggtgg

SEQ ID NO: 6074675 - DNA, 21 bp, Homo sapiens
cccagccccttcccctgggaa

SEQ ID NO: 6074676 - DNA, 17 bp, Homo sapiens
cccagccccttctccca

SEQ ID NO: 6074677 - DNA, 22 bp, Homo sapiens
cccagccccttctcccagcaca

SEQ ID NO: 6074678 - DNA, 19 bp, Homo sapiens
cccagccccttttctctgc

SEQ ID NO: 6074679 - DNA, 20 bp, Homo sapiens
cccagccccttttctctgct

SEQ ID NO: 6074680 - DNA, 16 bp, Homo sapiens
cccagcccggctgacc

SEQ ID NO: 6074681 - DNA, 15 bp, Homo sapiens
cccagccctcaggcc

SEQ ID NO: 6074682 - DNA, 16 bp, Homo sapiens
cccagccctcaggcca

SEQ ID NO: 6074683 - DNA, 21 bp, Homo sapiens
cccagccctcaggccagtgcc

SEQ ID NO: 6074684 - DNA, 18 bp, Homo sapiens
cccagccctcagtcaccc

SEQ ID NO: 6074685 - DNA, 14 bp, Homo sapiens
cccagccctcatcc

SEQ ID NO: 6074686 - DNA, 15 bp, Homo sapiens
cccagccctcccagc

SEQ ID NO: 6074687 - DNA, 16 bp, Homo sapiens
cccagccctcccagct

SEQ ID NO: 6074688 - DNA, 15 bp, Homo sapiens
cccagccctccccac

SEQ ID NO: 6074689 - DNA, 20 bp, Homo sapiens
cccagccctccccacctgct

SEQ ID NO: 6074690 - DNA, 20 bp, Homo sapiens
cccagccctccccgcagtgg

SEQ ID NO: 6074691 - DNA, 23 bp, Homo sapiens
cccagccctccttatcaaaggac

SEQ ID NO: 6074692 - DNA, 22 bp, Homo sapiens
cccagccctcgcctctgcgaga

SEQ ID NO: 6074693 - DNA, 14 bp, Homo sapiens
cccagccctctgtg

SEQ ID NO: 6074694 - DNA, 16 bp, Homo sapiens
cccagccctctgtggc

SEQ ID NO: 6074695 - DNA, 13 bp, Homo sapiens
cccagccctgagg

SEQ ID NO: 6074696 - DNA, 14 bp, Homo sapiens
cccagccctgccag

SEQ ID NO: 6074697 - DNA, 16 bp, Homo sapiens
cccagccctgcccaga

SEQ ID NO: 6074698 - DNA, 19 bp, Homo sapiens
cccagccctgctggccgcc

SEQ ID NO: 6074699 - DNA, 15 bp, Homo sapiens
cccagccctgctggg

SEQ ID NO: 6074700 - DNA, 17 bp, Homo sapiens
cccagccctgctgggga

SEQ ID NO: 6074701 - DNA, 13 bp, Homo sapiens
cccagccctggcc

SEQ ID NO: 6074702 - DNA, 12 bp, Homo sapiens
cccagccctggg

SEQ ID NO: 6074703 - DNA, 21 bp, Homo sapiens
cccagccctgggaaccactcc

SEQ ID NO: 6074704 - DNA, 23 bp, Homo sapiens
cccagccctgggaaccactccca

SEQ ID NO: 6074705 - DNA, 13 bp, Homo sapiens
cccagccctgggc

SEQ ID NO: 6074706 - DNA, 18 bp, Homo sapiens
cccagccctggtctcagc

SEQ ID NO: 6074707 - DNA, 21 bp, Homo sapiens
cccagccctggtctcagcagc

SEQ ID NO: 6074708 - DNA, 16 bp, Homo sapiens
cccagcccttctgcct

SEQ ID NO: 6074709 - DNA, 17 bp, Homo sapiens
cccagccctttccaggg

SEQ ID NO: 6074710 - DNA, 21 bp, Homo sapiens
cccagccctttgggaggctga

SEQ ID NO: 6074711 - DNA, 14 bp, Homo sapiens
cccagccgctcgga

SEQ ID NO: 6074712 - DNA, 17 bp, Homo sapiens
cccagccgctgcccggc

SEQ ID NO: 6074713 - DNA, 17 bp, Homo sapiens
cccagccggcctctctg

SEQ ID NO: 6074714 - DNA, 19 bp, Homo sapiens
cccagccggcctctctggc

SEQ ID NO: 6074715 - DNA, 22 bp, Homo sapiens
cccagccggggtggggtgcctg

SEQ ID NO: 6074716 - DNA, 19 bp, Homo sapiens
cccagccgtcgtctccctc

SEQ ID NO: 6074717 - DNA, 17 bp, Homo sapiens
cccagcctacccttcct

SEQ ID NO: 6074718 - DNA, 18 bp, Homo sapiens
cccagcctacctctccac

SEQ ID NO: 6074719 - DNA, 15 bp, Homo sapiens
cccagcctagcccac

SEQ ID NO: 6074720 - DNA, 16 bp, Homo sapiens
cccagcctagcccact

SEQ ID NO: 6074721 - DNA, 23 bp, Homo sapiens
cccagcctaggacgccaacttct

SEQ ID NO: 6074722 - DNA, 17 bp, Homo sapiens
cccagcctaggtggagg

SEQ ID NO: 6074723 - DNA, 18 bp, Homo sapiens
cccagcctatcaggtgcc

SEQ ID NO: 6074724 - DNA, 15 bp, Homo sapiens
cccagcctatgagca

SEQ ID NO: 6074725 - DNA, 20 bp, Homo sapiens
cccagcctcaatgtcacttg

SEQ ID NO: 6074726 - DNA, 20 bp, Homo sapiens
cccagcctcagaagccttct

SEQ ID NO: 6074727 - DNA, 20 bp, Homo sapiens
cccagcctcagcgcggccct

SEQ ID NO: 6074728 - DNA, 22 bp, Homo sapiens
cccagcctcagcgcggccctcc

SEQ ID NO: 6074729 - DNA, 16 bp, Homo sapiens
cccagcctcagtcctc

SEQ ID NO: 6074730 - DNA, 14 bp, Homo sapiens
cccagcctcattgt

SEQ ID NO: 6074731 - DNA, 14 bp, Homo sapiens
cccagcctcccagc

SEQ ID NO: 6074732 - DNA, 19 bp, Homo sapiens
cccagcctcccagctttct

SEQ ID NO: 6074733 - DNA, 17 bp, Homo sapiens
cccagcctcctcccacc

SEQ ID NO: 6074734 - DNA, 19 bp, Homo sapiens
cccagcctcctgagggctc

SEQ ID NO: 6074735 - DNA, 21 bp, Homo sapiens
cccagcctcctgagggctcca

SEQ ID NO: 6074736 - DNA, 18 bp, Homo sapiens
cccagcctcgcatgccag

SEQ ID NO: 6074737 - DNA, 17 bp, Homo sapiens
cccagcctcgcctgtca

SEQ ID NO: 6074738 - DNA, 21 bp, Homo sapiens
cccagcctcgcctgtcacccc

SEQ ID NO: 6074739 - DNA, 18 bp, Homo sapiens
cccagcctcgttggagag

SEQ ID NO: 6074740 - DNA, 22 bp, Homo sapiens
cccagcctctccccgctctgga

SEQ ID NO: 6074741 - DNA, 14 bp, Homo sapiens
cccagcctctctgg

SEQ ID NO: 6074742 - DNA, 18 bp, Homo sapiens
cccagcctctctggctca

SEQ ID NO: 6074743 - DNA, 20 bp, Homo sapiens
cccagcctctctggctcagc

SEQ ID NO: 6074744 - DNA, 15 bp, Homo sapiens
cccagcctctgcccc

SEQ ID NO: 6074745 - DNA, 16 bp, Homo sapiens
cccagcctctgcccca

SEQ ID NO: 6074746 - DNA, 17 bp, Homo sapiens
cccagcctctggggcag

SEQ ID NO: 6074747 - DNA, 13 bp, Homo sapiens
cccagcctcttcc

SEQ ID NO: 6074748 - DNA, 22 bp, Homo sapiens
aaataaattgtatattcacttt

SEQ ID NO: 6074749 - DNA, 15 bp, Homo sapiens
aaataaattgtttga

SEQ ID NO: 6074750 - DNA, 17 bp, Homo sapiens
aaataaatttatatgaa

SEQ ID NO: 6074751 - DNA, 14 bp, Homo sapiens
aaataaatttgact

SEQ ID NO: 6074752 - DNA, 19 bp, Homo sapiens
aaataaatttggttctaat

SEQ ID NO: 6074753 - DNA, 13 bp, Homo sapiens
aaataaattttaa

SEQ ID NO: 6074754 - DNA, 14 bp, Homo sapiens
aaataaattttaaa

SEQ ID NO: 6074755 - DNA, 15 bp, Homo sapiens
aaataaattttgaat

SEQ ID NO: 6074756 - DNA, 13 bp, Homo sapiens
aaataaattttgt

SEQ ID NO: 6074757 - DNA, 16 bp, Homo sapiens
aaataacaaaattttt

SEQ ID NO: 6074758 - DNA, 23 bp, Homo sapiens
aaataacaaatctcaagcaaaca

SEQ ID NO: 6074759 - DNA, 20 bp, Homo sapiens
aaataacaacttttttttct

SEQ ID NO: 6074760 - DNA, 22 bp, Homo sapiens
aaataacaagtaccaaagtttt

SEQ ID NO: 6074761 - DNA, 21 bp, Homo sapiens
aaataacaagtcgatgaacta

SEQ ID NO: 6074762 - DNA, 14 bp, Homo sapiens
aaataacaatgtgc

SEQ ID NO: 6074763 - DNA, 17 bp, Homo sapiens
aaataacaatgttaagg

SEQ ID NO: 6074764 - DNA, 13 bp, Homo sapiens
aaataacacacat

SEQ ID NO: 6074765 - DNA, 21 bp, Homo sapiens
aaataacacacatataaacat

SEQ ID NO: 6074766 - DNA, 15 bp, Homo sapiens
aaataacacagagag

SEQ ID NO: 6074767 - DNA, 17 bp, Homo sapiens
aaataacagaagaaaat

SEQ ID NO: 6074768 - DNA, 16 bp, Homo sapiens
aaataacagctttctt

SEQ ID NO: 6074769 - DNA, 20 bp, Homo sapiens
aaataacaggcatttgttca

SEQ ID NO: 6074770 - DNA, 14 bp, Homo sapiens
aaataacatattct

SEQ ID NO: 6074771 - DNA, 15 bp, Homo sapiens
aaataacattctgaa

SEQ ID NO: 6074772 - DNA, 16 bp, Homo sapiens
aaataacattctgaat

SEQ ID NO: 6074773 - DNA, 12 bp, Homo sapiens
aaataacattgc

SEQ ID NO: 6074774 - DNA, 15 bp, Homo sapiens
aaataacattgcact

SEQ ID NO: 6074775 - DNA, 16 bp, Homo sapiens
aaataaccacaaggtc

SEQ ID NO: 6074776 - DNA, 20 bp, Homo sapiens
aaataaccacaaggtccact

SEQ ID NO: 6074777 - DNA, 16 bp, Homo sapiens
aaataaccacactgaa

SEQ ID NO: 6074778 - DNA, 18 bp, Homo sapiens
aaataaccccattctttg

SEQ ID NO: 6074779 - DNA, 14 bp, Homo sapiens
aaataacctatttt

SEQ ID NO: 6074780 - DNA, 15 bp, Homo sapiens
aaataactaaaatgt

SEQ ID NO: 6074781 - DNA, 21 bp, Homo sapiens
aaataactatataagacatta

SEQ ID NO: 6074782 - DNA, 18 bp, Homo sapiens
aaataactgaatttggag

SEQ ID NO: 6074783 - DNA, 21 bp, Homo sapiens
aaataactggaaaacagaaca

SEQ ID NO: 6074784 - DNA, 20 bp, Homo sapiens
aaataactggaacaaattat

SEQ ID NO: 6074785 - DNA, 20 bp, Homo sapiens
aaataactggaagtgaagag

SEQ ID NO: 6074786 - DNA, 13 bp, Homo sapiens
aaataactgtaat

SEQ ID NO: 6074787 - DNA, 14 bp, Homo sapiens
aaataactgtgact

SEQ ID NO: 6074788 - DNA, 16 bp, Homo sapiens
aaataacttcagtcct

SEQ ID NO: 6074789 - DNA, 15 bp, Homo sapiens
aaataacttgcatct

SEQ ID NO: 6074790 - DNA, 17 bp, Homo sapiens
aaataacttgccatttc

SEQ ID NO: 6074791 - DNA, 19 bp, Homo sapiens
aaataacttgccatttctt

SEQ ID NO: 6074792 - DNA, 22 bp, Homo sapiens
aaataacttgccatttctttat

SEQ ID NO: 6074793 - DNA, 15 bp, Homo sapiens
aaataagaaaaatat

SEQ ID NO: 6074794 - DNA, 13 bp, Homo sapiens
aaataagaaaaga

SEQ ID NO: 6074795 - DNA, 22 bp, Homo sapiens
aaataagacaatagtatttctc

SEQ ID NO: 6074796 - DNA, 23 bp, Homo sapiens
aaataagacggatttatttttcc

SEQ ID NO: 6074797 - DNA, 14 bp, Homo sapiens
aaataagacttctg

SEQ ID NO: 6074798 - DNA, 15 bp, Homo sapiens
aaataagagttgctt

SEQ ID NO: 6074799 - DNA, 14 bp, Homo sapiens
aaataagatggaaa

SEQ ID NO: 6074800 - DNA, 18 bp, Homo sapiens
aaataagccaaaataaga

SEQ ID NO: 6074801 - DNA, 21 bp, Homo sapiens
aaataagcccagtgctgctgt

SEQ ID NO: 6074802 - DNA, 15 bp, Homo sapiens
aaataagcgtttaat

SEQ ID NO: 6074803 - DNA, 12 bp, Homo sapiens
aaataagctatt

SEQ ID NO: 6074804 - DNA, 18 bp, Homo sapiens
aaataagctcgagtgaat

SEQ ID NO: 6074805 - DNA, 17 bp, Homo sapiens
aaataaggacagcagct

SEQ ID NO: 6074806 - DNA, 20 bp, Homo sapiens
aaataaggatgactttagaa

SEQ ID NO: 6074807 - DNA, 18 bp, Homo sapiens
aaataagggcagagtcac

SEQ ID NO: 6074808 - DNA, 14 bp, Homo sapiens
aaataaggtgtatt

SEQ ID NO: 6074809 - DNA, 21 bp, Homo sapiens
aaataagtaacatataaatta

SEQ ID NO: 6074810 - DNA, 13 bp, Homo sapiens
aaataagtatcca

SEQ ID NO: 6074811 - DNA, 12 bp, Homo sapiens
aaataagtattt

SEQ ID NO: 6074812 - DNA, 14 bp, Homo sapiens
aaataagtatttat

SEQ ID NO: 6074813 - DNA, 17 bp, Homo sapiens
aaataagtatttataat

SEQ ID NO: 6074814 - DNA, 17 bp, Homo sapiens
aaataagtcaaaaggaa

SEQ ID NO: 6074815 - DNA, 15 bp, Homo sapiens
aaataagtcaacagt

SEQ ID NO: 6074816 - DNA, 18 bp, Homo sapiens
aaataagtcaacagtaaa

SEQ ID NO: 6074817 - DNA, 18 bp, Homo sapiens
aaataagtcctaaagtga

SEQ ID NO: 6074818 - DNA, 12 bp, Homo sapiens
aaataagtctga

SEQ ID NO: 6074819 - DNA, 16 bp, Homo sapiens
aaataagtctgattta

SEQ ID NO: 6074820 - DNA, 15 bp, Homo sapiens
aaataagtgaaattt

SEQ ID NO: 6074821 - DNA, 19 bp, Homo sapiens
aaataagtgtattttgaaa

SEQ ID NO: 6074822 - DNA, 15 bp, Homo sapiens
aaataagttgtttca

SEQ ID NO: 6074823 - DNA, 11 bp, Homo sapiens
aaataagtttt

SEQ ID NO: 6074824 - DNA, 22 bp, Homo sapiens
aaataagttttatacataaaca

SEQ ID NO: 6074825 - DNA, 13 bp, Homo sapiens
aaataagtttttc

SEQ ID NO: 6074826 - DNA, 14 bp, Homo sapiens
aaataagtttttgc

SEQ ID NO: 6074827 - DNA, 14 bp, Homo sapiens
aaataataaaagat

SEQ ID NO: 6074828 - DNA, 19 bp, Homo sapiens
aaataataaaagctaggcg

SEQ ID NO: 6074829 - DNA, 14 bp, Homo sapiens
aaataataaaatgc

SEQ ID NO: 6074830 - DNA, 17 bp, Homo sapiens
aaataataaagtaattg

SEQ ID NO: 6074831 - DNA, 11 bp, Homo sapiens
aaataataaat

SEQ ID NO: 6074832 - DNA, 12 bp, Homo sapiens
aaataataaatc

SEQ ID NO: 6074833 - DNA, 13 bp, Homo sapiens
aaataataaatta

SEQ ID NO: 6074834 - DNA, 17 bp, Homo sapiens
aaataataaattaacat

SEQ ID NO: 6074835 - DNA, 21 bp, Homo sapiens
aaataataaattaacattata

SEQ ID NO: 6074836 - DNA, 14 bp, Homo sapiens
aaataataataaag

SEQ ID NO: 6074837 - DNA, 15 bp, Homo sapiens
aaataataataatgt

SEQ ID NO: 6074838 - DNA, 19 bp, Homo sapiens
aaataataccttagaaggt

SEQ ID NO: 6074839 - DNA, 18 bp, Homo sapiens
aaataatataaatgaatg

SEQ ID NO: 6074840 - DNA, 17 bp, Homo sapiens
aaataatatatttcttc

SEQ ID NO: 6074841 - DNA, 18 bp, Homo sapiens
aaataatatctctaatat

SEQ ID NO: 6074842 - DNA, 12 bp, Homo sapiens
aaataatatgca

SEQ ID NO: 6074843 - DNA, 12 bp, Homo sapiens
aaataatattca

SEQ ID NO: 6074844 - DNA, 13 bp, Homo sapiens
aaataatattcat

SEQ ID NO: 6074845 - DNA, 15 bp, Homo sapiens
aaataatcaaaagct

SEQ ID NO: 6074846 - DNA, 14 bp, Homo sapiens
aaataatcaagatt

SEQ ID NO: 6074847 - DNA, 15 bp, Homo sapiens
aaataatcaagattt

SEQ ID NO: 6074848 - DNA, 18 bp, Homo sapiens
aaataatcatacacagaa

SEQ ID NO: 6074849 - DNA, 14 bp, Homo sapiens
aaataatcattctt

SEQ ID NO: 6074850 - DNA, 20 bp, Homo sapiens
aaataatccattccaaaata

SEQ ID NO: 6074851 - DNA, 15 bp, Homo sapiens
aaataatcggcccac

SEQ ID NO: 6074852 - DNA, 13 bp, Homo sapiens
aaataatctacat

SEQ ID NO: 6074853 - DNA, 23 bp, Homo sapiens
aaataatctatttctatgagaaa

SEQ ID NO: 6074854 - DNA, 23 bp, Homo sapiens
aaataatctcatccccaaactgt

SEQ ID NO: 6074855 - DNA, 13 bp, Homo sapiens
aaataatctctga

SEQ ID NO: 6074856 - DNA, 14 bp, Homo sapiens
aaataatctggtgt

SEQ ID NO: 6074857 - DNA, 21 bp, Homo sapiens
aaataatctgtgagtgaaagt

SEQ ID NO: 6074858 - DNA, 15 bp, Homo sapiens
aaataatgaacagca

SEQ ID NO: 6074859 - DNA, 13 bp, Homo sapiens
aaataatgaataa

SEQ ID NO: 6074860 - DNA, 12 bp, Homo sapiens
aaataatgaatc

SEQ ID NO: 6074861 - DNA, 13 bp, Homo sapiens
aaataatgaatct

SEQ ID NO: 6074862 - DNA, 20 bp, Homo sapiens
aaataatgattcaatgtgaa

SEQ ID NO: 6074863 - DNA, 13 bp, Homo sapiens
aaataatgattta

SEQ ID NO: 6074864 - DNA, 13 bp, Homo sapiens
aaataatgctgca

SEQ ID NO: 6074865 - DNA, 23 bp, Homo sapiens
aaataatgtactgaattctttat

SEQ ID NO: 6074866 - DNA, 22 bp, Homo sapiens
aaataatgtagttttgtttatg

SEQ ID NO: 6074867 - DNA, 12 bp, Homo sapiens
aaataatgtctc

SEQ ID NO: 6074868 - DNA, 22 bp, Homo sapiens
aaataatgtgaaactggattaa

SEQ ID NO: 6074869 - DNA, 23 bp, Homo sapiens
aaataatgttctgtcacgtgaaa

SEQ ID NO: 6074870 - DNA, 15 bp, Homo sapiens
aaataattaaaacaa

SEQ ID NO: 6074871 - DNA, 12 bp, Homo sapiens
aaataattaaat

SEQ ID NO: 6074872 - DNA, 22 bp, Homo sapiens
aaataattaaatctctttaaga

SEQ ID NO: 6074873 - DNA, 15 bp, Homo sapiens
aaataattacttttg

SEQ ID NO: 6074874 - DNA, 17 bp, Homo sapiens
aaataattaggtatttt

SEQ ID NO: 6074875 - DNA, 23 bp, Homo sapiens
aaataattatataactgtatttg

SEQ ID NO: 6074876 - DNA, 12 bp, Homo sapiens
aaataattcata

SEQ ID NO: 6074877 - DNA, 13 bp, Homo sapiens
aaataattctttt

SEQ ID NO: 6074878 - DNA, 21 bp, Homo sapiens
aaataattcttttttattaat

SEQ ID NO: 6074879 - DNA, 17 bp, Homo sapiens
aaataattgatttcaag

SEQ ID NO: 6074880 - DNA, 20 bp, Homo sapiens
aaataattgccatagaaagt

SEQ ID NO: 6074881 - DNA, 15 bp, Homo sapiens
aaataattgtgtcat

SEQ ID NO: 6074882 - DNA, 18 bp, Homo sapiens
aaataattgttgtgtgta

SEQ ID NO: 6074883 - DNA, 11 bp, Homo sapiens
aaataatttaa

SEQ ID NO: 6074884 - DNA, 19 bp, Homo sapiens
aaataatttaactaattta

SEQ ID NO: 6074885 - DNA, 20 bp, Homo sapiens
aaataatttatatgcatgca

SEQ ID NO: 6074886 - DNA, 14 bp, Homo sapiens
aaataatttatttt

SEQ ID NO: 6074887 - DNA, 19 bp, Homo sapiens
aaataatttgaactttgga

SEQ ID NO: 6074888 - DNA, 20 bp, Homo sapiens
aaataatttgaactttggaa

SEQ ID NO: 6074889 - DNA, 23 bp, Homo sapiens
aaataatttgaatgtatttgatt

SEQ ID NO: 6074890 - DNA, 15 bp, Homo sapiens
aaataatttgtgtct

SEQ ID NO: 6074891 - DNA, 21 bp, Homo sapiens
aaataatttgtgtctgtgttt

SEQ ID NO: 6074892 - DNA, 18 bp, Homo sapiens
aaataattttaaaaatgg

SEQ ID NO: 6074893 - DNA, 14 bp, Homo sapiens
aaataattttaaac

SEQ ID NO: 6074894 - DNA, 20 bp, Homo sapiens
aaataattttacatgtctca

SEQ ID NO: 6074895 - DNA, 13 bp, Homo sapiens
aaataattttagt

SEQ ID NO: 6074896 - DNA, 22 bp, Homo sapiens
aaataattttatgaactgcatg

SEQ ID NO: 6074897 - DNA, 23 bp, Homo sapiens
aaataattttatgaactgcatgt

SEQ ID NO: 6074898 - DNA, 17 bp, Homo sapiens
aaataattttctaagac

SEQ ID NO: 6074899 - DNA, 12 bp, Homo sapiens
aaataattttgt

SEQ ID NO: 6074900 - DNA, 14 bp, Homo sapiens
aaataattttgtaa

SEQ ID NO: 6074901 - DNA, 17 bp, Homo sapiens
aaataattttgttttaa

SEQ ID NO: 6074902 - DNA, 18 bp, Homo sapiens
aaataatttttatatttg

SEQ ID NO: 6074903 - DNA, 20 bp, Homo sapiens
aaataatttttatatttgaa

SEQ ID NO: 6074904 - DNA, 20 bp, Homo sapiens
aaataatttttcttacacat

SEQ ID NO: 6074905 - DNA, 15 bp, Homo sapiens
aaataattttttgca

SEQ ID NO: 6074906 - DNA, 15 bp, Homo sapiens
aaatacaaaaaatta

SEQ ID NO: 6074907 - DNA, 17 bp, Homo sapiens
aaatacaaaaaattagc

SEQ ID NO: 6074908 - DNA, 15 bp, Homo sapiens
aaatacaaaaatact

SEQ ID NO: 6074909 - DNA, 13 bp, Homo sapiens
aaatacaaaataa

SEQ ID NO: 6074910 - DNA, 18 bp, Homo sapiens
aaatacaaaataaaatta

SEQ ID NO: 6074911 - DNA, 21 bp, Homo sapiens
aaatacaaaataaaattatgg

SEQ ID NO: 6074912 - DNA, 20 bp, Homo sapiens
aaatacaaagtaaatacaag

SEQ ID NO: 6074913 - DNA, 14 bp, Homo sapiens
aaatacaaatctgt

SEQ ID NO: 6074914 - DNA, 18 bp, Homo sapiens
aaatacaaatctgtataa

SEQ ID NO: 6074915 - DNA, 15 bp, Homo sapiens
aaatacaaattttgt

SEQ ID NO: 6074916 - DNA, 20 bp, Homo sapiens
aaatacaaccagaaacaatg

SEQ ID NO: 6074917 - DNA, 19 bp, Homo sapiens
aaatacaagactgttgtga

SEQ ID NO: 6074918 - DNA, 21 bp, Homo sapiens
aaatacaagccaagctagaag

SEQ ID NO: 6074919 - DNA, 21 bp, Homo sapiens
aaatacaagttaaggtatctg

SEQ ID NO: 6074920 - DNA, 16 bp, Homo sapiens
aaatacaagttctatt

SEQ ID NO: 6074921 - DNA, 17 bp, Homo sapiens
aaatacaagttctattt

SEQ ID NO: 6074922 - DNA, 14 bp, Homo sapiens
aaatacaagttctt

SEQ ID NO: 6074923 - DNA, 18 bp, Homo sapiens
aaatacaagtttgaacag

SEQ ID NO: 6074924 - DNA, 23 bp, Homo sapiens
aaatacaatcagcccagtgcaaa

SEQ ID NO: 6074925 - DNA, 16 bp, Homo sapiens
aaatacaattattgta

SEQ ID NO: 6074926 - DNA, 19 bp, Homo sapiens
aaatacaattattgtatat

SEQ ID NO: 6074927 - DNA, 17 bp, Homo sapiens
aaatacaattttgtttc

SEQ ID NO: 6074928 - DNA, 21 bp, Homo sapiens
aaatacaattttgtttctgta

SEQ ID NO: 6074929 - DNA, 23 bp, Homo sapiens
aaatacacagatgattaaacaga

SEQ ID NO: 6074930 - DNA, 15 bp, Homo sapiens
aaatacacatacata

SEQ ID NO: 6074931 - DNA, 16 bp, Homo sapiens
aaatacacatacatat

SEQ ID NO: 6074932 - DNA, 16 bp, Homo sapiens
aaatacacatggaaaa

SEQ ID NO: 6074933 - DNA, 16 bp, Homo sapiens
aaatacacatttcaca

SEQ ID NO: 6074934 - DNA, 13 bp, Homo sapiens
aaatacacatttg

SEQ ID NO: 6074935 - DNA, 22 bp, Homo sapiens
aaatacaccacctcactcctgt

SEQ ID NO: 6074936 - DNA, 23 bp, Homo sapiens
aaatacaccacctcactcctgtt

SEQ ID NO: 6074937 - DNA, 18 bp, Homo sapiens
aaatacaccgtttagaaa

SEQ ID NO: 6074938 - DNA, 15 bp, Homo sapiens
aaatacacgtgtata

SEQ ID NO: 6074939 - DNA, 16 bp, Homo sapiens
aaatacacgtgtatat

SEQ ID NO: 6074940 - DNA, 15 bp, Homo sapiens
aaatacactacaaat

SEQ ID NO: 6074941 - DNA, 16 bp, Homo sapiens
aaatacactacaaatg

SEQ ID NO: 6074942 - DNA, 17 bp, Homo sapiens
aaatacactgaattgaa

SEQ ID NO: 6074943 - DNA, 16 bp, Homo sapiens
aaatacactgtgaaga

SEQ ID NO: 6074944 - DNA, 14 bp, Homo sapiens
aaatacacttcttt

SEQ ID NO: 6074945 - DNA, 14 bp, Homo sapiens
aaatacagacacta

SEQ ID NO: 6074946 - DNA, 17 bp, Homo sapiens
aaatacagattttgata

SEQ ID NO: 6074947 - DNA, 14 bp, Homo sapiens
aaatacagcaatta

SEQ ID NO: 6074948 - DNA, 13 bp, Homo sapiens
aaatacaggaaac

SEQ ID NO: 6074949 - DNA, 13 bp, Homo sapiens
aaatacaggaaga

SEQ ID NO: 6074950 - DNA, 14 bp, Homo sapiens
aaatacagtaaagt

SEQ ID NO: 6074951 - DNA, 15 bp, Homo sapiens
aaatacagtaaagtt

SEQ ID NO: 6074952 - DNA, 16 bp, Homo sapiens
aaatacagtaaagttt

SEQ ID NO: 6074953 - DNA, 16 bp, Homo sapiens
aaatacagtattctgt

SEQ ID NO: 6074954 - DNA, 13 bp, Homo sapiens
aaatacagtgctt

SEQ ID NO: 6074955 - DNA, 15 bp, Homo sapiens
aaatacataaaagaa

SEQ ID NO: 6074956 - DNA, 17 bp, Homo sapiens
aaatacataacttcagt

SEQ ID NO: 6074957 - DNA, 19 bp, Homo sapiens
aaatacataacttcagtgc

SEQ ID NO: 6074958 - DNA, 21 bp, Homo sapiens
aaatacatcctttttctgcta

SEQ ID NO: 6074959 - DNA, 13 bp, Homo sapiens
aaatacatctttt

SEQ ID NO: 6074960 - DNA, 20 bp, Homo sapiens
aaatacatgaagcttcatgc

SEQ ID NO: 6074961 - DNA, 14 bp, Homo sapiens
aaatacatgatgat

SEQ ID NO: 6074962 - DNA, 12 bp, Homo sapiens
aaatacatgcac

SEQ ID NO: 6074963 - DNA, 17 bp, Homo sapiens
aaatacatgcacagtca

SEQ ID NO: 6074964 - DNA, 14 bp, Homo sapiens
aaatacatgcatct

SEQ ID NO: 6074965 - DNA, 23 bp, Homo sapiens
aaatacatgccacatcaaacctt

SEQ ID NO: 6074966 - DNA, 11 bp, Homo sapiens
aaatacatgta

SEQ ID NO: 6074967 - DNA, 21 bp, Homo sapiens
aaatacatgtgtggatgtgta

SEQ ID NO: 6074968 - DNA, 19 bp, Homo sapiens
aaatacatgttgtaaatgg

SEQ ID NO: 6074969 - DNA, 12 bp, Homo sapiens
aaatacattaac

SEQ ID NO: 6074970 - DNA, 19 bp, Homo sapiens
aaatacattataacaacta

SEQ ID NO: 6074971 - DNA, 22 bp, Homo sapiens
aaatacattataacaactattt

SEQ ID NO: 6074972 - DNA, 12 bp, Homo sapiens
aaatacattatt

SEQ ID NO: 6074973 - DNA, 19 bp, Homo sapiens
aaatacattattagaatat

SEQ ID NO: 6074974 - DNA, 15 bp, Homo sapiens
aaatacattccagtg

SEQ ID NO: 6074975 - DNA, 22 bp, Homo sapiens
aaatacattccttttagagtta

SEQ ID NO: 6074976 - DNA, 15 bp, Homo sapiens
aaatacattcttaaa

SEQ ID NO: 6074977 - DNA, 16 bp, Homo sapiens
aaatacattcttaaac

SEQ ID NO: 6074978 - DNA, 13 bp, Homo sapiens
aaatacattcttt

SEQ ID NO: 6074979 - DNA, 19 bp, Homo sapiens
aaatacattctttttgctc

SEQ ID NO: 6074980 - DNA, 21 bp, Homo sapiens
aaataccaaaattatttcaga

SEQ ID NO: 6074981 - DNA, 23 bp, Homo sapiens
aaataccaaaattatttcagaaa

SEQ ID NO: 6074982 - DNA, 15 bp, Homo sapiens
aaataccaaatgcct

SEQ ID NO: 6074983 - DNA, 14 bp, Homo sapiens
aaataccaactgaa

SEQ ID NO: 6074984 - DNA, 14 bp, Homo sapiens
aaataccacaagcc

SEQ ID NO: 6074985 - DNA, 14 bp, Homo sapiens
aaataccagagcct

SEQ ID NO: 6074986 - DNA, 22 bp, Homo sapiens
aaataccagagccttcaagtgc

SEQ ID NO: 6074987 - DNA, 18 bp, Homo sapiens
aaataccagccagtaaat

SEQ ID NO: 6074988 - DNA, 18 bp, Homo sapiens
aaataccaggaccagttt

SEQ ID NO: 6074989 - DNA, 19 bp, Homo sapiens
aaataccataggaagacat

SEQ ID NO: 6074990 - DNA, 21 bp, Homo sapiens
aaataccatgccatttaaagc

SEQ ID NO: 6074991 - DNA, 17 bp, Homo sapiens
aaataccatgtctctaa

SEQ ID NO: 6074992 - DNA, 18 bp, Homo sapiens
aaataccattgaaatcag

SEQ ID NO: 6074993 - DNA, 18 bp, Homo sapiens
aaatacccaaatgtccct

SEQ ID NO: 6074994 - DNA, 19 bp, Homo sapiens
aaatacccaaatgtccctg

SEQ ID NO: 6074995 - DNA, 19 bp, Homo sapiens
aaataccccatcattcatg

SEQ ID NO: 6074996 - DNA, 21 bp, Homo sapiens
aaatacccttcttttatgagc

SEQ ID NO: 6074997 - DNA, 11 bp, Homo sapiens
aaatacctcaa

SEQ ID NO: 6074998 - DNA, 21 bp, Homo sapiens
aaatacctcaggaaagaatag

SEQ ID NO: 6074999 - DNA, 22 bp, Homo sapiens
aaatacctcatgtttatgaaaa

SEQ ID NO: 6075000 - DNA, 18 bp, Homo sapiens
aaatacctctaataaaca

SEQ ID NO: 6075001 - DNA, 23 bp, Homo sapiens
aaataccttagctcccttgagct

SEQ ID NO: 6075002 - DNA, 16 bp, Homo sapiens
aaataccttgagcaga

SEQ ID NO: 6075003 - DNA, 16 bp, Homo sapiens
aaatacgtattacaaa

SEQ ID NO: 6075004 - DNA, 15 bp, Homo sapiens
aaatactaaaagcaa

SEQ ID NO: 6075005 - DNA, 19 bp, Homo sapiens
aaatactaaaagcaaatct

SEQ ID NO: 6075006 - DNA, 18 bp, Homo sapiens
aaatactaactgctgatt

SEQ ID NO: 6075007 - DNA, 13 bp, Homo sapiens
aaatactaatgta

SEQ ID NO: 6075008 - DNA, 21 bp, Homo sapiens
aaatactacctataggaaagt

SEQ ID NO: 6075009 - DNA, 15 bp, Homo sapiens
aaatactatattaaa

SEQ ID NO: 6075010 - DNA, 18 bp, Homo sapiens
aaatactatccaaataaa

SEQ ID NO: 6075011 - DNA, 15 bp, Homo sapiens
aaatactatgcagta

SEQ ID NO: 6075012 - DNA, 22 bp, Homo sapiens
aaatactatgtatgtaaaatat

SEQ ID NO: 6075013 - DNA, 17 bp, Homo sapiens
aaatactattggacaga

SEQ ID NO: 6075014 - DNA, 22 bp, Homo sapiens
aaatactattggacagacacag

SEQ ID NO: 6075015 - DNA, 14 bp, Homo sapiens
aaatactcaccaaa

SEQ ID NO: 6075016 - DNA, 18 bp, Homo sapiens
aaatactcaccaaaatat

SEQ ID NO: 6075017 - DNA, 16 bp, Homo sapiens
aaatactcatgaatga

SEQ ID NO: 6075018 - DNA, 14 bp, Homo sapiens
aaatactcatgtgt

SEQ ID NO: 6075019 - DNA, 21 bp, Homo sapiens
aaatactcatgtgtatgggca

SEQ ID NO: 6075020 - DNA, 18 bp, Homo sapiens
aaatactccaaagatgac

SEQ ID NO: 6075021 - DNA, 15 bp, Homo sapiens
aaatactccattatt

SEQ ID NO: 6075022 - DNA, 16 bp, Homo sapiens
aaatactccattattt

SEQ ID NO: 6075023 - DNA, 20 bp, Homo sapiens
aaatactccattattttatt

SEQ ID NO: 6075024 - DNA, 17 bp, Homo sapiens
aaatactctaattctaa

SEQ ID NO: 6075025 - DNA, 18 bp, Homo sapiens
aaatactctttcaataaa

SEQ ID NO: 6075026 - DNA, 16 bp, Homo sapiens
aaatactgacaatgta

SEQ ID NO: 6075027 - DNA, 12 bp, Homo sapiens
aaatactgattt

SEQ ID NO: 6075028 - DNA, 17 bp, Homo sapiens
aaatactgcaagaaaat

SEQ ID NO: 6075029 - DNA, 13 bp, Homo sapiens
aaatactgccaga

SEQ ID NO: 6075030 - DNA, 14 bp, Homo sapiens
aaatactgctctga

SEQ ID NO: 6075031 - DNA, 15 bp, Homo sapiens
aaatactgctctgaa

SEQ ID NO: 6075032 - DNA, 17 bp, Homo sapiens
aaatactggactcagga

SEQ ID NO: 6075033 - DNA, 18 bp, Homo sapiens
aaatactggactcaggaa

SEQ ID NO: 6075034 - DNA, 16 bp, Homo sapiens
aaatactgtagataat

SEQ ID NO: 6075035 - DNA, 20 bp, Homo sapiens
aaatactgtagataattaac

SEQ ID NO: 6075036 - DNA, 18 bp, Homo sapiens
aaatactgtcaaacaata

SEQ ID NO: 6075037 - DNA, 19 bp, Homo sapiens
aaatactgtcaaacaataa

SEQ ID NO: 6075038 - DNA, 14 bp, Homo sapiens
aaatactgtgaaat

SEQ ID NO: 6075039 - DNA, 14 bp, Homo sapiens
aaatactgtgtgga

SEQ ID NO: 6075040 - DNA, 13 bp, Homo sapiens
aaatactgttggt

SEQ ID NO: 6075041 - DNA, 14 bp, Homo sapiens
aaatactgtttgag

SEQ ID NO: 6075042 - DNA, 15 bp, Homo sapiens
aaatacttaaatatt

SEQ ID NO: 6075043 - DNA, 15 bp, Homo sapiens
aaatacttaaatgtt

SEQ ID NO: 6075044 - DNA, 16 bp, Homo sapiens
aaatacttaaatgtta

SEQ ID NO: 6075045 - DNA, 20 bp, Homo sapiens
aaatacttaaatgttatgta

SEQ ID NO: 6075046 - DNA, 18 bp, Homo sapiens
aaatacttaacacgtgaa

SEQ ID NO: 6075047 - DNA, 19 bp, Homo sapiens
aaatacttaactactgttt

SEQ ID NO: 6075048 - DNA, 14 bp, Homo sapiens
aaatacttagcaaa

SEQ ID NO: 6075049 - DNA, 15 bp, Homo sapiens
aaatacttattcatt

SEQ ID NO: 6075050 - DNA, 22 bp, Homo sapiens
aaatacttgaaaacttctcatt

SEQ ID NO: 6075051 - DNA, 14 bp, Homo sapiens
aaatacttgcagtt

SEQ ID NO: 6075052 - DNA, 21 bp, Homo sapiens
aaatacttgtttcagcttctc

SEQ ID NO: 6075053 - DNA, 19 bp, Homo sapiens
aaatacttttactctgcct

SEQ ID NO: 6075054 - DNA, 15 bp, Homo sapiens
aaatactttttcagt

SEQ ID NO: 6075055 - DNA, 20 bp, Homo sapiens
aaatactttttcagttgttt

SEQ ID NO: 6075056 - DNA, 15 bp, Homo sapiens
aaatacttttttcta

SEQ ID NO: 6075057 - DNA, 16 bp, Homo sapiens
aaatacttttttctat

SEQ ID NO: 6075058 - DNA, 17 bp, Homo sapiens
aaatagaaaaagtgatg

SEQ ID NO: 6075059 - DNA, 18 bp, Homo sapiens
aaatagaaaacaggaaaa

SEQ ID NO: 6075060 - DNA, 14 bp, Homo sapiens
aaatagaaaagtta

SEQ ID NO: 6075061 - DNA, 14 bp, Homo sapiens
aaatagaaaatggt

SEQ ID NO: 6075062 - DNA, 15 bp, Homo sapiens
aaatagaaaatggtc

SEQ ID NO: 6075063 - DNA, 12 bp, Homo sapiens
aaatagaaacat

SEQ ID NO: 6075064 - DNA, 16 bp, Homo sapiens
aaatagaaagaagcca

SEQ ID NO: 6075065 - DNA, 22 bp, Homo sapiens
aaatagaaagttgcaaggcaaa

SEQ ID NO: 6075066 - DNA, 17 bp, Homo sapiens
aaatagaaattagattt

SEQ ID NO: 6075067 - DNA, 19 bp, Homo sapiens
aaatagaaattttgtaaga

SEQ ID NO: 6075068 - DNA, 22 bp, Homo sapiens
aaatagaacttgccttttaagt

SEQ ID NO: 6075069 - DNA, 12 bp, Homo sapiens
aaatagaagaag

SEQ ID NO: 6075070 - DNA, 16 bp, Homo sapiens
aaatagaagaagagga

SEQ ID NO: 6075071 - DNA, 16 bp, Homo sapiens
aaatagaagagagagg

SEQ ID NO: 6075072 - DNA, 18 bp, Homo sapiens
aaatagaagctataaaga

SEQ ID NO: 6075073 - DNA, 18 bp, Homo sapiens
aaatagaataattctttt

SEQ ID NO: 6075074 - DNA, 12 bp, Homo sapiens
aaatagaatata

SEQ ID NO: 6075075 - DNA, 21 bp, Homo sapiens
aaatagaatatagcatctttc

SEQ ID NO: 6075076 - DNA, 14 bp, Homo sapiens
aaatagaatgtaaa

SEQ ID NO: 6075077 - DNA, 19 bp, Homo sapiens
aaatagaatgtaaatgtct

SEQ ID NO: 6075078 - DNA, 23 bp, Homo sapiens
aaatagacaagagaatgctgtca

SEQ ID NO: 6075079 - DNA, 17 bp, Homo sapiens
aaatagacagcatgaga

SEQ ID NO: 6075080 - DNA, 16 bp, Homo sapiens
aaatagacagtatatt

SEQ ID NO: 6075081 - DNA, 14 bp, Homo sapiens
aaatagacatcttt

SEQ ID NO: 6075082 - DNA, 19 bp, Homo sapiens
aaatagagatgagctttct

SEQ ID NO: 6075083 - DNA, 15 bp, Homo sapiens
aaatagagcaaaatc

SEQ ID NO: 6075084 - DNA, 21 bp, Homo sapiens
aaatagagcaaaatcaacatg

SEQ ID NO: 6075085 - DNA, 22 bp, Homo sapiens
aaatagagccaactgattttgt

SEQ ID NO: 6075086 - DNA, 19 bp, Homo sapiens
aaatagaggctttgagcaa

SEQ ID NO: 6075087 - DNA, 19 bp, Homo sapiens
aaatagagtgcataaataa

SEQ ID NO: 6075088 - DNA, 14 bp, Homo sapiens
aaatagagtgtagt

SEQ ID NO: 6075089 - DNA, 18 bp, Homo sapiens
aaatagagtgtagtttac

SEQ ID NO: 6075090 - DNA, 19 bp, Homo sapiens
aaatagagtttgctattag

SEQ ID NO: 6075091 - DNA, 15 bp, Homo sapiens
aaatagataattaaa

SEQ ID NO: 6075092 - DNA, 13 bp, Homo sapiens
aaatagatacttt

SEQ ID NO: 6075093 - DNA, 14 bp, Homo sapiens
aaatagatactttt

SEQ ID NO: 6075094 - DNA, 21 bp, Homo sapiens
aaatagatcctaggtgctgga

SEQ ID NO: 6075095 - DNA, 16 bp, Homo sapiens
aaatagatgaagtgag

SEQ ID NO: 6075096 - DNA, 14 bp, Homo sapiens
aaatagatgacatt

SEQ ID NO: 6075097 - DNA, 21 bp, Homo sapiens
aaatagatgacattgactatt

SEQ ID NO: 6075098 - DNA, 21 bp, Homo sapiens
aaatagatgtcttttatagtg

SEQ ID NO: 6075099 - DNA, 12 bp, Homo sapiens
aaatagatgttt

SEQ ID NO: 6075100 - DNA, 17 bp, Homo sapiens
aaatagatgttttaact

SEQ ID NO: 6075101 - DNA, 18 bp, Homo sapiens
aaatagatgttttaactt

SEQ ID NO: 6075102 - DNA, 19 bp, Homo sapiens
aaatagattcagagaaatt

SEQ ID NO: 6075103 - DNA, 12 bp, Homo sapiens
aaatagatttag

SEQ ID NO: 6075104 - DNA, 14 bp, Homo sapiens
aaatagatttagtc

SEQ ID NO: 6075105 - DNA, 13 bp, Homo sapiens
aaatagattttaa

SEQ ID NO: 6075106 - DNA, 15 bp, Homo sapiens
aaatagattttttca

SEQ ID NO: 6075107 - DNA, 16 bp, Homo sapiens
aaatagcaaaagaaga

SEQ ID NO: 6075108 - DNA, 12 bp, Homo sapiens
aaatagcaaaga

SEQ ID NO: 6075109 - DNA, 12 bp, Homo sapiens
aaatagcaataa

SEQ ID NO: 6075110 - DNA, 15 bp, Homo sapiens
cccagcctcttccat

SEQ ID NO: 6075111 - DNA, 21 bp, Homo sapiens
cccagcctcttgctcagagct

SEQ ID NO: 6075112 - DNA, 18 bp, Homo sapiens
cccagcctgaaagataca

SEQ ID NO: 6075113 - DNA, 13 bp, Homo sapiens
cccagcctgacct

SEQ ID NO: 6075114 - DNA, 20 bp, Homo sapiens
cccagcctgacctgagactg

SEQ ID NO: 6075115 - DNA, 23 bp, Homo sapiens
cccagcctgcatctagctggagc

SEQ ID NO: 6075116 - DNA, 23 bp, Homo sapiens
cccagcctgcgcctgctgcatgc

SEQ ID NO: 6075117 - DNA, 16 bp, Homo sapiens
cccagcctgctagcta

SEQ ID NO: 6075118 - DNA, 17 bp, Homo sapiens
cccagcctgctctccct

SEQ ID NO: 6075119 - DNA, 14 bp, Homo sapiens
cccagcctgctgag

SEQ ID NO: 6075120 - DNA, 12 bp, Homo sapiens
cccagcctggcc

SEQ ID NO: 6075121 - DNA, 21 bp, Homo sapiens
cccagcctggccacgcagcca

SEQ ID NO: 6075122 - DNA, 22 bp, Homo sapiens
cccagcctggccacgcagccag

SEQ ID NO: 6075123 - DNA, 23 bp, Homo sapiens
cccagcctggccacgcagccagg

SEQ ID NO: 6075124 - DNA, 15 bp, Homo sapiens
cccagcctggcccag

SEQ ID NO: 6075125 - DNA, 18 bp, Homo sapiens
cccagcctggcccagctc

SEQ ID NO: 6075126 - DNA, 22 bp, Homo sapiens
cccagcctggcccagctccccc

SEQ ID NO: 6075127 - DNA, 20 bp, Homo sapiens
cccagcctggccccaaatgt

SEQ ID NO: 6075128 - DNA, 19 bp, Homo sapiens
cccagcctggccccaagca

SEQ ID NO: 6075129 - DNA, 12 bp, Homo sapiens
cccagcctggga

SEQ ID NO: 6075130 - DNA, 20 bp, Homo sapiens
cccagcctgggagcccagag

SEQ ID NO: 6075131 - DNA, 23 bp, Homo sapiens
cccagcctgggataggggcagag

SEQ ID NO: 6075132 - DNA, 13 bp, Homo sapiens
cccagcctgggcc

SEQ ID NO: 6075133 - DNA, 22 bp, Homo sapiens
cccagcctgggccatctcttag

SEQ ID NO: 6075134 - DNA, 23 bp, Homo sapiens
cccagcctgggcccatctccctg

SEQ ID NO: 6075135 - DNA, 18 bp, Homo sapiens
cccagcctgggcctatgg

SEQ ID NO: 6075136 - DNA, 13 bp, Homo sapiens
cccagcctgggct

SEQ ID NO: 6075137 - DNA, 15 bp, Homo sapiens
cccagcctgggctcc

SEQ ID NO: 6075138 - DNA, 17 bp, Homo sapiens
cccagcctggggctccc

SEQ ID NO: 6075139 - DNA, 24 bp, Homo sapiens
cccagcctggggctccctctctgg

SEQ ID NO: 6075140 - DNA, 19 bp, Homo sapiens
cccagcctgggggccagtg

SEQ ID NO: 6075141 - DNA, 21 bp, Homo sapiens
cccagcctgggggccagtggg

SEQ ID NO: 6075142 - DNA, 18 bp, Homo sapiens
cccagcctgtcccactgg

SEQ ID NO: 6075143 - DNA, 21 bp, Homo sapiens
cccagcctgtcccactggctc

SEQ ID NO: 6075144 - DNA, 22 bp, Homo sapiens
cccagcctgtcccactggctcc

SEQ ID NO: 6075145 - DNA, 15 bp, Homo sapiens
cccagcctgtcctgg

SEQ ID NO: 6075146 - DNA, 20 bp, Homo sapiens
cccagcctgtcctggtacag

SEQ ID NO: 6075147 - DNA, 12 bp, Homo sapiens
cccagcctgtgg

SEQ ID NO: 6075148 - DNA, 19 bp, Homo sapiens
cccagcctgtggcctcagc

SEQ ID NO: 6075149 - DNA, 24 bp, Homo sapiens
cccagcctgtggcctcagcatctc

SEQ ID NO: 6075150 - DNA, 23 bp, Homo sapiens
cccagccttctttgcttgcctct

SEQ ID NO: 6075151 - DNA, 12 bp, Homo sapiens
cccagccttgcc

SEQ ID NO: 6075152 - DNA, 15 bp, Homo sapiens
cccagccttgcccag

SEQ ID NO: 6075153 - DNA, 22 bp, Homo sapiens
cccagccttggtgggggagcct

SEQ ID NO: 6075154 - DNA, 20 bp, Homo sapiens
cccagcctttctaaggctca

SEQ ID NO: 6075155 - DNA, 16 bp, Homo sapiens
cccagcgacacagaag

SEQ ID NO: 6075156 - DNA, 20 bp, Homo sapiens
cccagcgacgcggcccgcgg

SEQ ID NO: 6075157 - DNA, 17 bp, Homo sapiens
cccagcgagccacagga

SEQ ID NO: 6075158 - DNA, 15 bp, Homo sapiens
cccagcgagccctgg

SEQ ID NO: 6075159 - DNA, 17 bp, Homo sapiens
cccagcgagccctggtg

SEQ ID NO: 6075160 - DNA, 18 bp, Homo sapiens
cccagcgagccctggtgg

SEQ ID NO: 6075161 - DNA, 14 bp, Homo sapiens
cccagcgattccct

SEQ ID NO: 6075162 - DNA, 21 bp, Homo sapiens
cccagcgattccctctcccag

SEQ ID NO: 6075163 - DNA, 14 bp, Homo sapiens
cccagcgcagagta

SEQ ID NO: 6075164 - DNA, 18 bp, Homo sapiens
cccagcgcatggcgcccc

SEQ ID NO: 6075165 - DNA, 19 bp, Homo sapiens
cccagcgcatggcgccccg

SEQ ID NO: 6075166 - DNA, 14 bp, Homo sapiens
cccagcgccctcta

SEQ ID NO: 6075167 - DNA, 20 bp, Homo sapiens
cccagcgccggggggaggga

SEQ ID NO: 6075168 - DNA, 13 bp, Homo sapiens
cccagcgcggcca

SEQ ID NO: 6075169 - DNA, 18 bp, Homo sapiens
cccagcgcggccagcgtc

SEQ ID NO: 6075170 - DNA, 20 bp, Homo sapiens
cccagcgcggcttggccgcc

SEQ ID NO: 6075171 - DNA, 15 bp, Homo sapiens
cccagcgctctgcct

SEQ ID NO: 6075172 - DNA, 16 bp, Homo sapiens
cccagcgctctgcctc

SEQ ID NO: 6075173 - DNA, 13 bp, Homo sapiens
cccagcgctgctg

SEQ ID NO: 6075174 - DNA, 18 bp, Homo sapiens
cccagcgctggctccagg

SEQ ID NO: 6075175 - DNA, 18 bp, Homo sapiens
cccagcggacagtggcag

SEQ ID NO: 6075176 - DNA, 19 bp, Homo sapiens
cccagcggcagatgggcct

SEQ ID NO: 6075177 - DNA, 16 bp, Homo sapiens
cccagcggcatcaggc

SEQ ID NO: 6075178 - DNA, 20 bp, Homo sapiens
cccagcggcccctcccacac

SEQ ID NO: 6075179 - DNA, 14 bp, Homo sapiens
cccagcggcctcag

SEQ ID NO: 6075180 - DNA, 16 bp, Homo sapiens
cccagcggcctcaggg

SEQ ID NO: 6075181 - DNA, 22 bp, Homo sapiens
cccagcggctggtgcagggcct

SEQ ID NO: 6075182 - DNA, 21 bp, Homo sapiens
cccagcggcttagccaagccc

SEQ ID NO: 6075183 - DNA, 16 bp, Homo sapiens
cccagcgggcagatgg

SEQ ID NO: 6075184 - DNA, 22 bp, Homo sapiens
cccagcgggcaggttctgcctg

SEQ ID NO: 6075185 - DNA, 21 bp, Homo sapiens
cccagcgggctggcgggcctt

SEQ ID NO: 6075186 - DNA, 14 bp, Homo sapiens
cccagcgtcaggcc

SEQ ID NO: 6075187 - DNA, 15 bp, Homo sapiens
cccagcgtcaggcct

SEQ ID NO: 6075188 - DNA, 14 bp, Homo sapiens
cccagcgtctgcag

SEQ ID NO: 6075189 - DNA, 13 bp, Homo sapiens
cccagcgtggccc

SEQ ID NO: 6075190 - DNA, 16 bp, Homo sapiens
cccagcgtggcccagg

SEQ ID NO: 6075191 - DNA, 18 bp, Homo sapiens
cccagcgtggcccaggcc

SEQ ID NO: 6075192 - DNA, 14 bp, Homo sapiens
cccagcgtgtgtat

SEQ ID NO: 6075193 - DNA, 16 bp, Homo sapiens
cccagcgtgtgtatcc

SEQ ID NO: 6075194 - DNA, 20 bp, Homo sapiens
cccagcgtgtgtatccgact

SEQ ID NO: 6075195 - DNA, 17 bp, Homo sapiens
cccagcgttcttcagga

SEQ ID NO: 6075196 - DNA, 23 bp, Homo sapiens
cccagcgttcttcaggagatgat

SEQ ID NO: 6075197 - DNA, 18 bp, Homo sapiens
cccagctaaagaggtggg

SEQ ID NO: 6075198 - DNA, 20 bp, Homo sapiens
cccagctaaagaggtggggt

SEQ ID NO: 6075199 - DNA, 20 bp, Homo sapiens
cccagctaagaacctggaac

SEQ ID NO: 6075200 - DNA, 15 bp, Homo sapiens
cccagctaataaacc

SEQ ID NO: 6075201 - DNA, 17 bp, Homo sapiens
cccagctaataaaccag

SEQ ID NO: 6075202 - DNA, 18 bp, Homo sapiens
cccagctaatctgtaggg

SEQ ID NO: 6075203 - DNA, 23 bp, Homo sapiens
cccagctaatctgtagggctgga

SEQ ID NO: 6075204 - DNA, 19 bp, Homo sapiens
cccagctaattgagaccac

SEQ ID NO: 6075205 - DNA, 14 bp, Homo sapiens
cccagctaattttt

SEQ ID NO: 6075206 - DNA, 14 bp, Homo sapiens
cccagctacattcc

SEQ ID NO: 6075207 - DNA, 17 bp, Homo sapiens
cccagctacattcctca

SEQ ID NO: 6075208 - DNA, 16 bp, Homo sapiens
cccagctacccaggag

SEQ ID NO: 6075209 - DNA, 10 bp, Homo sapiens
cccagctact

SEQ ID NO: 6075210 - DNA, 21 bp, Homo sapiens
cccagctactcaagaggctga

SEQ ID NO: 6075211 - DNA, 21 bp, Homo sapiens
cccagctactcagaagcctga

SEQ ID NO: 6075212 - DNA, 22 bp, Homo sapiens
cccagctactcgggaggctgag

SEQ ID NO: 6075213 - DNA, 19 bp, Homo sapiens
cccagctactctgtccagg

SEQ ID NO: 6075214 - DNA, 24 bp, Homo sapiens
cccagctactctgtccaggccact

SEQ ID NO: 6075215 - DNA, 17 bp, Homo sapiens
cccagctactggggagg

SEQ ID NO: 6075216 - DNA, 20 bp, Homo sapiens
cccagctactggggaggctg

SEQ ID NO: 6075217 - DNA, 18 bp, Homo sapiens
cccagctacttgggaagc

SEQ ID NO: 6075218 - DNA, 20 bp, Homo sapiens
cccagctacttgggagcctg

SEQ ID NO: 6075219 - DNA, 22 bp, Homo sapiens
cccagctacttgggagcctgag

SEQ ID NO: 6075220 - DNA, 18 bp, Homo sapiens
cccagctacttgggaggc

SEQ ID NO: 6075221 - DNA, 15 bp, Homo sapiens
cccagctaggaagca

SEQ ID NO: 6075222 - DNA, 17 bp, Homo sapiens
cccagctatacctgtgc

SEQ ID NO: 6075223 - DNA, 20 bp, Homo sapiens
cccagctatacctgtgcctc

SEQ ID NO: 6075224 - DNA, 21 bp, Homo sapiens
cccagctatggttctctcgca

SEQ ID NO: 6075225 - DNA, 17 bp, Homo sapiens
cccagctattttctgac

SEQ ID NO: 6075226 - DNA, 19 bp, Homo sapiens
cccagctattttctgacca

SEQ ID NO: 6075227 - DNA, 11 bp, Homo sapiens
cccagctcaat

SEQ ID NO: 6075228 - DNA, 17 bp, Homo sapiens
cccagctcactgcagcc

SEQ ID NO: 6075229 - DNA, 19 bp, Homo sapiens
cccagctcactgcagcctc

SEQ ID NO: 6075230 - DNA, 20 bp, Homo sapiens
cccagctcactgcagcctcg

SEQ ID NO: 6075231 - DNA, 15 bp, Homo sapiens
cccagctcagagccc

SEQ ID NO: 6075232 - DNA, 14 bp, Homo sapiens
cccagctcagaggg

SEQ ID NO: 6075233 - DNA, 12 bp, Homo sapiens
cccagctcagca

SEQ ID NO: 6075234 - DNA, 16 bp, Homo sapiens
cccagctcagctcagc

SEQ ID NO: 6075235 - DNA, 13 bp, Homo sapiens
cccagctcagggg

SEQ ID NO: 6075236 - DNA, 18 bp, Homo sapiens
cccagctcaggggcagct

SEQ ID NO: 6075237 - DNA, 17 bp, Homo sapiens
cccagctcagtgccaaa

SEQ ID NO: 6075238 - DNA, 14 bp, Homo sapiens
cccagctccacccc

SEQ ID NO: 6075239 - DNA, 21 bp, Homo sapiens
cccagctccactcagggctgg

SEQ ID NO: 6075240 - DNA, 13 bp, Homo sapiens
cccagctccaggc

SEQ ID NO: 6075241 - DNA, 14 bp, Homo sapiens
cccagctccaggcc

SEQ ID NO: 6075242 - DNA, 18 bp, Homo sapiens
cccagctccagggccaga

SEQ ID NO: 6075243 - DNA, 13 bp, Homo sapiens
cccagctcccaca

SEQ ID NO: 6075244 - DNA, 14 bp, Homo sapiens
cccagctcccacac

SEQ ID NO: 6075245 - DNA, 16 bp, Homo sapiens
cccagctcccccaggc

SEQ ID NO: 6075246 - DNA, 17 bp, Homo sapiens
cccagctcccccaggca

SEQ ID NO: 6075247 - DNA, 13 bp, Homo sapiens
cccagctcccccc

SEQ ID NO: 6075248 - DNA, 12 bp, Homo sapiens
cccagctcccct

SEQ ID NO: 6075249 - DNA, 15 bp, Homo sapiens
cccagctcccctctt

SEQ ID NO: 6075250 - DNA, 15 bp, Homo sapiens
cccagctccctagga

SEQ ID NO: 6075251 - DNA, 15 bp, Homo sapiens
cccagctccctgcac

SEQ ID NO: 6075252 - DNA, 15 bp, Homo sapiens
cccagctccgcctgc

SEQ ID NO: 6075253 - DNA, 20 bp, Homo sapiens
cccagctccgtttctaccac

SEQ ID NO: 6075254 - DNA, 16 bp, Homo sapiens
cccagctcctcaccca

SEQ ID NO: 6075255 - DNA, 18 bp, Homo sapiens
cccagctcctctgagcca

SEQ ID NO: 6075256 - DNA, 16 bp, Homo sapiens
cccagctcctcttcct

SEQ ID NO: 6075257 - DNA, 13 bp, Homo sapiens
cccagctccttgg

SEQ ID NO: 6075258 - DNA, 22 bp, Homo sapiens
cccagctccttggctgcagcca

SEQ ID NO: 6075259 - DNA, 18 bp, Homo sapiens
cccagctcctttctcctg

SEQ ID NO: 6075260 - DNA, 16 bp, Homo sapiens
cccagctcgcgggacc

SEQ ID NO: 6075261 - DNA, 20 bp, Homo sapiens
cccagctcgctggctttctc

SEQ ID NO: 6075262 - DNA, 18 bp, Homo sapiens
cccagctctaagcagcca

SEQ ID NO: 6075263 - DNA, 19 bp, Homo sapiens
cccagctctaagcagccag

SEQ ID NO: 6075264 - DNA, 21 bp, Homo sapiens
cccagctctagcctctggact

SEQ ID NO: 6075265 - DNA, 17 bp, Homo sapiens
cccagctctcagggctg

SEQ ID NO: 6075266 - DNA, 15 bp, Homo sapiens
cccagctctcagtag

SEQ ID NO: 6075267 - DNA, 15 bp, Homo sapiens
cccagctctcccaca

SEQ ID NO: 6075268 - DNA, 16 bp, Homo sapiens
cccagctctccctctg

SEQ ID NO: 6075269 - DNA, 17 bp, Homo sapiens
cccagctctccctctgg

SEQ ID NO: 6075270 - DNA, 21 bp, Homo sapiens
cccagctctccctctggccct

SEQ ID NO: 6075271 - DNA, 17 bp, Homo sapiens
cccagctctctctcctg

SEQ ID NO: 6075272 - DNA, 21 bp, Homo sapiens
cccagctctctctcctggagt

SEQ ID NO: 6075273 - DNA, 18 bp, Homo sapiens
cccagctctgaggggagg

SEQ ID NO: 6075274 - DNA, 11 bp, Homo sapiens
cccagctctgc

SEQ ID NO: 6075275 - DNA, 20 bp, Homo sapiens
cccagctctgcttgccgaaa

SEQ ID NO: 6075276 - DNA, 20 bp, Homo sapiens
cccagctctgtcctcttggc

SEQ ID NO: 6075277 - DNA, 15 bp, Homo sapiens
cccagctcttctctt

SEQ ID NO: 6075278 - DNA, 19 bp, Homo sapiens
cccagctcttctcttccta

SEQ ID NO: 6075279 - DNA, 14 bp, Homo sapiens
cccagctcttgctc

SEQ ID NO: 6075280 - DNA, 17 bp, Homo sapiens
cccagctcttgctctct

SEQ ID NO: 6075281 - DNA, 21 bp, Homo sapiens
cccagctcttgctctcttgtg

SEQ ID NO: 6075282 - DNA, 18 bp, Homo sapiens
cccagctgaaggcagtgg

SEQ ID NO: 6075283 - DNA, 19 bp, Homo sapiens
cccagctgacagtcctctc

SEQ ID NO: 6075284 - DNA, 12 bp, Homo sapiens
cccagctgcacc

SEQ ID NO: 6075285 - DNA, 22 bp, Homo sapiens
cccagctgcacctgccagcctg

SEQ ID NO: 6075286 - DNA, 12 bp, Homo sapiens
cccagctgcact

SEQ ID NO: 6075287 - DNA, 12 bp, Homo sapiens
cccagctgcaga

SEQ ID NO: 6075288 - DNA, 12 bp, Homo sapiens
cccagctgccag

SEQ ID NO: 6075289 - DNA, 13 bp, Homo sapiens
cccagctgccagg

SEQ ID NO: 6075290 - DNA, 22 bp, Homo sapiens
cccagctgccaggcggccctgg

SEQ ID NO: 6075291 - DNA, 24 bp, Homo sapiens
cccagctgccagggaagacagagc

SEQ ID NO: 6075292 - DNA, 21 bp, Homo sapiens
cccagctgcccctccctgcca

SEQ ID NO: 6075293 - DNA, 20 bp, Homo sapiens
cccagctgccggcagtgctg

SEQ ID NO: 6075294 - DNA, 12 bp, Homo sapiens
cccagctgctcc

SEQ ID NO: 6075295 - DNA, 20 bp, Homo sapiens
cccagctgctcccctgccac

SEQ ID NO: 6075296 - DNA, 12 bp, Homo sapiens
cccagctgctct

SEQ ID NO: 6075297 - DNA, 14 bp, Homo sapiens
cccagctgctctgc

SEQ ID NO: 6075298 - DNA, 17 bp, Homo sapiens
cccagctggcagcgcct

SEQ ID NO: 6075299 - DNA, 12 bp, Homo sapiens
cccagctggcca

SEQ ID NO: 6075300 - DNA, 13 bp, Homo sapiens
cccagctggccgg

SEQ ID NO: 6075301 - DNA, 18 bp, Homo sapiens
cccagctggcctctagaa

SEQ ID NO: 6075302 - DNA, 20 bp, Homo sapiens
cccagctggcctggccccca

SEQ ID NO: 6075303 - DNA, 23 bp, Homo sapiens
cccagctggctgggtcgcccctc

SEQ ID NO: 6075304 - DNA, 13 bp, Homo sapiens
cccagctgggagg

SEQ ID NO: 6075305 - DNA, 20 bp, Homo sapiens
cccagctgggaggcaagagg

SEQ ID NO: 6075306 - DNA, 12 bp, Homo sapiens
cccagctgggct

SEQ ID NO: 6075307 - DNA, 14 bp, Homo sapiens
cccagctgggctct

SEQ ID NO: 6075308 - DNA, 12 bp, Homo sapiens
cccagctggggc

SEQ ID NO: 6075309 - DNA, 17 bp, Homo sapiens
cccagctgggtcaggca

SEQ ID NO: 6075310 - DNA, 14 bp, Homo sapiens
cccagctggtcctg

SEQ ID NO: 6075311 - DNA, 15 bp, Homo sapiens
cccagctggtcctgt

SEQ ID NO: 6075312 - DNA, 21 bp, Homo sapiens
cccagctggtgtcactctgcc

SEQ ID NO: 6075313 - DNA, 22 bp, Homo sapiens
cccagctgtaccggccactgca

SEQ ID NO: 6075314 - DNA, 14 bp, Homo sapiens
cccagctgtagcca

SEQ ID NO: 6075315 - DNA, 22 bp, Homo sapiens
cccagctgtagccatggctcag

SEQ ID NO: 6075316 - DNA, 24 bp, Homo sapiens
cccagctgtagccatggctcaggc

SEQ ID NO: 6075317 - DNA, 21 bp, Homo sapiens
cccagctgtgactgagggcct

SEQ ID NO: 6075318 - DNA, 16 bp, Homo sapiens
cccagctgtgagcctt

SEQ ID NO: 6075319 - DNA, 19 bp, Homo sapiens
cccagctgtgagccttggc

SEQ ID NO: 6075320 - DNA, 23 bp, Homo sapiens
cccagctgtgctctggacaggca

SEQ ID NO: 6075321 - DNA, 15 bp, Homo sapiens
cccagctgtgctggg

SEQ ID NO: 6075322 - DNA, 21 bp, Homo sapiens
cccagctgtgctgtggagaga

SEQ ID NO: 6075323 - DNA, 20 bp, Homo sapiens
cccagctgtgggcggctcct

SEQ ID NO: 6075324 - DNA, 22 bp, Homo sapiens
cccagcttaaaggggctagagt

SEQ ID NO: 6075325 - DNA, 20 bp, Homo sapiens
cccagcttaaatcctagcag

SEQ ID NO: 6075326 - DNA, 22 bp, Homo sapiens
cccagcttcacttctgactctt

SEQ ID NO: 6075327 - DNA, 16 bp, Homo sapiens
cccagcttccagcagg

SEQ ID NO: 6075328 - DNA, 17 bp, Homo sapiens
cccagcttccagcagga

SEQ ID NO: 6075329 - DNA, 15 bp, Homo sapiens
cccagcttcctggtg

SEQ ID NO: 6075330 - DNA, 17 bp, Homo sapiens
cccagcttctctctccc

SEQ ID NO: 6075331 - DNA, 17 bp, Homo sapiens
cccagcttgctgagggg

SEQ ID NO: 6075332 - DNA, 14 bp, Homo sapiens
cccagcttgggcag

SEQ ID NO: 6075333 - DNA, 17 bp, Homo sapiens
cccagctttatctgtca

SEQ ID NO: 6075334 - DNA, 21 bp, Homo sapiens
cccagctttccctgccaggcc

SEQ ID NO: 6075335 - DNA, 13 bp, Homo sapiens
cccagctttgccc

SEQ ID NO: 6075336 - DNA, 19 bp, Homo sapiens
cccagcttttcttgccagc

SEQ ID NO: 6075337 - DNA, 20 bp, Homo sapiens
cccagcttttcttgccagct

SEQ ID NO: 6075338 - DNA, 22 bp, Homo sapiens
cccagcttttcttgccagctca

SEQ ID NO: 6075339 - DNA, 18 bp, Homo sapiens
cccaggaaaaactggaag

SEQ ID NO: 6075340 - DNA, 15 bp, Homo sapiens
cccaggaaagaggca

SEQ ID NO: 6075341 - DNA, 22 bp, Homo sapiens
cccaggaaaggacggctgagca

SEQ ID NO: 6075342 - DNA, 16 bp, Homo sapiens
cccaggaaaggaggac

SEQ ID NO: 6075343 - DNA, 19 bp, Homo sapiens
cccaggaaaggctccagga

SEQ ID NO: 6075344 - DNA, 23 bp, Homo sapiens
cccaggaaaggctccaggagcag

SEQ ID NO: 6075345 - DNA, 11 bp, Homo sapiens
cccaggaacaa

SEQ ID NO: 6075346 - DNA, 22 bp, Homo sapiens
cccaggaaccaaaaaaccccag

SEQ ID NO: 6075347 - DNA, 13 bp, Homo sapiens
cccaggaagcagg

SEQ ID NO: 6075348 - DNA, 14 bp, Homo sapiens
cccaggaagcaggg

SEQ ID NO: 6075349 - DNA, 18 bp, Homo sapiens
cccaggaagcccacacta

SEQ ID NO: 6075350 - DNA, 22 bp, Homo sapiens
cccaggaagcccactgcctcct

SEQ ID NO: 6075351 - DNA, 22 bp, Homo sapiens
cccaggaagccggtgcctgggt

SEQ ID NO: 6075352 - DNA, 12 bp, Homo sapiens
cccaggaaggcg

SEQ ID NO: 6075353 - DNA, 21 bp, Homo sapiens
cccaggaaggcggcaggcaga

SEQ ID NO: 6075354 - DNA, 16 bp, Homo sapiens
cccaggaagggaggga

SEQ ID NO: 6075355 - DNA, 21 bp, Homo sapiens
cccaggaagggagggagctga

SEQ ID NO: 6075356 - DNA, 15 bp, Homo sapiens
cccaggaagtaattt

SEQ ID NO: 6075357 - DNA, 20 bp, Homo sapiens
cccaggaatggagcctgcac

SEQ ID NO: 6075358 - DNA, 17 bp, Homo sapiens
cccaggaattctcacag

SEQ ID NO: 6075359 - DNA, 22 bp, Homo sapiens
cccaggaatttgaagctgcagt

SEQ ID NO: 6075360 - DNA, 19 bp, Homo sapiens
cccaggacaccacacccag

SEQ ID NO: 6075361 - DNA, 14 bp, Homo sapiens
cccaggacactgcc

SEQ ID NO: 6075362 - DNA, 20 bp, Homo sapiens
cccaggacactgcctttgct

SEQ ID NO: 6075363 - DNA, 13 bp, Homo sapiens
cccaggacaggaa

SEQ ID NO: 6075364 - DNA, 16 bp, Homo sapiens
cccaggaccacaggct

SEQ ID NO: 6075365 - DNA, 12 bp, Homo sapiens
cccaggaccaga

SEQ ID NO: 6075366 - DNA, 20 bp, Homo sapiens
cccaggaccagctcaggaca

SEQ ID NO: 6075367 - DNA, 22 bp, Homo sapiens
cccaggaccagctggggcgtgg

SEQ ID NO: 6075368 - DNA, 19 bp, Homo sapiens
cccaggaccatcctggagg

SEQ ID NO: 6075369 - DNA, 20 bp, Homo sapiens
cccaggaccccatggcagtg

SEQ ID NO: 6075370 - DNA, 20 bp, Homo sapiens
cccaggacccctgtccagga

SEQ ID NO: 6075371 - DNA, 12 bp, Homo sapiens
cccaggacctct

SEQ ID NO: 6075372 - DNA, 16 bp, Homo sapiens
cccaggacctctgggg

SEQ ID NO: 6075373 - DNA, 20 bp, Homo sapiens
cccaggacctcttcagctgc

SEQ ID NO: 6075374 - DNA, 17 bp, Homo sapiens
cccaggacgcagggaga

SEQ ID NO: 6075375 - DNA, 13 bp, Homo sapiens
cccaggacgccac

SEQ ID NO: 6075376 - DNA, 22 bp, Homo sapiens
cccaggacgccactcatttcat

SEQ ID NO: 6075377 - DNA, 19 bp, Homo sapiens
cccaggacggatgggccct

SEQ ID NO: 6075378 - DNA, 15 bp, Homo sapiens
cccaggacggggccg

SEQ ID NO: 6075379 - DNA, 17 bp, Homo sapiens
cccaggacggggccggc

SEQ ID NO: 6075380 - DNA, 23 bp, Homo sapiens
cccaggacggggccggccaggtg

SEQ ID NO: 6075381 - DNA, 17 bp, Homo sapiens
cccaggacggtctgtgc

SEQ ID NO: 6075382 - DNA, 17 bp, Homo sapiens
cccaggactcaccctcc

SEQ ID NO: 6075383 - DNA, 13 bp, Homo sapiens
cccaggactgggc

SEQ ID NO: 6075384 - DNA, 19 bp, Homo sapiens
cccaggagaagtcccacca

SEQ ID NO: 6075385 - DNA, 17 bp, Homo sapiens
cccaggagacagttcaa

SEQ ID NO: 6075386 - DNA, 20 bp, Homo sapiens
cccaggagaccacggggagc

SEQ ID NO: 6075387 - DNA, 16 bp, Homo sapiens
cccaggagacctccag

SEQ ID NO: 6075388 - DNA, 15 bp, Homo sapiens
cccaggagagccagc

SEQ ID NO: 6075389 - DNA, 16 bp, Homo sapiens
cccaggagagccccca

SEQ ID NO: 6075390 - DNA, 17 bp, Homo sapiens
cccaggagagtggaaga

SEQ ID NO: 6075391 - DNA, 20 bp, Homo sapiens
cccaggagatgggtccaggg

SEQ ID NO: 6075392 - DNA, 22 bp, Homo sapiens
cccaggagcaagtgaggccgga

SEQ ID NO: 6075393 - DNA, 16 bp, Homo sapiens
cccaggagcagaagag

SEQ ID NO: 6075394 - DNA, 19 bp, Homo sapiens
cccaggagcagctggcact

SEQ ID NO: 6075395 - DNA, 21 bp, Homo sapiens
cccaggagcagctggcactga

SEQ ID NO: 6075396 - DNA, 13 bp, Homo sapiens
cccaggagcccat

SEQ ID NO: 6075397 - DNA, 21 bp, Homo sapiens
cccaggagcccgtcaggccac

SEQ ID NO: 6075398 - DNA, 14 bp, Homo sapiens
cccaggagcctcac

SEQ ID NO: 6075399 - DNA, 13 bp, Homo sapiens
cccaggagctccc

SEQ ID NO: 6075400 - DNA, 17 bp, Homo sapiens
cccaggagctctgcgcc

SEQ ID NO: 6075401 - DNA, 20 bp, Homo sapiens
cccaggagctctgcgccagg

SEQ ID NO: 6075402 - DNA, 13 bp, Homo sapiens
cccaggaggacct

SEQ ID NO: 6075403 - DNA, 18 bp, Homo sapiens
cccaggaggagaccctcc

SEQ ID NO: 6075404 - DNA, 21 bp, Homo sapiens
cccaggaggcagggaggcagc

SEQ ID NO: 6075405 - DNA, 22 bp, Homo sapiens
cccaggaggcagggaggcagcc

SEQ ID NO: 6075406 - DNA, 22 bp, Homo sapiens
cccaggaggccagccttgacca

SEQ ID NO: 6075407 - DNA, 14 bp, Homo sapiens
cccaggaggcctgg

SEQ ID NO: 6075408 - DNA, 20 bp, Homo sapiens
cccaggaggctgaggcagga

SEQ ID NO: 6075409 - DNA, 22 bp, Homo sapiens
cccaggaggctgaggcaggaga

SEQ ID NO: 6075410 - DNA, 18 bp, Homo sapiens
cccaggagggcatccata

SEQ ID NO: 6075411 - DNA, 20 bp, Homo sapiens
cccaggaggggaacactgcc

SEQ ID NO: 6075412 - DNA, 13 bp, Homo sapiens
cccaggaggggcc

SEQ ID NO: 6075413 - DNA, 18 bp, Homo sapiens
cccaggaggggcctctga

SEQ ID NO: 6075414 - DNA, 21 bp, Homo sapiens
cccaggaggtgcttgaggccc

SEQ ID NO: 6075415 - DNA, 23 bp, Homo sapiens
cccaggaggtggaggttgcagtg

SEQ ID NO: 6075416 - DNA, 14 bp, Homo sapiens
cccaggagtccaga

SEQ ID NO: 6075417 - DNA, 16 bp, Homo sapiens
cccaggagtccaggcc

SEQ ID NO: 6075418 - DNA, 19 bp, Homo sapiens
cccaggagttcgagaccaa

SEQ ID NO: 6075419 - DNA, 24 bp, Homo sapiens
cccaggagttcgaggctgcagtca

SEQ ID NO: 6075420 - DNA, 17 bp, Homo sapiens
cccaggagttctgctca

SEQ ID NO: 6075421 - DNA, 20 bp, Homo sapiens
cccaggagtttgagacaagc

SEQ ID NO: 6075422 - DNA, 17 bp, Homo sapiens
cccaggagtttgaggct

SEQ ID NO: 6075423 - DNA, 17 bp, Homo sapiens
cccaggatactggcaca

SEQ ID NO: 6075424 - DNA, 17 bp, Homo sapiens
cccaggatatattttat

SEQ ID NO: 6075425 - DNA, 20 bp, Homo sapiens
cccaggatcactctctgctg

SEQ ID NO: 6075426 - DNA, 21 bp, Homo sapiens
cccaggatcactctctgctgg

SEQ ID NO: 6075427 - DNA, 23 bp, Homo sapiens
cccaggatcagattgcatgtgac

SEQ ID NO: 6075428 - DNA, 17 bp, Homo sapiens
cccaggatcccagagct

SEQ ID NO: 6075429 - DNA, 14 bp, Homo sapiens
cccaggatcccctg

SEQ ID NO: 6075430 - DNA, 12 bp, Homo sapiens
cccaggatctcc

SEQ ID NO: 6075431 - DNA, 23 bp, Homo sapiens
cccaggatctcctgccagcccag

SEQ ID NO: 6075432 - DNA, 16 bp, Homo sapiens
cccaggatctgctcca

SEQ ID NO: 6075433 - DNA, 17 bp, Homo sapiens
cccaggatctgctccaa

SEQ ID NO: 6075434 - DNA, 23 bp, Homo sapiens
cccaggatgcatgcagggccccc

SEQ ID NO: 6075435 - DNA, 14 bp, Homo sapiens
cccaggattcccag

SEQ ID NO: 6075436 - DNA, 16 bp, Homo sapiens
cccaggattcccagag

SEQ ID NO: 6075437 - DNA, 13 bp, Homo sapiens
cccaggattcccc

SEQ ID NO: 6075438 - DNA, 18 bp, Homo sapiens
cccaggattcccccagcc

SEQ ID NO: 6075439 - DNA, 18 bp, Homo sapiens
cccaggattgtgcaatag

SEQ ID NO: 6075440 - DNA, 16 bp, Homo sapiens
cccaggcaaggaacag

SEQ ID NO: 6075441 - DNA, 18 bp, Homo sapiens
cccaggcaaggctgtgga

SEQ ID NO: 6075442 - DNA, 16 bp, Homo sapiens
cccaggcaccaccagg

SEQ ID NO: 6075443 - DNA, 18 bp, Homo sapiens
cccaggcaccaccaggag

SEQ ID NO: 6075444 - DNA, 19 bp, Homo sapiens
cccaggcaccaccaggagc

SEQ ID NO: 6075445 - DNA, 22 bp, Homo sapiens
cccaggcaccaccaggagcagc

SEQ ID NO: 6075446 - DNA, 19 bp, Homo sapiens
cccaggcaccccctggctt

SEQ ID NO: 6075447 - DNA, 13 bp, Homo sapiens
cccaggcactctc

SEQ ID NO: 6075448 - DNA, 15 bp, Homo sapiens
cccaggcactctctt

SEQ ID NO: 6075449 - DNA, 19 bp, Homo sapiens
cccaggcagacaaccttgt

SEQ ID NO: 6075450 - DNA, 14 bp, Homo sapiens
cccaggcagagagc

SEQ ID NO: 6075451 - DNA, 16 bp, Homo sapiens
cccaggcagagctgac

SEQ ID NO: 6075452 - DNA, 10 bp, Homo sapiens
cccaggcagc

SEQ ID NO: 6075453 - DNA, 14 bp, Homo sapiens
cccaggcagccacc

SEQ ID NO: 6075454 - DNA, 15 bp, Homo sapiens
cccaggcagccacca

SEQ ID NO: 6075455 - DNA, 14 bp, Homo sapiens
cccaggcagcgcca

SEQ ID NO: 6075456 - DNA, 22 bp, Homo sapiens
cccaggcagctatttcagcctc

SEQ ID NO: 6075457 - DNA, 15 bp, Homo sapiens
cccaggcagctggca

SEQ ID NO: 6075458 - DNA, 17 bp, Homo sapiens
cccaggcagctggcagg

SEQ ID NO: 6075459 - DNA, 14 bp, Homo sapiens
cccaggcaggccac

SEQ ID NO: 6075460 - DNA, 17 bp, Homo sapiens
cccaggcaggcccagcc

SEQ ID NO: 6075461 - DNA, 18 bp, Homo sapiens
cccaggcaggcccagcct

SEQ ID NO: 6075462 - DNA, 20 bp, Homo sapiens
cccaggcaggcccagcctct

SEQ ID NO: 6075463 - DNA, 22 bp, Homo sapiens
cccaggcaggcccagcctctgc

SEQ ID NO: 6075464 - DNA, 23 bp, Homo sapiens
cccaggcaggcccagcctctgcc

SEQ ID NO: 6075465 - DNA, 13 bp, Homo sapiens
aaatagcaataac

SEQ ID NO: 6075466 - DNA, 18 bp, Homo sapiens
aaatagcaataactgaaa

SEQ ID NO: 6075467 - DNA, 22 bp, Homo sapiens
aaatagcagccctcaattgtga

SEQ ID NO: 6075468 - DNA, 14 bp, Homo sapiens
aaatagcatactgt

SEQ ID NO: 6075469 - DNA, 18 bp, Homo sapiens
aaatagcatactgtgtat

SEQ ID NO: 6075470 - DNA, 20 bp, Homo sapiens
aaatagcatactgtgtatgt

SEQ ID NO: 6075471 - DNA, 15 bp, Homo sapiens
aaatagcatgtattg

SEQ ID NO: 6075472 - DNA, 22 bp, Homo sapiens
aaatagcatgtattgtgtcttt

SEQ ID NO: 6075473 - DNA, 17 bp, Homo sapiens
aaatagcattatcttat

SEQ ID NO: 6075474 - DNA, 22 bp, Homo sapiens
aaatagcattatcttatcattt

SEQ ID NO: 6075475 - DNA, 13 bp, Homo sapiens
aaatagcatttgt

SEQ ID NO: 6075476 - DNA, 23 bp, Homo sapiens
aaatagccacttaccttcaataa

SEQ ID NO: 6075477 - DNA, 21 bp, Homo sapiens
aaatagccgggcatggtggcg

SEQ ID NO: 6075478 - DNA, 23 bp, Homo sapiens
aaatagcctaaatgatggtgctt

SEQ ID NO: 6075479 - DNA, 18 bp, Homo sapiens
aaatagccttcaaaaaga

SEQ ID NO: 6075480 - DNA, 22 bp, Homo sapiens
aaatagccttcaaaaagagaga

SEQ ID NO: 6075481 - DNA, 16 bp, Homo sapiens
aaatagcgatgtgcag

SEQ ID NO: 6075482 - DNA, 23 bp, Homo sapiens
aaatagcgatgtgcaggaagaaa

SEQ ID NO: 6075483 - DNA, 19 bp, Homo sapiens
aaatagcggtacaagttct

SEQ ID NO: 6075484 - DNA, 15 bp, Homo sapiens
aaatagcgttcttgt

SEQ ID NO: 6075485 - DNA, 21 bp, Homo sapiens
aaatagcgttcttgtaatttt

SEQ ID NO: 6075486 - DNA, 14 bp, Homo sapiens
aaatagctacagct

SEQ ID NO: 6075487 - DNA, 15 bp, Homo sapiens
aaatagctacagctg

SEQ ID NO: 6075488 - DNA, 16 bp, Homo sapiens
aaatagctactggaaa

SEQ ID NO: 6075489 - DNA, 18 bp, Homo sapiens
aaatagctagactggtga

SEQ ID NO: 6075490 - DNA, 19 bp, Homo sapiens
aaatagctatatccatgta

SEQ ID NO: 6075491 - DNA, 20 bp, Homo sapiens
aaatagctatggttgtaaca

SEQ ID NO: 6075492 - DNA, 15 bp, Homo sapiens
aaatagctatttttt

SEQ ID NO: 6075493 - DNA, 12 bp, Homo sapiens
aaatagctcttg

SEQ ID NO: 6075494 - DNA, 17 bp, Homo sapiens
aaatagctgaaaactaa

SEQ ID NO: 6075495 - DNA, 22 bp, Homo sapiens
aaatagctgaaaactaatgtac

SEQ ID NO: 6075496 - DNA, 22 bp, Homo sapiens
aaatagcttagcggcaagaagc

SEQ ID NO: 6075497 - DNA, 15 bp, Homo sapiens
aaatagcttatgaaa

SEQ ID NO: 6075498 - DNA, 14 bp, Homo sapiens
aaatagcttcagga

SEQ ID NO: 6075499 - DNA, 16 bp, Homo sapiens
aaatagcttttattga

SEQ ID NO: 6075500 - DNA, 17 bp, Homo sapiens
aaatagcttttttctct

SEQ ID NO: 6075501 - DNA, 20 bp, Homo sapiens
aaatagcttttttctctgat

SEQ ID NO: 6075502 - DNA, 14 bp, Homo sapiens
aaataggaaacaag

SEQ ID NO: 6075503 - DNA, 16 bp, Homo sapiens
aaataggaaagacttt

SEQ ID NO: 6075504 - DNA, 16 bp, Homo sapiens
aaataggagaggatga

SEQ ID NO: 6075505 - DNA, 18 bp, Homo sapiens
aaataggagggaaacctt

SEQ ID NO: 6075506 - DNA, 18 bp, Homo sapiens
aaataggagtgagtgtat

SEQ ID NO: 6075507 - DNA, 17 bp, Homo sapiens
aaataggattgcttcaa

SEQ ID NO: 6075508 - DNA, 23 bp, Homo sapiens
aaataggattgcttcaattaaaa

SEQ ID NO: 6075509 - DNA, 21 bp, Homo sapiens
aaataggatttgcactgcttt

SEQ ID NO: 6075510 - DNA, 19 bp, Homo sapiens
aaataggattttgaaccca

SEQ ID NO: 6075511 - DNA, 16 bp, Homo sapiens
aaataggcttagagag

SEQ ID NO: 6075512 - DNA, 21 bp, Homo sapiens
aaataggcttagagaggaaaa

SEQ ID NO: 6075513 - DNA, 22 bp, Homo sapiens
aaataggcttagagaggaaaag

SEQ ID NO: 6075514 - DNA, 19 bp, Homo sapiens
aaataggctttagaagaga

SEQ ID NO: 6075515 - DNA, 14 bp, Homo sapiens
aaataggcttttta

SEQ ID NO: 6075516 - DNA, 17 bp, Homo sapiens
aaatagggaagatggag

SEQ ID NO: 6075517 - DNA, 15 bp, Homo sapiens
aaatagggaatatga

SEQ ID NO: 6075518 - DNA, 17 bp, Homo sapiens
aaatagggaatatgata

SEQ ID NO: 6075519 - DNA, 22 bp, Homo sapiens
aaatagggtccttgaaacagaa

SEQ ID NO: 6075520 - DNA, 16 bp, Homo sapiens
aaataggtatcaaaat

SEQ ID NO: 6075521 - DNA, 16 bp, Homo sapiens
aaataggtcatcatga

SEQ ID NO: 6075522 - DNA, 18 bp, Homo sapiens
aaataggttttccctgtt

SEQ ID NO: 6075523 - DNA, 13 bp, Homo sapiens
aaatagtaaaaat

SEQ ID NO: 6075524 - DNA, 16 bp, Homo sapiens
aaatagtaaaaataaa

SEQ ID NO: 6075525 - DNA, 15 bp, Homo sapiens
aaatagtagaaaaat

SEQ ID NO: 6075526 - DNA, 20 bp, Homo sapiens
aaatagtaggaccaatgttg

SEQ ID NO: 6075527 - DNA, 23 bp, Homo sapiens
aaatagtaggcaagatggcacag

SEQ ID NO: 6075528 - DNA, 20 bp, Homo sapiens
aaatagtaggctaaaaacat

SEQ ID NO: 6075529 - DNA, 13 bp, Homo sapiens
aaatagtattcca

SEQ ID NO: 6075530 - DNA, 23 bp, Homo sapiens
aaatagtcaaaaattaaatatat

SEQ ID NO: 6075531 - DNA, 21 bp, Homo sapiens
aaatagtcatgattctatgta

SEQ ID NO: 6075532 - DNA, 19 bp, Homo sapiens
aaatagtcatgtttctgca

SEQ ID NO: 6075533 - DNA, 16 bp, Homo sapiens
aaatagtcatttttag

SEQ ID NO: 6075534 - DNA, 17 bp, Homo sapiens
aaatagtctcattgcca

SEQ ID NO: 6075535 - DNA, 20 bp, Homo sapiens
aaatagtctgattttaatga

SEQ ID NO: 6075536 - DNA, 13 bp, Homo sapiens
aaatagtgaaaag

SEQ ID NO: 6075537 - DNA, 19 bp, Homo sapiens
aaatagtgacataatatat

SEQ ID NO: 6075538 - DNA, 21 bp, Homo sapiens
aaatagtgacataatatattc

SEQ ID NO: 6075539 - DNA, 22 bp, Homo sapiens
aaatagtgacataatatattct

SEQ ID NO: 6075540 - DNA, 21 bp, Homo sapiens
aaatagtgcagaatctcatag

SEQ ID NO: 6075541 - DNA, 13 bp, Homo sapiens
aaatagtgtaaga

SEQ ID NO: 6075542 - DNA, 15 bp, Homo sapiens
aaatagtgtaagaac

SEQ ID NO: 6075543 - DNA, 15 bp, Homo sapiens
aaatagtgtgaaata

SEQ ID NO: 6075544 - DNA, 20 bp, Homo sapiens
aaatagtgtggaaattaaga

SEQ ID NO: 6075545 - DNA, 15 bp, Homo sapiens
aaatagtgttctttt

SEQ ID NO: 6075546 - DNA, 21 bp, Homo sapiens
aaatagtgttctttttaaaaa

SEQ ID NO: 6075547 - DNA, 13 bp, Homo sapiens
aaatagttaacac

SEQ ID NO: 6075548 - DNA, 14 bp, Homo sapiens
aaatagttaacaca

SEQ ID NO: 6075549 - DNA, 18 bp, Homo sapiens
aaatagttaacacagatc

SEQ ID NO: 6075550 - DNA, 14 bp, Homo sapiens
aaatagttaatata

SEQ ID NO: 6075551 - DNA, 17 bp, Homo sapiens
aaatagttacaagcatt

SEQ ID NO: 6075552 - DNA, 20 bp, Homo sapiens
aaatagttattttaatacct

SEQ ID NO: 6075553 - DNA, 21 bp, Homo sapiens
aaatagttattttaatacctt

SEQ ID NO: 6075554 - DNA, 17 bp, Homo sapiens
aaatagttctatttcta

SEQ ID NO: 6075555 - DNA, 16 bp, Homo sapiens
aaatagttctgtgact

SEQ ID NO: 6075556 - DNA, 13 bp, Homo sapiens
aaatagttgtaaa

SEQ ID NO: 6075557 - DNA, 14 bp, Homo sapiens
aaatagttgtctgt

SEQ ID NO: 6075558 - DNA, 16 bp, Homo sapiens
aaatagttgtctgtgc

SEQ ID NO: 6075559 - DNA, 17 bp, Homo sapiens
aaatagttgtctgtgct

SEQ ID NO: 6075560 - DNA, 15 bp, Homo sapiens
aaatagtttaaaaat

SEQ ID NO: 6075561 - DNA, 18 bp, Homo sapiens
aaatagtttaaaaatatt

SEQ ID NO: 6075562 - DNA, 22 bp, Homo sapiens
aaatagtttacttcactttcat

SEQ ID NO: 6075563 - DNA, 12 bp, Homo sapiens
aaatagtttatt

SEQ ID NO: 6075564 - DNA, 21 bp, Homo sapiens
aaatagtttattttaaaacaa

SEQ ID NO: 6075565 - DNA, 21 bp, Homo sapiens
aaatagtttcaaatgagttta

SEQ ID NO: 6075566 - DNA, 13 bp, Homo sapiens
aaatagtttccaa

SEQ ID NO: 6075567 - DNA, 19 bp, Homo sapiens
aaatagtttccaagaaatt

SEQ ID NO: 6075568 - DNA, 20 bp, Homo sapiens
aaatagtttgaattcagtaa

SEQ ID NO: 6075569 - DNA, 23 bp, Homo sapiens
aaatagttttaaatatgaacaaa

SEQ ID NO: 6075570 - DNA, 18 bp, Homo sapiens
aaatagttttacattaac

SEQ ID NO: 6075571 - DNA, 21 bp, Homo sapiens
aaatagttttctaaatgtttc

SEQ ID NO: 6075572 - DNA, 11 bp, Homo sapiens
aaatataaaac

SEQ ID NO: 6075573 - DNA, 16 bp, Homo sapiens
aaatataaaacaaata

SEQ ID NO: 6075574 - DNA, 12 bp, Homo sapiens
aaatataaaact

SEQ ID NO: 6075575 - DNA, 15 bp, Homo sapiens
aaatataaaatacat

SEQ ID NO: 6075576 - DNA, 18 bp, Homo sapiens
aaatataaaattatgaga

SEQ ID NO: 6075577 - DNA, 22 bp, Homo sapiens
aaatataaacaaagattcatga

SEQ ID NO: 6075578 - DNA, 23 bp, Homo sapiens
aaatataaacaaagattcatgat

SEQ ID NO: 6075579 - DNA, 15 bp, Homo sapiens
aaatataaacaatgt

SEQ ID NO: 6075580 - DNA, 21 bp, Homo sapiens
aaatataaaccagctacttga

SEQ ID NO: 6075581 - DNA, 11 bp, Homo sapiens
aaatataaact

SEQ ID NO: 6075582 - DNA, 14 bp, Homo sapiens
aaatataaactgtg

SEQ ID NO: 6075583 - DNA, 15 bp, Homo sapiens
aaatataaactgtga

SEQ ID NO: 6075584 - DNA, 17 bp, Homo sapiens
aaatataaactgtgaga

SEQ ID NO: 6075585 - DNA, 14 bp, Homo sapiens
aaatataaacttgt

SEQ ID NO: 6075586 - DNA, 19 bp, Homo sapiens
aaatataaagcatctaaac

SEQ ID NO: 6075587 - DNA, 13 bp, Homo sapiens
aaatataaatgca

SEQ ID NO: 6075588 - DNA, 15 bp, Homo sapiens
aaatataaatgcatg

SEQ ID NO: 6075589 - DNA, 17 bp, Homo sapiens
aaatataaatggtaagc

SEQ ID NO: 6075590 - DNA, 16 bp, Homo sapiens
aaatataaatgtttaa

SEQ ID NO: 6075591 - DNA, 12 bp, Homo sapiens
aaatataaatta

SEQ ID NO: 6075592 - DNA, 17 bp, Homo sapiens
aaatataaattgtacat

SEQ ID NO: 6075593 - DNA, 15 bp, Homo sapiens
aaatataaattttgt

SEQ ID NO: 6075594 - DNA, 16 bp, Homo sapiens
aaatataacacagttt

SEQ ID NO: 6075595 - DNA, 16 bp, Homo sapiens
aaatataacacatttt

SEQ ID NO: 6075596 - DNA, 17 bp, Homo sapiens
aaatataaccattacat

SEQ ID NO: 6075597 - DNA, 17 bp, Homo sapiens
aaatataagacatttgt

SEQ ID NO: 6075598 - DNA, 19 bp, Homo sapiens
aaatataagacatttgttt

SEQ ID NO: 6075599 - DNA, 21 bp, Homo sapiens
aaatataagacatttgtttgc

SEQ ID NO: 6075600 - DNA, 14 bp, Homo sapiens
aaatataagatttt

SEQ ID NO: 6075601 - DNA, 14 bp, Homo sapiens
aaatataagccttt

SEQ ID NO: 6075602 - DNA, 20 bp, Homo sapiens
aaatataagtctatactaat

SEQ ID NO: 6075603 - DNA, 20 bp, Homo sapiens
aaatataagtggtgcttaga

SEQ ID NO: 6075604 - DNA, 22 bp, Homo sapiens
aaatataatgttgataatatat

SEQ ID NO: 6075605 - DNA, 13 bp, Homo sapiens
aaatataattctg

SEQ ID NO: 6075606 - DNA, 19 bp, Homo sapiens
aaatataattgttttttat

SEQ ID NO: 6075607 - DNA, 12 bp, Homo sapiens
aaatataattta

SEQ ID NO: 6075608 - DNA, 21 bp, Homo sapiens
aaatataatttataagcattg

SEQ ID NO: 6075609 - DNA, 22 bp, Homo sapiens
aaatataatttataagcattgc

SEQ ID NO: 6075610 - DNA, 20 bp, Homo sapiens
aaatatacaaacatgtggca

SEQ ID NO: 6075611 - DNA, 20 bp, Homo sapiens
aaatatacagcatgagattg

SEQ ID NO: 6075612 - DNA, 12 bp, Homo sapiens
aaatatacagtt

SEQ ID NO: 6075613 - DNA, 13 bp, Homo sapiens
aaatatacagttt

SEQ ID NO: 6075614 - DNA, 18 bp, Homo sapiens
aaatatacagtttgactt

SEQ ID NO: 6075615 - DNA, 17 bp, Homo sapiens
aaatatacataaactta

SEQ ID NO: 6075616 - DNA, 15 bp, Homo sapiens
aaatatacattttct

SEQ ID NO: 6075617 - DNA, 20 bp, Homo sapiens
aaatatacattttctaaata

SEQ ID NO: 6075618 - DNA, 12 bp, Homo sapiens
aaatatactaat

SEQ ID NO: 6075619 - DNA, 17 bp, Homo sapiens
aaatatactaataaaaa

SEQ ID NO: 6075620 - DNA, 18 bp, Homo sapiens
aaatatactaataaaaag

SEQ ID NO: 6075621 - DNA, 22 bp, Homo sapiens
aaatatactaataaaaaggttt

SEQ ID NO: 6075622 - DNA, 12 bp, Homo sapiens
aaatatactgta

SEQ ID NO: 6075623 - DNA, 14 bp, Homo sapiens
aaatatactgtaaa

SEQ ID NO: 6075624 - DNA, 15 bp, Homo sapiens
aaatatactgtaaag

SEQ ID NO: 6075625 - DNA, 18 bp, Homo sapiens
aaatatacttaaatggaa

SEQ ID NO: 6075626 - DNA, 12 bp, Homo sapiens
aaatatacttga

SEQ ID NO: 6075627 - DNA, 16 bp, Homo sapiens
aaatatagaattttta

SEQ ID NO: 6075628 - DNA, 16 bp, Homo sapiens
aaatatagagacagga

SEQ ID NO: 6075629 - DNA, 13 bp, Homo sapiens
aaatatagattag

SEQ ID NO: 6075630 - DNA, 16 bp, Homo sapiens
aaatatagctgtacaa

SEQ ID NO: 6075631 - DNA, 20 bp, Homo sapiens
aaatatagctgtacaaatat

SEQ ID NO: 6075632 - DNA, 20 bp, Homo sapiens
aaatataggatagacactgg

SEQ ID NO: 6075633 - DNA, 13 bp, Homo sapiens
aaatatagtagca

SEQ ID NO: 6075634 - DNA, 17 bp, Homo sapiens
aaatatagtgaagcaat

SEQ ID NO: 6075635 - DNA, 15 bp, Homo sapiens
aaatatagtgttgtg

SEQ ID NO: 6075636 - DNA, 16 bp, Homo sapiens
aaatatagtgttgtgt

SEQ ID NO: 6075637 - DNA, 11 bp, Homo sapiens
aaatatagttg

SEQ ID NO: 6075638 - DNA, 14 bp, Homo sapiens
aaatatagttgaaa

SEQ ID NO: 6075639 - DNA, 21 bp, Homo sapiens
aaatatagttgaacaagattt

SEQ ID NO: 6075640 - DNA, 9 bp, Homo sapiens
aaatatata

SEQ ID NO: 6075641 - DNA, 14 bp, Homo sapiens
aaatatataaacaa

SEQ ID NO: 6075642 - DNA, 18 bp, Homo sapiens
aaatatataaacaaacaa

SEQ ID NO: 6075643 - DNA, 12 bp, Homo sapiens
aaatatataaat

SEQ ID NO: 6075644 - DNA, 15 bp, Homo sapiens
aaatatataaatata

SEQ ID NO: 6075645 - DNA, 12 bp, Homo sapiens
cccaggcaggga

SEQ ID NO: 6075646 - DNA, 17 bp, Homo sapiens
cccaggcagggagacgg

SEQ ID NO: 6075647 - DNA, 22 bp, Homo sapiens
cccaggcagggagggaaacccg

SEQ ID NO: 6075648 - DNA, 23 bp, Homo sapiens
cccaggcagggccaacccttctc

SEQ ID NO: 6075649 - DNA, 23 bp, Homo sapiens
cccaggcaggtcttgaactcctg

SEQ ID NO: 6075650 - DNA, 16 bp, Homo sapiens
cccaggcatcccatcc

SEQ ID NO: 6075651 - DNA, 15 bp, Homo sapiens
cccaggcatctcctt

SEQ ID NO: 6075652 - DNA, 23 bp, Homo sapiens
cccaggcatctccttgggctggg

SEQ ID NO: 6075653 - DNA, 14 bp, Homo sapiens
cccaggcatctgtt

SEQ ID NO: 6075654 - DNA, 21 bp, Homo sapiens
cccaggcatctgttagcagag

SEQ ID NO: 6075655 - DNA, 21 bp, Homo sapiens
cccaggcatgaaattcttcct

SEQ ID NO: 6075656 - DNA, 16 bp, Homo sapiens
cccaggcatgcagctg

SEQ ID NO: 6075657 - DNA, 17 bp, Homo sapiens
cccaggcatgcagctgc

SEQ ID NO: 6075658 - DNA, 21 bp, Homo sapiens
cccaggcattgccaagggctt

SEQ ID NO: 6075659 - DNA, 14 bp, Homo sapiens
cccaggccacagag

SEQ ID NO: 6075660 - DNA, 19 bp, Homo sapiens
cccaggccacagagaacct

SEQ ID NO: 6075661 - DNA, 13 bp, Homo sapiens
cccaggccacagc

SEQ ID NO: 6075662 - DNA, 14 bp, Homo sapiens
cccaggccacagcc

SEQ ID NO: 6075663 - DNA, 23 bp, Homo sapiens
cccaggccacagccagggctcca

SEQ ID NO: 6075664 - DNA, 16 bp, Homo sapiens
cccaggccacagccgc

SEQ ID NO: 6075665 - DNA, 18 bp, Homo sapiens
cccaggccacagccgcct

SEQ ID NO: 6075666 - DNA, 11 bp, Homo sapiens
cccaggccacc

SEQ ID NO: 6075667 - DNA, 18 bp, Homo sapiens
cccaggccagccccccca

SEQ ID NO: 6075668 - DNA, 23 bp, Homo sapiens
cccaggccagcccccccacccac

SEQ ID NO: 6075669 - DNA, 13 bp, Homo sapiens
cccaggccagcga

SEQ ID NO: 6075670 - DNA, 16 bp, Homo sapiens
cccaggccagctgcgg

SEQ ID NO: 6075671 - DNA, 17 bp, Homo sapiens
cccaggccagctgcggc

SEQ ID NO: 6075672 - DNA, 18 bp, Homo sapiens
cccaggccagcttcgagc

SEQ ID NO: 6075673 - DNA, 11 bp, Homo sapiens
cccaggccagg

SEQ ID NO: 6075674 - DNA, 13 bp, Homo sapiens
cccaggccaggac

SEQ ID NO: 6075675 - DNA, 14 bp, Homo sapiens
cccaggccaggact

SEQ ID NO: 6075676 - DNA, 19 bp, Homo sapiens
cccaggccaggactctgca

SEQ ID NO: 6075677 - DNA, 23 bp, Homo sapiens
cccaggccaggctccttcctgtc

SEQ ID NO: 6075678 - DNA, 13 bp, Homo sapiens
cccaggccagggc

SEQ ID NO: 6075679 - DNA, 21 bp, Homo sapiens
cccaggccagggctgggtcac

SEQ ID NO: 6075680 - DNA, 15 bp, Homo sapiens
cccaggccaggtagc

SEQ ID NO: 6075681 - DNA, 19 bp, Homo sapiens
cccaggccaggtgcccagg

SEQ ID NO: 6075682 - DNA, 20 bp, Homo sapiens
cccaggccaggtgcccagga

SEQ ID NO: 6075683 - DNA, 19 bp, Homo sapiens
cccaggccataccaggtgc

SEQ ID NO: 6075684 - DNA, 21 bp, Homo sapiens
cccaggccatcttccaggtgg

SEQ ID NO: 6075685 - DNA, 15 bp, Homo sapiens
cccaggccatgtggc

SEQ ID NO: 6075686 - DNA, 18 bp, Homo sapiens
cccaggccatgtggcctg

SEQ ID NO: 6075687 - DNA, 23 bp, Homo sapiens
cccaggccatgtggcctgcccag

SEQ ID NO: 6075688 - DNA, 11 bp, Homo sapiens
cccaggcccac

SEQ ID NO: 6075689 - DNA, 17 bp, Homo sapiens
cccaggcccagccctcc

SEQ ID NO: 6075690 - DNA, 18 bp, Homo sapiens
cccaggcccagccctcct

SEQ ID NO: 6075691 - DNA, 14 bp, Homo sapiens
cccaggcccagcct

SEQ ID NO: 6075692 - DNA, 15 bp, Homo sapiens
cccaggcccagcctc

SEQ ID NO: 6075693 - DNA, 17 bp, Homo sapiens
cccaggccccaggaagc

SEQ ID NO: 6075694 - DNA, 20 bp, Homo sapiens
cccaggccccatgacctcca

SEQ ID NO: 6075695 - DNA, 12 bp, Homo sapiens
cccaggccccct

SEQ ID NO: 6075696 - DNA, 23 bp, Homo sapiens
cccaggccccgaggacccagacc

SEQ ID NO: 6075697 - DNA, 21 bp, Homo sapiens
cccaggcccctgccaccctgg

SEQ ID NO: 6075698 - DNA, 23 bp, Homo sapiens
cccaggcccctggaggctgcctc

SEQ ID NO: 6075699 - DNA, 13 bp, Homo sapiens
cccaggcccgaga

SEQ ID NO: 6075700 - DNA, 13 bp, Homo sapiens
cccaggcccgccc

SEQ ID NO: 6075701 - DNA, 18 bp, Homo sapiens
cccaggcccgccctgccc

SEQ ID NO: 6075702 - DNA, 20 bp, Homo sapiens
cccaggcccggatgcagagg

SEQ ID NO: 6075703 - DNA, 17 bp, Homo sapiens
cccaggccctagaccct

SEQ ID NO: 6075704 - DNA, 13 bp, Homo sapiens
cccaggccctccc

SEQ ID NO: 6075705 - DNA, 16 bp, Homo sapiens
cccaggccctcccacc

SEQ ID NO: 6075706 - DNA, 18 bp, Homo sapiens
cccaggccctcccaccac

SEQ ID NO: 6075707 - DNA, 19 bp, Homo sapiens
cccaggccctcccaccacc

SEQ ID NO: 6075708 - DNA, 21 bp, Homo sapiens
cccaggccctcccaccacccc

SEQ ID NO: 6075709 - DNA, 14 bp, Homo sapiens
cccaggccctccct

SEQ ID NO: 6075710 - DNA, 18 bp, Homo sapiens
cccaggccctgccagagc

SEQ ID NO: 6075711 - DNA, 20 bp, Homo sapiens
cccaggccctgccagagcag

SEQ ID NO: 6075712 - DNA, 13 bp, Homo sapiens
cccaggcccttca

SEQ ID NO: 6075713 - DNA, 14 bp, Homo sapiens
cccaggccctttgg

SEQ ID NO: 6075714 - DNA, 18 bp, Homo sapiens
cccaggccgagaagccag

SEQ ID NO: 6075715 - DNA, 19 bp, Homo sapiens
cccaggccgcaccatttct

SEQ ID NO: 6075716 - DNA, 13 bp, Homo sapiens
cccaggccgcagc

SEQ ID NO: 6075717 - DNA, 15 bp, Homo sapiens
cccaggccgcatggc

SEQ ID NO: 6075718 - DNA, 14 bp, Homo sapiens
cccaggccggagcc

SEQ ID NO: 6075719 - DNA, 17 bp, Homo sapiens
cccaggccggagcccag

SEQ ID NO: 6075720 - DNA, 13 bp, Homo sapiens
cccaggccggcca

SEQ ID NO: 6075721 - DNA, 14 bp, Homo sapiens
cccaggccggccca

SEQ ID NO: 6075722 - DNA, 15 bp, Homo sapiens
cccaggccgggaaga

SEQ ID NO: 6075723 - DNA, 15 bp, Homo sapiens
cccaggccgtggctg

SEQ ID NO: 6075724 - DNA, 21 bp, Homo sapiens
cccaggccgttccccttggct

SEQ ID NO: 6075725 - DNA, 9 bp, Homo sapiens
cccaggcct

SEQ ID NO: 6075726 - DNA, 14 bp, Homo sapiens
cccaggcctccagc

SEQ ID NO: 6075727 - DNA, 17 bp, Homo sapiens
cccaggcctccagcctc

SEQ ID NO: 6075728 - DNA, 18 bp, Homo sapiens
cccaggcctccagcctct

SEQ ID NO: 6075729 - DNA, 19 bp, Homo sapiens
cccaggcctccagcctctc

SEQ ID NO: 6075730 - DNA, 17 bp, Homo sapiens
cccaggcctcctacagc

SEQ ID NO: 6075731 - DNA, 22 bp, Homo sapiens
cccaggcctcctaggggaaggg

SEQ ID NO: 6075732 - DNA, 22 bp, Homo sapiens
cccaggcctctgccccaagagc

SEQ ID NO: 6075733 - DNA, 17 bp, Homo sapiens
cccaggcctgagctgct

SEQ ID NO: 6075734 - DNA, 19 bp, Homo sapiens
cccaggcctgccctgctat

SEQ ID NO: 6075735 - DNA, 15 bp, Homo sapiens
cccaggcctgcctgc

SEQ ID NO: 6075736 - DNA, 13 bp, Homo sapiens
cccaggcctgctg

SEQ ID NO: 6075737 - DNA, 15 bp, Homo sapiens
cccaggcctgctggc

SEQ ID NO: 6075738 - DNA, 16 bp, Homo sapiens
cccaggcctgctggca

SEQ ID NO: 6075739 - DNA, 11 bp, Homo sapiens
cccaggcctgg

SEQ ID NO: 6075740 - DNA, 14 bp, Homo sapiens
cccaggcctggagc

SEQ ID NO: 6075741 - DNA, 13 bp, Homo sapiens
cccaggcctggcc

SEQ ID NO: 6075742 - DNA, 15 bp, Homo sapiens
cccaggcctggcctc

SEQ ID NO: 6075743 - DNA, 20 bp, Homo sapiens
cccaggcctggcctcggggc

SEQ ID NO: 6075744 - DNA, 13 bp, Homo sapiens
cccaggcctggct

SEQ ID NO: 6075745 - DNA, 14 bp, Homo sapiens
cccaggcctggctc

SEQ ID NO: 6075746 - DNA, 14 bp, Homo sapiens
cccaggcctgtggc

SEQ ID NO: 6075747 - DNA, 18 bp, Homo sapiens
cccaggcctgtggcccca

SEQ ID NO: 6075748 - DNA, 16 bp, Homo sapiens
cccaggccttgtccta

SEQ ID NO: 6075749 - DNA, 12 bp, Homo sapiens
cccaggcgctgc

SEQ ID NO: 6075750 - DNA, 16 bp, Homo sapiens
cccaggcgctgcatac

SEQ ID NO: 6075751 - DNA, 23 bp, Homo sapiens
cccaggcgctgcatacaggggag

SEQ ID NO: 6075752 - DNA, 16 bp, Homo sapiens
cccaggcggaggggct

SEQ ID NO: 6075753 - DNA, 14 bp, Homo sapiens
cccaggctccatgg

SEQ ID NO: 6075754 - DNA, 16 bp, Homo sapiens
cccaggctccatgggg

SEQ ID NO: 6075755 - DNA, 19 bp, Homo sapiens
cccaggctccatggggaag

SEQ ID NO: 6075756 - DNA, 14 bp, Homo sapiens
cccaggctcccctg

SEQ ID NO: 6075757 - DNA, 17 bp, Homo sapiens
cccaggctcccctggtc

SEQ ID NO: 6075758 - DNA, 20 bp, Homo sapiens
cccaggctcccctggtctcc

SEQ ID NO: 6075759 - DNA, 14 bp, Homo sapiens
cccaggctccgccc

SEQ ID NO: 6075760 - DNA, 22 bp, Homo sapiens
cccaggctcggaggaccctgga

SEQ ID NO: 6075761 - DNA, 19 bp, Homo sapiens
cccaggctcggcctgcccc

SEQ ID NO: 6075762 - DNA, 12 bp, Homo sapiens
cccaggctctgc

SEQ ID NO: 6075763 - DNA, 14 bp, Homo sapiens
cccaggctctgctg

SEQ ID NO: 6075764 - DNA, 17 bp, Homo sapiens
cccaggctctgctgact

SEQ ID NO: 6075765 - DNA, 14 bp, Homo sapiens
cccaggctctggga

SEQ ID NO: 6075766 - DNA, 18 bp, Homo sapiens
cccaggctctgggaaggg

SEQ ID NO: 6075767 - DNA, 20 bp, Homo sapiens
cccaggctctgggaaggggt

SEQ ID NO: 6075768 - DNA, 15 bp, Homo sapiens
cccaggctgaagagt

SEQ ID NO: 6075769 - DNA, 16 bp, Homo sapiens
cccaggctgagagcca

SEQ ID NO: 6075770 - DNA, 14 bp, Homo sapiens
cccaggctgcactg

SEQ ID NO: 6075771 - DNA, 16 bp, Homo sapiens
cccaggctgcactgca

SEQ ID NO: 6075772 - DNA, 20 bp, Homo sapiens
cccaggctgcccagagctgc

SEQ ID NO: 6075773 - DNA, 17 bp, Homo sapiens
cccaggctgccggctcc

SEQ ID NO: 6075774 - DNA, 20 bp, Homo sapiens
cccaggctgcctgagcacct

SEQ ID NO: 6075775 - DNA, 13 bp, Homo sapiens
cccaggctgcgcc

SEQ ID NO: 6075776 - DNA, 17 bp, Homo sapiens
cccaggctgcgcctgcc

SEQ ID NO: 6075777 - DNA, 21 bp, Homo sapiens
cccaggctgctggagtgcagt

SEQ ID NO: 6075778 - DNA, 21 bp, Homo sapiens
cccaggctggacatgctgact

SEQ ID NO: 6075779 - DNA, 15 bp, Homo sapiens
cccaggctggactgc

SEQ ID NO: 6075780 - DNA, 14 bp, Homo sapiens
cccaggctggagac

SEQ ID NO: 6075781 - DNA, 14 bp, Homo sapiens
cccaggctggagta

SEQ ID NO: 6075782 - DNA, 20 bp, Homo sapiens
cccaggctggagtgcaatgg

SEQ ID NO: 6075783 - DNA, 20 bp, Homo sapiens
cccaggctggagtgcagtga

SEQ ID NO: 6075784 - DNA, 22 bp, Homo sapiens
cccaggctggagtgcagtgaca

SEQ ID NO: 6075785 - DNA, 15 bp, Homo sapiens
cccaggctggatgct

SEQ ID NO: 6075786 - DNA, 14 bp, Homo sapiens
cccaggctggcctg

SEQ ID NO: 6075787 - DNA, 19 bp, Homo sapiens
cccaggctggcgtgcagtg

SEQ ID NO: 6075788 - DNA, 13 bp, Homo sapiens
cccaggctgggaa

SEQ ID NO: 6075789 - DNA, 12 bp, Homo sapiens
cccaggctgggc

SEQ ID NO: 6075790 - DNA, 13 bp, Homo sapiens
cccaggctggtct

SEQ ID NO: 6075791 - DNA, 21 bp, Homo sapiens
cccaggctgtgcagcgcagct

SEQ ID NO: 6075792 - DNA, 22 bp, Homo sapiens
cccaggctgtgcagcgcagctg

SEQ ID NO: 6075793 - DNA, 23 bp, Homo sapiens
cccaggctgtgcagcgcagctgg

SEQ ID NO: 6075794 - DNA, 15 bp, Homo sapiens
cccaggcttagtcac

SEQ ID NO: 6075795 - DNA, 17 bp, Homo sapiens
cccaggcttccgcgccc

SEQ ID NO: 6075796 - DNA, 13 bp, Homo sapiens
cccaggcttctca

SEQ ID NO: 6075797 - DNA, 22 bp, Homo sapiens
cccaggcttgtcactagcagct

SEQ ID NO: 6075798 - DNA, 17 bp, Homo sapiens
cccagggaagcagcagc

SEQ ID NO: 6075799 - DNA, 19 bp, Homo sapiens
cccagggaagcagcagcct

SEQ ID NO: 6075800 - DNA, 23 bp, Homo sapiens
cccagggaagcagcagcctcgcc

SEQ ID NO: 6075801 - DNA, 21 bp, Homo sapiens
cccagggaagcctgggtgtca

SEQ ID NO: 6075802 - DNA, 14 bp, Homo sapiens
cccagggaaggaaa

SEQ ID NO: 6075803 - DNA, 13 bp, Homo sapiens
cccagggaaggac

SEQ ID NO: 6075804 - DNA, 18 bp, Homo sapiens
cccagggaaggtggggcc

SEQ ID NO: 6075805 - DNA, 20 bp, Homo sapiens
cccagggaaggtggggccct

SEQ ID NO: 6075806 - DNA, 22 bp, Homo sapiens
cccagggaatcagggaccagct

SEQ ID NO: 6075807 - DNA, 20 bp, Homo sapiens
cccagggacaccagccaggc

SEQ ID NO: 6075808 - DNA, 21 bp, Homo sapiens
cccagggacagaaaccaaggc

SEQ ID NO: 6075809 - DNA, 23 bp, Homo sapiens
cccagggacatgtatgcttccag

SEQ ID NO: 6075810 - DNA, 21 bp, Homo sapiens
cccagggacattgcagagtgg

SEQ ID NO: 6075811 - DNA, 15 bp, Homo sapiens
cccagggaccagcac

SEQ ID NO: 6075812 - DNA, 22 bp, Homo sapiens
cccagggacgtgataatgcaga

SEQ ID NO: 6075813 - DNA, 14 bp, Homo sapiens
cccagggagaggct

SEQ ID NO: 6075814 - DNA, 21 bp, Homo sapiens
cccagggagcggaaagcagct

SEQ ID NO: 6075815 - DNA, 13 bp, Homo sapiens
cccagggagctct

SEQ ID NO: 6075816 - DNA, 14 bp, Homo sapiens
cccagggagctctg

SEQ ID NO: 6075817 - DNA, 15 bp, Homo sapiens
cccagggagctctgg

SEQ ID NO: 6075818 - DNA, 19 bp, Homo sapiens
cccagggagctctggggac

SEQ ID NO: 6075819 - DNA, 20 bp, Homo sapiens
cccagggagctgatgcccct

SEQ ID NO: 6075820 - DNA, 17 bp, Homo sapiens
cccagggaggcagcgtg

SEQ ID NO: 6075821 - DNA, 23 bp, Homo sapiens
cccagggaggcagcgtgggctct

SEQ ID NO: 6075822 - DNA, 18 bp, Homo sapiens
cccagggaggccgaagct

SEQ ID NO: 6075823 - DNA, 19 bp, Homo sapiens
cccagggagggaagtgtga

SEQ ID NO: 6075824 - DNA, 12 bp, Homo sapiens
cccagggagggg

SEQ ID NO: 6075825 - DNA, 17 bp, Homo sapiens
aaatatataaatatata

SEQ ID NO: 6075826 - DNA, 18 bp, Homo sapiens
aaatatataaatatatat

SEQ ID NO: 6075827 - DNA, 12 bp, Homo sapiens
aaatatataata

SEQ ID NO: 6075828 - DNA, 16 bp, Homo sapiens
aaatatataatatact

SEQ ID NO: 6075829 - DNA, 14 bp, Homo sapiens
aaatatataatatt

SEQ ID NO: 6075830 - DNA, 13 bp, Homo sapiens
aaatatatacatt

SEQ ID NO: 6075831 - DNA, 21 bp, Homo sapiens
aaatatatataaatatatata

SEQ ID NO: 6075832 - DNA, 15 bp, Homo sapiens
aaatatatatacata

SEQ ID NO: 6075833 - DNA, 16 bp, Homo sapiens
aaatatatatagatat

SEQ ID NO: 6075834 - DNA, 12 bp, Homo sapiens
aaatatatatat

SEQ ID NO: 6075835 - DNA, 19 bp, Homo sapiens
aaatatatatatatataaa

SEQ ID NO: 6075836 - DNA, 15 bp, Homo sapiens
aaatatatatatgta

SEQ ID NO: 6075837 - DNA, 14 bp, Homo sapiens
aaatatatatcaaa

SEQ ID NO: 6075838 - DNA, 22 bp, Homo sapiens
aaatatatatctaaatttagaa

SEQ ID NO: 6075839 - DNA, 19 bp, Homo sapiens
aaatatatatgatcattga

SEQ ID NO: 6075840 - DNA, 16 bp, Homo sapiens
aaatatatatgtcaat

SEQ ID NO: 6075841 - DNA, 23 bp, Homo sapiens
aaatatatatgtgtgtgtatgtt

SEQ ID NO: 6075842 - DNA, 13 bp, Homo sapiens
aaatatatattat

SEQ ID NO: 6075843 - DNA, 15 bp, Homo sapiens
aaatatatattattc

SEQ ID NO: 6075844 - DNA, 21 bp, Homo sapiens
aaatatatattattctcattt

SEQ ID NO: 6075845 - DNA, 15 bp, Homo sapiens
aaatatatattgtat

SEQ ID NO: 6075846 - DNA, 16 bp, Homo sapiens
aaatatatatttatca

SEQ ID NO: 6075847 - DNA, 13 bp, Homo sapiens
aaatatatatttt

SEQ ID NO: 6075848 - DNA, 16 bp, Homo sapiens
aaatatatatttttca

SEQ ID NO: 6075849 - DNA, 18 bp, Homo sapiens
aaatatatatttttcaaa

SEQ ID NO: 6075850 - DNA, 20 bp, Homo sapiens
aaatatatatttttcaaata

SEQ ID NO: 6075851 - DNA, 23 bp, Homo sapiens
aaatatatatttttcaaatagat

SEQ ID NO: 6075852 - DNA, 15 bp, Homo sapiens
aaatatatcctgtgt

SEQ ID NO: 6075853 - DNA, 19 bp, Homo sapiens
aaatatatctgttggagaa

SEQ ID NO: 6075854 - DNA, 17 bp, Homo sapiens
aaatatatctttgtaaa

SEQ ID NO: 6075855 - DNA, 15 bp, Homo sapiens
aaatatatgaacatt

SEQ ID NO: 6075856 - DNA, 21 bp, Homo sapiens
aaatatatgaagacaataatt

SEQ ID NO: 6075857 - DNA, 18 bp, Homo sapiens
aaatatatgcctggcaca

SEQ ID NO: 6075858 - DNA, 21 bp, Homo sapiens
aaatatatggtctaatgttta

SEQ ID NO: 6075859 - DNA, 12 bp, Homo sapiens
aaatatatgtaa

SEQ ID NO: 6075860 - DNA, 14 bp, Homo sapiens
aaatatatgtaata

SEQ ID NO: 6075861 - DNA, 15 bp, Homo sapiens
aaatatatgtaatat

SEQ ID NO: 6075862 - DNA, 12 bp, Homo sapiens
aaatatatgtat

SEQ ID NO: 6075863 - DNA, 13 bp, Homo sapiens
aaatatatgtata

SEQ ID NO: 6075864 - DNA, 19 bp, Homo sapiens
aaatatatgtatatatatt

SEQ ID NO: 6075865 - DNA, 20 bp, Homo sapiens
aaatatatgtatatatattc

SEQ ID NO: 6075866 - DNA, 21 bp, Homo sapiens
aaatatatgtatatatattct

SEQ ID NO: 6075867 - DNA, 14 bp, Homo sapiens
aaatatatgtatgt

SEQ ID NO: 6075868 - DNA, 15 bp, Homo sapiens
aaatatatgtatgta

SEQ ID NO: 6075869 - DNA, 20 bp, Homo sapiens
aaatatatgtatgtaaaaat

SEQ ID NO: 6075870 - DNA, 20 bp, Homo sapiens
aaatatatgtatttaaaaac

SEQ ID NO: 6075871 - DNA, 12 bp, Homo sapiens
aaatatatgtct

SEQ ID NO: 6075872 - DNA, 11 bp, Homo sapiens
aaatatatgtt

SEQ ID NO: 6075873 - DNA, 15 bp, Homo sapiens
aaatatatgttttga

SEQ ID NO: 6075874 - DNA, 15 bp, Homo sapiens
aaatatattaaaaat

SEQ ID NO: 6075875 - DNA, 18 bp, Homo sapiens
aaatatattaaaaatata

SEQ ID NO: 6075876 - DNA, 20 bp, Homo sapiens
aaatatattaaaaatataaa

SEQ ID NO: 6075877 - DNA, 22 bp, Homo sapiens
aaatatattaaaaatataaaca

SEQ ID NO: 6075878 - DNA, 12 bp, Homo sapiens
aaatatattatt

SEQ ID NO: 6075879 - DNA, 16 bp, Homo sapiens
aaatatattattactt

SEQ ID NO: 6075880 - DNA, 23 bp, Homo sapiens
aaatatattattacttgtaaata

SEQ ID NO: 6075881 - DNA, 17 bp, Homo sapiens
aaatatattctctttgg

SEQ ID NO: 6075882 - DNA, 14 bp, Homo sapiens
aaatatattgtata

SEQ ID NO: 6075883 - DNA, 22 bp, Homo sapiens
aaatatattgttaatctctgtt

SEQ ID NO: 6075884 - DNA, 15 bp, Homo sapiens
aaatatatttaacta

SEQ ID NO: 6075885 - DNA, 21 bp, Homo sapiens
aaatatatttaagataattat

SEQ ID NO: 6075886 - DNA, 14 bp, Homo sapiens
aaatatatttaatg

SEQ ID NO: 6075887 - DNA, 16 bp, Homo sapiens
aaatatatttgtcact

SEQ ID NO: 6075888 - DNA, 17 bp, Homo sapiens
aaatatattttaaatgt

SEQ ID NO: 6075889 - DNA, 19 bp, Homo sapiens
aaatatattttaaatgtgg

SEQ ID NO: 6075890 - DNA, 22 bp, Homo sapiens
aaatatattttaagacgaaaca

SEQ ID NO: 6075891 - DNA, 15 bp, Homo sapiens
aaatatattttatga

SEQ ID NO: 6075892 - DNA, 22 bp, Homo sapiens
aaatatattttatgatttaaaa

SEQ ID NO: 6075893 - DNA, 19 bp, Homo sapiens
aaatatattttctcttttt

SEQ ID NO: 6075894 - DNA, 23 bp, Homo sapiens
aaatatatttttccctgtttgcc

SEQ ID NO: 6075895 - DNA, 17 bp, Homo sapiens
aaatatcaaaaggaaga

SEQ ID NO: 6075896 - DNA, 19 bp, Homo sapiens
aaatatcaaacacggaccc

SEQ ID NO: 6075897 - DNA, 12 bp, Homo sapiens
aaatatcaaagt

SEQ ID NO: 6075898 - DNA, 13 bp, Homo sapiens
aaatatcaaatta

SEQ ID NO: 6075899 - DNA, 20 bp, Homo sapiens
aaatatcaaattaattgtgt

SEQ ID NO: 6075900 - DNA, 23 bp, Homo sapiens
aaatatcaaattaattgtgtgaa

SEQ ID NO: 6075901 - DNA, 14 bp, Homo sapiens
aaatatcaatcatt

SEQ ID NO: 6075902 - DNA, 18 bp, Homo sapiens
aaatatcaatcattttcc

SEQ ID NO: 6075903 - DNA, 21 bp, Homo sapiens
aaatatcacactgaataagag

SEQ ID NO: 6075904 - DNA, 20 bp, Homo sapiens
aaatatcacagtattatctg

SEQ ID NO: 6075905 - DNA, 21 bp, Homo sapiens
aaatatcaccccttgaagcct

SEQ ID NO: 6075906 - DNA, 22 bp, Homo sapiens
aaatatcacttgtcaataaaat

SEQ ID NO: 6075907 - DNA, 14 bp, Homo sapiens
aaatatcactttgt

SEQ ID NO: 6075908 - DNA, 22 bp, Homo sapiens
aaatatcagacaagcactattt

SEQ ID NO: 6075909 - DNA, 16 bp, Homo sapiens
aaatatcagcttttct

SEQ ID NO: 6075910 - DNA, 21 bp, Homo sapiens
aaatatcagcttttcttattc

SEQ ID NO: 6075911 - DNA, 12 bp, Homo sapiens
aaatatcagtat

SEQ ID NO: 6075912 - DNA, 17 bp, Homo sapiens
aaatatcagtattctga

SEQ ID NO: 6075913 - DNA, 13 bp, Homo sapiens
aaatatcataaag

SEQ ID NO: 6075914 - DNA, 15 bp, Homo sapiens
aaatatcataaagca

SEQ ID NO: 6075915 - DNA, 17 bp, Homo sapiens
aaatatcataaagcatt

SEQ ID NO: 6075916 - DNA, 11 bp, Homo sapiens
aaatatcattc

SEQ ID NO: 6075917 - DNA, 13 bp, Homo sapiens
aaatatcattgta

SEQ ID NO: 6075918 - DNA, 16 bp, Homo sapiens
aaatatcatttactct

SEQ ID NO: 6075919 - DNA, 21 bp, Homo sapiens
aaatatcccagagaacaatca

SEQ ID NO: 6075920 - DNA, 19 bp, Homo sapiens
aaatatcccgggggtgggg

SEQ ID NO: 6075921 - DNA, 15 bp, Homo sapiens
aaatatccctcattt

SEQ ID NO: 6075922 - DNA, 14 bp, Homo sapiens
aaatatcccttccg

SEQ ID NO: 6075923 - DNA, 20 bp, Homo sapiens
aaatatcccttggacatttt

SEQ ID NO: 6075924 - DNA, 14 bp, Homo sapiens
aaatatcctgctca

SEQ ID NO: 6075925 - DNA, 19 bp, Homo sapiens
aaatatcgctgatgcagac

SEQ ID NO: 6075926 - DNA, 18 bp, Homo sapiens
aaatatctacctgccctc

SEQ ID NO: 6075927 - DNA, 19 bp, Homo sapiens
aaatatctacctgccctct

SEQ ID NO: 6075928 - DNA, 20 bp, Homo sapiens
aaatatctacctgccctctc

SEQ ID NO: 6075929 - DNA, 19 bp, Homo sapiens
aaatatctagtaatatatt

SEQ ID NO: 6075930 - DNA, 20 bp, Homo sapiens
aaatatctagtaatatattt

SEQ ID NO: 6075931 - DNA, 13 bp, Homo sapiens
aaatatctagtgc

SEQ ID NO: 6075932 - DNA, 16 bp, Homo sapiens
aaatatctagtgctaa

SEQ ID NO: 6075933 - DNA, 17 bp, Homo sapiens
aaatatctatgttttac

SEQ ID NO: 6075934 - DNA, 22 bp, Homo sapiens
aaatatctatttgaataaatta

SEQ ID NO: 6075935 - DNA, 22 bp, Homo sapiens
aaatatctcctccaatgtcctg

SEQ ID NO: 6075936 - DNA, 10 bp, Homo sapiens
aaatatctga

SEQ ID NO: 6075937 - DNA, 21 bp, Homo sapiens
aaatatctgaaaatgtatgtg

SEQ ID NO: 6075938 - DNA, 23 bp, Homo sapiens
aaatatctgaaaatgtatgtgta

SEQ ID NO: 6075939 - DNA, 17 bp, Homo sapiens
aaatatctgaacattta

SEQ ID NO: 6075940 - DNA, 15 bp, Homo sapiens
aaatatctgacatct

SEQ ID NO: 6075941 - DNA, 13 bp, Homo sapiens
aaatatctgttat

SEQ ID NO: 6075942 - DNA, 14 bp, Homo sapiens
aaatatctgttatt

SEQ ID NO: 6075943 - DNA, 14 bp, Homo sapiens
aaatatcttccttt

SEQ ID NO: 6075944 - DNA, 17 bp, Homo sapiens
aaatatcttcctttggg

SEQ ID NO: 6075945 - DNA, 15 bp, Homo sapiens
aaatatcttttatgt

SEQ ID NO: 6075946 - DNA, 22 bp, Homo sapiens
aaatatcttttatgtttgaata

SEQ ID NO: 6075947 - DNA, 19 bp, Homo sapiens
aaatatgaaaaatgtaaat

SEQ ID NO: 6075948 - DNA, 13 bp, Homo sapiens
aaatatgaaatga

SEQ ID NO: 6075949 - DNA, 24 bp, Homo sapiens
aaatatgaaatgataaagatgtca

SEQ ID NO: 6075950 - DNA, 18 bp, Homo sapiens
aaatatgaaattccagca

SEQ ID NO: 6075951 - DNA, 15 bp, Homo sapiens
aaatatgaacaaaga

SEQ ID NO: 6075952 - DNA, 18 bp, Homo sapiens
aaatatgaaccctttgtt

SEQ ID NO: 6075953 - DNA, 20 bp, Homo sapiens
aaatatgaacctattttcat

SEQ ID NO: 6075954 - DNA, 13 bp, Homo sapiens
aaatatgaatgaa

SEQ ID NO: 6075955 - DNA, 12 bp, Homo sapiens
aaatatgaatgc

SEQ ID NO: 6075956 - DNA, 20 bp, Homo sapiens
aaatatgaattctgttgtaa

SEQ ID NO: 6075957 - DNA, 20 bp, Homo sapiens
aaatatgacagaatttgtga

SEQ ID NO: 6075958 - DNA, 20 bp, Homo sapiens
aaatatgagagaactattgt

SEQ ID NO: 6075959 - DNA, 12 bp, Homo sapiens
aaatatgatact

SEQ ID NO: 6075960 - DNA, 22 bp, Homo sapiens
aaatatgatactctcagatttt

SEQ ID NO: 6075961 - DNA, 19 bp, Homo sapiens
aaatatgattttatttgac

SEQ ID NO: 6075962 - DNA, 13 bp, Homo sapiens
aaatatgcaaagc

SEQ ID NO: 6075963 - DNA, 15 bp, Homo sapiens
aaatatgcaaagcac

SEQ ID NO: 6075964 - DNA, 17 bp, Homo sapiens
aaatatgcaacctgtgc

SEQ ID NO: 6075965 - DNA, 18 bp, Homo sapiens
aaatatgcaacctgtgca

SEQ ID NO: 6075966 - DNA, 19 bp, Homo sapiens
aaatatgcaacctgtgcaa

SEQ ID NO: 6075967 - DNA, 20 bp, Homo sapiens
aaatatgcaacctgtgcaaa

SEQ ID NO: 6075968 - DNA, 22 bp, Homo sapiens
aaatatgcaacctgtgcaaaat

SEQ ID NO: 6075969 - DNA, 19 bp, Homo sapiens
aaatatgcactttccctag

SEQ ID NO: 6075970 - DNA, 21 bp, Homo sapiens
aaatatgcactttccctagaa

SEQ ID NO: 6075971 - DNA, 17 bp, Homo sapiens
aaatatgcagaatctct

SEQ ID NO: 6075972 - DNA, 23 bp, Homo sapiens
aaatatgcagtgatatggcagaa

SEQ ID NO: 6075973 - DNA, 18 bp, Homo sapiens
aaatatgcatctggccca

SEQ ID NO: 6075974 - DNA, 16 bp, Homo sapiens
aaatatgcatttttct

SEQ ID NO: 6075975 - DNA, 15 bp, Homo sapiens
aaatatgctaaatgt

SEQ ID NO: 6075976 - DNA, 19 bp, Homo sapiens
aaatatgctaatttgggga

SEQ ID NO: 6075977 - DNA, 18 bp, Homo sapiens
aaatatgctcttttgttt

SEQ ID NO: 6075978 - DNA, 22 bp, Homo sapiens
aaatatgctgttatgtccagaa

SEQ ID NO: 6075979 - DNA, 16 bp, Homo sapiens
aaatatggaacttaca

SEQ ID NO: 6075980 - DNA, 18 bp, Homo sapiens
aaatatggaacttacatt

SEQ ID NO: 6075981 - DNA, 16 bp, Homo sapiens
aaatatggacacttaa

SEQ ID NO: 6075982 - DNA, 17 bp, Homo sapiens
aaatatggcctttcttc

SEQ ID NO: 6075983 - DNA, 19 bp, Homo sapiens
aaatatggcctttcttcta

SEQ ID NO: 6075984 - DNA, 14 bp, Homo sapiens
aaatatggtagctc

SEQ ID NO: 6075985 - DNA, 19 bp, Homo sapiens
aaatatggtttggtttttc

SEQ ID NO: 6075986 - DNA, 12 bp, Homo sapiens
aaatatgtaaac

SEQ ID NO: 6075987 - DNA, 15 bp, Homo sapiens
aaatatgtaagaaca

SEQ ID NO: 6075988 - DNA, 12 bp, Homo sapiens
aaatatgtaata

SEQ ID NO: 6075989 - DNA, 21 bp, Homo sapiens
aaatatgtaatataaatttaa

SEQ ID NO: 6075990 - DNA, 14 bp, Homo sapiens
aaatatgtaatgct

SEQ ID NO: 6075991 - DNA, 22 bp, Homo sapiens
aaatatgtaatgcttccaatct

SEQ ID NO: 6075992 - DNA, 12 bp, Homo sapiens
aaatatgtaatt

SEQ ID NO: 6075993 - DNA, 19 bp, Homo sapiens
aaatatgtaatttcaaaat

SEQ ID NO: 6075994 - DNA, 20 bp, Homo sapiens
aaatatgtaatttcaaaata

SEQ ID NO: 6075995 - DNA, 20 bp, Homo sapiens
aaatatgtacatttctcagg

SEQ ID NO: 6075996 - DNA, 16 bp, Homo sapiens
aaatatgtactgtata

SEQ ID NO: 6075997 - DNA, 18 bp, Homo sapiens
aaatatgtactgtataac

SEQ ID NO: 6075998 - DNA, 17 bp, Homo sapiens
aaatatgtagaatgtaa

SEQ ID NO: 6075999 - DNA, 17 bp, Homo sapiens
aaatatgtatcctctat

SEQ ID NO: 6076000 - DNA, 20 bp, Homo sapiens
aaatatgtgaaggaccttca

SEQ ID NO: 6076001 - DNA, 13 bp, Homo sapiens
aaatatgtgaagt

SEQ ID NO: 6076002 - DNA, 23 bp, Homo sapiens
aaatatgtgagattttttattgc

SEQ ID NO: 6076003 - DNA, 20 bp, Homo sapiens
aaatatgtgagcatgaaact

SEQ ID NO: 6076004 - DNA, 19 bp, Homo sapiens
cccagggagggtgagctgg

SEQ ID NO: 6076005 - DNA, 20 bp, Homo sapiens
cccagggagggtgagctggt

SEQ ID NO: 6076006 - DNA, 17 bp, Homo sapiens
cccagggaggtggcagg

SEQ ID NO: 6076007 - DNA, 14 bp, Homo sapiens
cccagggagtcctt

SEQ ID NO: 6076008 - DNA, 15 bp, Homo sapiens
cccagggagtgagca

SEQ ID NO: 6076009 - DNA, 20 bp, Homo sapiens
cccagggagtgagcagctac

SEQ ID NO: 6076010 - DNA, 22 bp, Homo sapiens
cccagggagtgagcagctactg

SEQ ID NO: 6076011 - DNA, 11 bp, Homo sapiens
cccagggatgg

SEQ ID NO: 6076012 - DNA, 18 bp, Homo sapiens
cccagggcaagctccgca

SEQ ID NO: 6076013 - DNA, 16 bp, Homo sapiens
cccagggcacaggagc

SEQ ID NO: 6076014 - DNA, 16 bp, Homo sapiens
cccagggcacccaggc

SEQ ID NO: 6076015 - DNA, 13 bp, Homo sapiens
cccagggcagcca

SEQ ID NO: 6076016 - DNA, 15 bp, Homo sapiens
cccagggcagccagg

SEQ ID NO: 6076017 - DNA, 14 bp, Homo sapiens
cccagggcagcctc

SEQ ID NO: 6076018 - DNA, 14 bp, Homo sapiens
cccagggcagcctg

SEQ ID NO: 6076019 - DNA, 23 bp, Homo sapiens
cccagggcagctttgccctccaa

SEQ ID NO: 6076020 - DNA, 12 bp, Homo sapiens
cccagggcaggg

SEQ ID NO: 6076021 - DNA, 22 bp, Homo sapiens
cccagggccagggccctgcaga

SEQ ID NO: 6076022 - DNA, 13 bp, Homo sapiens
cccagggcccaga

SEQ ID NO: 6076023 - DNA, 15 bp, Homo sapiens
cccagggcccagagc

SEQ ID NO: 6076024 - DNA, 11 bp, Homo sapiens
cccagggcccc

SEQ ID NO: 6076025 - DNA, 14 bp, Homo sapiens
cccagggcccctcc

SEQ ID NO: 6076026 - DNA, 14 bp, Homo sapiens
cccagggcccggca

SEQ ID NO: 6076027 - DNA, 17 bp, Homo sapiens
cccagggccctcccagc

SEQ ID NO: 6076028 - DNA, 19 bp, Homo sapiens
cccagggccctgctcaggc

SEQ ID NO: 6076029 - DNA, 23 bp, Homo sapiens
cccagggccctgctcaggcctca

SEQ ID NO: 6076030 - DNA, 15 bp, Homo sapiens
cccagggccctggat

SEQ ID NO: 6076031 - DNA, 15 bp, Homo sapiens
cccagggccctggcc

SEQ ID NO: 6076032 - DNA, 18 bp, Homo sapiens
cccagggccctggccagc

SEQ ID NO: 6076033 - DNA, 19 bp, Homo sapiens
cccagggccctggccagcc

SEQ ID NO: 6076034 - DNA, 18 bp, Homo sapiens
cccagggccgcttctcct

SEQ ID NO: 6076035 - DNA, 19 bp, Homo sapiens
cccagggccgcttctcctg

SEQ ID NO: 6076036 - DNA, 19 bp, Homo sapiens
cccagggcctccagggccc

SEQ ID NO: 6076037 - DNA, 12 bp, Homo sapiens
cccagggcctct

SEQ ID NO: 6076038 - DNA, 15 bp, Homo sapiens
cccagggcctctggc

SEQ ID NO: 6076039 - DNA, 18 bp, Homo sapiens
cccagggcctctggcttc

SEQ ID NO: 6076040 - DNA, 19 bp, Homo sapiens
cccagggcctctggcttcc

SEQ ID NO: 6076041 - DNA, 14 bp, Homo sapiens
cccagggcctgact

SEQ ID NO: 6076042 - DNA, 21 bp, Homo sapiens
cccagggcctgacttgagcca

SEQ ID NO: 6076043 - DNA, 22 bp, Homo sapiens
cccagggcctgacttgagccac

SEQ ID NO: 6076044 - DNA, 23 bp, Homo sapiens
cccagggcctgacttgagccact

SEQ ID NO: 6076045 - DNA, 16 bp, Homo sapiens
cccagggcctgcagga

SEQ ID NO: 6076046 - DNA, 19 bp, Homo sapiens
cccagggcctgcaggacct

SEQ ID NO: 6076047 - DNA, 20 bp, Homo sapiens
cccagggcctgcttcccctt

SEQ ID NO: 6076048 - DNA, 12 bp, Homo sapiens
cccagggcctgt

SEQ ID NO: 6076049 - DNA, 14 bp, Homo sapiens
cccagggcctgtct

SEQ ID NO: 6076050 - DNA, 17 bp, Homo sapiens
cccagggcctgtctccc

SEQ ID NO: 6076051 - DNA, 10 bp, Homo sapiens
cccagggcta

SEQ ID NO: 6076052 - DNA, 15 bp, Homo sapiens
cccagggctaccctc

SEQ ID NO: 6076053 - DNA, 18 bp, Homo sapiens
cccagggctagtgaagtg

SEQ ID NO: 6076054 - DNA, 14 bp, Homo sapiens
cccagggctcagcc

SEQ ID NO: 6076055 - DNA, 16 bp, Homo sapiens
cccagggctcagcctg

SEQ ID NO: 6076056 - DNA, 22 bp, Homo sapiens
cccagggctccctcctggagca

SEQ ID NO: 6076057 - DNA, 16 bp, Homo sapiens
cccagggctctctgga

SEQ ID NO: 6076058 - DNA, 20 bp, Homo sapiens
cccagggctctgcaggccac

SEQ ID NO: 6076059 - DNA, 16 bp, Homo sapiens
cccagggctctgtaag

SEQ ID NO: 6076060 - DNA, 12 bp, Homo sapiens
cccagggctggc

SEQ ID NO: 6076061 - DNA, 14 bp, Homo sapiens
cccagggctgggag

SEQ ID NO: 6076062 - DNA, 23 bp, Homo sapiens
cccagggctgtaactgccaggct

SEQ ID NO: 6076063 - DNA, 19 bp, Homo sapiens
cccaggggaacactgggga

SEQ ID NO: 6076064 - DNA, 24 bp, Homo sapiens
cccaggggagagggtctggagaag

SEQ ID NO: 6076065 - DNA, 17 bp, Homo sapiens
cccaggggagccagctg

SEQ ID NO: 6076066 - DNA, 22 bp, Homo sapiens
cccaggggagccagctgcttga

SEQ ID NO: 6076067 - DNA, 16 bp, Homo sapiens
cccaggggaggcggca

SEQ ID NO: 6076068 - DNA, 22 bp, Homo sapiens
cccaggggaggtgtattgtgta

SEQ ID NO: 6076069 - DNA, 18 bp, Homo sapiens
cccaggggcactgtgttc

SEQ ID NO: 6076070 - DNA, 23 bp, Homo sapiens
cccaggggcagcaaggccttggt

SEQ ID NO: 6076071 - DNA, 14 bp, Homo sapiens
cccaggggcagcca

SEQ ID NO: 6076072 - DNA, 17 bp, Homo sapiens
cccaggggcagccacac

SEQ ID NO: 6076073 - DNA, 16 bp, Homo sapiens
cccaggggcaggactg

SEQ ID NO: 6076074 - DNA, 17 bp, Homo sapiens
cccaggggcaggactga

SEQ ID NO: 6076075 - DNA, 16 bp, Homo sapiens
cccaggggcatgactg

SEQ ID NO: 6076076 - DNA, 23 bp, Homo sapiens
cccaggggctccctccgccccca

SEQ ID NO: 6076077 - DNA, 16 bp, Homo sapiens
cccaggggctttggtg

SEQ ID NO: 6076078 - DNA, 18 bp, Homo sapiens
cccaggggctttggtggc

SEQ ID NO: 6076079 - DNA, 19 bp, Homo sapiens
cccagggggcatgaccaga

SEQ ID NO: 6076080 - DNA, 16 bp, Homo sapiens
cccaggggtcccagcc

SEQ ID NO: 6076081 - DNA, 14 bp, Homo sapiens
cccaggggtctccc

SEQ ID NO: 6076082 - DNA, 22 bp, Homo sapiens
cccaggggtctccctggctccc

SEQ ID NO: 6076083 - DNA, 17 bp, Homo sapiens
cccaggggtgagccccg

SEQ ID NO: 6076084 - DNA, 20 bp, Homo sapiens
cccaggggtgagccccgccg

SEQ ID NO: 6076085 - DNA, 19 bp, Homo sapiens
cccaggggtgccccctcct

SEQ ID NO: 6076086 - DNA, 23 bp, Homo sapiens
cccaggggtgccccctcctctcc

SEQ ID NO: 6076087 - DNA, 17 bp, Homo sapiens
cccaggggtggggccca

SEQ ID NO: 6076088 - DNA, 21 bp, Homo sapiens
cccaggggtggggcccatggg

SEQ ID NO: 6076089 - DNA, 23 bp, Homo sapiens
cccaggggtggggcccatggggt

SEQ ID NO: 6076090 - DNA, 13 bp, Homo sapiens
cccagggtagccc

SEQ ID NO: 6076091 - DNA, 16 bp, Homo sapiens
cccagggtagcccgcc

SEQ ID NO: 6076092 - DNA, 18 bp, Homo sapiens
cccagggtcccaccccca

SEQ ID NO: 6076093 - DNA, 20 bp, Homo sapiens
cccagggtcccctgcatggc

SEQ ID NO: 6076094 - DNA, 18 bp, Homo sapiens
cccagggtccctgcccac

SEQ ID NO: 6076095 - DNA, 12 bp, Homo sapiens
cccagggtcctg

SEQ ID NO: 6076096 - DNA, 16 bp, Homo sapiens
cccagggtcctgggag

SEQ ID NO: 6076097 - DNA, 14 bp, Homo sapiens
cccagggtcctgtg

SEQ ID NO: 6076098 - DNA, 23 bp, Homo sapiens
cccagggtctagccgctgccctg

SEQ ID NO: 6076099 - DNA, 16 bp, Homo sapiens
cccagggtctgaaagg

SEQ ID NO: 6076100 - DNA, 19 bp, Homo sapiens
cccagggtctgaaaggggt

SEQ ID NO: 6076101 - DNA, 9 bp, Homo sapiens
cccagggtg

SEQ ID NO: 6076102 - DNA, 19 bp, Homo sapiens
cccagggtgagcagggccc

SEQ ID NO: 6076103 - DNA, 12 bp, Homo sapiens
cccagggtgcag

SEQ ID NO: 6076104 - DNA, 14 bp, Homo sapiens
cccagggtgcagtg

SEQ ID NO: 6076105 - DNA, 14 bp, Homo sapiens
cccagggtgctggg

SEQ ID NO: 6076106 - DNA, 19 bp, Homo sapiens
cccagggtggagtgcagtg

SEQ ID NO: 6076107 - DNA, 20 bp, Homo sapiens
cccagggtggagtgcagtgg

SEQ ID NO: 6076108 - DNA, 14 bp, Homo sapiens
cccagggtggccac

SEQ ID NO: 6076109 - DNA, 19 bp, Homo sapiens
cccagggtggccacacctc

SEQ ID NO: 6076110 - DNA, 17 bp, Homo sapiens
cccagggtggcgtccac

SEQ ID NO: 6076111 - DNA, 17 bp, Homo sapiens
cccagggtggctgccag

SEQ ID NO: 6076112 - DNA, 18 bp, Homo sapiens
cccagggtggctgccagc

SEQ ID NO: 6076113 - DNA, 19 bp, Homo sapiens
cccagggtggctgccagcc

SEQ ID NO: 6076114 - DNA, 16 bp, Homo sapiens
cccagggtgtttgcag

SEQ ID NO: 6076115 - DNA, 18 bp, Homo sapiens
cccagggttcagtcctca

SEQ ID NO: 6076116 - DNA, 14 bp, Homo sapiens
cccagggttctgta

SEQ ID NO: 6076117 - DNA, 15 bp, Homo sapiens
cccagggttctgtat

SEQ ID NO: 6076118 - DNA, 21 bp, Homo sapiens
cccagggttggggggtgccgg

SEQ ID NO: 6076119 - DNA, 14 bp, Homo sapiens
cccaggtaagcagg

SEQ ID NO: 6076120 - DNA, 14 bp, Homo sapiens
cccaggtaccagct

SEQ ID NO: 6076121 - DNA, 15 bp, Homo sapiens
cccaggtagctggga

SEQ ID NO: 6076122 - DNA, 16 bp, Homo sapiens
cccaggtagctgggat

SEQ ID NO: 6076123 - DNA, 20 bp, Homo sapiens
cccaggtaggccaaggtgtc

SEQ ID NO: 6076124 - DNA, 22 bp, Homo sapiens
cccaggtatcctgggggaagag

SEQ ID NO: 6076125 - DNA, 15 bp, Homo sapiens
cccaggtcagccctg

SEQ ID NO: 6076126 - DNA, 17 bp, Homo sapiens
cccaggtcagccctgtg

SEQ ID NO: 6076127 - DNA, 18 bp, Homo sapiens
cccaggtcagccctgtgt

SEQ ID NO: 6076128 - DNA, 20 bp, Homo sapiens
cccaggtcagccctgtgtct

SEQ ID NO: 6076129 - DNA, 13 bp, Homo sapiens
cccaggtcctgtc

SEQ ID NO: 6076130 - DNA, 16 bp, Homo sapiens
cccaggtcctgtctct

SEQ ID NO: 6076131 - DNA, 18 bp, Homo sapiens
cccaggtcctgtctctgc

SEQ ID NO: 6076132 - DNA, 18 bp, Homo sapiens
cccaggtcgcccacctgt

SEQ ID NO: 6076133 - DNA, 16 bp, Homo sapiens
cccaggtcgggcagtg

SEQ ID NO: 6076134 - DNA, 13 bp, Homo sapiens
cccaggtctcctg

SEQ ID NO: 6076135 - DNA, 16 bp, Homo sapiens
cccaggtctcctgggc

SEQ ID NO: 6076136 - DNA, 23 bp, Homo sapiens
cccaggtctcctgggcatctggc

SEQ ID NO: 6076137 - DNA, 14 bp, Homo sapiens
cccaggtctctcca

SEQ ID NO: 6076138 - DNA, 16 bp, Homo sapiens
cccaggtctgatgcca

SEQ ID NO: 6076139 - DNA, 22 bp, Homo sapiens
cccaggtctgatgccaaagctg

SEQ ID NO: 6076140 - DNA, 14 bp, Homo sapiens
cccaggtcttccag

SEQ ID NO: 6076141 - DNA, 16 bp, Homo sapiens
cccaggtcttccagac

SEQ ID NO: 6076142 - DNA, 18 bp, Homo sapiens
cccaggtcttcctgcttt

SEQ ID NO: 6076143 - DNA, 12 bp, Homo sapiens
cccaggtctttt

SEQ ID NO: 6076144 - DNA, 23 bp, Homo sapiens
cccaggtcttttctttgggaccc

SEQ ID NO: 6076145 - DNA, 16 bp, Homo sapiens
cccaggtgagaattca

SEQ ID NO: 6076146 - DNA, 18 bp, Homo sapiens
cccaggtgagacagcggt

SEQ ID NO: 6076147 - DNA, 21 bp, Homo sapiens
cccaggtgagggaaggagaca

SEQ ID NO: 6076148 - DNA, 16 bp, Homo sapiens
cccaggtgatattttt

SEQ ID NO: 6076149 - DNA, 20 bp, Homo sapiens
cccaggtgcagccagaggca

SEQ ID NO: 6076150 - DNA, 17 bp, Homo sapiens
cccaggtgcagccccag

SEQ ID NO: 6076151 - DNA, 18 bp, Homo sapiens
cccaggtgccaccaataa

SEQ ID NO: 6076152 - DNA, 21 bp, Homo sapiens
cccaggtgccaccaataaaaa

SEQ ID NO: 6076153 - DNA, 16 bp, Homo sapiens
cccaggtgccagcctg

SEQ ID NO: 6076154 - DNA, 15 bp, Homo sapiens
cccaggtgctggagg

SEQ ID NO: 6076155 - DNA, 17 bp, Homo sapiens
cccaggtgctggaggca

SEQ ID NO: 6076156 - DNA, 23 bp, Homo sapiens
cccaggtggaaggcagacagcag

SEQ ID NO: 6076157 - DNA, 18 bp, Homo sapiens
cccaggtggagggcacag

SEQ ID NO: 6076158 - DNA, 22 bp, Homo sapiens
cccaggtggagggcacagccct

SEQ ID NO: 6076159 - DNA, 20 bp, Homo sapiens
cccaggtggaggtgccagga

SEQ ID NO: 6076160 - DNA, 21 bp, Homo sapiens
cccaggtggattttgtggagg

SEQ ID NO: 6076161 - DNA, 23 bp, Homo sapiens
cccaggtggctgacccagtccct

SEQ ID NO: 6076162 - DNA, 15 bp, Homo sapiens
cccaggtggctgtgg

SEQ ID NO: 6076163 - DNA, 14 bp, Homo sapiens
cccaggtgtgcctg

SEQ ID NO: 6076164 - DNA, 17 bp, Homo sapiens
cccaggtgtgcctgtgc

SEQ ID NO: 6076165 - DNA, 19 bp, Homo sapiens
cccaggtgtgcctgtgctc

SEQ ID NO: 6076166 - DNA, 20 bp, Homo sapiens
cccaggttcatgaatatggt

SEQ ID NO: 6076167 - DNA, 19 bp, Homo sapiens
cccaggttcccccagcaag

SEQ ID NO: 6076168 - DNA, 18 bp, Homo sapiens
cccaggttcgagacccaa

SEQ ID NO: 6076169 - DNA, 17 bp, Homo sapiens
cccaggttggaggccct

SEQ ID NO: 6076170 - DNA, 16 bp, Homo sapiens
cccaggttggctctgc

SEQ ID NO: 6076171 - DNA, 19 bp, Homo sapiens
cccaggtttctggtctcta

SEQ ID NO: 6076172 - DNA, 22 bp, Homo sapiens
cccaggtttctggtctctaggc

SEQ ID NO: 6076173 - DNA, 13 bp, Homo sapiens
cccagtaaaattg

SEQ ID NO: 6076174 - DNA, 16 bp, Homo sapiens
cccagtaaaattgcca

SEQ ID NO: 6076175 - DNA, 18 bp, Homo sapiens
cccagtaaaattgccata

SEQ ID NO: 6076176 - DNA, 17 bp, Homo sapiens
cccagtaaagataccat

SEQ ID NO: 6076177 - DNA, 14 bp, Homo sapiens
cccagtaagccact

SEQ ID NO: 6076178 - DNA, 19 bp, Homo sapiens
cccagtacaccccacctct

SEQ ID NO: 6076179 - DNA, 18 bp, Homo sapiens
cccagtacctccaagcaa

SEQ ID NO: 6076180 - DNA, 20 bp, Homo sapiens
cccagtagccattttgtaac

SEQ ID NO: 6076181 - DNA, 15 bp, Homo sapiens
cccagtatacctcat

SEQ ID NO: 6076182 - DNA, 18 bp, Homo sapiens
cccagtattactgctgct

SEQ ID NO: 6076183 - DNA, 16 bp, Homo sapiens
aaatatgtgattatca

SEQ ID NO: 6076184 - DNA, 19 bp, Homo sapiens
aaatatgtgattatcattt

SEQ ID NO: 6076185 - DNA, 12 bp, Homo sapiens
aaatatgtgtac

SEQ ID NO: 6076186 - DNA, 13 bp, Homo sapiens
aaatatgttctct

SEQ ID NO: 6076187 - DNA, 22 bp, Homo sapiens
aaatatgtttcacacaaacaag

SEQ ID NO: 6076188 - DNA, 13 bp, Homo sapiens
aaatatgttttta

SEQ ID NO: 6076189 - DNA, 19 bp, Homo sapiens
aaatatgttttttagatca

SEQ ID NO: 6076190 - DNA, 12 bp, Homo sapiens
aaatattaaaaa

SEQ ID NO: 6076191 - DNA, 22 bp, Homo sapiens
aaatattaaaaagtcttttaaa

SEQ ID NO: 6076192 - DNA, 14 bp, Homo sapiens
aaatattaaaattg

SEQ ID NO: 6076193 - DNA, 22 bp, Homo sapiens
aaatattaacatattatttcat

SEQ ID NO: 6076194 - DNA, 13 bp, Homo sapiens
aaatattaagaaa

SEQ ID NO: 6076195 - DNA, 15 bp, Homo sapiens
aaatattaagaaaat

SEQ ID NO: 6076196 - DNA, 18 bp, Homo sapiens
aaatattaagaacatttt

SEQ ID NO: 6076197 - DNA, 14 bp, Homo sapiens
aaatattaagcatg

SEQ ID NO: 6076198 - DNA, 18 bp, Homo sapiens
aaatattaatatgtactt

SEQ ID NO: 6076199 - DNA, 15 bp, Homo sapiens
aaatattacaacaag

SEQ ID NO: 6076200 - DNA, 22 bp, Homo sapiens
aaatattaccaaaaaagtattt

SEQ ID NO: 6076201 - DNA, 18 bp, Homo sapiens
aaatattaccctgtaata

SEQ ID NO: 6076202 - DNA, 13 bp, Homo sapiens
aaatattagatgt

SEQ ID NO: 6076203 - DNA, 15 bp, Homo sapiens
aaatattagatgtga

SEQ ID NO: 6076204 - DNA, 14 bp, Homo sapiens
aaatattagcaaag

SEQ ID NO: 6076205 - DNA, 15 bp, Homo sapiens
aaatattagcaaaga

SEQ ID NO: 6076206 - DNA, 19 bp, Homo sapiens
aaatattaggcttaaaaac

SEQ ID NO: 6076207 - DNA, 19 bp, Homo sapiens
aaatattagttaatggatt

SEQ ID NO: 6076208 - DNA, 15 bp, Homo sapiens
aaatattagttactt

SEQ ID NO: 6076209 - DNA, 15 bp, Homo sapiens
aaatattatctttgt

SEQ ID NO: 6076210 - DNA, 22 bp, Homo sapiens
aaatattatctttgtaattatt

SEQ ID NO: 6076211 - DNA, 15 bp, Homo sapiens
aaatattatgtgttt

SEQ ID NO: 6076212 - DNA, 17 bp, Homo sapiens
aaatattatgttatgaa

SEQ ID NO: 6076213 - DNA, 21 bp, Homo sapiens
aaatattatttgtgtttccta

SEQ ID NO: 6076214 - DNA, 17 bp, Homo sapiens
aaatattcactggcccc

SEQ ID NO: 6076215 - DNA, 15 bp, Homo sapiens
aaatattcagaaatt

SEQ ID NO: 6076216 - DNA, 20 bp, Homo sapiens
aaatattcatatattatcaa

SEQ ID NO: 6076217 - DNA, 13 bp, Homo sapiens
aaatattcatatt

SEQ ID NO: 6076218 - DNA, 16 bp, Homo sapiens
aaatattcatgcttct

SEQ ID NO: 6076219 - DNA, 23 bp, Homo sapiens
aaatattccatccatatactttg

SEQ ID NO: 6076220 - DNA, 18 bp, Homo sapiens
aaatattccctagaaact

SEQ ID NO: 6076221 - DNA, 19 bp, Homo sapiens
aaatattccctagaaactt

SEQ ID NO: 6076222 - DNA, 15 bp, Homo sapiens
aaatattcctgcatt

SEQ ID NO: 6076223 - DNA, 19 bp, Homo sapiens
aaatattcctttgcatatt

SEQ ID NO: 6076224 - DNA, 14 bp, Homo sapiens
aaatattctaaaaa

SEQ ID NO: 6076225 - DNA, 13 bp, Homo sapiens
aaatattctatat

SEQ ID NO: 6076226 - DNA, 22 bp, Homo sapiens
aaatattctattttcattttct

SEQ ID NO: 6076227 - DNA, 14 bp, Homo sapiens
aaatattctgtaca

SEQ ID NO: 6076228 - DNA, 22 bp, Homo sapiens
aaatattcttgtccacattcta

SEQ ID NO: 6076229 - DNA, 15 bp, Homo sapiens
aaatattctttctca

SEQ ID NO: 6076230 - DNA, 21 bp, Homo sapiens
aaatattgaaaggcaaacatt

SEQ ID NO: 6076231 - DNA, 19 bp, Homo sapiens
aaatattgaaatgctgtat

SEQ ID NO: 6076232 - DNA, 15 bp, Homo sapiens
aaatattgaagttgt

SEQ ID NO: 6076233 - DNA, 16 bp, Homo sapiens
aaatattgaagttgtt

SEQ ID NO: 6076234 - DNA, 17 bp, Homo sapiens
aaatattgaagttgttt

SEQ ID NO: 6076235 - DNA, 23 bp, Homo sapiens
aaatattgaagttgtttatcaac

SEQ ID NO: 6076236 - DNA, 16 bp, Homo sapiens
aaatattgaatgcctt

SEQ ID NO: 6076237 - DNA, 18 bp, Homo sapiens
aaatattgaatgccttat

SEQ ID NO: 6076238 - DNA, 13 bp, Homo sapiens
aaatattgacact

SEQ ID NO: 6076239 - DNA, 20 bp, Homo sapiens
aaatattgacttctcttgaa

SEQ ID NO: 6076240 - DNA, 16 bp, Homo sapiens
aaatattgatctgtat

SEQ ID NO: 6076241 - DNA, 22 bp, Homo sapiens
aaatattgccaactcttctatt

SEQ ID NO: 6076242 - DNA, 13 bp, Homo sapiens
aaatattgctaaa

SEQ ID NO: 6076243 - DNA, 18 bp, Homo sapiens
aaatattgctaaaagtgc

SEQ ID NO: 6076244 - DNA, 19 bp, Homo sapiens
aaatattgctattgtttat

SEQ ID NO: 6076245 - DNA, 23 bp, Homo sapiens
aaatattgctctaattcttttca

SEQ ID NO: 6076246 - DNA, 13 bp, Homo sapiens
aaatattgctggg

SEQ ID NO: 6076247 - DNA, 21 bp, Homo sapiens
aaatattgcttcaatttcaaa

SEQ ID NO: 6076248 - DNA, 17 bp, Homo sapiens
aaatattggttgaaagt

SEQ ID NO: 6076249 - DNA, 13 bp, Homo sapiens
aaatattgtaata

SEQ ID NO: 6076250 - DNA, 17 bp, Homo sapiens
aaatattgtaatatgac

SEQ ID NO: 6076251 - DNA, 21 bp, Homo sapiens
aaatattgtagtttgaatatt

SEQ ID NO: 6076252 - DNA, 14 bp, Homo sapiens
aaatattgtatttg

SEQ ID NO: 6076253 - DNA, 17 bp, Homo sapiens
aaatattgtcatgttta

SEQ ID NO: 6076254 - DNA, 21 bp, Homo sapiens
aaatattgtcattacaaatct

SEQ ID NO: 6076255 - DNA, 20 bp, Homo sapiens
aaatattgtgttgtgaatgt

SEQ ID NO: 6076256 - DNA, 17 bp, Homo sapiens
aaatattgttctgctgt

SEQ ID NO: 6076257 - DNA, 17 bp, Homo sapiens
aaatattgttgacaact

SEQ ID NO: 6076258 - DNA, 11 bp, Homo sapiens
aaatattgttt

SEQ ID NO: 6076259 - DNA, 15 bp, Homo sapiens
aaatattgtttctgc

SEQ ID NO: 6076260 - DNA, 22 bp, Homo sapiens
aaatattgttttacaatagttc

SEQ ID NO: 6076261 - DNA, 16 bp, Homo sapiens
aaatattgttttgcat

SEQ ID NO: 6076262 - DNA, 14 bp, Homo sapiens
aaatatttaaacct

SEQ ID NO: 6076263 - DNA, 14 bp, Homo sapiens
aaatatttaacgaa

SEQ ID NO: 6076264 - DNA, 16 bp, Homo sapiens
aaatatttaacttttt

SEQ ID NO: 6076265 - DNA, 13 bp, Homo sapiens
aaatatttaatat

SEQ ID NO: 6076266 - DNA, 20 bp, Homo sapiens
aaatatttaatatcaaaaga

SEQ ID NO: 6076267 - DNA, 14 bp, Homo sapiens
aaatatttacctaa

SEQ ID NO: 6076268 - DNA, 17 bp, Homo sapiens
aaatatttaccttgaaa

SEQ ID NO: 6076269 - DNA, 18 bp, Homo sapiens
aaatatttaccttgaaaa

SEQ ID NO: 6076270 - DNA, 20 bp, Homo sapiens
aaatatttactctttgcaaa

SEQ ID NO: 6076271 - DNA, 16 bp, Homo sapiens
aaatatttagcaaata

SEQ ID NO: 6076272 - DNA, 10 bp, Homo sapiens
aaatatttat

SEQ ID NO: 6076273 - DNA, 22 bp, Homo sapiens
aaatatttatgaagaaaatact

SEQ ID NO: 6076274 - DNA, 23 bp, Homo sapiens
aaatatttatgcttaaaatatgt

SEQ ID NO: 6076275 - DNA, 18 bp, Homo sapiens
aaatatttattaaataaa

SEQ ID NO: 6076276 - DNA, 23 bp, Homo sapiens
aaatatttattcattatttgtca

SEQ ID NO: 6076277 - DNA, 18 bp, Homo sapiens
aaatatttatttattcta

SEQ ID NO: 6076278 - DNA, 19 bp, Homo sapiens
aaatatttatttgttttgg

SEQ ID NO: 6076279 - DNA, 16 bp, Homo sapiens
aaatatttcagatatc

SEQ ID NO: 6076280 - DNA, 15 bp, Homo sapiens
aaatatttcataaat

SEQ ID NO: 6076281 - DNA, 17 bp, Homo sapiens
aaatatttcataaatta

SEQ ID NO: 6076282 - DNA, 19 bp, Homo sapiens
aaatatttcatgattcaca

SEQ ID NO: 6076283 - DNA, 20 bp, Homo sapiens
aaatatttctaagcttattt

SEQ ID NO: 6076284 - DNA, 12 bp, Homo sapiens
aaatatttgaaa

SEQ ID NO: 6076285 - DNA, 12 bp, Homo sapiens
aaatatttgaat

SEQ ID NO: 6076286 - DNA, 17 bp, Homo sapiens
aaatatttgaatgaaaa

SEQ ID NO: 6076287 - DNA, 19 bp, Homo sapiens
aaatatttgcgtaaatggt

SEQ ID NO: 6076288 - DNA, 21 bp, Homo sapiens
aaatatttgcgtaaatggttt

SEQ ID NO: 6076289 - DNA, 19 bp, Homo sapiens
aaatatttgtctttaaaca

SEQ ID NO: 6076290 - DNA, 12 bp, Homo sapiens
aaatatttgtgt

SEQ ID NO: 6076291 - DNA, 19 bp, Homo sapiens
aaatattttaaaatcagct

SEQ ID NO: 6076292 - DNA, 14 bp, Homo sapiens
aaatattttaaaga

SEQ ID NO: 6076293 - DNA, 16 bp, Homo sapiens
aaatattttaagtatg

SEQ ID NO: 6076294 - DNA, 20 bp, Homo sapiens
aaatattttaatttttaaat

SEQ ID NO: 6076295 - DNA, 16 bp, Homo sapiens
aaatattttagaagct

SEQ ID NO: 6076296 - DNA, 17 bp, Homo sapiens
aaatattttaggaaact

SEQ ID NO: 6076297 - DNA, 12 bp, Homo sapiens
aaatattttcat

SEQ ID NO: 6076298 - DNA, 22 bp, Homo sapiens
aaatattttcatgtattttaca

SEQ ID NO: 6076299 - DNA, 22 bp, Homo sapiens
aaatattttccgtcacttaaat

SEQ ID NO: 6076300 - DNA, 16 bp, Homo sapiens
aaatattttctacttt

SEQ ID NO: 6076301 - DNA, 17 bp, Homo sapiens
aaatattttctacttta

SEQ ID NO: 6076302 - DNA, 22 bp, Homo sapiens
aaatattttctactttaaattg

SEQ ID NO: 6076303 - DNA, 19 bp, Homo sapiens
aaatattttctattttaag

SEQ ID NO: 6076304 - DNA, 12 bp, Homo sapiens
aaatattttctc

SEQ ID NO: 6076305 - DNA, 15 bp, Homo sapiens
aaatattttctctgt

SEQ ID NO: 6076306 - DNA, 18 bp, Homo sapiens
aaatattttctgtgtgtt

SEQ ID NO: 6076307 - DNA, 19 bp, Homo sapiens
aaatattttctgtgtgttc

SEQ ID NO: 6076308 - DNA, 20 bp, Homo sapiens
aaatattttctgtgtgttcc

SEQ ID NO: 6076309 - DNA, 19 bp, Homo sapiens
aaatattttcttaattatg

SEQ ID NO: 6076310 - DNA, 22 bp, Homo sapiens
aaatattttgaatacacatctc

SEQ ID NO: 6076311 - DNA, 13 bp, Homo sapiens
aaatattttgata

SEQ ID NO: 6076312 - DNA, 17 bp, Homo sapiens
aaatattttgatacaaa

SEQ ID NO: 6076313 - DNA, 14 bp, Homo sapiens
aaatattttgctaa

SEQ ID NO: 6076314 - DNA, 15 bp, Homo sapiens
aaatattttgctaac

SEQ ID NO: 6076315 - DNA, 18 bp, Homo sapiens
aaatattttgctaactgg

SEQ ID NO: 6076316 - DNA, 20 bp, Homo sapiens
aaatattttgctaactggtt

SEQ ID NO: 6076317 - DNA, 16 bp, Homo sapiens
aaatattttgctagtt

SEQ ID NO: 6076318 - DNA, 21 bp, Homo sapiens
aaatattttgtcactgctgta

SEQ ID NO: 6076319 - DNA, 14 bp, Homo sapiens
aaatattttgtcta

SEQ ID NO: 6076320 - DNA, 15 bp, Homo sapiens
aaatattttgtctaa

SEQ ID NO: 6076321 - DNA, 17 bp, Homo sapiens
aaatattttgtctaaaa

SEQ ID NO: 6076322 - DNA, 15 bp, Homo sapiens
aaatatttttataga

SEQ ID NO: 6076323 - DNA, 17 bp, Homo sapiens
aaatatttttatgtgaa

SEQ ID NO: 6076324 - DNA, 15 bp, Homo sapiens
aaatatttttccctc

SEQ ID NO: 6076325 - DNA, 14 bp, Homo sapiens
aaatatttttgtac

SEQ ID NO: 6076326 - DNA, 22 bp, Homo sapiens
aaatattttttatatatacagt

SEQ ID NO: 6076327 - DNA, 16 bp, Homo sapiens
aaatatttttttcctt

SEQ ID NO: 6076328 - DNA, 21 bp, Homo sapiens
aaatatttttttctagctata

SEQ ID NO: 6076329 - DNA, 17 bp, Homo sapiens
aaatatttttttgtaga

SEQ ID NO: 6076330 - DNA, 21 bp, Homo sapiens
aaatcaaaactcacaagtgct

SEQ ID NO: 6076331 - DNA, 18 bp, Homo sapiens
aaatcaaaagctgcttga

SEQ ID NO: 6076332 - DNA, 22 bp, Homo sapiens
aaatcaaaagggccaaagaacc

SEQ ID NO: 6076333 - DNA, 14 bp, Homo sapiens
aaatcaaaaggtaa

SEQ ID NO: 6076334 - DNA, 21 bp, Homo sapiens
aaatcaaaataaaagaaatat

SEQ ID NO: 6076335 - DNA, 18 bp, Homo sapiens
aaatcaaacaaccttcag

SEQ ID NO: 6076336 - DNA, 13 bp, Homo sapiens
aaatcaaacccac

SEQ ID NO: 6076337 - DNA, 17 bp, Homo sapiens
aaatcaaagtagaaact

SEQ ID NO: 6076338 - DNA, 13 bp, Homo sapiens
aaatcaaagtgct

SEQ ID NO: 6076339 - DNA, 14 bp, Homo sapiens
aaatcaaagttatg

SEQ ID NO: 6076340 - DNA, 14 bp, Homo sapiens
aaatcaaatatgca

SEQ ID NO: 6076341 - DNA, 16 bp, Homo sapiens
aaatcaaatatgcaaa

SEQ ID NO: 6076342 - DNA, 19 bp, Homo sapiens
aaatcaaatatgcaaagca

SEQ ID NO: 6076343 - DNA, 22 bp, Homo sapiens
aaatcaaatgtaaagtttaatt

SEQ ID NO: 6076344 - DNA, 14 bp, Homo sapiens
aaatcaaattgctt

SEQ ID NO: 6076345 - DNA, 13 bp, Homo sapiens
aaatcaaatttga

SEQ ID NO: 6076346 - DNA, 15 bp, Homo sapiens
aaatcaaatttttct

SEQ ID NO: 6076347 - DNA, 17 bp, Homo sapiens
aaatcaaatttttctgg

SEQ ID NO: 6076348 - DNA, 21 bp, Homo sapiens
aaatcaacaccttaatatgct

SEQ ID NO: 6076349 - DNA, 17 bp, Homo sapiens
aaatcaacagaagcatt

SEQ ID NO: 6076350 - DNA, 16 bp, Homo sapiens
aaatcaacttaacatg

SEQ ID NO: 6076351 - DNA, 22 bp, Homo sapiens
aaatcaacttgtcacaaagtga

SEQ ID NO: 6076352 - DNA, 19 bp, Homo sapiens
aaatcaacttgtgtactga

SEQ ID NO: 6076353 - DNA, 11 bp, Homo sapiens
aaatcaacttt

SEQ ID NO: 6076354 - DNA, 13 bp, Homo sapiens
aaatcaactttta

SEQ ID NO: 6076355 - DNA, 23 bp, Homo sapiens
aaatcaactttttattgccttct

SEQ ID NO: 6076356 - DNA, 19 bp, Homo sapiens
aaatcaagagcattgcttt

SEQ ID NO: 6076357 - DNA, 21 bp, Homo sapiens
aaatcaagcaggttagagaaa

SEQ ID NO: 6076358 - DNA, 17 bp, Homo sapiens
aaatcaaggatgctcag

SEQ ID NO: 6076359 - DNA, 18 bp, Homo sapiens
aaatcaaggcaaaaggaa

SEQ ID NO: 6076360 - DNA, 12 bp, Homo sapiens
aaatcaaggtga

SEQ ID NO: 6076361 - DNA, 17 bp, Homo sapiens
aaatcaaggtgaaggat

SEQ ID NO: 6076362 - DNA, 12 bp, Homo sapiens
aaatcaagtatt

SEQ ID NO: 6076363 - DNA, 20 bp, Homo sapiens
cccagtattactgctgctgt

SEQ ID NO: 6076364 - DNA, 23 bp, Homo sapiens
cccagtattactgctgctgtgct

SEQ ID NO: 6076365 - DNA, 23 bp, Homo sapiens
cccagtattctaggtagtgccct

SEQ ID NO: 6076366 - DNA, 17 bp, Homo sapiens
cccagtcacctccccac

SEQ ID NO: 6076367 - DNA, 18 bp, Homo sapiens
cccagtcacttcctgtcc

SEQ ID NO: 6076368 - DNA, 18 bp, Homo sapiens
cccagtcagaagttctgg

SEQ ID NO: 6076369 - DNA, 17 bp, Homo sapiens
cccagtcagcctctctc

SEQ ID NO: 6076370 - DNA, 22 bp, Homo sapiens
cccagtcagcctctctcccagt

SEQ ID NO: 6076371 - DNA, 19 bp, Homo sapiens
cccagtccatgctccaggg

SEQ ID NO: 6076372 - DNA, 17 bp, Homo sapiens
cccagtcccacactgtg

SEQ ID NO: 6076373 - DNA, 14 bp, Homo sapiens
cccagtcccagcct

SEQ ID NO: 6076374 - DNA, 15 bp, Homo sapiens
cccagtccccacccc

SEQ ID NO: 6076375 - DNA, 18 bp, Homo sapiens
cccagtccccacccctgc

SEQ ID NO: 6076376 - DNA, 19 bp, Homo sapiens
cccagtccccacccctgcc

SEQ ID NO: 6076377 - DNA, 21 bp, Homo sapiens
cccagtccccacccgcctgca

SEQ ID NO: 6076378 - DNA, 18 bp, Homo sapiens
cccagtccccagccctgg

SEQ ID NO: 6076379 - DNA, 20 bp, Homo sapiens
cccagtccccagccctgggc

SEQ ID NO: 6076380 - DNA, 13 bp, Homo sapiens
cccagtccccgtg

SEQ ID NO: 6076381 - DNA, 16 bp, Homo sapiens
cccagtccctggagct

SEQ ID NO: 6076382 - DNA, 17 bp, Homo sapiens
cccagtccctggagctg

SEQ ID NO: 6076383 - DNA, 23 bp, Homo sapiens
cccagtccctgggggaagccctg

SEQ ID NO: 6076384 - DNA, 14 bp, Homo sapiens
cccagtccggtgcc

SEQ ID NO: 6076385 - DNA, 15 bp, Homo sapiens
cccagtcctcactgt

SEQ ID NO: 6076386 - DNA, 17 bp, Homo sapiens
cccagtcctcactgtcc

SEQ ID NO: 6076387 - DNA, 18 bp, Homo sapiens
cccagtcctcactgtcct

SEQ ID NO: 6076388 - DNA, 17 bp, Homo sapiens
cccagtcctcaggcagc

SEQ ID NO: 6076389 - DNA, 15 bp, Homo sapiens
cccagtcctctccca

SEQ ID NO: 6076390 - DNA, 16 bp, Homo sapiens
cccagtcctctgcctc

SEQ ID NO: 6076391 - DNA, 16 bp, Homo sapiens
cccagtcctgatggcc

SEQ ID NO: 6076392 - DNA, 15 bp, Homo sapiens
cccagtcctgcctga

SEQ ID NO: 6076393 - DNA, 17 bp, Homo sapiens
cccagtcctggcctggc

SEQ ID NO: 6076394 - DNA, 21 bp, Homo sapiens
cccagtcctggcctggcttct

SEQ ID NO: 6076395 - DNA, 16 bp, Homo sapiens
cccagtcctggttcag

SEQ ID NO: 6076396 - DNA, 16 bp, Homo sapiens
cccagtccttccacct

SEQ ID NO: 6076397 - DNA, 22 bp, Homo sapiens
cccagtcggccccatctctcat

SEQ ID NO: 6076398 - DNA, 18 bp, Homo sapiens
cccagtcgtccgctcagc

SEQ ID NO: 6076399 - DNA, 23 bp, Homo sapiens
cccagtcgtgatgtggaggaaga

SEQ ID NO: 6076400 - DNA, 15 bp, Homo sapiens
cccagtctacccaga

SEQ ID NO: 6076401 - DNA, 16 bp, Homo sapiens
cccagtctacccagag

SEQ ID NO: 6076402 - DNA, 17 bp, Homo sapiens
cccagtctacccagaga

SEQ ID NO: 6076403 - DNA, 22 bp, Homo sapiens
cccagtctacgttctccagccc

SEQ ID NO: 6076404 - DNA, 21 bp, Homo sapiens
cccagtctaggagctccttct

SEQ ID NO: 6076405 - DNA, 19 bp, Homo sapiens
cccagtctcatctcctgac

SEQ ID NO: 6076406 - DNA, 14 bp, Homo sapiens
cccagtctcctctc

SEQ ID NO: 6076407 - DNA, 15 bp, Homo sapiens
cccagtctcctctcc

SEQ ID NO: 6076408 - DNA, 21 bp, Homo sapiens
cccagtctctcttaaagttgg

SEQ ID NO: 6076409 - DNA, 19 bp, Homo sapiens
cccagtctggaagaagagg

SEQ ID NO: 6076410 - DNA, 15 bp, Homo sapiens
cccagtcttattttt

SEQ ID NO: 6076411 - DNA, 17 bp, Homo sapiens
cccagtgaactcctgcc

SEQ ID NO: 6076412 - DNA, 23 bp, Homo sapiens
cccagtgaactcctgccaggcac

SEQ ID NO: 6076413 - DNA, 15 bp, Homo sapiens
cccagtgaagatgca

SEQ ID NO: 6076414 - DNA, 17 bp, Homo sapiens
cccagtgaagcctctga

SEQ ID NO: 6076415 - DNA, 21 bp, Homo sapiens
cccagtgaataaatattttag

SEQ ID NO: 6076416 - DNA, 18 bp, Homo sapiens
cccagtgacacttcagag

SEQ ID NO: 6076417 - DNA, 14 bp, Homo sapiens
cccagtgacagcta

SEQ ID NO: 6076418 - DNA, 13 bp, Homo sapiens
cccagtgactcca

SEQ ID NO: 6076419 - DNA, 14 bp, Homo sapiens
cccagtgactccag

SEQ ID NO: 6076420 - DNA, 21 bp, Homo sapiens
cccagtgagaagggcctgctc

SEQ ID NO: 6076421 - DNA, 23 bp, Homo sapiens
cccagtgagaagggcctgctctg

SEQ ID NO: 6076422 - DNA, 20 bp, Homo sapiens
cccagtgagagtgaggcccc

SEQ ID NO: 6076423 - DNA, 19 bp, Homo sapiens
cccagtgagcactcccaag

SEQ ID NO: 6076424 - DNA, 21 bp, Homo sapiens
cccagtgagcactcccaagtc

SEQ ID NO: 6076425 - DNA, 17 bp, Homo sapiens
cccagtgagccctgctc

SEQ ID NO: 6076426 - DNA, 12 bp, Homo sapiens
cccagtgatggc

SEQ ID NO: 6076427 - DNA, 23 bp, Homo sapiens
cccagtgatggcattactctgca

SEQ ID NO: 6076428 - DNA, 16 bp, Homo sapiens
cccagtgcaaaccact

SEQ ID NO: 6076429 - DNA, 21 bp, Homo sapiens
cccagtgcaaaccacttctcc

SEQ ID NO: 6076430 - DNA, 17 bp, Homo sapiens
cccagtgcaaatgcatg

SEQ ID NO: 6076431 - DNA, 18 bp, Homo sapiens
cccagtgcaatctgtcca

SEQ ID NO: 6076432 - DNA, 19 bp, Homo sapiens
cccagtgcatggtggccag

SEQ ID NO: 6076433 - DNA, 21 bp, Homo sapiens
cccagtgcatggtggccagag

SEQ ID NO: 6076434 - DNA, 15 bp, Homo sapiens
cccagtgccacagag

SEQ ID NO: 6076435 - DNA, 13 bp, Homo sapiens
cccagtgccagca

SEQ ID NO: 6076436 - DNA, 15 bp, Homo sapiens
cccagtgccagcaag

SEQ ID NO: 6076437 - DNA, 15 bp, Homo sapiens
cccagtgccagctcc

SEQ ID NO: 6076438 - DNA, 14 bp, Homo sapiens
cccagtgccagctg

SEQ ID NO: 6076439 - DNA, 12 bp, Homo sapiens
cccagtgccccc

SEQ ID NO: 6076440 - DNA, 19 bp, Homo sapiens
cccagtgcccccactgacc

SEQ ID NO: 6076441 - DNA, 22 bp, Homo sapiens
cccagtgcccccactgaccaga

SEQ ID NO: 6076442 - DNA, 14 bp, Homo sapiens
cccagtgccctctc

SEQ ID NO: 6076443 - DNA, 15 bp, Homo sapiens
cccagtgccgagaag

SEQ ID NO: 6076444 - DNA, 17 bp, Homo sapiens
cccagtgccgagaagga

SEQ ID NO: 6076445 - DNA, 15 bp, Homo sapiens
cccagtgcctcacct

SEQ ID NO: 6076446 - DNA, 16 bp, Homo sapiens
cccagtgcctgccact

SEQ ID NO: 6076447 - DNA, 17 bp, Homo sapiens
cccagtgcctgccactc

SEQ ID NO: 6076448 - DNA, 16 bp, Homo sapiens
cccagtgcctgtctgg

SEQ ID NO: 6076449 - DNA, 20 bp, Homo sapiens
cccagtgcggacccttccca

SEQ ID NO: 6076450 - DNA, 14 bp, Homo sapiens
cccagtgctcctgt

SEQ ID NO: 6076451 - DNA, 14 bp, Homo sapiens
cccagtgctgccat

SEQ ID NO: 6076452 - DNA, 16 bp, Homo sapiens
cccagtgctgccatgc

SEQ ID NO: 6076453 - DNA, 20 bp, Homo sapiens
cccagtgctgccatgccact

SEQ ID NO: 6076454 - DNA, 14 bp, Homo sapiens
cccagtgctggcca

SEQ ID NO: 6076455 - DNA, 20 bp, Homo sapiens
cccagtgctggccacacagc

SEQ ID NO: 6076456 - DNA, 22 bp, Homo sapiens
cccagtgctggccacacagcag

SEQ ID NO: 6076457 - DNA, 22 bp, Homo sapiens
cccagtgcttctccaacactga

SEQ ID NO: 6076458 - DNA, 19 bp, Homo sapiens
cccagtggagcctgccgcc

SEQ ID NO: 6076459 - DNA, 17 bp, Homo sapiens
cccagtggcagggcaca

SEQ ID NO: 6076460 - DNA, 23 bp, Homo sapiens
cccagtggcagggcacagggcct

SEQ ID NO: 6076461 - DNA, 19 bp, Homo sapiens
cccagtggcctcaaccctc

SEQ ID NO: 6076462 - DNA, 21 bp, Homo sapiens
cccagtggcctcaaccctccc

SEQ ID NO: 6076463 - DNA, 17 bp, Homo sapiens
cccagtggctgctgccc

SEQ ID NO: 6076464 - DNA, 14 bp, Homo sapiens
cccagtgggacaga

SEQ ID NO: 6076465 - DNA, 22 bp, Homo sapiens
cccagtgggaccacatgccact

SEQ ID NO: 6076466 - DNA, 12 bp, Homo sapiens
cccagtgggagg

SEQ ID NO: 6076467 - DNA, 16 bp, Homo sapiens
cccagtgggaggcgcg

SEQ ID NO: 6076468 - DNA, 20 bp, Homo sapiens
cccagtgggaggcgcgagcc

SEQ ID NO: 6076469 - DNA, 14 bp, Homo sapiens
cccagtgggagggg

SEQ ID NO: 6076470 - DNA, 16 bp, Homo sapiens
cccagtgggaggggca

SEQ ID NO: 6076471 - DNA, 18 bp, Homo sapiens
cccagtgggaggggcagg

SEQ ID NO: 6076472 - DNA, 19 bp, Homo sapiens
cccagtgggcatagtcagt

SEQ ID NO: 6076473 - DNA, 20 bp, Homo sapiens
cccagtgggcatagtcagtg

SEQ ID NO: 6076474 - DNA, 15 bp, Homo sapiens
cccagtgggctgtgt

SEQ ID NO: 6076475 - DNA, 16 bp, Homo sapiens
cccagtggggacaggg

SEQ ID NO: 6076476 - DNA, 17 bp, Homo sapiens
cccagtgggtctgggat

SEQ ID NO: 6076477 - DNA, 13 bp, Homo sapiens
cccagtggtcagc

SEQ ID NO: 6076478 - DNA, 19 bp, Homo sapiens
cccagtggtcagcaggtgt

SEQ ID NO: 6076479 - DNA, 16 bp, Homo sapiens
cccagtggtttccctt

SEQ ID NO: 6076480 - DNA, 19 bp, Homo sapiens
cccagtgtcccctttcttc

SEQ ID NO: 6076481 - DNA, 14 bp, Homo sapiens
cccagtgtccttcc

SEQ ID NO: 6076482 - DNA, 16 bp, Homo sapiens
cccagtgtctggccca

SEQ ID NO: 6076483 - DNA, 22 bp, Homo sapiens
cccagtgtctggcccagccatg

SEQ ID NO: 6076484 - DNA, 18 bp, Homo sapiens
cccagtgtgagaccccaa

SEQ ID NO: 6076485 - DNA, 20 bp, Homo sapiens
cccagtgtggccccagcccg

SEQ ID NO: 6076486 - DNA, 12 bp, Homo sapiens
cccagtgtggct

SEQ ID NO: 6076487 - DNA, 21 bp, Homo sapiens
cccagtgttatttattcccca

SEQ ID NO: 6076488 - DNA, 22 bp, Homo sapiens
cccagtgttctgcatggattca

SEQ ID NO: 6076489 - DNA, 16 bp, Homo sapiens
cccagtgttgtttgta

SEQ ID NO: 6076490 - DNA, 17 bp, Homo sapiens
cccagtgttgtttgtaa

SEQ ID NO: 6076491 - DNA, 16 bp, Homo sapiens
cccagtgttttaggag

SEQ ID NO: 6076492 - DNA, 14 bp, Homo sapiens
cccagttaaagatt

SEQ ID NO: 6076493 - DNA, 15 bp, Homo sapiens
cccagttaagtgaag

SEQ ID NO: 6076494 - DNA, 20 bp, Homo sapiens
cccagttaatactccagaga

SEQ ID NO: 6076495 - DNA, 19 bp, Homo sapiens
cccagttcaggagtcccaa

SEQ ID NO: 6076496 - DNA, 16 bp, Homo sapiens
cccagttcatctctgc

SEQ ID NO: 6076497 - DNA, 16 bp, Homo sapiens
cccagttccacagcag

SEQ ID NO: 6076498 - DNA, 20 bp, Homo sapiens
cccagttcctatgacacagt

SEQ ID NO: 6076499 - DNA, 21 bp, Homo sapiens
cccagttcctgtggctccctc

SEQ ID NO: 6076500 - DNA, 23 bp, Homo sapiens
cccagttctctagggaaggccac

SEQ ID NO: 6076501 - DNA, 20 bp, Homo sapiens
cccagttctgctcctctcca

SEQ ID NO: 6076502 - DNA, 23 bp, Homo sapiens
cccagttctgctcctctccaggc

SEQ ID NO: 6076503 - DNA, 15 bp, Homo sapiens
cccagttcttcctgc

SEQ ID NO: 6076504 - DNA, 19 bp, Homo sapiens
cccagttcttcctgcaacc

SEQ ID NO: 6076505 - DNA, 19 bp, Homo sapiens
cccagttgcactcaggtga

SEQ ID NO: 6076506 - DNA, 12 bp, Homo sapiens
cccagttgctgt

SEQ ID NO: 6076507 - DNA, 17 bp, Homo sapiens
cccagttggagctccag

SEQ ID NO: 6076508 - DNA, 22 bp, Homo sapiens
cccagttggagctccagcctga

SEQ ID NO: 6076509 - DNA, 24 bp, Homo sapiens
cccagttggggaagccaggtgagc

SEQ ID NO: 6076510 - DNA, 19 bp, Homo sapiens
cccagttggggctgcgacc

SEQ ID NO: 6076511 - DNA, 19 bp, Homo sapiens
cccagttgtggcaactaaa

SEQ ID NO: 6076512 - DNA, 22 bp, Homo sapiens
cccagtttatggatatgctgct

SEQ ID NO: 6076513 - DNA, 19 bp, Homo sapiens
cccagtttctaaactggag

SEQ ID NO: 6076514 - DNA, 20 bp, Homo sapiens
cccagtttctaaactggaga

SEQ ID NO: 6076515 - DNA, 22 bp, Homo sapiens
cccagtttctaaactggagact

SEQ ID NO: 6076516 - DNA, 14 bp, Homo sapiens
cccagtttcttctt

SEQ ID NO: 6076517 - DNA, 17 bp, Homo sapiens
cccagtttcttcttaca

SEQ ID NO: 6076518 - DNA, 22 bp, Homo sapiens
cccagtttcttcttacacttct

SEQ ID NO: 6076519 - DNA, 22 bp, Homo sapiens
cccagtttgcagaaaagcacct

SEQ ID NO: 6076520 - DNA, 23 bp, Homo sapiens
cccagtttgcagaaaagcacctg

SEQ ID NO: 6076521 - DNA, 21 bp, Homo sapiens
cccagtttgggaactcatcaa

SEQ ID NO: 6076522 - DNA, 17 bp, Homo sapiens
cccagttttgaaaaggt

SEQ ID NO: 6076523 - DNA, 18 bp, Homo sapiens
cccataaaaatttttcct

SEQ ID NO: 6076524 - DNA, 12 bp, Homo sapiens
cccataaacagc

SEQ ID NO: 6076525 - DNA, 15 bp, Homo sapiens
cccataaacagcaca

SEQ ID NO: 6076526 - DNA, 16 bp, Homo sapiens
cccataaacagcacac

SEQ ID NO: 6076527 - DNA, 16 bp, Homo sapiens
cccataaacagtaatg

SEQ ID NO: 6076528 - DNA, 22 bp, Homo sapiens
cccataacaattcccccatcct

SEQ ID NO: 6076529 - DNA, 18 bp, Homo sapiens
cccataagacaaacactg

SEQ ID NO: 6076530 - DNA, 16 bp, Homo sapiens
cccataagccctgaga

SEQ ID NO: 6076531 - DNA, 17 bp, Homo sapiens
cccataaggccagaaac

SEQ ID NO: 6076532 - DNA, 12 bp, Homo sapiens
cccataataaag

SEQ ID NO: 6076533 - DNA, 13 bp, Homo sapiens
cccataataaagc

SEQ ID NO: 6076534 - DNA, 20 bp, Homo sapiens
cccataataaccctgccagt

SEQ ID NO: 6076535 - DNA, 23 bp, Homo sapiens
cccataattttttttttcctttt

SEQ ID NO: 6076536 - DNA, 16 bp, Homo sapiens
cccatacaatgtatgt

SEQ ID NO: 6076537 - DNA, 20 bp, Homo sapiens
cccatacaatgtatgtacaa

SEQ ID NO: 6076538 - DNA, 12 bp, Homo sapiens
cccatacacaca

SEQ ID NO: 6076539 - DNA, 13 bp, Homo sapiens
cccatacacacac

SEQ ID NO: 6076540 - DNA, 17 bp, Homo sapiens
cccatacccctgcctgg

SEQ ID NO: 6076541 - DNA, 17 bp, Homo sapiens
cccataccccttattgc

SEQ ID NO: 6076542 - DNA, 13 bp, Homo sapiens
cccatactcagcc

SEQ ID NO: 6076543 - DNA, 18 bp, Homo sapiens
cccatactctgtctccct

SEQ ID NO: 6076544 - DNA, 18 bp, Homo sapiens
cccatacttttggctcct

SEQ ID NO: 6076545 - DNA, 17 bp, Homo sapiens
cccatagaaacatgaca

SEQ ID NO: 6076546 - DNA, 20 bp, Homo sapiens
cccatagagaccaggaggga

SEQ ID NO: 6076547 - DNA, 16 bp, Homo sapiens
cccatagatcttctga

SEQ ID NO: 6076548 - DNA, 17 bp, Homo sapiens
cccatagatcttctgaa

SEQ ID NO: 6076549 - DNA, 22 bp, Homo sapiens
cccatagatcttctgaaatgaa

SEQ ID NO: 6076550 - DNA, 16 bp, Homo sapiens
cccatagcgctggctc

SEQ ID NO: 6076551 - DNA, 20 bp, Homo sapiens
cccatagctattttccttgc

SEQ ID NO: 6076552 - DNA, 13 bp, Homo sapiens
cccatagcttcca

SEQ ID NO: 6076553 - DNA, 18 bp, Homo sapiens
cccataggcccacacaca

SEQ ID NO: 6076554 - DNA, 22 bp, Homo sapiens
cccataggcccacacacaggtg

SEQ ID NO: 6076555 - DNA, 20 bp, Homo sapiens
cccatagggtcggaggtgct

SEQ ID NO: 6076556 - DNA, 15 bp, Homo sapiens
cccatatacacctgg

SEQ ID NO: 6076557 - DNA, 13 bp, Homo sapiens
cccatatataaat

SEQ ID NO: 6076558 - DNA, 19 bp, Homo sapiens
cccatatattaccccttca

SEQ ID NO: 6076559 - DNA, 23 bp, Homo sapiens
cccatatcatataaaatttcagg

SEQ ID NO: 6076560 - DNA, 14 bp, Homo sapiens
cccatatccctccc

SEQ ID NO: 6076561 - DNA, 14 bp, Homo sapiens
cccatatcctgcct

SEQ ID NO: 6076562 - DNA, 18 bp, Homo sapiens
cccatatctgtgtgccct

SEQ ID NO: 6076563 - DNA, 22 bp, Homo sapiens
cccatatctgtgtgccctaggg

SEQ ID NO: 6076564 - DNA, 17 bp, Homo sapiens
cccatatcttgccttca

SEQ ID NO: 6076565 - DNA, 21 bp, Homo sapiens
cccatatgctaccaccagctg

SEQ ID NO: 6076566 - DNA, 19 bp, Homo sapiens
cccatatttacttactgct

SEQ ID NO: 6076567 - DNA, 16 bp, Homo sapiens
cccatatttcatcgtg

SEQ ID NO: 6076568 - DNA, 20 bp, Homo sapiens
cccatatttgtacaccaata

SEQ ID NO: 6076569 - DNA, 14 bp, Homo sapiens
cccatcaccccttc

SEQ ID NO: 6076570 - DNA, 16 bp, Homo sapiens
cccatcaccccttccc

SEQ ID NO: 6076571 - DNA, 17 bp, Homo sapiens
cccatcaccccttcccc

SEQ ID NO: 6076572 - DNA, 16 bp, Homo sapiens
cccatcaccggaggag

SEQ ID NO: 6076573 - DNA, 18 bp, Homo sapiens
cccatcacctctactgtc

SEQ ID NO: 6076574 - DNA, 17 bp, Homo sapiens
cccatcactcgcaggac

SEQ ID NO: 6076575 - DNA, 14 bp, Homo sapiens
cccatcactgtgtc

SEQ ID NO: 6076576 - DNA, 15 bp, Homo sapiens
cccatcactgtgtct

SEQ ID NO: 6076577 - DNA, 18 bp, Homo sapiens
cccatcagaacctgagct

SEQ ID NO: 6076578 - DNA, 13 bp, Homo sapiens
cccatcagacagg

SEQ ID NO: 6076579 - DNA, 18 bp, Homo sapiens
cccatcagcaccatggag

SEQ ID NO: 6076580 - DNA, 15 bp, Homo sapiens
cccatcagcagcttg

SEQ ID NO: 6076581 - DNA, 12 bp, Homo sapiens
cccatcagccca

SEQ ID NO: 6076582 - DNA, 13 bp, Homo sapiens
cccatcagccctg

SEQ ID NO: 6076583 - DNA, 16 bp, Homo sapiens
cccatcagccctgcta

SEQ ID NO: 6076584 - DNA, 18 bp, Homo sapiens
cccatcagctccagctgc

SEQ ID NO: 6076585 - DNA, 19 bp, Homo sapiens
cccatcaggactcttgtga

SEQ ID NO: 6076586 - DNA, 20 bp, Homo sapiens
cccatcataatataaaacag

SEQ ID NO: 6076587 - DNA, 21 bp, Homo sapiens
cccatcatatgacatgccacc

SEQ ID NO: 6076588 - DNA, 23 bp, Homo sapiens
cccatcatcaccgattcttcctt

SEQ ID NO: 6076589 - DNA, 14 bp, Homo sapiens
cccatcatcctctg

SEQ ID NO: 6076590 - DNA, 13 bp, Homo sapiens
cccatcatccttt

SEQ ID NO: 6076591 - DNA, 19 bp, Homo sapiens
cccatcatctctgcctttg

SEQ ID NO: 6076592 - DNA, 14 bp, Homo sapiens
cccatcatggctgc

SEQ ID NO: 6076593 - DNA, 22 bp, Homo sapiens
cccatcattacccttccctgca

SEQ ID NO: 6076594 - DNA, 20 bp, Homo sapiens
cccatcattcatgctactgc

SEQ ID NO: 6076595 - DNA, 22 bp, Homo sapiens
cccatcattgcacctgcaggct

SEQ ID NO: 6076596 - DNA, 13 bp, Homo sapiens
cccatccacagtt

SEQ ID NO: 6076597 - DNA, 14 bp, Homo sapiens
cccatccagccacg

SEQ ID NO: 6076598 - DNA, 16 bp, Homo sapiens
cccatccagccagacc

SEQ ID NO: 6076599 - DNA, 15 bp, Homo sapiens
cccatccagccaggg

SEQ ID NO: 6076600 - DNA, 15 bp, Homo sapiens
cccatccagcctcca

SEQ ID NO: 6076601 - DNA, 18 bp, Homo sapiens
cccatccagcctccaggg

SEQ ID NO: 6076602 - DNA, 12 bp, Homo sapiens
cccatccagcgt

SEQ ID NO: 6076603 - DNA, 14 bp, Homo sapiens
cccatccaggcagt

SEQ ID NO: 6076604 - DNA, 13 bp, Homo sapiens
cccatccagggcc

SEQ ID NO: 6076605 - DNA, 20 bp, Homo sapiens
cccatccagtctcccaactt

SEQ ID NO: 6076606 - DNA, 16 bp, Homo sapiens
cccatccatcagctcc

SEQ ID NO: 6076607 - DNA, 18 bp, Homo sapiens
cccatcccacccctccat

SEQ ID NO: 6076608 - DNA, 23 bp, Homo sapiens
cccatcccagggtcccaccccca

SEQ ID NO: 6076609 - DNA, 15 bp, Homo sapiens
cccatcccagtccct

SEQ ID NO: 6076610 - DNA, 16 bp, Homo sapiens
cccatcccatcccatc

SEQ ID NO: 6076611 - DNA, 16 bp, Homo sapiens
cccatcccattttcat

SEQ ID NO: 6076612 - DNA, 15 bp, Homo sapiens
cccatccccaccagc

SEQ ID NO: 6076613 - DNA, 20 bp, Homo sapiens
cccatcccccctcaccaggg

SEQ ID NO: 6076614 - DNA, 16 bp, Homo sapiens
cccatccccgcagtgt

SEQ ID NO: 6076615 - DNA, 22 bp, Homo sapiens
cccatcccctcaacaccctgct

SEQ ID NO: 6076616 - DNA, 16 bp, Homo sapiens
cccatcccctgcctct

SEQ ID NO: 6076617 - DNA, 14 bp, Homo sapiens
cccatcccctttcc

SEQ ID NO: 6076618 - DNA, 17 bp, Homo sapiens
cccatcccctttcctcc

SEQ ID NO: 6076619 - DNA, 20 bp, Homo sapiens
cccatcccgtttccctccag

SEQ ID NO: 6076620 - DNA, 21 bp, Homo sapiens
cccatcccgtttccctccagg

SEQ ID NO: 6076621 - DNA, 15 bp, Homo sapiens
cccatccctaccact

SEQ ID NO: 6076622 - DNA, 17 bp, Homo sapiens
cccatccctcggaccca

SEQ ID NO: 6076623 - DNA, 14 bp, Homo sapiens
cccatccctgaaac

SEQ ID NO: 6076624 - DNA, 20 bp, Homo sapiens
cccatccctgcctggaggct

SEQ ID NO: 6076625 - DNA, 18 bp, Homo sapiens
cccatccctgcctggtca

SEQ ID NO: 6076626 - DNA, 15 bp, Homo sapiens
cccatccctgtcctc

SEQ ID NO: 6076627 - DNA, 16 bp, Homo sapiens
cccatccctgtcttta

SEQ ID NO: 6076628 - DNA, 14 bp, Homo sapiens
cccatccctgtggt

SEQ ID NO: 6076629 - DNA, 17 bp, Homo sapiens
cccatcccttcctcccc

SEQ ID NO: 6076630 - DNA, 17 bp, Homo sapiens
cccatcctaccaatgca

SEQ ID NO: 6076631 - DNA, 19 bp, Homo sapiens
cccatcctaccaatgcatg

SEQ ID NO: 6076632 - DNA, 20 bp, Homo sapiens
cccatcctaccaatgcatgc

SEQ ID NO: 6076633 - DNA, 12 bp, Homo sapiens
cccatcctaccc

SEQ ID NO: 6076634 - DNA, 13 bp, Homo sapiens
cccatcctaccct

SEQ ID NO: 6076635 - DNA, 15 bp, Homo sapiens
cccatcctcacccag

SEQ ID NO: 6076636 - DNA, 16 bp, Homo sapiens
cccatcctcatccctg

SEQ ID NO: 6076637 - DNA, 17 bp, Homo sapiens
cccatcctcatccctga

SEQ ID NO: 6076638 - DNA, 18 bp, Homo sapiens
cccatcctccagcaggga

SEQ ID NO: 6076639 - DNA, 17 bp, Homo sapiens
cccatcctccagcttct

SEQ ID NO: 6076640 - DNA, 15 bp, Homo sapiens
cccatcctccccttc

SEQ ID NO: 6076641 - DNA, 22 bp, Homo sapiens
cccatcctccccttccctgcaa

SEQ ID NO: 6076642 - DNA, 12 bp, Homo sapiens
cccatcctcccg

SEQ ID NO: 6076643 - DNA, 15 bp, Homo sapiens
cccatcctcctgccc

SEQ ID NO: 6076644 - DNA, 22 bp, Homo sapiens
cccatcctcctgcccccacccc

SEQ ID NO: 6076645 - DNA, 20 bp, Homo sapiens
cccatcctcttcttttagca

SEQ ID NO: 6076646 - DNA, 15 bp, Homo sapiens
cccatcctgaccagc

SEQ ID NO: 6076647 - DNA, 12 bp, Homo sapiens
cccatcctgcca

SEQ ID NO: 6076648 - DNA, 17 bp, Homo sapiens
cccatcctgccatcctc

SEQ ID NO: 6076649 - DNA, 15 bp, Homo sapiens
cccatcctgggcctt

SEQ ID NO: 6076650 - DNA, 13 bp, Homo sapiens
cccatcctggggc

SEQ ID NO: 6076651 - DNA, 16 bp, Homo sapiens
cccatcctggggcagc

SEQ ID NO: 6076652 - DNA, 21 bp, Homo sapiens
cccatccttcccgcagcacca

SEQ ID NO: 6076653 - DNA, 17 bp, Homo sapiens
cccatcgccacaaactc

SEQ ID NO: 6076654 - DNA, 22 bp, Homo sapiens
cccatcgcctgggacgcccctt

SEQ ID NO: 6076655 - DNA, 14 bp, Homo sapiens
cccatcgccttctg

SEQ ID NO: 6076656 - DNA, 18 bp, Homo sapiens
cccatcgccttctggctg

SEQ ID NO: 6076657 - DNA, 16 bp, Homo sapiens
cccatcgccttctggg

SEQ ID NO: 6076658 - DNA, 16 bp, Homo sapiens
cccatcggccctgtcc

SEQ ID NO: 6076659 - DNA, 19 bp, Homo sapiens
cccatcggccctgtcccct

SEQ ID NO: 6076660 - DNA, 20 bp, Homo sapiens
cccatcggtgtccatttata

SEQ ID NO: 6076661 - DNA, 15 bp, Homo sapiens
cccatcgtataagga

SEQ ID NO: 6076662 - DNA, 18 bp, Homo sapiens
cccatcgtataaggaaat

SEQ ID NO: 6076663 - DNA, 18 bp, Homo sapiens
cccatcgtccaccccagt

SEQ ID NO: 6076664 - DNA, 22 bp, Homo sapiens
cccatcgtctcggccttcacaa

SEQ ID NO: 6076665 - DNA, 20 bp, Homo sapiens
cccatcgttgcccccatttc

SEQ ID NO: 6076666 - DNA, 21 bp, Homo sapiens
cccatctaaaccagaaggaag

SEQ ID NO: 6076667 - DNA, 23 bp, Homo sapiens
cccatctcacctctaggcctcag

SEQ ID NO: 6076668 - DNA, 14 bp, Homo sapiens
cccatctcactctt

SEQ ID NO: 6076669 - DNA, 13 bp, Homo sapiens
cccatctcaggac

SEQ ID NO: 6076670 - DNA, 16 bp, Homo sapiens
cccatctcaggccaga

SEQ ID NO: 6076671 - DNA, 15 bp, Homo sapiens
cccatctcaggtgcc

SEQ ID NO: 6076672 - DNA, 15 bp, Homo sapiens
cccatctcatcctgg

SEQ ID NO: 6076673 - DNA, 12 bp, Homo sapiens
cccatctccatt

SEQ ID NO: 6076674 - DNA, 15 bp, Homo sapiens
cccatctcccaccct

SEQ ID NO: 6076675 - DNA, 14 bp, Homo sapiens
cccatctccccagg

SEQ ID NO: 6076676 - DNA, 16 bp, Homo sapiens
cccatctccccaggcc

SEQ ID NO: 6076677 - DNA, 17 bp, Homo sapiens
cccatctccccaggcct

SEQ ID NO: 6076678 - DNA, 16 bp, Homo sapiens
cccatctcccctcagc

SEQ ID NO: 6076679 - DNA, 14 bp, Homo sapiens
cccatctccctgcc

SEQ ID NO: 6076680 - DNA, 17 bp, Homo sapiens
cccatctccctgcctgg

SEQ ID NO: 6076681 - DNA, 14 bp, Homo sapiens
cccatctccctgct

SEQ ID NO: 6076682 - DNA, 13 bp, Homo sapiens
cccatctcctccc

SEQ ID NO: 6076683 - DNA, 18 bp, Homo sapiens
cccatctccttacctctg

SEQ ID NO: 6076684 - DNA, 21 bp, Homo sapiens
cccatctccttacctctggaa

SEQ ID NO: 6076685 - DNA, 22 bp, Homo sapiens
cccatctccttacctctggaac

SEQ ID NO: 6076686 - DNA, 15 bp, Homo sapiens
cccatctccttcccc

SEQ ID NO: 6076687 - DNA, 19 bp, Homo sapiens
cccatctccttcccccagc

SEQ ID NO: 6076688 - DNA, 22 bp, Homo sapiens
cccatctccttcccccagccca

SEQ ID NO: 6076689 - DNA, 21 bp, Homo sapiens
cccatctcgctccctcccagg

SEQ ID NO: 6076690 - DNA, 19 bp, Homo sapiens
cccatctctacaaaaagca

SEQ ID NO: 6076691 - DNA, 12 bp, Homo sapiens
cccatctctccc

SEQ ID NO: 6076692 - DNA, 18 bp, Homo sapiens
cccatctctcccacttcc

SEQ ID NO: 6076693 - DNA, 20 bp, Homo sapiens
cccatctctcccacttcctc

SEQ ID NO: 6076694 - DNA, 22 bp, Homo sapiens
cccatctctcccacttcctcct

SEQ ID NO: 6076695 - DNA, 23 bp, Homo sapiens
cccatctctccctcccctgccat

SEQ ID NO: 6076696 - DNA, 14 bp, Homo sapiens
cccatctctcctgc

SEQ ID NO: 6076697 - DNA, 18 bp, Homo sapiens
cccatctctgaactggta

SEQ ID NO: 6076698 - DNA, 18 bp, Homo sapiens
cccatctctgagtggagg

SEQ ID NO: 6076699 - DNA, 11 bp, Homo sapiens
cccatctctgt

SEQ ID NO: 6076700 - DNA, 18 bp, Homo sapiens
cccatctcttcctaccca

SEQ ID NO: 6076701 - DNA, 23 bp, Homo sapiens
cccatctgaacacaaccagaggt

SEQ ID NO: 6076702 - DNA, 12 bp, Homo sapiens
cccatctgcacc

SEQ ID NO: 6076703 - DNA, 13 bp, Homo sapiens
cccatctgcaccc

SEQ ID NO: 6076704 - DNA, 17 bp, Homo sapiens
cccatctgcagggcccc

SEQ ID NO: 6076705 - DNA, 16 bp, Homo sapiens
cccatctgccagatca

SEQ ID NO: 6076706 - DNA, 20 bp, Homo sapiens
cccatctgccccacagtctc

SEQ ID NO: 6076707 - DNA, 18 bp, Homo sapiens
cccatctgccctccctgt

SEQ ID NO: 6076708 - DNA, 18 bp, Homo sapiens
cccatctgccgcctgggg

SEQ ID NO: 6076709 - DNA, 12 bp, Homo sapiens
cccatctgctcc

SEQ ID NO: 6076710 - DNA, 17 bp, Homo sapiens
cccatctgctcctccca

SEQ ID NO: 6076711 - DNA, 20 bp, Homo sapiens
cccatctggaggctcccatg

SEQ ID NO: 6076712 - DNA, 21 bp, Homo sapiens
cccatctggaggctcccatgg

SEQ ID NO: 6076713 - DNA, 16 bp, Homo sapiens
cccatctgggagtccc

SEQ ID NO: 6076714 - DNA, 14 bp, Homo sapiens
cccatctgtatgct

SEQ ID NO: 6076715 - DNA, 12 bp, Homo sapiens
cccatctgtcca

SEQ ID NO: 6076716 - DNA, 22 bp, Homo sapiens
cccatctgtccatcctcctctc

SEQ ID NO: 6076717 - DNA, 23 bp, Homo sapiens
cccatctgtccatcctcctctcc

SEQ ID NO: 6076718 - DNA, 24 bp, Homo sapiens
cccatctgtccatcctcctctcca

SEQ ID NO: 6076719 - DNA, 17 bp, Homo sapiens
cccatctgtctgccaac

SEQ ID NO: 6076720 - DNA, 23 bp, Homo sapiens
aaatcaagtattataaacaagaa

SEQ ID NO: 6076721 - DNA, 18 bp, Homo sapiens
aaatcaagtatttgggaa

SEQ ID NO: 6076722 - DNA, 16 bp, Homo sapiens
aaatcaagtcctttaa

SEQ ID NO: 6076723 - DNA, 16 bp, Homo sapiens
aaatcaagtttccaag

SEQ ID NO: 6076724 - DNA, 22 bp, Homo sapiens
aaatcaatacactagttgtttc

SEQ ID NO: 6076725 - DNA, 16 bp, Homo sapiens
aaatcaatatgcagaa

SEQ ID NO: 6076726 - DNA, 12 bp, Homo sapiens
aaatcaatcaat

SEQ ID NO: 6076727 - DNA, 22 bp, Homo sapiens
aaatcaatcaatggtgcaaaaa

SEQ ID NO: 6076728 - DNA, 20 bp, Homo sapiens
aaatcaatctgtaaaactaa

SEQ ID NO: 6076729 - DNA, 20 bp, Homo sapiens
aaatcaatgaaggatttctt

SEQ ID NO: 6076730 - DNA, 19 bp, Homo sapiens
aaatcaatgctttatctga

SEQ ID NO: 6076731 - DNA, 11 bp, Homo sapiens
aaatcaatttt

SEQ ID NO: 6076732 - DNA, 13 bp, Homo sapiens
aaatcacaaaaac

SEQ ID NO: 6076733 - DNA, 14 bp, Homo sapiens
aaatcacaaacata

SEQ ID NO: 6076734 - DNA, 14 bp, Homo sapiens
aaatcacaagcaat

SEQ ID NO: 6076735 - DNA, 15 bp, Homo sapiens
aaatcacaagcaata

SEQ ID NO: 6076736 - DNA, 18 bp, Homo sapiens
aaatcacaagcaataatt

SEQ ID NO: 6076737 - DNA, 14 bp, Homo sapiens
aaatcacacattca

SEQ ID NO: 6076738 - DNA, 14 bp, Homo sapiens
aaatcacactcaaa

SEQ ID NO: 6076739 - DNA, 17 bp, Homo sapiens
aaatcacactcaaactt

SEQ ID NO: 6076740 - DNA, 20 bp, Homo sapiens
aaatcacagaaaaaaatggt

SEQ ID NO: 6076741 - DNA, 23 bp, Homo sapiens
aaatcacagatgggtattaaact

SEQ ID NO: 6076742 - DNA, 16 bp, Homo sapiens
aaatcacagatttcca

SEQ ID NO: 6076743 - DNA, 18 bp, Homo sapiens
aaatcacagatttccaaa

SEQ ID NO: 6076744 - DNA, 21 bp, Homo sapiens
aaatcacagatttccaaaagt

SEQ ID NO: 6076745 - DNA, 14 bp, Homo sapiens
aaatcacatcctta

SEQ ID NO: 6076746 - DNA, 17 bp, Homo sapiens
aaatcacatctcacctc

SEQ ID NO: 6076747 - DNA, 12 bp, Homo sapiens
aaatcacatttt

SEQ ID NO: 6076748 - DNA, 15 bp, Homo sapiens
aaatcacattttaag

SEQ ID NO: 6076749 - DNA, 23 bp, Homo sapiens
aaatcacattttaagtgcttcac

SEQ ID NO: 6076750 - DNA, 23 bp, Homo sapiens
aaatcacccacaaccctctggaa

SEQ ID NO: 6076751 - DNA, 21 bp, Homo sapiens
aaatcacccagttgtgctata

SEQ ID NO: 6076752 - DNA, 23 bp, Homo sapiens
aaatcaccttttctaaaaagtca

SEQ ID NO: 6076753 - DNA, 17 bp, Homo sapiens
aaatcacgctttttgaa

SEQ ID NO: 6076754 - DNA, 21 bp, Homo sapiens
aaatcactgaggcatttttac

SEQ ID NO: 6076755 - DNA, 15 bp, Homo sapiens
aaatcactgtattta

SEQ ID NO: 6076756 - DNA, 16 bp, Homo sapiens
aaatcactgtgaaatt

SEQ ID NO: 6076757 - DNA, 22 bp, Homo sapiens
aaatcactgtggggaaacaatt

SEQ ID NO: 6076758 - DNA, 13 bp, Homo sapiens
aaatcacttcaat

SEQ ID NO: 6076759 - DNA, 12 bp, Homo sapiens
aaatcacttcag

SEQ ID NO: 6076760 - DNA, 16 bp, Homo sapiens
aaatcacttcattgtt

SEQ ID NO: 6076761 - DNA, 14 bp, Homo sapiens
aaatcacttgtaaa

SEQ ID NO: 6076762 - DNA, 13 bp, Homo sapiens
aaatcacttgttt

SEQ ID NO: 6076763 - DNA, 19 bp, Homo sapiens
aaatcactttaatttagaa

SEQ ID NO: 6076764 - DNA, 22 bp, Homo sapiens
aaatcactttacctgcaggctc

SEQ ID NO: 6076765 - DNA, 14 bp, Homo sapiens
aaatcactttcata

SEQ ID NO: 6076766 - DNA, 15 bp, Homo sapiens
aaatcagaaaaatta

SEQ ID NO: 6076767 - DNA, 15 bp, Homo sapiens
aaatcagaaagacat

SEQ ID NO: 6076768 - DNA, 18 bp, Homo sapiens
aaatcagaagtcatcttg

SEQ ID NO: 6076769 - DNA, 14 bp, Homo sapiens
aaatcagaataaat

SEQ ID NO: 6076770 - DNA, 12 bp, Homo sapiens
aaatcagacaca

SEQ ID NO: 6076771 - DNA, 13 bp, Homo sapiens
aaatcagacacaa

SEQ ID NO: 6076772 - DNA, 21 bp, Homo sapiens
aaatcagacacaattagagaa

SEQ ID NO: 6076773 - DNA, 16 bp, Homo sapiens
aaatcagagacaaaat

SEQ ID NO: 6076774 - DNA, 22 bp, Homo sapiens
aaatcagagacaaaatatttcc

SEQ ID NO: 6076775 - DNA, 20 bp, Homo sapiens
aaatcagaggagagacggtg

SEQ ID NO: 6076776 - DNA, 22 bp, Homo sapiens
aaatcagatgttgaattctttt

SEQ ID NO: 6076777 - DNA, 16 bp, Homo sapiens
aaatcagcaacttcta

SEQ ID NO: 6076778 - DNA, 16 bp, Homo sapiens
aaatcagcatgacaaa

SEQ ID NO: 6076779 - DNA, 21 bp, Homo sapiens
aaatcagccaattatgttaaa

SEQ ID NO: 6076780 - DNA, 11 bp, Homo sapiens
aaatcagccag

SEQ ID NO: 6076781 - DNA, 12 bp, Homo sapiens
aaatcagcctgc

SEQ ID NO: 6076782 - DNA, 18 bp, Homo sapiens
aaatcagcctgctccagc

SEQ ID NO: 6076783 - DNA, 23 bp, Homo sapiens
aaatcagccttgcacaagtactt

SEQ ID NO: 6076784 - DNA, 19 bp, Homo sapiens
aaatcagctattttgtgaa

SEQ ID NO: 6076785 - DNA, 14 bp, Homo sapiens
aaatcagctttgta

SEQ ID NO: 6076786 - DNA, 12 bp, Homo sapiens
aaatcaggagcc

SEQ ID NO: 6076787 - DNA, 17 bp, Homo sapiens
aaatcaggattttagtg

SEQ ID NO: 6076788 - DNA, 20 bp, Homo sapiens
aaatcaggcatttttccaaa

SEQ ID NO: 6076789 - DNA, 23 bp, Homo sapiens
aaatcaggcttttgtttcctttt

SEQ ID NO: 6076790 - DNA, 16 bp, Homo sapiens
aaatcaggggccagag

SEQ ID NO: 6076791 - DNA, 17 bp, Homo sapiens
aaatcaggggccagaga

SEQ ID NO: 6076792 - DNA, 22 bp, Homo sapiens
aaatcaggtagaccatattcta

SEQ ID NO: 6076793 - DNA, 15 bp, Homo sapiens
aaatcaggtattaat

SEQ ID NO: 6076794 - DNA, 20 bp, Homo sapiens
aaatcaggtgttttaagact

SEQ ID NO: 6076795 - DNA, 22 bp, Homo sapiens
aaatcaggtgttttaagactga

SEQ ID NO: 6076796 - DNA, 15 bp, Homo sapiens
aaatcagtaagaggt

SEQ ID NO: 6076797 - DNA, 15 bp, Homo sapiens
aaatcagtaatctgt

SEQ ID NO: 6076798 - DNA, 20 bp, Homo sapiens
aaatcagtagaaagctaaag

SEQ ID NO: 6076799 - DNA, 22 bp, Homo sapiens
aaatcagtatattttctgtatt

SEQ ID NO: 6076800 - DNA, 22 bp, Homo sapiens
aaatcagtatttttttttaatt

SEQ ID NO: 6076801 - DNA, 14 bp, Homo sapiens
aaatcagtcaagct

SEQ ID NO: 6076802 - DNA, 22 bp, Homo sapiens
aaatcagtcagtgcaaatgtca

SEQ ID NO: 6076803 - DNA, 22 bp, Homo sapiens
aaatcagtcttccttgtggaat

SEQ ID NO: 6076804 - DNA, 18 bp, Homo sapiens
aaatcagtgggttaattt

SEQ ID NO: 6076805 - DNA, 20 bp, Homo sapiens
aaatcagtggtgttacattt

SEQ ID NO: 6076806 - DNA, 22 bp, Homo sapiens
aaatcagtgtttaaataaagac

SEQ ID NO: 6076807 - DNA, 13 bp, Homo sapiens
aaatcagttttgt

SEQ ID NO: 6076808 - DNA, 17 bp, Homo sapiens
aaatcagtttttgttct

SEQ ID NO: 6076809 - DNA, 19 bp, Homo sapiens
aaatcagtttttgttctta

SEQ ID NO: 6076810 - DNA, 21 bp, Homo sapiens
aaatcagtttttgttcttaaa

SEQ ID NO: 6076811 - DNA, 16 bp, Homo sapiens
aaatcataaagtcagt

SEQ ID NO: 6076812 - DNA, 23 bp, Homo sapiens
aaatcataataaagtttccatta

SEQ ID NO: 6076813 - DNA, 15 bp, Homo sapiens
aaatcataatcatcc

SEQ ID NO: 6076814 - DNA, 19 bp, Homo sapiens
aaatcatactgtaaggaaa

SEQ ID NO: 6076815 - DNA, 17 bp, Homo sapiens
aaatcatagtatatgat

SEQ ID NO: 6076816 - DNA, 21 bp, Homo sapiens
aaatcatatagaccaattgaa

SEQ ID NO: 6076817 - DNA, 19 bp, Homo sapiens
aaatcatattagtattaat

SEQ ID NO: 6076818 - DNA, 15 bp, Homo sapiens
aaatcatattctcat

SEQ ID NO: 6076819 - DNA, 18 bp, Homo sapiens
aaatcatattgagaataa

SEQ ID NO: 6076820 - DNA, 13 bp, Homo sapiens
aaatcatattgat

SEQ ID NO: 6076821 - DNA, 22 bp, Homo sapiens
aaatcatatttacctgtgaatc

SEQ ID NO: 6076822 - DNA, 11 bp, Homo sapiens
aaatcatcaag

SEQ ID NO: 6076823 - DNA, 14 bp, Homo sapiens
aaatcatcaagaag

SEQ ID NO: 6076824 - DNA, 18 bp, Homo sapiens
aaatcatcaagaagggct

SEQ ID NO: 6076825 - DNA, 15 bp, Homo sapiens
aaatcatcctgtttt

SEQ ID NO: 6076826 - DNA, 17 bp, Homo sapiens
aaatcatcgaaaattca

SEQ ID NO: 6076827 - DNA, 12 bp, Homo sapiens
aaatcatctatt

SEQ ID NO: 6076828 - DNA, 14 bp, Homo sapiens
aaatcatctatttt

SEQ ID NO: 6076829 - DNA, 16 bp, Homo sapiens
aaatcatctattttga

SEQ ID NO: 6076830 - DNA, 16 bp, Homo sapiens
aaatcatctcaccttg

SEQ ID NO: 6076831 - DNA, 20 bp, Homo sapiens
aaatcatctgcattcctgat

SEQ ID NO: 6076832 - DNA, 15 bp, Homo sapiens
aaatcatgaatattt

SEQ ID NO: 6076833 - DNA, 23 bp, Homo sapiens
aaatcatgccattgcactccagc

SEQ ID NO: 6076834 - DNA, 22 bp, Homo sapiens
aaatcatgcttataagcaacat

SEQ ID NO: 6076835 - DNA, 17 bp, Homo sapiens
aaatcatggaatggtta

SEQ ID NO: 6076836 - DNA, 13 bp, Homo sapiens
aaatcatgtatgt

SEQ ID NO: 6076837 - DNA, 21 bp, Homo sapiens
aaatcatgtatgttatgatat

SEQ ID NO: 6076838 - DNA, 17 bp, Homo sapiens
aaatcatgtgctcagaa

SEQ ID NO: 6076839 - DNA, 21 bp, Homo sapiens
aaatcatgtggcctaatattg

SEQ ID NO: 6076840 - DNA, 23 bp, Homo sapiens
aaatcatgtggcctaatattgaa

SEQ ID NO: 6076841 - DNA, 13 bp, Homo sapiens
aaatcatgttatg

SEQ ID NO: 6076842 - DNA, 18 bp, Homo sapiens
aaatcatgttatgataaa

SEQ ID NO: 6076843 - DNA, 23 bp, Homo sapiens
aaatcatgttgatcatgtacttt

SEQ ID NO: 6076844 - DNA, 12 bp, Homo sapiens
aaatcatgtttg

SEQ ID NO: 6076845 - DNA, 15 bp, Homo sapiens
aaatcatgttttttc

SEQ ID NO: 6076846 - DNA, 21 bp, Homo sapiens
aaatcatgttttttctgcaat

SEQ ID NO: 6076847 - DNA, 19 bp, Homo sapiens
aaatcattaatactcttct

SEQ ID NO: 6076848 - DNA, 22 bp, Homo sapiens
aaatcattcaaaactttcagct

SEQ ID NO: 6076849 - DNA, 13 bp, Homo sapiens
aaatcattcattc

SEQ ID NO: 6076850 - DNA, 18 bp, Homo sapiens
aaatcattgtcaaaatta

SEQ ID NO: 6076851 - DNA, 15 bp, Homo sapiens
aaatcatttagatgc

SEQ ID NO: 6076852 - DNA, 20 bp, Homo sapiens
aaatcatttcagtatcatct

SEQ ID NO: 6076853 - DNA, 22 bp, Homo sapiens
aaatcatttctgcatcagctgc

SEQ ID NO: 6076854 - DNA, 12 bp, Homo sapiens
aaatcatttggg

SEQ ID NO: 6076855 - DNA, 16 bp, Homo sapiens
aaatcattttaggaaa

SEQ ID NO: 6076856 - DNA, 18 bp, Homo sapiens
aaatcattttaggaaagg

SEQ ID NO: 6076857 - DNA, 19 bp, Homo sapiens
aaatcattttaggaaagga

SEQ ID NO: 6076858 - DNA, 21 bp, Homo sapiens
aaatcattttatatgtcaaag

SEQ ID NO: 6076859 - DNA, 14 bp, Homo sapiens
aaatcattttatgt

SEQ ID NO: 6076860 - DNA, 15 bp, Homo sapiens
aaatcattttatgtc

SEQ ID NO: 6076861 - DNA, 19 bp, Homo sapiens
aaatcattttcattaaaag

SEQ ID NO: 6076862 - DNA, 14 bp, Homo sapiens
aaatcattttgatg

SEQ ID NO: 6076863 - DNA, 19 bp, Homo sapiens
aaatcattttgatgtatta

SEQ ID NO: 6076864 - DNA, 15 bp, Homo sapiens
aaatccaaactgctg

SEQ ID NO: 6076865 - DNA, 17 bp, Homo sapiens
aaatccaaactgctgtc

SEQ ID NO: 6076866 - DNA, 21 bp, Homo sapiens
aaatccaaactgctgtctctt

SEQ ID NO: 6076867 - DNA, 12 bp, Homo sapiens
aaatccaaagaa

SEQ ID NO: 6076868 - DNA, 14 bp, Homo sapiens
aaatccaaagaaaa

SEQ ID NO: 6076869 - DNA, 20 bp, Homo sapiens
aaatccaaccctgtcagaat

SEQ ID NO: 6076870 - DNA, 12 bp, Homo sapiens
aaatccaacttt

SEQ ID NO: 6076871 - DNA, 12 bp, Homo sapiens
aaatccaagact

SEQ ID NO: 6076872 - DNA, 15 bp, Homo sapiens
aaatccaagatgctg

SEQ ID NO: 6076873 - DNA, 16 bp, Homo sapiens
aaatccaaggaaacat

SEQ ID NO: 6076874 - DNA, 17 bp, Homo sapiens
aaatccaataatcagaa

SEQ ID NO: 6076875 - DNA, 21 bp, Homo sapiens
aaatccaatagtctgccacaa

SEQ ID NO: 6076876 - DNA, 18 bp, Homo sapiens
aaatccacaccagtccac

SEQ ID NO: 6076877 - DNA, 17 bp, Homo sapiens
aaatccacccagcccac

SEQ ID NO: 6076878 - DNA, 19 bp, Homo sapiens
aaatccacccatatgttaa

SEQ ID NO: 6076879 - DNA, 23 bp, Homo sapiens
aaatccagaaacttgttcttcca

SEQ ID NO: 6076880 - DNA, 15 bp, Homo sapiens
aaatccagaaagaaa

SEQ ID NO: 6076881 - DNA, 17 bp, Homo sapiens
aaatccagaagttttaa

SEQ ID NO: 6076882 - DNA, 12 bp, Homo sapiens
aaatccagcccc

SEQ ID NO: 6076883 - DNA, 19 bp, Homo sapiens
aaatccaggaccctgccag

SEQ ID NO: 6076884 - DNA, 11 bp, Homo sapiens
aaatccagtgg

SEQ ID NO: 6076885 - DNA, 20 bp, Homo sapiens
aaatccagtgtgcacccctc

SEQ ID NO: 6076886 - DNA, 20 bp, Homo sapiens
aaatccagttacgggtggag

SEQ ID NO: 6076887 - DNA, 20 bp, Homo sapiens
aaatccatactgtagacact

SEQ ID NO: 6076888 - DNA, 22 bp, Homo sapiens
aaatccatagatttattttaca

SEQ ID NO: 6076889 - DNA, 16 bp, Homo sapiens
aaatccatagcacaag

SEQ ID NO: 6076890 - DNA, 19 bp, Homo sapiens
aaatccatgtgaccattct

SEQ ID NO: 6076891 - DNA, 15 bp, Homo sapiens
aaatccatgtgtccc

SEQ ID NO: 6076892 - DNA, 16 bp, Homo sapiens
aaatccatttggaaat

SEQ ID NO: 6076893 - DNA, 14 bp, Homo sapiens
aaatcccaacaaaa

SEQ ID NO: 6076894 - DNA, 16 bp, Homo sapiens
aaatcccatctgcatt

SEQ ID NO: 6076895 - DNA, 19 bp, Homo sapiens
aaatcccattattcaaagt

SEQ ID NO: 6076896 - DNA, 18 bp, Homo sapiens
aaatcccattgtatttaa

SEQ ID NO: 6076897 - DNA, 19 bp, Homo sapiens
aaatccccaaaaaagcgaa

SEQ ID NO: 6076898 - DNA, 20 bp, Homo sapiens
aaatcccccgactccctccc

SEQ ID NO: 6076899 - DNA, 13 bp, Homo sapiens
cccatctgtcttc

SEQ ID NO: 6076900 - DNA, 12 bp, Homo sapiens
cccatctgtgaa

SEQ ID NO: 6076901 - DNA, 20 bp, Homo sapiens
cccatctgtgaaaggaaaga

SEQ ID NO: 6076902 - DNA, 17 bp, Homo sapiens
cccatctgtgtgtgaat

SEQ ID NO: 6076903 - DNA, 15 bp, Homo sapiens
cccatctgtgttcta

SEQ ID NO: 6076904 - DNA, 21 bp, Homo sapiens
cccatcttccctggcgtcctc

SEQ ID NO: 6076905 - DNA, 18 bp, Homo sapiens
cccatcttcctgagctag

SEQ ID NO: 6076906 - DNA, 16 bp, Homo sapiens
cccatcttcctgctgc

SEQ ID NO: 6076907 - DNA, 18 bp, Homo sapiens
cccatcttcctgctgctg

SEQ ID NO: 6076908 - DNA, 17 bp, Homo sapiens
cccatcttcgggaccag

SEQ ID NO: 6076909 - DNA, 21 bp, Homo sapiens
cccatcttcgggaccaggatt

SEQ ID NO: 6076910 - DNA, 12 bp, Homo sapiens
cccatcttgctt

SEQ ID NO: 6076911 - DNA, 17 bp, Homo sapiens
cccatcttggtcctgtc

SEQ ID NO: 6076912 - DNA, 20 bp, Homo sapiens
cccatctttgatccttctga

SEQ ID NO: 6076913 - DNA, 21 bp, Homo sapiens
cccatctttgctgccagctct

SEQ ID NO: 6076914 - DNA, 16 bp, Homo sapiens
cccatgaaacagcagc

SEQ ID NO: 6076915 - DNA, 19 bp, Homo sapiens
cccatgaaacagcagctga

SEQ ID NO: 6076916 - DNA, 22 bp, Homo sapiens
cccatgaaattgacccccaaat

SEQ ID NO: 6076917 - DNA, 22 bp, Homo sapiens
cccatgaacttaaaatgaaagt

SEQ ID NO: 6076918 - DNA, 15 bp, Homo sapiens
cccatgaagatattt

SEQ ID NO: 6076919 - DNA, 12 bp, Homo sapiens
cccatgaagcct

SEQ ID NO: 6076920 - DNA, 17 bp, Homo sapiens
cccatgaagctggccct

SEQ ID NO: 6076921 - DNA, 21 bp, Homo sapiens
cccatgaagctggccctcagc

SEQ ID NO: 6076922 - DNA, 23 bp, Homo sapiens
cccatgaaggctggaaggcagca

SEQ ID NO: 6076923 - DNA, 16 bp, Homo sapiens
cccatgaatcaaagac

SEQ ID NO: 6076924 - DNA, 19 bp, Homo sapiens
cccatgacccacccctgtg

SEQ ID NO: 6076925 - DNA, 18 bp, Homo sapiens
cccatgacccaggctggg

SEQ ID NO: 6076926 - DNA, 19 bp, Homo sapiens
cccatgacccaggctgggc

SEQ ID NO: 6076927 - DNA, 22 bp, Homo sapiens
cccatgaccttatccttcctct

SEQ ID NO: 6076928 - DNA, 15 bp, Homo sapiens
cccatgacctttttc

SEQ ID NO: 6076929 - DNA, 19 bp, Homo sapiens
cccatgactgcacccagct

SEQ ID NO: 6076930 - DNA, 17 bp, Homo sapiens
cccatgactgccccttg

SEQ ID NO: 6076931 - DNA, 21 bp, Homo sapiens
cccatgagaccctggtgcctg

SEQ ID NO: 6076932 - DNA, 19 bp, Homo sapiens
cccatgagactgccctgcc

SEQ ID NO: 6076933 - DNA, 16 bp, Homo sapiens
cccatgagcagtccag

SEQ ID NO: 6076934 - DNA, 15 bp, Homo sapiens
cccatgagcctcagc

SEQ ID NO: 6076935 - DNA, 15 bp, Homo sapiens
cccatgagcctgccc

SEQ ID NO: 6076936 - DNA, 14 bp, Homo sapiens
cccatgagctcctt

SEQ ID NO: 6076937 - DNA, 16 bp, Homo sapiens
cccatgagctcggggt

SEQ ID NO: 6076938 - DNA, 20 bp, Homo sapiens
cccatgagggagatgccatg

SEQ ID NO: 6076939 - DNA, 21 bp, Homo sapiens
cccatgagggagatgccatga

SEQ ID NO: 6076940 - DNA, 13 bp, Homo sapiens
cccatgatccaga

SEQ ID NO: 6076941 - DNA, 19 bp, Homo sapiens
cccatgatgccgctcttct

SEQ ID NO: 6076942 - DNA, 17 bp, Homo sapiens
cccatgattccctcctc

SEQ ID NO: 6076943 - DNA, 21 bp, Homo sapiens
cccatgcaagcagaggaccag

SEQ ID NO: 6076944 - DNA, 15 bp, Homo sapiens
cccatgcacagtaca

SEQ ID NO: 6076945 - DNA, 19 bp, Homo sapiens
cccatgcacgcaccccgcc

SEQ ID NO: 6076946 - DNA, 20 bp, Homo sapiens
cccatgcacgcaccccgccc

SEQ ID NO: 6076947 - DNA, 16 bp, Homo sapiens
cccatgcactgtgaag

SEQ ID NO: 6076948 - DNA, 19 bp, Homo sapiens
cccatgcagctgctcccca

SEQ ID NO: 6076949 - DNA, 19 bp, Homo sapiens
cccatgcaggccctttgaa

SEQ ID NO: 6076950 - DNA, 18 bp, Homo sapiens
cccatgcataacacacta

SEQ ID NO: 6076951 - DNA, 13 bp, Homo sapiens
cccatgcatggcc

SEQ ID NO: 6076952 - DNA, 20 bp, Homo sapiens
cccatgcatggcctcccagc

SEQ ID NO: 6076953 - DNA, 22 bp, Homo sapiens
cccatgccaaggcctccctcag

SEQ ID NO: 6076954 - DNA, 16 bp, Homo sapiens
cccatgccaatgtcca

SEQ ID NO: 6076955 - DNA, 12 bp, Homo sapiens
cccatgccacca

SEQ ID NO: 6076956 - DNA, 13 bp, Homo sapiens
cccatgccagaga

SEQ ID NO: 6076957 - DNA, 14 bp, Homo sapiens
cccatgcccacctg

SEQ ID NO: 6076958 - DNA, 20 bp, Homo sapiens
cccatgccccactctgctga

SEQ ID NO: 6076959 - DNA, 14 bp, Homo sapiens
cccatgccccagtc

SEQ ID NO: 6076960 - DNA, 23 bp, Homo sapiens
cccatgcccccttcgctcctcct

SEQ ID NO: 6076961 - DNA, 21 bp, Homo sapiens
cccatgccctccgtcctggca

SEQ ID NO: 6076962 - DNA, 13 bp, Homo sapiens
cccatgccctgcc

SEQ ID NO: 6076963 - DNA, 21 bp, Homo sapiens
cccatgccctgccaagcctgg

SEQ ID NO: 6076964 - DNA, 23 bp, Homo sapiens
cccatgccctgccaagcctggag

SEQ ID NO: 6076965 - DNA, 20 bp, Homo sapiens
cccatgcgccttcgtgcctg

SEQ ID NO: 6076966 - DNA, 23 bp, Homo sapiens
cccatgcgtgccgcctgctcctc

SEQ ID NO: 6076967 - DNA, 21 bp, Homo sapiens
cccatgctctctgtggcctcc

SEQ ID NO: 6076968 - DNA, 14 bp, Homo sapiens
cccatgctgccctg

SEQ ID NO: 6076969 - DNA, 16 bp, Homo sapiens
cccatgctgccctgtg

SEQ ID NO: 6076970 - DNA, 19 bp, Homo sapiens
cccatgctgccttcaggga

SEQ ID NO: 6076971 - DNA, 15 bp, Homo sapiens
cccatgctggagcct

SEQ ID NO: 6076972 - DNA, 16 bp, Homo sapiens
cccatgctggagcctg

SEQ ID NO: 6076973 - DNA, 18 bp, Homo sapiens
cccatgctggagcctgtg

SEQ ID NO: 6076974 - DNA, 15 bp, Homo sapiens
cccatgctggctggg

SEQ ID NO: 6076975 - DNA, 13 bp, Homo sapiens
cccatgctgtccg

SEQ ID NO: 6076976 - DNA, 14 bp, Homo sapiens
cccatgctgttgat

SEQ ID NO: 6076977 - DNA, 15 bp, Homo sapiens
cccatggaacaaatg

SEQ ID NO: 6076978 - DNA, 21 bp, Homo sapiens
cccatggaacagccctgcacg

SEQ ID NO: 6076979 - DNA, 13 bp, Homo sapiens
cccatggaatatt

SEQ ID NO: 6076980 - DNA, 17 bp, Homo sapiens
cccatggaatatttcca

SEQ ID NO: 6076981 - DNA, 20 bp, Homo sapiens
cccatggacactccagtgcc

SEQ ID NO: 6076982 - DNA, 22 bp, Homo sapiens
cccatggacaggctggctccag

SEQ ID NO: 6076983 - DNA, 21 bp, Homo sapiens
cccatggagattgacctggat

SEQ ID NO: 6076984 - DNA, 19 bp, Homo sapiens
cccatggagccagctccct

SEQ ID NO: 6076985 - DNA, 15 bp, Homo sapiens
cccatggagccccag

SEQ ID NO: 6076986 - DNA, 16 bp, Homo sapiens
cccatggaggagacag

SEQ ID NO: 6076987 - DNA, 18 bp, Homo sapiens
cccatggaggcagatgcc

SEQ ID NO: 6076988 - DNA, 21 bp, Homo sapiens
cccatggcccagcagcttggc

SEQ ID NO: 6076989 - DNA, 13 bp, Homo sapiens
cccatggccccag

SEQ ID NO: 6076990 - DNA, 14 bp, Homo sapiens
cccatggccccagc

SEQ ID NO: 6076991 - DNA, 16 bp, Homo sapiens
cccatggccccagctg

SEQ ID NO: 6076992 - DNA, 14 bp, Homo sapiens
cccatggcccccaa

SEQ ID NO: 6076993 - DNA, 21 bp, Homo sapiens
cccatggcccccaataaaggc

SEQ ID NO: 6076994 - DNA, 14 bp, Homo sapiens
cccatggccctgag

SEQ ID NO: 6076995 - DNA, 15 bp, Homo sapiens
cccatggcctcagat

SEQ ID NO: 6076996 - DNA, 19 bp, Homo sapiens
cccatggcctcagccctgc

SEQ ID NO: 6076997 - DNA, 20 bp, Homo sapiens
cccatggcctgctgggcttg

SEQ ID NO: 6076998 - DNA, 11 bp, Homo sapiens
cccatggcctt

SEQ ID NO: 6076999 - DNA, 15 bp, Homo sapiens
cccatggctctattt

SEQ ID NO: 6077000 - DNA, 23 bp, Homo sapiens
cccatggctgaagctggagcagc

SEQ ID NO: 6077001 - DNA, 24 bp, Homo sapiens
cccatgggacaaattgcacagaag

SEQ ID NO: 6077002 - DNA, 15 bp, Homo sapiens
cccatgggcacagtg

SEQ ID NO: 6077003 - DNA, 18 bp, Homo sapiens
cccatgggcactgctggg

SEQ ID NO: 6077004 - DNA, 16 bp, Homo sapiens
cccatgggcagaagat

SEQ ID NO: 6077005 - DNA, 14 bp, Homo sapiens
cccatgggcaggag

SEQ ID NO: 6077006 - DNA, 17 bp, Homo sapiens
cccatgggccctcagcg

SEQ ID NO: 6077007 - DNA, 17 bp, Homo sapiens
cccatgggctcccactg

SEQ ID NO: 6077008 - DNA, 17 bp, Homo sapiens
cccatgggctctggccc

SEQ ID NO: 6077009 - DNA, 14 bp, Homo sapiens
cccatgggctgctg

SEQ ID NO: 6077010 - DNA, 23 bp, Homo sapiens
cccatgggctgtgtcctaaggcc

SEQ ID NO: 6077011 - DNA, 16 bp, Homo sapiens
cccatgggcttggact

SEQ ID NO: 6077012 - DNA, 23 bp, Homo sapiens
cccatgggggtgctgcagccagg

SEQ ID NO: 6077013 - DNA, 13 bp, Homo sapiens
cccatggggtcct

SEQ ID NO: 6077014 - DNA, 17 bp, Homo sapiens
cccatggtcacagaccc

SEQ ID NO: 6077015 - DNA, 18 bp, Homo sapiens
cccatggtcacagacccc

SEQ ID NO: 6077016 - DNA, 18 bp, Homo sapiens
cccatggtccatcccctg

SEQ ID NO: 6077017 - DNA, 14 bp, Homo sapiens
cccatggtggcctc

SEQ ID NO: 6077018 - DNA, 15 bp, Homo sapiens
cccatggtgtatgtg

SEQ ID NO: 6077019 - DNA, 13 bp, Homo sapiens
cccatgtaaatat

SEQ ID NO: 6077020 - DNA, 14 bp, Homo sapiens
cccatgtagccccc

SEQ ID NO: 6077021 - DNA, 22 bp, Homo sapiens
cccatgtagccccctggcctct

SEQ ID NO: 6077022 - DNA, 22 bp, Homo sapiens
cccatgtcaccggtcagtgcct

SEQ ID NO: 6077023 - DNA, 23 bp, Homo sapiens
cccatgtcccagcctggcctgtg

SEQ ID NO: 6077024 - DNA, 19 bp, Homo sapiens
cccatgtcgcgctcagcat

SEQ ID NO: 6077025 - DNA, 15 bp, Homo sapiens
cccatgtcttctgct

SEQ ID NO: 6077026 - DNA, 21 bp, Homo sapiens
cccatgtcttctgctgttctt

SEQ ID NO: 6077027 - DNA, 22 bp, Homo sapiens
cccatgtctttctccaaagtta

SEQ ID NO: 6077028 - DNA, 18 bp, Homo sapiens
cccatgtgagctgctgcc

SEQ ID NO: 6077029 - DNA, 18 bp, Homo sapiens
cccatgtgagtccctgtg

SEQ ID NO: 6077030 - DNA, 20 bp, Homo sapiens
cccatgtgagtccctgtgat

SEQ ID NO: 6077031 - DNA, 19 bp, Homo sapiens
cccatgtgcctgcaccagg

SEQ ID NO: 6077032 - DNA, 16 bp, Homo sapiens
cccatgtgctgggaaa

SEQ ID NO: 6077033 - DNA, 19 bp, Homo sapiens
cccatgtggagtcagcctc

SEQ ID NO: 6077034 - DNA, 17 bp, Homo sapiens
cccatgtggcagcccat

SEQ ID NO: 6077035 - DNA, 13 bp, Homo sapiens
cccatgtggctga

SEQ ID NO: 6077036 - DNA, 16 bp, Homo sapiens
cccatgtgggcgccca

SEQ ID NO: 6077037 - DNA, 21 bp, Homo sapiens
cccatgtgggcgcccaccctg

SEQ ID NO: 6077038 - DNA, 18 bp, Homo sapiens
cccatgtgtgatgctgac

SEQ ID NO: 6077039 - DNA, 21 bp, Homo sapiens
cccatgtgtgatgctgacacc

SEQ ID NO: 6077040 - DNA, 19 bp, Homo sapiens
cccatgttacttctctgag

SEQ ID NO: 6077041 - DNA, 18 bp, Homo sapiens
cccatgttctgcccccag

SEQ ID NO: 6077042 - DNA, 15 bp, Homo sapiens
cccatgttctgtccc

SEQ ID NO: 6077043 - DNA, 20 bp, Homo sapiens
cccatgttgcatgcctatgt

SEQ ID NO: 6077044 - DNA, 17 bp, Homo sapiens
cccatgttgggaaaaac

SEQ ID NO: 6077045 - DNA, 14 bp, Homo sapiens
cccatgttgtaatg

SEQ ID NO: 6077046 - DNA, 18 bp, Homo sapiens
cccatgttgtaatgctgc

SEQ ID NO: 6077047 - DNA, 24 bp, Homo sapiens
cccatgtttaaactttgtgccttt

SEQ ID NO: 6077048 - DNA, 13 bp, Homo sapiens
cccatgtttcaaa

SEQ ID NO: 6077049 - DNA, 21 bp, Homo sapiens
cccattaaggggaagaatgaa

SEQ ID NO: 6077050 - DNA, 22 bp, Homo sapiens
cccattaatcttgatcattccg

SEQ ID NO: 6077051 - DNA, 21 bp, Homo sapiens
cccattaggacaatcagtccc

SEQ ID NO: 6077052 - DNA, 20 bp, Homo sapiens
cccattatgcgctgtggcca

SEQ ID NO: 6077053 - DNA, 12 bp, Homo sapiens
cccattcaccct

SEQ ID NO: 6077054 - DNA, 13 bp, Homo sapiens
cccattcagaact

SEQ ID NO: 6077055 - DNA, 18 bp, Homo sapiens
cccattcagagactgtcc

SEQ ID NO: 6077056 - DNA, 14 bp, Homo sapiens
cccattcagcctcg

SEQ ID NO: 6077057 - DNA, 18 bp, Homo sapiens
cccattcattccattctg

SEQ ID NO: 6077058 - DNA, 13 bp, Homo sapiens
cccattcccacca

SEQ ID NO: 6077059 - DNA, 15 bp, Homo sapiens
cccattccccttaag

SEQ ID NO: 6077060 - DNA, 16 bp, Homo sapiens
cccattcccgcagtgg

SEQ ID NO: 6077061 - DNA, 12 bp, Homo sapiens
cccattccctgg

SEQ ID NO: 6077062 - DNA, 14 bp, Homo sapiens
cccattcctgcctg

SEQ ID NO: 6077063 - DNA, 22 bp, Homo sapiens
cccattccttgcgcctcagccc

SEQ ID NO: 6077064 - DNA, 20 bp, Homo sapiens
cccattctacttgctctgga

SEQ ID NO: 6077065 - DNA, 21 bp, Homo sapiens
cccattctacttgctctggac

SEQ ID NO: 6077066 - DNA, 15 bp, Homo sapiens
cccattctagatcct

SEQ ID NO: 6077067 - DNA, 18 bp, Homo sapiens
cccattctagatcctgca

SEQ ID NO: 6077068 - DNA, 19 bp, Homo sapiens
cccattctagatcctgcac

SEQ ID NO: 6077069 - DNA, 11 bp, Homo sapiens
cccattctcca

SEQ ID NO: 6077070 - DNA, 17 bp, Homo sapiens
cccattctcccagtctc

SEQ ID NO: 6077071 - DNA, 19 bp, Homo sapiens
cccattctctccagtgtgt

SEQ ID NO: 6077072 - DNA, 18 bp, Homo sapiens
cccattctctctcctgtc

SEQ ID NO: 6077073 - DNA, 19 bp, Homo sapiens
cccattctctctcctgtcc

SEQ ID NO: 6077074 - DNA, 15 bp, Homo sapiens
cccattctgcaccac

SEQ ID NO: 6077075 - DNA, 22 bp, Homo sapiens
cccattctgcctgcccaggccc

SEQ ID NO: 6077076 - DNA, 21 bp, Homo sapiens
cccattcttcctagttttctc

SEQ ID NO: 6077077 - DNA, 11 bp, Homo sapiens
cccattctttg

SEQ ID NO: 6077078 - DNA, 19 bp, Homo sapiens
cccattcttttcacttcct

SEQ ID NO: 6077079 - DNA, 20 bp, Homo sapiens
cccattgagatcttcctgct

SEQ ID NO: 6077080 - DNA, 15 bp, Homo sapiens
cccattgcagaccct

SEQ ID NO: 6077081 - DNA, 17 bp, Homo sapiens
cccattgcccagtgagc

SEQ ID NO: 6077082 - DNA, 14 bp, Homo sapiens
cccattgctccatt

SEQ ID NO: 6077083 - DNA, 22 bp, Homo sapiens
cccattgctccattcactccca

SEQ ID NO: 6077084 - DNA, 18 bp, Homo sapiens
cccattggagcacctggg

SEQ ID NO: 6077085 - DNA, 21 bp, Homo sapiens
cccattggccgagctcctggg

SEQ ID NO: 6077086 - DNA, 14 bp, Homo sapiens
cccattgtatttaa

SEQ ID NO: 6077087 - DNA, 14 bp, Homo sapiens
cccattgtccctct

SEQ ID NO: 6077088 - DNA, 18 bp, Homo sapiens
cccattgtccctctgccc

SEQ ID NO: 6077089 - DNA, 12 bp, Homo sapiens
cccattgtcctc

SEQ ID NO: 6077090 - DNA, 20 bp, Homo sapiens
cccattgtctcattgccagt

SEQ ID NO: 6077091 - DNA, 22 bp, Homo sapiens
cccattgtgaatgttgtcctgt

SEQ ID NO: 6077092 - DNA, 18 bp, Homo sapiens
cccattgtgacagcgatg

SEQ ID NO: 6077093 - DNA, 13 bp, Homo sapiens
cccattgtggagg

SEQ ID NO: 6077094 - DNA, 15 bp, Homo sapiens
cccattgtggctcct

SEQ ID NO: 6077095 - DNA, 19 bp, Homo sapiens
cccattgtggctcctatct

SEQ ID NO: 6077096 - DNA, 18 bp, Homo sapiens
cccattgttcccttcctc

SEQ ID NO: 6077097 - DNA, 21 bp, Homo sapiens
cccattgttggcgctgaggtg

SEQ ID NO: 6077098 - DNA, 17 bp, Homo sapiens
cccattgttgtcaagga

SEQ ID NO: 6077099 - DNA, 20 bp, Homo sapiens
cccattgttgtcaaggaaga

SEQ ID NO: 6077100 - DNA, 22 bp, Homo sapiens
cccatttagaatggtgatttta

SEQ ID NO: 6077101 - DNA, 19 bp, Homo sapiens
cccatttatagatggggga

SEQ ID NO: 6077102 - DNA, 15 bp, Homo sapiens
cccatttatccacct

SEQ ID NO: 6077103 - DNA, 14 bp, Homo sapiens
cccatttcaatgtg

SEQ ID NO: 6077104 - DNA, 17 bp, Homo sapiens
cccatttcaggaggtgc

SEQ ID NO: 6077105 - DNA, 17 bp, Homo sapiens
cccatttcccatctgca

SEQ ID NO: 6077106 - DNA, 14 bp, Homo sapiens
cccatttcccgcac

SEQ ID NO: 6077107 - DNA, 11 bp, Homo sapiens
cccatttcctg

SEQ ID NO: 6077108 - DNA, 22 bp, Homo sapiens
cccatttctactcttaagtttc

SEQ ID NO: 6077109 - DNA, 20 bp, Homo sapiens
cccatttctagaacatccct

SEQ ID NO: 6077110 - DNA, 15 bp, Homo sapiens
cccatttctcactga

SEQ ID NO: 6077111 - DNA, 15 bp, Homo sapiens
cccatttctccagaa

SEQ ID NO: 6077112 - DNA, 14 bp, Homo sapiens
cccatttctctaca

SEQ ID NO: 6077113 - DNA, 13 bp, Homo sapiens
cccatttctgttg

SEQ ID NO: 6077114 - DNA, 23 bp, Homo sapiens
cccatttgcaggatctgtctgtg

SEQ ID NO: 6077115 - DNA, 18 bp, Homo sapiens
cccatttgccatgctgct

SEQ ID NO: 6077116 - DNA, 18 bp, Homo sapiens
cccatttgtaatgtatct

SEQ ID NO: 6077117 - DNA, 14 bp, Homo sapiens
cccatttgtcccag

SEQ ID NO: 6077118 - DNA, 16 bp, Homo sapiens
cccatttgtgtttcag

SEQ ID NO: 6077119 - DNA, 22 bp, Homo sapiens
cccatttgttttcggcagcctt

SEQ ID NO: 6077120 - DNA, 20 bp, Homo sapiens
cccattttagaaaatcagat

SEQ ID NO: 6077121 - DNA, 18 bp, Homo sapiens
cccattttataccaaagg

SEQ ID NO: 6077122 - DNA, 14 bp, Homo sapiens
cccattttcatcct

SEQ ID NO: 6077123 - DNA, 18 bp, Homo sapiens
cccattttcatcctgagc

SEQ ID NO: 6077124 - DNA, 19 bp, Homo sapiens
cccattttcatcctgagcc

SEQ ID NO: 6077125 - DNA, 17 bp, Homo sapiens
cccattttccccttcct

SEQ ID NO: 6077126 - DNA, 14 bp, Homo sapiens
cccattttctgtgg

SEQ ID NO: 6077127 - DNA, 17 bp, Homo sapiens
cccattttgaggccaga

SEQ ID NO: 6077128 - DNA, 19 bp, Homo sapiens
cccattttgcaaaatttcc

SEQ ID NO: 6077129 - DNA, 15 bp, Homo sapiens
cccattttgcctctg

SEQ ID NO: 6077130 - DNA, 20 bp, Homo sapiens
cccatttttatatcgatctc

SEQ ID NO: 6077131 - DNA, 13 bp, Homo sapiens
cccatttttctct

SEQ ID NO: 6077132 - DNA, 12 bp, Homo sapiens
cccatttttgct

SEQ ID NO: 6077133 - DNA, 22 bp, Homo sapiens
cccatttttgctctatgggaaa

SEQ ID NO: 6077134 - DNA, 19 bp, Homo sapiens
ccccaaaacaaagtctttg

SEQ ID NO: 6077135 - DNA, 15 bp, Homo sapiens
ccccaaaaccacagc

SEQ ID NO: 6077136 - DNA, 21 bp, Homo sapiens
ccccaaaactctcctctgctg

SEQ ID NO: 6077137 - DNA, 20 bp, Homo sapiens
ccccaaaagaaaccatgaca

SEQ ID NO: 6077138 - DNA, 22 bp, Homo sapiens
ccccaaaatccaaaacttctct

SEQ ID NO: 6077139 - DNA, 13 bp, Homo sapiens
ccccaaaattagc

SEQ ID NO: 6077140 - DNA, 22 bp, Homo sapiens
ccccaaacaccttccagctcct

SEQ ID NO: 6077141 - DNA, 14 bp, Homo sapiens
ccccaaacagcatg

SEQ ID NO: 6077142 - DNA, 16 bp, Homo sapiens
ccccaaacatagcccc

SEQ ID NO: 6077143 - DNA, 23 bp, Homo sapiens
ccccaaacattaatcaccaaagt

SEQ ID NO: 6077144 - DNA, 17 bp, Homo sapiens
ccccaaacccagaaaga

SEQ ID NO: 6077145 - DNA, 15 bp, Homo sapiens
ccccaaaccccagcc

SEQ ID NO: 6077146 - DNA, 20 bp, Homo sapiens
ccccaaaccccagccccaac

SEQ ID NO: 6077147 - DNA, 23 bp, Homo sapiens
ccccaaaccctgcttctgctgcc

SEQ ID NO: 6077148 - DNA, 20 bp, Homo sapiens
ccccaaactgtgccctgcct

SEQ ID NO: 6077149 - DNA, 22 bp, Homo sapiens
ccccaaactgtgccctgccttc

SEQ ID NO: 6077150 - DNA, 15 bp, Homo sapiens
ccccaaagaagaagt

SEQ ID NO: 6077151 - DNA, 14 bp, Homo sapiens
ccccaaagagcctg

SEQ ID NO: 6077152 - DNA, 14 bp, Homo sapiens
ccccaaagagctgt

SEQ ID NO: 6077153 - DNA, 21 bp, Homo sapiens
ccccaaagatagacaggtcct

SEQ ID NO: 6077154 - DNA, 21 bp, Homo sapiens
ccccaaagcagcaggcctctg

SEQ ID NO: 6077155 - DNA, 23 bp, Homo sapiens
ccccaaagcagcaggcctctggt

SEQ ID NO: 6077156 - DNA, 16 bp, Homo sapiens
ccccaaagccactgga

SEQ ID NO: 6077157 - DNA, 16 bp, Homo sapiens
ccccaaagctttcctg

SEQ ID NO: 6077158 - DNA, 19 bp, Homo sapiens
ccccaaaggaacactgaca

SEQ ID NO: 6077159 - DNA, 19 bp, Homo sapiens
ccccaaaggaaccgcccag

SEQ ID NO: 6077160 - DNA, 20 bp, Homo sapiens
ccccaaaggcatcccagcct

SEQ ID NO: 6077161 - DNA, 22 bp, Homo sapiens
ccccaaaggcatcccagcctgg

SEQ ID NO: 6077162 - DNA, 23 bp, Homo sapiens
ccccaaaggcatcccagcctggg

SEQ ID NO: 6077163 - DNA, 23 bp, Homo sapiens
ccccaaaggggcctctccttttc

SEQ ID NO: 6077164 - DNA, 21 bp, Homo sapiens
ccccaaaggtccgcaccctgt

SEQ ID NO: 6077165 - DNA, 16 bp, Homo sapiens
ccccaaagtccaggct

SEQ ID NO: 6077166 - DNA, 15 bp, Homo sapiens
ccccaaagtgctggg

SEQ ID NO: 6077167 - DNA, 16 bp, Homo sapiens
ccccaaagtgctggga

SEQ ID NO: 6077168 - DNA, 21 bp, Homo sapiens
ccccaaatcacaaacatatgt

SEQ ID NO: 6077169 - DNA, 15 bp, Homo sapiens
ccccaaatcttcctc

SEQ ID NO: 6077170 - DNA, 22 bp, Homo sapiens
ccccaaatggaaatgggcagag

SEQ ID NO: 6077171 - DNA, 19 bp, Homo sapiens
ccccaaattgccttcagcc

SEQ ID NO: 6077172 - DNA, 14 bp, Homo sapiens
ccccaacacaggca

SEQ ID NO: 6077173 - DNA, 20 bp, Homo sapiens
ccccaacacaggcaagtcca

SEQ ID NO: 6077174 - DNA, 18 bp, Homo sapiens
ccccaacacctgcctctg

SEQ ID NO: 6077175 - DNA, 17 bp, Homo sapiens
ccccaacacctgctgcg

SEQ ID NO: 6077176 - DNA, 15 bp, Homo sapiens
ccccaacactccagg

SEQ ID NO: 6077177 - DNA, 13 bp, Homo sapiens
ccccaacactgtc

SEQ ID NO: 6077178 - DNA, 16 bp, Homo sapiens
ccccaacactgtgccc

SEQ ID NO: 6077179 - DNA, 22 bp, Homo sapiens
ccccaacactgtgccctggtgg

SEQ ID NO: 6077180 - DNA, 22 bp, Homo sapiens
ccccaacagctggaccctgacc

SEQ ID NO: 6077181 - DNA, 18 bp, Homo sapiens
ccccaacatataaaataa

SEQ ID NO: 6077182 - DNA, 20 bp, Homo sapiens
ccccaaccaaggaaggagcc

SEQ ID NO: 6077183 - DNA, 18 bp, Homo sapiens
ccccaaccatcttcactg

SEQ ID NO: 6077184 - DNA, 23 bp, Homo sapiens
ccccaaccatttcctcagactct

SEQ ID NO: 6077185 - DNA, 15 bp, Homo sapiens
ccccaacccacctct

SEQ ID NO: 6077186 - DNA, 23 bp, Homo sapiens
ccccaacccacctctggccctgt

SEQ ID NO: 6077187 - DNA, 17 bp, Homo sapiens
ccccaaccccagacccc

SEQ ID NO: 6077188 - DNA, 13 bp, Homo sapiens
ccccaaccccagc

SEQ ID NO: 6077189 - DNA, 16 bp, Homo sapiens
ccccaaccccgcggtg

SEQ ID NO: 6077190 - DNA, 21 bp, Homo sapiens
ccccaaccccgcggtgctctg

SEQ ID NO: 6077191 - DNA, 22 bp, Homo sapiens
ccccaaccccgcggtgctctgg

SEQ ID NO: 6077192 - DNA, 23 bp, Homo sapiens
ccccaacccctccttccccagac

SEQ ID NO: 6077193 - DNA, 17 bp, Homo sapiens
ccccaacccctctccag

SEQ ID NO: 6077194 - DNA, 21 bp, Homo sapiens
ccccaacccctctccaggcct

SEQ ID NO: 6077195 - DNA, 14 bp, Homo sapiens
ccccaacccctgag

SEQ ID NO: 6077196 - DNA, 20 bp, Homo sapiens
ccccaacccgtggaggctgc

SEQ ID NO: 6077197 - DNA, 18 bp, Homo sapiens
ccccaaccctcggagccc

SEQ ID NO: 6077198 - DNA, 13 bp, Homo sapiens
ccccaacctcaga

SEQ ID NO: 6077199 - DNA, 21 bp, Homo sapiens
ccccaacctcagggctcccag

SEQ ID NO: 6077200 - DNA, 13 bp, Homo sapiens
ccccaacctgctc

SEQ ID NO: 6077201 - DNA, 14 bp, Homo sapiens
ccccaacctgctct

SEQ ID NO: 6077202 - DNA, 19 bp, Homo sapiens
ccccaacctgctctcctct

SEQ ID NO: 6077203 - DNA, 21 bp, Homo sapiens
ccccaacctgctctcctcttc

SEQ ID NO: 6077204 - DNA, 16 bp, Homo sapiens
ccccaacgaaaagcac

SEQ ID NO: 6077205 - DNA, 18 bp, Homo sapiens
ccccaacgggaaaggaaa

SEQ ID NO: 6077206 - DNA, 17 bp, Homo sapiens
ccccaacgtcccctccg

SEQ ID NO: 6077207 - DNA, 19 bp, Homo sapiens
ccccaactattaaagtgcc

SEQ ID NO: 6077208 - DNA, 23 bp, Homo sapiens
ccccaactcaagtgtcacctcct

SEQ ID NO: 6077209 - DNA, 14 bp, Homo sapiens
ccccaactcaggac

SEQ ID NO: 6077210 - DNA, 23 bp, Homo sapiens
ccccaactccaggggcacctatg

SEQ ID NO: 6077211 - DNA, 17 bp, Homo sapiens
ccccaactccctgccat

SEQ ID NO: 6077212 - DNA, 16 bp, Homo sapiens
ccccaactccttccag

SEQ ID NO: 6077213 - DNA, 15 bp, Homo sapiens
ccccaactccttcct

SEQ ID NO: 6077214 - DNA, 20 bp, Homo sapiens
ccccaactcgggctcccggg

SEQ ID NO: 6077215 - DNA, 16 bp, Homo sapiens
ccccaactctccccag

SEQ ID NO: 6077216 - DNA, 18 bp, Homo sapiens
ccccaactctccccagtg

SEQ ID NO: 6077217 - DNA, 22 bp, Homo sapiens
ccccaactcttctccaagtcta

SEQ ID NO: 6077218 - DNA, 18 bp, Homo sapiens
ccccaactgctccagcct

SEQ ID NO: 6077219 - DNA, 20 bp, Homo sapiens
ccccaactgtggtagctcca

SEQ ID NO: 6077220 - DNA, 20 bp, Homo sapiens
ccccaacttcaccaccccct

SEQ ID NO: 6077221 - DNA, 22 bp, Homo sapiens
ccccaacttggcagctttttct

SEQ ID NO: 6077222 - DNA, 16 bp, Homo sapiens
ccccaagaaagcctca

SEQ ID NO: 6077223 - DNA, 19 bp, Homo sapiens
ccccaagaccccctggggt

SEQ ID NO: 6077224 - DNA, 14 bp, Homo sapiens
ccccaagactctgc

SEQ ID NO: 6077225 - DNA, 16 bp, Homo sapiens
ccccaagactctgctc

SEQ ID NO: 6077226 - DNA, 23 bp, Homo sapiens
ccccaagacttggtgtcctttcc

SEQ ID NO: 6077227 - DNA, 16 bp, Homo sapiens
ccccaagagcaggagg

SEQ ID NO: 6077228 - DNA, 20 bp, Homo sapiens
ccccaagagcccaaaagagg

SEQ ID NO: 6077229 - DNA, 16 bp, Homo sapiens
ccccaagatctgccag

SEQ ID NO: 6077230 - DNA, 19 bp, Homo sapiens
ccccaagatgagctgcagc

SEQ ID NO: 6077231 - DNA, 16 bp, Homo sapiens
ccccaagatgttgggg

SEQ ID NO: 6077232 - DNA, 13 bp, Homo sapiens
ccccaagcagcca

SEQ ID NO: 6077233 - DNA, 18 bp, Homo sapiens
ccccaagcagccagccag

SEQ ID NO: 6077234 - DNA, 13 bp, Homo sapiens
ccccaagccacag

SEQ ID NO: 6077235 - DNA, 18 bp, Homo sapiens
ccccaagcccaccaggtg

SEQ ID NO: 6077236 - DNA, 15 bp, Homo sapiens
ccccaagcctctgcc

SEQ ID NO: 6077237 - DNA, 18 bp, Homo sapiens
ccccaagcctctgcccca

SEQ ID NO: 6077238 - DNA, 22 bp, Homo sapiens
ccccaagcctctgccccaaggg

SEQ ID NO: 6077239 - DNA, 17 bp, Homo sapiens
ccccaagcctggcaggg

SEQ ID NO: 6077240 - DNA, 13 bp, Homo sapiens
ccccaagcctggg

SEQ ID NO: 6077241 - DNA, 17 bp, Homo sapiens
ccccaagcgcctggctg

SEQ ID NO: 6077242 - DNA, 17 bp, Homo sapiens
ccccaagctgttttctt

SEQ ID NO: 6077243 - DNA, 15 bp, Homo sapiens
ccccaagcttcccaa

SEQ ID NO: 6077244 - DNA, 12 bp, Homo sapiens
ccccaagcttct

SEQ ID NO: 6077245 - DNA, 13 bp, Homo sapiens
ccccaagcttctg

SEQ ID NO: 6077246 - DNA, 17 bp, Homo sapiens
ccccaaggaagaacaaa

SEQ ID NO: 6077247 - DNA, 13 bp, Homo sapiens
ccccaaggacaag

SEQ ID NO: 6077248 - DNA, 17 bp, Homo sapiens
ccccaaggacccagccc

SEQ ID NO: 6077249 - DNA, 14 bp, Homo sapiens
ccccaaggaggcag

SEQ ID NO: 6077250 - DNA, 23 bp, Homo sapiens
ccccaaggaggcagcctggacca

SEQ ID NO: 6077251 - DNA, 17 bp, Homo sapiens
ccccaaggatggggttc

SEQ ID NO: 6077252 - DNA, 20 bp, Homo sapiens
ccccaaggccccagggacag

SEQ ID NO: 6077253 - DNA, 11 bp, Homo sapiens
ccccaaggcct

SEQ ID NO: 6077254 - DNA, 13 bp, Homo sapiens
ccccaaggcctct

SEQ ID NO: 6077255 - DNA, 22 bp, Homo sapiens
aaatccccggctgcttccttct

SEQ ID NO: 6077256 - DNA, 11 bp, Homo sapiens
aaatcccctca

SEQ ID NO: 6077257 - DNA, 18 bp, Homo sapiens
aaatcccctcagcctctt

SEQ ID NO: 6077258 - DNA, 13 bp, Homo sapiens
aaatccccttctc

SEQ ID NO: 6077259 - DNA, 15 bp, Homo sapiens
aaatccgacttgaat

SEQ ID NO: 6077260 - DNA, 22 bp, Homo sapiens
aaatccgacttgaatattcctg

SEQ ID NO: 6077261 - DNA, 20 bp, Homo sapiens
aaatccgccagtgtttctga

SEQ ID NO: 6077262 - DNA, 21 bp, Homo sapiens
aaatccggtcagccaagtgca

SEQ ID NO: 6077263 - DNA, 19 bp, Homo sapiens
aaatccgtgaagtcacatt

SEQ ID NO: 6077264 - DNA, 22 bp, Homo sapiens
aaatcctaagacacaaatgcat

SEQ ID NO: 6077265 - DNA, 19 bp, Homo sapiens
aaatcctagacttgaaagt

SEQ ID NO: 6077266 - DNA, 22 bp, Homo sapiens
aaatcctagagattcttagctc

SEQ ID NO: 6077267 - DNA, 18 bp, Homo sapiens
aaatcctaggaagttatc

SEQ ID NO: 6077268 - DNA, 17 bp, Homo sapiens
aaatcctatatctgttt

SEQ ID NO: 6077269 - DNA, 14 bp, Homo sapiens
aaatcctatgtgat

SEQ ID NO: 6077270 - DNA, 23 bp, Homo sapiens
aaatcctatgtgattttaactct

SEQ ID NO: 6077271 - DNA, 14 bp, Homo sapiens
aaatcctcaggaaa

SEQ ID NO: 6077272 - DNA, 13 bp, Homo sapiens
aaatcctcttcct

SEQ ID NO: 6077273 - DNA, 17 bp, Homo sapiens
aaatcctcttcctctga

SEQ ID NO: 6077274 - DNA, 17 bp, Homo sapiens
aaatcctgaagagcatt

SEQ ID NO: 6077275 - DNA, 16 bp, Homo sapiens
aaatcctgccatttaa

SEQ ID NO: 6077276 - DNA, 18 bp, Homo sapiens
aaatcctgcccaaaatgt

SEQ ID NO: 6077277 - DNA, 21 bp, Homo sapiens
aaatcctggaagattttggta

SEQ ID NO: 6077278 - DNA, 19 bp, Homo sapiens
aaatcctggaaggacacag

SEQ ID NO: 6077279 - DNA, 12 bp, Homo sapiens
aaatcctgtgtt

SEQ ID NO: 6077280 - DNA, 17 bp, Homo sapiens
aaatcctgttgaaaagc

SEQ ID NO: 6077281 - DNA, 19 bp, Homo sapiens
aaatccttaacatttctct

SEQ ID NO: 6077282 - DNA, 18 bp, Homo sapiens
aaatccttacttccagca

SEQ ID NO: 6077283 - DNA, 16 bp, Homo sapiens
aaatccttatttatat

SEQ ID NO: 6077284 - DNA, 15 bp, Homo sapiens
aaatccttcccaagt

SEQ ID NO: 6077285 - DNA, 15 bp, Homo sapiens
aaatccttctaatct

SEQ ID NO: 6077286 - DNA, 18 bp, Homo sapiens
aaatccttctaatctgct

SEQ ID NO: 6077287 - DNA, 17 bp, Homo sapiens
aaatccttgccttcaaa

SEQ ID NO: 6077288 - DNA, 12 bp, Homo sapiens
aaatccttgtta

SEQ ID NO: 6077289 - DNA, 18 bp, Homo sapiens
aaatcctttcataaagca

SEQ ID NO: 6077290 - DNA, 16 bp, Homo sapiens
aaatcctttctgcccc

SEQ ID NO: 6077291 - DNA, 20 bp, Homo sapiens
aaatcgaatgaaattaactg

SEQ ID NO: 6077292 - DNA, 15 bp, Homo sapiens
aaatcgatattagaa

SEQ ID NO: 6077293 - DNA, 13 bp, Homo sapiens
aaatcgatgcagt

SEQ ID NO: 6077294 - DNA, 14 bp, Homo sapiens
aaatcgattggctt

SEQ ID NO: 6077295 - DNA, 15 bp, Homo sapiens
aaatcgattggcttt

SEQ ID NO: 6077296 - DNA, 22 bp, Homo sapiens
aaatcgcattaatgaaatacca

SEQ ID NO: 6077297 - DNA, 18 bp, Homo sapiens
aaatcgccataggccaag

SEQ ID NO: 6077298 - DNA, 17 bp, Homo sapiens
aaatcgccttatgagaa

SEQ ID NO: 6077299 - DNA, 15 bp, Homo sapiens
aaatcgcttttgata

SEQ ID NO: 6077300 - DNA, 17 bp, Homo sapiens
aaatcgggaaggatggg

SEQ ID NO: 6077301 - DNA, 21 bp, Homo sapiens
aaatcgggttcagaacacttt

SEQ ID NO: 6077302 - DNA, 22 bp, Homo sapiens
aaatcgtattctaattcttcat

SEQ ID NO: 6077303 - DNA, 21 bp, Homo sapiens
aaatcgtggcacgtattgctg

SEQ ID NO: 6077304 - DNA, 22 bp, Homo sapiens
aaatcgttggaaaataaattca

SEQ ID NO: 6077305 - DNA, 16 bp, Homo sapiens
aaatcgtttaatgttt

SEQ ID NO: 6077306 - DNA, 23 bp, Homo sapiens
aaatcgtttaatgtttatacaga

SEQ ID NO: 6077307 - DNA, 22 bp, Homo sapiens
aaatctaaaacaaaatctgaac

SEQ ID NO: 6077308 - DNA, 13 bp, Homo sapiens
aaatctaaaagaa

SEQ ID NO: 6077309 - DNA, 13 bp, Homo sapiens
aaatctaaaatgt

SEQ ID NO: 6077310 - DNA, 15 bp, Homo sapiens
aaatctaaaatgtgt

SEQ ID NO: 6077311 - DNA, 12 bp, Homo sapiens
aaatctaaaatt

SEQ ID NO: 6077312 - DNA, 17 bp, Homo sapiens
aaatctaaaatttaaaa

SEQ ID NO: 6077313 - DNA, 18 bp, Homo sapiens
aaatctaaaatttcataa

SEQ ID NO: 6077314 - DNA, 12 bp, Homo sapiens
aaatctaaagtt

SEQ ID NO: 6077315 - DNA, 21 bp, Homo sapiens
aaatctaaatagatacttttg

SEQ ID NO: 6077316 - DNA, 16 bp, Homo sapiens
aaatctaaatctattt

SEQ ID NO: 6077317 - DNA, 15 bp, Homo sapiens
aaatctaaattaact

SEQ ID NO: 6077318 - DNA, 21 bp, Homo sapiens
aaatctaatcaggttgttaat

SEQ ID NO: 6077319 - DNA, 23 bp, Homo sapiens
aaatctaatcaggttgttaatgt

SEQ ID NO: 6077320 - DNA, 13 bp, Homo sapiens
aaatctaatctct

SEQ ID NO: 6077321 - DNA, 19 bp, Homo sapiens
aaatctaatgacattcaat

SEQ ID NO: 6077322 - DNA, 19 bp, Homo sapiens
aaatctaatgtaagaaaat

SEQ ID NO: 6077323 - DNA, 17 bp, Homo sapiens
aaatctaccttctgtag

SEQ ID NO: 6077324 - DNA, 15 bp, Homo sapiens
aaatctactgagcca

SEQ ID NO: 6077325 - DNA, 14 bp, Homo sapiens
aaatctacttccta

SEQ ID NO: 6077326 - DNA, 15 bp, Homo sapiens
aaatctagaaaattg

SEQ ID NO: 6077327 - DNA, 21 bp, Homo sapiens
aaatctagaaaattgagtttt

SEQ ID NO: 6077328 - DNA, 15 bp, Homo sapiens
aaatctagaagatgc

SEQ ID NO: 6077329 - DNA, 18 bp, Homo sapiens
aaatctagaatttagtga

SEQ ID NO: 6077330 - DNA, 21 bp, Homo sapiens
aaatctagacattcttttaat

SEQ ID NO: 6077331 - DNA, 18 bp, Homo sapiens
aaatctagagtttataca

SEQ ID NO: 6077332 - DNA, 22 bp, Homo sapiens
aaatctaggaaaattattctat

SEQ ID NO: 6077333 - DNA, 17 bp, Homo sapiens
aaatctaggatgtgatg

SEQ ID NO: 6077334 - DNA, 20 bp, Homo sapiens
aaatctagttttttttgtaa

SEQ ID NO: 6077335 - DNA, 14 bp, Homo sapiens
aaatctatagaaag

SEQ ID NO: 6077336 - DNA, 17 bp, Homo sapiens
aaatctatagaaagtgt

SEQ ID NO: 6077337 - DNA, 18 bp, Homo sapiens
aaatctatagtttgattc

SEQ ID NO: 6077338 - DNA, 20 bp, Homo sapiens
aaatctatattaaagtgtta

SEQ ID NO: 6077339 - DNA, 19 bp, Homo sapiens
aaatctatatttttgtgaa

SEQ ID NO: 6077340 - DNA, 23 bp, Homo sapiens
aaatctatctctatataaaaaat

SEQ ID NO: 6077341 - DNA, 17 bp, Homo sapiens
aaatctatgatatattt

SEQ ID NO: 6077342 - DNA, 16 bp, Homo sapiens
aaatctatgattccag

SEQ ID NO: 6077343 - DNA, 13 bp, Homo sapiens
aaatctattcaga

SEQ ID NO: 6077344 - DNA, 22 bp, Homo sapiens
aaatctatttaattaggaaaaa

SEQ ID NO: 6077345 - DNA, 13 bp, Homo sapiens
aaatctcaaattt

SEQ ID NO: 6077346 - DNA, 17 bp, Homo sapiens
aaatctcaaatttctaa

SEQ ID NO: 6077347 - DNA, 18 bp, Homo sapiens
aaatctcaatatttcaga

SEQ ID NO: 6077348 - DNA, 20 bp, Homo sapiens
aaatctcagatacttatgaa

SEQ ID NO: 6077349 - DNA, 11 bp, Homo sapiens
aaatctcagca

SEQ ID NO: 6077350 - DNA, 18 bp, Homo sapiens
aaatctcatctctacaaa

SEQ ID NO: 6077351 - DNA, 20 bp, Homo sapiens
aaatctcattatttcaaaat

SEQ ID NO: 6077352 - DNA, 16 bp, Homo sapiens
aaatctccaatccaca

SEQ ID NO: 6077353 - DNA, 20 bp, Homo sapiens
aaatctccagcttactataa

SEQ ID NO: 6077354 - DNA, 16 bp, Homo sapiens
aaatctcccattttgg

SEQ ID NO: 6077355 - DNA, 14 bp, Homo sapiens
aaatctcctatttt

SEQ ID NO: 6077356 - DNA, 20 bp, Homo sapiens
aaatctcctctttgtgaaat

SEQ ID NO: 6077357 - DNA, 17 bp, Homo sapiens
aaatctcctttgtccat

SEQ ID NO: 6077358 - DNA, 15 bp, Homo sapiens
aaatctctaatatgg

SEQ ID NO: 6077359 - DNA, 22 bp, Homo sapiens
aaatctctacaaatttttctgt

SEQ ID NO: 6077360 - DNA, 16 bp, Homo sapiens
aaatctctagcctctt

SEQ ID NO: 6077361 - DNA, 17 bp, Homo sapiens
aaatctctccactttca

SEQ ID NO: 6077362 - DNA, 19 bp, Homo sapiens
aaatctctccactttcagc

SEQ ID NO: 6077363 - DNA, 20 bp, Homo sapiens
aaatctctccactttcagct

SEQ ID NO: 6077364 - DNA, 13 bp, Homo sapiens
aaatctcttctgt

SEQ ID NO: 6077365 - DNA, 18 bp, Homo sapiens
aaatctcttgcttgtcat

SEQ ID NO: 6077366 - DNA, 20 bp, Homo sapiens
aaatctgaactctcaaaagt

SEQ ID NO: 6077367 - DNA, 15 bp, Homo sapiens
aaatctgaagattgc

SEQ ID NO: 6077368 - DNA, 15 bp, Homo sapiens
aaatctgaagattgt

SEQ ID NO: 6077369 - DNA, 20 bp, Homo sapiens
aaatctgaagattgtttatc

SEQ ID NO: 6077370 - DNA, 14 bp, Homo sapiens
aaatctgaagcctt

SEQ ID NO: 6077371 - DNA, 16 bp, Homo sapiens
aaatctgaagcctttt

SEQ ID NO: 6077372 - DNA, 19 bp, Homo sapiens
aaatctgaattttaaaaca

SEQ ID NO: 6077373 - DNA, 16 bp, Homo sapiens
aaatctgaattttgca

SEQ ID NO: 6077374 - DNA, 18 bp, Homo sapiens
aaatctgaattttgcaat

SEQ ID NO: 6077375 - DNA, 19 bp, Homo sapiens
aaatctgacagtctcaaat

SEQ ID NO: 6077376 - DNA, 23 bp, Homo sapiens
aaatctgacataaaaacagtgct

SEQ ID NO: 6077377 - DNA, 14 bp, Homo sapiens
aaatctgacatatt

SEQ ID NO: 6077378 - DNA, 18 bp, Homo sapiens
aaatctgacccagtgccc

SEQ ID NO: 6077379 - DNA, 23 bp, Homo sapiens
aaatctgactttttctgtgcgcc

SEQ ID NO: 6077380 - DNA, 23 bp, Homo sapiens
aaatctgagatctccctccaggg

SEQ ID NO: 6077381 - DNA, 18 bp, Homo sapiens
aaatctgagcctaaatct

SEQ ID NO: 6077382 - DNA, 22 bp, Homo sapiens
aaatctgagggaaatgttttgt

SEQ ID NO: 6077383 - DNA, 16 bp, Homo sapiens
aaatctgattagaagt

SEQ ID NO: 6077384 - DNA, 15 bp, Homo sapiens
aaatctgatttaatg

SEQ ID NO: 6077385 - DNA, 16 bp, Homo sapiens
aaatctgatttaatgt

SEQ ID NO: 6077386 - DNA, 18 bp, Homo sapiens
aaatctgatttaatgttt

SEQ ID NO: 6077387 - DNA, 15 bp, Homo sapiens
aaatctgcaaagcat

SEQ ID NO: 6077388 - DNA, 17 bp, Homo sapiens
aaatctgcaaagcatgt

SEQ ID NO: 6077389 - DNA, 23 bp, Homo sapiens
aaatctgcaaagcatgttttgca

SEQ ID NO: 6077390 - DNA, 21 bp, Homo sapiens
aaatctgcctttgtttctaaa

SEQ ID NO: 6077391 - DNA, 18 bp, Homo sapiens
aaatctgctctgtacatc

SEQ ID NO: 6077392 - DNA, 18 bp, Homo sapiens
aaatctgctgatctctgt

SEQ ID NO: 6077393 - DNA, 19 bp, Homo sapiens
aaatctgctgatctctgta

SEQ ID NO: 6077394 - DNA, 14 bp, Homo sapiens
aaatctgctgcacc

SEQ ID NO: 6077395 - DNA, 19 bp, Homo sapiens
aaatctgctgcaccttgta

SEQ ID NO: 6077396 - DNA, 17 bp, Homo sapiens
aaatctgctttcatcca

SEQ ID NO: 6077397 - DNA, 19 bp, Homo sapiens
aaatctgctttcatccagc

SEQ ID NO: 6077398 - DNA, 18 bp, Homo sapiens
aaatctgctttttaaaga

SEQ ID NO: 6077399 - DNA, 12 bp, Homo sapiens
aaatctggaaat

SEQ ID NO: 6077400 - DNA, 13 bp, Homo sapiens
aaatctggaaatc

SEQ ID NO: 6077401 - DNA, 19 bp, Homo sapiens
aaatctggatatagaaagg

SEQ ID NO: 6077402 - DNA, 22 bp, Homo sapiens
aaatctggcaaagttatattta

SEQ ID NO: 6077403 - DNA, 23 bp, Homo sapiens
aaatctggggaagaggttttatt

SEQ ID NO: 6077404 - DNA, 23 bp, Homo sapiens
aaatctggtctaatttattaatc

SEQ ID NO: 6077405 - DNA, 15 bp, Homo sapiens
aaatctggtcttgtt

SEQ ID NO: 6077406 - DNA, 22 bp, Homo sapiens
aaatctggtcttgttagaaaac

SEQ ID NO: 6077407 - DNA, 22 bp, Homo sapiens
aaatctgtaacaggtattttgt

SEQ ID NO: 6077408 - DNA, 18 bp, Homo sapiens
aaatctgtaattctattg

SEQ ID NO: 6077409 - DNA, 13 bp, Homo sapiens
aaatctgtacttt

SEQ ID NO: 6077410 - DNA, 22 bp, Homo sapiens
aaatctgtacttttttcaaata

SEQ ID NO: 6077411 - DNA, 16 bp, Homo sapiens
aaatctgtatatgttg

SEQ ID NO: 6077412 - DNA, 15 bp, Homo sapiens
aaatctgtattgcta

SEQ ID NO: 6077413 - DNA, 22 bp, Homo sapiens
aaatctgtcagcatctggctgt

SEQ ID NO: 6077414 - DNA, 21 bp, Homo sapiens
aaatctgtccaaaggaggctg

SEQ ID NO: 6077415 - DNA, 12 bp, Homo sapiens
aaatctgtcctc

SEQ ID NO: 6077416 - DNA, 17 bp, Homo sapiens
aaatctgtcctctgtag

SEQ ID NO: 6077417 - DNA, 14 bp, Homo sapiens
aaatctgtcctgtg

SEQ ID NO: 6077418 - DNA, 15 bp, Homo sapiens
aaatctgtcctgtgg

SEQ ID NO: 6077419 - DNA, 16 bp, Homo sapiens
aaatctgtctgattct

SEQ ID NO: 6077420 - DNA, 14 bp, Homo sapiens
aaatctgtctgctg

SEQ ID NO: 6077421 - DNA, 14 bp, Homo sapiens
aaatctgtctttgc

SEQ ID NO: 6077422 - DNA, 21 bp, Homo sapiens
aaatctgtgacctgtcagaat

SEQ ID NO: 6077423 - DNA, 19 bp, Homo sapiens
aaatctgtgatgatcctca

SEQ ID NO: 6077424 - DNA, 15 bp, Homo sapiens
aaatctgtgcaataa

SEQ ID NO: 6077425 - DNA, 17 bp, Homo sapiens
aaatctgtgcaataaaa

SEQ ID NO: 6077426 - DNA, 22 bp, Homo sapiens
aaatctgtgcaataaaataaca

SEQ ID NO: 6077427 - DNA, 12 bp, Homo sapiens
aaatctgtgtat

SEQ ID NO: 6077428 - DNA, 22 bp, Homo sapiens
aaatctgtgtatattatttggc

SEQ ID NO: 6077429 - DNA, 20 bp, Homo sapiens
aaatctgttctgggctcttt

SEQ ID NO: 6077430 - DNA, 15 bp, Homo sapiens
aaatctgttggtttt

SEQ ID NO: 6077431 - DNA, 15 bp, Homo sapiens
aaatctgttgttcca

SEQ ID NO: 6077432 - DNA, 16 bp, Homo sapiens
aaatctgttgttccaa

SEQ ID NO: 6077433 - DNA, 15 bp, Homo sapiens
ccccaaggcctctct

SEQ ID NO: 6077434 - DNA, 19 bp, Homo sapiens
ccccaaggcctctctctgc

SEQ ID NO: 6077435 - DNA, 23 bp, Homo sapiens
ccccaaggcctctctctgcctga

SEQ ID NO: 6077436 - DNA, 21 bp, Homo sapiens
ccccaagggcccagaccctgg

SEQ ID NO: 6077437 - DNA, 13 bp, Homo sapiens
ccccaagggccct

SEQ ID NO: 6077438 - DNA, 16 bp, Homo sapiens
ccccaaggggcagtct

SEQ ID NO: 6077439 - DNA, 18 bp, Homo sapiens
ccccaagggggctgctgc

SEQ ID NO: 6077440 - DNA, 18 bp, Homo sapiens
ccccaaggttccagaggc

SEQ ID NO: 6077441 - DNA, 13 bp, Homo sapiens
ccccaagtcctca

SEQ ID NO: 6077442 - DNA, 21 bp, Homo sapiens
ccccaagtgtcctggaccctg

SEQ ID NO: 6077443 - DNA, 15 bp, Homo sapiens
ccccaataaaccagt

SEQ ID NO: 6077444 - DNA, 22 bp, Homo sapiens
ccccaataaaccagtgtgaacc

SEQ ID NO: 6077445 - DNA, 19 bp, Homo sapiens
ccccaataaaggcagctgc

SEQ ID NO: 6077446 - DNA, 20 bp, Homo sapiens
ccccaataaaggcagctgcc

SEQ ID NO: 6077447 - DNA, 19 bp, Homo sapiens
ccccaataccccatggacc

SEQ ID NO: 6077448 - DNA, 20 bp, Homo sapiens
ccccaatagctagtgacagc

SEQ ID NO: 6077449 - DNA, 22 bp, Homo sapiens
ccccaatatggtggccctgggg

SEQ ID NO: 6077450 - DNA, 15 bp, Homo sapiens
ccccaatccagagaa

SEQ ID NO: 6077451 - DNA, 16 bp, Homo sapiens
ccccaatccctgaccc

SEQ ID NO: 6077452 - DNA, 23 bp, Homo sapiens
ccccaatccctgccactgggctc

SEQ ID NO: 6077453 - DNA, 20 bp, Homo sapiens
ccccaatcggactgccaaat

SEQ ID NO: 6077454 - DNA, 18 bp, Homo sapiens
ccccaatgtgacctgggg

SEQ ID NO: 6077455 - DNA, 21 bp, Homo sapiens
ccccaattaaacccagaacca

SEQ ID NO: 6077456 - DNA, 14 bp, Homo sapiens
ccccaattcatgtt

SEQ ID NO: 6077457 - DNA, 19 bp, Homo sapiens
ccccaattctgcctgcctc

SEQ ID NO: 6077458 - DNA, 13 bp, Homo sapiens
ccccacaacacgc

SEQ ID NO: 6077459 - DNA, 17 bp, Homo sapiens
ccccacaagcaccactc

SEQ ID NO: 6077460 - DNA, 19 bp, Homo sapiens
ccccacaagctgtccctgc

SEQ ID NO: 6077461 - DNA, 19 bp, Homo sapiens
ccccacaaggaaccctcag

SEQ ID NO: 6077462 - DNA, 14 bp, Homo sapiens
ccccacaaggcctg

SEQ ID NO: 6077463 - DNA, 21 bp, Homo sapiens
ccccacaaggcctggtctggg

SEQ ID NO: 6077464 - DNA, 18 bp, Homo sapiens
ccccacaagtgccctcca

SEQ ID NO: 6077465 - DNA, 13 bp, Homo sapiens
ccccacaatctgg

SEQ ID NO: 6077466 - DNA, 12 bp, Homo sapiens
ccccacacacac

SEQ ID NO: 6077467 - DNA, 14 bp, Homo sapiens
ccccacacacacac

SEQ ID NO: 6077468 - DNA, 13 bp, Homo sapiens
ccccacacacact

SEQ ID NO: 6077469 - DNA, 14 bp, Homo sapiens
ccccacacagcctc

SEQ ID NO: 6077470 - DNA, 15 bp, Homo sapiens
ccccacacagcctct

SEQ ID NO: 6077471 - DNA, 13 bp, Homo sapiens
ccccacacaggcc

SEQ ID NO: 6077472 - DNA, 18 bp, Homo sapiens
ccccacacaggcctggcc

SEQ ID NO: 6077473 - DNA, 13 bp, Homo sapiens
ccccacacagggc

SEQ ID NO: 6077474 - DNA, 14 bp, Homo sapiens
ccccacaccaggcc

SEQ ID NO: 6077475 - DNA, 18 bp, Homo sapiens
ccccacaccctggagtgg

SEQ ID NO: 6077476 - DNA, 12 bp, Homo sapiens
ccccacacctgc

SEQ ID NO: 6077477 - DNA, 19 bp, Homo sapiens
ccccacacgccggggctgg

SEQ ID NO: 6077478 - DNA, 22 bp, Homo sapiens
ccccacacgccggggctggccc

SEQ ID NO: 6077479 - DNA, 15 bp, Homo sapiens
ccccacactccactc

SEQ ID NO: 6077480 - DNA, 13 bp, Homo sapiens
ccccacactgggg

SEQ ID NO: 6077481 - DNA, 12 bp, Homo sapiens
ccccacagatcc

SEQ ID NO: 6077482 - DNA, 13 bp, Homo sapiens
ccccacagatcca

SEQ ID NO: 6077483 - DNA, 15 bp, Homo sapiens
ccccacagcacccag

SEQ ID NO: 6077484 - DNA, 12 bp, Homo sapiens
ccccacagccca

SEQ ID NO: 6077485 - DNA, 21 bp, Homo sapiens
ccccacagcccacgtcctgtc

SEQ ID NO: 6077486 - DNA, 12 bp, Homo sapiens
ccccacagcccc

SEQ ID NO: 6077487 - DNA, 12 bp, Homo sapiens
ccccacagcctc

SEQ ID NO: 6077488 - DNA, 13 bp, Homo sapiens
ccccacagcctct

SEQ ID NO: 6077489 - DNA, 22 bp, Homo sapiens
ccccacagcctctggctccaca

SEQ ID NO: 6077490 - DNA, 13 bp, Homo sapiens
ccccacagcgctc

SEQ ID NO: 6077491 - DNA, 18 bp, Homo sapiens
ccccacagcgtccctggc

SEQ ID NO: 6077492 - DNA, 10 bp, Homo sapiens
ccccacagct

SEQ ID NO: 6077493 - DNA, 14 bp, Homo sapiens
ccccacagctgggg

SEQ ID NO: 6077494 - DNA, 19 bp, Homo sapiens
ccccacaggagcgtgtcct

SEQ ID NO: 6077495 - DNA, 23 bp, Homo sapiens
ccccacaggatgaactagccatg

SEQ ID NO: 6077496 - DNA, 20 bp, Homo sapiens
ccccacaggcacattaactg

SEQ ID NO: 6077497 - DNA, 22 bp, Homo sapiens
ccccacaggccccccgcagcac

SEQ ID NO: 6077498 - DNA, 22 bp, Homo sapiens
ccccacagtctccggcctctcc

SEQ ID NO: 6077499 - DNA, 15 bp, Homo sapiens
ccccacagtgccacc

SEQ ID NO: 6077500 - DNA, 13 bp, Homo sapiens
ccccacagttgct

SEQ ID NO: 6077501 - DNA, 19 bp, Homo sapiens
ccccacatcgcacactggg

SEQ ID NO: 6077502 - DNA, 18 bp, Homo sapiens
ccccacattggacttcct

SEQ ID NO: 6077503 - DNA, 14 bp, Homo sapiens
ccccaccacacatc

SEQ ID NO: 6077504 - DNA, 18 bp, Homo sapiens
ccccaccacacatcccag

SEQ ID NO: 6077505 - DNA, 19 bp, Homo sapiens
ccccaccacacatcccagc

SEQ ID NO: 6077506 - DNA, 15 bp, Homo sapiens
ccccaccacactgaa

SEQ ID NO: 6077507 - DNA, 21 bp, Homo sapiens
ccccaccagacatcacccttt

SEQ ID NO: 6077508 - DNA, 14 bp, Homo sapiens
ccccaccagagctg

SEQ ID NO: 6077509 - DNA, 16 bp, Homo sapiens
ccccaccagagctgcc

SEQ ID NO: 6077510 - DNA, 13 bp, Homo sapiens
ccccaccagcagc

SEQ ID NO: 6077511 - DNA, 15 bp, Homo sapiens
ccccaccagccacct

SEQ ID NO: 6077512 - DNA, 13 bp, Homo sapiens
ccccaccagctcg

SEQ ID NO: 6077513 - DNA, 14 bp, Homo sapiens
ccccaccagctcgt

SEQ ID NO: 6077514 - DNA, 13 bp, Homo sapiens
ccccaccagctgc

SEQ ID NO: 6077515 - DNA, 14 bp, Homo sapiens
ccccaccagctgca

SEQ ID NO: 6077516 - DNA, 17 bp, Homo sapiens
ccccaccagctgcagcc

SEQ ID NO: 6077517 - DNA, 19 bp, Homo sapiens
ccccaccatctgctgtctt

SEQ ID NO: 6077518 - DNA, 23 bp, Homo sapiens
ccccacccaactccacagggctg

SEQ ID NO: 6077519 - DNA, 16 bp, Homo sapiens
ccccacccaagcttgg

SEQ ID NO: 6077520 - DNA, 18 bp, Homo sapiens
ccccacccaagcttggca

SEQ ID NO: 6077521 - DNA, 19 bp, Homo sapiens
ccccacccaagcttggcag

SEQ ID NO: 6077522 - DNA, 20 bp, Homo sapiens
ccccacccacccccaggcct

SEQ ID NO: 6077523 - DNA, 13 bp, Homo sapiens
ccccacccacctc

SEQ ID NO: 6077524 - DNA, 20 bp, Homo sapiens
ccccacccacctccacccag

SEQ ID NO: 6077525 - DNA, 15 bp, Homo sapiens
ccccacccacctcct

SEQ ID NO: 6077526 - DNA, 16 bp, Homo sapiens
ccccacccacctttgc

SEQ ID NO: 6077527 - DNA, 17 bp, Homo sapiens
ccccacccacctttgca

SEQ ID NO: 6077528 - DNA, 12 bp, Homo sapiens
ccccacccagct

SEQ ID NO: 6077529 - DNA, 13 bp, Homo sapiens
ccccacccaggag

SEQ ID NO: 6077530 - DNA, 13 bp, Homo sapiens
ccccacccatcag

SEQ ID NO: 6077531 - DNA, 18 bp, Homo sapiens
ccccacccatgccagcgc

SEQ ID NO: 6077532 - DNA, 17 bp, Homo sapiens
ccccaccccaaaattag

SEQ ID NO: 6077533 - DNA, 16 bp, Homo sapiens
ccccaccccacacttg

SEQ ID NO: 6077534 - DNA, 17 bp, Homo sapiens
ccccaccccaccccacc

SEQ ID NO: 6077535 - DNA, 12 bp, Homo sapiens
ccccaccccacg

SEQ ID NO: 6077536 - DNA, 13 bp, Homo sapiens
ccccaccccactc

SEQ ID NO: 6077537 - DNA, 15 bp, Homo sapiens
ccccaccccagagtt

SEQ ID NO: 6077538 - DNA, 18 bp, Homo sapiens
ccccaccccagagttggg

SEQ ID NO: 6077539 - DNA, 13 bp, Homo sapiens
ccccaccccaggc

SEQ ID NO: 6077540 - DNA, 15 bp, Homo sapiens
ccccaccccagggca

SEQ ID NO: 6077541 - DNA, 20 bp, Homo sapiens
ccccaccccagggcagccag

SEQ ID NO: 6077542 - DNA, 14 bp, Homo sapiens
ccccacccccaagg

SEQ ID NO: 6077543 - DNA, 12 bp, Homo sapiens
ccccacccccac

SEQ ID NO: 6077544 - DNA, 15 bp, Homo sapiens
ccccacccccagcca

SEQ ID NO: 6077545 - DNA, 14 bp, Homo sapiens
ccccacccccagtg

SEQ ID NO: 6077546 - DNA, 15 bp, Homo sapiens
ccccacccccctcct

SEQ ID NO: 6077547 - DNA, 23 bp, Homo sapiens
ccccacccccgggtgcctgtgac

SEQ ID NO: 6077548 - DNA, 20 bp, Homo sapiens
ccccacccccgtcaccccgc

SEQ ID NO: 6077549 - DNA, 15 bp, Homo sapiens
ccccaccccctgggc

SEQ ID NO: 6077550 - DNA, 12 bp, Homo sapiens
ccccaccccctt

SEQ ID NO: 6077551 - DNA, 20 bp, Homo sapiens
ccccaccccgggctctcctg

SEQ ID NO: 6077552 - DNA, 14 bp, Homo sapiens
ccccacccctaagt

SEQ ID NO: 6077553 - DNA, 13 bp, Homo sapiens
ccccacccctacc

SEQ ID NO: 6077554 - DNA, 15 bp, Homo sapiens
ccccacccctccacg

SEQ ID NO: 6077555 - DNA, 14 bp, Homo sapiens
ccccacccctccag

SEQ ID NO: 6077556 - DNA, 13 bp, Homo sapiens
ccccacccctgcc

SEQ ID NO: 6077557 - DNA, 17 bp, Homo sapiens
ccccacccctgccccca

SEQ ID NO: 6077558 - DNA, 20 bp, Homo sapiens
ccccacccctgggggctctc

SEQ ID NO: 6077559 - DNA, 13 bp, Homo sapiens
ccccacccctgta

SEQ ID NO: 6077560 - DNA, 12 bp, Homo sapiens
ccccaccccttc

SEQ ID NO: 6077561 - DNA, 13 bp, Homo sapiens
ccccaccccttcc

SEQ ID NO: 6077562 - DNA, 17 bp, Homo sapiens
ccccaccctactccctc

SEQ ID NO: 6077563 - DNA, 18 bp, Homo sapiens
ccccaccctagcctccac

SEQ ID NO: 6077564 - DNA, 22 bp, Homo sapiens
ccccaccctcaaaccctgtggg

SEQ ID NO: 6077565 - DNA, 19 bp, Homo sapiens
ccccaccctcagccgctct

SEQ ID NO: 6077566 - DNA, 17 bp, Homo sapiens
ccccaccctccactcag

SEQ ID NO: 6077567 - DNA, 13 bp, Homo sapiens
ccccaccctccat

SEQ ID NO: 6077568 - DNA, 18 bp, Homo sapiens
ccccaccctcccctctcc

SEQ ID NO: 6077569 - DNA, 22 bp, Homo sapiens
ccccaccctcctggcctcagac

SEQ ID NO: 6077570 - DNA, 16 bp, Homo sapiens
ccccaccctgcctcac

SEQ ID NO: 6077571 - DNA, 14 bp, Homo sapiens
ccccaccctgcttc

SEQ ID NO: 6077572 - DNA, 15 bp, Homo sapiens
ccccaccctgggctc

SEQ ID NO: 6077573 - DNA, 16 bp, Homo sapiens
ccccaccctgggctct

SEQ ID NO: 6077574 - DNA, 20 bp, Homo sapiens
ccccaccctggtgggccaac

SEQ ID NO: 6077575 - DNA, 13 bp, Homo sapiens
ccccaccctgtcc

SEQ ID NO: 6077576 - DNA, 15 bp, Homo sapiens
ccccaccctgtccca

SEQ ID NO: 6077577 - DNA, 16 bp, Homo sapiens
ccccaccctgtcccag

SEQ ID NO: 6077578 - DNA, 19 bp, Homo sapiens
ccccaccctgtctgcaggc

SEQ ID NO: 6077579 - DNA, 13 bp, Homo sapiens
ccccaccctgtgc

SEQ ID NO: 6077580 - DNA, 20 bp, Homo sapiens
ccccaccctgtttggatttt

SEQ ID NO: 6077581 - DNA, 16 bp, Homo sapiens
ccccaccgaagagccc

SEQ ID NO: 6077582 - DNA, 18 bp, Homo sapiens
ccccaccgaagagccctg

SEQ ID NO: 6077583 - DNA, 23 bp, Homo sapiens
ccccaccgaggttcccagggctg

SEQ ID NO: 6077584 - DNA, 16 bp, Homo sapiens
ccccaccgccggggtc

SEQ ID NO: 6077585 - DNA, 22 bp, Homo sapiens
ccccaccgccggggtcctggga

SEQ ID NO: 6077586 - DNA, 23 bp, Homo sapiens
ccccaccgccggggtcctgggag

SEQ ID NO: 6077587 - DNA, 16 bp, Homo sapiens
ccccaccgccgtggag

SEQ ID NO: 6077588 - DNA, 18 bp, Homo sapiens
ccccaccgctcagtgtca

SEQ ID NO: 6077589 - DNA, 18 bp, Homo sapiens
ccccaccggaactgggct

SEQ ID NO: 6077590 - DNA, 21 bp, Homo sapiens
ccccaccgggctgcaggtgct

SEQ ID NO: 6077591 - DNA, 17 bp, Homo sapiens
ccccaccggtccagctg

SEQ ID NO: 6077592 - DNA, 13 bp, Homo sapiens
ccccacctcccca

SEQ ID NO: 6077593 - DNA, 14 bp, Homo sapiens
ccccacctccccac

SEQ ID NO: 6077594 - DNA, 19 bp, Homo sapiens
ccccacctcccccttcccc

SEQ ID NO: 6077595 - DNA, 14 bp, Homo sapiens
ccccacctcccgcc

SEQ ID NO: 6077596 - DNA, 15 bp, Homo sapiens
ccccacctccctgcg

SEQ ID NO: 6077597 - DNA, 13 bp, Homo sapiens
ccccacctccgcc

SEQ ID NO: 6077598 - DNA, 17 bp, Homo sapiens
ccccacctctccctgac

SEQ ID NO: 6077599 - DNA, 13 bp, Homo sapiens
ccccacctctggt

SEQ ID NO: 6077600 - DNA, 14 bp, Homo sapiens
ccccacctcttcct

SEQ ID NO: 6077601 - DNA, 17 bp, Homo sapiens
ccccacctcttttccta

SEQ ID NO: 6077602 - DNA, 14 bp, Homo sapiens
ccccacctgaaggg

SEQ ID NO: 6077603 - DNA, 23 bp, Homo sapiens
ccccacctgacaatggcagctag

SEQ ID NO: 6077604 - DNA, 14 bp, Homo sapiens
ccccacctgacctc

SEQ ID NO: 6077605 - DNA, 17 bp, Homo sapiens
ccccacctgacctctgc

SEQ ID NO: 6077606 - DNA, 12 bp, Homo sapiens
ccccacctgcag

SEQ ID NO: 6077607 - DNA, 12 bp, Homo sapiens
ccccacctgcca

SEQ ID NO: 6077608 - DNA, 13 bp, Homo sapiens
ccccacctgccac

SEQ ID NO: 6077609 - DNA, 14 bp, Homo sapiens
ccccacctgccagc

SEQ ID NO: 6077610 - DNA, 12 bp, Homo sapiens
ccccacctgcct

SEQ ID NO: 6077611 - DNA, 13 bp, Homo sapiens
ccccacctgcctg

SEQ ID NO: 6077612 - DNA, 18 bp, Homo sapiens
ccccacctgcctggtgca

SEQ ID NO: 6077613 - DNA, 14 bp, Homo sapiens
ccccacctgcgctt

SEQ ID NO: 6077614 - DNA, 17 bp, Homo sapiens
ccccacctgcgcttcac

SEQ ID NO: 6077615 - DNA, 12 bp, Homo sapiens
ccccacctgcgg

SEQ ID NO: 6077616 - DNA, 13 bp, Homo sapiens
ccccacctgctca

SEQ ID NO: 6077617 - DNA, 12 bp, Homo sapiens
ccccacctggac

SEQ ID NO: 6077618 - DNA, 23 bp, Homo sapiens
ccccacctggacacacactcacc

SEQ ID NO: 6077619 - DNA, 17 bp, Homo sapiens
ccccaccttccccagac

SEQ ID NO: 6077620 - DNA, 23 bp, Homo sapiens
ccccaccttggtccctctcagat

SEQ ID NO: 6077621 - DNA, 14 bp, Homo sapiens
ccccacgagggctg

SEQ ID NO: 6077622 - DNA, 17 bp, Homo sapiens
ccccacgaggggaccca

SEQ ID NO: 6077623 - DNA, 22 bp, Homo sapiens
ccccacgagtcacctgcaagcc

SEQ ID NO: 6077624 - DNA, 14 bp, Homo sapiens
ccccacgccacagc

SEQ ID NO: 6077625 - DNA, 15 bp, Homo sapiens
ccccacgccacagcc

SEQ ID NO: 6077626 - DNA, 14 bp, Homo sapiens
ccccacgccctcat

SEQ ID NO: 6077627 - DNA, 14 bp, Homo sapiens
ccccacgccctccc

SEQ ID NO: 6077628 - DNA, 20 bp, Homo sapiens
ccccacgcttctggaggtgg

SEQ ID NO: 6077629 - DNA, 19 bp, Homo sapiens
ccccacggaaggcgggctg

SEQ ID NO: 6077630 - DNA, 19 bp, Homo sapiens
ccccacggagacagaggaa

SEQ ID NO: 6077631 - DNA, 19 bp, Homo sapiens
ccccacggccgctccaggg

SEQ ID NO: 6077632 - DNA, 21 bp, Homo sapiens
ccccacggggcctcgggacct

SEQ ID NO: 6077633 - DNA, 14 bp, Homo sapiens
ccccacgtccctgc

SEQ ID NO: 6077634 - DNA, 19 bp, Homo sapiens
ccccacgtctctctgcctg

SEQ ID NO: 6077635 - DNA, 21 bp, Homo sapiens
ccccacgtctctctgcctgct

SEQ ID NO: 6077636 - DNA, 17 bp, Homo sapiens
ccccacgttgtccctga

SEQ ID NO: 6077637 - DNA, 22 bp, Homo sapiens
ccccactactcaatactacctc

SEQ ID NO: 6077638 - DNA, 23 bp, Homo sapiens
ccccactactgcagcacctccag

SEQ ID NO: 6077639 - DNA, 13 bp, Homo sapiens
ccccactcacaca

SEQ ID NO: 6077640 - DNA, 13 bp, Homo sapiens
ccccactcacaga

SEQ ID NO: 6077641 - DNA, 16 bp, Homo sapiens
ccccactcacagggag

SEQ ID NO: 6077642 - DNA, 15 bp, Homo sapiens
ccccactcaggggac

SEQ ID NO: 6077643 - DNA, 16 bp, Homo sapiens
ccccactcaggggacc

SEQ ID NO: 6077644 - DNA, 15 bp, Homo sapiens
ccccactccagcaga

SEQ ID NO: 6077645 - DNA, 15 bp, Homo sapiens
ccccactccagccct

SEQ ID NO: 6077646 - DNA, 17 bp, Homo sapiens
ccccactccagcctggg

SEQ ID NO: 6077647 - DNA, 15 bp, Homo sapiens
ccccactcccctcac

SEQ ID NO: 6077648 - DNA, 11 bp, Homo sapiens
ccccactcccg

SEQ ID NO: 6077649 - DNA, 15 bp, Homo sapiens
ccccactccctgcca

SEQ ID NO: 6077650 - DNA, 23 bp, Homo sapiens
ccccactccctggctctcagaag

SEQ ID NO: 6077651 - DNA, 19 bp, Homo sapiens
ccccactcccttgctggcc

SEQ ID NO: 6077652 - DNA, 20 bp, Homo sapiens
ccccactccggccctccaga

SEQ ID NO: 6077653 - DNA, 13 bp, Homo sapiens
ccccactcctcct

SEQ ID NO: 6077654 - DNA, 14 bp, Homo sapiens
ccccactcctcctc

SEQ ID NO: 6077655 - DNA, 13 bp, Homo sapiens
ccccactcctctc

SEQ ID NO: 6077656 - DNA, 19 bp, Homo sapiens
ccccactcctctcccacag

SEQ ID NO: 6077657 - DNA, 11 bp, Homo sapiens
ccccactctca

SEQ ID NO: 6077658 - DNA, 16 bp, Homo sapiens
ccccactctcagaggc

SEQ ID NO: 6077659 - DNA, 20 bp, Homo sapiens
ccccactctcattccccagg

SEQ ID NO: 6077660 - DNA, 16 bp, Homo sapiens
ccccactctctcaccc

SEQ ID NO: 6077661 - DNA, 11 bp, Homo sapiens
ccccactctgc

SEQ ID NO: 6077662 - DNA, 14 bp, Homo sapiens
ccccactctgcctg

SEQ ID NO: 6077663 - DNA, 13 bp, Homo sapiens
ccccactctgctc

SEQ ID NO: 6077664 - DNA, 17 bp, Homo sapiens
ccccactctgctcccag

SEQ ID NO: 6077665 - DNA, 16 bp, Homo sapiens
ccccactctgctctga

SEQ ID NO: 6077666 - DNA, 19 bp, Homo sapiens
ccccactctgctctgatgc

SEQ ID NO: 6077667 - DNA, 12 bp, Homo sapiens
ccccactctgtg

SEQ ID NO: 6077668 - DNA, 17 bp, Homo sapiens
ccccactgacctgccca

SEQ ID NO: 6077669 - DNA, 18 bp, Homo sapiens
ccccactgacctgcccat

SEQ ID NO: 6077670 - DNA, 20 bp, Homo sapiens
ccccactgacctgcccatgt

SEQ ID NO: 6077671 - DNA, 20 bp, Homo sapiens
ccccactgagagctgctcct

SEQ ID NO: 6077672 - DNA, 23 bp, Homo sapiens
ccccactgagagctgctcctttg

SEQ ID NO: 6077673 - DNA, 15 bp, Homo sapiens
ccccactgatgctgt

SEQ ID NO: 6077674 - DNA, 16 bp, Homo sapiens
ccccactgcaggcccc

SEQ ID NO: 6077675 - DNA, 14 bp, Homo sapiens
ccccactgccacac

SEQ ID NO: 6077676 - DNA, 19 bp, Homo sapiens
ccccactgccagcagcagc

SEQ ID NO: 6077677 - DNA, 22 bp, Homo sapiens
ccccactgccagcagcagcagg

SEQ ID NO: 6077678 - DNA, 19 bp, Homo sapiens
ccccactgccctccagggc

SEQ ID NO: 6077679 - DNA, 22 bp, Homo sapiens
ccccactgccctccagggccag

SEQ ID NO: 6077680 - DNA, 19 bp, Homo sapiens
ccccactgcctactgcatc

SEQ ID NO: 6077681 - DNA, 12 bp, Homo sapiens
ccccactgcctg

SEQ ID NO: 6077682 - DNA, 17 bp, Homo sapiens
ccccactgcctgcccac

SEQ ID NO: 6077683 - DNA, 18 bp, Homo sapiens
ccccactgctaaggctgc

SEQ ID NO: 6077684 - DNA, 23 bp, Homo sapiens
ccccactgctaaggctgctggct

SEQ ID NO: 6077685 - DNA, 14 bp, Homo sapiens
ccccactgctgagc

SEQ ID NO: 6077686 - DNA, 11 bp, Homo sapiens
ccccactggac

SEQ ID NO: 6077687 - DNA, 20 bp, Homo sapiens
ccccactggactgacctggt

SEQ ID NO: 6077688 - DNA, 13 bp, Homo sapiens
ccccactggagca

SEQ ID NO: 6077689 - DNA, 14 bp, Homo sapiens
ccccactggagcag

SEQ ID NO: 6077690 - DNA, 19 bp, Homo sapiens
ccccactggagcgtgtact

SEQ ID NO: 6077691 - DNA, 20 bp, Homo sapiens
ccccactggctgtgggctcc

SEQ ID NO: 6077692 - DNA, 13 bp, Homo sapiens
ccccactgggcac

SEQ ID NO: 6077693 - DNA, 21 bp, Homo sapiens
ccccactgggccagccctgca

SEQ ID NO: 6077694 - DNA, 22 bp, Homo sapiens
ccccactgggccagccctgcag

SEQ ID NO: 6077695 - DNA, 23 bp, Homo sapiens
ccccactgggccagccctgcagc

SEQ ID NO: 6077696 - DNA, 14 bp, Homo sapiens
ccccactggggaaa

SEQ ID NO: 6077697 - DNA, 22 bp, Homo sapiens
ccccactggggaaataacagct

SEQ ID NO: 6077698 - DNA, 14 bp, Homo sapiens
ccccactggtgaca

SEQ ID NO: 6077699 - DNA, 21 bp, Homo sapiens
ccccactgtagacaggaaagc

SEQ ID NO: 6077700 - DNA, 14 bp, Homo sapiens
ccccactgtatcta

SEQ ID NO: 6077701 - DNA, 18 bp, Homo sapiens
ccccacttaccgcgtaat

SEQ ID NO: 6077702 - DNA, 20 bp, Homo sapiens
ccccacttatgctgctgtga

SEQ ID NO: 6077703 - DNA, 22 bp, Homo sapiens
ccccacttatgctgctgtgaat

SEQ ID NO: 6077704 - DNA, 14 bp, Homo sapiens
ccccacttcacccc

SEQ ID NO: 6077705 - DNA, 19 bp, Homo sapiens
ccccacttcactttcttca

SEQ ID NO: 6077706 - DNA, 21 bp, Homo sapiens
ccccacttcatgcccactgcc

SEQ ID NO: 6077707 - DNA, 17 bp, Homo sapiens
ccccacttcccacttgc

SEQ ID NO: 6077708 - DNA, 16 bp, Homo sapiens
ccccacttcccatctc

SEQ ID NO: 6077709 - DNA, 23 bp, Homo sapiens
ccccacttctctactctggaagt

SEQ ID NO: 6077710 - DNA, 15 bp, Homo sapiens
ccccacttgcctctt

SEQ ID NO: 6077711 - DNA, 16 bp, Homo sapiens
ccccacttgcctcttc

SEQ ID NO: 6077712 - DNA, 20 bp, Homo sapiens
ccccactttcaagaatcaga

SEQ ID NO: 6077713 - DNA, 22 bp, Homo sapiens
ccccactttcgcctcctccagc

SEQ ID NO: 6077714 - DNA, 13 bp, Homo sapiens
ccccacttttcta

SEQ ID NO: 6077715 - DNA, 14 bp, Homo sapiens
ccccagaaaatgaa

SEQ ID NO: 6077716 - DNA, 15 bp, Homo sapiens
ccccagaaagcctca

SEQ ID NO: 6077717 - DNA, 17 bp, Homo sapiens
ccccagaaagcctcctg

SEQ ID NO: 6077718 - DNA, 15 bp, Homo sapiens
ccccagaaattattg

SEQ ID NO: 6077719 - DNA, 20 bp, Homo sapiens
ccccagaaattctggcccag

SEQ ID NO: 6077720 - DNA, 23 bp, Homo sapiens
ccccagaaattctggcccagcca

SEQ ID NO: 6077721 - DNA, 17 bp, Homo sapiens
ccccagaactctgcctg

SEQ ID NO: 6077722 - DNA, 17 bp, Homo sapiens
ccccagaactggctggg

SEQ ID NO: 6077723 - DNA, 20 bp, Homo sapiens
ccccagaactggctgggccc

SEQ ID NO: 6077724 - DNA, 14 bp, Homo sapiens
ccccagaagcagag

SEQ ID NO: 6077725 - DNA, 17 bp, Homo sapiens
ccccagaagcagagagc

SEQ ID NO: 6077726 - DNA, 21 bp, Homo sapiens
ccccagacacattctcctgtg

SEQ ID NO: 6077727 - DNA, 16 bp, Homo sapiens
ccccagacagctgctc

SEQ ID NO: 6077728 - DNA, 18 bp, Homo sapiens
ccccagacagggctccag

SEQ ID NO: 6077729 - DNA, 20 bp, Homo sapiens
ccccagaccaaccctgggac

SEQ ID NO: 6077730 - DNA, 13 bp, Homo sapiens
ccccagaccagta

SEQ ID NO: 6077731 - DNA, 19 bp, Homo sapiens
ccccagaccagtagtgacc

SEQ ID NO: 6077732 - DNA, 13 bp, Homo sapiens
ccccagaccccgc

SEQ ID NO: 6077733 - DNA, 17 bp, Homo sapiens
ccccagactcagctcca

SEQ ID NO: 6077734 - DNA, 15 bp, Homo sapiens
ccccagactcagctg

SEQ ID NO: 6077735 - DNA, 15 bp, Homo sapiens
ccccagactccaggc

SEQ ID NO: 6077736 - DNA, 16 bp, Homo sapiens
ccccagactctcaggt

SEQ ID NO: 6077737 - DNA, 17 bp, Homo sapiens
ccccagactgagctctc

SEQ ID NO: 6077738 - DNA, 15 bp, Homo sapiens
ccccagactgggccc

SEQ ID NO: 6077739 - DNA, 21 bp, Homo sapiens
ccccagactgggcccaggcag

SEQ ID NO: 6077740 - DNA, 22 bp, Homo sapiens
ccccagactgggcccaggcagg

SEQ ID NO: 6077741 - DNA, 23 bp, Homo sapiens
ccccagacttgttggcgtaggct

SEQ ID NO: 6077742 - DNA, 22 bp, Homo sapiens
ccccagagacacggtcccacca

SEQ ID NO: 6077743 - DNA, 17 bp, Homo sapiens
ccccagagacctttgcc

SEQ ID NO: 6077744 - DNA, 20 bp, Homo sapiens
ccccagagacctttgcccac

SEQ ID NO: 6077745 - DNA, 20 bp, Homo sapiens
ccccagagaccttttctctc

SEQ ID NO: 6077746 - DNA, 16 bp, Homo sapiens
ccccagagactgccca

SEQ ID NO: 6077747 - DNA, 21 bp, Homo sapiens
ccccagagactgcccaccctg

SEQ ID NO: 6077748 - DNA, 12 bp, Homo sapiens
ccccagagagac

SEQ ID NO: 6077749 - DNA, 15 bp, Homo sapiens
ccccagagagcaggc

SEQ ID NO: 6077750 - DNA, 17 bp, Homo sapiens
ccccagagagcaggcag

SEQ ID NO: 6077751 - DNA, 18 bp, Homo sapiens
ccccagagagcaggcagg

SEQ ID NO: 6077752 - DNA, 22 bp, Homo sapiens
ccccagagagcaggcaggggca

SEQ ID NO: 6077753 - DNA, 19 bp, Homo sapiens
ccccagagatgccagccct

SEQ ID NO: 6077754 - DNA, 13 bp, Homo sapiens
ccccagagcactg

SEQ ID NO: 6077755 - DNA, 19 bp, Homo sapiens
ccccagagcatctgcccca

SEQ ID NO: 6077756 - DNA, 14 bp, Homo sapiens
ccccagagccacag

SEQ ID NO: 6077757 - DNA, 15 bp, Homo sapiens
ccccagagccacagt

SEQ ID NO: 6077758 - DNA, 18 bp, Homo sapiens
ccccagagccagggctgt

SEQ ID NO: 6077759 - DNA, 21 bp, Homo sapiens
ccccagagccagggctgtcct

SEQ ID NO: 6077760 - DNA, 22 bp, Homo sapiens
ccccagagccagggctgtcctt

SEQ ID NO: 6077761 - DNA, 11 bp, Homo sapiens
ccccagagccc

SEQ ID NO: 6077762 - DNA, 14 bp, Homo sapiens
ccccagagcccagc

SEQ ID NO: 6077763 - DNA, 16 bp, Homo sapiens
ccccagagcccaggct

SEQ ID NO: 6077764 - DNA, 16 bp, Homo sapiens
ccccagagcccgtcag

SEQ ID NO: 6077765 - DNA, 21 bp, Homo sapiens
ccccagagcccgtcagcgtgg

SEQ ID NO: 6077766 - DNA, 15 bp, Homo sapiens
ccccagagccctgca

SEQ ID NO: 6077767 - DNA, 11 bp, Homo sapiens
ccccagagctg

SEQ ID NO: 6077768 - DNA, 16 bp, Homo sapiens
ccccagagctgcctgc

SEQ ID NO: 6077769 - DNA, 13 bp, Homo sapiens
ccccagagctggc

SEQ ID NO: 6077770 - DNA, 21 bp, Homo sapiens
ccccagagctgtttatggcct

SEQ ID NO: 6077771 - DNA, 22 bp, Homo sapiens
ccccagagctgtttatggcctc

SEQ ID NO: 6077772 - DNA, 14 bp, Homo sapiens
ccccagaggccctg

SEQ ID NO: 6077773 - DNA, 18 bp, Homo sapiens
ccccagaggccctggagg

SEQ ID NO: 6077774 - DNA, 15 bp, Homo sapiens
ccccagaggccttgt

SEQ ID NO: 6077775 - DNA, 19 bp, Homo sapiens
ccccagagggaccagctgg

SEQ ID NO: 6077776 - DNA, 20 bp, Homo sapiens
ccccagagggaccagctggg

SEQ ID NO: 6077777 - DNA, 16 bp, Homo sapiens
ccccagaggtggccct

SEQ ID NO: 6077778 - DNA, 15 bp, Homo sapiens
ccccagagtggccca

SEQ ID NO: 6077779 - DNA, 16 bp, Homo sapiens
ccccagagtggcccac

SEQ ID NO: 6077780 - DNA, 21 bp, Homo sapiens
ccccagagtgggagaggctgg

SEQ ID NO: 6077781 - DNA, 22 bp, Homo sapiens
ccccagagtgggatccacttct

SEQ ID NO: 6077782 - DNA, 11 bp, Homo sapiens
ccccagagttg

SEQ ID NO: 6077783 - DNA, 16 bp, Homo sapiens
ccccagatagagctgg

SEQ ID NO: 6077784 - DNA, 20 bp, Homo sapiens
ccccagatagagctgggtgg

SEQ ID NO: 6077785 - DNA, 16 bp, Homo sapiens
ccccagatctgcctgg

SEQ ID NO: 6077786 - DNA, 18 bp, Homo sapiens
ccccagatctgcctgggc

SEQ ID NO: 6077787 - DNA, 19 bp, Homo sapiens
ccccagatctgtcctgggg

SEQ ID NO: 6077788 - DNA, 22 bp, Homo sapiens
ccccagcaaagcccccagagcc

SEQ ID NO: 6077789 - DNA, 24 bp, Homo sapiens
ccccagcaaagcccccagagccca

SEQ ID NO: 6077790 - DNA, 19 bp, Homo sapiens
ccccagcaacacgtcattg

SEQ ID NO: 6077791 - DNA, 23 bp, Homo sapiens
ccccagcaacacgtcattgtgta

SEQ ID NO: 6077792 - DNA, 20 bp, Homo sapiens
ccccagcaagtgagagctgg

SEQ ID NO: 6077793 - DNA, 22 bp, Homo sapiens
ccccagcaagtggtcctagagg

SEQ ID NO: 6077794 - DNA, 15 bp, Homo sapiens
ccccagcacagccac

SEQ ID NO: 6077795 - DNA, 21 bp, Homo sapiens
ccccagcacagctcctcccct

SEQ ID NO: 6077796 - DNA, 18 bp, Homo sapiens
aaatctgtttgatccctg

SEQ ID NO: 6077797 - DNA, 13 bp, Homo sapiens
aaatctgttttgt

SEQ ID NO: 6077798 - DNA, 19 bp, Homo sapiens
aaatctgttttgtatatga

SEQ ID NO: 6077799 - DNA, 14 bp, Homo sapiens
aaatcttaacttga

SEQ ID NO: 6077800 - DNA, 12 bp, Homo sapiens
aaatcttaagaa

SEQ ID NO: 6077801 - DNA, 23 bp, Homo sapiens
aaatcttaagagaatccacataa

SEQ ID NO: 6077802 - DNA, 21 bp, Homo sapiens
aaatcttaagattacaagata

SEQ ID NO: 6077803 - DNA, 17 bp, Homo sapiens
aaatcttaatactgtta

SEQ ID NO: 6077804 - DNA, 23 bp, Homo sapiens
aaatcttaatactgttattcttt

SEQ ID NO: 6077805 - DNA, 23 bp, Homo sapiens
aaatcttaatgttcctcaaagct

SEQ ID NO: 6077806 - DNA, 13 bp, Homo sapiens
aaatcttacaaaa

SEQ ID NO: 6077807 - DNA, 14 bp, Homo sapiens
aaatcttacaaaat

SEQ ID NO: 6077808 - DNA, 15 bp, Homo sapiens
aaatcttagtgttca

SEQ ID NO: 6077809 - DNA, 17 bp, Homo sapiens
aaatcttataatttaaa

SEQ ID NO: 6077810 - DNA, 16 bp, Homo sapiens
aaatcttatagttcta

SEQ ID NO: 6077811 - DNA, 17 bp, Homo sapiens
aaatcttatagttctag

SEQ ID NO: 6077812 - DNA, 18 bp, Homo sapiens
aaatcttatagttctagg

SEQ ID NO: 6077813 - DNA, 21 bp, Homo sapiens
aaatcttatattccatatatt

SEQ ID NO: 6077814 - DNA, 12 bp, Homo sapiens
aaatcttattaa

SEQ ID NO: 6077815 - DNA, 14 bp, Homo sapiens
aaatcttattaaag

SEQ ID NO: 6077816 - DNA, 20 bp, Homo sapiens
aaatcttattaaagtttcaa

SEQ ID NO: 6077817 - DNA, 19 bp, Homo sapiens
aaatcttcagctggtggat

SEQ ID NO: 6077818 - DNA, 16 bp, Homo sapiens
aaatcttcatggaatt

SEQ ID NO: 6077819 - DNA, 13 bp, Homo sapiens
aaatcttccttgt

SEQ ID NO: 6077820 - DNA, 13 bp, Homo sapiens
aaatcttgaaatt

SEQ ID NO: 6077821 - DNA, 20 bp, Homo sapiens
aaatcttgatagctaaataa

SEQ ID NO: 6077822 - DNA, 14 bp, Homo sapiens
aaatcttgatcagt

SEQ ID NO: 6077823 - DNA, 20 bp, Homo sapiens
aaatcttgcatggcattaat

SEQ ID NO: 6077824 - DNA, 19 bp, Homo sapiens
aaatcttggaagtacatga

SEQ ID NO: 6077825 - DNA, 17 bp, Homo sapiens
aaatcttggcacagaaa

SEQ ID NO: 6077826 - DNA, 14 bp, Homo sapiens
aaatcttggtgtaa

SEQ ID NO: 6077827 - DNA, 16 bp, Homo sapiens
aaatcttggtgtaact

SEQ ID NO: 6077828 - DNA, 17 bp, Homo sapiens
aaatcttgtaagtattt

SEQ ID NO: 6077829 - DNA, 18 bp, Homo sapiens
aaatcttgtaagtattta

SEQ ID NO: 6077830 - DNA, 18 bp, Homo sapiens
aaatcttgtcatgtgtat

SEQ ID NO: 6077831 - DNA, 20 bp, Homo sapiens
aaatcttgtcatgtgtataa

SEQ ID NO: 6077832 - DNA, 20 bp, Homo sapiens
aaatcttgtgctagaatact

SEQ ID NO: 6077833 - DNA, 22 bp, Homo sapiens
aaatcttgttattgaagtgttc

SEQ ID NO: 6077834 - DNA, 17 bp, Homo sapiens
aaatcttgtttgttact

SEQ ID NO: 6077835 - DNA, 13 bp, Homo sapiens
aaatctttaagaa

SEQ ID NO: 6077836 - DNA, 19 bp, Homo sapiens
aaatctttcaagttgcatt

SEQ ID NO: 6077837 - DNA, 12 bp, Homo sapiens
aaatctttcaga

SEQ ID NO: 6077838 - DNA, 14 bp, Homo sapiens
aaatctttcagaat

SEQ ID NO: 6077839 - DNA, 18 bp, Homo sapiens
aaatctttccatctcatt

SEQ ID NO: 6077840 - DNA, 14 bp, Homo sapiens
aaatctttctttct

SEQ ID NO: 6077841 - DNA, 16 bp, Homo sapiens
aaatctttctttctta

SEQ ID NO: 6077842 - DNA, 18 bp, Homo sapiens
aaatctttgattcagaca

SEQ ID NO: 6077843 - DNA, 22 bp, Homo sapiens
aaatctttgtgaacattctgta

SEQ ID NO: 6077844 - DNA, 11 bp, Homo sapiens
aaatcttttac

SEQ ID NO: 6077845 - DNA, 18 bp, Homo sapiens
aaatcttttataggattt

SEQ ID NO: 6077846 - DNA, 23 bp, Homo sapiens
aaatcttttccaggaaaaagaac

SEQ ID NO: 6077847 - DNA, 15 bp, Homo sapiens
aaatcttttgaagca

SEQ ID NO: 6077848 - DNA, 12 bp, Homo sapiens
aaatctttttat

SEQ ID NO: 6077849 - DNA, 23 bp, Homo sapiens
aaatctttttgcttctactttca

SEQ ID NO: 6077850 - DNA, 15 bp, Homo sapiens
aaatgaaaaaaaaag

SEQ ID NO: 6077851 - DNA, 14 bp, Homo sapiens
aaatgaaaaaatat

SEQ ID NO: 6077852 - DNA, 16 bp, Homo sapiens
aaatgaaaacttttgt

SEQ ID NO: 6077853 - DNA, 13 bp, Homo sapiens
aaatgaaaagcaa

SEQ ID NO: 6077854 - DNA, 16 bp, Homo sapiens
aaatgaaaagcaatac

SEQ ID NO: 6077855 - DNA, 15 bp, Homo sapiens
aaatgaaaatgaata

SEQ ID NO: 6077856 - DNA, 15 bp, Homo sapiens
aaatgaaaatgtctt

SEQ ID NO: 6077857 - DNA, 14 bp, Homo sapiens
aaatgaaaattgta

SEQ ID NO: 6077858 - DNA, 20 bp, Homo sapiens
aaatgaaactctttcattct

SEQ ID NO: 6077859 - DNA, 16 bp, Homo sapiens
aaatgaaacttggcca

SEQ ID NO: 6077860 - DNA, 14 bp, Homo sapiens
aaatgaaagaaaat

SEQ ID NO: 6077861 - DNA, 15 bp, Homo sapiens
aaatgaaagaaaatt

SEQ ID NO: 6077862 - DNA, 14 bp, Homo sapiens
aaatgaaagagaaa

SEQ ID NO: 6077863 - DNA, 16 bp, Homo sapiens
aaatgaaagagaaaat

SEQ ID NO: 6077864 - DNA, 17 bp, Homo sapiens
aaatgaaagatttttac

SEQ ID NO: 6077865 - DNA, 15 bp, Homo sapiens
aaatgaaagcatgtg

SEQ ID NO: 6077866 - DNA, 20 bp, Homo sapiens
aaatgaaagccaaatttata

SEQ ID NO: 6077867 - DNA, 13 bp, Homo sapiens
aaatgaaaggagt

SEQ ID NO: 6077868 - DNA, 11 bp, Homo sapiens
aaatgaaaggg

SEQ ID NO: 6077869 - DNA, 12 bp, Homo sapiens
aaatgaaaggga

SEQ ID NO: 6077870 - DNA, 14 bp, Homo sapiens
aaatgaaagggaaa

SEQ ID NO: 6077871 - DNA, 14 bp, Homo sapiens
aaatgaaagggtca

SEQ ID NO: 6077872 - DNA, 22 bp, Homo sapiens
aaatgaaaggtagtgagtaatt

SEQ ID NO: 6077873 - DNA, 15 bp, Homo sapiens
aaatgaaagtggtaa

SEQ ID NO: 6077874 - DNA, 12 bp, Homo sapiens
aaatgaaataaa

SEQ ID NO: 6077875 - DNA, 12 bp, Homo sapiens
aaatgaaatact

SEQ ID NO: 6077876 - DNA, 13 bp, Homo sapiens
aaatgaaatactt

SEQ ID NO: 6077877 - DNA, 21 bp, Homo sapiens
aaatgaaatatatttaaaata

SEQ ID NO: 6077878 - DNA, 22 bp, Homo sapiens
aaatgaaatccgtgaagtcaca

SEQ ID NO: 6077879 - DNA, 14 bp, Homo sapiens
aaatgaaatcttcc

SEQ ID NO: 6077880 - DNA, 22 bp, Homo sapiens
aaatgaaatcttcccagtatta

SEQ ID NO: 6077881 - DNA, 12 bp, Homo sapiens
aaatgaaatgca

SEQ ID NO: 6077882 - DNA, 17 bp, Homo sapiens
aaatgaaatgcattttg

SEQ ID NO: 6077883 - DNA, 18 bp, Homo sapiens
aaatgaaatgccaaagga

SEQ ID NO: 6077884 - DNA, 14 bp, Homo sapiens
aaatgaaatgtctt

SEQ ID NO: 6077885 - DNA, 12 bp, Homo sapiens
aaatgaaatgtt

SEQ ID NO: 6077886 - DNA, 14 bp, Homo sapiens
aaatgaaattgaca

SEQ ID NO: 6077887 - DNA, 19 bp, Homo sapiens
aaatgaaatttaaacatta

SEQ ID NO: 6077888 - DNA, 16 bp, Homo sapiens
aaatgaaatttaagca

SEQ ID NO: 6077889 - DNA, 16 bp, Homo sapiens
aaatgaaatttgcaaa

SEQ ID NO: 6077890 - DNA, 19 bp, Homo sapiens
aaatgaaatttgcaaaatc

SEQ ID NO: 6077891 - DNA, 13 bp, Homo sapiens
aaatgaaatttta

SEQ ID NO: 6077892 - DNA, 15 bp, Homo sapiens
aaatgaaattttacc

SEQ ID NO: 6077893 - DNA, 22 bp, Homo sapiens
aaatgaaatttttcaatatttg

SEQ ID NO: 6077894 - DNA, 13 bp, Homo sapiens
aaatgaacaaaag

SEQ ID NO: 6077895 - DNA, 13 bp, Homo sapiens
aaatgaacaagag

SEQ ID NO: 6077896 - DNA, 22 bp, Homo sapiens
aaatgaacaaggcaggaaacaa

SEQ ID NO: 6077897 - DNA, 22 bp, Homo sapiens
aaatgaacacagctctttaaca

SEQ ID NO: 6077898 - DNA, 17 bp, Homo sapiens
aaatgaacacatggcag

SEQ ID NO: 6077899 - DNA, 19 bp, Homo sapiens
aaatgaacatctcttgaaa

SEQ ID NO: 6077900 - DNA, 12 bp, Homo sapiens
aaatgaacctga

SEQ ID NO: 6077901 - DNA, 17 bp, Homo sapiens
aaatgaacctgatcact

SEQ ID NO: 6077902 - DNA, 23 bp, Homo sapiens
aaatgaaccttgctatcaagaaa

SEQ ID NO: 6077903 - DNA, 20 bp, Homo sapiens
aaatgaactaactgccatgt

SEQ ID NO: 6077904 - DNA, 16 bp, Homo sapiens
aaatgaactactgcta

SEQ ID NO: 6077905 - DNA, 17 bp, Homo sapiens
aaatgaactactgctat

SEQ ID NO: 6077906 - DNA, 14 bp, Homo sapiens
aaatgaactgaagt

SEQ ID NO: 6077907 - DNA, 14 bp, Homo sapiens
aaatgaactgtata

SEQ ID NO: 6077908 - DNA, 17 bp, Homo sapiens
aaatgaactgtatatta

SEQ ID NO: 6077909 - DNA, 23 bp, Homo sapiens
aaatgaactttcagcagtctaaa

SEQ ID NO: 6077910 - DNA, 12 bp, Homo sapiens
aaatgaactttt

SEQ ID NO: 6077911 - DNA, 18 bp, Homo sapiens
aaatgaacttttacagaa

SEQ ID NO: 6077912 - DNA, 19 bp, Homo sapiens
aaatgaacttttacagaat

SEQ ID NO: 6077913 - DNA, 11 bp, Homo sapiens
aaatgaagaaa

SEQ ID NO: 6077914 - DNA, 14 bp, Homo sapiens
aaatgaagaaggaa

SEQ ID NO: 6077915 - DNA, 23 bp, Homo sapiens
aaatgaagagacttaagaaagct

SEQ ID NO: 6077916 - DNA, 11 bp, Homo sapiens
aaatgaagcag

SEQ ID NO: 6077917 - DNA, 13 bp, Homo sapiens
aaatgaagcagag

SEQ ID NO: 6077918 - DNA, 17 bp, Homo sapiens
aaatgaagcagaggaag

SEQ ID NO: 6077919 - DNA, 18 bp, Homo sapiens
aaatgaagcagctttaaa

SEQ ID NO: 6077920 - DNA, 21 bp, Homo sapiens
aaatgaagtaacttgtcttaa

SEQ ID NO: 6077921 - DNA, 23 bp, Homo sapiens
aaatgaagtacagtagtttccct

SEQ ID NO: 6077922 - DNA, 19 bp, Homo sapiens
aaatgaagtattatctgta

SEQ ID NO: 6077923 - DNA, 11 bp, Homo sapiens
aaatgaagtgc

SEQ ID NO: 6077924 - DNA, 16 bp, Homo sapiens
aaatgaagttaactta

SEQ ID NO: 6077925 - DNA, 17 bp, Homo sapiens
aaatgaagtttatacag

SEQ ID NO: 6077926 - DNA, 16 bp, Homo sapiens
aaatgaataatttatt

SEQ ID NO: 6077927 - DNA, 18 bp, Homo sapiens
aaatgaatagcttgtttc

SEQ ID NO: 6077928 - DNA, 16 bp, Homo sapiens
aaatgaatatctatta

SEQ ID NO: 6077929 - DNA, 19 bp, Homo sapiens
aaatgaatatctattaata

SEQ ID NO: 6077930 - DNA, 16 bp, Homo sapiens
aaatgaatattttgat

SEQ ID NO: 6077931 - DNA, 19 bp, Homo sapiens
aaatgaatattttgataat

SEQ ID NO: 6077932 - DNA, 23 bp, Homo sapiens
aaatgaatgaaatataaactgtg

SEQ ID NO: 6077933 - DNA, 17 bp, Homo sapiens
aaatgaatgaataacta

SEQ ID NO: 6077934 - DNA, 17 bp, Homo sapiens
aaatgaatgcctttcaa

SEQ ID NO: 6077935 - DNA, 21 bp, Homo sapiens
aaatgaatgcctttcaaacat

SEQ ID NO: 6077936 - DNA, 20 bp, Homo sapiens
aaatgaatggacaaagctca

SEQ ID NO: 6077937 - DNA, 23 bp, Homo sapiens
aaatgaatggaggaactttccaa

SEQ ID NO: 6077938 - DNA, 13 bp, Homo sapiens
aaatgaatggttc

SEQ ID NO: 6077939 - DNA, 19 bp, Homo sapiens
aaatgaatgtcacttctgg

SEQ ID NO: 6077940 - DNA, 14 bp, Homo sapiens
aaatgaatgtctga

SEQ ID NO: 6077941 - DNA, 11 bp, Homo sapiens
aaatgaatgtg

SEQ ID NO: 6077942 - DNA, 15 bp, Homo sapiens
aaatgaatgtgtgtg

SEQ ID NO: 6077943 - DNA, 15 bp, Homo sapiens
aaatgaatgttgtct

SEQ ID NO: 6077944 - DNA, 19 bp, Homo sapiens
aaatgaattgaaaaacaat

SEQ ID NO: 6077945 - DNA, 15 bp, Homo sapiens
aaatgaattgccttt

SEQ ID NO: 6077946 - DNA, 19 bp, Homo sapiens
aaatgaatttatcatttta

SEQ ID NO: 6077947 - DNA, 16 bp, Homo sapiens
aaatgaatttatctga

SEQ ID NO: 6077948 - DNA, 16 bp, Homo sapiens
aaatgaatttgactgg

SEQ ID NO: 6077949 - DNA, 18 bp, Homo sapiens
aaatgaattttccacgca

SEQ ID NO: 6077950 - DNA, 13 bp, Homo sapiens
aaatgaattttta

SEQ ID NO: 6077951 - DNA, 19 bp, Homo sapiens
aaatgacaaagccattctt

SEQ ID NO: 6077952 - DNA, 16 bp, Homo sapiens
aaatgacaaagtgttg

SEQ ID NO: 6077953 - DNA, 19 bp, Homo sapiens
aaatgacaaagtgttgaaa

SEQ ID NO: 6077954 - DNA, 23 bp, Homo sapiens
aaatgacactcatataattatat

SEQ ID NO: 6077955 - DNA, 19 bp, Homo sapiens
aaatgacagattctgacat

SEQ ID NO: 6077956 - DNA, 20 bp, Homo sapiens
aaatgacagccccttaagca

SEQ ID NO: 6077957 - DNA, 13 bp, Homo sapiens
aaatgacagtgaa

SEQ ID NO: 6077958 - DNA, 20 bp, Homo sapiens
aaatgacatctttttaaagc

SEQ ID NO: 6077959 - DNA, 22 bp, Homo sapiens
aaatgacatctttttaaagctt

SEQ ID NO: 6077960 - DNA, 19 bp, Homo sapiens
aaatgacatgcactgaccc

SEQ ID NO: 6077961 - DNA, 17 bp, Homo sapiens
aaatgacatgttccttt

SEQ ID NO: 6077962 - DNA, 22 bp, Homo sapiens
aaatgacattattaaagttttc

SEQ ID NO: 6077963 - DNA, 15 bp, Homo sapiens
aaatgacatttcact

SEQ ID NO: 6077964 - DNA, 17 bp, Homo sapiens
aaatgacatttcactaa

SEQ ID NO: 6077965 - DNA, 15 bp, Homo sapiens
aaatgacattttgct

SEQ ID NO: 6077966 - DNA, 13 bp, Homo sapiens
aaatgaccaagaa

SEQ ID NO: 6077967 - DNA, 18 bp, Homo sapiens
aaatgaccaagaaaaaga

SEQ ID NO: 6077968 - DNA, 15 bp, Homo sapiens
aaatgaccaatatta

SEQ ID NO: 6077969 - DNA, 12 bp, Homo sapiens
aaatgaccagtt

SEQ ID NO: 6077970 - DNA, 16 bp, Homo sapiens
aaatgacccaaacata

SEQ ID NO: 6077971 - DNA, 16 bp, Homo sapiens
aaatgacccaaagacc

SEQ ID NO: 6077972 - DNA, 17 bp, Homo sapiens
aaatgacccaaagacca

SEQ ID NO: 6077973 - DNA, 22 bp, Homo sapiens
aaatgaccgagccctggagagc

SEQ ID NO: 6077974 - DNA, 18 bp, Homo sapiens
aaatgacggtgttaattt

SEQ ID NO: 6077975 - DNA, 23 bp, Homo sapiens
aaatgacggtgttaattttgcta

SEQ ID NO: 6077976 - DNA, 19 bp, Homo sapiens
aaatgactaaaaaacaaag

SEQ ID NO: 6077977 - DNA, 19 bp, Homo sapiens
ccccagcacccgggctcag

SEQ ID NO: 6077978 - DNA, 11 bp, Homo sapiens
ccccagcacta

SEQ ID NO: 6077979 - DNA, 22 bp, Homo sapiens
ccccagcactcctctgtctctg

SEQ ID NO: 6077980 - DNA, 15 bp, Homo sapiens
ccccagcactgagga

SEQ ID NO: 6077981 - DNA, 16 bp, Homo sapiens
ccccagcactgaggaa

SEQ ID NO: 6077982 - DNA, 11 bp, Homo sapiens
ccccagcactt

SEQ ID NO: 6077983 - DNA, 22 bp, Homo sapiens
ccccagcagaggcaggctggga

SEQ ID NO: 6077984 - DNA, 17 bp, Homo sapiens
ccccagcagccctcaac

SEQ ID NO: 6077985 - DNA, 20 bp, Homo sapiens
ccccagcagccctcaacagg

SEQ ID NO: 6077986 - DNA, 15 bp, Homo sapiens
ccccagcagtttctg

SEQ ID NO: 6077987 - DNA, 12 bp, Homo sapiens
ccccagcatcac

SEQ ID NO: 6077988 - DNA, 20 bp, Homo sapiens
ccccagcatcactccccaag

SEQ ID NO: 6077989 - DNA, 19 bp, Homo sapiens
ccccagcattccagcccct

SEQ ID NO: 6077990 - DNA, 19 bp, Homo sapiens
ccccagcattctcaggcac

SEQ ID NO: 6077991 - DNA, 11 bp, Homo sapiens
ccccagccaag

SEQ ID NO: 6077992 - DNA, 14 bp, Homo sapiens
ccccagccaagtgc

SEQ ID NO: 6077993 - DNA, 12 bp, Homo sapiens
ccccagccacag

SEQ ID NO: 6077994 - DNA, 12 bp, Homo sapiens
ccccagccactc

SEQ ID NO: 6077995 - DNA, 18 bp, Homo sapiens
ccccagccactcctcaac

SEQ ID NO: 6077996 - DNA, 16 bp, Homo sapiens
ccccagccagcccttc

SEQ ID NO: 6077997 - DNA, 11 bp, Homo sapiens
ccccagccagg

SEQ ID NO: 6077998 - DNA, 15 bp, Homo sapiens
ccccagccaggctat

SEQ ID NO: 6077999 - DNA, 23 bp, Homo sapiens
ccccagccatgccagctggcctt

SEQ ID NO: 6078000 - DNA, 16 bp, Homo sapiens
ccccagcccaagtcca

SEQ ID NO: 6078001 - DNA, 15 bp, Homo sapiens
ccccagcccaataaa

SEQ ID NO: 6078002 - DNA, 16 bp, Homo sapiens
ccccagcccaataaag

SEQ ID NO: 6078003 - DNA, 12 bp, Homo sapiens
ccccagcccacc

SEQ ID NO: 6078004 - DNA, 17 bp, Homo sapiens
ccccagcccacctgctc

SEQ ID NO: 6078005 - DNA, 16 bp, Homo sapiens
ccccagcccagacagc

SEQ ID NO: 6078006 - DNA, 13 bp, Homo sapiens
ccccagcccagag

SEQ ID NO: 6078007 - DNA, 16 bp, Homo sapiens
ccccagcccagcaccc

SEQ ID NO: 6078008 - DNA, 12 bp, Homo sapiens
ccccagcccagg

SEQ ID NO: 6078009 - DNA, 13 bp, Homo sapiens
ccccagcccaggg

SEQ ID NO: 6078010 - DNA, 14 bp, Homo sapiens
ccccagcccagggc

SEQ ID NO: 6078011 - DNA, 10 bp, Homo sapiens
ccccagcccc

SEQ ID NO: 6078012 - DNA, 12 bp, Homo sapiens
ccccagccccaa

SEQ ID NO: 6078013 - DNA, 14 bp, Homo sapiens
ccccagccccaact

SEQ ID NO: 6078014 - DNA, 19 bp, Homo sapiens
ccccagccccaatccagag

SEQ ID NO: 6078015 - DNA, 13 bp, Homo sapiens
ccccagccccact

SEQ ID NO: 6078016 - DNA, 15 bp, Homo sapiens
ccccagccccactgc

SEQ ID NO: 6078017 - DNA, 15 bp, Homo sapiens
ccccagccccactta

SEQ ID NO: 6078018 - DNA, 14 bp, Homo sapiens
ccccagccccatcc

SEQ ID NO: 6078019 - DNA, 15 bp, Homo sapiens
ccccagcccccacag

SEQ ID NO: 6078020 - DNA, 17 bp, Homo sapiens
ccccagcccccacagcc

SEQ ID NO: 6078021 - DNA, 17 bp, Homo sapiens
ccccagccccctggcat

SEQ ID NO: 6078022 - DNA, 23 bp, Homo sapiens
ccccagccccctggcatgtttca

SEQ ID NO: 6078023 - DNA, 18 bp, Homo sapiens
ccccagccccgactccag

SEQ ID NO: 6078024 - DNA, 18 bp, Homo sapiens
ccccagccccgtcccaga

SEQ ID NO: 6078025 - DNA, 20 bp, Homo sapiens
ccccagcccctagcccagga

SEQ ID NO: 6078026 - DNA, 16 bp, Homo sapiens
ccccagcccctccatg

SEQ ID NO: 6078027 - DNA, 20 bp, Homo sapiens
ccccagcccctcccccatct

SEQ ID NO: 6078028 - DNA, 22 bp, Homo sapiens
ccccagcccctcccccatctcc

SEQ ID NO: 6078029 - DNA, 23 bp, Homo sapiens
ccccagcccctcccccatctccc

SEQ ID NO: 6078030 - DNA, 14 bp, Homo sapiens
ccccagcccctcct

SEQ ID NO: 6078031 - DNA, 15 bp, Homo sapiens
ccccagccccttcca

SEQ ID NO: 6078032 - DNA, 20 bp, Homo sapiens
ccccagccctaatctcaccc

SEQ ID NO: 6078033 - DNA, 14 bp, Homo sapiens
ccccagccctcagg

SEQ ID NO: 6078034 - DNA, 15 bp, Homo sapiens
ccccagccctcagtc

SEQ ID NO: 6078035 - DNA, 16 bp, Homo sapiens
ccccagccctcagtca

SEQ ID NO: 6078036 - DNA, 13 bp, Homo sapiens
ccccagccctgct

SEQ ID NO: 6078037 - DNA, 14 bp, Homo sapiens
ccccagccctgctg

SEQ ID NO: 6078038 - DNA, 12 bp, Homo sapiens
ccccagccctgg

SEQ ID NO: 6078039 - DNA, 13 bp, Homo sapiens
ccccagccctggc

SEQ ID NO: 6078040 - DNA, 16 bp, Homo sapiens
ccccagccctggctct

SEQ ID NO: 6078041 - DNA, 17 bp, Homo sapiens
ccccagccctgggcttg

SEQ ID NO: 6078042 - DNA, 23 bp, Homo sapiens
ccccagcccttagcacagagagg

SEQ ID NO: 6078043 - DNA, 20 bp, Homo sapiens
ccccagcccttcctctgctc

SEQ ID NO: 6078044 - DNA, 14 bp, Homo sapiens
ccccagcccttctg

SEQ ID NO: 6078045 - DNA, 11 bp, Homo sapiens
ccccagcctaa

SEQ ID NO: 6078046 - DNA, 16 bp, Homo sapiens
ccccagcctacccttc

SEQ ID NO: 6078047 - DNA, 12 bp, Homo sapiens
ccccagcctagg

SEQ ID NO: 6078048 - DNA, 14 bp, Homo sapiens
ccccagcctatgag

SEQ ID NO: 6078049 - DNA, 10 bp, Homo sapiens
ccccagcctc

SEQ ID NO: 6078050 - DNA, 11 bp, Homo sapiens
ccccagcctca

SEQ ID NO: 6078051 - DNA, 22 bp, Homo sapiens
ccccagcctcaaatccaggacc

SEQ ID NO: 6078052 - DNA, 17 bp, Homo sapiens
ccccagcctcattgtgc

SEQ ID NO: 6078053 - DNA, 22 bp, Homo sapiens
ccccagcctcattgtgccaagc

SEQ ID NO: 6078054 - DNA, 11 bp, Homo sapiens
ccccagcctcc

SEQ ID NO: 6078055 - DNA, 14 bp, Homo sapiens
ccccagcctccaga

SEQ ID NO: 6078056 - DNA, 16 bp, Homo sapiens
ccccagcctcccccag

SEQ ID NO: 6078057 - DNA, 17 bp, Homo sapiens
ccccagcctcctgaggg

SEQ ID NO: 6078058 - DNA, 18 bp, Homo sapiens
ccccagcctcgcctgtca

SEQ ID NO: 6078059 - DNA, 16 bp, Homo sapiens
ccccagcctctggcat

SEQ ID NO: 6078060 - DNA, 12 bp, Homo sapiens
ccccagcctgcg

SEQ ID NO: 6078061 - DNA, 11 bp, Homo sapiens
ccccagcctgg

SEQ ID NO: 6078062 - DNA, 14 bp, Homo sapiens
ccccagcctggcac

SEQ ID NO: 6078063 - DNA, 13 bp, Homo sapiens
ccccagcctggcc

SEQ ID NO: 6078064 - DNA, 14 bp, Homo sapiens
ccccagcctggcca

SEQ ID NO: 6078065 - DNA, 16 bp, Homo sapiens
ccccagcctggccacg

SEQ ID NO: 6078066 - DNA, 22 bp, Homo sapiens
ccccagcctggccacgcagcca

SEQ ID NO: 6078067 - DNA, 18 bp, Homo sapiens
ccccagcctggcccagct

SEQ ID NO: 6078068 - DNA, 12 bp, Homo sapiens
ccccagcctggg

SEQ ID NO: 6078069 - DNA, 14 bp, Homo sapiens
ccccagcctgggcc

SEQ ID NO: 6078070 - DNA, 15 bp, Homo sapiens
ccccagcctgggcct

SEQ ID NO: 6078071 - DNA, 20 bp, Homo sapiens
ccccagcctgggcctatgga

SEQ ID NO: 6078072 - DNA, 12 bp, Homo sapiens
ccccagccttct

SEQ ID NO: 6078073 - DNA, 17 bp, Homo sapiens
ccccagccttgcccagc

SEQ ID NO: 6078074 - DNA, 12 bp, Homo sapiens
ccccagccttgg

SEQ ID NO: 6078075 - DNA, 19 bp, Homo sapiens
ccccagcgagtctggagac

SEQ ID NO: 6078076 - DNA, 21 bp, Homo sapiens
ccccagcggcagatgggcctg

SEQ ID NO: 6078077 - DNA, 23 bp, Homo sapiens
ccccagcggctgttccccctgcc

SEQ ID NO: 6078078 - DNA, 14 bp, Homo sapiens
ccccagcgggctgg

SEQ ID NO: 6078079 - DNA, 21 bp, Homo sapiens
ccccagcgggctggcgggcct

SEQ ID NO: 6078080 - DNA, 18 bp, Homo sapiens
ccccagcgtcccagtctc

SEQ ID NO: 6078081 - DNA, 21 bp, Homo sapiens
ccccagctaagaacctggaac

SEQ ID NO: 6078082 - DNA, 17 bp, Homo sapiens
ccccagctactctgatc

SEQ ID NO: 6078083 - DNA, 20 bp, Homo sapiens
ccccagctagcgtctcggcc

SEQ ID NO: 6078084 - DNA, 14 bp, Homo sapiens
ccccagctattttc

SEQ ID NO: 6078085 - DNA, 23 bp, Homo sapiens
ccccagctattttctgaccaaaa

SEQ ID NO: 6078086 - DNA, 15 bp, Homo sapiens
ccccagctcagagcc

SEQ ID NO: 6078087 - DNA, 14 bp, Homo sapiens
ccccagctcagggg

SEQ ID NO: 6078088 - DNA, 21 bp, Homo sapiens
ccccagctcaggggcagctca

SEQ ID NO: 6078089 - DNA, 14 bp, Homo sapiens
ccccagctccaggc

SEQ ID NO: 6078090 - DNA, 15 bp, Homo sapiens
ccccagctccaggca

SEQ ID NO: 6078091 - DNA, 11 bp, Homo sapiens
ccccagctccc

SEQ ID NO: 6078092 - DNA, 14 bp, Homo sapiens
ccccagctccccag

SEQ ID NO: 6078093 - DNA, 19 bp, Homo sapiens
ccccagctcccccaggcag

SEQ ID NO: 6078094 - DNA, 17 bp, Homo sapiens
ccccagctccctgcacc

SEQ ID NO: 6078095 - DNA, 19 bp, Homo sapiens
ccccagctccctgcaccgc

SEQ ID NO: 6078096 - DNA, 20 bp, Homo sapiens
ccccagctccctgcaccgcc

SEQ ID NO: 6078097 - DNA, 13 bp, Homo sapiens
ccccagctccggc

SEQ ID NO: 6078098 - DNA, 16 bp, Homo sapiens
ccccagctccgtttct

SEQ ID NO: 6078099 - DNA, 15 bp, Homo sapiens
ccccagctccttggc

SEQ ID NO: 6078100 - DNA, 21 bp, Homo sapiens
ccccagctccttggctgcagc

SEQ ID NO: 6078101 - DNA, 13 bp, Homo sapiens
ccccagctcgctg

SEQ ID NO: 6078102 - DNA, 18 bp, Homo sapiens
ccccagctcgctggcttt

SEQ ID NO: 6078103 - DNA, 23 bp, Homo sapiens
ccccagctcgctggctttctctc

SEQ ID NO: 6078104 - DNA, 24 bp, Homo sapiens
ccccagctctaagcagccaggagg

SEQ ID NO: 6078105 - DNA, 19 bp, Homo sapiens
ccccagctctcttctggct

SEQ ID NO: 6078106 - DNA, 21 bp, Homo sapiens
ccccagctctgaggggagggg

SEQ ID NO: 6078107 - DNA, 18 bp, Homo sapiens
ccccagctcttctcttcc

SEQ ID NO: 6078108 - DNA, 10 bp, Homo sapiens
ccccagctga

SEQ ID NO: 6078109 - DNA, 16 bp, Homo sapiens
ccccagctgacatgga

SEQ ID NO: 6078110 - DNA, 14 bp, Homo sapiens
ccccagctgactgt

SEQ ID NO: 6078111 - DNA, 15 bp, Homo sapiens
ccccagctgactgtg

SEQ ID NO: 6078112 - DNA, 12 bp, Homo sapiens
ccccagctgcca

SEQ ID NO: 6078113 - DNA, 13 bp, Homo sapiens
ccccagctgccag

SEQ ID NO: 6078114 - DNA, 14 bp, Homo sapiens
ccccagctgccagg

SEQ ID NO: 6078115 - DNA, 21 bp, Homo sapiens
ccccagctgccaggcggccct

SEQ ID NO: 6078116 - DNA, 14 bp, Homo sapiens
ccccagctgccggc

SEQ ID NO: 6078117 - DNA, 13 bp, Homo sapiens
ccccagctgctct

SEQ ID NO: 6078118 - DNA, 11 bp, Homo sapiens
ccccagctggc

SEQ ID NO: 6078119 - DNA, 13 bp, Homo sapiens
ccccagctggccc

SEQ ID NO: 6078120 - DNA, 15 bp, Homo sapiens
ccccagctggcctct

SEQ ID NO: 6078121 - DNA, 22 bp, Homo sapiens
ccccagctggctgggtcgcccc

SEQ ID NO: 6078122 - DNA, 21 bp, Homo sapiens
ccccagctgggaggcaagagg

SEQ ID NO: 6078123 - DNA, 22 bp, Homo sapiens
ccccagctgggaggcaagaggg

SEQ ID NO: 6078124 - DNA, 13 bp, Homo sapiens
ccccagctgggct

SEQ ID NO: 6078125 - DNA, 21 bp, Homo sapiens
ccccagctgggctgttggctg

SEQ ID NO: 6078126 - DNA, 23 bp, Homo sapiens
ccccagctgtcatcaattaaagg

SEQ ID NO: 6078127 - DNA, 15 bp, Homo sapiens
ccccagctgtgagcc

SEQ ID NO: 6078128 - DNA, 18 bp, Homo sapiens
ccccagcttcacttctga

SEQ ID NO: 6078129 - DNA, 14 bp, Homo sapiens
ccccagcttccagc

SEQ ID NO: 6078130 - DNA, 16 bp, Homo sapiens
ccccagcttccagcag

SEQ ID NO: 6078131 - DNA, 18 bp, Homo sapiens
ccccagcttccagcagga

SEQ ID NO: 6078132 - DNA, 19 bp, Homo sapiens
ccccagcttttcttgccag

SEQ ID NO: 6078133 - DNA, 22 bp, Homo sapiens
ccccagcttttcttgccagctc

SEQ ID NO: 6078134 - DNA, 12 bp, Homo sapiens
ccccaggaagcc

SEQ ID NO: 6078135 - DNA, 18 bp, Homo sapiens
ccccaggaagcccaggag

SEQ ID NO: 6078136 - DNA, 15 bp, Homo sapiens
ccccaggacaggctg

SEQ ID NO: 6078137 - DNA, 13 bp, Homo sapiens
ccccaggaccaga

SEQ ID NO: 6078138 - DNA, 14 bp, Homo sapiens
ccccaggaccagaa

SEQ ID NO: 6078139 - DNA, 16 bp, Homo sapiens
ccccaggaccagctca

SEQ ID NO: 6078140 - DNA, 19 bp, Homo sapiens
ccccaggacccccccagtc

SEQ ID NO: 6078141 - DNA, 21 bp, Homo sapiens
ccccaggacccctgtccagga

SEQ ID NO: 6078142 - DNA, 24 bp, Homo sapiens
ccccaggacctcttcagctgctga

SEQ ID NO: 6078143 - DNA, 17 bp, Homo sapiens
ccccaggacctggctgc

SEQ ID NO: 6078144 - DNA, 21 bp, Homo sapiens
ccccaggacctggctgccata

SEQ ID NO: 6078145 - DNA, 23 bp, Homo sapiens
ccccaggacgccactcatttcat

SEQ ID NO: 6078146 - DNA, 15 bp, Homo sapiens
ccccaggactcaccc

SEQ ID NO: 6078147 - DNA, 17 bp, Homo sapiens
ccccaggactcaccctc

SEQ ID NO: 6078148 - DNA, 19 bp, Homo sapiens
ccccaggactcaccctcat

SEQ ID NO: 6078149 - DNA, 14 bp, Homo sapiens
ccccaggactctgg

SEQ ID NO: 6078150 - DNA, 16 bp, Homo sapiens
ccccaggactctggca

SEQ ID NO: 6078151 - DNA, 22 bp, Homo sapiens
ccccaggactggctgccccgtg

SEQ ID NO: 6078152 - DNA, 14 bp, Homo sapiens
ccccaggactgggc

SEQ ID NO: 6078153 - DNA, 18 bp, Homo sapiens
ccccaggagcagctggca

SEQ ID NO: 6078154 - DNA, 21 bp, Homo sapiens
ccccaggaggcagctcaggat

SEQ ID NO: 6078155 - DNA, 17 bp, Homo sapiens
ccccaggaggccagcct

SEQ ID NO: 6078156 - DNA, 22 bp, Homo sapiens
ccccaggaggccagccttgacc

SEQ ID NO: 6078157 - DNA, 19 bp, Homo sapiens
ccccaggagggaggcaggg

SEQ ID NO: 6078158 - DNA, 20 bp, Homo sapiens
ccccaggatcactctctgct

SEQ ID NO: 6078159 - DNA, 21 bp, Homo sapiens
ccccaggatcactctctgctg

SEQ ID NO: 6078160 - DNA, 13 bp, Homo sapiens
aaatgactactac

SEQ ID NO: 6078161 - DNA, 19 bp, Homo sapiens
aaatgactactacacactg

SEQ ID NO: 6078162 - DNA, 17 bp, Homo sapiens
aaatgactattgtaatg

SEQ ID NO: 6078163 - DNA, 18 bp, Homo sapiens
aaatgactcataggtccc

SEQ ID NO: 6078164 - DNA, 16 bp, Homo sapiens
aaatgactgaagtgct

SEQ ID NO: 6078165 - DNA, 15 bp, Homo sapiens
aaatgacttattgat

SEQ ID NO: 6078166 - DNA, 13 bp, Homo sapiens
aaatgacttattt

SEQ ID NO: 6078167 - DNA, 20 bp, Homo sapiens
aaatgacttatttctgctct

SEQ ID NO: 6078168 - DNA, 20 bp, Homo sapiens
aaatgacttctccaggcaga

SEQ ID NO: 6078169 - DNA, 18 bp, Homo sapiens
aaatgactttattattta

SEQ ID NO: 6078170 - DNA, 13 bp, Homo sapiens
aaatgactttgaa

SEQ ID NO: 6078171 - DNA, 20 bp, Homo sapiens
aaatgactttgaactgaaac

SEQ ID NO: 6078172 - DNA, 17 bp, Homo sapiens
aaatgacttttattatg

SEQ ID NO: 6078173 - DNA, 17 bp, Homo sapiens
aaatgacttttcttaag

SEQ ID NO: 6078174 - DNA, 16 bp, Homo sapiens
aaatgagaaatctaaa

SEQ ID NO: 6078175 - DNA, 12 bp, Homo sapiens
aaatgagaaatt

SEQ ID NO: 6078176 - DNA, 15 bp, Homo sapiens
aaatgagaacatgtt

SEQ ID NO: 6078177 - DNA, 18 bp, Homo sapiens
aaatgagaacatgttggt

SEQ ID NO: 6078178 - DNA, 15 bp, Homo sapiens
aaatgagaccccttt

SEQ ID NO: 6078179 - DNA, 21 bp, Homo sapiens
aaatgagacccctttaaactg

SEQ ID NO: 6078180 - DNA, 23 bp, Homo sapiens
aaatgagacgaaatgctgatgta

SEQ ID NO: 6078181 - DNA, 13 bp, Homo sapiens
aaatgagactttt

SEQ ID NO: 6078182 - DNA, 16 bp, Homo sapiens
aaatgagaggagaaca

SEQ ID NO: 6078183 - DNA, 18 bp, Homo sapiens
aaatgagaggagaacagt

SEQ ID NO: 6078184 - DNA, 20 bp, Homo sapiens
aaatgagagggcagtgtttc

SEQ ID NO: 6078185 - DNA, 21 bp, Homo sapiens
aaatgagatatgcaataaata

SEQ ID NO: 6078186 - DNA, 22 bp, Homo sapiens
aaatgagatcccagagttattt

SEQ ID NO: 6078187 - DNA, 20 bp, Homo sapiens
aaatgagatgtatgcccaaa

SEQ ID NO: 6078188 - DNA, 17 bp, Homo sapiens
aaatgagattatatgtg

SEQ ID NO: 6078189 - DNA, 21 bp, Homo sapiens
aaatgagcagcccttacagta

SEQ ID NO: 6078190 - DNA, 20 bp, Homo sapiens
aaatgagcatctcaaatgtt

SEQ ID NO: 6078191 - DNA, 14 bp, Homo sapiens
aaatgagctcctgc

SEQ ID NO: 6078192 - DNA, 19 bp, Homo sapiens
aaatgagctctgaaatctt

SEQ ID NO: 6078193 - DNA, 19 bp, Homo sapiens
aaatgagcttgattaaatc

SEQ ID NO: 6078194 - DNA, 12 bp, Homo sapiens
aaatgaggaaac

SEQ ID NO: 6078195 - DNA, 12 bp, Homo sapiens
aaatgaggaaga

SEQ ID NO: 6078196 - DNA, 19 bp, Homo sapiens
aaatgaggaatccaaaaga

SEQ ID NO: 6078197 - DNA, 22 bp, Homo sapiens
aaatgaggaatccaaaagacaa

SEQ ID NO: 6078198 - DNA, 14 bp, Homo sapiens
aaatgaggacatgt

SEQ ID NO: 6078199 - DNA, 13 bp, Homo sapiens
aaatgaggatcca

SEQ ID NO: 6078200 - DNA, 15 bp, Homo sapiens
aaatgaggatccagg

SEQ ID NO: 6078201 - DNA, 22 bp, Homo sapiens
aaatgaggatccagggcagcag

SEQ ID NO: 6078202 - DNA, 20 bp, Homo sapiens
aaatgaggccggacagaggg

SEQ ID NO: 6078203 - DNA, 9 bp, Homo sapiens
aaatgaggg

SEQ ID NO: 6078204 - DNA, 16 bp, Homo sapiens
aaatgagggtttctga

SEQ ID NO: 6078205 - DNA, 17 bp, Homo sapiens
aaatgaggtcagagcct

SEQ ID NO: 6078206 - DNA, 19 bp, Homo sapiens
aaatgaggtcagagcctgc

SEQ ID NO: 6078207 - DNA, 15 bp, Homo sapiens
aaatgaggtctgttt

SEQ ID NO: 6078208 - DNA, 20 bp, Homo sapiens
aaatgagtaaaaactagaag

SEQ ID NO: 6078209 - DNA, 16 bp, Homo sapiens
aaatgagtcactgagc

SEQ ID NO: 6078210 - DNA, 21 bp, Homo sapiens
aaatgagtcacttacttcata

SEQ ID NO: 6078211 - DNA, 20 bp, Homo sapiens
aaatgagtcaggcaattgat

SEQ ID NO: 6078212 - DNA, 22 bp, Homo sapiens
aaatgagtccaaactggaatga

SEQ ID NO: 6078213 - DNA, 16 bp, Homo sapiens
aaatgagtctgtttga

SEQ ID NO: 6078214 - DNA, 15 bp, Homo sapiens
aaatgagtgtgaagg

SEQ ID NO: 6078215 - DNA, 21 bp, Homo sapiens
aaatgagttacctacatttta

SEQ ID NO: 6078216 - DNA, 23 bp, Homo sapiens
aaatgagttgtgaaagttttgag

SEQ ID NO: 6078217 - DNA, 20 bp, Homo sapiens
aaatgagttgtgatgaatca

SEQ ID NO: 6078218 - DNA, 21 bp, Homo sapiens
aaatgagtttaaaaaaataac

SEQ ID NO: 6078219 - DNA, 22 bp, Homo sapiens
aaatgagtttaaaaaaataaca

SEQ ID NO: 6078220 - DNA, 14 bp, Homo sapiens
aaatgataaagact

SEQ ID NO: 6078221 - DNA, 16 bp, Homo sapiens
aaatgataaagacttt

SEQ ID NO: 6078222 - DNA, 17 bp, Homo sapiens
aaatgataaagactttt

SEQ ID NO: 6078223 - DNA, 19 bp, Homo sapiens
aaatgataaagacttttat

SEQ ID NO: 6078224 - DNA, 14 bp, Homo sapiens
aaatgataaatgta

SEQ ID NO: 6078225 - DNA, 20 bp, Homo sapiens
aaatgatagaactgtactgt

SEQ ID NO: 6078226 - DNA, 13 bp, Homo sapiens
aaatgatagattt

SEQ ID NO: 6078227 - DNA, 17 bp, Homo sapiens
aaatgatagttttctag

SEQ ID NO: 6078228 - DNA, 20 bp, Homo sapiens
aaatgatatctatattctaa

SEQ ID NO: 6078229 - DNA, 20 bp, Homo sapiens
aaatgatattaaaaattggc

SEQ ID NO: 6078230 - DNA, 21 bp, Homo sapiens
aaatgatcaccatgttagcct

SEQ ID NO: 6078231 - DNA, 22 bp, Homo sapiens
aaatgatccccaagtgtgaaca

SEQ ID NO: 6078232 - DNA, 23 bp, Homo sapiens
aaatgatccccagctgtttatgc

SEQ ID NO: 6078233 - DNA, 13 bp, Homo sapiens
aaatgatctaaac

SEQ ID NO: 6078234 - DNA, 15 bp, Homo sapiens
aaatgatctattgca

SEQ ID NO: 6078235 - DNA, 19 bp, Homo sapiens
aaatgatgatgtggaagaa

SEQ ID NO: 6078236 - DNA, 18 bp, Homo sapiens
aaatgatgattatgagtt

SEQ ID NO: 6078237 - DNA, 14 bp, Homo sapiens
aaatgatgattcgt

SEQ ID NO: 6078238 - DNA, 12 bp, Homo sapiens
aaatgatggaag

SEQ ID NO: 6078239 - DNA, 21 bp, Homo sapiens
aaatgatggatcaccattata

SEQ ID NO: 6078240 - DNA, 22 bp, Homo sapiens
aaatgatgtgaaagataaatga

SEQ ID NO: 6078241 - DNA, 23 bp, Homo sapiens
aaatgatgtgaaagataaatgat

SEQ ID NO: 6078242 - DNA, 16 bp, Homo sapiens
aaatgatgtgttggtt

SEQ ID NO: 6078243 - DNA, 18 bp, Homo sapiens
aaatgatgttatagaatt

SEQ ID NO: 6078244 - DNA, 17 bp, Homo sapiens
aaatgattactaaggaa

SEQ ID NO: 6078245 - DNA, 22 bp, Homo sapiens
aaatgattataagccctgcata

SEQ ID NO: 6078246 - DNA, 18 bp, Homo sapiens
aaatgattatattcacag

SEQ ID NO: 6078247 - DNA, 18 bp, Homo sapiens
aaatgattcaaattgctg

SEQ ID NO: 6078248 - DNA, 16 bp, Homo sapiens
aaatgattcagggtta

SEQ ID NO: 6078249 - DNA, 16 bp, Homo sapiens
aaatgattcatctttc

SEQ ID NO: 6078250 - DNA, 22 bp, Homo sapiens
aaatgattcatctttcagaaat

SEQ ID NO: 6078251 - DNA, 12 bp, Homo sapiens
aaatgattccaa

SEQ ID NO: 6078252 - DNA, 17 bp, Homo sapiens
aaatgattgcttttaaa

SEQ ID NO: 6078253 - DNA, 20 bp, Homo sapiens
aaatgattgcttttaaaatt

SEQ ID NO: 6078254 - DNA, 15 bp, Homo sapiens
aaatgattgtaaaat

SEQ ID NO: 6078255 - DNA, 14 bp, Homo sapiens
aaatgattgtcttt

SEQ ID NO: 6078256 - DNA, 20 bp, Homo sapiens
aaatgattgttttagaagtt

SEQ ID NO: 6078257 - DNA, 11 bp, Homo sapiens
aaatgatttca

SEQ ID NO: 6078258 - DNA, 15 bp, Homo sapiens
aaatgatttcacagt

SEQ ID NO: 6078259 - DNA, 14 bp, Homo sapiens
aaatgatttcatat

SEQ ID NO: 6078260 - DNA, 16 bp, Homo sapiens
aaatgatttcatattg

SEQ ID NO: 6078261 - DNA, 16 bp, Homo sapiens
aaatgatttccacaaa

SEQ ID NO: 6078262 - DNA, 21 bp, Homo sapiens
aaatgatttcctctgtaatct

SEQ ID NO: 6078263 - DNA, 21 bp, Homo sapiens
aaatgatttgtagtggaaaca

SEQ ID NO: 6078264 - DNA, 16 bp, Homo sapiens
aaatgattttcatcaa

SEQ ID NO: 6078265 - DNA, 20 bp, Homo sapiens
aaatgattttcatcaattta

SEQ ID NO: 6078266 - DNA, 23 bp, Homo sapiens
aaatgatttttacaagttttaaa

SEQ ID NO: 6078267 - DNA, 18 bp, Homo sapiens
aaatgcaaaaaaaattag

SEQ ID NO: 6078268 - DNA, 14 bp, Homo sapiens
aaatgcaaaaatat

SEQ ID NO: 6078269 - DNA, 17 bp, Homo sapiens
aaatgcaaacacacaaa

SEQ ID NO: 6078270 - DNA, 21 bp, Homo sapiens
aaatgcaaacactgtgtattt

SEQ ID NO: 6078271 - DNA, 17 bp, Homo sapiens
aaatgcaaagcacacct

SEQ ID NO: 6078272 - DNA, 13 bp, Homo sapiens
aaatgcaaatgaa

SEQ ID NO: 6078273 - DNA, 16 bp, Homo sapiens
aaatgcaaatgaatca

SEQ ID NO: 6078274 - DNA, 19 bp, Homo sapiens
aaatgcaaatgaatcattg

SEQ ID NO: 6078275 - DNA, 20 bp, Homo sapiens
aaatgcaaatgaatcattgt

SEQ ID NO: 6078276 - DNA, 21 bp, Homo sapiens
aaatgcaaatttctataaatt

SEQ ID NO: 6078277 - DNA, 17 bp, Homo sapiens
aaatgcaaccagaattg

SEQ ID NO: 6078278 - DNA, 17 bp, Homo sapiens
aaatgcaagtgcctaga

SEQ ID NO: 6078279 - DNA, 15 bp, Homo sapiens
aaatgcaataactct

SEQ ID NO: 6078280 - DNA, 21 bp, Homo sapiens
aaatgcaatctcttttctaca

SEQ ID NO: 6078281 - DNA, 15 bp, Homo sapiens
aaatgcacaatgtct

SEQ ID NO: 6078282 - DNA, 18 bp, Homo sapiens
aaatgcacatttgtcact

SEQ ID NO: 6078283 - DNA, 18 bp, Homo sapiens
aaatgcaccaagaaagct

SEQ ID NO: 6078284 - DNA, 19 bp, Homo sapiens
aaatgcactaagacaagaa

SEQ ID NO: 6078285 - DNA, 23 bp, Homo sapiens
aaatgcactaagacaagaacatt

SEQ ID NO: 6078286 - DNA, 15 bp, Homo sapiens
aaatgcagacacaca

SEQ ID NO: 6078287 - DNA, 13 bp, Homo sapiens
aaatgcagcccat

SEQ ID NO: 6078288 - DNA, 15 bp, Homo sapiens
aaatgcagggagggg

SEQ ID NO: 6078289 - DNA, 16 bp, Homo sapiens
aaatgcaggtgaactt

SEQ ID NO: 6078290 - DNA, 19 bp, Homo sapiens
aaatgcaggtgtcctgagc

SEQ ID NO: 6078291 - DNA, 14 bp, Homo sapiens
aaatgcagtccaga

SEQ ID NO: 6078292 - DNA, 18 bp, Homo sapiens
aaatgcagtccagaataa

SEQ ID NO: 6078293 - DNA, 15 bp, Homo sapiens
aaatgcagtgtattt

SEQ ID NO: 6078294 - DNA, 17 bp, Homo sapiens
aaatgcagttacaaatt

SEQ ID NO: 6078295 - DNA, 15 bp, Homo sapiens
aaatgcataaatgca

SEQ ID NO: 6078296 - DNA, 14 bp, Homo sapiens
aaatgcatactgtt

SEQ ID NO: 6078297 - DNA, 16 bp, Homo sapiens
aaatgcatactgttga

SEQ ID NO: 6078298 - DNA, 20 bp, Homo sapiens
aaatgcatactgttgataca

SEQ ID NO: 6078299 - DNA, 22 bp, Homo sapiens
aaatgcatactgttgatacaaa

SEQ ID NO: 6078300 - DNA, 13 bp, Homo sapiens
aaatgcatagagc

SEQ ID NO: 6078301 - DNA, 14 bp, Homo sapiens
aaatgcatagagca

SEQ ID NO: 6078302 - DNA, 19 bp, Homo sapiens
aaatgcatatcctgagcca

SEQ ID NO: 6078303 - DNA, 11 bp, Homo sapiens
aaatgcatatt

SEQ ID NO: 6078304 - DNA, 15 bp, Homo sapiens
aaatgcatattgtat

SEQ ID NO: 6078305 - DNA, 23 bp, Homo sapiens
aaatgcatccattcctcagggac

SEQ ID NO: 6078306 - DNA, 15 bp, Homo sapiens
aaatgcatctttgat

SEQ ID NO: 6078307 - DNA, 20 bp, Homo sapiens
aaatgcatgattttatacat

SEQ ID NO: 6078308 - DNA, 21 bp, Homo sapiens
aaatgcatgattttatacata

SEQ ID NO: 6078309 - DNA, 15 bp, Homo sapiens
aaatgcatgtcttaa

SEQ ID NO: 6078310 - DNA, 16 bp, Homo sapiens
aaatgcatgtcttaaa

SEQ ID NO: 6078311 - DNA, 19 bp, Homo sapiens
aaatgcattctatcgttat

SEQ ID NO: 6078312 - DNA, 20 bp, Homo sapiens
aaatgcattctatcgttatt

SEQ ID NO: 6078313 - DNA, 15 bp, Homo sapiens
aaatgcattgaacat

SEQ ID NO: 6078314 - DNA, 13 bp, Homo sapiens
aaatgcattgtat

SEQ ID NO: 6078315 - DNA, 11 bp, Homo sapiens
aaatgcattta

SEQ ID NO: 6078316 - DNA, 21 bp, Homo sapiens
aaatgcatttaagttgtaaac

SEQ ID NO: 6078317 - DNA, 22 bp, Homo sapiens
aaatgcatttaagttgtaaacg

SEQ ID NO: 6078318 - DNA, 13 bp, Homo sapiens
aaatgcatttata

SEQ ID NO: 6078319 - DNA, 21 bp, Homo sapiens
aaatgcatttatagatcattt

SEQ ID NO: 6078320 - DNA, 19 bp, Homo sapiens
aaatgcattttcttcagaa

SEQ ID NO: 6078321 - DNA, 20 bp, Homo sapiens
aaatgcattttcttcagaat

SEQ ID NO: 6078322 - DNA, 13 bp, Homo sapiens
aaatgcatttttt

SEQ ID NO: 6078323 - DNA, 11 bp, Homo sapiens
aaatgccaaaa

SEQ ID NO: 6078324 - DNA, 20 bp, Homo sapiens
aaatgccaaaaacaaaatgg

SEQ ID NO: 6078325 - DNA, 16 bp, Homo sapiens
aaatgccaaattaaaa

SEQ ID NO: 6078326 - DNA, 22 bp, Homo sapiens
aaatgccaagtgcctgcttagt

SEQ ID NO: 6078327 - DNA, 18 bp, Homo sapiens
aaatgccaccatccaata

SEQ ID NO: 6078328 - DNA, 20 bp, Homo sapiens
aaatgccaccatccaataaa

SEQ ID NO: 6078329 - DNA, 18 bp, Homo sapiens
aaatgccactccctaccc

SEQ ID NO: 6078330 - DNA, 18 bp, Homo sapiens
aaatgccactctgggcag

SEQ ID NO: 6078331 - DNA, 16 bp, Homo sapiens
aaatgccagaaacagt

SEQ ID NO: 6078332 - DNA, 16 bp, Homo sapiens
aaatgccagagccaac

SEQ ID NO: 6078333 - DNA, 21 bp, Homo sapiens
aaatgccagagccaacctgga

SEQ ID NO: 6078334 - DNA, 22 bp, Homo sapiens
aaatgccagagccaacctggac

SEQ ID NO: 6078335 - DNA, 17 bp, Homo sapiens
aaatgccaggacagctg

SEQ ID NO: 6078336 - DNA, 18 bp, Homo sapiens
aaatgccatagaaatgta

SEQ ID NO: 6078337 - DNA, 14 bp, Homo sapiens
aaatgccatgaaaa

SEQ ID NO: 6078338 - DNA, 22 bp, Homo sapiens
ccccaggatcactctctgctgg

SEQ ID NO: 6078339 - DNA, 23 bp, Homo sapiens
ccccaggatcactctctgctggc

SEQ ID NO: 6078340 - DNA, 16 bp, Homo sapiens
ccccaggatctgggtt

SEQ ID NO: 6078341 - DNA, 16 bp, Homo sapiens
ccccaggattccccca

SEQ ID NO: 6078342 - DNA, 17 bp, Homo sapiens
ccccaggcagctcctgt

SEQ ID NO: 6078343 - DNA, 22 bp, Homo sapiens
ccccaggccaggccaccaggat

SEQ ID NO: 6078344 - DNA, 16 bp, Homo sapiens
ccccaggcccactcag

SEQ ID NO: 6078345 - DNA, 22 bp, Homo sapiens
ccccaggcccactcaggggtca

SEQ ID NO: 6078346 - DNA, 12 bp, Homo sapiens
ccccaggcccag

SEQ ID NO: 6078347 - DNA, 13 bp, Homo sapiens
ccccaggcccagc

SEQ ID NO: 6078348 - DNA, 11 bp, Homo sapiens
ccccaggcccc

SEQ ID NO: 6078349 - DNA, 14 bp, Homo sapiens
ccccaggccccaga

SEQ ID NO: 6078350 - DNA, 19 bp, Homo sapiens
ccccaggcccgccctgccc

SEQ ID NO: 6078351 - DNA, 16 bp, Homo sapiens
ccccaggccctcccac

SEQ ID NO: 6078352 - DNA, 15 bp, Homo sapiens
ccccaggccctccct

SEQ ID NO: 6078353 - DNA, 16 bp, Homo sapiens
ccccaggccctccctg

SEQ ID NO: 6078354 - DNA, 21 bp, Homo sapiens
ccccaggccctgccagagcag

SEQ ID NO: 6078355 - DNA, 17 bp, Homo sapiens
ccccaggccggagccca

SEQ ID NO: 6078356 - DNA, 15 bp, Homo sapiens
ccccaggcctccagc

SEQ ID NO: 6078357 - DNA, 17 bp, Homo sapiens
ccccaggcctccagcct

SEQ ID NO: 6078358 - DNA, 13 bp, Homo sapiens
ccccaggcctcct

SEQ ID NO: 6078359 - DNA, 15 bp, Homo sapiens
ccccaggcctgagct

SEQ ID NO: 6078360 - DNA, 18 bp, Homo sapiens
ccccaggcctgagctgct

SEQ ID NO: 6078361 - DNA, 23 bp, Homo sapiens
ccccaggcctgagctgcttcact

SEQ ID NO: 6078362 - DNA, 13 bp, Homo sapiens
ccccaggcctggc

SEQ ID NO: 6078363 - DNA, 15 bp, Homo sapiens
ccccaggcctggcct

SEQ ID NO: 6078364 - DNA, 19 bp, Homo sapiens
ccccaggcctggctccccg

SEQ ID NO: 6078365 - DNA, 23 bp, Homo sapiens
ccccaggcggaggggcttggagc

SEQ ID NO: 6078366 - DNA, 18 bp, Homo sapiens
ccccaggctcccctggtc

SEQ ID NO: 6078367 - DNA, 18 bp, Homo sapiens
ccccaggctcgtggactg

SEQ ID NO: 6078368 - DNA, 15 bp, Homo sapiens
ccccaggctgagagc

SEQ ID NO: 6078369 - DNA, 18 bp, Homo sapiens
ccccaggctgcgcctgcc

SEQ ID NO: 6078370 - DNA, 20 bp, Homo sapiens
ccccaggctgcgcctgcccg

SEQ ID NO: 6078371 - DNA, 22 bp, Homo sapiens
ccccaggctgcgcctgcccgcc

SEQ ID NO: 6078372 - DNA, 19 bp, Homo sapiens
ccccaggctggacatgctg

SEQ ID NO: 6078373 - DNA, 22 bp, Homo sapiens
ccccaggctggacatgctgact

SEQ ID NO: 6078374 - DNA, 23 bp, Homo sapiens
ccccaggctggagtgcagtggct

SEQ ID NO: 6078375 - DNA, 21 bp, Homo sapiens
ccccaggcttccgcgcccagc

SEQ ID NO: 6078376 - DNA, 22 bp, Homo sapiens
ccccaggcttgtcactagcagc

SEQ ID NO: 6078377 - DNA, 22 bp, Homo sapiens
ccccagggaatcagggaccagc

SEQ ID NO: 6078378 - DNA, 24 bp, Homo sapiens
ccccagggaatcagggaccagctt

SEQ ID NO: 6078379 - DNA, 23 bp, Homo sapiens
ccccagggacaaaacactgtgtc

SEQ ID NO: 6078380 - DNA, 17 bp, Homo sapiens
ccccagggacagaggcc

SEQ ID NO: 6078381 - DNA, 18 bp, Homo sapiens
ccccagggacagaggcca

SEQ ID NO: 6078382 - DNA, 20 bp, Homo sapiens
ccccagggacagaggccaag

SEQ ID NO: 6078383 - DNA, 14 bp, Homo sapiens
ccccagggagctct

SEQ ID NO: 6078384 - DNA, 13 bp, Homo sapiens
ccccagggagggg

SEQ ID NO: 6078385 - DNA, 11 bp, Homo sapiens
ccccagggcac

SEQ ID NO: 6078386 - DNA, 19 bp, Homo sapiens
ccccagggcacaggagcta

SEQ ID NO: 6078387 - DNA, 23 bp, Homo sapiens
ccccagggcacaggagctacctg

SEQ ID NO: 6078388 - DNA, 12 bp, Homo sapiens
ccccagggcact

SEQ ID NO: 6078389 - DNA, 20 bp, Homo sapiens
ccccagggcacttcacagag

SEQ ID NO: 6078390 - DNA, 14 bp, Homo sapiens
ccccagggcagcct

SEQ ID NO: 6078391 - DNA, 15 bp, Homo sapiens
ccccagggcagcctc

SEQ ID NO: 6078392 - DNA, 23 bp, Homo sapiens
ccccagggcagggtgggcagcct

SEQ ID NO: 6078393 - DNA, 20 bp, Homo sapiens
ccccagggcccccacaggcc

SEQ ID NO: 6078394 - DNA, 22 bp, Homo sapiens
ccccagggcccctccctctgcc

SEQ ID NO: 6078395 - DNA, 23 bp, Homo sapiens
ccccagggcccctccctctgccc

SEQ ID NO: 6078396 - DNA, 13 bp, Homo sapiens
ccccagggccctg

SEQ ID NO: 6078397 - DNA, 15 bp, Homo sapiens
ccccagggccctgct

SEQ ID NO: 6078398 - DNA, 14 bp, Homo sapiens
ccccagggccctgg

SEQ ID NO: 6078399 - DNA, 18 bp, Homo sapiens
ccccagggccctggccag

SEQ ID NO: 6078400 - DNA, 15 bp, Homo sapiens
ccccagggcctccag

SEQ ID NO: 6078401 - DNA, 16 bp, Homo sapiens
ccccagggcctccagg

SEQ ID NO: 6078402 - DNA, 21 bp, Homo sapiens
ccccagggcctgagcctggcc

SEQ ID NO: 6078403 - DNA, 17 bp, Homo sapiens
ccccagggcctgggggc

SEQ ID NO: 6078404 - DNA, 19 bp, Homo sapiens
ccccagggcctgtctccct

SEQ ID NO: 6078405 - DNA, 22 bp, Homo sapiens
ccccagggctgtaactgccagg

SEQ ID NO: 6078406 - DNA, 20 bp, Homo sapiens
ccccagggctgtgggtgggg

SEQ ID NO: 6078407 - DNA, 17 bp, Homo sapiens
ccccaggggaaaatgaa

SEQ ID NO: 6078408 - DNA, 18 bp, Homo sapiens
ccccaggggaaaatgaag

SEQ ID NO: 6078409 - DNA, 20 bp, Homo sapiens
ccccaggggagaaagaggag

SEQ ID NO: 6078410 - DNA, 20 bp, Homo sapiens
ccccaggggcacacttcccc

SEQ ID NO: 6078411 - DNA, 14 bp, Homo sapiens
ccccaggggcagca

SEQ ID NO: 6078412 - DNA, 18 bp, Homo sapiens
ccccaggggggcctcctc

SEQ ID NO: 6078413 - DNA, 18 bp, Homo sapiens
ccccagggtagccatggc

SEQ ID NO: 6078414 - DNA, 19 bp, Homo sapiens
ccccagggtgagcagggcc

SEQ ID NO: 6078415 - DNA, 16 bp, Homo sapiens
ccccagggtgcaggcg

SEQ ID NO: 6078416 - DNA, 22 bp, Homo sapiens
ccccagggtgcaggcgcgcacc

SEQ ID NO: 6078417 - DNA, 11 bp, Homo sapiens
ccccagggtgg

SEQ ID NO: 6078418 - DNA, 22 bp, Homo sapiens
ccccagggttgaggggaccaag

SEQ ID NO: 6078419 - DNA, 16 bp, Homo sapiens
ccccaggtattgtctt

SEQ ID NO: 6078420 - DNA, 14 bp, Homo sapiens
ccccaggtcagccc

SEQ ID NO: 6078421 - DNA, 15 bp, Homo sapiens
ccccaggtcagccct

SEQ ID NO: 6078422 - DNA, 19 bp, Homo sapiens
ccccaggtcagccctgtgt

SEQ ID NO: 6078423 - DNA, 18 bp, Homo sapiens
ccccaggtcaggggctcc

SEQ ID NO: 6078424 - DNA, 22 bp, Homo sapiens
ccccaggtcctgtctctgcaca

SEQ ID NO: 6078425 - DNA, 15 bp, Homo sapiens
ccccaggtcttcctg

SEQ ID NO: 6078426 - DNA, 14 bp, Homo sapiens
ccccaggtcttttc

SEQ ID NO: 6078427 - DNA, 20 bp, Homo sapiens
ccccaggtgcagccccaggg

SEQ ID NO: 6078428 - DNA, 17 bp, Homo sapiens
ccccaggtgccaccaat

SEQ ID NO: 6078429 - DNA, 18 bp, Homo sapiens
ccccaggtgccaccaata

SEQ ID NO: 6078430 - DNA, 22 bp, Homo sapiens
ccccaggtgccaccaataaaaa

SEQ ID NO: 6078431 - DNA, 12 bp, Homo sapiens
ccccaggtgctg

SEQ ID NO: 6078432 - DNA, 13 bp, Homo sapiens
ccccaggtgctgg

SEQ ID NO: 6078433 - DNA, 21 bp, Homo sapiens
ccccaggtggaggtgccagga

SEQ ID NO: 6078434 - DNA, 23 bp, Homo sapiens
ccccaggtttttgcccatcctcc

SEQ ID NO: 6078435 - DNA, 14 bp, Homo sapiens
ccccagtacacagg

SEQ ID NO: 6078436 - DNA, 18 bp, Homo sapiens
ccccagtacctccaagca

SEQ ID NO: 6078437 - DNA, 20 bp, Homo sapiens
ccccagtacctccaagcaag

SEQ ID NO: 6078438 - DNA, 17 bp, Homo sapiens
ccccagtagctgggacc

SEQ ID NO: 6078439 - DNA, 18 bp, Homo sapiens
ccccagtcacttcctgtc

SEQ ID NO: 6078440 - DNA, 15 bp, Homo sapiens
ccccagtcagcctct

SEQ ID NO: 6078441 - DNA, 16 bp, Homo sapiens
ccccagtcagcctctc

SEQ ID NO: 6078442 - DNA, 23 bp, Homo sapiens
ccccagtcagcctctctcccagt

SEQ ID NO: 6078443 - DNA, 20 bp, Homo sapiens
ccccagtcagcctggctggg

SEQ ID NO: 6078444 - DNA, 11 bp, Homo sapiens
ccccagtccca

SEQ ID NO: 6078445 - DNA, 17 bp, Homo sapiens
ccccagtccccagccct

SEQ ID NO: 6078446 - DNA, 17 bp, Homo sapiens
ccccagtccccttcccg

SEQ ID NO: 6078447 - DNA, 17 bp, Homo sapiens
ccccagtcctccctagc

SEQ ID NO: 6078448 - DNA, 14 bp, Homo sapiens
ccccagtcctggtt

SEQ ID NO: 6078449 - DNA, 17 bp, Homo sapiens
ccccagtcgagccctgc

SEQ ID NO: 6078450 - DNA, 22 bp, Homo sapiens
ccccagtcgagccctgcagcca

SEQ ID NO: 6078451 - DNA, 22 bp, Homo sapiens
ccccagtcgtgatgtggaggaa

SEQ ID NO: 6078452 - DNA, 14 bp, Homo sapiens
ccccagtcttcctt

SEQ ID NO: 6078453 - DNA, 14 bp, Homo sapiens
ccccagtgactcca

SEQ ID NO: 6078454 - DNA, 19 bp, Homo sapiens
ccccagtgatctcgactcc

SEQ ID NO: 6078455 - DNA, 16 bp, Homo sapiens
ccccagtgcacccact

SEQ ID NO: 6078456 - DNA, 14 bp, Homo sapiens
ccccagtgccacag

SEQ ID NO: 6078457 - DNA, 15 bp, Homo sapiens
ccccagtgccacaga

SEQ ID NO: 6078458 - DNA, 14 bp, Homo sapiens
ccccagtgcccaca

SEQ ID NO: 6078459 - DNA, 15 bp, Homo sapiens
ccccagtgcccacag

SEQ ID NO: 6078460 - DNA, 16 bp, Homo sapiens
ccccagtgcccacagg

SEQ ID NO: 6078461 - DNA, 23 bp, Homo sapiens
ccccagtgcccggtgcagggcct

SEQ ID NO: 6078462 - DNA, 13 bp, Homo sapiens
ccccagtgcctgc

SEQ ID NO: 6078463 - DNA, 15 bp, Homo sapiens
ccccagtgcctgcca

SEQ ID NO: 6078464 - DNA, 13 bp, Homo sapiens
ccccagtgcgctc

SEQ ID NO: 6078465 - DNA, 15 bp, Homo sapiens
ccccagtgctcacac

SEQ ID NO: 6078466 - DNA, 16 bp, Homo sapiens
ccccagtgctcctgtg

SEQ ID NO: 6078467 - DNA, 15 bp, Homo sapiens
ccccagtgctggaag

SEQ ID NO: 6078468 - DNA, 20 bp, Homo sapiens
ccccagtgggaccacatgcc

SEQ ID NO: 6078469 - DNA, 15 bp, Homo sapiens
ccccagtgggatggg

SEQ ID NO: 6078470 - DNA, 19 bp, Homo sapiens
ccccagtggtgcgggccag

SEQ ID NO: 6078471 - DNA, 20 bp, Homo sapiens
ccccagtgtccccaggggca

SEQ ID NO: 6078472 - DNA, 19 bp, Homo sapiens
ccccagtgtggactctgga

SEQ ID NO: 6078473 - DNA, 17 bp, Homo sapiens
ccccagtgtggccccag

SEQ ID NO: 6078474 - DNA, 21 bp, Homo sapiens
ccccagttcagtctgtaggga

SEQ ID NO: 6078475 - DNA, 21 bp, Homo sapiens
ccccagttcgcctggagccct

SEQ ID NO: 6078476 - DNA, 17 bp, Homo sapiens
ccccagttctgctcctc

SEQ ID NO: 6078477 - DNA, 19 bp, Homo sapiens
ccccagttctgctcctctc

SEQ ID NO: 6078478 - DNA, 20 bp, Homo sapiens
ccccagttctgctcctctcc

SEQ ID NO: 6078479 - DNA, 19 bp, Homo sapiens
ccccagttggcccttctgc

SEQ ID NO: 6078480 - DNA, 21 bp, Homo sapiens
ccccagtttggggtgccaaga

SEQ ID NO: 6078481 - DNA, 20 bp, Homo sapiens
ccccataagacaaacactgc

SEQ ID NO: 6078482 - DNA, 18 bp, Homo sapiens
ccccataagccctgagac

SEQ ID NO: 6078483 - DNA, 17 bp, Homo sapiens
ccccataataaccctgc

SEQ ID NO: 6078484 - DNA, 22 bp, Homo sapiens
ccccataataaccctgccagtg

SEQ ID NO: 6078485 - DNA, 15 bp, Homo sapiens
ccccataatgcttct

SEQ ID NO: 6078486 - DNA, 13 bp, Homo sapiens
ccccatacacaca

SEQ ID NO: 6078487 - DNA, 15 bp, Homo sapiens
ccccatacacacaca

SEQ ID NO: 6078488 - DNA, 16 bp, Homo sapiens
ccccatacttcctggg

SEQ ID NO: 6078489 - DNA, 18 bp, Homo sapiens
ccccatagagaccaggag

SEQ ID NO: 6078490 - DNA, 17 bp, Homo sapiens
ccccatatacacctgga

SEQ ID NO: 6078491 - DNA, 16 bp, Homo sapiens
ccccatatataaatta

SEQ ID NO: 6078492 - DNA, 19 bp, Homo sapiens
ccccatcactgcgccactg

SEQ ID NO: 6078493 - DNA, 17 bp, Homo sapiens
ccccatcagaggctggg

SEQ ID NO: 6078494 - DNA, 15 bp, Homo sapiens
ccccatcaggtagct

SEQ ID NO: 6078495 - DNA, 14 bp, Homo sapiens
ccccatcagtgctc

SEQ ID NO: 6078496 - DNA, 16 bp, Homo sapiens
ccccatcatcctctgg

SEQ ID NO: 6078497 - DNA, 17 bp, Homo sapiens
ccccatcatcctctggc

SEQ ID NO: 6078498 - DNA, 17 bp, Homo sapiens
ccccatccagcctccag

SEQ ID NO: 6078499 - DNA, 13 bp, Homo sapiens
ccccatcccacat

SEQ ID NO: 6078500 - DNA, 12 bp, Homo sapiens
ccccatcccagg

SEQ ID NO: 6078501 - DNA, 15 bp, Homo sapiens
ccccatcccagggtc

SEQ ID NO: 6078502 - DNA, 14 bp, Homo sapiens
ccccatcccatgct

SEQ ID NO: 6078503 - DNA, 13 bp, Homo sapiens
ccccatccccacc

SEQ ID NO: 6078504 - DNA, 14 bp, Homo sapiens
ccccatccccacca

SEQ ID NO: 6078505 - DNA, 13 bp, Homo sapiens
ccccatcccccac

SEQ ID NO: 6078506 - DNA, 16 bp, Homo sapiens
ccccatcccccactgc

SEQ ID NO: 6078507 - DNA, 15 bp, Homo sapiens
ccccatcccctttcc

SEQ ID NO: 6078508 - DNA, 13 bp, Homo sapiens
ccccatccctacc

SEQ ID NO: 6078509 - DNA, 14 bp, Homo sapiens
ccccatccctcggg

SEQ ID NO: 6078510 - DNA, 11 bp, Homo sapiens
ccccatccctg

SEQ ID NO: 6078511 - DNA, 14 bp, Homo sapiens
ccccatccctgctt

SEQ ID NO: 6078512 - DNA, 14 bp, Homo sapiens
ccccatccctggct

SEQ ID NO: 6078513 - DNA, 19 bp, Homo sapiens
ccccatcctcatccctgac

SEQ ID NO: 6078514 - DNA, 19 bp, Homo sapiens
ccccatcctccccttccct

SEQ ID NO: 6078515 - DNA, 14 bp, Homo sapiens
ccccatcctccctc

SEQ ID NO: 6078516 - DNA, 18 bp, Homo sapiens
ccccatcctcctgccccc

SEQ ID NO: 6078517 - DNA, 21 bp, Homo sapiens
cctccaagtggtccacaagct

SEQ ID NO: 6078518 - DNA, 21 bp, Homo sapiens
cctccaataaagtgccttctg

SEQ ID NO: 6078519 - DNA, 23 bp, Homo sapiens
cctccaatcccaccaaccctcag

SEQ ID NO: 6078520 - DNA, 17 bp, Homo sapiens
cctccaatccccactcc

SEQ ID NO: 6078521 - DNA, 15 bp, Homo sapiens
cctccaatcctgccc

SEQ ID NO: 6078522 - DNA, 19 bp, Homo sapiens
cctccaatcctttccaccc

SEQ ID NO: 6078523 - DNA, 17 bp, Homo sapiens
cctccaatgcattggcc

SEQ ID NO: 6078524 - DNA, 19 bp, Homo sapiens
cctccaatgcattggcctc

SEQ ID NO: 6078525 - DNA, 22 bp, Homo sapiens
cctccaatgcattggcctctgt

SEQ ID NO: 6078526 - DNA, 18 bp, Homo sapiens
cctccaatgtcctgaaac

SEQ ID NO: 6078527 - DNA, 21 bp, Homo sapiens
cctccacaaagagaccagggg

SEQ ID NO: 6078528 - DNA, 21 bp, Homo sapiens
cctccacaactcagtttcata

SEQ ID NO: 6078529 - DNA, 22 bp, Homo sapiens
cctccacacaaacctaaaaatt

SEQ ID NO: 6078530 - DNA, 21 bp, Homo sapiens
cctccacacaagggaaggaca

SEQ ID NO: 6078531 - DNA, 22 bp, Homo sapiens
cctccacaccagtggcctcgtg

SEQ ID NO: 6078532 - DNA, 13 bp, Homo sapiens
cctccacacccac

SEQ ID NO: 6078533 - DNA, 14 bp, Homo sapiens
cctccacacccacc

SEQ ID NO: 6078534 - DNA, 20 bp, Homo sapiens
cctccacacccaccccctct

SEQ ID NO: 6078535 - DNA, 19 bp, Homo sapiens
cctccacacccgcgccccg

SEQ ID NO: 6078536 - DNA, 17 bp, Homo sapiens
cctccacacctccaccc

SEQ ID NO: 6078537 - DNA, 18 bp, Homo sapiens
cctccacacctccacccg

SEQ ID NO: 6078538 - DNA, 15 bp, Homo sapiens
cctccacacctgcgg

SEQ ID NO: 6078539 - DNA, 17 bp, Homo sapiens
cctccacacctgcggcc

SEQ ID NO: 6078540 - DNA, 19 bp, Homo sapiens
cctccacagccccaacctc

SEQ ID NO: 6078541 - DNA, 15 bp, Homo sapiens
cctccacagccgcag

SEQ ID NO: 6078542 - DNA, 13 bp, Homo sapiens
cctccacagcgag

SEQ ID NO: 6078543 - DNA, 11 bp, Homo sapiens
cctccacagct

SEQ ID NO: 6078544 - DNA, 13 bp, Homo sapiens
cctccacaggagc

SEQ ID NO: 6078545 - DNA, 18 bp, Homo sapiens
cctccacagtagcatttc

SEQ ID NO: 6078546 - DNA, 17 bp, Homo sapiens
cctccacagtcccccac

SEQ ID NO: 6078547 - DNA, 17 bp, Homo sapiens
cctccacagtgctgctt

SEQ ID NO: 6078548 - DNA, 17 bp, Homo sapiens
cctccacagttcagtgg

SEQ ID NO: 6078549 - DNA, 12 bp, Homo sapiens
cctccacatcct

SEQ ID NO: 6078550 - DNA, 16 bp, Homo sapiens
cctccacatcctgtgt

SEQ ID NO: 6078551 - DNA, 19 bp, Homo sapiens
cctccacatgctgcctggc

SEQ ID NO: 6078552 - DNA, 15 bp, Homo sapiens
cctccacatttgttt

SEQ ID NO: 6078553 - DNA, 17 bp, Homo sapiens
cctccaccaaaccccac

SEQ ID NO: 6078554 - DNA, 22 bp, Homo sapiens
cctccaccaaccccgcggccca

SEQ ID NO: 6078555 - DNA, 19 bp, Homo sapiens
cctccaccacaagagctcc

SEQ ID NO: 6078556 - DNA, 22 bp, Homo sapiens
cctccaccacaagagctccttg

SEQ ID NO: 6078557 - DNA, 22 bp, Homo sapiens
cctccaccacatctgccagacc

SEQ ID NO: 6078558 - DNA, 17 bp, Homo sapiens
cctccaccaccactggc

SEQ ID NO: 6078559 - DNA, 19 bp, Homo sapiens
cctccaccaccactggcca

SEQ ID NO: 6078560 - DNA, 16 bp, Homo sapiens
cctccaccagcaaggg

SEQ ID NO: 6078561 - DNA, 22 bp, Homo sapiens
cctccaccagcctgctgacaga

SEQ ID NO: 6078562 - DNA, 22 bp, Homo sapiens
cctccaccatccccgcacaaag

SEQ ID NO: 6078563 - DNA, 22 bp, Homo sapiens
cctccaccatgcactcacccct

SEQ ID NO: 6078564 - DNA, 12 bp, Homo sapiens
cctccaccccag

SEQ ID NO: 6078565 - DNA, 15 bp, Homo sapiens
cctccaccccagtcc

SEQ ID NO: 6078566 - DNA, 22 bp, Homo sapiens
cctccacccccatgtggcagcc

SEQ ID NO: 6078567 - DNA, 17 bp, Homo sapiens
cctccaccccccagaac

SEQ ID NO: 6078568 - DNA, 20 bp, Homo sapiens
cctccacccccgccacggcc

SEQ ID NO: 6078569 - DNA, 13 bp, Homo sapiens
cctccacccgtcc

SEQ ID NO: 6078570 - DNA, 11 bp, Homo sapiens
cctccacccta

SEQ ID NO: 6078571 - DNA, 21 bp, Homo sapiens
cctccaccctaaagtctcagg

SEQ ID NO: 6078572 - DNA, 21 bp, Homo sapiens
cctccaccctgcattttcctc

SEQ ID NO: 6078573 - DNA, 16 bp, Homo sapiens
cctccaccctgccctg

SEQ ID NO: 6078574 - DNA, 17 bp, Homo sapiens
cctccaccctgccctgc

SEQ ID NO: 6078575 - DNA, 14 bp, Homo sapiens
cctccaccctgtcc

SEQ ID NO: 6078576 - DNA, 20 bp, Homo sapiens
cctccaccctgtcccccagc

SEQ ID NO: 6078577 - DNA, 21 bp, Homo sapiens
cctccaccctgtcccccagct

SEQ ID NO: 6078578 - DNA, 24 bp, Homo sapiens
cctccaccctgtcccccagctctg

SEQ ID NO: 6078579 - DNA, 19 bp, Homo sapiens
cctccaccgagccagcttg

SEQ ID NO: 6078580 - DNA, 13 bp, Homo sapiens
cctccaccgctgc

SEQ ID NO: 6078581 - DNA, 19 bp, Homo sapiens
cctccacctcaagaccccc

SEQ ID NO: 6078582 - DNA, 18 bp, Homo sapiens
cctccacctcccaccctg

SEQ ID NO: 6078583 - DNA, 14 bp, Homo sapiens
cctccacctccctg

SEQ ID NO: 6078584 - DNA, 22 bp, Homo sapiens
cctccacctccctgcaataaaa

SEQ ID NO: 6078585 - DNA, 22 bp, Homo sapiens
cctccacctctcacgggccctg

SEQ ID NO: 6078586 - DNA, 14 bp, Homo sapiens
cctccacctgcagc

SEQ ID NO: 6078587 - DNA, 21 bp, Homo sapiens
cctccaccttccattttcccc

SEQ ID NO: 6078588 - DNA, 17 bp, Homo sapiens
cctccaccttccgttcc

SEQ ID NO: 6078589 - DNA, 18 bp, Homo sapiens
cctccaccttccgttccc

SEQ ID NO: 6078590 - DNA, 23 bp, Homo sapiens
cctccaccttgctcttctttctg

SEQ ID NO: 6078591 - DNA, 19 bp, Homo sapiens
cctccacgcaaggctgtgc

SEQ ID NO: 6078592 - DNA, 21 bp, Homo sapiens
cctccacgcctcctggccaga

SEQ ID NO: 6078593 - DNA, 23 bp, Homo sapiens
cctccacggtccgcggcctgcac

SEQ ID NO: 6078594 - DNA, 22 bp, Homo sapiens
cctccacgtgtccgtccaccct

SEQ ID NO: 6078595 - DNA, 21 bp, Homo sapiens
cctccacgttctgctcatcat

SEQ ID NO: 6078596 - DNA, 20 bp, Homo sapiens
cctccactcaccacaagctg

SEQ ID NO: 6078597 - DNA, 23 bp, Homo sapiens
cctccactcaccacaagctgagc

SEQ ID NO: 6078598 - DNA, 16 bp, Homo sapiens
cctccactccacctcc

SEQ ID NO: 6078599 - DNA, 12 bp, Homo sapiens
cctccactccca

SEQ ID NO: 6078600 - DNA, 21 bp, Homo sapiens
cctccactcccacctcacccg

SEQ ID NO: 6078601 - DNA, 14 bp, Homo sapiens
cctccactcccact

SEQ ID NO: 6078602 - DNA, 18 bp, Homo sapiens
cctccactcccacttccc

SEQ ID NO: 6078603 - DNA, 12 bp, Homo sapiens
cctccactcccc

SEQ ID NO: 6078604 - DNA, 14 bp, Homo sapiens
cctccactccctgt

SEQ ID NO: 6078605 - DNA, 18 bp, Homo sapiens
cctccactccctgtctga

SEQ ID NO: 6078606 - DNA, 13 bp, Homo sapiens
cctccactcctcc

SEQ ID NO: 6078607 - DNA, 14 bp, Homo sapiens
cctccactcctccc

SEQ ID NO: 6078608 - DNA, 14 bp, Homo sapiens
cctccactcctctc

SEQ ID NO: 6078609 - DNA, 13 bp, Homo sapiens
cctccactccttc

SEQ ID NO: 6078610 - DNA, 11 bp, Homo sapiens
cctccactctg

SEQ ID NO: 6078611 - DNA, 15 bp, Homo sapiens
cctccactctgaggt

SEQ ID NO: 6078612 - DNA, 20 bp, Homo sapiens
cctccactctgaggtctcac

SEQ ID NO: 6078613 - DNA, 16 bp, Homo sapiens
cctccactgccctctg

SEQ ID NO: 6078614 - DNA, 23 bp, Homo sapiens
cctccacttcccgtctcagaatc

SEQ ID NO: 6078615 - DNA, 22 bp, Homo sapiens
cctccagaaccttactggcact

SEQ ID NO: 6078616 - DNA, 23 bp, Homo sapiens
cctccagaaccttactggcactg

SEQ ID NO: 6078617 - DNA, 12 bp, Homo sapiens
cctccagaactc

SEQ ID NO: 6078618 - DNA, 17 bp, Homo sapiens
cctccagaagcctctgg

SEQ ID NO: 6078619 - DNA, 19 bp, Homo sapiens
cctccagaagtcccttcaa

SEQ ID NO: 6078620 - DNA, 22 bp, Homo sapiens
cctccagaatggaactcaagct

SEQ ID NO: 6078621 - DNA, 17 bp, Homo sapiens
cctccagaccaccagcc

SEQ ID NO: 6078622 - DNA, 18 bp, Homo sapiens
cctccagaccaccagccg

SEQ ID NO: 6078623 - DNA, 14 bp, Homo sapiens
cctccagaccctgc

SEQ ID NO: 6078624 - DNA, 15 bp, Homo sapiens
cctccagaccctgcc

SEQ ID NO: 6078625 - DNA, 17 bp, Homo sapiens
cctccagaccctgcctg

SEQ ID NO: 6078626 - DNA, 18 bp, Homo sapiens
cctccagaccctgcctga

SEQ ID NO: 6078627 - DNA, 19 bp, Homo sapiens
cctccagaccctgcctgag

SEQ ID NO: 6078628 - DNA, 14 bp, Homo sapiens
cctccagactcagc

SEQ ID NO: 6078629 - DNA, 22 bp, Homo sapiens
cctccagactcgagagggctga

SEQ ID NO: 6078630 - DNA, 21 bp, Homo sapiens
cctccagactgcggagcagcc

SEQ ID NO: 6078631 - DNA, 23 bp, Homo sapiens
cctccagactgcggagcagcctc

SEQ ID NO: 6078632 - DNA, 13 bp, Homo sapiens
cctccagagaagc

SEQ ID NO: 6078633 - DNA, 14 bp, Homo sapiens
cctccagagacact

SEQ ID NO: 6078634 - DNA, 16 bp, Homo sapiens
cctccagagacactga

SEQ ID NO: 6078635 - DNA, 18 bp, Homo sapiens
cctccagagacactgagc

SEQ ID NO: 6078636 - DNA, 20 bp, Homo sapiens
cctccagagacactgagcca

SEQ ID NO: 6078637 - DNA, 20 bp, Homo sapiens
cctccagagacaggaaagaa

SEQ ID NO: 6078638 - DNA, 11 bp, Homo sapiens
cctccagagcc

SEQ ID NO: 6078639 - DNA, 13 bp, Homo sapiens
cctccagagccag

SEQ ID NO: 6078640 - DNA, 17 bp, Homo sapiens
cctccagagccagcctg

SEQ ID NO: 6078641 - DNA, 20 bp, Homo sapiens
cctccagagccagcctggga

SEQ ID NO: 6078642 - DNA, 16 bp, Homo sapiens
cctccagagcctgggc

SEQ ID NO: 6078643 - DNA, 18 bp, Homo sapiens
cctccagagcctgggcgc

SEQ ID NO: 6078644 - DNA, 20 bp, Homo sapiens
cctccagagctgtcctcctg

SEQ ID NO: 6078645 - DNA, 14 bp, Homo sapiens
cctccagaggtgga

SEQ ID NO: 6078646 - DNA, 17 bp, Homo sapiens
cctccagattattttct

SEQ ID NO: 6078647 - DNA, 12 bp, Homo sapiens
cctccagcacag

SEQ ID NO: 6078648 - DNA, 13 bp, Homo sapiens
cctccagcacaga

SEQ ID NO: 6078649 - DNA, 12 bp, Homo sapiens
cctccagcagac

SEQ ID NO: 6078650 - DNA, 13 bp, Homo sapiens
cctccagccacct

SEQ ID NO: 6078651 - DNA, 20 bp, Homo sapiens
cctccagccacttatttcca

SEQ ID NO: 6078652 - DNA, 15 bp, Homo sapiens
cctccagcccacagt

SEQ ID NO: 6078653 - DNA, 13 bp, Homo sapiens
cctccagcccctg

SEQ ID NO: 6078654 - DNA, 14 bp, Homo sapiens
cctccagcccctgt

SEQ ID NO: 6078655 - DNA, 14 bp, Homo sapiens
cctccagcccggga

SEQ ID NO: 6078656 - DNA, 15 bp, Homo sapiens
cctccagcccgggag

SEQ ID NO: 6078657 - DNA, 19 bp, Homo sapiens
cctccagcccgggagccta

SEQ ID NO: 6078658 - DNA, 13 bp, Homo sapiens
cctccagccctgg

SEQ ID NO: 6078659 - DNA, 14 bp, Homo sapiens
cctccagccctggg

SEQ ID NO: 6078660 - DNA, 20 bp, Homo sapiens
cctccagcccttcagacgag

SEQ ID NO: 6078661 - DNA, 12 bp, Homo sapiens
cctccagcctcc

SEQ ID NO: 6078662 - DNA, 15 bp, Homo sapiens
cctccagcctcccct

SEQ ID NO: 6078663 - DNA, 16 bp, Homo sapiens
cctccagcctcccctc

SEQ ID NO: 6078664 - DNA, 21 bp, Homo sapiens
cctccagcctccctgtctcca

SEQ ID NO: 6078665 - DNA, 22 bp, Homo sapiens
cctccagcctccctgtctccag

SEQ ID NO: 6078666 - DNA, 13 bp, Homo sapiens
cctccagcctctg

SEQ ID NO: 6078667 - DNA, 14 bp, Homo sapiens
cctccagcctctgt

SEQ ID NO: 6078668 - DNA, 15 bp, Homo sapiens
cctccagcctctgtt

SEQ ID NO: 6078669 - DNA, 16 bp, Homo sapiens
cctccagcctgaacag

SEQ ID NO: 6078670 - DNA, 13 bp, Homo sapiens
cctccagcctggt

SEQ ID NO: 6078671 - DNA, 20 bp, Homo sapiens
cctccagcctggtggcccag

SEQ ID NO: 6078672 - DNA, 21 bp, Homo sapiens
cctccagcctggtggcccagc

SEQ ID NO: 6078673 - DNA, 21 bp, Homo sapiens
cctccagcgagtaccccagcc

SEQ ID NO: 6078674 - DNA, 22 bp, Homo sapiens
cctccagcgagtaccccagcca

SEQ ID NO: 6078675 - DNA, 15 bp, Homo sapiens
cctccagctcagcag

SEQ ID NO: 6078676 - DNA, 18 bp, Homo sapiens
cctccagctcagcagtga

SEQ ID NO: 6078677 - DNA, 14 bp, Homo sapiens
cctccagctccagt

SEQ ID NO: 6078678 - DNA, 13 bp, Homo sapiens
cctccagctccca

SEQ ID NO: 6078679 - DNA, 16 bp, Homo sapiens
cctccagctcccactc

SEQ ID NO: 6078680 - DNA, 15 bp, Homo sapiens
cctccagctcctgcc

SEQ ID NO: 6078681 - DNA, 18 bp, Homo sapiens
cctccagctcctgccccg

SEQ ID NO: 6078682 - DNA, 22 bp, Homo sapiens
cctccagctctttcctccttcc

SEQ ID NO: 6078683 - DNA, 18 bp, Homo sapiens
cctccagctgcaccagag

SEQ ID NO: 6078684 - DNA, 19 bp, Homo sapiens
cctccagctgcaccagagc

SEQ ID NO: 6078685 - DNA, 12 bp, Homo sapiens
cctccagctgcg

SEQ ID NO: 6078686 - DNA, 13 bp, Homo sapiens
cctccagctgctg

SEQ ID NO: 6078687 - DNA, 11 bp, Homo sapiens
cctccagctgt

SEQ ID NO: 6078688 - DNA, 20 bp, Homo sapiens
cctccagctgtcagcctggt

SEQ ID NO: 6078689 - DNA, 12 bp, Homo sapiens
cctccagctgtt

SEQ ID NO: 6078690 - DNA, 22 bp, Homo sapiens
cctccagcttgtggagccccac

SEQ ID NO: 6078691 - DNA, 13 bp, Homo sapiens
cctccagctttcc

SEQ ID NO: 6078692 - DNA, 17 bp, Homo sapiens
cctccagctttcctgta

SEQ ID NO: 6078693 - DNA, 20 bp, Homo sapiens
cctccagcttttcctcaggg

SEQ ID NO: 6078694 - DNA, 17 bp, Homo sapiens
cctccaggaagaagcag

SEQ ID NO: 6078695 - DNA, 13 bp, Homo sapiens
cctccaggaagcc

SEQ ID NO: 6078696 - DNA, 19 bp, Homo sapiens
ccccatcctctgtacagag

SEQ ID NO: 6078697 - DNA, 22 bp, Homo sapiens
ccccatcctctgtacagagccc

SEQ ID NO: 6078698 - DNA, 15 bp, Homo sapiens
ccccatcctgggcct

SEQ ID NO: 6078699 - DNA, 23 bp, Homo sapiens
ccccatcctggggttgccctggg

SEQ ID NO: 6078700 - DNA, 17 bp, Homo sapiens
ccccatccttcccgcag

SEQ ID NO: 6078701 - DNA, 13 bp, Homo sapiens
ccccatcgctctg

SEQ ID NO: 6078702 - DNA, 14 bp, Homo sapiens
ccccatcggccctg

SEQ ID NO: 6078703 - DNA, 20 bp, Homo sapiens
ccccatcgttacccatttct

SEQ ID NO: 6078704 - DNA, 19 bp, Homo sapiens
ccccatcgttgcccccatt

SEQ ID NO: 6078705 - DNA, 14 bp, Homo sapiens
ccccatctcactct

SEQ ID NO: 6078706 - DNA, 17 bp, Homo sapiens
ccccatctcatcctggc

SEQ ID NO: 6078707 - DNA, 23 bp, Homo sapiens
ccccatctcatgcccctggctgg

SEQ ID NO: 6078708 - DNA, 13 bp, Homo sapiens
ccccatctccatt

SEQ ID NO: 6078709 - DNA, 14 bp, Homo sapiens
ccccatctccccag

SEQ ID NO: 6078710 - DNA, 19 bp, Homo sapiens
ccccatctccccaggcctc

SEQ ID NO: 6078711 - DNA, 20 bp, Homo sapiens
ccccatctccccaggcctcc

SEQ ID NO: 6078712 - DNA, 13 bp, Homo sapiens
ccccatctctcat

SEQ ID NO: 6078713 - DNA, 15 bp, Homo sapiens
ccccatctctgtctg

SEQ ID NO: 6078714 - DNA, 16 bp, Homo sapiens
ccccatctctgtctgg

SEQ ID NO: 6078715 - DNA, 16 bp, Homo sapiens
ccccatctgcattccc

SEQ ID NO: 6078716 - DNA, 14 bp, Homo sapiens
ccccatctgctgag

SEQ ID NO: 6078717 - DNA, 14 bp, Homo sapiens
ccccatctgggtcc

SEQ ID NO: 6078718 - DNA, 21 bp, Homo sapiens
ccccatctgtccagctggggc

SEQ ID NO: 6078719 - DNA, 17 bp, Homo sapiens
ccccatctgtcttcagc

SEQ ID NO: 6078720 - DNA, 13 bp, Homo sapiens
ccccatctgtgaa

SEQ ID NO: 6078721 - DNA, 17 bp, Homo sapiens
ccccatcttcacccagg

SEQ ID NO: 6078722 - DNA, 19 bp, Homo sapiens
ccccatcttcgggaccagg

SEQ ID NO: 6078723 - DNA, 20 bp, Homo sapiens
ccccatcttgatctttgagc

SEQ ID NO: 6078724 - DNA, 14 bp, Homo sapiens
ccccatcttggtcc

SEQ ID NO: 6078725 - DNA, 20 bp, Homo sapiens
ccccatgaagccacagccca

SEQ ID NO: 6078726 - DNA, 13 bp, Homo sapiens
ccccatgacctcc

SEQ ID NO: 6078727 - DNA, 15 bp, Homo sapiens
ccccatgaggaagga

SEQ ID NO: 6078728 - DNA, 14 bp, Homo sapiens
ccccatgaggctca

SEQ ID NO: 6078729 - DNA, 17 bp, Homo sapiens
ccccatgattccctcct

SEQ ID NO: 6078730 - DNA, 19 bp, Homo sapiens
ccccatgcactgtgaagga

SEQ ID NO: 6078731 - DNA, 13 bp, Homo sapiens
ccccatgcagtct

SEQ ID NO: 6078732 - DNA, 19 bp, Homo sapiens
ccccatgccaccacccacc

SEQ ID NO: 6078733 - DNA, 17 bp, Homo sapiens
ccccatgcccctcccct

SEQ ID NO: 6078734 - DNA, 14 bp, Homo sapiens
ccccatgccctccc

SEQ ID NO: 6078735 - DNA, 13 bp, Homo sapiens
ccccatgcctgtc

SEQ ID NO: 6078736 - DNA, 19 bp, Homo sapiens
ccccatgcctgtccagcct

SEQ ID NO: 6078737 - DNA, 20 bp, Homo sapiens
ccccatgcctgtccagcctg

SEQ ID NO: 6078738 - DNA, 23 bp, Homo sapiens
ccccatgcctgtccagcctgggc

SEQ ID NO: 6078739 - DNA, 15 bp, Homo sapiens
ccccatgctctgccc

SEQ ID NO: 6078740 - DNA, 22 bp, Homo sapiens
ccccatgctctgccccaagccc

SEQ ID NO: 6078741 - DNA, 18 bp, Homo sapiens
ccccatgctgccttcagg

SEQ ID NO: 6078742 - DNA, 18 bp, Homo sapiens
ccccatgctggagcctgt

SEQ ID NO: 6078743 - DNA, 19 bp, Homo sapiens
ccccatgctggagcctgtg

SEQ ID NO: 6078744 - DNA, 21 bp, Homo sapiens
ccccatgctggagcctgtgta

SEQ ID NO: 6078745 - DNA, 22 bp, Homo sapiens
ccccatgctggagcctgtgtaa

SEQ ID NO: 6078746 - DNA, 15 bp, Homo sapiens
ccccatgctggaggt

SEQ ID NO: 6078747 - DNA, 13 bp, Homo sapiens
ccccatgctggcc

SEQ ID NO: 6078748 - DNA, 14 bp, Homo sapiens
ccccatgctgggct

SEQ ID NO: 6078749 - DNA, 23 bp, Homo sapiens
ccccatgcttaacatacccgcct

SEQ ID NO: 6078750 - DNA, 24 bp, Homo sapiens
ccccatgcttccttgcctgatgac

SEQ ID NO: 6078751 - DNA, 15 bp, Homo sapiens
ccccatggaacagcc

SEQ ID NO: 6078752 - DNA, 19 bp, Homo sapiens
ccccatggaacagccctgc

SEQ ID NO: 6078753 - DNA, 22 bp, Homo sapiens
ccccatggagacaataaacagc

SEQ ID NO: 6078754 - DNA, 15 bp, Homo sapiens
ccccatggcagctcc

SEQ ID NO: 6078755 - DNA, 20 bp, Homo sapiens
ccccatggccccaggcccac

SEQ ID NO: 6078756 - DNA, 13 bp, Homo sapiens
ccccatggccctg

SEQ ID NO: 6078757 - DNA, 17 bp, Homo sapiens
ccccatggccctgagcg

SEQ ID NO: 6078758 - DNA, 22 bp, Homo sapiens
ccccatgggaagacgaggccct

SEQ ID NO: 6078759 - DNA, 23 bp, Homo sapiens
ccccatgggcctcatgaataaat

SEQ ID NO: 6078760 - DNA, 17 bp, Homo sapiens
ccccatgggctcctgcc

SEQ ID NO: 6078761 - DNA, 20 bp, Homo sapiens
ccccatgggctcctgcccct

SEQ ID NO: 6078762 - DNA, 12 bp, Homo sapiens
ccccatgggctg

SEQ ID NO: 6078763 - DNA, 13 bp, Homo sapiens
ccccatgggctgc

SEQ ID NO: 6078764 - DNA, 17 bp, Homo sapiens
ccccatgggctgtgtcc

SEQ ID NO: 6078765 - DNA, 23 bp, Homo sapiens
ccccatgggctgtgtcctaaggc

SEQ ID NO: 6078766 - DNA, 14 bp, Homo sapiens
ccccatgggcttgg

SEQ ID NO: 6078767 - DNA, 15 bp, Homo sapiens
ccccatggggtcctt

SEQ ID NO: 6078768 - DNA, 19 bp, Homo sapiens
ccccatggtcagccctagg

SEQ ID NO: 6078769 - DNA, 18 bp, Homo sapiens
ccccatggtccatcccct

SEQ ID NO: 6078770 - DNA, 19 bp, Homo sapiens
ccccatggtgcagtgaaga

SEQ ID NO: 6078771 - DNA, 15 bp, Homo sapiens
ccccatgtctctcag

SEQ ID NO: 6078772 - DNA, 23 bp, Homo sapiens
ccccatgtgcctgcaccaggaga

SEQ ID NO: 6078773 - DNA, 21 bp, Homo sapiens
ccccatgtgccttgtccagga

SEQ ID NO: 6078774 - DNA, 20 bp, Homo sapiens
ccccatgtggcagcccatgg

SEQ ID NO: 6078775 - DNA, 23 bp, Homo sapiens
ccccatgtgggtgaccaggtcct

SEQ ID NO: 6078776 - DNA, 18 bp, Homo sapiens
ccccatgtgtcctggttc

SEQ ID NO: 6078777 - DNA, 15 bp, Homo sapiens
ccccatgttctgtcc

SEQ ID NO: 6078778 - DNA, 17 bp, Homo sapiens
ccccattagctttcaat

SEQ ID NO: 6078779 - DNA, 20 bp, Homo sapiens
ccccattcagaactctcaga

SEQ ID NO: 6078780 - DNA, 20 bp, Homo sapiens
ccccattcctgatcccatgg

SEQ ID NO: 6078781 - DNA, 23 bp, Homo sapiens
ccccattcctgggaaatattccc

SEQ ID NO: 6078782 - DNA, 13 bp, Homo sapiens
ccccattccttgc

SEQ ID NO: 6078783 - DNA, 15 bp, Homo sapiens
ccccattctcccagt

SEQ ID NO: 6078784 - DNA, 14 bp, Homo sapiens
ccccattctgcctg

SEQ ID NO: 6078785 - DNA, 21 bp, Homo sapiens
ccccattcttcctagttttct

SEQ ID NO: 6078786 - DNA, 22 bp, Homo sapiens
ccccattctttgcttgaacaca

SEQ ID NO: 6078787 - DNA, 16 bp, Homo sapiens
ccccattgctccattc

SEQ ID NO: 6078788 - DNA, 18 bp, Homo sapiens
ccccattgtgaatgttgt

SEQ ID NO: 6078789 - DNA, 15 bp, Homo sapiens
ccccattgtggtcac

SEQ ID NO: 6078790 - DNA, 18 bp, Homo sapiens
ccccatttaggtttctga

SEQ ID NO: 6078791 - DNA, 17 bp, Homo sapiens
ccccatttatccacctc

SEQ ID NO: 6078792 - DNA, 19 bp, Homo sapiens
ccccatttcccatctgcac

SEQ ID NO: 6078793 - DNA, 22 bp, Homo sapiens
ccccatttcccatctgcacccc

SEQ ID NO: 6078794 - DNA, 16 bp, Homo sapiens
ccccatttcctcacac

SEQ ID NO: 6078795 - DNA, 14 bp, Homo sapiens
ccccatttcctgta

SEQ ID NO: 6078796 - DNA, 20 bp, Homo sapiens
ccccatttctatttatttac

SEQ ID NO: 6078797 - DNA, 19 bp, Homo sapiens
ccccatttctgcctcgctc

SEQ ID NO: 6078798 - DNA, 19 bp, Homo sapiens
cccccaaaccctgcttctg

SEQ ID NO: 6078799 - DNA, 15 bp, Homo sapiens
cccccaaagacctgc

SEQ ID NO: 6078800 - DNA, 17 bp, Homo sapiens
cccccaaagagctgtgg

SEQ ID NO: 6078801 - DNA, 18 bp, Homo sapiens
cccccaaagagctgtggc

SEQ ID NO: 6078802 - DNA, 22 bp, Homo sapiens
cccccaaagcaatgtgagtccc

SEQ ID NO: 6078803 - DNA, 20 bp, Homo sapiens
cccccaacaccaccccttgc

SEQ ID NO: 6078804 - DNA, 15 bp, Homo sapiens
cccccaacactccag

SEQ ID NO: 6078805 - DNA, 19 bp, Homo sapiens
cccccaacactccaggccc

SEQ ID NO: 6078806 - DNA, 15 bp, Homo sapiens
cccccaacactgagc

SEQ ID NO: 6078807 - DNA, 16 bp, Homo sapiens
cccccaacactgtgcc

SEQ ID NO: 6078808 - DNA, 20 bp, Homo sapiens
cccccaacactgtgccctgg

SEQ ID NO: 6078809 - DNA, 22 bp, Homo sapiens
cccccaacactgtgccctggtg

SEQ ID NO: 6078810 - DNA, 23 bp, Homo sapiens
cccccaaccaagtggctcccaca

SEQ ID NO: 6078811 - DNA, 15 bp, Homo sapiens
cccccaacccccaga

SEQ ID NO: 6078812 - DNA, 16 bp, Homo sapiens
cccccaaccccctgca

SEQ ID NO: 6078813 - DNA, 22 bp, Homo sapiens
cccccaacccctcctccctcag

SEQ ID NO: 6078814 - DNA, 18 bp, Homo sapiens
cccccaacccctgaggaa

SEQ ID NO: 6078815 - DNA, 14 bp, Homo sapiens
cccccaacctcagg

SEQ ID NO: 6078816 - DNA, 15 bp, Homo sapiens
cccccaacctcaggg

SEQ ID NO: 6078817 - DNA, 20 bp, Homo sapiens
cccccaactctgagcccatg

SEQ ID NO: 6078818 - DNA, 18 bp, Homo sapiens
cccccaactcttcctccc

SEQ ID NO: 6078819 - DNA, 23 bp, Homo sapiens
cccccaactgtggtagctccagc

SEQ ID NO: 6078820 - DNA, 21 bp, Homo sapiens
cccccaacttcaccaccccct

SEQ ID NO: 6078821 - DNA, 11 bp, Homo sapiens
cccccaagcct

SEQ ID NO: 6078822 - DNA, 14 bp, Homo sapiens
cccccaagcctgca

SEQ ID NO: 6078823 - DNA, 19 bp, Homo sapiens
cccccaagctgttttcttc

SEQ ID NO: 6078824 - DNA, 16 bp, Homo sapiens
cccccaaggggcagtc

SEQ ID NO: 6078825 - DNA, 12 bp, Homo sapiens
cccccaataaac

SEQ ID NO: 6078826 - DNA, 14 bp, Homo sapiens
cccccaataaacca

SEQ ID NO: 6078827 - DNA, 12 bp, Homo sapiens
cccccaataaag

SEQ ID NO: 6078828 - DNA, 15 bp, Homo sapiens
cccccaataaaggca

SEQ ID NO: 6078829 - DNA, 16 bp, Homo sapiens
cccccaataaaggcag

SEQ ID NO: 6078830 - DNA, 19 bp, Homo sapiens
cccccaataaaggcagctg

SEQ ID NO: 6078831 - DNA, 23 bp, Homo sapiens
cccccaataaaggcagctgcctc

SEQ ID NO: 6078832 - DNA, 21 bp, Homo sapiens
cccccaatgaccttagcccca

SEQ ID NO: 6078833 - DNA, 17 bp, Homo sapiens
cccccacaaggaaccct

SEQ ID NO: 6078834 - DNA, 12 bp, Homo sapiens
cccccacacaca

SEQ ID NO: 6078835 - DNA, 14 bp, Homo sapiens
cccccacacacact

SEQ ID NO: 6078836 - DNA, 14 bp, Homo sapiens
cccccacagatcca

SEQ ID NO: 6078837 - DNA, 15 bp, Homo sapiens
cccccacagccctgg

SEQ ID NO: 6078838 - DNA, 14 bp, Homo sapiens
cccccacagcgctc

SEQ ID NO: 6078839 - DNA, 16 bp, Homo sapiens
cccccacagctccttg

SEQ ID NO: 6078840 - DNA, 18 bp, Homo sapiens
cccccacagctccttgca

SEQ ID NO: 6078841 - DNA, 20 bp, Homo sapiens
cccccacattctggctccac

SEQ ID NO: 6078842 - DNA, 17 bp, Homo sapiens
cccccaccacactgaat

SEQ ID NO: 6078843 - DNA, 22 bp, Homo sapiens
cccccaccacggccactggcca

SEQ ID NO: 6078844 - DNA, 14 bp, Homo sapiens
cccccaccagacat

SEQ ID NO: 6078845 - DNA, 14 bp, Homo sapiens
cccccaccagcagc

SEQ ID NO: 6078846 - DNA, 20 bp, Homo sapiens
cccccaccaggggaaggaag

SEQ ID NO: 6078847 - DNA, 14 bp, Homo sapiens
cccccaccagtgta

SEQ ID NO: 6078848 - DNA, 16 bp, Homo sapiens
cccccaccattccaca

SEQ ID NO: 6078849 - DNA, 13 bp, Homo sapiens
cccccacccaagg

SEQ ID NO: 6078850 - DNA, 24 bp, Homo sapiens
cccccacccaagggcctggcctga

SEQ ID NO: 6078851 - DNA, 12 bp, Homo sapiens
cccccacccacc

SEQ ID NO: 6078852 - DNA, 19 bp, Homo sapiens
cccccacccacccccaggc

SEQ ID NO: 6078853 - DNA, 21 bp, Homo sapiens
cccccacccacccccaggcct

SEQ ID NO: 6078854 - DNA, 14 bp, Homo sapiens
cccccacccacctt

SEQ ID NO: 6078855 - DNA, 15 bp, Homo sapiens
cccccaccccagagt

SEQ ID NO: 6078856 - DNA, 17 bp, Homo sapiens
cccccaccccagcacag

SEQ ID NO: 6078857 - DNA, 14 bp, Homo sapiens
cccccacccccagc

SEQ ID NO: 6078858 - DNA, 14 bp, Homo sapiens
cccccacccctcca

SEQ ID NO: 6078859 - DNA, 14 bp, Homo sapiens
cccccacccctggc

SEQ ID NO: 6078860 - DNA, 13 bp, Homo sapiens
cccccaccctcca

SEQ ID NO: 6078861 - DNA, 18 bp, Homo sapiens
cccccaccctgttcctgc

SEQ ID NO: 6078862 - DNA, 13 bp, Homo sapiens
cccccaccgggct

SEQ ID NO: 6078863 - DNA, 18 bp, Homo sapiens
cccccaccggtccagctg

SEQ ID NO: 6078864 - DNA, 20 bp, Homo sapiens
cccccacctctgctgcctcc

SEQ ID NO: 6078865 - DNA, 14 bp, Homo sapiens
cccccacctctggt

SEQ ID NO: 6078866 - DNA, 16 bp, Homo sapiens
cccccacctctggtcc

SEQ ID NO: 6078867 - DNA, 13 bp, Homo sapiens
cccccacctgcag

SEQ ID NO: 6078868 - DNA, 23 bp, Homo sapiens
cccccacctgcagcgctgggccc

SEQ ID NO: 6078869 - DNA, 15 bp, Homo sapiens
cccccacctggctca

SEQ ID NO: 6078870 - DNA, 20 bp, Homo sapiens
cccccacctggctcaccttg

SEQ ID NO: 6078871 - DNA, 15 bp, Homo sapiens
cccccacggccgtcc

SEQ ID NO: 6078872 - DNA, 19 bp, Homo sapiens
cccccacggccgtccctga

SEQ ID NO: 6078873 - DNA, 18 bp, Homo sapiens
cccccacgtctctctgcc

SEQ ID NO: 6078874 - DNA, 22 bp, Homo sapiens
cccccacgtctctctgcctgct

SEQ ID NO: 6078875 - DNA, 15 bp, Homo sapiens
cctccaggaagcctt

SEQ ID NO: 6078876 - DNA, 22 bp, Homo sapiens
cctccaggaatgatctcttctt

SEQ ID NO: 6078877 - DNA, 23 bp, Homo sapiens
cctccaggaccttgcttccttct

SEQ ID NO: 6078878 - DNA, 19 bp, Homo sapiens
cctccaggagaaggggccc

SEQ ID NO: 6078879 - DNA, 20 bp, Homo sapiens
cctccaggagaaggggccca

SEQ ID NO: 6078880 - DNA, 23 bp, Homo sapiens
cctccaggagaaggggcccaagg

SEQ ID NO: 6078881 - DNA, 14 bp, Homo sapiens
cctccaggagagag

SEQ ID NO: 6078882 - DNA, 16 bp, Homo sapiens
cctccaggagagagcc

SEQ ID NO: 6078883 - DNA, 19 bp, Homo sapiens
cctccaggagagagccagg

SEQ ID NO: 6078884 - DNA, 12 bp, Homo sapiens
cctccaggagct

SEQ ID NO: 6078885 - DNA, 18 bp, Homo sapiens
cctccaggagcttcttgt

SEQ ID NO: 6078886 - DNA, 19 bp, Homo sapiens
cctccaggagcttcttgtt

SEQ ID NO: 6078887 - DNA, 19 bp, Homo sapiens
cctccaggagggaccaccc

SEQ ID NO: 6078888 - DNA, 17 bp, Homo sapiens
cctccaggaggggcctg

SEQ ID NO: 6078889 - DNA, 23 bp, Homo sapiens
cctccaggaggggcctgggcagc

SEQ ID NO: 6078890 - DNA, 19 bp, Homo sapiens
cctccaggcaggccaggct

SEQ ID NO: 6078891 - DNA, 22 bp, Homo sapiens
cctccaggcatgctggcctccc

SEQ ID NO: 6078892 - DNA, 16 bp, Homo sapiens
cctccaggcccatctc

SEQ ID NO: 6078893 - DNA, 12 bp, Homo sapiens
cctccaggcctg

SEQ ID NO: 6078894 - DNA, 15 bp, Homo sapiens
cctccaggcctgcct

SEQ ID NO: 6078895 - DNA, 14 bp, Homo sapiens
cctccaggctccag

SEQ ID NO: 6078896 - DNA, 15 bp, Homo sapiens
cctccaggctggggc

SEQ ID NO: 6078897 - DNA, 17 bp, Homo sapiens
cctccaggctggggcct

SEQ ID NO: 6078898 - DNA, 22 bp, Homo sapiens
cctccaggctggggcctggcct

SEQ ID NO: 6078899 - DNA, 19 bp, Homo sapiens
cctccagggaaggtggcca

SEQ ID NO: 6078900 - DNA, 18 bp, Homo sapiens
cctccagggaatccgcct

SEQ ID NO: 6078901 - DNA, 20 bp, Homo sapiens
cctccagggaatccgcctgc

SEQ ID NO: 6078902 - DNA, 13 bp, Homo sapiens
cctccagggacag

SEQ ID NO: 6078903 - DNA, 12 bp, Homo sapiens
cctccagggcca

SEQ ID NO: 6078904 - DNA, 16 bp, Homo sapiens
cctccagggccacgtg

SEQ ID NO: 6078905 - DNA, 17 bp, Homo sapiens
cctccagggccacgtgc

SEQ ID NO: 6078906 - DNA, 18 bp, Homo sapiens
cctccagggccacgtgcc

SEQ ID NO: 6078907 - DNA, 14 bp, Homo sapiens
cctccagggccagg

SEQ ID NO: 6078908 - DNA, 12 bp, Homo sapiens
cctccagggccc

SEQ ID NO: 6078909 - DNA, 14 bp, Homo sapiens
cctccagggccccc

SEQ ID NO: 6078910 - DNA, 16 bp, Homo sapiens
cctccagggcccccca

SEQ ID NO: 6078911 - DNA, 13 bp, Homo sapiens
cctccagggctgg

SEQ ID NO: 6078912 - DNA, 20 bp, Homo sapiens
cctccagggctggactgagg

SEQ ID NO: 6078913 - DNA, 17 bp, Homo sapiens
cctccaggggctcctgg

SEQ ID NO: 6078914 - DNA, 20 bp, Homo sapiens
cctccaggggctcctgggtt

SEQ ID NO: 6078915 - DNA, 17 bp, Homo sapiens
cctccagggggcctgca

SEQ ID NO: 6078916 - DNA, 12 bp, Homo sapiens
cctccagggtcc

SEQ ID NO: 6078917 - DNA, 13 bp, Homo sapiens
cctccagggtcct

SEQ ID NO: 6078918 - DNA, 22 bp, Homo sapiens
cctccaggtcggagtgcctgga

SEQ ID NO: 6078919 - DNA, 21 bp, Homo sapiens
cctccaggtgcacaagctcca

SEQ ID NO: 6078920 - DNA, 22 bp, Homo sapiens
cctccaggtgcacaagctccaa

SEQ ID NO: 6078921 - DNA, 19 bp, Homo sapiens
cctccaggtgtgcacgtgg

SEQ ID NO: 6078922 - DNA, 19 bp, Homo sapiens
cctccaggtttttcaatta

SEQ ID NO: 6078923 - DNA, 20 bp, Homo sapiens
cctccaggtttttcaattaa

SEQ ID NO: 6078924 - DNA, 21 bp, Homo sapiens
cctccaggtttttcaattaaa

SEQ ID NO: 6078925 - DNA, 22 bp, Homo sapiens
cctccagtattgccccctctca

SEQ ID NO: 6078926 - DNA, 12 bp, Homo sapiens
cctccagtcaca

SEQ ID NO: 6078927 - DNA, 15 bp, Homo sapiens
cctccagtcacactc

SEQ ID NO: 6078928 - DNA, 12 bp, Homo sapiens
cctccagtccag

SEQ ID NO: 6078929 - DNA, 19 bp, Homo sapiens
cctccagtccagtttccca

SEQ ID NO: 6078930 - DNA, 13 bp, Homo sapiens
cctccagtcctgc

SEQ ID NO: 6078931 - DNA, 14 bp, Homo sapiens
cctccagtcctgct

SEQ ID NO: 6078932 - DNA, 16 bp, Homo sapiens
cctccagtcctgctgg

SEQ ID NO: 6078933 - DNA, 17 bp, Homo sapiens
cctccagtcctgctggc

SEQ ID NO: 6078934 - DNA, 19 bp, Homo sapiens
cctccagtcctgctggcct

SEQ ID NO: 6078935 - DNA, 21 bp, Homo sapiens
cctccagtcctgctggcctgc

SEQ ID NO: 6078936 - DNA, 22 bp, Homo sapiens
cctccagtcctgctggcctgct

SEQ ID NO: 6078937 - DNA, 21 bp, Homo sapiens
cctccagtcgttatttctgtt

SEQ ID NO: 6078938 - DNA, 16 bp, Homo sapiens
cctccagtctgttctc

SEQ ID NO: 6078939 - DNA, 14 bp, Homo sapiens
cctccagtgctggc

SEQ ID NO: 6078940 - DNA, 18 bp, Homo sapiens
cctccagtgcttggctgc

SEQ ID NO: 6078941 - DNA, 23 bp, Homo sapiens
cctccagtgggaggacagagccg

SEQ ID NO: 6078942 - DNA, 19 bp, Homo sapiens
cctccagtgggctgatgct

SEQ ID NO: 6078943 - DNA, 23 bp, Homo sapiens
cctccagtgggctgatgctggga

SEQ ID NO: 6078944 - DNA, 16 bp, Homo sapiens
cctccagttctgatga

SEQ ID NO: 6078945 - DNA, 19 bp, Homo sapiens
cctccagttctgatgaggc

SEQ ID NO: 6078946 - DNA, 18 bp, Homo sapiens
cctccagttgtagcaggt

SEQ ID NO: 6078947 - DNA, 15 bp, Homo sapiens
cctccataagtttaa

SEQ ID NO: 6078948 - DNA, 16 bp, Homo sapiens
cctccataagtttaac

SEQ ID NO: 6078949 - DNA, 23 bp, Homo sapiens
cctccatacctcgaacatcagtt

SEQ ID NO: 6078950 - DNA, 21 bp, Homo sapiens
cctccatactcaagctgtctc

SEQ ID NO: 6078951 - DNA, 23 bp, Homo sapiens
cctccatcaaacctcacatttgt

SEQ ID NO: 6078952 - DNA, 13 bp, Homo sapiens
cctccatcacccc

SEQ ID NO: 6078953 - DNA, 23 bp, Homo sapiens
cctccatcacccctggtggctgc

SEQ ID NO: 6078954 - DNA, 20 bp, Homo sapiens
cctccatccacccctctggc

SEQ ID NO: 6078955 - DNA, 12 bp, Homo sapiens
cctccatccacg

SEQ ID NO: 6078956 - DNA, 17 bp, Homo sapiens
cctccatccatgtgttc

SEQ ID NO: 6078957 - DNA, 15 bp, Homo sapiens
cctccatcccgacat

SEQ ID NO: 6078958 - DNA, 12 bp, Homo sapiens
cctccatccctg

SEQ ID NO: 6078959 - DNA, 16 bp, Homo sapiens
cctccatccctggccc

SEQ ID NO: 6078960 - DNA, 19 bp, Homo sapiens
cctccatcccttccccaga

SEQ ID NO: 6078961 - DNA, 22 bp, Homo sapiens
cctccatcctaccccctgtgcc

SEQ ID NO: 6078962 - DNA, 23 bp, Homo sapiens
cctccatcctaccccctgtgcct

SEQ ID NO: 6078963 - DNA, 18 bp, Homo sapiens
cctccatcctcatctctc

SEQ ID NO: 6078964 - DNA, 18 bp, Homo sapiens
cctccatcctcctccttc

SEQ ID NO: 6078965 - DNA, 14 bp, Homo sapiens
cctccatcctgagg

SEQ ID NO: 6078966 - DNA, 18 bp, Homo sapiens
cctccatctaaactgccc

SEQ ID NO: 6078967 - DNA, 23 bp, Homo sapiens
cctccatctccaagaatgctgaa

SEQ ID NO: 6078968 - DNA, 14 bp, Homo sapiens
cctccatctgggga

SEQ ID NO: 6078969 - DNA, 15 bp, Homo sapiens
cctccatctttctac

SEQ ID NO: 6078970 - DNA, 19 bp, Homo sapiens
cctccatgactgcacagta

SEQ ID NO: 6078971 - DNA, 19 bp, Homo sapiens
cctccatgattccaagggc

SEQ ID NO: 6078972 - DNA, 23 bp, Homo sapiens
cctccatgcactttatgtggaga

SEQ ID NO: 6078973 - DNA, 20 bp, Homo sapiens
cctccatgccccagctctgg

SEQ ID NO: 6078974 - DNA, 20 bp, Homo sapiens
cctccatgcccccgccacct

SEQ ID NO: 6078975 - DNA, 23 bp, Homo sapiens
cctccatgcccccgccacctccc

SEQ ID NO: 6078976 - DNA, 14 bp, Homo sapiens
cctccatgctcctc

SEQ ID NO: 6078977 - DNA, 18 bp, Homo sapiens
cctccatgctcctcacct

SEQ ID NO: 6078978 - DNA, 19 bp, Homo sapiens
cctccatgctcctcacctg

SEQ ID NO: 6078979 - DNA, 20 bp, Homo sapiens
cctccatgctcctcacctgt

SEQ ID NO: 6078980 - DNA, 15 bp, Homo sapiens
cctccatgctgtccc

SEQ ID NO: 6078981 - DNA, 16 bp, Homo sapiens
cctccatgctgtccct

SEQ ID NO: 6078982 - DNA, 17 bp, Homo sapiens
cctccatggcagcagcc

SEQ ID NO: 6078983 - DNA, 20 bp, Homo sapiens
cctccatggcagcagccagg

SEQ ID NO: 6078984 - DNA, 18 bp, Homo sapiens
cctccatgggccccaggg

SEQ ID NO: 6078985 - DNA, 21 bp, Homo sapiens
cctccatgggggctcagccag

SEQ ID NO: 6078986 - DNA, 15 bp, Homo sapiens
cctccatggtgcctc

SEQ ID NO: 6078987 - DNA, 12 bp, Homo sapiens
cctccatgtcat

SEQ ID NO: 6078988 - DNA, 15 bp, Homo sapiens
cctccatgtggcccc

SEQ ID NO: 6078989 - DNA, 23 bp, Homo sapiens
cctccatgtggccccaggtgcca

SEQ ID NO: 6078990 - DNA, 16 bp, Homo sapiens
cctccattatccattc

SEQ ID NO: 6078991 - DNA, 23 bp, Homo sapiens
cctccattcatccttccatccat

SEQ ID NO: 6078992 - DNA, 14 bp, Homo sapiens
cctccattcctgct

SEQ ID NO: 6078993 - DNA, 20 bp, Homo sapiens
cctccattggctcccaagtc

SEQ ID NO: 6078994 - DNA, 21 bp, Homo sapiens
cctccattgggcacagtccag

SEQ ID NO: 6078995 - DNA, 22 bp, Homo sapiens
cctccattgggcacagtccaga

SEQ ID NO: 6078996 - DNA, 17 bp, Homo sapiens
cctccatttcaactcca

SEQ ID NO: 6078997 - DNA, 13 bp, Homo sapiens
cctccatttccca

SEQ ID NO: 6078998 - DNA, 21 bp, Homo sapiens
cctccatttcccaaagtcctc

SEQ ID NO: 6078999 - DNA, 20 bp, Homo sapiens
cctccatttctctccaggaa

SEQ ID NO: 6079000 - DNA, 22 bp, Homo sapiens
cctccatttctctccaggaagt

SEQ ID NO: 6079001 - DNA, 24 bp, Homo sapiens
cctccatttctggcttctagtctg

SEQ ID NO: 6079002 - DNA, 12 bp, Homo sapiens
cctccattttct

SEQ ID NO: 6079003 - DNA, 14 bp, Homo sapiens
cctccatttttctc

SEQ ID NO: 6079004 - DNA, 14 bp, Homo sapiens
cctcccaaaagact

SEQ ID NO: 6079005 - DNA, 18 bp, Homo sapiens
cctcccaaaatgctggga

SEQ ID NO: 6079006 - DNA, 13 bp, Homo sapiens
cctcccaaagagg

SEQ ID NO: 6079007 - DNA, 14 bp, Homo sapiens
cctcccaaagtgct

SEQ ID NO: 6079008 - DNA, 15 bp, Homo sapiens
cctcccaaagtgctg

SEQ ID NO: 6079009 - DNA, 15 bp, Homo sapiens
cctcccaacagagct

SEQ ID NO: 6079010 - DNA, 20 bp, Homo sapiens
cctcccaaccaaccagcagg

SEQ ID NO: 6079011 - DNA, 13 bp, Homo sapiens
cctcccaacccag

SEQ ID NO: 6079012 - DNA, 13 bp, Homo sapiens
cctcccaacctca

SEQ ID NO: 6079013 - DNA, 14 bp, Homo sapiens
cctcccaactcacc

SEQ ID NO: 6079014 - DNA, 23 bp, Homo sapiens
cctcccaactcaccccagcccca

SEQ ID NO: 6079015 - DNA, 12 bp, Homo sapiens
cctcccaactct

SEQ ID NO: 6079016 - DNA, 17 bp, Homo sapiens
cctcccaactctggcct

SEQ ID NO: 6079017 - DNA, 19 bp, Homo sapiens
cctcccaagcagctgaagg

SEQ ID NO: 6079018 - DNA, 22 bp, Homo sapiens
cctcccaagctgatggacatga

SEQ ID NO: 6079019 - DNA, 20 bp, Homo sapiens
cctcccaagctggctggggt

SEQ ID NO: 6079020 - DNA, 21 bp, Homo sapiens
cctcccaaggcattctcccag

SEQ ID NO: 6079021 - DNA, 15 bp, Homo sapiens
cctcccaaggtcctc

SEQ ID NO: 6079022 - DNA, 21 bp, Homo sapiens
cctcccaaggtttgagtccct

SEQ ID NO: 6079023 - DNA, 17 bp, Homo sapiens
cctcccaataaagctgg

SEQ ID NO: 6079024 - DNA, 15 bp, Homo sapiens
cctcccaatcacccc

SEQ ID NO: 6079025 - DNA, 22 bp, Homo sapiens
cctcccaatcctctctcccctc

SEQ ID NO: 6079026 - DNA, 22 bp, Homo sapiens
cctcccacacccaaagctgagc

SEQ ID NO: 6079027 - DNA, 15 bp, Homo sapiens
cctcccacactccca

SEQ ID NO: 6079028 - DNA, 17 bp, Homo sapiens
cctcccacactccccca

SEQ ID NO: 6079029 - DNA, 14 bp, Homo sapiens
cctcccacactcgc

SEQ ID NO: 6079030 - DNA, 16 bp, Homo sapiens
cctcccacacttgctg

SEQ ID NO: 6079031 - DNA, 15 bp, Homo sapiens
cctcccacagacctg

SEQ ID NO: 6079032 - DNA, 13 bp, Homo sapiens
cctcccacagtga

SEQ ID NO: 6079033 - DNA, 15 bp, Homo sapiens
cctcccacatccccc

SEQ ID NO: 6079034 - DNA, 11 bp, Homo sapiens
cctcccaccag

SEQ ID NO: 6079035 - DNA, 15 bp, Homo sapiens
cctcccaccagagcc

SEQ ID NO: 6079036 - DNA, 16 bp, Homo sapiens
cctcccaccatgcgct

SEQ ID NO: 6079037 - DNA, 20 bp, Homo sapiens
cctcccacccacagccatag

SEQ ID NO: 6079038 - DNA, 13 bp, Homo sapiens
cctcccaccccac

SEQ ID NO: 6079039 - DNA, 14 bp, Homo sapiens
cctcccaccccact

SEQ ID NO: 6079040 - DNA, 18 bp, Homo sapiens
cctcccaccccactccag

SEQ ID NO: 6079041 - DNA, 15 bp, Homo sapiens
cctcccacccccagc

SEQ ID NO: 6079042 - DNA, 20 bp, Homo sapiens
cctcccaccccctccccggg

SEQ ID NO: 6079043 - DNA, 20 bp, Homo sapiens
cctcccacccccttctctgc

SEQ ID NO: 6079044 - DNA, 11 bp, Homo sapiens
cctcccacctc

SEQ ID NO: 6079045 - DNA, 15 bp, Homo sapiens
cctcccacctccagt

SEQ ID NO: 6079046 - DNA, 14 bp, Homo sapiens
cctcccacctctgt

SEQ ID NO: 6079047 - DNA, 19 bp, Homo sapiens
cctcccacctctgtgacct

SEQ ID NO: 6079048 - DNA, 19 bp, Homo sapiens
cctcccaccttggcctccc

SEQ ID NO: 6079049 - DNA, 23 bp, Homo sapiens
cctcccacgctgggacacagacc

SEQ ID NO: 6079050 - DNA, 20 bp, Homo sapiens
cctcccactcccatggctct

SEQ ID NO: 6079051 - DNA, 13 bp, Homo sapiens
cctcccactccct

SEQ ID NO: 6079052 - DNA, 12 bp, Homo sapiens
cctcccactggg

SEQ ID NO: 6079053 - DNA, 22 bp, Homo sapiens
cccccactcacagggagctggc

SEQ ID NO: 6079054 - DNA, 12 bp, Homo sapiens
cccccactcccc

SEQ ID NO: 6079055 - DNA, 13 bp, Homo sapiens
cccccactcctcc

SEQ ID NO: 6079056 - DNA, 14 bp, Homo sapiens
cccccactcctcct

SEQ ID NO: 6079057 - DNA, 21 bp, Homo sapiens
cccccactcctcctcctttct

SEQ ID NO: 6079058 - DNA, 21 bp, Homo sapiens
cccccactctcattccccagg

SEQ ID NO: 6079059 - DNA, 20 bp, Homo sapiens
cccccactctctcacccacc

SEQ ID NO: 6079060 - DNA, 18 bp, Homo sapiens
cccccactgacctgccca

SEQ ID NO: 6079061 - DNA, 14 bp, Homo sapiens
cccccactgcaccc

SEQ ID NO: 6079062 - DNA, 14 bp, Homo sapiens
cccccactgcaggc

SEQ ID NO: 6079063 - DNA, 14 bp, Homo sapiens
cccccactgccaca

SEQ ID NO: 6079064 - DNA, 22 bp, Homo sapiens
cccccactgctaaggctgctgg

SEQ ID NO: 6079065 - DNA, 15 bp, Homo sapiens
cccccactggctgtg

SEQ ID NO: 6079066 - DNA, 21 bp, Homo sapiens
cccccactggctgtgggctcc

SEQ ID NO: 6079067 - DNA, 11 bp, Homo sapiens
cccccactggt

SEQ ID NO: 6079068 - DNA, 23 bp, Homo sapiens
cccccactttcgcctcctccagc

SEQ ID NO: 6079069 - DNA, 21 bp, Homo sapiens
cccccagaaagcctcctgccc

SEQ ID NO: 6079070 - DNA, 18 bp, Homo sapiens
cccccagaaagctgccag

SEQ ID NO: 6079071 - DNA, 18 bp, Homo sapiens
cccccagacacagcccag

SEQ ID NO: 6079072 - DNA, 15 bp, Homo sapiens
cccccagaccccgcc

SEQ ID NO: 6079073 - DNA, 23 bp, Homo sapiens
cccccagaccccgcccctgggga

SEQ ID NO: 6079074 - DNA, 11 bp, Homo sapiens
cccccagagac

SEQ ID NO: 6079075 - DNA, 12 bp, Homo sapiens
cccccagagacc

SEQ ID NO: 6079076 - DNA, 16 bp, Homo sapiens
cccccagagcccaggc

SEQ ID NO: 6079077 - DNA, 12 bp, Homo sapiens
cccccagatatc

SEQ ID NO: 6079078 - DNA, 19 bp, Homo sapiens
cccccagattccaacattt

SEQ ID NO: 6079079 - DNA, 16 bp, Homo sapiens
cccccagcaaccctcc

SEQ ID NO: 6079080 - DNA, 20 bp, Homo sapiens
cccccagcaacgcccctcca

SEQ ID NO: 6079081 - DNA, 19 bp, Homo sapiens
cccccagcacaaagcactg

SEQ ID NO: 6079082 - DNA, 23 bp, Homo sapiens
cccccagcactaaggccgtgtct

SEQ ID NO: 6079083 - DNA, 12 bp, Homo sapiens
cccccagcatcg

SEQ ID NO: 6079084 - DNA, 15 bp, Homo sapiens
cccccagccaaactg

SEQ ID NO: 6079085 - DNA, 14 bp, Homo sapiens
cccccagccaggct

SEQ ID NO: 6079086 - DNA, 20 bp, Homo sapiens
cccccagccatgccagctgg

SEQ ID NO: 6079087 - DNA, 21 bp, Homo sapiens
cccccagccatgccagctggc

SEQ ID NO: 6079088 - DNA, 23 bp, Homo sapiens
cccccagccatgccagctggcct

SEQ ID NO: 6079089 - DNA, 12 bp, Homo sapiens
cccccagccccc

SEQ ID NO: 6079090 - DNA, 22 bp, Homo sapiens
cccccagccccctcctggtgcc

SEQ ID NO: 6079091 - DNA, 24 bp, Homo sapiens
cccccagccccgactccagccagc

SEQ ID NO: 6079092 - DNA, 22 bp, Homo sapiens
cccccagcccctcctccctcag

SEQ ID NO: 6079093 - DNA, 23 bp, Homo sapiens
cccccagcccctcctccctcaga

SEQ ID NO: 6079094 - DNA, 11 bp, Homo sapiens
cccccagccct

SEQ ID NO: 6079095 - DNA, 12 bp, Homo sapiens
cccccagccctc

SEQ ID NO: 6079096 - DNA, 15 bp, Homo sapiens
cccccagccctcagg

SEQ ID NO: 6079097 - DNA, 16 bp, Homo sapiens
cccccagccctcaggc

SEQ ID NO: 6079098 - DNA, 15 bp, Homo sapiens
cccccagccctggcc

SEQ ID NO: 6079099 - DNA, 16 bp, Homo sapiens
cccccagccctgggaa

SEQ ID NO: 6079100 - DNA, 15 bp, Homo sapiens
cccccagcctatgag

SEQ ID NO: 6079101 - DNA, 14 bp, Homo sapiens
cccccagcctcagc

SEQ ID NO: 6079102 - DNA, 17 bp, Homo sapiens
cccccagcctcagccca

SEQ ID NO: 6079103 - DNA, 16 bp, Homo sapiens
cccccagcctccccca

SEQ ID NO: 6079104 - DNA, 18 bp, Homo sapiens
cccccagcctcccccagg

SEQ ID NO: 6079105 - DNA, 18 bp, Homo sapiens
cccccagcctggccagac

SEQ ID NO: 6079106 - DNA, 14 bp, Homo sapiens
cccccagcctgggc

SEQ ID NO: 6079107 - DNA, 13 bp, Homo sapiens
cccccagctaaga

SEQ ID NO: 6079108 - DNA, 21 bp, Homo sapiens
cccccagctcaggggcagctc

SEQ ID NO: 6079109 - DNA, 15 bp, Homo sapiens
cccccagctccggcc

SEQ ID NO: 6079110 - DNA, 12 bp, Homo sapiens
cccccagctcct

SEQ ID NO: 6079111 - DNA, 11 bp, Homo sapiens
cccccagctgg

SEQ ID NO: 6079112 - DNA, 14 bp, Homo sapiens
cccccagctgggtc

SEQ ID NO: 6079113 - DNA, 14 bp, Homo sapiens
cccccagcttccag

SEQ ID NO: 6079114 - DNA, 13 bp, Homo sapiens
cccccaggaagcc

SEQ ID NO: 6079115 - DNA, 14 bp, Homo sapiens
cccccaggacaggc

SEQ ID NO: 6079116 - DNA, 14 bp, Homo sapiens
cccccaggaccaga

SEQ ID NO: 6079117 - DNA, 23 bp, Homo sapiens
cccccaggacctcttcagctgct

SEQ ID NO: 6079118 - DNA, 11 bp, Homo sapiens
cccccaggact

SEQ ID NO: 6079119 - DNA, 17 bp, Homo sapiens
cccccaggactgggcca

SEQ ID NO: 6079120 - DNA, 12 bp, Homo sapiens
cccccaggagga

SEQ ID NO: 6079121 - DNA, 16 bp, Homo sapiens
cccccaggattccccc

SEQ ID NO: 6079122 - DNA, 18 bp, Homo sapiens
cccccaggattgtgcaat

SEQ ID NO: 6079123 - DNA, 12 bp, Homo sapiens
cccccaggcagc

SEQ ID NO: 6079124 - DNA, 14 bp, Homo sapiens
cccccaggcagcca

SEQ ID NO: 6079125 - DNA, 15 bp, Homo sapiens
cccccaggcagccac

SEQ ID NO: 6079126 - DNA, 19 bp, Homo sapiens
cccccaggcagccaccagt

SEQ ID NO: 6079127 - DNA, 15 bp, Homo sapiens
cccccaggcctgccc

SEQ ID NO: 6079128 - DNA, 17 bp, Homo sapiens
cccccaggcctgccctg

SEQ ID NO: 6079129 - DNA, 12 bp, Homo sapiens
cccccaggctgc

SEQ ID NO: 6079130 - DNA, 14 bp, Homo sapiens
cccccaggctgcgc

SEQ ID NO: 6079131 - DNA, 20 bp, Homo sapiens
cccccaggctgcgcctgccc

SEQ ID NO: 6079132 - DNA, 19 bp, Homo sapiens
cccccaggctgttctccag

SEQ ID NO: 6079133 - DNA, 15 bp, Homo sapiens
cccccaggggcagga

SEQ ID NO: 6079134 - DNA, 19 bp, Homo sapiens
cccccagggtcctaaaact

SEQ ID NO: 6079135 - DNA, 11 bp, Homo sapiens
cccccaggtct

SEQ ID NO: 6079136 - DNA, 15 bp, Homo sapiens
cccccagtccccacc

SEQ ID NO: 6079137 - DNA, 15 bp, Homo sapiens
cccccagtccgcccc

SEQ ID NO: 6079138 - DNA, 14 bp, Homo sapiens
cccccagtcctcac

SEQ ID NO: 6079139 - DNA, 16 bp, Homo sapiens
cccccagtcctcactg

SEQ ID NO: 6079140 - DNA, 18 bp, Homo sapiens
cccccagtcgagccctgc

SEQ ID NO: 6079141 - DNA, 20 bp, Homo sapiens
cccccagtcgagccctgcag

SEQ ID NO: 6079142 - DNA, 15 bp, Homo sapiens
cccccagtctccagg

SEQ ID NO: 6079143 - DNA, 21 bp, Homo sapiens
cccccagtgctcacacaatca

SEQ ID NO: 6079144 - DNA, 22 bp, Homo sapiens
cccccagtgctcacacaatcag

SEQ ID NO: 6079145 - DNA, 11 bp, Homo sapiens
cccccagtggg

SEQ ID NO: 6079146 - DNA, 14 bp, Homo sapiens
cccccagtgggacc

SEQ ID NO: 6079147 - DNA, 22 bp, Homo sapiens
cccccagtgtattttgtccaag

SEQ ID NO: 6079148 - DNA, 11 bp, Homo sapiens
cccccagtgtg

SEQ ID NO: 6079149 - DNA, 22 bp, Homo sapiens
cccccagttcagtctgtaggga

SEQ ID NO: 6079150 - DNA, 13 bp, Homo sapiens
cccccagttccta

SEQ ID NO: 6079151 - DNA, 13 bp, Homo sapiens
cccccatccagcc

SEQ ID NO: 6079152 - DNA, 20 bp, Homo sapiens
cccccatccagccacggagg

SEQ ID NO: 6079153 - DNA, 11 bp, Homo sapiens
cccccatcccc

SEQ ID NO: 6079154 - DNA, 11 bp, Homo sapiens
cccccatcccg

SEQ ID NO: 6079155 - DNA, 19 bp, Homo sapiens
cccccatcctccccttccc

SEQ ID NO: 6079156 - DNA, 17 bp, Homo sapiens
cccccatcctgctcagc

SEQ ID NO: 6079157 - DNA, 15 bp, Homo sapiens
cccccatctctgagt

SEQ ID NO: 6079158 - DNA, 18 bp, Homo sapiens
cccccatctgtcttcagc

SEQ ID NO: 6079159 - DNA, 16 bp, Homo sapiens
cccccatcttcgggac

SEQ ID NO: 6079160 - DNA, 18 bp, Homo sapiens
cccccatcttcgggacca

SEQ ID NO: 6079161 - DNA, 21 bp, Homo sapiens
cccccatgccaccacccaccc

SEQ ID NO: 6079162 - DNA, 17 bp, Homo sapiens
cccccatgggctgctgg

SEQ ID NO: 6079163 - DNA, 13 bp, Homo sapiens
cccccatgtggca

SEQ ID NO: 6079164 - DNA, 22 bp, Homo sapiens
cccccatgtttaaactttgtgc

SEQ ID NO: 6079165 - DNA, 17 bp, Homo sapiens
cccccattctcatctgc

SEQ ID NO: 6079166 - DNA, 15 bp, Homo sapiens
ccccccaaagtgctg

SEQ ID NO: 6079167 - DNA, 12 bp, Homo sapiens
ccccccaaatct

SEQ ID NO: 6079168 - DNA, 19 bp, Homo sapiens
ccccccaacccggaaacag

SEQ ID NO: 6079169 - DNA, 12 bp, Homo sapiens
ccccccacccac

SEQ ID NO: 6079170 - DNA, 12 bp, Homo sapiens
ccccccacccca

SEQ ID NO: 6079171 - DNA, 12 bp, Homo sapiens
ccccccacccct

SEQ ID NO: 6079172 - DNA, 11 bp, Homo sapiens
ccccccactcc

SEQ ID NO: 6079173 - DNA, 13 bp, Homo sapiens
ccccccagcctct

SEQ ID NO: 6079174 - DNA, 12 bp, Homo sapiens
ccccccagcctg

SEQ ID NO: 6079175 - DNA, 13 bp, Homo sapiens
ccccccagctccc

SEQ ID NO: 6079176 - DNA, 16 bp, Homo sapiens
ccccccagctccctgc

SEQ ID NO: 6079177 - DNA, 12 bp, Homo sapiens
ccccccaggccc

SEQ ID NO: 6079178 - DNA, 13 bp, Homo sapiens
ccccccaggccct

SEQ ID NO: 6079179 - DNA, 12 bp, Homo sapiens
ccccccaggcct

SEQ ID NO: 6079180 - DNA, 12 bp, Homo sapiens
ccccccagtctc

SEQ ID NO: 6079181 - DNA, 13 bp, Homo sapiens
cccccccacccac

SEQ ID NO: 6079182 - DNA, 13 bp, Homo sapiens
cccccccagcctg

SEQ ID NO: 6079183 - DNA, 13 bp, Homo sapiens
cccccccaggcct

SEQ ID NO: 6079184 - DNA, 11 bp, Homo sapiens
cccccccctta

SEQ ID NO: 6079185 - DNA, 14 bp, Homo sapiens
cccccctcaccagg

SEQ ID NO: 6079186 - DNA, 21 bp, Homo sapiens
cccccctcagcaaggggctgc

SEQ ID NO: 6079187 - DNA, 12 bp, Homo sapiens
cccccctcccag

SEQ ID NO: 6079188 - DNA, 14 bp, Homo sapiens
cccccctcccagag

SEQ ID NO: 6079189 - DNA, 13 bp, Homo sapiens
cccccctcctcca

SEQ ID NO: 6079190 - DNA, 13 bp, Homo sapiens
cccccctcctttc

SEQ ID NO: 6079191 - DNA, 12 bp, Homo sapiens
cccccctgctca

SEQ ID NO: 6079192 - DNA, 12 bp, Homo sapiens
cccccctgctgc

SEQ ID NO: 6079193 - DNA, 13 bp, Homo sapiens
cccccctgctgcc

SEQ ID NO: 6079194 - DNA, 13 bp, Homo sapiens
cccccctgtacac

SEQ ID NO: 6079195 - DNA, 14 bp, Homo sapiens
cccccctgtgcctg

SEQ ID NO: 6079196 - DNA, 11 bp, Homo sapiens
cccccctgtgg

SEQ ID NO: 6079197 - DNA, 11 bp, Homo sapiens
ccccccttcca

SEQ ID NO: 6079198 - DNA, 12 bp, Homo sapiens
ccccccttctga

SEQ ID NO: 6079199 - DNA, 11 bp, Homo sapiens
ccccccttgaa

SEQ ID NO: 6079200 - DNA, 16 bp, Homo sapiens
cccccgacactgctgc

SEQ ID NO: 6079201 - DNA, 18 bp, Homo sapiens
cccccgacagcccagcct

SEQ ID NO: 6079202 - DNA, 16 bp, Homo sapiens
cccccgaccagatcct

SEQ ID NO: 6079203 - DNA, 20 bp, Homo sapiens
cccccgaccaggttggggag

SEQ ID NO: 6079204 - DNA, 14 bp, Homo sapiens
cccccgaccctgcc

SEQ ID NO: 6079205 - DNA, 17 bp, Homo sapiens
cccccgacggcctccag

SEQ ID NO: 6079206 - DNA, 18 bp, Homo sapiens
cccccgactgcctgtctc

SEQ ID NO: 6079207 - DNA, 13 bp, Homo sapiens
cccccgagccctg

SEQ ID NO: 6079208 - DNA, 14 bp, Homo sapiens
cccccgagctcttg

SEQ ID NO: 6079209 - DNA, 19 bp, Homo sapiens
cccccgagcttgcctcagg

SEQ ID NO: 6079210 - DNA, 22 bp, Homo sapiens
cccccgagcttgcctcagggcc

SEQ ID NO: 6079211 - DNA, 15 bp, Homo sapiens
cccccgaggctgcta

SEQ ID NO: 6079212 - DNA, 21 bp, Homo sapiens
cccccgcacagccacccgtgg

SEQ ID NO: 6079213 - DNA, 17 bp, Homo sapiens
cccccgcaccaagcaga

SEQ ID NO: 6079214 - DNA, 17 bp, Homo sapiens
cccccgcagaggcagaa

SEQ ID NO: 6079215 - DNA, 20 bp, Homo sapiens
cccccgcagcaccctgcaga

SEQ ID NO: 6079216 - DNA, 13 bp, Homo sapiens
cccccgccaggcg

SEQ ID NO: 6079217 - DNA, 13 bp, Homo sapiens
cccccgccccaga

SEQ ID NO: 6079218 - DNA, 11 bp, Homo sapiens
cccccgccccg

SEQ ID NO: 6079219 - DNA, 13 bp, Homo sapiens
cccccgccctctg

SEQ ID NO: 6079220 - DNA, 15 bp, Homo sapiens
cccccgccctctgcc

SEQ ID NO: 6079221 - DNA, 21 bp, Homo sapiens
cccccgcgcgcgtccccctgc

SEQ ID NO: 6079222 - DNA, 16 bp, Homo sapiens
cccccgcgggttctag

SEQ ID NO: 6079223 - DNA, 18 bp, Homo sapiens
cccccgcgggttctagac

SEQ ID NO: 6079224 - DNA, 20 bp, Homo sapiens
cccccgctctgccatcagcc

SEQ ID NO: 6079225 - DNA, 18 bp, Homo sapiens
cccccgctggcagccacc

SEQ ID NO: 6079226 - DNA, 23 bp, Homo sapiens
cccccgctgtaatgaaacacctt

SEQ ID NO: 6079227 - DNA, 12 bp, Homo sapiens
cccccggacgcc

SEQ ID NO: 6079228 - DNA, 14 bp, Homo sapiens
cccccggaggcgcc

SEQ ID NO: 6079229 - DNA, 15 bp, Homo sapiens
cccccggaggcgccc

SEQ ID NO: 6079230 - DNA, 14 bp, Homo sapiens
cccccggccccctg

SEQ ID NO: 6079231 - DNA, 21 bp, Homo sapiens
cccccggcctccaggctgggg

SEQ ID NO: 6079232 - DNA, 22 bp, Homo sapiens
cccccggctcggcctcttgaga

SEQ ID NO: 6079233 - DNA, 18 bp, Homo sapiens
cccccgggaggggcccgc

SEQ ID NO: 6079234 - DNA, 20 bp, Homo sapiens
cccccgggaggggcccgctt

SEQ ID NO: 6079235 - DNA, 23 bp, Homo sapiens
cccccgggccgacggagccggga

SEQ ID NO: 6079236 - DNA, 13 bp, Homo sapiens
cccccgggcctgc

SEQ ID NO: 6079237 - DNA, 15 bp, Homo sapiens
cccccggtgcctctc

SEQ ID NO: 6079238 - DNA, 21 bp, Homo sapiens
cccccgtctcctgccgggcag

SEQ ID NO: 6079239 - DNA, 13 bp, Homo sapiens
cctcccactggga

SEQ ID NO: 6079240 - DNA, 14 bp, Homo sapiens
cctcccactgggac

SEQ ID NO: 6079241 - DNA, 15 bp, Homo sapiens
cctcccactggggtc

SEQ ID NO: 6079242 - DNA, 16 bp, Homo sapiens
cctcccacttcactgc

SEQ ID NO: 6079243 - DNA, 19 bp, Homo sapiens
cctcccacttgacctgaga

SEQ ID NO: 6079244 - DNA, 19 bp, Homo sapiens
cctcccactttgctgttcc

SEQ ID NO: 6079245 - DNA, 20 bp, Homo sapiens
cctcccactttgtctgtaca

SEQ ID NO: 6079246 - DNA, 21 bp, Homo sapiens
cctcccactttgtctgtacat

SEQ ID NO: 6079247 - DNA, 20 bp, Homo sapiens
cctcccagaaaaactggctc

SEQ ID NO: 6079248 - DNA, 22 bp, Homo sapiens
cctcccagaaaaactggctctg

SEQ ID NO: 6079249 - DNA, 17 bp, Homo sapiens
cctcccagaacacactc

SEQ ID NO: 6079250 - DNA, 19 bp, Homo sapiens
cctcccagacaggccctcc

SEQ ID NO: 6079251 - DNA, 22 bp, Homo sapiens
cctcccagacccccttgcccag

SEQ ID NO: 6079252 - DNA, 15 bp, Homo sapiens
cctcccagactacct

SEQ ID NO: 6079253 - DNA, 16 bp, Homo sapiens
cctcccagagcacctg

SEQ ID NO: 6079254 - DNA, 17 bp, Homo sapiens
cctcccagagcacctgc

SEQ ID NO: 6079255 - DNA, 11 bp, Homo sapiens
cctcccagagg

SEQ ID NO: 6079256 - DNA, 12 bp, Homo sapiens
cctcccagaggt

SEQ ID NO: 6079257 - DNA, 16 bp, Homo sapiens
cctcccagaggtccag

SEQ ID NO: 6079258 - DNA, 18 bp, Homo sapiens
cctcccagaggtccagcc

SEQ ID NO: 6079259 - DNA, 22 bp, Homo sapiens
cctcccagaggtccagcccatc

SEQ ID NO: 6079260 - DNA, 18 bp, Homo sapiens
cctcccagagtgctagga

SEQ ID NO: 6079261 - DNA, 19 bp, Homo sapiens
cctcccagagtgctaggat

SEQ ID NO: 6079262 - DNA, 14 bp, Homo sapiens
cctcccagatccag

SEQ ID NO: 6079263 - DNA, 22 bp, Homo sapiens
cctcccagatccaggaacacat

SEQ ID NO: 6079264 - DNA, 13 bp, Homo sapiens
cctcccagcacag

SEQ ID NO: 6079265 - DNA, 12 bp, Homo sapiens
cctcccagccac

SEQ ID NO: 6079266 - DNA, 13 bp, Homo sapiens
cctcccagccacc

SEQ ID NO: 6079267 - DNA, 15 bp, Homo sapiens
cctcccagcccataa

SEQ ID NO: 6079268 - DNA, 15 bp, Homo sapiens
cctcccagcccattg

SEQ ID NO: 6079269 - DNA, 15 bp, Homo sapiens
cctcccagccccagg

SEQ ID NO: 6079270 - DNA, 20 bp, Homo sapiens
cctcccagccctgcccagag

SEQ ID NO: 6079271 - DNA, 12 bp, Homo sapiens
cctcccagcggc

SEQ ID NO: 6079272 - DNA, 17 bp, Homo sapiens
cctcccagcgtgtgtat

SEQ ID NO: 6079273 - DNA, 12 bp, Homo sapiens
cctcccagctcc

SEQ ID NO: 6079274 - DNA, 13 bp, Homo sapiens
cctcccagctctg

SEQ ID NO: 6079275 - DNA, 16 bp, Homo sapiens
cctcccagctgacagt

SEQ ID NO: 6079276 - DNA, 15 bp, Homo sapiens
cctcccagctgcact

SEQ ID NO: 6079277 - DNA, 13 bp, Homo sapiens
cctcccagctggt

SEQ ID NO: 6079278 - DNA, 11 bp, Homo sapiens
cctcccagctt

SEQ ID NO: 6079279 - DNA, 20 bp, Homo sapiens
cctcccagcttgtaggagct

SEQ ID NO: 6079280 - DNA, 14 bp, Homo sapiens
cctcccagctttct

SEQ ID NO: 6079281 - DNA, 20 bp, Homo sapiens
cctcccagctttctgtgtgc

SEQ ID NO: 6079282 - DNA, 19 bp, Homo sapiens
cctcccaggaggtgcttga

SEQ ID NO: 6079283 - DNA, 15 bp, Homo sapiens
cctcccaggctctca

SEQ ID NO: 6079284 - DNA, 21 bp, Homo sapiens
cctcccagggccagggccctg

SEQ ID NO: 6079285 - DNA, 16 bp, Homo sapiens
cctcccagggcctcct

SEQ ID NO: 6079286 - DNA, 12 bp, Homo sapiens
cctcccagggct

SEQ ID NO: 6079287 - DNA, 23 bp, Homo sapiens
cctcccagggctacacagaccct

SEQ ID NO: 6079288 - DNA, 13 bp, Homo sapiens
cctcccaggggag

SEQ ID NO: 6079289 - DNA, 17 bp, Homo sapiens
cctcccaggggagccag

SEQ ID NO: 6079290 - DNA, 18 bp, Homo sapiens
cctcccaggggagccagc

SEQ ID NO: 6079291 - DNA, 21 bp, Homo sapiens
cctcccaggggagccagctgc

SEQ ID NO: 6079292 - DNA, 12 bp, Homo sapiens
cctcccagggtt

SEQ ID NO: 6079293 - DNA, 18 bp, Homo sapiens
cctcccaggtcgggcagt

SEQ ID NO: 6079294 - DNA, 13 bp, Homo sapiens
cctcccagtgcct

SEQ ID NO: 6079295 - DNA, 18 bp, Homo sapiens
cctcccagtgccttctgg

SEQ ID NO: 6079296 - DNA, 13 bp, Homo sapiens
cctcccagtggcc

SEQ ID NO: 6079297 - DNA, 15 bp, Homo sapiens
cctcccatagtgctg

SEQ ID NO: 6079298 - DNA, 23 bp, Homo sapiens
cctcccatcattacccttccctg

SEQ ID NO: 6079299 - DNA, 16 bp, Homo sapiens
cctcccatccagcgtc

SEQ ID NO: 6079300 - DNA, 17 bp, Homo sapiens
cctcccatccagcgtct

SEQ ID NO: 6079301 - DNA, 17 bp, Homo sapiens
cctcccatcccctggac

SEQ ID NO: 6079302 - DNA, 16 bp, Homo sapiens
cctcccatctcacaca

SEQ ID NO: 6079303 - DNA, 16 bp, Homo sapiens
cctcccatctgggagt

SEQ ID NO: 6079304 - DNA, 20 bp, Homo sapiens
cctcccatgagactgccctg

SEQ ID NO: 6079305 - DNA, 12 bp, Homo sapiens
cctcccatggcc

SEQ ID NO: 6079306 - DNA, 13 bp, Homo sapiens
cctcccatggccc

SEQ ID NO: 6079307 - DNA, 15 bp, Homo sapiens
cctcccatggcccag

SEQ ID NO: 6079308 - DNA, 19 bp, Homo sapiens
cctcccatggccttccctc

SEQ ID NO: 6079309 - DNA, 14 bp, Homo sapiens
cctcccattcccct

SEQ ID NO: 6079310 - DNA, 13 bp, Homo sapiens
cctcccattctgc

SEQ ID NO: 6079311 - DNA, 16 bp, Homo sapiens
cctcccattgcccagt

SEQ ID NO: 6079312 - DNA, 18 bp, Homo sapiens
cctcccattgcccagtga

SEQ ID NO: 6079313 - DNA, 19 bp, Homo sapiens
cctcccattgcccagtgag

SEQ ID NO: 6079314 - DNA, 18 bp, Homo sapiens
cctcccatttctgttgct

SEQ ID NO: 6079315 - DNA, 20 bp, Homo sapiens
cctccccaaacccatcagac

SEQ ID NO: 6079316 - DNA, 13 bp, Homo sapiens
cctccccaaagcc

SEQ ID NO: 6079317 - DNA, 21 bp, Homo sapiens
cctccccaaagccactggaag

SEQ ID NO: 6079318 - DNA, 20 bp, Homo sapiens
cctccccaaatcaatacact

SEQ ID NO: 6079319 - DNA, 16 bp, Homo sapiens
cctccccaaccctgcc

SEQ ID NO: 6079320 - DNA, 13 bp, Homo sapiens
cctccccaactcc

SEQ ID NO: 6079321 - DNA, 22 bp, Homo sapiens
cctccccaaggccccctgcctg

SEQ ID NO: 6079322 - DNA, 23 bp, Homo sapiens
cctccccaaggccccctgcctgc

SEQ ID NO: 6079323 - DNA, 13 bp, Homo sapiens
cctccccaatcca

SEQ ID NO: 6079324 - DNA, 18 bp, Homo sapiens
cctccccacacacaggcc

SEQ ID NO: 6079325 - DNA, 17 bp, Homo sapiens
cctccccaccagagctg

SEQ ID NO: 6079326 - DNA, 19 bp, Homo sapiens
cctccccaccagagctgcc

SEQ ID NO: 6079327 - DNA, 23 bp, Homo sapiens
cctccccaccagagctgcctccc

SEQ ID NO: 6079328 - DNA, 13 bp, Homo sapiens
cctccccacccaa

SEQ ID NO: 6079329 - DNA, 14 bp, Homo sapiens
cctccccacccacc

SEQ ID NO: 6079330 - DNA, 13 bp, Homo sapiens
cctccccacccca

SEQ ID NO: 6079331 - DNA, 20 bp, Homo sapiens
cctccccaccccaaccactc

SEQ ID NO: 6079332 - DNA, 19 bp, Homo sapiens
cctccccacccccgctggg

SEQ ID NO: 6079333 - DNA, 19 bp, Homo sapiens
cctccccacccctgccttt

SEQ ID NO: 6079334 - DNA, 18 bp, Homo sapiens
cctccccaccctcctggc

SEQ ID NO: 6079335 - DNA, 14 bp, Homo sapiens
cctccccacctgct

SEQ ID NO: 6079336 - DNA, 16 bp, Homo sapiens
cctccccacctgctca

SEQ ID NO: 6079337 - DNA, 14 bp, Homo sapiens
cctccccaccttcc

SEQ ID NO: 6079338 - DNA, 22 bp, Homo sapiens
cctccccacggccgctccaggg

SEQ ID NO: 6079339 - DNA, 21 bp, Homo sapiens
cctccccacgtggcacctcct

SEQ ID NO: 6079340 - DNA, 24 bp, Homo sapiens
cctccccagacagggctccagcct

SEQ ID NO: 6079341 - DNA, 14 bp, Homo sapiens
cctccccagactct

SEQ ID NO: 6079342 - DNA, 16 bp, Homo sapiens
cctccccagagccctg

SEQ ID NO: 6079343 - DNA, 18 bp, Homo sapiens
cctccccagagccctgca

SEQ ID NO: 6079344 - DNA, 17 bp, Homo sapiens
cctccccagatctgtcc

SEQ ID NO: 6079345 - DNA, 19 bp, Homo sapiens
cctccccagatctgtcctg

SEQ ID NO: 6079346 - DNA, 20 bp, Homo sapiens
cctccccagatctgtcctgg

SEQ ID NO: 6079347 - DNA, 12 bp, Homo sapiens
cctccccagcag

SEQ ID NO: 6079348 - DNA, 22 bp, Homo sapiens
cctccccagcattccagcccct

SEQ ID NO: 6079349 - DNA, 13 bp, Homo sapiens
cctccccagccag

SEQ ID NO: 6079350 - DNA, 23 bp, Homo sapiens
cctccccagccagcccttccctg

SEQ ID NO: 6079351 - DNA, 22 bp, Homo sapiens
cctccccagcccctagcccagg

SEQ ID NO: 6079352 - DNA, 12 bp, Homo sapiens
cctccccagcct

SEQ ID NO: 6079353 - DNA, 13 bp, Homo sapiens
cctccccagcctg

SEQ ID NO: 6079354 - DNA, 17 bp, Homo sapiens
cctccccagctccggag

SEQ ID NO: 6079355 - DNA, 22 bp, Homo sapiens
cctccccagctcttctcttcct

SEQ ID NO: 6079356 - DNA, 12 bp, Homo sapiens
cctccccaggac

SEQ ID NO: 6079357 - DNA, 22 bp, Homo sapiens
cctccccaggctggagaccccc

SEQ ID NO: 6079358 - DNA, 12 bp, Homo sapiens
cctccccagggg

SEQ ID NO: 6079359 - DNA, 13 bp, Homo sapiens
cctccccatacac

SEQ ID NO: 6079360 - DNA, 18 bp, Homo sapiens
cctccccatacacacaca

SEQ ID NO: 6079361 - DNA, 12 bp, Homo sapiens
cctccccatgca

SEQ ID NO: 6079362 - DNA, 19 bp, Homo sapiens
cctccccatgggcacagtg

SEQ ID NO: 6079363 - DNA, 21 bp, Homo sapiens
cctccccattagagtcagcct

SEQ ID NO: 6079364 - DNA, 18 bp, Homo sapiens
cctcccccaaaccctgct

SEQ ID NO: 6079365 - DNA, 19 bp, Homo sapiens
cctcccccaacccccaccc

SEQ ID NO: 6079366 - DNA, 23 bp, Homo sapiens
cctcccccacaaataatgaacag

SEQ ID NO: 6079367 - DNA, 16 bp, Homo sapiens
cctcccccaccattcc

SEQ ID NO: 6079368 - DNA, 22 bp, Homo sapiens
cctcccccaccattccacatcc

SEQ ID NO: 6079369 - DNA, 14 bp, Homo sapiens
cctcccccacccct

SEQ ID NO: 6079370 - DNA, 15 bp, Homo sapiens
cctcccccactgcca

SEQ ID NO: 6079371 - DNA, 12 bp, Homo sapiens
cctcccccactt

SEQ ID NO: 6079372 - DNA, 20 bp, Homo sapiens
cctcccccactttcaagaca

SEQ ID NO: 6079373 - DNA, 15 bp, Homo sapiens
cctcccccagagccc

SEQ ID NO: 6079374 - DNA, 16 bp, Homo sapiens
cctcccccagagcccc

SEQ ID NO: 6079375 - DNA, 15 bp, Homo sapiens
cctcccccagccagg

SEQ ID NO: 6079376 - DNA, 15 bp, Homo sapiens
cctcccccagctcct

SEQ ID NO: 6079377 - DNA, 22 bp, Homo sapiens
cctcccccaggctgcgcctgcc

SEQ ID NO: 6079378 - DNA, 12 bp, Homo sapiens
cctcccccaggg

SEQ ID NO: 6079379 - DNA, 16 bp, Homo sapiens
cctcccccagggaggg

SEQ ID NO: 6079380 - DNA, 15 bp, Homo sapiens
cctcccccatcccca

SEQ ID NO: 6079381 - DNA, 19 bp, Homo sapiens
cctccccccaatccctcaa

SEQ ID NO: 6079382 - DNA, 13 bp, Homo sapiens
cctccccccactg

SEQ ID NO: 6079383 - DNA, 15 bp, Homo sapiens
cctccccccactgca

SEQ ID NO: 6079384 - DNA, 14 bp, Homo sapiens
cctccccccagacc

SEQ ID NO: 6079385 - DNA, 17 bp, Homo sapiens
cctccccccagcccctc

SEQ ID NO: 6079386 - DNA, 22 bp, Homo sapiens
cctccccccagcccctcctccc

SEQ ID NO: 6079387 - DNA, 15 bp, Homo sapiens
cctcccccccatgca

SEQ ID NO: 6079388 - DNA, 13 bp, Homo sapiens
cctcccccgcaga

SEQ ID NO: 6079389 - DNA, 16 bp, Homo sapiens
cctcccccgcagacag

SEQ ID NO: 6079390 - DNA, 16 bp, Homo sapiens
cctcccccgccactcc

SEQ ID NO: 6079391 - DNA, 17 bp, Homo sapiens
cctcccccgccactcct

SEQ ID NO: 6079392 - DNA, 19 bp, Homo sapiens
cctcccccggggtctccac

SEQ ID NO: 6079393 - DNA, 13 bp, Homo sapiens
cctccccctaacc

SEQ ID NO: 6079394 - DNA, 16 bp, Homo sapiens
cctccccctcctaggg

SEQ ID NO: 6079395 - DNA, 14 bp, Homo sapiens
cctccccctccttc

SEQ ID NO: 6079396 - DNA, 21 bp, Homo sapiens
cctccccctccttcccagctg

SEQ ID NO: 6079397 - DNA, 14 bp, Homo sapiens
cctccccctgcaac

SEQ ID NO: 6079398 - DNA, 20 bp, Homo sapiens
cctccccctgccagaggcct

SEQ ID NO: 6079399 - DNA, 20 bp, Homo sapiens
cctccccctgccagtgcctt

SEQ ID NO: 6079400 - DNA, 14 bp, Homo sapiens
cctccccctgcccc

SEQ ID NO: 6079401 - DNA, 13 bp, Homo sapiens
cctccccctgctg

SEQ ID NO: 6079402 - DNA, 15 bp, Homo sapiens
cctccccctgctgct

SEQ ID NO: 6079403 - DNA, 16 bp, Homo sapiens
cctccccctggcactg

SEQ ID NO: 6079404 - DNA, 13 bp, Homo sapiens
cctccccctgtgt

SEQ ID NO: 6079405 - DNA, 14 bp, Homo sapiens
cctccccctgtgtg

SEQ ID NO: 6079406 - DNA, 15 bp, Homo sapiens
cctcccccttcccct

SEQ ID NO: 6079407 - DNA, 15 bp, Homo sapiens
cctcccccttctccc

SEQ ID NO: 6079408 - DNA, 22 bp, Homo sapiens
cctcccccttctcccacccctg

SEQ ID NO: 6079409 - DNA, 19 bp, Homo sapiens
cctccccctttcacactgg

SEQ ID NO: 6079410 - DNA, 14 bp, Homo sapiens
cctccccctttggg

SEQ ID NO: 6079411 - DNA, 19 bp, Homo sapiens
cctccccgaagacactcct

SEQ ID NO: 6079412 - DNA, 21 bp, Homo sapiens
cctccccgcaccccccaagct

SEQ ID NO: 6079413 - DNA, 21 bp, Homo sapiens
cctccccgcagtgggaagtga

SEQ ID NO: 6079414 - DNA, 16 bp, Homo sapiens
cctccccgccccctga

SEQ ID NO: 6079415 - DNA, 15 bp, Homo sapiens
cctccccgcctcctc

SEQ ID NO: 6079416 - DNA, 21 bp, Homo sapiens
cctccccgcctggccagggca

SEQ ID NO: 6079417 - DNA, 21 bp, Homo sapiens
cctccccgctccgtctctgtc

SEQ ID NO: 6079418 - DNA, 18 bp, Homo sapiens
cctccccgctctccctgt

SEQ ID NO: 6079419 - DNA, 17 bp, Homo sapiens
cctccccggccacatgc

SEQ ID NO: 6079420 - DNA, 23 bp, Homo sapiens
cccccgtggggctcccggcatcc

SEQ ID NO: 6079421 - DNA, 15 bp, Homo sapiens
cccccgtggtctttg

SEQ ID NO: 6079422 - DNA, 17 bp, Homo sapiens
cccccgtggtctttgaa

SEQ ID NO: 6079423 - DNA, 19 bp, Homo sapiens
cccccgtttctccttttcc

SEQ ID NO: 6079424 - DNA, 15 bp, Homo sapiens
ccccctacccaccga

SEQ ID NO: 6079425 - DNA, 13 bp, Homo sapiens
ccccctagagact

SEQ ID NO: 6079426 - DNA, 16 bp, Homo sapiens
ccccctatccttggca

SEQ ID NO: 6079427 - DNA, 19 bp, Homo sapiens
ccccctcaaacctcctctt

SEQ ID NO: 6079428 - DNA, 17 bp, Homo sapiens
ccccctcaagccccagc

SEQ ID NO: 6079429 - DNA, 19 bp, Homo sapiens
ccccctcagccttgggacc

SEQ ID NO: 6079430 - DNA, 19 bp, Homo sapiens
ccccctcaggaccctcgct

SEQ ID NO: 6079431 - DNA, 13 bp, Homo sapiens
ccccctcatctca

SEQ ID NO: 6079432 - DNA, 16 bp, Homo sapiens
ccccctccaatcctgc

SEQ ID NO: 6079433 - DNA, 12 bp, Homo sapiens
ccccctccagct

SEQ ID NO: 6079434 - DNA, 14 bp, Homo sapiens
ccccctccagctca

SEQ ID NO: 6079435 - DNA, 12 bp, Homo sapiens
ccccctccaggc

SEQ ID NO: 6079436 - DNA, 13 bp, Homo sapiens
ccccctccagtgc

SEQ ID NO: 6079437 - DNA, 18 bp, Homo sapiens
ccccctccattcccaccc

SEQ ID NO: 6079438 - DNA, 16 bp, Homo sapiens
ccccctcccaccctgc

SEQ ID NO: 6079439 - DNA, 17 bp, Homo sapiens
ccccctcccaccgctgc

SEQ ID NO: 6079440 - DNA, 20 bp, Homo sapiens
ccccctcccaccgctgcctc

SEQ ID NO: 6079441 - DNA, 14 bp, Homo sapiens
ccccctcccagagg

SEQ ID NO: 6079442 - DNA, 15 bp, Homo sapiens
ccccctcccagaggc

SEQ ID NO: 6079443 - DNA, 12 bp, Homo sapiens
ccccctccccaa

SEQ ID NO: 6079444 - DNA, 16 bp, Homo sapiens
ccccctccccaaagcc

SEQ ID NO: 6079445 - DNA, 16 bp, Homo sapiens
ccccctccccctcctg

SEQ ID NO: 6079446 - DNA, 14 bp, Homo sapiens
ccccctcccctcct

SEQ ID NO: 6079447 - DNA, 16 bp, Homo sapiens
ccccctcccctccttt

SEQ ID NO: 6079448 - DNA, 12 bp, Homo sapiens
ccccctccctcc

SEQ ID NO: 6079449 - DNA, 15 bp, Homo sapiens
ccccctccctgctcc

SEQ ID NO: 6079450 - DNA, 14 bp, Homo sapiens
ccccctccctggat

SEQ ID NO: 6079451 - DNA, 14 bp, Homo sapiens
ccccctccctggcc

SEQ ID NO: 6079452 - DNA, 13 bp, Homo sapiens
ccccctcccttca

SEQ ID NO: 6079453 - DNA, 19 bp, Homo sapiens
ccccctccgccctgccact

SEQ ID NO: 6079454 - DNA, 15 bp, Homo sapiens
ccccctcctcagcca

SEQ ID NO: 6079455 - DNA, 15 bp, Homo sapiens
ccccctcctccagta

SEQ ID NO: 6079456 - DNA, 15 bp, Homo sapiens
ccccctcctccccgc

SEQ ID NO: 6079457 - DNA, 14 bp, Homo sapiens
ccccctcctctccc

SEQ ID NO: 6079458 - DNA, 22 bp, Homo sapiens
ccccctcctctcccatccccct

SEQ ID NO: 6079459 - DNA, 13 bp, Homo sapiens
ccccctcctctct

SEQ ID NO: 6079460 - DNA, 15 bp, Homo sapiens
ccccctcctgctcct

SEQ ID NO: 6079461 - DNA, 13 bp, Homo sapiens
ccccctcctgctg

SEQ ID NO: 6079462 - DNA, 12 bp, Homo sapiens
ccccctccttcc

SEQ ID NO: 6079463 - DNA, 21 bp, Homo sapiens
ccccctccttcccagctgccc

SEQ ID NO: 6079464 - DNA, 15 bp, Homo sapiens
ccccctccttgctct

SEQ ID NO: 6079465 - DNA, 14 bp, Homo sapiens
ccccctcgccagct

SEQ ID NO: 6079466 - DNA, 16 bp, Homo sapiens
ccccctcgccagcttg

SEQ ID NO: 6079467 - DNA, 18 bp, Homo sapiens
ccccctcgccagcttggc

SEQ ID NO: 6079468 - DNA, 22 bp, Homo sapiens
ccccctcgggtctcctcactcc

SEQ ID NO: 6079469 - DNA, 14 bp, Homo sapiens
ccccctctaacccc

SEQ ID NO: 6079470 - DNA, 17 bp, Homo sapiens
ccccctctcaggagcca

SEQ ID NO: 6079471 - DNA, 19 bp, Homo sapiens
ccccctctccctgcatggc

SEQ ID NO: 6079472 - DNA, 14 bp, Homo sapiens
ccccctctcctccc

SEQ ID NO: 6079473 - DNA, 19 bp, Homo sapiens
ccccctctcctcccagctg

SEQ ID NO: 6079474 - DNA, 21 bp, Homo sapiens
ccccctctcctcccagctgct

SEQ ID NO: 6079475 - DNA, 16 bp, Homo sapiens
ccccctctcctggagg

SEQ ID NO: 6079476 - DNA, 10 bp, Homo sapiens
ccccctctct

SEQ ID NO: 6079477 - DNA, 12 bp, Homo sapiens
ccccctctgcct

SEQ ID NO: 6079478 - DNA, 11 bp, Homo sapiens
ccccctctgct

SEQ ID NO: 6079479 - DNA, 12 bp, Homo sapiens
ccccctctgctt

SEQ ID NO: 6079480 - DNA, 13 bp, Homo sapiens
ccccctctggaga

SEQ ID NO: 6079481 - DNA, 22 bp, Homo sapiens
ccccctctggagaaggcctgga

SEQ ID NO: 6079482 - DNA, 20 bp, Homo sapiens
ccccctcttcaaagcagagt

SEQ ID NO: 6079483 - DNA, 20 bp, Homo sapiens
ccccctgaaacatgtgcccc

SEQ ID NO: 6079484 - DNA, 22 bp, Homo sapiens
ccccctgaaacatgtgcccctg

SEQ ID NO: 6079485 - DNA, 19 bp, Homo sapiens
ccccctgcaaagcccagct

SEQ ID NO: 6079486 - DNA, 21 bp, Homo sapiens
ccccctgcaaagcccagcttg

SEQ ID NO: 6079487 - DNA, 13 bp, Homo sapiens
ccccctgcaccca

SEQ ID NO: 6079488 - DNA, 14 bp, Homo sapiens
ccccctgcacccac

SEQ ID NO: 6079489 - DNA, 16 bp, Homo sapiens
ccccctgcacccaccc

SEQ ID NO: 6079490 - DNA, 18 bp, Homo sapiens
ccccctgccagaggcctg

SEQ ID NO: 6079491 - DNA, 14 bp, Homo sapiens
ccccctgccagccg

SEQ ID NO: 6079492 - DNA, 14 bp, Homo sapiens
ccccctgccagtgc

SEQ ID NO: 6079493 - DNA, 13 bp, Homo sapiens
ccccctgccccag

SEQ ID NO: 6079494 - DNA, 17 bp, Homo sapiens
ccccctgccccagagaa

SEQ ID NO: 6079495 - DNA, 16 bp, Homo sapiens
ccccctgccccccagc

SEQ ID NO: 6079496 - DNA, 21 bp, Homo sapiens
ccccctgccccccagcctctg

SEQ ID NO: 6079497 - DNA, 12 bp, Homo sapiens
ccccctgccctg

SEQ ID NO: 6079498 - DNA, 16 bp, Homo sapiens
ccccctgcctgccata

SEQ ID NO: 6079499 - DNA, 12 bp, Homo sapiens
ccccctgctgat

SEQ ID NO: 6079500 - DNA, 14 bp, Homo sapiens
ccccctgctgctca

SEQ ID NO: 6079501 - DNA, 18 bp, Homo sapiens
ccccctgctggctcttct

SEQ ID NO: 6079502 - DNA, 20 bp, Homo sapiens
ccccctgctggctcttctgc

SEQ ID NO: 6079503 - DNA, 18 bp, Homo sapiens
ccccctgcttcagtccct

SEQ ID NO: 6079504 - DNA, 18 bp, Homo sapiens
ccccctgcttctcccgcc

SEQ ID NO: 6079505 - DNA, 19 bp, Homo sapiens
ccccctggacggggcgggc

SEQ ID NO: 6079506 - DNA, 18 bp, Homo sapiens
ccccctggatgtcccctg

SEQ ID NO: 6079507 - DNA, 21 bp, Homo sapiens
ccccctggcagctgcccctcc

SEQ ID NO: 6079508 - DNA, 22 bp, Homo sapiens
ccccctggcctctgtgccttct

SEQ ID NO: 6079509 - DNA, 15 bp, Homo sapiens
ccccctggctgactg

SEQ ID NO: 6079510 - DNA, 12 bp, Homo sapiens
ccccctgggaga

SEQ ID NO: 6079511 - DNA, 22 bp, Homo sapiens
ccccctgggcagatgtccccca

SEQ ID NO: 6079512 - DNA, 19 bp, Homo sapiens
ccccctggggcttctcctg

SEQ ID NO: 6079513 - DNA, 23 bp, Homo sapiens
ccccctggggcttctcctgaccc

SEQ ID NO: 6079514 - DNA, 16 bp, Homo sapiens
ccccctggggggcaca

SEQ ID NO: 6079515 - DNA, 20 bp, Homo sapiens
ccccctggggggcacagcca

SEQ ID NO: 6079516 - DNA, 15 bp, Homo sapiens
ccccctggtctctgg

SEQ ID NO: 6079517 - DNA, 16 bp, Homo sapiens
ccccctggtctctggt

SEQ ID NO: 6079518 - DNA, 11 bp, Homo sapiens
ccccctggtgg

SEQ ID NO: 6079519 - DNA, 23 bp, Homo sapiens
ccccctggtggaatgcgggggag

SEQ ID NO: 6079520 - DNA, 12 bp, Homo sapiens
ccccctggtggg

SEQ ID NO: 6079521 - DNA, 12 bp, Homo sapiens
ccccctgtacac

SEQ ID NO: 6079522 - DNA, 20 bp, Homo sapiens
ccccctgtacacaactcact

SEQ ID NO: 6079523 - DNA, 18 bp, Homo sapiens
ccccctgtagactagtgc

SEQ ID NO: 6079524 - DNA, 16 bp, Homo sapiens
ccccctgtgccagctc

SEQ ID NO: 6079525 - DNA, 21 bp, Homo sapiens
ccccctgtgcccacccagggc

SEQ ID NO: 6079526 - DNA, 13 bp, Homo sapiens
ccccctgtgccct

SEQ ID NO: 6079527 - DNA, 20 bp, Homo sapiens
ccccctgtgcctgctgggca

SEQ ID NO: 6079528 - DNA, 15 bp, Homo sapiens
ccccctgtggtctgt

SEQ ID NO: 6079529 - DNA, 17 bp, Homo sapiens
ccccctgtgtggccctg

SEQ ID NO: 6079530 - DNA, 17 bp, Homo sapiens
ccccctgttccctgttc

SEQ ID NO: 6079531 - DNA, 17 bp, Homo sapiens
cccccttcagctcctga

SEQ ID NO: 6079532 - DNA, 11 bp, Homo sapiens
cccccttcagg

SEQ ID NO: 6079533 - DNA, 14 bp, Homo sapiens
cccccttccatgga

SEQ ID NO: 6079534 - DNA, 17 bp, Homo sapiens
cccccttcccctaccca

SEQ ID NO: 6079535 - DNA, 13 bp, Homo sapiens
cccccttcccctg

SEQ ID NO: 6079536 - DNA, 16 bp, Homo sapiens
cccccttccccttctg

SEQ ID NO: 6079537 - DNA, 17 bp, Homo sapiens
cccccttcccgccttcc

SEQ ID NO: 6079538 - DNA, 17 bp, Homo sapiens
cccccttcccttggagg

SEQ ID NO: 6079539 - DNA, 12 bp, Homo sapiens
cccccttcctag

SEQ ID NO: 6079540 - DNA, 14 bp, Homo sapiens
cccccttcgctcct

SEQ ID NO: 6079541 - DNA, 14 bp, Homo sapiens
cccccttctcccac

SEQ ID NO: 6079542 - DNA, 17 bp, Homo sapiens
cccccttctcccacact

SEQ ID NO: 6079543 - DNA, 22 bp, Homo sapiens
cccccttctctgctccaccaca

SEQ ID NO: 6079544 - DNA, 14 bp, Homo sapiens
cccccttctgggca

SEQ ID NO: 6079545 - DNA, 20 bp, Homo sapiens
cccccttctttgcagctgcc

SEQ ID NO: 6079546 - DNA, 15 bp, Homo sapiens
cccccttgaagcaat

SEQ ID NO: 6079547 - DNA, 19 bp, Homo sapiens
cccccttgaagcaataact

SEQ ID NO: 6079548 - DNA, 20 bp, Homo sapiens
cccccttgaagcaataactc

SEQ ID NO: 6079549 - DNA, 23 bp, Homo sapiens
cccccttgaggattgtggaaaac

SEQ ID NO: 6079550 - DNA, 18 bp, Homo sapiens
cccccttgatcgacttct

SEQ ID NO: 6079551 - DNA, 18 bp, Homo sapiens
cccccttgccagacatgt

SEQ ID NO: 6079552 - DNA, 19 bp, Homo sapiens
cccccttggaggagggctg

SEQ ID NO: 6079553 - DNA, 14 bp, Homo sapiens
cccccttgtcttcc

SEQ ID NO: 6079554 - DNA, 19 bp, Homo sapiens
cccccttgtcttcccccct

SEQ ID NO: 6079555 - DNA, 21 bp, Homo sapiens
ccccctttacctagctgtgcc

SEQ ID NO: 6079556 - DNA, 18 bp, Homo sapiens
ccccctttcacaggcagc

SEQ ID NO: 6079557 - DNA, 22 bp, Homo sapiens
ccccctttcagatgtcttctgc

SEQ ID NO: 6079558 - DNA, 13 bp, Homo sapiens
ccccctttcccgg

SEQ ID NO: 6079559 - DNA, 14 bp, Homo sapiens
ccccctttcccggg

SEQ ID NO: 6079560 - DNA, 15 bp, Homo sapiens
ccccctttcccgggc

SEQ ID NO: 6079561 - DNA, 12 bp, Homo sapiens
ccccctttcctg

SEQ ID NO: 6079562 - DNA, 15 bp, Homo sapiens
ccccctttctctgcc

SEQ ID NO: 6079563 - DNA, 15 bp, Homo sapiens
ccccctttcttcctc

SEQ ID NO: 6079564 - DNA, 16 bp, Homo sapiens
ccccctttcttcctca

SEQ ID NO: 6079565 - DNA, 20 bp, Homo sapiens
ccccctttgactctggggtg

SEQ ID NO: 6079566 - DNA, 16 bp, Homo sapiens
ccccctttgggcccag

SEQ ID NO: 6079567 - DNA, 20 bp, Homo sapiens
ccccctttgggcccagggac

SEQ ID NO: 6079568 - DNA, 23 bp, Homo sapiens
cccccttttcagctgagccctgg

SEQ ID NO: 6079569 - DNA, 18 bp, Homo sapiens
cccccttttctccccacg

SEQ ID NO: 6079570 - DNA, 14 bp, Homo sapiens
ccccgaactgtgcc

SEQ ID NO: 6079571 - DNA, 22 bp, Homo sapiens
ccccgaagaaggaccagtgaag

SEQ ID NO: 6079572 - DNA, 19 bp, Homo sapiens
ccccgaagggagcatctgt

SEQ ID NO: 6079573 - DNA, 16 bp, Homo sapiens
ccccgacactgctgca

SEQ ID NO: 6079574 - DNA, 18 bp, Homo sapiens
ccccgacactgctgcacc

SEQ ID NO: 6079575 - DNA, 15 bp, Homo sapiens
ccccgacagcccagc

SEQ ID NO: 6079576 - DNA, 19 bp, Homo sapiens
ccccgaccaatccccagcc

SEQ ID NO: 6079577 - DNA, 23 bp, Homo sapiens
ccccgacccttgccgtctacctg

SEQ ID NO: 6079578 - DNA, 14 bp, Homo sapiens
ccccgacgccacag

SEQ ID NO: 6079579 - DNA, 15 bp, Homo sapiens
ccccgacggcctcca

SEQ ID NO: 6079580 - DNA, 18 bp, Homo sapiens
ccccgacgtttgcggcag

SEQ ID NO: 6079581 - DNA, 19 bp, Homo sapiens
ccccgactatccctgcaca

SEQ ID NO: 6079582 - DNA, 13 bp, Homo sapiens
ccccgactccagc

SEQ ID NO: 6079583 - DNA, 15 bp, Homo sapiens
ccccgactccagcca

SEQ ID NO: 6079584 - DNA, 16 bp, Homo sapiens
ccccgactccagccag

SEQ ID NO: 6079585 - DNA, 18 bp, Homo sapiens
ccccgactccctccccag

SEQ ID NO: 6079586 - DNA, 15 bp, Homo sapiens
ccccgactgcctgtc

SEQ ID NO: 6079587 - DNA, 16 bp, Homo sapiens
ccccgacttcatccca

SEQ ID NO: 6079588 - DNA, 14 bp, Homo sapiens
ccccgacttcctga

SEQ ID NO: 6079589 - DNA, 16 bp, Homo sapiens
ccccgacttcctgact

SEQ ID NO: 6079590 - DNA, 14 bp, Homo sapiens
ccccgacttttgtt

SEQ ID NO: 6079591 - DNA, 16 bp, Homo sapiens
ccccgagaagtgctct

SEQ ID NO: 6079592 - DNA, 13 bp, Homo sapiens
ccccgagacacca

SEQ ID NO: 6079593 - DNA, 21 bp, Homo sapiens
ccccgagacaccatcctgagc

SEQ ID NO: 6079594 - DNA, 19 bp, Homo sapiens
ccccgagccctgactcctg

SEQ ID NO: 6079595 - DNA, 18 bp, Homo sapiens
ccccgagctcttggcctt

SEQ ID NO: 6079596 - DNA, 22 bp, Homo sapiens
ccccgagctcttggcctttgca

SEQ ID NO: 6079597 - DNA, 13 bp, Homo sapiens
ccccgagcttgcc

SEQ ID NO: 6079598 - DNA, 17 bp, Homo sapiens
ccccgaggacccagacc

SEQ ID NO: 6079599 - DNA, 17 bp, Homo sapiens
ccccgaggagctgggcc

SEQ ID NO: 6079600 - DNA, 13 bp, Homo sapiens
ccccgaggccccc

SEQ ID NO: 6079601 - DNA, 14 bp, Homo sapiens
ccccgaggcccccc

SEQ ID NO: 6079602 - DNA, 14 bp, Homo sapiens
ccccgaggctgccc

SEQ ID NO: 6079603 - DNA, 14 bp, Homo sapiens
cctccccggcccta

SEQ ID NO: 6079604 - DNA, 21 bp, Homo sapiens
cctccccggccctaccagcgc

SEQ ID NO: 6079605 - DNA, 22 bp, Homo sapiens
cctccccgggcagcagagagag

SEQ ID NO: 6079606 - DNA, 16 bp, Homo sapiens
cctccccgtccctgtc

SEQ ID NO: 6079607 - DNA, 23 bp, Homo sapiens
cctccccgtccctgtcccccagc

SEQ ID NO: 6079608 - DNA, 9 bp, Homo sapiens
cctcccctc

SEQ ID NO: 6079609 - DNA, 15 bp, Homo sapiens
cctcccctcacagcc

SEQ ID NO: 6079610 - DNA, 14 bp, Homo sapiens
cctcccctcagagc

SEQ ID NO: 6079611 - DNA, 17 bp, Homo sapiens
cctcccctcagagccca

SEQ ID NO: 6079612 - DNA, 14 bp, Homo sapiens
cctcccctcagcct

SEQ ID NO: 6079613 - DNA, 13 bp, Homo sapiens
cctcccctccagc

SEQ ID NO: 6079614 - DNA, 13 bp, Homo sapiens
cctcccctcccac

SEQ ID NO: 6079615 - DNA, 14 bp, Homo sapiens
cctcccctcccagt

SEQ ID NO: 6079616 - DNA, 19 bp, Homo sapiens
cctcccctcccctgctgca

SEQ ID NO: 6079617 - DNA, 16 bp, Homo sapiens
cctcccctcccctggg

SEQ ID NO: 6079618 - DNA, 13 bp, Homo sapiens
cctcccctcccgt

SEQ ID NO: 6079619 - DNA, 15 bp, Homo sapiens
cctcccctccgcagc

SEQ ID NO: 6079620 - DNA, 12 bp, Homo sapiens
cctcccctcctt

SEQ ID NO: 6079621 - DNA, 14 bp, Homo sapiens
cctcccctccttgt

SEQ ID NO: 6079622 - DNA, 16 bp, Homo sapiens
cctcccctcctttacc

SEQ ID NO: 6079623 - DNA, 18 bp, Homo sapiens
cctcccctctcagaacat

SEQ ID NO: 6079624 - DNA, 23 bp, Homo sapiens
cctcccctctcatccccctgtgg

SEQ ID NO: 6079625 - DNA, 14 bp, Homo sapiens
cctcccctgaggct

SEQ ID NO: 6079626 - DNA, 22 bp, Homo sapiens
cctcccctgaggctcagggaaa

SEQ ID NO: 6079627 - DNA, 17 bp, Homo sapiens
cctcccctgccaccagg

SEQ ID NO: 6079628 - DNA, 14 bp, Homo sapiens
cctcccctgccctc

SEQ ID NO: 6079629 - DNA, 15 bp, Homo sapiens
cctcccctgccctcg

SEQ ID NO: 6079630 - DNA, 15 bp, Homo sapiens
cctcccctgccctgg

SEQ ID NO: 6079631 - DNA, 12 bp, Homo sapiens
cctcccctgccg

SEQ ID NO: 6079632 - DNA, 15 bp, Homo sapiens
cctcccctgccgcct

SEQ ID NO: 6079633 - DNA, 16 bp, Homo sapiens
cctcccctgccgcctc

SEQ ID NO: 6079634 - DNA, 13 bp, Homo sapiens
cctcccctgcctt

SEQ ID NO: 6079635 - DNA, 14 bp, Homo sapiens
cctcccctgccttg

SEQ ID NO: 6079636 - DNA, 15 bp, Homo sapiens
cctcccctgccttgc

SEQ ID NO: 6079637 - DNA, 12 bp, Homo sapiens
cctcccctggca

SEQ ID NO: 6079638 - DNA, 12 bp, Homo sapiens
cctcccctggga

SEQ ID NO: 6079639 - DNA, 13 bp, Homo sapiens
cctcccctgggac

SEQ ID NO: 6079640 - DNA, 15 bp, Homo sapiens
cctcccctgggcagg

SEQ ID NO: 6079641 - DNA, 22 bp, Homo sapiens
cctcccctgggttaacaaatga

SEQ ID NO: 6079642 - DNA, 19 bp, Homo sapiens
cctcccctgtcttctctca

SEQ ID NO: 6079643 - DNA, 20 bp, Homo sapiens
cctcccctgtcttctctcaa

SEQ ID NO: 6079644 - DNA, 12 bp, Homo sapiens
cctccccttccc

SEQ ID NO: 6079645 - DNA, 22 bp, Homo sapiens
cctccccttgccagctgctgag

SEQ ID NO: 6079646 - DNA, 13 bp, Homo sapiens
cctccccttgcct

SEQ ID NO: 6079647 - DNA, 16 bp, Homo sapiens
cctccccttgggcggc

SEQ ID NO: 6079648 - DNA, 18 bp, Homo sapiens
cctccccttttaccactc

SEQ ID NO: 6079649 - DNA, 20 bp, Homo sapiens
cctccccttttaccactccc

SEQ ID NO: 6079650 - DNA, 16 bp, Homo sapiens
cctcccgacctaccac

SEQ ID NO: 6079651 - DNA, 15 bp, Homo sapiens
cctcccgactgacca

SEQ ID NO: 6079652 - DNA, 19 bp, Homo sapiens
cctcccgagctcctcttcc

SEQ ID NO: 6079653 - DNA, 20 bp, Homo sapiens
cctcccgcatgctgcctgcc

SEQ ID NO: 6079654 - DNA, 20 bp, Homo sapiens
cctcccgccaccctgtctca

SEQ ID NO: 6079655 - DNA, 16 bp, Homo sapiens
cctcccgccaggagct

SEQ ID NO: 6079656 - DNA, 18 bp, Homo sapiens
cctcccgccccagcctcc

SEQ ID NO: 6079657 - DNA, 20 bp, Homo sapiens
cctcccgccccagcctcctg

SEQ ID NO: 6079658 - DNA, 14 bp, Homo sapiens
cctcccgccgcctc

SEQ ID NO: 6079659 - DNA, 23 bp, Homo sapiens
cctcccgccgcctcgggccgcct

SEQ ID NO: 6079660 - DNA, 13 bp, Homo sapiens
cctcccgcttcct

SEQ ID NO: 6079661 - DNA, 14 bp, Homo sapiens
cctcccggccctgc

SEQ ID NO: 6079662 - DNA, 18 bp, Homo sapiens
cctcccggccctgcctgc

SEQ ID NO: 6079663 - DNA, 17 bp, Homo sapiens
cctcccggctgccccca

SEQ ID NO: 6079664 - DNA, 17 bp, Homo sapiens
cctcccggctttgcagg

SEQ ID NO: 6079665 - DNA, 16 bp, Homo sapiens
cctcccggtgcccaag

SEQ ID NO: 6079666 - DNA, 20 bp, Homo sapiens
cctcccgtagtctcctgggt

SEQ ID NO: 6079667 - DNA, 21 bp, Homo sapiens
cctcccgtagtctcctgggtg

SEQ ID NO: 6079668 - DNA, 21 bp, Homo sapiens
cctccctaagttgctgggatt

SEQ ID NO: 6079669 - DNA, 14 bp, Homo sapiens
cctccctacacaca

SEQ ID NO: 6079670 - DNA, 16 bp, Homo sapiens
cctccctacacacaca

SEQ ID NO: 6079671 - DNA, 19 bp, Homo sapiens
cctccctacctcaacctgt

SEQ ID NO: 6079672 - DNA, 22 bp, Homo sapiens
cctccctacctcaacctgtaaa

SEQ ID NO: 6079673 - DNA, 24 bp, Homo sapiens
cctccctacctgaggcctatctga

SEQ ID NO: 6079674 - DNA, 15 bp, Homo sapiens
cctccctactcccct

SEQ ID NO: 6079675 - DNA, 18 bp, Homo sapiens
cctccctagatccaggct

SEQ ID NO: 6079676 - DNA, 15 bp, Homo sapiens
cctccctagccagca

SEQ ID NO: 6079677 - DNA, 13 bp, Homo sapiens
cctccctagccct

SEQ ID NO: 6079678 - DNA, 15 bp, Homo sapiens
cctccctagcccttc

SEQ ID NO: 6079679 - DNA, 22 bp, Homo sapiens
cctccctagcccttccagcctg

SEQ ID NO: 6079680 - DNA, 20 bp, Homo sapiens
cctccctcactgaaggacct

SEQ ID NO: 6079681 - DNA, 22 bp, Homo sapiens
cctccctcactgaaggacctga

SEQ ID NO: 6079682 - DNA, 11 bp, Homo sapiens
cctccctcaga

SEQ ID NO: 6079683 - DNA, 12 bp, Homo sapiens
cctccctcagac

SEQ ID NO: 6079684 - DNA, 13 bp, Homo sapiens
cctccctcagacc

SEQ ID NO: 6079685 - DNA, 23 bp, Homo sapiens
cctccctcagacccaggggtcca

SEQ ID NO: 6079686 - DNA, 11 bp, Homo sapiens
cctccctcagc

SEQ ID NO: 6079687 - DNA, 12 bp, Homo sapiens
cctccctcagcc

SEQ ID NO: 6079688 - DNA, 19 bp, Homo sapiens
cctccctcagccacgcctc

SEQ ID NO: 6079689 - DNA, 14 bp, Homo sapiens
cctccctcagcccc

SEQ ID NO: 6079690 - DNA, 22 bp, Homo sapiens
cctccctcagccgtcagccatc

SEQ ID NO: 6079691 - DNA, 13 bp, Homo sapiens
cctccctcagcct

SEQ ID NO: 6079692 - DNA, 16 bp, Homo sapiens
cctccctcagcctccc

SEQ ID NO: 6079693 - DNA, 15 bp, Homo sapiens
cctccctcaggccca

SEQ ID NO: 6079694 - DNA, 23 bp, Homo sapiens
cctccctcaggcccaggagtcca

SEQ ID NO: 6079695 - DNA, 17 bp, Homo sapiens
cctccctcattcatctt

SEQ ID NO: 6079696 - DNA, 15 bp, Homo sapiens
cctccctccaagcct

SEQ ID NO: 6079697 - DNA, 20 bp, Homo sapiens
cctccctccaagcctggcac

SEQ ID NO: 6079698 - DNA, 13 bp, Homo sapiens
cctccctccaccc

SEQ ID NO: 6079699 - DNA, 16 bp, Homo sapiens
cctccctccaccccag

SEQ ID NO: 6079700 - DNA, 16 bp, Homo sapiens
cctccctccagctgcg

SEQ ID NO: 6079701 - DNA, 14 bp, Homo sapiens
cctccctccagggt

SEQ ID NO: 6079702 - DNA, 15 bp, Homo sapiens
cctccctccagggtc

SEQ ID NO: 6079703 - DNA, 13 bp, Homo sapiens
cctccctcccaca

SEQ ID NO: 6079704 - DNA, 13 bp, Homo sapiens
cctccctcccaga

SEQ ID NO: 6079705 - DNA, 15 bp, Homo sapiens
cctccctcccagatc

SEQ ID NO: 6079706 - DNA, 13 bp, Homo sapiens
cctccctcccagc

SEQ ID NO: 6079707 - DNA, 18 bp, Homo sapiens
cctccctcccagctgcac

SEQ ID NO: 6079708 - DNA, 18 bp, Homo sapiens
cctccctccccagctccg

SEQ ID NO: 6079709 - DNA, 18 bp, Homo sapiens
cctccctcccctgccctc

SEQ ID NO: 6079710 - DNA, 15 bp, Homo sapiens
cctccctccctccac

SEQ ID NO: 6079711 - DNA, 16 bp, Homo sapiens
cctccctccctccaca

SEQ ID NO: 6079712 - DNA, 16 bp, Homo sapiens
cctccctcccttcctt

SEQ ID NO: 6079713 - DNA, 12 bp, Homo sapiens
cctccctcctca

SEQ ID NO: 6079714 - DNA, 13 bp, Homo sapiens
cctccctcctcac

SEQ ID NO: 6079715 - DNA, 15 bp, Homo sapiens
cctccctcctcaggg

SEQ ID NO: 6079716 - DNA, 23 bp, Homo sapiens
cctccctcctcattctctcccta

SEQ ID NO: 6079717 - DNA, 13 bp, Homo sapiens
cctccctcctcgt

SEQ ID NO: 6079718 - DNA, 16 bp, Homo sapiens
cctccctcctctggcc

SEQ ID NO: 6079719 - DNA, 17 bp, Homo sapiens
cctccctcctctggccc

SEQ ID NO: 6079720 - DNA, 12 bp, Homo sapiens
cctccctcctgc

SEQ ID NO: 6079721 - DNA, 15 bp, Homo sapiens
cctccctcctgcagg

SEQ ID NO: 6079722 - DNA, 19 bp, Homo sapiens
cctccctcctgcaggctgg

SEQ ID NO: 6079723 - DNA, 15 bp, Homo sapiens
cctccctcctgccga

SEQ ID NO: 6079724 - DNA, 14 bp, Homo sapiens
cctccctcctgcct

SEQ ID NO: 6079725 - DNA, 13 bp, Homo sapiens
cctccctcctggc

SEQ ID NO: 6079726 - DNA, 14 bp, Homo sapiens
cctccctccttcct

SEQ ID NO: 6079727 - DNA, 12 bp, Homo sapiens
cctccctccttg

SEQ ID NO: 6079728 - DNA, 14 bp, Homo sapiens
cctccctccttggg

SEQ ID NO: 6079729 - DNA, 21 bp, Homo sapiens
cctccctcgtgggcttgtgct

SEQ ID NO: 6079730 - DNA, 13 bp, Homo sapiens
cctccctctaatt

SEQ ID NO: 6079731 - DNA, 23 bp, Homo sapiens
cctccctctcagaggcctgctgc

SEQ ID NO: 6079732 - DNA, 13 bp, Homo sapiens
cctccctctccag

SEQ ID NO: 6079733 - DNA, 13 bp, Homo sapiens
cctccctctcctc

SEQ ID NO: 6079734 - DNA, 13 bp, Homo sapiens
cctccctctctca

SEQ ID NO: 6079735 - DNA, 18 bp, Homo sapiens
cctccctctctcttctgc

SEQ ID NO: 6079736 - DNA, 13 bp, Homo sapiens
cctccctctctgc

SEQ ID NO: 6079737 - DNA, 13 bp, Homo sapiens
cctccctctcttc

SEQ ID NO: 6079738 - DNA, 14 bp, Homo sapiens
cctccctctgacct

SEQ ID NO: 6079739 - DNA, 19 bp, Homo sapiens
cctccctctgaggctgtag

SEQ ID NO: 6079740 - DNA, 13 bp, Homo sapiens
cctccctctgccc

SEQ ID NO: 6079741 - DNA, 17 bp, Homo sapiens
cctccctctgccccaag

SEQ ID NO: 6079742 - DNA, 22 bp, Homo sapiens
cctccctctgccccaagcagcc

SEQ ID NO: 6079743 - DNA, 22 bp, Homo sapiens
cctccctctgcctcatcctcct

SEQ ID NO: 6079744 - DNA, 12 bp, Homo sapiens
cctccctctgct

SEQ ID NO: 6079745 - DNA, 13 bp, Homo sapiens
cctccctcttccc

SEQ ID NO: 6079746 - DNA, 15 bp, Homo sapiens
cctccctcttcccag

SEQ ID NO: 6079747 - DNA, 13 bp, Homo sapiens
cctccctgaacca

SEQ ID NO: 6079748 - DNA, 22 bp, Homo sapiens
cctccctgaccctgcagagatg

SEQ ID NO: 6079749 - DNA, 20 bp, Homo sapiens
cctccctgacgtctgccacc

SEQ ID NO: 6079750 - DNA, 16 bp, Homo sapiens
cctccctgagcctgca

SEQ ID NO: 6079751 - DNA, 22 bp, Homo sapiens
cctccctgagctagaaccctct

SEQ ID NO: 6079752 - DNA, 14 bp, Homo sapiens
cctccctgatgtac

SEQ ID NO: 6079753 - DNA, 16 bp, Homo sapiens
cctccctgcaataaaa

SEQ ID NO: 6079754 - DNA, 14 bp, Homo sapiens
cctccctgcacttc

SEQ ID NO: 6079755 - DNA, 11 bp, Homo sapiens
cctccctgcag

SEQ ID NO: 6079756 - DNA, 14 bp, Homo sapiens
cctccctgcagctt

SEQ ID NO: 6079757 - DNA, 12 bp, Homo sapiens
cctccctgcagg

SEQ ID NO: 6079758 - DNA, 13 bp, Homo sapiens
cctccctgcaggg

SEQ ID NO: 6079759 - DNA, 16 bp, Homo sapiens
cctccctgcaggggct

SEQ ID NO: 6079760 - DNA, 22 bp, Homo sapiens
cctccctgcatctgaccagcag

SEQ ID NO: 6079761 - DNA, 13 bp, Homo sapiens
cctccctgccagt

SEQ ID NO: 6079762 - DNA, 11 bp, Homo sapiens
cctccctgccc

SEQ ID NO: 6079763 - DNA, 14 bp, Homo sapiens
cctccctgcccaaa

SEQ ID NO: 6079764 - DNA, 22 bp, Homo sapiens
cctccctgcccaaactcccctt

SEQ ID NO: 6079765 - DNA, 13 bp, Homo sapiens
cctccctgcccat

SEQ ID NO: 6079766 - DNA, 18 bp, Homo sapiens
cctccctgccccccaagg

SEQ ID NO: 6079767 - DNA, 18 bp, Homo sapiens
cctccctgcccctccctt

SEQ ID NO: 6079768 - DNA, 12 bp, Homo sapiens
cctccctgccct

SEQ ID NO: 6079769 - DNA, 13 bp, Homo sapiens
cctccctgccctg

SEQ ID NO: 6079770 - DNA, 14 bp, Homo sapiens
cctccctgccctgt

SEQ ID NO: 6079771 - DNA, 15 bp, Homo sapiens
cctccctgcctcagg

SEQ ID NO: 6079772 - DNA, 12 bp, Homo sapiens
cctccctgcctg

SEQ ID NO: 6079773 - DNA, 17 bp, Homo sapiens
cctccctgcctgctcct

SEQ ID NO: 6079774 - DNA, 13 bp, Homo sapiens
cctccctgcctgg

SEQ ID NO: 6079775 - DNA, 12 bp, Homo sapiens
cctccctgcgcc

SEQ ID NO: 6079776 - DNA, 20 bp, Homo sapiens
cctccctgcgcttcctgagc

SEQ ID NO: 6079777 - DNA, 19 bp, Homo sapiens
cctccctgctcagtgcttg

SEQ ID NO: 6079778 - DNA, 14 bp, Homo sapiens
cctccctgctccca

SEQ ID NO: 6079779 - DNA, 15 bp, Homo sapiens
cctccctgctcccag

SEQ ID NO: 6079780 - DNA, 18 bp, Homo sapiens
cctccctgctcctcatgg

SEQ ID NO: 6079781 - DNA, 19 bp, Homo sapiens
cctccctgctcctcatggg

SEQ ID NO: 6079782 - DNA, 22 bp, Homo sapiens
cctccctgctgccaggctccca

SEQ ID NO: 6079783 - DNA, 14 bp, Homo sapiens
cctccctgctgtcc

SEQ ID NO: 6079784 - DNA, 15 bp, Homo sapiens
cctccctgctgtccc

SEQ ID NO: 6079785 - DNA, 12 bp, Homo sapiens
cctccctggaga

SEQ ID NO: 6079786 - DNA, 12 bp, Homo sapiens
cctccctggagc

SEQ ID NO: 6079787 - DNA, 13 bp, Homo sapiens
cctccctggagtg

SEQ ID NO: 6079788 - DNA, 18 bp, Homo sapiens
ccccgagggatgatgcca

SEQ ID NO: 6079789 - DNA, 21 bp, Homo sapiens
ccccgagggatgatgccacac

SEQ ID NO: 6079790 - DNA, 22 bp, Homo sapiens
ccccgagggatgatgccacacc

SEQ ID NO: 6079791 - DNA, 19 bp, Homo sapiens
ccccgagggctcagaagag

SEQ ID NO: 6079792 - DNA, 19 bp, Homo sapiens
ccccgagggctgagcctgg

SEQ ID NO: 6079793 - DNA, 21 bp, Homo sapiens
ccccgagggctgagcctggtc

SEQ ID NO: 6079794 - DNA, 22 bp, Homo sapiens
ccccgagggctgaggagcagcc

SEQ ID NO: 6079795 - DNA, 22 bp, Homo sapiens
ccccgatccccgacagtggctc

SEQ ID NO: 6079796 - DNA, 16 bp, Homo sapiens
ccccgatgctgacctc

SEQ ID NO: 6079797 - DNA, 20 bp, Homo sapiens
ccccgatgctgacctcacct

SEQ ID NO: 6079798 - DNA, 20 bp, Homo sapiens
ccccgatgtgagccgcctcg

SEQ ID NO: 6079799 - DNA, 17 bp, Homo sapiens
ccccgcaacccacagct

SEQ ID NO: 6079800 - DNA, 22 bp, Homo sapiens
ccccgcaacccacagctcagct

SEQ ID NO: 6079801 - DNA, 19 bp, Homo sapiens
ccccgcacaaagcggctct

SEQ ID NO: 6079802 - DNA, 17 bp, Homo sapiens
ccccgcacccccgccag

SEQ ID NO: 6079803 - DNA, 15 bp, Homo sapiens
ccccgcacgactgcg

SEQ ID NO: 6079804 - DNA, 16 bp, Homo sapiens
ccccgcacgcaagcct

SEQ ID NO: 6079805 - DNA, 20 bp, Homo sapiens
ccccgcacgcaagcctcagc

SEQ ID NO: 6079806 - DNA, 13 bp, Homo sapiens
ccccgcactgcag

SEQ ID NO: 6079807 - DNA, 15 bp, Homo sapiens
ccccgcactgcagac

SEQ ID NO: 6079808 - DNA, 14 bp, Homo sapiens
ccccgcagacacct

SEQ ID NO: 6079809 - DNA, 14 bp, Homo sapiens
ccccgcagacctcc

SEQ ID NO: 6079810 - DNA, 21 bp, Homo sapiens
ccccgcagacggtctgtgtgc

SEQ ID NO: 6079811 - DNA, 17 bp, Homo sapiens
ccccgcaggatccctcc

SEQ ID NO: 6079812 - DNA, 19 bp, Homo sapiens
ccccgcagtccccagccct

SEQ ID NO: 6079813 - DNA, 22 bp, Homo sapiens
ccccgcagtcgtcagcctccct

SEQ ID NO: 6079814 - DNA, 23 bp, Homo sapiens
ccccgcagtcgtcagcctccctg

SEQ ID NO: 6079815 - DNA, 17 bp, Homo sapiens
ccccgcattccaggctc

SEQ ID NO: 6079816 - DNA, 24 bp, Homo sapiens
ccccgccagcctacactgccagcc

SEQ ID NO: 6079817 - DNA, 18 bp, Homo sapiens
ccccgccatgcatgcagc

SEQ ID NO: 6079818 - DNA, 16 bp, Homo sapiens
ccccgcccacaccctc

SEQ ID NO: 6079819 - DNA, 14 bp, Homo sapiens
ccccgcccacccac

SEQ ID NO: 6079820 - DNA, 14 bp, Homo sapiens
ccccgcccaggctg

SEQ ID NO: 6079821 - DNA, 13 bp, Homo sapiens
ccccgcccatgct

SEQ ID NO: 6079822 - DNA, 13 bp, Homo sapiens
ccccgccccacat

SEQ ID NO: 6079823 - DNA, 16 bp, Homo sapiens
ccccgccccacattcc

SEQ ID NO: 6079824 - DNA, 13 bp, Homo sapiens
ccccgccccagag

SEQ ID NO: 6079825 - DNA, 15 bp, Homo sapiens
ccccgccccagagct

SEQ ID NO: 6079826 - DNA, 16 bp, Homo sapiens
ccccgccccagagctc

SEQ ID NO: 6079827 - DNA, 22 bp, Homo sapiens
ccccgcccccacccctacagcc

SEQ ID NO: 6079828 - DNA, 12 bp, Homo sapiens
ccccgcccccag

SEQ ID NO: 6079829 - DNA, 17 bp, Homo sapiens
ccccgccccccagagcc

SEQ ID NO: 6079830 - DNA, 14 bp, Homo sapiens
ccccgcccccgccc

SEQ ID NO: 6079831 - DNA, 18 bp, Homo sapiens
ccccgcccccgccccgcg

SEQ ID NO: 6079832 - DNA, 14 bp, Homo sapiens
ccccgccccctgaa

SEQ ID NO: 6079833 - DNA, 13 bp, Homo sapiens
ccccgccccgccc

SEQ ID NO: 6079834 - DNA, 13 bp, Homo sapiens
ccccgcccctccc

SEQ ID NO: 6079835 - DNA, 16 bp, Homo sapiens
ccccgcccctcccacg

SEQ ID NO: 6079836 - DNA, 16 bp, Homo sapiens
ccccgcccgcacagct

SEQ ID NO: 6079837 - DNA, 18 bp, Homo sapiens
ccccgcccgccctcctct

SEQ ID NO: 6079838 - DNA, 20 bp, Homo sapiens
ccccgcccgccctcctctgc

SEQ ID NO: 6079839 - DNA, 13 bp, Homo sapiens
ccccgccctctgc

SEQ ID NO: 6079840 - DNA, 13 bp, Homo sapiens
ccccgcctcaagg

SEQ ID NO: 6079841 - DNA, 23 bp, Homo sapiens
ccccgcctcaaggaagagccagc

SEQ ID NO: 6079842 - DNA, 15 bp, Homo sapiens
ccccgcctcccagcc

SEQ ID NO: 6079843 - DNA, 14 bp, Homo sapiens
ccccgcctcctccc

SEQ ID NO: 6079844 - DNA, 12 bp, Homo sapiens
ccccgcctgagt

SEQ ID NO: 6079845 - DNA, 14 bp, Homo sapiens
ccccgcctgcagtc

SEQ ID NO: 6079846 - DNA, 18 bp, Homo sapiens
ccccgcctgccctcatgg

SEQ ID NO: 6079847 - DNA, 22 bp, Homo sapiens
ccccgcctggccagggcagggc

SEQ ID NO: 6079848 - DNA, 15 bp, Homo sapiens
ccccgcctgggcacc

SEQ ID NO: 6079849 - DNA, 15 bp, Homo sapiens
ccccgccttccctca

SEQ ID NO: 6079850 - DNA, 15 bp, Homo sapiens
ccccgccttcctggg

SEQ ID NO: 6079851 - DNA, 21 bp, Homo sapiens
ccccgccttcgtgtgctgctg

SEQ ID NO: 6079852 - DNA, 22 bp, Homo sapiens
ccccgcgaccatgtggccacaa

SEQ ID NO: 6079853 - DNA, 18 bp, Homo sapiens
ccccgcgctcgcccagca

SEQ ID NO: 6079854 - DNA, 21 bp, Homo sapiens
ccccgcgctcgcccagcagga

SEQ ID NO: 6079855 - DNA, 22 bp, Homo sapiens
ccccgcgctcgcccagcaggag

SEQ ID NO: 6079856 - DNA, 14 bp, Homo sapiens
ccccgcggagcccc

SEQ ID NO: 6079857 - DNA, 20 bp, Homo sapiens
ccccgcggatcaaccaggca

SEQ ID NO: 6079858 - DNA, 12 bp, Homo sapiens
ccccgcggccca

SEQ ID NO: 6079859 - DNA, 13 bp, Homo sapiens
ccccgcggcccag

SEQ ID NO: 6079860 - DNA, 16 bp, Homo sapiens
ccccgcgggttctaga

SEQ ID NO: 6079861 - DNA, 16 bp, Homo sapiens
ccccgcggtgctctgg

SEQ ID NO: 6079862 - DNA, 18 bp, Homo sapiens
ccccgcggtgctctggcg

SEQ ID NO: 6079863 - DNA, 23 bp, Homo sapiens
ccccgcggttcatacgcatccca

SEQ ID NO: 6079864 - DNA, 17 bp, Homo sapiens
ccccgcgtccgagaagg

SEQ ID NO: 6079865 - DNA, 16 bp, Homo sapiens
ccccgctaaggaagat

SEQ ID NO: 6079866 - DNA, 23 bp, Homo sapiens
ccccgctcacgctgacagcctcc

SEQ ID NO: 6079867 - DNA, 23 bp, Homo sapiens
ccccgctcatgggcccctctgac

SEQ ID NO: 6079868 - DNA, 14 bp, Homo sapiens
ccccgctccagatc

SEQ ID NO: 6079869 - DNA, 12 bp, Homo sapiens
ccccgctcccac

SEQ ID NO: 6079870 - DNA, 13 bp, Homo sapiens
ccccgctccgtct

SEQ ID NO: 6079871 - DNA, 15 bp, Homo sapiens
ccccgctctccctgt

SEQ ID NO: 6079872 - DNA, 16 bp, Homo sapiens
ccccgctctccctgtc

SEQ ID NO: 6079873 - DNA, 14 bp, Homo sapiens
ccccgctctgcatg

SEQ ID NO: 6079874 - DNA, 15 bp, Homo sapiens
ccccgctgcctggcg

SEQ ID NO: 6079875 - DNA, 13 bp, Homo sapiens
ccccgctgctccc

SEQ ID NO: 6079876 - DNA, 13 bp, Homo sapiens
ccccgctgctgtg

SEQ ID NO: 6079877 - DNA, 15 bp, Homo sapiens
ccccgctggcagcca

SEQ ID NO: 6079878 - DNA, 14 bp, Homo sapiens
ccccgctggctcac

SEQ ID NO: 6079879 - DNA, 20 bp, Homo sapiens
ccccgcttagccccgctgag

SEQ ID NO: 6079880 - DNA, 12 bp, Homo sapiens
ccccgcttcccc

SEQ ID NO: 6079881 - DNA, 17 bp, Homo sapiens
ccccgcttcctccctct

SEQ ID NO: 6079882 - DNA, 17 bp, Homo sapiens
ccccgcttgtccagcgc

SEQ ID NO: 6079883 - DNA, 18 bp, Homo sapiens
ccccgcttgtccagcgcc

SEQ ID NO: 6079884 - DNA, 18 bp, Homo sapiens
ccccggacaagcccagga

SEQ ID NO: 6079885 - DNA, 21 bp, Homo sapiens
ccccggacatactctctgcct

SEQ ID NO: 6079886 - DNA, 13 bp, Homo sapiens
ccccggacgccgc

SEQ ID NO: 6079887 - DNA, 22 bp, Homo sapiens
ccccggagctgggaaggtcccg

SEQ ID NO: 6079888 - DNA, 19 bp, Homo sapiens
ccccggaggaagcttgggg

SEQ ID NO: 6079889 - DNA, 17 bp, Homo sapiens
ccccggaggcgcccacc

SEQ ID NO: 6079890 - DNA, 21 bp, Homo sapiens
ccccggaggcgcccacctgcc

SEQ ID NO: 6079891 - DNA, 13 bp, Homo sapiens
ccccggcaagcca

SEQ ID NO: 6079892 - DNA, 22 bp, Homo sapiens
ccccggcatcatttcccctccc

SEQ ID NO: 6079893 - DNA, 18 bp, Homo sapiens
ccccggccaaggacccag

SEQ ID NO: 6079894 - DNA, 19 bp, Homo sapiens
ccccggccaaggacccagg

SEQ ID NO: 6079895 - DNA, 21 bp, Homo sapiens
ccccggccaaggacccaggcg

SEQ ID NO: 6079896 - DNA, 14 bp, Homo sapiens
ccccggccacctgc

SEQ ID NO: 6079897 - DNA, 18 bp, Homo sapiens
ccccggcccaacctcgcc

SEQ ID NO: 6079898 - DNA, 21 bp, Homo sapiens
ccccggcccaacctcgccctc

SEQ ID NO: 6079899 - DNA, 18 bp, Homo sapiens
ccccggccccagccagag

SEQ ID NO: 6079900 - DNA, 19 bp, Homo sapiens
ccccggcccccagcaggga

SEQ ID NO: 6079901 - DNA, 12 bp, Homo sapiens
ccccggccccct

SEQ ID NO: 6079902 - DNA, 18 bp, Homo sapiens
ccccggccccggccccag

SEQ ID NO: 6079903 - DNA, 13 bp, Homo sapiens
ccccggccctggg

SEQ ID NO: 6079904 - DNA, 13 bp, Homo sapiens
ccccggcctcagg

SEQ ID NO: 6079905 - DNA, 23 bp, Homo sapiens
ccccggcctcagggcgctcagac

SEQ ID NO: 6079906 - DNA, 15 bp, Homo sapiens
ccccggcctccaggc

SEQ ID NO: 6079907 - DNA, 20 bp, Homo sapiens
ccccggcctccaggctgggg

SEQ ID NO: 6079908 - DNA, 15 bp, Homo sapiens
ccccggcggcgccgg

SEQ ID NO: 6079909 - DNA, 16 bp, Homo sapiens
ccccggcggtgccgcg

SEQ ID NO: 6079910 - DNA, 19 bp, Homo sapiens
ccccggcggtgccgcgctc

SEQ ID NO: 6079911 - DNA, 24 bp, Homo sapiens
ccccggctgcttccttctgcaccc

SEQ ID NO: 6079912 - DNA, 17 bp, Homo sapiens
ccccgggaaaggccggt

SEQ ID NO: 6079913 - DNA, 23 bp, Homo sapiens
ccccgggaggggcccgcttgcct

SEQ ID NO: 6079914 - DNA, 15 bp, Homo sapiens
ccccgggatattata

SEQ ID NO: 6079915 - DNA, 17 bp, Homo sapiens
ccccgggatgcgaggct

SEQ ID NO: 6079916 - DNA, 14 bp, Homo sapiens
ccccgggcagcaga

SEQ ID NO: 6079917 - DNA, 20 bp, Homo sapiens
ccccgggcagcagagagaga

SEQ ID NO: 6079918 - DNA, 13 bp, Homo sapiens
ccccgggcccttt

SEQ ID NO: 6079919 - DNA, 13 bp, Homo sapiens
ccccgggcctgca

SEQ ID NO: 6079920 - DNA, 16 bp, Homo sapiens
ccccgggcctgcacag

SEQ ID NO: 6079921 - DNA, 14 bp, Homo sapiens
ccccgggcctgcct

SEQ ID NO: 6079922 - DNA, 18 bp, Homo sapiens
ccccgggctctctgctgt

SEQ ID NO: 6079923 - DNA, 18 bp, Homo sapiens
ccccgggctggagaaaga

SEQ ID NO: 6079924 - DNA, 20 bp, Homo sapiens
ccccgggctggagaaagagc

SEQ ID NO: 6079925 - DNA, 20 bp, Homo sapiens
ccccgggctggccctgtgca

SEQ ID NO: 6079926 - DNA, 21 bp, Homo sapiens
ccccgggctgggcccctccag

SEQ ID NO: 6079927 - DNA, 17 bp, Homo sapiens
ccccggggaccctgtga

SEQ ID NO: 6079928 - DNA, 21 bp, Homo sapiens
ccccggggcatggacagggcc

SEQ ID NO: 6079929 - DNA, 17 bp, Homo sapiens
ccccggggccccctggt

SEQ ID NO: 6079930 - DNA, 13 bp, Homo sapiens
ccccggggcctgt

SEQ ID NO: 6079931 - DNA, 12 bp, Homo sapiens
ccccggggctgg

SEQ ID NO: 6079932 - DNA, 13 bp, Homo sapiens
ccccggggctggc

SEQ ID NO: 6079933 - DNA, 14 bp, Homo sapiens
ccccggggctggca

SEQ ID NO: 6079934 - DNA, 17 bp, Homo sapiens
ccccgggggaggaaggg

SEQ ID NO: 6079935 - DNA, 23 bp, Homo sapiens
ccccgggggccaactcacccttg

SEQ ID NO: 6079936 - DNA, 21 bp, Homo sapiens
ccccggggtattagcacctct

SEQ ID NO: 6079937 - DNA, 17 bp, Homo sapiens
ccccgggtccccagctc

SEQ ID NO: 6079938 - DNA, 22 bp, Homo sapiens
ccccgggtccccagctccccag

SEQ ID NO: 6079939 - DNA, 15 bp, Homo sapiens
ccccggtcccttgag

SEQ ID NO: 6079940 - DNA, 15 bp, Homo sapiens
ccccggtggctgggc

SEQ ID NO: 6079941 - DNA, 18 bp, Homo sapiens
ccccggttgctggtcagg

SEQ ID NO: 6079942 - DNA, 21 bp, Homo sapiens
ccccgtactaggttggacagc

SEQ ID NO: 6079943 - DNA, 18 bp, Homo sapiens
ccccgtagccccggcccc

SEQ ID NO: 6079944 - DNA, 15 bp, Homo sapiens
ccccgtcaagagtga

SEQ ID NO: 6079945 - DNA, 14 bp, Homo sapiens
ccccgtcacagcct

SEQ ID NO: 6079946 - DNA, 16 bp, Homo sapiens
ccccgtcacagcctca

SEQ ID NO: 6079947 - DNA, 21 bp, Homo sapiens
ccccgtcaccatctcaggcca

SEQ ID NO: 6079948 - DNA, 14 bp, Homo sapiens
ccccgtcaccccgc

SEQ ID NO: 6079949 - DNA, 16 bp, Homo sapiens
ccccgtcagggagagg

SEQ ID NO: 6079950 - DNA, 14 bp, Homo sapiens
ccccgtcccacctc

SEQ ID NO: 6079951 - DNA, 16 bp, Homo sapiens
ccccgtcccacctcgc

SEQ ID NO: 6079952 - DNA, 20 bp, Homo sapiens
ccccgtccccctctggctcc

SEQ ID NO: 6079953 - DNA, 16 bp, Homo sapiens
ccccgtcccctaaccc

SEQ ID NO: 6079954 - DNA, 17 bp, Homo sapiens
ccccgtcccctgcagcc

SEQ ID NO: 6079955 - DNA, 22 bp, Homo sapiens
ccccgtcccctgcagcctgggt

SEQ ID NO: 6079956 - DNA, 15 bp, Homo sapiens
ccccgtccctttccc

SEQ ID NO: 6079957 - DNA, 14 bp, Homo sapiens
ccccgtcggaatgg

SEQ ID NO: 6079958 - DNA, 13 bp, Homo sapiens
ccccgtctcaggt

SEQ ID NO: 6079959 - DNA, 14 bp, Homo sapiens
ccccgtctctacta

SEQ ID NO: 6079960 - DNA, 18 bp, Homo sapiens
ccccgtctctcttggacc

SEQ ID NO: 6079961 - DNA, 13 bp, Homo sapiens
ccccgtctctgcc

SEQ ID NO: 6079962 - DNA, 13 bp, Homo sapiens
ccccgtctctgtt

SEQ ID NO: 6079963 - DNA, 13 bp, Homo sapiens
ccccgtctgcccc

SEQ ID NO: 6079964 - DNA, 21 bp, Homo sapiens
ccccgtctggggttcagcccc

SEQ ID NO: 6079965 - DNA, 17 bp, Homo sapiens
ccccgtcttgtaaaaag

SEQ ID NO: 6079966 - DNA, 12 bp, Homo sapiens
ccccgtgcccct

SEQ ID NO: 6079967 - DNA, 13 bp, Homo sapiens
ccccgtgcggccc

SEQ ID NO: 6079968 - DNA, 14 bp, Homo sapiens
ccccgtgcggcccg

SEQ ID NO: 6079969 - DNA, 12 bp, Homo sapiens
cctccctggatg

SEQ ID NO: 6079970 - DNA, 12 bp, Homo sapiens
cctccctggcac

SEQ ID NO: 6079971 - DNA, 13 bp, Homo sapiens
cctccctggcaga

SEQ ID NO: 6079972 - DNA, 17 bp, Homo sapiens
cctccctggcagacaca

SEQ ID NO: 6079973 - DNA, 12 bp, Homo sapiens
cctccctggctc

SEQ ID NO: 6079974 - DNA, 16 bp, Homo sapiens
cctccctggctcaagc

SEQ ID NO: 6079975 - DNA, 16 bp, Homo sapiens
cctccctggctcccat

SEQ ID NO: 6079976 - DNA, 18 bp, Homo sapiens
cctccctggctcccatga

SEQ ID NO: 6079977 - DNA, 14 bp, Homo sapiens
cctccctggctcct

SEQ ID NO: 6079978 - DNA, 15 bp, Homo sapiens
cctccctggctgcag

SEQ ID NO: 6079979 - DNA, 14 bp, Homo sapiens
cctccctggctgcc

SEQ ID NO: 6079980 - DNA, 15 bp, Homo sapiens
cctccctggctgccc

SEQ ID NO: 6079981 - DNA, 18 bp, Homo sapiens
cctccctggctgccctgg

SEQ ID NO: 6079982 - DNA, 22 bp, Homo sapiens
cctccctggctgccctggccct

SEQ ID NO: 6079983 - DNA, 16 bp, Homo sapiens
cctccctggctgtgag

SEQ ID NO: 6079984 - DNA, 22 bp, Homo sapiens
cctccctggctgtgagcagcct

SEQ ID NO: 6079985 - DNA, 12 bp, Homo sapiens
cctccctgggat

SEQ ID NO: 6079986 - DNA, 13 bp, Homo sapiens
cctccctgggatg

SEQ ID NO: 6079987 - DNA, 17 bp, Homo sapiens
cctccctgggccacctc

SEQ ID NO: 6079988 - DNA, 22 bp, Homo sapiens
cctccctgggccacctcctacc

SEQ ID NO: 6079989 - DNA, 16 bp, Homo sapiens
cctccctgggcctgtc

SEQ ID NO: 6079990 - DNA, 17 bp, Homo sapiens
cctccctgggcctgtct

SEQ ID NO: 6079991 - DNA, 18 bp, Homo sapiens
cctccctgggcctgtctc

SEQ ID NO: 6079992 - DNA, 19 bp, Homo sapiens
cctccctgggcctgtctca

SEQ ID NO: 6079993 - DNA, 20 bp, Homo sapiens
cctccctgggctaagcaggg

SEQ ID NO: 6079994 - DNA, 18 bp, Homo sapiens
cctccctggggaccagga

SEQ ID NO: 6079995 - DNA, 23 bp, Homo sapiens
cctccctggggaccaggagctag

SEQ ID NO: 6079996 - DNA, 17 bp, Homo sapiens
cctccctgggggcggga

SEQ ID NO: 6079997 - DNA, 19 bp, Homo sapiens
cctccctgtaatgcactcc

SEQ ID NO: 6079998 - DNA, 22 bp, Homo sapiens
cctccctgtaatgcactcctgc

SEQ ID NO: 6079999 - DNA, 12 bp, Homo sapiens
cctccctgtcaa

SEQ ID NO: 6080000 - DNA, 21 bp, Homo sapiens
cctccctgtcactcagctgag

SEQ ID NO: 6080001 - DNA, 12 bp, Homo sapiens
cctccctgtccc

SEQ ID NO: 6080002 - DNA, 15 bp, Homo sapiens
cctccctgtcctcct

SEQ ID NO: 6080003 - DNA, 18 bp, Homo sapiens
cctccctgtctccagggc

SEQ ID NO: 6080004 - DNA, 19 bp, Homo sapiens
cctccctgtgcccccagcc

SEQ ID NO: 6080005 - DNA, 23 bp, Homo sapiens
cctccctgtgcccccagcctcag

SEQ ID NO: 6080006 - DNA, 15 bp, Homo sapiens
cctccctgttcccca

SEQ ID NO: 6080007 - DNA, 19 bp, Homo sapiens
cctccctgttccccacagg

SEQ ID NO: 6080008 - DNA, 24 bp, Homo sapiens
cctccctgttccccacaggtcctc

SEQ ID NO: 6080009 - DNA, 16 bp, Homo sapiens
cctccctgtttctcca

SEQ ID NO: 6080010 - DNA, 10 bp, Homo sapiens
cctcccttcc

SEQ ID NO: 6080011 - DNA, 12 bp, Homo sapiens
cctcccttccca

SEQ ID NO: 6080012 - DNA, 13 bp, Homo sapiens
cctcccttcccac

SEQ ID NO: 6080013 - DNA, 16 bp, Homo sapiens
cctcccttcccagtgg

SEQ ID NO: 6080014 - DNA, 21 bp, Homo sapiens
cctcccttccctccctgaggc

SEQ ID NO: 6080015 - DNA, 15 bp, Homo sapiens
cctcccttccgaccc

SEQ ID NO: 6080016 - DNA, 20 bp, Homo sapiens
cctcccttccgaccctctgg

SEQ ID NO: 6080017 - DNA, 12 bp, Homo sapiens
cctcccttcctc

SEQ ID NO: 6080018 - DNA, 16 bp, Homo sapiens
cctcccttcctccgct

SEQ ID NO: 6080019 - DNA, 19 bp, Homo sapiens
cctcccttccttgggcaga

SEQ ID NO: 6080020 - DNA, 20 bp, Homo sapiens
cctcccttccttgggcagaa

SEQ ID NO: 6080021 - DNA, 18 bp, Homo sapiens
cctcccttctccctggat

SEQ ID NO: 6080022 - DNA, 17 bp, Homo sapiens
cctcccttctttccttc

SEQ ID NO: 6080023 - DNA, 22 bp, Homo sapiens
cctcccttgagaattccctgtg

SEQ ID NO: 6080024 - DNA, 20 bp, Homo sapiens
cctcccttgagtaggccctg

SEQ ID NO: 6080025 - DNA, 22 bp, Homo sapiens
cctcccttgagtaggccctgct

SEQ ID NO: 6080026 - DNA, 23 bp, Homo sapiens
cctcccttgagtaggccctgctt

SEQ ID NO: 6080027 - DNA, 14 bp, Homo sapiens
cctcccttgcccca

SEQ ID NO: 6080028 - DNA, 22 bp, Homo sapiens
cctcccttgccccaggccaggt

SEQ ID NO: 6080029 - DNA, 13 bp, Homo sapiens
cctcccttgcctt

SEQ ID NO: 6080030 - DNA, 18 bp, Homo sapiens
cctcccttgctgaacaca

SEQ ID NO: 6080031 - DNA, 21 bp, Homo sapiens
cctcccttgctgaacacacac

SEQ ID NO: 6080032 - DNA, 21 bp, Homo sapiens
cctcccttggaaacctgccct

SEQ ID NO: 6080033 - DNA, 23 bp, Homo sapiens
cctcccttggaaacctgccctgc

SEQ ID NO: 6080034 - DNA, 19 bp, Homo sapiens
cctcccttgggttctgata

SEQ ID NO: 6080035 - DNA, 17 bp, Homo sapiens
cctcccttgtccttgaa

SEQ ID NO: 6080036 - DNA, 14 bp, Homo sapiens
cctccctttctccc

SEQ ID NO: 6080037 - DNA, 16 bp, Homo sapiens
cctccctttctctctc

SEQ ID NO: 6080038 - DNA, 16 bp, Homo sapiens
cctccctttggggaga

SEQ ID NO: 6080039 - DNA, 21 bp, Homo sapiens
cctcccttttatcttctagcc

SEQ ID NO: 6080040 - DNA, 17 bp, Homo sapiens
cctccctttttccttgt

SEQ ID NO: 6080041 - DNA, 18 bp, Homo sapiens
cctccctttttccttgtc

SEQ ID NO: 6080042 - DNA, 19 bp, Homo sapiens
cctccctttttccttgtcc

SEQ ID NO: 6080043 - DNA, 17 bp, Homo sapiens
cctccgacgctgcctct

SEQ ID NO: 6080044 - DNA, 14 bp, Homo sapiens
cctccgactccaga

SEQ ID NO: 6080045 - DNA, 12 bp, Homo sapiens
cctccgagacag

SEQ ID NO: 6080046 - DNA, 22 bp, Homo sapiens
cctccgagacagtccagtgtca

SEQ ID NO: 6080047 - DNA, 20 bp, Homo sapiens
cctccgagaggcagccagac

SEQ ID NO: 6080048 - DNA, 14 bp, Homo sapiens
cctccgagcttggg

SEQ ID NO: 6080049 - DNA, 19 bp, Homo sapiens
cctccgaggcctacctgct

SEQ ID NO: 6080050 - DNA, 14 bp, Homo sapiens
cctccgaggctccc

SEQ ID NO: 6080051 - DNA, 19 bp, Homo sapiens
cctccgaggctccccgcct

SEQ ID NO: 6080052 - DNA, 23 bp, Homo sapiens
cctccgatgctgaggccacccac

SEQ ID NO: 6080053 - DNA, 19 bp, Homo sapiens
cctccgcagcagggaagct

SEQ ID NO: 6080054 - DNA, 15 bp, Homo sapiens
cctccgcagtgtctc

SEQ ID NO: 6080055 - DNA, 17 bp, Homo sapiens
cctccgcagtgtctcca

SEQ ID NO: 6080056 - DNA, 20 bp, Homo sapiens
cctccgccaatgcacggcct

SEQ ID NO: 6080057 - DNA, 12 bp, Homo sapiens
cctccgccagcc

SEQ ID NO: 6080058 - DNA, 14 bp, Homo sapiens
cctccgccaggcga

SEQ ID NO: 6080059 - DNA, 14 bp, Homo sapiens
cctccgccatccac

SEQ ID NO: 6080060 - DNA, 23 bp, Homo sapiens
cctccgccattctcaagccctgc

SEQ ID NO: 6080061 - DNA, 19 bp, Homo sapiens
cctccgccccagacacacc

SEQ ID NO: 6080062 - DNA, 12 bp, Homo sapiens
cctccgccctgc

SEQ ID NO: 6080063 - DNA, 15 bp, Homo sapiens
cctccgccctgccac

SEQ ID NO: 6080064 - DNA, 18 bp, Homo sapiens
cctccgccctgccactca

SEQ ID NO: 6080065 - DNA, 19 bp, Homo sapiens
cctccgccctttttgtcct

SEQ ID NO: 6080066 - DNA, 20 bp, Homo sapiens
cctccgcctactgtccctct

SEQ ID NO: 6080067 - DNA, 14 bp, Homo sapiens
cctccgcctcccag

SEQ ID NO: 6080068 - DNA, 16 bp, Homo sapiens
cctccgcctcccgggt

SEQ ID NO: 6080069 - DNA, 13 bp, Homo sapiens
cctccgcctcctg

SEQ ID NO: 6080070 - DNA, 13 bp, Homo sapiens
cctccgcctcttg

SEQ ID NO: 6080071 - DNA, 15 bp, Homo sapiens
cctccgcctgggatc

SEQ ID NO: 6080072 - DNA, 22 bp, Homo sapiens
cctccgcctgggtcatgggcct

SEQ ID NO: 6080073 - DNA, 18 bp, Homo sapiens
cctccgccttcacattcc

SEQ ID NO: 6080074 - DNA, 15 bp, Homo sapiens
cctccgcggcgggcc

SEQ ID NO: 6080075 - DNA, 18 bp, Homo sapiens
cctccgcggcgggccctg

SEQ ID NO: 6080076 - DNA, 17 bp, Homo sapiens
cctccgcggctggagcg

SEQ ID NO: 6080077 - DNA, 21 bp, Homo sapiens
cctccgctaaggcttccggct

SEQ ID NO: 6080078 - DNA, 23 bp, Homo sapiens
cctccgctaaggcttccggctga

SEQ ID NO: 6080079 - DNA, 19 bp, Homo sapiens
cctccgctcccctttccca

SEQ ID NO: 6080080 - DNA, 21 bp, Homo sapiens
cctccgctcccctttcccatc

SEQ ID NO: 6080081 - DNA, 19 bp, Homo sapiens
cctccgctgggaggaacct

SEQ ID NO: 6080082 - DNA, 21 bp, Homo sapiens
cctccgctgggcttcattccg

SEQ ID NO: 6080083 - DNA, 17 bp, Homo sapiens
cctccgcttatcctgct

SEQ ID NO: 6080084 - DNA, 18 bp, Homo sapiens
cctccgcttatcctgcta

SEQ ID NO: 6080085 - DNA, 19 bp, Homo sapiens
cctccgcttgccagaggcc

SEQ ID NO: 6080086 - DNA, 13 bp, Homo sapiens
cctccggactggt

SEQ ID NO: 6080087 - DNA, 16 bp, Homo sapiens
cctccggactggtgcc

SEQ ID NO: 6080088 - DNA, 22 bp, Homo sapiens
cctccggagcctcatgttctct

SEQ ID NO: 6080089 - DNA, 19 bp, Homo sapiens
cctccggaggagcagcctc

SEQ ID NO: 6080090 - DNA, 18 bp, Homo sapiens
cctccggccatactgcct

SEQ ID NO: 6080091 - DNA, 13 bp, Homo sapiens
cctccggccctgc

SEQ ID NO: 6080092 - DNA, 16 bp, Homo sapiens
cctccggcctcccctc

SEQ ID NO: 6080093 - DNA, 19 bp, Homo sapiens
cctccggcgtcagcctcca

SEQ ID NO: 6080094 - DNA, 20 bp, Homo sapiens
cctccggcgtcagcctccag

SEQ ID NO: 6080095 - DNA, 22 bp, Homo sapiens
cctccggcgtcagcctccagcc

SEQ ID NO: 6080096 - DNA, 14 bp, Homo sapiens
cctccggctaagca

SEQ ID NO: 6080097 - DNA, 18 bp, Homo sapiens
cctccggctggacctggg

SEQ ID NO: 6080098 - DNA, 22 bp, Homo sapiens
cctccgggactgaccttcggca

SEQ ID NO: 6080099 - DNA, 16 bp, Homo sapiens
cctccgggcaggcaag

SEQ ID NO: 6080100 - DNA, 13 bp, Homo sapiens
cctccgggcaggg

SEQ ID NO: 6080101 - DNA, 22 bp, Homo sapiens
cctccgggcaggggagccaggg

SEQ ID NO: 6080102 - DNA, 19 bp, Homo sapiens
cctccgggcctcggcctgg

SEQ ID NO: 6080103 - DNA, 14 bp, Homo sapiens
cctccggggagagc

SEQ ID NO: 6080104 - DNA, 19 bp, Homo sapiens
cctccggggagagcagagg

SEQ ID NO: 6080105 - DNA, 19 bp, Homo sapiens
cctccggggctcagccctg

SEQ ID NO: 6080106 - DNA, 21 bp, Homo sapiens
cctccggggttcagcctcctg

SEQ ID NO: 6080107 - DNA, 22 bp, Homo sapiens
cctccgtagggtctttcttggg

SEQ ID NO: 6080108 - DNA, 14 bp, Homo sapiens
cctccgtcactacc

SEQ ID NO: 6080109 - DNA, 13 bp, Homo sapiens
cctccgtcatcca

SEQ ID NO: 6080110 - DNA, 17 bp, Homo sapiens
cctccgtcatccatgcc

SEQ ID NO: 6080111 - DNA, 15 bp, Homo sapiens
cctccgtccacccag

SEQ ID NO: 6080112 - DNA, 18 bp, Homo sapiens
cctccgtccacccaggct

SEQ ID NO: 6080113 - DNA, 20 bp, Homo sapiens
cctccgtccacccaggctgc

SEQ ID NO: 6080114 - DNA, 15 bp, Homo sapiens
cctccgtccatatca

SEQ ID NO: 6080115 - DNA, 15 bp, Homo sapiens
cctccgtcccacccc

SEQ ID NO: 6080116 - DNA, 16 bp, Homo sapiens
cctccgtccctctgtc

SEQ ID NO: 6080117 - DNA, 16 bp, Homo sapiens
cctccgtcctggcagg

SEQ ID NO: 6080118 - DNA, 23 bp, Homo sapiens
cctccgtcgggcccctgcctgcc

SEQ ID NO: 6080119 - DNA, 18 bp, Homo sapiens
cctccgtctgaccctctg

SEQ ID NO: 6080120 - DNA, 19 bp, Homo sapiens
cctccgtctgaccctctgc

SEQ ID NO: 6080121 - DNA, 14 bp, Homo sapiens
cctccgtgctgggc

SEQ ID NO: 6080122 - DNA, 16 bp, Homo sapiens
cctccgtggaacattc

SEQ ID NO: 6080123 - DNA, 18 bp, Homo sapiens
cctccgtgggcagctcct

SEQ ID NO: 6080124 - DNA, 22 bp, Homo sapiens
cctccgtgggcagctcctcggg

SEQ ID NO: 6080125 - DNA, 15 bp, Homo sapiens
cctccgtgtggagca

SEQ ID NO: 6080126 - DNA, 18 bp, Homo sapiens
cctccgttcccacctctg

SEQ ID NO: 6080127 - DNA, 24 bp, Homo sapiens
cctccgttcccacctctgaggact

SEQ ID NO: 6080128 - DNA, 19 bp, Homo sapiens
cctccgttcctcctcagcc

SEQ ID NO: 6080129 - DNA, 23 bp, Homo sapiens
cctccgttgcggctgtgctcctg

SEQ ID NO: 6080130 - DNA, 21 bp, Homo sapiens
cctccgtttatgggccttgct

SEQ ID NO: 6080131 - DNA, 19 bp, Homo sapiens
cctcctaaaaggcccagag

SEQ ID NO: 6080132 - DNA, 21 bp, Homo sapiens
cctcctaaaaggcccagagag

SEQ ID NO: 6080133 - DNA, 14 bp, Homo sapiens
cctcctaaagctga

SEQ ID NO: 6080134 - DNA, 21 bp, Homo sapiens
cctcctaaatgtcagctgttg

SEQ ID NO: 6080135 - DNA, 17 bp, Homo sapiens
cctcctaagcagctggg

SEQ ID NO: 6080136 - DNA, 16 bp, Homo sapiens
cctcctaagtcccttc

SEQ ID NO: 6080137 - DNA, 17 bp, Homo sapiens
cctcctaagtcccttcc

SEQ ID NO: 6080138 - DNA, 18 bp, Homo sapiens
cctcctaagtcccttcct

SEQ ID NO: 6080139 - DNA, 15 bp, Homo sapiens
cctcctaatggcatg

SEQ ID NO: 6080140 - DNA, 21 bp, Homo sapiens
cctcctaatggcatggagact

SEQ ID NO: 6080141 - DNA, 16 bp, Homo sapiens
cctcctacccctccca

SEQ ID NO: 6080142 - DNA, 17 bp, Homo sapiens
cctcctaccccttcctg

SEQ ID NO: 6080143 - DNA, 23 bp, Homo sapiens
cctcctacctggggactcctcaa

SEQ ID NO: 6080144 - DNA, 19 bp, Homo sapiens
cctcctagaaaacccttcc

SEQ ID NO: 6080145 - DNA, 13 bp, Homo sapiens
cctcctagaactc

SEQ ID NO: 6080146 - DNA, 18 bp, Homo sapiens
cctcctagacccaggtgg

SEQ ID NO: 6080147 - DNA, 13 bp, Homo sapiens
ccccgtgctcctc

SEQ ID NO: 6080148 - DNA, 18 bp, Homo sapiens
ccccgtggatggtctcca

SEQ ID NO: 6080149 - DNA, 16 bp, Homo sapiens
ccccgtggctctggga

SEQ ID NO: 6080150 - DNA, 19 bp, Homo sapiens
ccccgtggctctgggagag

SEQ ID NO: 6080151 - DNA, 17 bp, Homo sapiens
ccccgtgggccatggca

SEQ ID NO: 6080152 - DNA, 16 bp, Homo sapiens
ccccgtggggctcccg

SEQ ID NO: 6080153 - DNA, 19 bp, Homo sapiens
ccccgtgtaaaaagcctcc

SEQ ID NO: 6080154 - DNA, 17 bp, Homo sapiens
ccccgtgtctggatgca

SEQ ID NO: 6080155 - DNA, 22 bp, Homo sapiens
ccccgtgtgaatgtagcttcca

SEQ ID NO: 6080156 - DNA, 22 bp, Homo sapiens
ccccgtgtgcacaccaccctcc

SEQ ID NO: 6080157 - DNA, 12 bp, Homo sapiens
ccccgtgtggct

SEQ ID NO: 6080158 - DNA, 17 bp, Homo sapiens
ccccgtgtttgcgcttg

SEQ ID NO: 6080159 - DNA, 14 bp, Homo sapiens
ccccgttcccagcg

SEQ ID NO: 6080160 - DNA, 22 bp, Homo sapiens
ccccgttggaagcgcagcagcg

SEQ ID NO: 6080161 - DNA, 16 bp, Homo sapiens
ccccgttgttgtccct

SEQ ID NO: 6080162 - DNA, 23 bp, Homo sapiens
ccccgtttcagtggaccctgtgg

SEQ ID NO: 6080163 - DNA, 13 bp, Homo sapiens
ccccgttttgggg

SEQ ID NO: 6080164 - DNA, 21 bp, Homo sapiens
cccctaaaagcactcctgctt

SEQ ID NO: 6080165 - DNA, 13 bp, Homo sapiens
cccctaaacatgg

SEQ ID NO: 6080166 - DNA, 22 bp, Homo sapiens
cccctaaagatggcgcacccgg

SEQ ID NO: 6080167 - DNA, 18 bp, Homo sapiens
cccctaaagccaggctca

SEQ ID NO: 6080168 - DNA, 19 bp, Homo sapiens
cccctaaagcctcaaaaca

SEQ ID NO: 6080169 - DNA, 23 bp, Homo sapiens
cccctaaccctttgtgtgctctc

SEQ ID NO: 6080170 - DNA, 14 bp, Homo sapiens
cccctaactttctt

SEQ ID NO: 6080171 - DNA, 18 bp, Homo sapiens
cccctaactttcttgctt

SEQ ID NO: 6080172 - DNA, 14 bp, Homo sapiens
cccctaagactgcc

SEQ ID NO: 6080173 - DNA, 17 bp, Homo sapiens
cccctaagactgccttc

SEQ ID NO: 6080174 - DNA, 20 bp, Homo sapiens
cccctaagactgccttcagt

SEQ ID NO: 6080175 - DNA, 14 bp, Homo sapiens
cccctaagccccgt

SEQ ID NO: 6080176 - DNA, 16 bp, Homo sapiens
cccctaagccccgtcc

SEQ ID NO: 6080177 - DNA, 18 bp, Homo sapiens
cccctaagctccaggtgc

SEQ ID NO: 6080178 - DNA, 13 bp, Homo sapiens
cccctacacacac

SEQ ID NO: 6080179 - DNA, 14 bp, Homo sapiens
cccctacacacaca

SEQ ID NO: 6080180 - DNA, 15 bp, Homo sapiens
cccctacacacacac

SEQ ID NO: 6080181 - DNA, 15 bp, Homo sapiens
cccctacagatcctc

SEQ ID NO: 6080182 - DNA, 17 bp, Homo sapiens
cccctaccaatattagg

SEQ ID NO: 6080183 - DNA, 16 bp, Homo sapiens
cccctacccaaccctg

SEQ ID NO: 6080184 - DNA, 20 bp, Homo sapiens
cccctaccccacaccaggcc

SEQ ID NO: 6080185 - DNA, 13 bp, Homo sapiens
cccctaccccaga

SEQ ID NO: 6080186 - DNA, 15 bp, Homo sapiens
cccctaccccctcat

SEQ ID NO: 6080187 - DNA, 22 bp, Homo sapiens
cccctaccccctcctctctgcc

SEQ ID NO: 6080188 - DNA, 20 bp, Homo sapiens
cccctacccccttgtctgct

SEQ ID NO: 6080189 - DNA, 15 bp, Homo sapiens
cccctaccgcatggc

SEQ ID NO: 6080190 - DNA, 19 bp, Homo sapiens
cccctacgggcgctgcagc

SEQ ID NO: 6080191 - DNA, 23 bp, Homo sapiens
cccctacgggcgctgcagcctcc

SEQ ID NO: 6080192 - DNA, 16 bp, Homo sapiens
cccctagaaacccaag

SEQ ID NO: 6080193 - DNA, 13 bp, Homo sapiens
cccctagaaatcc

SEQ ID NO: 6080194 - DNA, 19 bp, Homo sapiens
cccctagaataatctcatc

SEQ ID NO: 6080195 - DNA, 23 bp, Homo sapiens
cccctagaataatctcatccccc

SEQ ID NO: 6080196 - DNA, 22 bp, Homo sapiens
cccctagagacagtgatgcctg

SEQ ID NO: 6080197 - DNA, 15 bp, Homo sapiens
cccctagagccctct

SEQ ID NO: 6080198 - DNA, 13 bp, Homo sapiens
cccctagatccag

SEQ ID NO: 6080199 - DNA, 18 bp, Homo sapiens
cccctagcaatacaggga

SEQ ID NO: 6080200 - DNA, 20 bp, Homo sapiens
cccctagcaatacagggagg

SEQ ID NO: 6080201 - DNA, 21 bp, Homo sapiens
cccctagcaatacagggaggc

SEQ ID NO: 6080202 - DNA, 16 bp, Homo sapiens
cccctagccaccagtg

SEQ ID NO: 6080203 - DNA, 19 bp, Homo sapiens
cccctagccatttttactg

SEQ ID NO: 6080204 - DNA, 14 bp, Homo sapiens
cccctagccctggt

SEQ ID NO: 6080205 - DNA, 19 bp, Homo sapiens
cccctagccggttcctgtc

SEQ ID NO: 6080206 - DNA, 21 bp, Homo sapiens
cccctagccggttcctgtccc

SEQ ID NO: 6080207 - DNA, 15 bp, Homo sapiens
cccctagcctgcctc

SEQ ID NO: 6080208 - DNA, 22 bp, Homo sapiens
cccctaggactcaggcctgcca

SEQ ID NO: 6080209 - DNA, 21 bp, Homo sapiens
cccctaggatgctgcagcaga

SEQ ID NO: 6080210 - DNA, 16 bp, Homo sapiens
cccctagggactgtcc

SEQ ID NO: 6080211 - DNA, 23 bp, Homo sapiens
cccctagggactgtcctagccag

SEQ ID NO: 6080212 - DNA, 17 bp, Homo sapiens
cccctaggtgcccaggg

SEQ ID NO: 6080213 - DNA, 18 bp, Homo sapiens
cccctaggtgcccagggc

SEQ ID NO: 6080214 - DNA, 19 bp, Homo sapiens
cccctaggtgcccagggcc

SEQ ID NO: 6080215 - DNA, 17 bp, Homo sapiens
cccctagtatctggctg

SEQ ID NO: 6080216 - DNA, 19 bp, Homo sapiens
cccctagtccggttcttct

SEQ ID NO: 6080217 - DNA, 20 bp, Homo sapiens
cccctagtgctattctgtgt

SEQ ID NO: 6080218 - DNA, 13 bp, Homo sapiens
cccctagttccct

SEQ ID NO: 6080219 - DNA, 16 bp, Homo sapiens
cccctatccacccagc

SEQ ID NO: 6080220 - DNA, 19 bp, Homo sapiens
cccctatccacccagccca

SEQ ID NO: 6080221 - DNA, 14 bp, Homo sapiens
cccctatcctgcac

SEQ ID NO: 6080222 - DNA, 17 bp, Homo sapiens
cccctatcctgcaccct

SEQ ID NO: 6080223 - DNA, 18 bp, Homo sapiens
cccctatcctgttcttcc

SEQ ID NO: 6080224 - DNA, 14 bp, Homo sapiens
cccctatccttggc

SEQ ID NO: 6080225 - DNA, 20 bp, Homo sapiens
cccctatccttggcaccaaa

SEQ ID NO: 6080226 - DNA, 18 bp, Homo sapiens
cccctcaaaagccaaaaa

SEQ ID NO: 6080227 - DNA, 21 bp, Homo sapiens
cccctcaaacctcctcttctg

SEQ ID NO: 6080228 - DNA, 18 bp, Homo sapiens
cccctcaacaccctgctt

SEQ ID NO: 6080229 - DNA, 15 bp, Homo sapiens
cccctcaacacctct

SEQ ID NO: 6080230 - DNA, 19 bp, Homo sapiens
cccctcaacctcctgtgga

SEQ ID NO: 6080231 - DNA, 12 bp, Homo sapiens
cccctcaagccc

SEQ ID NO: 6080232 - DNA, 14 bp, Homo sapiens
cccctcaagcccct

SEQ ID NO: 6080233 - DNA, 23 bp, Homo sapiens
cccctcaaggacaaagtctccag

SEQ ID NO: 6080234 - DNA, 17 bp, Homo sapiens
cccctcacactgcaagg

SEQ ID NO: 6080235 - DNA, 13 bp, Homo sapiens
cccctcacagcct

SEQ ID NO: 6080236 - DNA, 14 bp, Homo sapiens
cccctcacagcctc

SEQ ID NO: 6080237 - DNA, 20 bp, Homo sapiens
cccctcacagtattgctcac

SEQ ID NO: 6080238 - DNA, 11 bp, Homo sapiens
cccctcacatc

SEQ ID NO: 6080239 - DNA, 20 bp, Homo sapiens
cccctcacatcctctccagg

SEQ ID NO: 6080240 - DNA, 12 bp, Homo sapiens
cccctcaccacc

SEQ ID NO: 6080241 - DNA, 13 bp, Homo sapiens
cccctcacccctc

SEQ ID NO: 6080242 - DNA, 23 bp, Homo sapiens
cccctcacccgctgcccagccct

SEQ ID NO: 6080243 - DNA, 15 bp, Homo sapiens
cccctcaccctctgt

SEQ ID NO: 6080244 - DNA, 12 bp, Homo sapiens
cccctcacctcc

SEQ ID NO: 6080245 - DNA, 14 bp, Homo sapiens
cccctcacctcctc

SEQ ID NO: 6080246 - DNA, 12 bp, Homo sapiens
cccctcacctct

SEQ ID NO: 6080247 - DNA, 17 bp, Homo sapiens
cccctcacctgggcctt

SEQ ID NO: 6080248 - DNA, 20 bp, Homo sapiens
cccctcacctgggcctttcc

SEQ ID NO: 6080249 - DNA, 15 bp, Homo sapiens
cccctcaccttgggc

SEQ ID NO: 6080250 - DNA, 18 bp, Homo sapiens
cccctcacgcaagtgcca

SEQ ID NO: 6080251 - DNA, 12 bp, Homo sapiens
cccctcactctg

SEQ ID NO: 6080252 - DNA, 15 bp, Homo sapiens
cccctcactggctgg

SEQ ID NO: 6080253 - DNA, 14 bp, Homo sapiens
cccctcagagcatg

SEQ ID NO: 6080254 - DNA, 20 bp, Homo sapiens
cccctcagagccctgccctg

SEQ ID NO: 6080255 - DNA, 20 bp, Homo sapiens
cccctcagatgatctctcca

SEQ ID NO: 6080256 - DNA, 14 bp, Homo sapiens
cccctcagccaccc

SEQ ID NO: 6080257 - DNA, 11 bp, Homo sapiens
cccctcagcct

SEQ ID NO: 6080258 - DNA, 12 bp, Homo sapiens
cccctcagcctc

SEQ ID NO: 6080259 - DNA, 13 bp, Homo sapiens
cccctcagcctcc

SEQ ID NO: 6080260 - DNA, 13 bp, Homo sapiens
cccctcagcctgc

SEQ ID NO: 6080261 - DNA, 19 bp, Homo sapiens
cccctcagcgcccccagag

SEQ ID NO: 6080262 - DNA, 15 bp, Homo sapiens
cccctcagcgctccc

SEQ ID NO: 6080263 - DNA, 18 bp, Homo sapiens
cccctcagctcggctcag

SEQ ID NO: 6080264 - DNA, 13 bp, Homo sapiens
cccctcagctctg

SEQ ID NO: 6080265 - DNA, 15 bp, Homo sapiens
cccctcagctctgtc

SEQ ID NO: 6080266 - DNA, 19 bp, Homo sapiens
cccctcaggaccctcgctg

SEQ ID NO: 6080267 - DNA, 18 bp, Homo sapiens
cccctcagggggccagct

SEQ ID NO: 6080268 - DNA, 17 bp, Homo sapiens
cccctcagttgtgcagc

SEQ ID NO: 6080269 - DNA, 14 bp, Homo sapiens
cccctcatcagcct

SEQ ID NO: 6080270 - DNA, 11 bp, Homo sapiens
cccctcatctg

SEQ ID NO: 6080271 - DNA, 21 bp, Homo sapiens
cccctcatggcgggactggag

SEQ ID NO: 6080272 - DNA, 23 bp, Homo sapiens
cccctcatggcgggactggagaa

SEQ ID NO: 6080273 - DNA, 18 bp, Homo sapiens
cccctcatttatcactct

SEQ ID NO: 6080274 - DNA, 16 bp, Homo sapiens
cccctccaatcctgcc

SEQ ID NO: 6080275 - DNA, 17 bp, Homo sapiens
cccctccaatcctgccc

SEQ ID NO: 6080276 - DNA, 18 bp, Homo sapiens
cccctccacagctgcagc

SEQ ID NO: 6080277 - DNA, 21 bp, Homo sapiens
cccctccacgcaaggctgtgc

SEQ ID NO: 6080278 - DNA, 12 bp, Homo sapiens
cccctccactgg

SEQ ID NO: 6080279 - DNA, 13 bp, Homo sapiens
cccctccagcaca

SEQ ID NO: 6080280 - DNA, 16 bp, Homo sapiens
cccctccagcaccact

SEQ ID NO: 6080281 - DNA, 13 bp, Homo sapiens
cccctccagctca

SEQ ID NO: 6080282 - DNA, 16 bp, Homo sapiens
cccctccaggcatgct

SEQ ID NO: 6080283 - DNA, 20 bp, Homo sapiens
cccctccaggcatgctggcc

SEQ ID NO: 6080284 - DNA, 23 bp, Homo sapiens
cccctccagtgcttggctgcccc

SEQ ID NO: 6080285 - DNA, 12 bp, Homo sapiens
cccctccagtgt

SEQ ID NO: 6080286 - DNA, 15 bp, Homo sapiens
cccctccatccaccc

SEQ ID NO: 6080287 - DNA, 12 bp, Homo sapiens
cccctccatccc

SEQ ID NO: 6080288 - DNA, 19 bp, Homo sapiens
cccctccatccccatcggc

SEQ ID NO: 6080289 - DNA, 20 bp, Homo sapiens
cccctccatgggcgtccttt

SEQ ID NO: 6080290 - DNA, 23 bp, Homo sapiens
cccctccattggctcccaagtca

SEQ ID NO: 6080291 - DNA, 21 bp, Homo sapiens
cccctcccacacccaaagctg

SEQ ID NO: 6080292 - DNA, 18 bp, Homo sapiens
cccctcccacccacagcc

SEQ ID NO: 6080293 - DNA, 14 bp, Homo sapiens
cccctcccacctcc

SEQ ID NO: 6080294 - DNA, 20 bp, Homo sapiens
cccctcccacgcctcaccag

SEQ ID NO: 6080295 - DNA, 11 bp, Homo sapiens
cccctcccaga

SEQ ID NO: 6080296 - DNA, 16 bp, Homo sapiens
cccctcccagacaggc

SEQ ID NO: 6080297 - DNA, 21 bp, Homo sapiens
cccctcccagacaggccctcc

SEQ ID NO: 6080298 - DNA, 12 bp, Homo sapiens
cccctcccagag

SEQ ID NO: 6080299 - DNA, 12 bp, Homo sapiens
cccctcccagct

SEQ ID NO: 6080300 - DNA, 22 bp, Homo sapiens
cccctcccagctgacagtcctc

SEQ ID NO: 6080301 - DNA, 12 bp, Homo sapiens
cccctcccaggg

SEQ ID NO: 6080302 - DNA, 19 bp, Homo sapiens
cccctcccaggggagccag

SEQ ID NO: 6080303 - DNA, 11 bp, Homo sapiens
cccctcccagt

SEQ ID NO: 6080304 - DNA, 11 bp, Homo sapiens
cccctcccatc

SEQ ID NO: 6080305 - DNA, 12 bp, Homo sapiens
cccctcccatgg

SEQ ID NO: 6080306 - DNA, 17 bp, Homo sapiens
cccctcccatggcccag

SEQ ID NO: 6080307 - DNA, 14 bp, Homo sapiens
cccctccccaactc

SEQ ID NO: 6080308 - DNA, 13 bp, Homo sapiens
cccctccccaccc

SEQ ID NO: 6080309 - DNA, 15 bp, Homo sapiens
cccctccccagcccc

SEQ ID NO: 6080310 - DNA, 19 bp, Homo sapiens
cccctccccagctcccttg

SEQ ID NO: 6080311 - DNA, 13 bp, Homo sapiens
cccctccccatgc

SEQ ID NO: 6080312 - DNA, 15 bp, Homo sapiens
cccctcccccaaccc

SEQ ID NO: 6080313 - DNA, 18 bp, Homo sapiens
cccctcccccagccactc

SEQ ID NO: 6080314 - DNA, 17 bp, Homo sapiens
cccctcccccctgtaaa

SEQ ID NO: 6080315 - DNA, 11 bp, Homo sapiens
cccctcccccg

SEQ ID NO: 6080316 - DNA, 16 bp, Homo sapiens
cccctccccctaccgc

SEQ ID NO: 6080317 - DNA, 13 bp, Homo sapiens
cccctccccgcct

SEQ ID NO: 6080318 - DNA, 15 bp, Homo sapiens
cccctccccgggcag

SEQ ID NO: 6080319 - DNA, 17 bp, Homo sapiens
cccctcccctcagagcc

SEQ ID NO: 6080320 - DNA, 17 bp, Homo sapiens
cccctcccctcagcctg

SEQ ID NO: 6080321 - DNA, 17 bp, Homo sapiens
cccctcccctccccgtg

SEQ ID NO: 6080322 - DNA, 13 bp, Homo sapiens
cccctcccctgct

SEQ ID NO: 6080323 - DNA, 15 bp, Homo sapiens
cccctcccctgctgc

SEQ ID NO: 6080324 - DNA, 14 bp, Homo sapiens
cccctcccctggga

SEQ ID NO: 6080325 - DNA, 13 bp, Homo sapiens
cccctccctaccc

SEQ ID NO: 6080326 - DNA, 14 bp, Homo sapiens
cccctccctaccct

SEQ ID NO: 6080327 - DNA, 14 bp, Homo sapiens
cccctccctacctc

SEQ ID NO: 6080328 - DNA, 15 bp, Homo sapiens
cccctccctacctca

SEQ ID NO: 6080329 - DNA, 19 bp, Homo sapiens
cctcctagaggtgggcagc

SEQ ID NO: 6080330 - DNA, 17 bp, Homo sapiens
cctcctagcaagacctg

SEQ ID NO: 6080331 - DNA, 15 bp, Homo sapiens
cctcctagccaccca

SEQ ID NO: 6080332 - DNA, 21 bp, Homo sapiens
cctcctagcctctccgcccac

SEQ ID NO: 6080333 - DNA, 16 bp, Homo sapiens
cctcctagcctgctct

SEQ ID NO: 6080334 - DNA, 17 bp, Homo sapiens
cctcctagctctcccag

SEQ ID NO: 6080335 - DNA, 13 bp, Homo sapiens
cctcctaggagta

SEQ ID NO: 6080336 - DNA, 20 bp, Homo sapiens
cctcctaggcgctcagaggc

SEQ ID NO: 6080337 - DNA, 13 bp, Homo sapiens
cctcctaggctgg

SEQ ID NO: 6080338 - DNA, 17 bp, Homo sapiens
cctcctaggggaagggg

SEQ ID NO: 6080339 - DNA, 19 bp, Homo sapiens
cctcctatccttggagagc

SEQ ID NO: 6080340 - DNA, 17 bp, Homo sapiens
cctcctatctccctggc

SEQ ID NO: 6080341 - DNA, 18 bp, Homo sapiens
cctcctatctccctggct

SEQ ID NO: 6080342 - DNA, 22 bp, Homo sapiens
cctcctattcagttcccagaat

SEQ ID NO: 6080343 - DNA, 19 bp, Homo sapiens
cctcctattctataaaact

SEQ ID NO: 6080344 - DNA, 13 bp, Homo sapiens
cctcctcacccac

SEQ ID NO: 6080345 - DNA, 14 bp, Homo sapiens
cctcctcaccccca

SEQ ID NO: 6080346 - DNA, 13 bp, Homo sapiens
cctcctcaccccg

SEQ ID NO: 6080347 - DNA, 16 bp, Homo sapiens
cctcctcacctcatgc

SEQ ID NO: 6080348 - DNA, 14 bp, Homo sapiens
cctcctcacctctg

SEQ ID NO: 6080349 - DNA, 13 bp, Homo sapiens
cctcctcactccc

SEQ ID NO: 6080350 - DNA, 15 bp, Homo sapiens
cctcctcactcccta

SEQ ID NO: 6080351 - DNA, 17 bp, Homo sapiens
cctcctcactggccatc

SEQ ID NO: 6080352 - DNA, 21 bp, Homo sapiens
cctcctcacttggctgtctga

SEQ ID NO: 6080353 - DNA, 20 bp, Homo sapiens
cctcctcagcctctgcaact

SEQ ID NO: 6080354 - DNA, 13 bp, Homo sapiens
cctcctcagcctg

SEQ ID NO: 6080355 - DNA, 14 bp, Homo sapiens
cctcctcaggagaa

SEQ ID NO: 6080356 - DNA, 12 bp, Homo sapiens
cctcctcaggga

SEQ ID NO: 6080357 - DNA, 13 bp, Homo sapiens
cctcctcaggggg

SEQ ID NO: 6080358 - DNA, 18 bp, Homo sapiens
cctcctcagggggtagga

SEQ ID NO: 6080359 - DNA, 21 bp, Homo sapiens
cctcctcatgtacataccctg

SEQ ID NO: 6080360 - DNA, 15 bp, Homo sapiens
cctcctcattcagac

SEQ ID NO: 6080361 - DNA, 16 bp, Homo sapiens
cctcctcattcagacc

SEQ ID NO: 6080362 - DNA, 18 bp, Homo sapiens
cctcctcattcagaccaa

SEQ ID NO: 6080363 - DNA, 12 bp, Homo sapiens
cctcctccaccc

SEQ ID NO: 6080364 - DNA, 15 bp, Homo sapiens
cctcctccacccacc

SEQ ID NO: 6080365 - DNA, 17 bp, Homo sapiens
cctcctccacctcacct

SEQ ID NO: 6080366 - DNA, 15 bp, Homo sapiens
cctcctccactccac

SEQ ID NO: 6080367 - DNA, 18 bp, Homo sapiens
cctcctccagcccaccca

SEQ ID NO: 6080368 - DNA, 16 bp, Homo sapiens
cctcctccagcccctg

SEQ ID NO: 6080369 - DNA, 21 bp, Homo sapiens
cctcctccagccgccatgctc

SEQ ID NO: 6080370 - DNA, 15 bp, Homo sapiens
cctcctccagctcct

SEQ ID NO: 6080371 - DNA, 19 bp, Homo sapiens
cctcctccagctcctgccc

SEQ ID NO: 6080372 - DNA, 15 bp, Homo sapiens
cctcctccaggcctg

SEQ ID NO: 6080373 - DNA, 14 bp, Homo sapiens
cctcctccagggac

SEQ ID NO: 6080374 - DNA, 16 bp, Homo sapiens
cctcctccagggacag

SEQ ID NO: 6080375 - DNA, 18 bp, Homo sapiens
cctcctccagggacagca

SEQ ID NO: 6080376 - DNA, 21 bp, Homo sapiens
cctcctccagttctgatgagg

SEQ ID NO: 6080377 - DNA, 14 bp, Homo sapiens
cctcctccatgctg

SEQ ID NO: 6080378 - DNA, 18 bp, Homo sapiens
cctcctccatgctgtccc

SEQ ID NO: 6080379 - DNA, 13 bp, Homo sapiens
cctcctcccacca

SEQ ID NO: 6080380 - DNA, 15 bp, Homo sapiens
cctcctcccactgcc

SEQ ID NO: 6080381 - DNA, 14 bp, Homo sapiens
cctcctcccactgg

SEQ ID NO: 6080382 - DNA, 14 bp, Homo sapiens
cctcctcccatctc

SEQ ID NO: 6080383 - DNA, 15 bp, Homo sapiens
cctcctcccatctcc

SEQ ID NO: 6080384 - DNA, 13 bp, Homo sapiens
cctcctccccact

SEQ ID NO: 6080385 - DNA, 14 bp, Homo sapiens
cctcctccccactt

SEQ ID NO: 6080386 - DNA, 17 bp, Homo sapiens
cctcctccccagagctg

SEQ ID NO: 6080387 - DNA, 15 bp, Homo sapiens
cctcctcccccagtg

SEQ ID NO: 6080388 - DNA, 12 bp, Homo sapiens
cctcctccccct

SEQ ID NO: 6080389 - DNA, 13 bp, Homo sapiens
cctcctccccctt

SEQ ID NO: 6080390 - DNA, 14 bp, Homo sapiens
cctcctcccccttt

SEQ ID NO: 6080391 - DNA, 14 bp, Homo sapiens
cctcctcccctcct

SEQ ID NO: 6080392 - DNA, 14 bp, Homo sapiens
cctcctccccttcc

SEQ ID NO: 6080393 - DNA, 17 bp, Homo sapiens
cctcctccccttcctgc

SEQ ID NO: 6080394 - DNA, 20 bp, Homo sapiens
cctcctccccttcctgcacc

SEQ ID NO: 6080395 - DNA, 20 bp, Homo sapiens
cctcctcccgactgaccact

SEQ ID NO: 6080396 - DNA, 23 bp, Homo sapiens
cctcctccctcagacccaggagt

SEQ ID NO: 6080397 - DNA, 16 bp, Homo sapiens
cctcctccctcagact

SEQ ID NO: 6080398 - DNA, 14 bp, Homo sapiens
cctcctccctcagg

SEQ ID NO: 6080399 - DNA, 20 bp, Homo sapiens
cctcctccctcattcatctt

SEQ ID NO: 6080400 - DNA, 23 bp, Homo sapiens
cctcctccctccaagcctggcac

SEQ ID NO: 6080401 - DNA, 17 bp, Homo sapiens
cctcctccctcctcact

SEQ ID NO: 6080402 - DNA, 18 bp, Homo sapiens
cctcctccctcctcactc

SEQ ID NO: 6080403 - DNA, 13 bp, Homo sapiens
cctcctccctgca

SEQ ID NO: 6080404 - DNA, 17 bp, Homo sapiens
cctcctccctgcatctg

SEQ ID NO: 6080405 - DNA, 14 bp, Homo sapiens
cctcctccctggct

SEQ ID NO: 6080406 - DNA, 16 bp, Homo sapiens
cctcctccctggctgc

SEQ ID NO: 6080407 - DNA, 22 bp, Homo sapiens
cctcctccctggctgcagcctc

SEQ ID NO: 6080408 - DNA, 12 bp, Homo sapiens
cctcctccctta

SEQ ID NO: 6080409 - DNA, 17 bp, Homo sapiens
cctcctccctttttcct

SEQ ID NO: 6080410 - DNA, 13 bp, Homo sapiens
cctcctcctagct

SEQ ID NO: 6080411 - DNA, 14 bp, Homo sapiens
cctcctcctagctg

SEQ ID NO: 6080412 - DNA, 12 bp, Homo sapiens
cctcctcctcct

SEQ ID NO: 6080413 - DNA, 16 bp, Homo sapiens
cctcctcctcctcctg

SEQ ID NO: 6080414 - DNA, 14 bp, Homo sapiens
cctcctcctcctgc

SEQ ID NO: 6080415 - DNA, 15 bp, Homo sapiens
cctcctcctcctgcc

SEQ ID NO: 6080416 - DNA, 14 bp, Homo sapiens
cctcctcctcttca

SEQ ID NO: 6080417 - DNA, 17 bp, Homo sapiens
cctcctcctcttcacca

SEQ ID NO: 6080418 - DNA, 12 bp, Homo sapiens
cctcctcctgac

SEQ ID NO: 6080419 - DNA, 12 bp, Homo sapiens
cctcctcctgca

SEQ ID NO: 6080420 - DNA, 13 bp, Homo sapiens
cctcctcctgcat

SEQ ID NO: 6080421 - DNA, 12 bp, Homo sapiens
cctcctcctgcc

SEQ ID NO: 6080422 - DNA, 14 bp, Homo sapiens
cctcctcctgccct

SEQ ID NO: 6080423 - DNA, 15 bp, Homo sapiens
cctcctcctgccctc

SEQ ID NO: 6080424 - DNA, 12 bp, Homo sapiens
cctcctcctggg

SEQ ID NO: 6080425 - DNA, 16 bp, Homo sapiens
cctcctccttgctgat

SEQ ID NO: 6080426 - DNA, 17 bp, Homo sapiens
cctcctccttgctgatt

SEQ ID NO: 6080427 - DNA, 16 bp, Homo sapiens
cctcctcgaagccatg

SEQ ID NO: 6080428 - DNA, 18 bp, Homo sapiens
cctcctcgaagccatgtg

SEQ ID NO: 6080429 - DNA, 14 bp, Homo sapiens
cctcctcgctcctc

SEQ ID NO: 6080430 - DNA, 19 bp, Homo sapiens
cctcctcgctcctccttcc

SEQ ID NO: 6080431 - DNA, 18 bp, Homo sapiens
cctcctcgctgtgccacc

SEQ ID NO: 6080432 - DNA, 21 bp, Homo sapiens
cctcctcgctgtgccaccacc

SEQ ID NO: 6080433 - DNA, 23 bp, Homo sapiens
cctcctcggaaccgctcacctag

SEQ ID NO: 6080434 - DNA, 19 bp, Homo sapiens
cctcctcggagagcagcag

SEQ ID NO: 6080435 - DNA, 17 bp, Homo sapiens
cctcctcggctggctgt

SEQ ID NO: 6080436 - DNA, 21 bp, Homo sapiens
cctcctcggctggctgtccac

SEQ ID NO: 6080437 - DNA, 22 bp, Homo sapiens
cctcctcgggccgaggcccagc

SEQ ID NO: 6080438 - DNA, 20 bp, Homo sapiens
cctcctcgggcgcctgcgct

SEQ ID NO: 6080439 - DNA, 19 bp, Homo sapiens
cctcctcggggctccaggc

SEQ ID NO: 6080440 - DNA, 13 bp, Homo sapiens
cctcctctacctc

SEQ ID NO: 6080441 - DNA, 13 bp, Homo sapiens
cctcctctcactc

SEQ ID NO: 6080442 - DNA, 14 bp, Homo sapiens
cctcctctcactcc

SEQ ID NO: 6080443 - DNA, 14 bp, Homo sapiens
cctcctctcagtgt

SEQ ID NO: 6080444 - DNA, 15 bp, Homo sapiens
cctcctctccaccat

SEQ ID NO: 6080445 - DNA, 16 bp, Homo sapiens
cctcctctccatgcaa

SEQ ID NO: 6080446 - DNA, 23 bp, Homo sapiens
cctcctctccatgcaagtgctgt

SEQ ID NO: 6080447 - DNA, 16 bp, Homo sapiens
cctcctctcccgtctc

SEQ ID NO: 6080448 - DNA, 13 bp, Homo sapiens
cctcctctccctg

SEQ ID NO: 6080449 - DNA, 14 bp, Homo sapiens
cctcctctcctcgt

SEQ ID NO: 6080450 - DNA, 13 bp, Homo sapiens
cctcctctcctgg

SEQ ID NO: 6080451 - DNA, 15 bp, Homo sapiens
cctcctctctccctg

SEQ ID NO: 6080452 - DNA, 21 bp, Homo sapiens
cctcctctctccctgcctcac

SEQ ID NO: 6080453 - DNA, 18 bp, Homo sapiens
cctcctctctgccaccac

SEQ ID NO: 6080454 - DNA, 16 bp, Homo sapiens
cctcctctgaaacagc

SEQ ID NO: 6080455 - DNA, 18 bp, Homo sapiens
cctcctctgacttgggga

SEQ ID NO: 6080456 - DNA, 22 bp, Homo sapiens
cctcctctgaggaagcagttgg

SEQ ID NO: 6080457 - DNA, 18 bp, Homo sapiens
cctcctctgccacctccc

SEQ ID NO: 6080458 - DNA, 15 bp, Homo sapiens
cctcctctgccagca

SEQ ID NO: 6080459 - DNA, 18 bp, Homo sapiens
cctcctctgccagcagga

SEQ ID NO: 6080460 - DNA, 21 bp, Homo sapiens
cctcctctgccagcaggaata

SEQ ID NO: 6080461 - DNA, 13 bp, Homo sapiens
cctcctctgcccc

SEQ ID NO: 6080462 - DNA, 13 bp, Homo sapiens
cctcctctgccta

SEQ ID NO: 6080463 - DNA, 14 bp, Homo sapiens
cctcctctgcctac

SEQ ID NO: 6080464 - DNA, 17 bp, Homo sapiens
cctcctctgctgggact

SEQ ID NO: 6080465 - DNA, 16 bp, Homo sapiens
cctcctctgcttgcca

SEQ ID NO: 6080466 - DNA, 21 bp, Homo sapiens
cctcctctggacggcaggctc

SEQ ID NO: 6080467 - DNA, 23 bp, Homo sapiens
cctcctctggcaggcttccccct

SEQ ID NO: 6080468 - DNA, 17 bp, Homo sapiens
cctcctctggcccagcc

SEQ ID NO: 6080469 - DNA, 17 bp, Homo sapiens
cctcctctgggccctgt

SEQ ID NO: 6080470 - DNA, 19 bp, Homo sapiens
cctcctctgggccctgtcg

SEQ ID NO: 6080471 - DNA, 14 bp, Homo sapiens
cctcctctgtccct

SEQ ID NO: 6080472 - DNA, 16 bp, Homo sapiens
cctcctctgtctgccc

SEQ ID NO: 6080473 - DNA, 11 bp, Homo sapiens
cctcctctgtg

SEQ ID NO: 6080474 - DNA, 12 bp, Homo sapiens
cctcctctgtga

SEQ ID NO: 6080475 - DNA, 13 bp, Homo sapiens
cctcctctgtgaa

SEQ ID NO: 6080476 - DNA, 14 bp, Homo sapiens
cctcctctgtgaaa

SEQ ID NO: 6080477 - DNA, 17 bp, Homo sapiens
cctcctctgtgctccct

SEQ ID NO: 6080478 - DNA, 19 bp, Homo sapiens
cctcctctgtgctccctcg

SEQ ID NO: 6080479 - DNA, 19 bp, Homo sapiens
cctcctcttcaccaggtgc

SEQ ID NO: 6080480 - DNA, 14 bp, Homo sapiens
cctcctcttcaccc

SEQ ID NO: 6080481 - DNA, 22 bp, Homo sapiens
cctcctcttcaccccggcaggc

SEQ ID NO: 6080482 - DNA, 21 bp, Homo sapiens
cctcctcttcccttagcctct

SEQ ID NO: 6080483 - DNA, 14 bp, Homo sapiens
cctcctcttctgac

SEQ ID NO: 6080484 - DNA, 15 bp, Homo sapiens
cctcctcttggaatt

SEQ ID NO: 6080485 - DNA, 14 bp, Homo sapiens
cctcctctttctct

SEQ ID NO: 6080486 - DNA, 21 bp, Homo sapiens
cctcctgaaacttacacacaa

SEQ ID NO: 6080487 - DNA, 15 bp, Homo sapiens
cctcctgaacagctg

SEQ ID NO: 6080488 - DNA, 12 bp, Homo sapiens
cctcctgaaccc

SEQ ID NO: 6080489 - DNA, 22 bp, Homo sapiens
cctcctgaaccgcacagctcag

SEQ ID NO: 6080490 - DNA, 19 bp, Homo sapiens
cctcctgaagcctctgccc

SEQ ID NO: 6080491 - DNA, 22 bp, Homo sapiens
cctcctgaagcctctgccctgc

SEQ ID NO: 6080492 - DNA, 22 bp, Homo sapiens
cctcctgaaggaggcggggctc

SEQ ID NO: 6080493 - DNA, 23 bp, Homo sapiens
cctcctgaaggaggcggggctct

SEQ ID NO: 6080494 - DNA, 17 bp, Homo sapiens
cctcctgacaccccact

SEQ ID NO: 6080495 - DNA, 21 bp, Homo sapiens
cctcctgacccattgctgttg

SEQ ID NO: 6080496 - DNA, 22 bp, Homo sapiens
cctcctgactcatccgcctggc

SEQ ID NO: 6080497 - DNA, 12 bp, Homo sapiens
cctcctgagaaa

SEQ ID NO: 6080498 - DNA, 12 bp, Homo sapiens
cctcctgagcct

SEQ ID NO: 6080499 - DNA, 13 bp, Homo sapiens
cctcctgagcctg

SEQ ID NO: 6080500 - DNA, 18 bp, Homo sapiens
cctcctgagcctgtgggt

SEQ ID NO: 6080501 - DNA, 22 bp, Homo sapiens
cctcctgagctcggggggctct

SEQ ID NO: 6080502 - DNA, 18 bp, Homo sapiens
cctcctgagtagctggga

SEQ ID NO: 6080503 - DNA, 20 bp, Homo sapiens
cctcctgagtagctgggact

SEQ ID NO: 6080504 - DNA, 21 bp, Homo sapiens
cctcctgagtagctgggatta

SEQ ID NO: 6080505 - DNA, 20 bp, Homo sapiens
cctcctgagtgccccacttc

SEQ ID NO: 6080506 - DNA, 14 bp, Homo sapiens
cctcctgcacacag

SEQ ID NO: 6080507 - DNA, 15 bp, Homo sapiens
cctcctgcacacagg

SEQ ID NO: 6080508 - DNA, 18 bp, Homo sapiens
cctcctgcaggctggctg

SEQ ID NO: 6080509 - DNA, 22 bp, Homo sapiens
cctcctgcaggctggctgttgg

SEQ ID NO: 6080510 - DNA, 23 bp, Homo sapiens
cctcctgcatgtcggggcccctg

SEQ ID NO: 6080511 - DNA, 17 bp, Homo sapiens
cccctccctacctcaac

SEQ ID NO: 6080512 - DNA, 14 bp, Homo sapiens
cccctccctctcca

SEQ ID NO: 6080513 - DNA, 15 bp, Homo sapiens
cccctccctctccag

SEQ ID NO: 6080514 - DNA, 16 bp, Homo sapiens
cccctccctctgcccc

SEQ ID NO: 6080515 - DNA, 20 bp, Homo sapiens
cccctccctgcccaaactcc

SEQ ID NO: 6080516 - DNA, 14 bp, Homo sapiens
cccctccctgcttc

SEQ ID NO: 6080517 - DNA, 18 bp, Homo sapiens
cccctccctgcttgcaca

SEQ ID NO: 6080518 - DNA, 13 bp, Homo sapiens
cccctccctggct

SEQ ID NO: 6080519 - DNA, 13 bp, Homo sapiens
cccctccctgtca

SEQ ID NO: 6080520 - DNA, 13 bp, Homo sapiens
cccctccctgtcc

SEQ ID NO: 6080521 - DNA, 19 bp, Homo sapiens
cccctccctgtcccagggc

SEQ ID NO: 6080522 - DNA, 15 bp, Homo sapiens
cccctcccttcaacc

SEQ ID NO: 6080523 - DNA, 15 bp, Homo sapiens
cccctcccttcacag

SEQ ID NO: 6080524 - DNA, 12 bp, Homo sapiens
cccctccctttc

SEQ ID NO: 6080525 - DNA, 18 bp, Homo sapiens
cccctccgatgctgaggc

SEQ ID NO: 6080526 - DNA, 19 bp, Homo sapiens
cccctccgccctgccactc

SEQ ID NO: 6080527 - DNA, 18 bp, Homo sapiens
cccctccggccccgtctc

SEQ ID NO: 6080528 - DNA, 23 bp, Homo sapiens
cccctccgggcagagaccaccgc

SEQ ID NO: 6080529 - DNA, 19 bp, Homo sapiens
cccctcctacccctcccag

SEQ ID NO: 6080530 - DNA, 15 bp, Homo sapiens
cccctcctagggggt

SEQ ID NO: 6080531 - DNA, 19 bp, Homo sapiens
cccctcctagtttgggagg

SEQ ID NO: 6080532 - DNA, 12 bp, Homo sapiens
cccctcctcact

SEQ ID NO: 6080533 - DNA, 23 bp, Homo sapiens
cccctcctcactggccatccctc

SEQ ID NO: 6080534 - DNA, 12 bp, Homo sapiens
cccctcctcagt

SEQ ID NO: 6080535 - DNA, 13 bp, Homo sapiens
cccctcctcagtg

SEQ ID NO: 6080536 - DNA, 11 bp, Homo sapiens
cccctcctcca

SEQ ID NO: 6080537 - DNA, 15 bp, Homo sapiens
cccctcctccactct

SEQ ID NO: 6080538 - DNA, 13 bp, Homo sapiens
cccctcctccaga

SEQ ID NO: 6080539 - DNA, 22 bp, Homo sapiens
cccctcctccagagcctgggcg

SEQ ID NO: 6080540 - DNA, 17 bp, Homo sapiens
cccctcctccagcccct

SEQ ID NO: 6080541 - DNA, 22 bp, Homo sapiens
cccctcctcccagggcctcctg

SEQ ID NO: 6080542 - DNA, 21 bp, Homo sapiens
cccctcctccccttcctgcac

SEQ ID NO: 6080543 - DNA, 21 bp, Homo sapiens
cccctcctccctcagactcag

SEQ ID NO: 6080544 - DNA, 13 bp, Homo sapiens
cccctcctccctt

SEQ ID NO: 6080545 - DNA, 22 bp, Homo sapiens
cccctcctccctttttccttgt

SEQ ID NO: 6080546 - DNA, 22 bp, Homo sapiens
cccctcctcctggactcctgca

SEQ ID NO: 6080547 - DNA, 13 bp, Homo sapiens
cccctcctccttg

SEQ ID NO: 6080548 - DNA, 19 bp, Homo sapiens
cccctcctcgggcgcctgc

SEQ ID NO: 6080549 - DNA, 11 bp, Homo sapiens
cccctcctcta

SEQ ID NO: 6080550 - DNA, 13 bp, Homo sapiens
cccctcctctccc

SEQ ID NO: 6080551 - DNA, 23 bp, Homo sapiens
cccctcctctcccctaccactgt

SEQ ID NO: 6080552 - DNA, 23 bp, Homo sapiens
cccctcctctgaaacagctgcct

SEQ ID NO: 6080553 - DNA, 14 bp, Homo sapiens
cccctcctctgcca

SEQ ID NO: 6080554 - DNA, 14 bp, Homo sapiens
cccctcctctgctt

SEQ ID NO: 6080555 - DNA, 12 bp, Homo sapiens
cccctcctctgt

SEQ ID NO: 6080556 - DNA, 16 bp, Homo sapiens
cccctcctctgtgctc

SEQ ID NO: 6080557 - DNA, 17 bp, Homo sapiens
cccctcctctgtgctcc

SEQ ID NO: 6080558 - DNA, 23 bp, Homo sapiens
cccctcctgactcatccgcctgg

SEQ ID NO: 6080559 - DNA, 12 bp, Homo sapiens
cccctcctgctc

SEQ ID NO: 6080560 - DNA, 13 bp, Homo sapiens
cccctcctgctcc

SEQ ID NO: 6080561 - DNA, 20 bp, Homo sapiens
cccctcctgctcctccctgc

SEQ ID NO: 6080562 - DNA, 12 bp, Homo sapiens
cccctcctgctg

SEQ ID NO: 6080563 - DNA, 14 bp, Homo sapiens
cccctcctgctggg

SEQ ID NO: 6080564 - DNA, 16 bp, Homo sapiens
cccctcctgctgggcg

SEQ ID NO: 6080565 - DNA, 13 bp, Homo sapiens
cccctcctgctgt

SEQ ID NO: 6080566 - DNA, 13 bp, Homo sapiens
cccctcctggctg

SEQ ID NO: 6080567 - DNA, 13 bp, Homo sapiens
cccctcctgtaag

SEQ ID NO: 6080568 - DNA, 16 bp, Homo sapiens
cccctccttccccaga

SEQ ID NO: 6080569 - DNA, 20 bp, Homo sapiens
cccctccttccctggtccag

SEQ ID NO: 6080570 - DNA, 12 bp, Homo sapiens
cccctccttctc

SEQ ID NO: 6080571 - DNA, 13 bp, Homo sapiens
cccctccttctcc

SEQ ID NO: 6080572 - DNA, 20 bp, Homo sapiens
cccctccttctcccctccag

SEQ ID NO: 6080573 - DNA, 12 bp, Homo sapiens
cccctccttgca

SEQ ID NO: 6080574 - DNA, 19 bp, Homo sapiens
cccctccttgcaaccaggc

SEQ ID NO: 6080575 - DNA, 20 bp, Homo sapiens
cccctccttgcaaccaggca

SEQ ID NO: 6080576 - DNA, 21 bp, Homo sapiens
cccctccttgcaaccaggcag

SEQ ID NO: 6080577 - DNA, 18 bp, Homo sapiens
cccctccttgcctcctgt

SEQ ID NO: 6080578 - DNA, 21 bp, Homo sapiens
cccctccttggctttatgcaa

SEQ ID NO: 6080579 - DNA, 17 bp, Homo sapiens
cccctccttttggcctg

SEQ ID NO: 6080580 - DNA, 16 bp, Homo sapiens
cccctcgaccctgtgc

SEQ ID NO: 6080581 - DNA, 23 bp, Homo sapiens
cccctcgaccctgtgcaggagct

SEQ ID NO: 6080582 - DNA, 16 bp, Homo sapiens
cccctcgactcagcac

SEQ ID NO: 6080583 - DNA, 16 bp, Homo sapiens
cccctcgaggcctaca

SEQ ID NO: 6080584 - DNA, 16 bp, Homo sapiens
cccctcgcaaccctgc

SEQ ID NO: 6080585 - DNA, 17 bp, Homo sapiens
cccctcgcaaccctgcc

SEQ ID NO: 6080586 - DNA, 20 bp, Homo sapiens
cccctcgcaaccctgcctgt

SEQ ID NO: 6080587 - DNA, 18 bp, Homo sapiens
cccctcgcaactgtccac

SEQ ID NO: 6080588 - DNA, 15 bp, Homo sapiens
cccctcgcacacagg

SEQ ID NO: 6080589 - DNA, 16 bp, Homo sapiens
cccctcgccagcttct

SEQ ID NO: 6080590 - DNA, 21 bp, Homo sapiens
cccctcgccagcttctcctgc

SEQ ID NO: 6080591 - DNA, 14 bp, Homo sapiens
cccctcgcccagtc

SEQ ID NO: 6080592 - DNA, 23 bp, Homo sapiens
cccctcgcccagtcccagcagcc

SEQ ID NO: 6080593 - DNA, 17 bp, Homo sapiens
cccctcgccccagcctc

SEQ ID NO: 6080594 - DNA, 16 bp, Homo sapiens
cccctcgcgcccctgt

SEQ ID NO: 6080595 - DNA, 18 bp, Homo sapiens
cccctcgcgcccctgtcc

SEQ ID NO: 6080596 - DNA, 13 bp, Homo sapiens
cccctcgctgctg

SEQ ID NO: 6080597 - DNA, 14 bp, Homo sapiens
cccctcgcttcata

SEQ ID NO: 6080598 - DNA, 21 bp, Homo sapiens
cccctcgcttggacggctggg

SEQ ID NO: 6080599 - DNA, 15 bp, Homo sapiens
cccctcggagaagag

SEQ ID NO: 6080600 - DNA, 22 bp, Homo sapiens
cccctcggcattcacacacagc

SEQ ID NO: 6080601 - DNA, 23 bp, Homo sapiens
cccctcggcattcacacacagcc

SEQ ID NO: 6080602 - DNA, 18 bp, Homo sapiens
cccctcggcccctcacca

SEQ ID NO: 6080603 - DNA, 22 bp, Homo sapiens
cccctcggctaccccccgtctc

SEQ ID NO: 6080604 - DNA, 18 bp, Homo sapiens
cccctcgtccacccccca

SEQ ID NO: 6080605 - DNA, 18 bp, Homo sapiens
cccctcgtcccatccagc

SEQ ID NO: 6080606 - DNA, 17 bp, Homo sapiens
cccctcgtcctgtccca

SEQ ID NO: 6080607 - DNA, 15 bp, Homo sapiens
cccctctcagccctc

SEQ ID NO: 6080608 - DNA, 13 bp, Homo sapiens
cccctctcaggag

SEQ ID NO: 6080609 - DNA, 14 bp, Homo sapiens
cccctctcaggaga

SEQ ID NO: 6080610 - DNA, 13 bp, Homo sapiens
cccctctcatcac

SEQ ID NO: 6080611 - DNA, 18 bp, Homo sapiens
cccctctcatctgacctt

SEQ ID NO: 6080612 - DNA, 18 bp, Homo sapiens
cccctctccaccagccct

SEQ ID NO: 6080613 - DNA, 13 bp, Homo sapiens
cccctctccccgg

SEQ ID NO: 6080614 - DNA, 13 bp, Homo sapiens
cccctctcccctt

SEQ ID NO: 6080615 - DNA, 14 bp, Homo sapiens
cccctctccccttg

SEQ ID NO: 6080616 - DNA, 16 bp, Homo sapiens
cccctctcccttccct

SEQ ID NO: 6080617 - DNA, 16 bp, Homo sapiens
cccctctcctcccagc

SEQ ID NO: 6080618 - DNA, 20 bp, Homo sapiens
cccctctcctcccagctgct

SEQ ID NO: 6080619 - DNA, 21 bp, Homo sapiens
cccctctcctccccttcctgt

SEQ ID NO: 6080620 - DNA, 19 bp, Homo sapiens
cccctctcctccgccaccc

SEQ ID NO: 6080621 - DNA, 15 bp, Homo sapiens
cccctctcctgaagc

SEQ ID NO: 6080622 - DNA, 20 bp, Homo sapiens
cccctctcctgcatccctcc

SEQ ID NO: 6080623 - DNA, 15 bp, Homo sapiens
cccctctccttctta

SEQ ID NO: 6080624 - DNA, 13 bp, Homo sapiens
cccctctctcaca

SEQ ID NO: 6080625 - DNA, 11 bp, Homo sapiens
cccctctctgc

SEQ ID NO: 6080626 - DNA, 19 bp, Homo sapiens
cccctctctgcatctgacc

SEQ ID NO: 6080627 - DNA, 13 bp, Homo sapiens
cccctctctgccc

SEQ ID NO: 6080628 - DNA, 13 bp, Homo sapiens
cccctctctgggc

SEQ ID NO: 6080629 - DNA, 18 bp, Homo sapiens
cccctctctgtggctcca

SEQ ID NO: 6080630 - DNA, 12 bp, Homo sapiens
cccctctgattg

SEQ ID NO: 6080631 - DNA, 17 bp, Homo sapiens
cccctctgcacccagaa

SEQ ID NO: 6080632 - DNA, 15 bp, Homo sapiens
cccctctgcccagct

SEQ ID NO: 6080633 - DNA, 17 bp, Homo sapiens
cccctctgcccagcttg

SEQ ID NO: 6080634 - DNA, 16 bp, Homo sapiens
cccctctgcccctgca

SEQ ID NO: 6080635 - DNA, 14 bp, Homo sapiens
cccctctgccctgc

SEQ ID NO: 6080636 - DNA, 17 bp, Homo sapiens
cccctctgccctgtata

SEQ ID NO: 6080637 - DNA, 14 bp, Homo sapiens
cccctctgccttgc

SEQ ID NO: 6080638 - DNA, 22 bp, Homo sapiens
cccctctgccttgccctcctgg

SEQ ID NO: 6080639 - DNA, 23 bp, Homo sapiens
cccctctgcctttgagcttctcc

SEQ ID NO: 6080640 - DNA, 19 bp, Homo sapiens
cccctctgcgccccagcga

SEQ ID NO: 6080641 - DNA, 15 bp, Homo sapiens
cccctctgctctgtc

SEQ ID NO: 6080642 - DNA, 13 bp, Homo sapiens
cccctctgctgcc

SEQ ID NO: 6080643 - DNA, 16 bp, Homo sapiens
cccctctgctgctgtc

SEQ ID NO: 6080644 - DNA, 13 bp, Homo sapiens
cccctctgctgtc

SEQ ID NO: 6080645 - DNA, 12 bp, Homo sapiens
cccctctggaga

SEQ ID NO: 6080646 - DNA, 21 bp, Homo sapiens
cccctctggagaaggcctgga

SEQ ID NO: 6080647 - DNA, 13 bp, Homo sapiens
cccctctggccag

SEQ ID NO: 6080648 - DNA, 19 bp, Homo sapiens
cccctctggctccagctgg

SEQ ID NO: 6080649 - DNA, 12 bp, Homo sapiens
cccctctggctt

SEQ ID NO: 6080650 - DNA, 12 bp, Homo sapiens
cccctctggtcg

SEQ ID NO: 6080651 - DNA, 20 bp, Homo sapiens
cccctctggtcgctcctgcc

SEQ ID NO: 6080652 - DNA, 21 bp, Homo sapiens
cccctctgtcatcactccctg

SEQ ID NO: 6080653 - DNA, 12 bp, Homo sapiens
cccctctgtctt

SEQ ID NO: 6080654 - DNA, 17 bp, Homo sapiens
cccctctgtggagcgcc

SEQ ID NO: 6080655 - DNA, 11 bp, Homo sapiens
cccctctgtgt

SEQ ID NO: 6080656 - DNA, 21 bp, Homo sapiens
cccctctgttctctcccctca

SEQ ID NO: 6080657 - DNA, 15 bp, Homo sapiens
cccctcttcaaagca

SEQ ID NO: 6080658 - DNA, 18 bp, Homo sapiens
cccctcttcaaagcagag

SEQ ID NO: 6080659 - DNA, 17 bp, Homo sapiens
cccctcttcccccttcc

SEQ ID NO: 6080660 - DNA, 12 bp, Homo sapiens
cccctcttccct

SEQ ID NO: 6080661 - DNA, 12 bp, Homo sapiens
cccctcttcctc

SEQ ID NO: 6080662 - DNA, 14 bp, Homo sapiens
cccctcttcctctt

SEQ ID NO: 6080663 - DNA, 19 bp, Homo sapiens
cccctcttcctcttgaccc

SEQ ID NO: 6080664 - DNA, 12 bp, Homo sapiens
cccctcttctga

SEQ ID NO: 6080665 - DNA, 14 bp, Homo sapiens
cccctcttctgagc

SEQ ID NO: 6080666 - DNA, 14 bp, Homo sapiens
cccctcttctgctc

SEQ ID NO: 6080667 - DNA, 20 bp, Homo sapiens
cccctcttgagaggggtgag

SEQ ID NO: 6080668 - DNA, 14 bp, Homo sapiens
cccctcttgcccca

SEQ ID NO: 6080669 - DNA, 22 bp, Homo sapiens
cccctctttctctttcttcctt

SEQ ID NO: 6080670 - DNA, 18 bp, Homo sapiens
cccctgaaacatgtgccc

SEQ ID NO: 6080671 - DNA, 20 bp, Homo sapiens
cccctgaaacatgtgcccct

SEQ ID NO: 6080672 - DNA, 20 bp, Homo sapiens
cccctgaaagtgacagagac

SEQ ID NO: 6080673 - DNA, 19 bp, Homo sapiens
cccctgaactggccccagc

SEQ ID NO: 6080674 - DNA, 21 bp, Homo sapiens
cccctgaactggccccagctc

SEQ ID NO: 6080675 - DNA, 13 bp, Homo sapiens
cccctgaagactt

SEQ ID NO: 6080676 - DNA, 22 bp, Homo sapiens
cccctgaatctgctgagaggca

SEQ ID NO: 6080677 - DNA, 17 bp, Homo sapiens
cccctgaccactcagag

SEQ ID NO: 6080678 - DNA, 18 bp, Homo sapiens
cccctgaccactcagaga

SEQ ID NO: 6080679 - DNA, 20 bp, Homo sapiens
cccctgaccactcagagaca

SEQ ID NO: 6080680 - DNA, 22 bp, Homo sapiens
cccctgacctaccccagccagg

SEQ ID NO: 6080681 - DNA, 17 bp, Homo sapiens
cccctgacctgtccagg

SEQ ID NO: 6080682 - DNA, 15 bp, Homo sapiens
cccctgacctgtgag

SEQ ID NO: 6080683 - DNA, 14 bp, Homo sapiens
cccctgactcatca

SEQ ID NO: 6080684 - DNA, 22 bp, Homo sapiens
cccctgagaccacccccaaaca

SEQ ID NO: 6080685 - DNA, 19 bp, Homo sapiens
cccctgagatcccctgagc

SEQ ID NO: 6080686 - DNA, 17 bp, Homo sapiens
cccctgagccagcaggg

SEQ ID NO: 6080687 - DNA, 16 bp, Homo sapiens
cccctgagcctgtgtc

SEQ ID NO: 6080688 - DNA, 23 bp, Homo sapiens
cccctgagcctgtgtcctgaaga

SEQ ID NO: 6080689 - DNA, 22 bp, Homo sapiens
cccctgaggacaggggcatctc

SEQ ID NO: 6080690 - DNA, 23 bp, Homo sapiens
cccctgaggacaggggcatctct

SEQ ID NO: 6080691 - DNA, 18 bp, Homo sapiens
cccctgaggacctttctg

SEQ ID NO: 6080692 - DNA, 13 bp, Homo sapiens
cccctgaggactg

SEQ ID NO: 6080693 - DNA, 16 bp, Homo sapiens
cctcctgcccagctcc

SEQ ID NO: 6080694 - DNA, 20 bp, Homo sapiens
cctcctgcccagctcctcac

SEQ ID NO: 6080695 - DNA, 22 bp, Homo sapiens
cctcctgcccagctcctcacat

SEQ ID NO: 6080696 - DNA, 19 bp, Homo sapiens
cctcctgcccaggagagcc

SEQ ID NO: 6080697 - DNA, 14 bp, Homo sapiens
cctcctgccccaca

SEQ ID NO: 6080698 - DNA, 22 bp, Homo sapiens
cctcctgcccccaccccaggct

SEQ ID NO: 6080699 - DNA, 14 bp, Homo sapiens
cctcctgccccctg

SEQ ID NO: 6080700 - DNA, 17 bp, Homo sapiens
cctcctgccccctgcca

SEQ ID NO: 6080701 - DNA, 21 bp, Homo sapiens
cctcctgcccgccctccctcc

SEQ ID NO: 6080702 - DNA, 16 bp, Homo sapiens
cctcctgccctgtccc

SEQ ID NO: 6080703 - DNA, 20 bp, Homo sapiens
cctcctgccctgtccctgtc

SEQ ID NO: 6080704 - DNA, 23 bp, Homo sapiens
cctcctgccctgtccctgtcccc

SEQ ID NO: 6080705 - DNA, 18 bp, Homo sapiens
cctcctgccgactcctgg

SEQ ID NO: 6080706 - DNA, 12 bp, Homo sapiens
cctcctgcctca

SEQ ID NO: 6080707 - DNA, 14 bp, Homo sapiens
cctcctgcctcagc

SEQ ID NO: 6080708 - DNA, 12 bp, Homo sapiens
cctcctgcctcc

SEQ ID NO: 6080709 - DNA, 23 bp, Homo sapiens
cctcctgcctcgaactggctgca

SEQ ID NO: 6080710 - DNA, 23 bp, Homo sapiens
cctcctgcgcgcatgtgcgcaca

SEQ ID NO: 6080711 - DNA, 16 bp, Homo sapiens
cctcctgcgctgcccc

SEQ ID NO: 6080712 - DNA, 15 bp, Homo sapiens
cctcctgcggctcag

SEQ ID NO: 6080713 - DNA, 17 bp, Homo sapiens
cctcctgcggctcagcc

SEQ ID NO: 6080714 - DNA, 22 bp, Homo sapiens
cctcctgcggctcagccttgca

SEQ ID NO: 6080715 - DNA, 15 bp, Homo sapiens
cctcctgctactctg

SEQ ID NO: 6080716 - DNA, 11 bp, Homo sapiens
cctcctgctca

SEQ ID NO: 6080717 - DNA, 11 bp, Homo sapiens
cctcctgctcc

SEQ ID NO: 6080718 - DNA, 15 bp, Homo sapiens
cctcctgctcctccc

SEQ ID NO: 6080719 - DNA, 18 bp, Homo sapiens
cctcctgctctgcttcct

SEQ ID NO: 6080720 - DNA, 14 bp, Homo sapiens
cctcctgctctggg

SEQ ID NO: 6080721 - DNA, 17 bp, Homo sapiens
cctcctgctctgggacg

SEQ ID NO: 6080722 - DNA, 12 bp, Homo sapiens
cctcctgctgag

SEQ ID NO: 6080723 - DNA, 11 bp, Homo sapiens
cctcctgctgc

SEQ ID NO: 6080724 - DNA, 14 bp, Homo sapiens
cctcctgctggctg

SEQ ID NO: 6080725 - DNA, 15 bp, Homo sapiens
cctcctgctggctga

SEQ ID NO: 6080726 - DNA, 17 bp, Homo sapiens
cctcctgctggctgagg

SEQ ID NO: 6080727 - DNA, 23 bp, Homo sapiens
cctcctgctggctgaggcttggg

SEQ ID NO: 6080728 - DNA, 21 bp, Homo sapiens
cctcctgctgtagtcctttct

SEQ ID NO: 6080729 - DNA, 12 bp, Homo sapiens
cctcctgctgtg

SEQ ID NO: 6080730 - DNA, 14 bp, Homo sapiens
cctcctgctgtgct

SEQ ID NO: 6080731 - DNA, 12 bp, Homo sapiens
cctcctgctttg

SEQ ID NO: 6080732 - DNA, 13 bp, Homo sapiens
cctcctgctttgg

SEQ ID NO: 6080733 - DNA, 19 bp, Homo sapiens
cctcctggaaccttgctgt

SEQ ID NO: 6080734 - DNA, 21 bp, Homo sapiens
cctcctggaaccttgctgtcc

SEQ ID NO: 6080735 - DNA, 15 bp, Homo sapiens
cctcctggaatggag

SEQ ID NO: 6080736 - DNA, 23 bp, Homo sapiens
cctcctggacccagcaggggcag

SEQ ID NO: 6080737 - DNA, 13 bp, Homo sapiens
cctcctggagcag

SEQ ID NO: 6080738 - DNA, 14 bp, Homo sapiens
cctcctggagcaga

SEQ ID NO: 6080739 - DNA, 21 bp, Homo sapiens
cctcctggagcagcagctgag

SEQ ID NO: 6080740 - DNA, 20 bp, Homo sapiens
cctcctggagcatcccaggc

SEQ ID NO: 6080741 - DNA, 15 bp, Homo sapiens
cctcctggcacctga

SEQ ID NO: 6080742 - DNA, 19 bp, Homo sapiens
cctcctggccaagcaggct

SEQ ID NO: 6080743 - DNA, 12 bp, Homo sapiens
cctcctggccag

SEQ ID NO: 6080744 - DNA, 14 bp, Homo sapiens
cctcctggccagac

SEQ ID NO: 6080745 - DNA, 22 bp, Homo sapiens
cctcctggccagacgctgccgc

SEQ ID NO: 6080746 - DNA, 21 bp, Homo sapiens
cctcctggccagatgtcgctg

SEQ ID NO: 6080747 - DNA, 20 bp, Homo sapiens
cctcctggcccgccctcacc

SEQ ID NO: 6080748 - DNA, 22 bp, Homo sapiens
cctcctggcccgccctcacctc

SEQ ID NO: 6080749 - DNA, 23 bp, Homo sapiens
cctcctggccggggcccctcacc

SEQ ID NO: 6080750 - DNA, 12 bp, Homo sapiens
cctcctggcctg

SEQ ID NO: 6080751 - DNA, 20 bp, Homo sapiens
cctcctggcctgagcgcagc

SEQ ID NO: 6080752 - DNA, 19 bp, Homo sapiens
cctcctggccttcctcgtt

SEQ ID NO: 6080753 - DNA, 13 bp, Homo sapiens
cctcctggctcac

SEQ ID NO: 6080754 - DNA, 20 bp, Homo sapiens
cctcctggctcacagccacc

SEQ ID NO: 6080755 - DNA, 11 bp, Homo sapiens
cctcctggctg

SEQ ID NO: 6080756 - DNA, 11 bp, Homo sapiens
cctcctgggaa

SEQ ID NO: 6080757 - DNA, 19 bp, Homo sapiens
cctcctgggaaggccacct

SEQ ID NO: 6080758 - DNA, 12 bp, Homo sapiens
cctcctgggagc

SEQ ID NO: 6080759 - DNA, 21 bp, Homo sapiens
cctcctgggccctctctgctc

SEQ ID NO: 6080760 - DNA, 16 bp, Homo sapiens
cctcctgggccctggg

SEQ ID NO: 6080761 - DNA, 17 bp, Homo sapiens
cctcctgggccctgggc

SEQ ID NO: 6080762 - DNA, 14 bp, Homo sapiens
cctcctgggctaag

SEQ ID NO: 6080763 - DNA, 17 bp, Homo sapiens
cctcctggggccaggcc

SEQ ID NO: 6080764 - DNA, 18 bp, Homo sapiens
cctcctggggccaggccg

SEQ ID NO: 6080765 - DNA, 12 bp, Homo sapiens
cctcctgggggc

SEQ ID NO: 6080766 - DNA, 22 bp, Homo sapiens
cctcctgggggcccattctgca

SEQ ID NO: 6080767 - DNA, 20 bp, Homo sapiens
cctcctgggtgccagtccat

SEQ ID NO: 6080768 - DNA, 22 bp, Homo sapiens
cctcctgggttcacaccattct

SEQ ID NO: 6080769 - DNA, 21 bp, Homo sapiens
cctcctgggtttaagcaatgc

SEQ ID NO: 6080770 - DNA, 17 bp, Homo sapiens
cctcctggtcctggaca

SEQ ID NO: 6080771 - DNA, 21 bp, Homo sapiens
cctcctggtctcttcaccact

SEQ ID NO: 6080772 - DNA, 21 bp, Homo sapiens
cctcctggtgcccacagcagg

SEQ ID NO: 6080773 - DNA, 19 bp, Homo sapiens
cctcctggtgggtccaggg

SEQ ID NO: 6080774 - DNA, 20 bp, Homo sapiens
cctcctggtgggtccagggg

SEQ ID NO: 6080775 - DNA, 21 bp, Homo sapiens
cctcctggtgggtccaggggc

SEQ ID NO: 6080776 - DNA, 18 bp, Homo sapiens
cctcctggtttcctttct

SEQ ID NO: 6080777 - DNA, 19 bp, Homo sapiens
cctcctggtttcctttctc

SEQ ID NO: 6080778 - DNA, 13 bp, Homo sapiens
cctcctgtacata

SEQ ID NO: 6080779 - DNA, 23 bp, Homo sapiens
cctcctgtcactcactgaggcca

SEQ ID NO: 6080780 - DNA, 14 bp, Homo sapiens
cctcctgtccagca

SEQ ID NO: 6080781 - DNA, 10 bp, Homo sapiens
cctcctgtct

SEQ ID NO: 6080782 - DNA, 17 bp, Homo sapiens
cctcctgtcttcccagg

SEQ ID NO: 6080783 - DNA, 18 bp, Homo sapiens
cctcctgtcttcccaggg

SEQ ID NO: 6080784 - DNA, 17 bp, Homo sapiens
cctcctgtgccccagct

SEQ ID NO: 6080785 - DNA, 21 bp, Homo sapiens
cctcctgtgccccagctgcca

SEQ ID NO: 6080786 - DNA, 14 bp, Homo sapiens
cctcctgtgcctgg

SEQ ID NO: 6080787 - DNA, 22 bp, Homo sapiens
cctcctgtgctatttgtacaaa

SEQ ID NO: 6080788 - DNA, 18 bp, Homo sapiens
cctcctgtgctcagccct

SEQ ID NO: 6080789 - DNA, 19 bp, Homo sapiens
cctcctgtgctcagccctg

SEQ ID NO: 6080790 - DNA, 11 bp, Homo sapiens
cctcctgtgga

SEQ ID NO: 6080791 - DNA, 16 bp, Homo sapiens
cctcctgtgggcctca

SEQ ID NO: 6080792 - DNA, 17 bp, Homo sapiens
cctcctgtgtactgtgt

SEQ ID NO: 6080793 - DNA, 17 bp, Homo sapiens
cctcctgtgtgactggc

SEQ ID NO: 6080794 - DNA, 12 bp, Homo sapiens
cctcctgtgtgt

SEQ ID NO: 6080795 - DNA, 22 bp, Homo sapiens
cctcctgtgttgtgctgggagc

SEQ ID NO: 6080796 - DNA, 15 bp, Homo sapiens
cctcctgttccgtgt

SEQ ID NO: 6080797 - DNA, 15 bp, Homo sapiens
cctcctgttcctgcc

SEQ ID NO: 6080798 - DNA, 17 bp, Homo sapiens
cctcctgttctgcccac

SEQ ID NO: 6080799 - DNA, 19 bp, Homo sapiens
cctcctgttgcacccagcc

SEQ ID NO: 6080800 - DNA, 18 bp, Homo sapiens
cctcctgttgccacactt

SEQ ID NO: 6080801 - DNA, 23 bp, Homo sapiens
cctcctgttgggagagggcgcag

SEQ ID NO: 6080802 - DNA, 16 bp, Homo sapiens
cctcctgtttgcaggc

SEQ ID NO: 6080803 - DNA, 13 bp, Homo sapiens
cctccttacctgg

SEQ ID NO: 6080804 - DNA, 23 bp, Homo sapiens
cctccttagctttccctgtgcca

SEQ ID NO: 6080805 - DNA, 20 bp, Homo sapiens
cctccttatcaaaggacacc

SEQ ID NO: 6080806 - DNA, 16 bp, Homo sapiens
cctccttatttatcaa

SEQ ID NO: 6080807 - DNA, 21 bp, Homo sapiens
cctccttcactccctgtcata

SEQ ID NO: 6080808 - DNA, 13 bp, Homo sapiens
cctccttcagaca

SEQ ID NO: 6080809 - DNA, 14 bp, Homo sapiens
cctccttcagacac

SEQ ID NO: 6080810 - DNA, 15 bp, Homo sapiens
cctccttcagacacc

SEQ ID NO: 6080811 - DNA, 11 bp, Homo sapiens
cctccttccac

SEQ ID NO: 6080812 - DNA, 14 bp, Homo sapiens
cctccttccaggcc

SEQ ID NO: 6080813 - DNA, 17 bp, Homo sapiens
cctccttccaggcccca

SEQ ID NO: 6080814 - DNA, 22 bp, Homo sapiens
cctccttccaggccccaggctg

SEQ ID NO: 6080815 - DNA, 11 bp, Homo sapiens
cctccttccca

SEQ ID NO: 6080816 - DNA, 16 bp, Homo sapiens
cctccttcccagctgc

SEQ ID NO: 6080817 - DNA, 11 bp, Homo sapiens
cctccttcccc

SEQ ID NO: 6080818 - DNA, 14 bp, Homo sapiens
cctccttccccacc

SEQ ID NO: 6080819 - DNA, 23 bp, Homo sapiens
cctccttccccagctcccccagg

SEQ ID NO: 6080820 - DNA, 22 bp, Homo sapiens
cctccttccccccatctctgag

SEQ ID NO: 6080821 - DNA, 23 bp, Homo sapiens
cctccttccccgagtgactctgg

SEQ ID NO: 6080822 - DNA, 12 bp, Homo sapiens
cctccttcccgc

SEQ ID NO: 6080823 - DNA, 21 bp, Homo sapiens
cctccttcccgccgcccgacc

SEQ ID NO: 6080824 - DNA, 17 bp, Homo sapiens
cctccttccctcacccc

SEQ ID NO: 6080825 - DNA, 13 bp, Homo sapiens
cctccttccctct

SEQ ID NO: 6080826 - DNA, 19 bp, Homo sapiens
cctccttcccttctctcct

SEQ ID NO: 6080827 - DNA, 19 bp, Homo sapiens
cctccttcctcagtcctgg

SEQ ID NO: 6080828 - DNA, 13 bp, Homo sapiens
cctccttcctctt

SEQ ID NO: 6080829 - DNA, 22 bp, Homo sapiens
cctccttcctgggaccccctcg

SEQ ID NO: 6080830 - DNA, 15 bp, Homo sapiens
cctccttccttgacc

SEQ ID NO: 6080831 - DNA, 14 bp, Homo sapiens
cctccttctatttt

SEQ ID NO: 6080832 - DNA, 13 bp, Homo sapiens
cctccttctcccc

SEQ ID NO: 6080833 - DNA, 17 bp, Homo sapiens
cctccttctcccctcca

SEQ ID NO: 6080834 - DNA, 18 bp, Homo sapiens
cctccttctcccctccag

SEQ ID NO: 6080835 - DNA, 15 bp, Homo sapiens
cctccttctcccttt

SEQ ID NO: 6080836 - DNA, 16 bp, Homo sapiens
cctccttctccctttt

SEQ ID NO: 6080837 - DNA, 17 bp, Homo sapiens
cctccttctcccttttt

SEQ ID NO: 6080838 - DNA, 12 bp, Homo sapiens
cctccttctcct

SEQ ID NO: 6080839 - DNA, 17 bp, Homo sapiens
cctccttctgagctcct

SEQ ID NO: 6080840 - DNA, 19 bp, Homo sapiens
cctccttctgagctcctgt

SEQ ID NO: 6080841 - DNA, 15 bp, Homo sapiens
cctccttctgcaaag

SEQ ID NO: 6080842 - DNA, 19 bp, Homo sapiens
cctccttcttgccctgagc

SEQ ID NO: 6080843 - DNA, 17 bp, Homo sapiens
cctccttgccacccccc

SEQ ID NO: 6080844 - DNA, 12 bp, Homo sapiens
cctccttgccag

SEQ ID NO: 6080845 - DNA, 13 bp, Homo sapiens
cctccttgccagc

SEQ ID NO: 6080846 - DNA, 19 bp, Homo sapiens
cctccttgccgctgggaga

SEQ ID NO: 6080847 - DNA, 14 bp, Homo sapiens
cctccttgcctcct

SEQ ID NO: 6080848 - DNA, 20 bp, Homo sapiens
cctccttgcctcctgtgtaa

SEQ ID NO: 6080849 - DNA, 22 bp, Homo sapiens
cctccttgctctgcaggcacct

SEQ ID NO: 6080850 - DNA, 21 bp, Homo sapiens
cctccttgctgaccccaggtc

SEQ ID NO: 6080851 - DNA, 16 bp, Homo sapiens
cctccttggccaccag

SEQ ID NO: 6080852 - DNA, 22 bp, Homo sapiens
cctccttggctttatgcaaata

SEQ ID NO: 6080853 - DNA, 21 bp, Homo sapiens
cctccttgggtcattgacctc

SEQ ID NO: 6080854 - DNA, 17 bp, Homo sapiens
cctccttggtgcctctg

SEQ ID NO: 6080855 - DNA, 18 bp, Homo sapiens
cctccttggtgcctctgg

SEQ ID NO: 6080856 - DNA, 15 bp, Homo sapiens
cctccttggtgcctg

SEQ ID NO: 6080857 - DNA, 13 bp, Homo sapiens
cctccttgtcagg

SEQ ID NO: 6080858 - DNA, 23 bp, Homo sapiens
cctccttgtcagggtctccttcc

SEQ ID NO: 6080859 - DNA, 16 bp, Homo sapiens
cctccttgtccaccca

SEQ ID NO: 6080860 - DNA, 16 bp, Homo sapiens
cctccttgtccaggtc

SEQ ID NO: 6080861 - DNA, 14 bp, Homo sapiens
cctccttgtgcaat

SEQ ID NO: 6080862 - DNA, 13 bp, Homo sapiens
cctcctttatcac

SEQ ID NO: 6080863 - DNA, 12 bp, Homo sapiens
cctcctttccaa

SEQ ID NO: 6080864 - DNA, 12 bp, Homo sapiens
cctcctttccca

SEQ ID NO: 6080865 - DNA, 15 bp, Homo sapiens
cctcctttccttttt

SEQ ID NO: 6080866 - DNA, 21 bp, Homo sapiens
cctcctttcctttttctttcc

SEQ ID NO: 6080867 - DNA, 12 bp, Homo sapiens
cctcctttctcc

SEQ ID NO: 6080868 - DNA, 14 bp, Homo sapiens
cctcctttctctgt

SEQ ID NO: 6080869 - DNA, 16 bp, Homo sapiens
cctcctttctctgtat

SEQ ID NO: 6080870 - DNA, 21 bp, Homo sapiens
cctcctttctcttctctgttc

SEQ ID NO: 6080871 - DNA, 15 bp, Homo sapiens
cctcctttctgaggg

SEQ ID NO: 6080872 - DNA, 13 bp, Homo sapiens
cctcctttctgtg

SEQ ID NO: 6080873 - DNA, 22 bp, Homo sapiens
cctcctttctgtgccctactca

SEQ ID NO: 6080874 - DNA, 16 bp, Homo sapiens
cccctgaggactggag

SEQ ID NO: 6080875 - DNA, 19 bp, Homo sapiens
cccctgaggagctttgtgt

SEQ ID NO: 6080876 - DNA, 18 bp, Homo sapiens
cccctgaggatcccctgt

SEQ ID NO: 6080877 - DNA, 11 bp, Homo sapiens
cccctgaggca

SEQ ID NO: 6080878 - DNA, 14 bp, Homo sapiens
cccctgaggcagcc

SEQ ID NO: 6080879 - DNA, 21 bp, Homo sapiens
cccctgagggacgagcagagc

SEQ ID NO: 6080880 - DNA, 23 bp, Homo sapiens
cccctgagggacgagcagagcgc

SEQ ID NO: 6080881 - DNA, 24 bp, Homo sapiens
cccctgagggacgagcagagcgca

SEQ ID NO: 6080882 - DNA, 22 bp, Homo sapiens
cccctgagtccgcctgcgcctc

SEQ ID NO: 6080883 - DNA, 20 bp, Homo sapiens
cccctgagttgggcagccag

SEQ ID NO: 6080884 - DNA, 15 bp, Homo sapiens
cccctgatcactccc

SEQ ID NO: 6080885 - DNA, 20 bp, Homo sapiens
cccctgatctctgacctctg

SEQ ID NO: 6080886 - DNA, 21 bp, Homo sapiens
cccctgatgacgggatgctct

SEQ ID NO: 6080887 - DNA, 16 bp, Homo sapiens
cccctgatgcagcctg

SEQ ID NO: 6080888 - DNA, 15 bp, Homo sapiens
cccctgatgcccagg

SEQ ID NO: 6080889 - DNA, 12 bp, Homo sapiens
cccctgattaca

SEQ ID NO: 6080890 - DNA, 17 bp, Homo sapiens
cccctgcaaaaagaaaa

SEQ ID NO: 6080891 - DNA, 21 bp, Homo sapiens
cccctgcaaaaagaaaaaaag

SEQ ID NO: 6080892 - DNA, 15 bp, Homo sapiens
cccctgcaaagacag

SEQ ID NO: 6080893 - DNA, 18 bp, Homo sapiens
cccctgcaaagcccagct

SEQ ID NO: 6080894 - DNA, 22 bp, Homo sapiens
cccctgcaacttccgctgaggg

SEQ ID NO: 6080895 - DNA, 15 bp, Homo sapiens
cccctgcaagaagcg

SEQ ID NO: 6080896 - DNA, 22 bp, Homo sapiens
cccctgcaagaagcgccgactc

SEQ ID NO: 6080897 - DNA, 17 bp, Homo sapiens
cccctgcacaagccatg

SEQ ID NO: 6080898 - DNA, 22 bp, Homo sapiens
cccctgcacagcaggctgccag

SEQ ID NO: 6080899 - DNA, 12 bp, Homo sapiens
cccctgcaccca

SEQ ID NO: 6080900 - DNA, 15 bp, Homo sapiens
cccctgcactaggca

SEQ ID NO: 6080901 - DNA, 22 bp, Homo sapiens
cccctgcactaggcaggtaata

SEQ ID NO: 6080902 - DNA, 18 bp, Homo sapiens
cccctgcactccagcctg

SEQ ID NO: 6080903 - DNA, 16 bp, Homo sapiens
cccctgcactgtaaaa

SEQ ID NO: 6080904 - DNA, 17 bp, Homo sapiens
cccctgcactgtaaaat

SEQ ID NO: 6080905 - DNA, 18 bp, Homo sapiens
cccctgcactgtaaaatg

SEQ ID NO: 6080906 - DNA, 22 bp, Homo sapiens
cccctgcagacggatgcccatt

SEQ ID NO: 6080907 - DNA, 22 bp, Homo sapiens
cccctgcagacgtctggccctg

SEQ ID NO: 6080908 - DNA, 20 bp, Homo sapiens
cccctgcagcacggacaata

SEQ ID NO: 6080909 - DNA, 22 bp, Homo sapiens
cccctgcagcacggacaataaa

SEQ ID NO: 6080910 - DNA, 16 bp, Homo sapiens
cccctgcagccatccc

SEQ ID NO: 6080911 - DNA, 16 bp, Homo sapiens
cccctgcagcccaggc

SEQ ID NO: 6080912 - DNA, 13 bp, Homo sapiens
cccctgcagccct

SEQ ID NO: 6080913 - DNA, 13 bp, Homo sapiens
cccctgcagcctg

SEQ ID NO: 6080914 - DNA, 15 bp, Homo sapiens
cccctgcagcctggg

SEQ ID NO: 6080915 - DNA, 17 bp, Homo sapiens
cccctgcagcctgggtc

SEQ ID NO: 6080916 - DNA, 12 bp, Homo sapiens
cccctgcagctg

SEQ ID NO: 6080917 - DNA, 23 bp, Homo sapiens
cccctgcagcttgtagccagccg

SEQ ID NO: 6080918 - DNA, 14 bp, Homo sapiens
cccctgcaggaagg

SEQ ID NO: 6080919 - DNA, 15 bp, Homo sapiens
cccctgcaggaagga

SEQ ID NO: 6080920 - DNA, 18 bp, Homo sapiens
cccctgcaggaaggagct

SEQ ID NO: 6080921 - DNA, 21 bp, Homo sapiens
cccctgcaggaaggagctgcc

SEQ ID NO: 6080922 - DNA, 22 bp, Homo sapiens
cccctgcaggcggtatccagag

SEQ ID NO: 6080923 - DNA, 20 bp, Homo sapiens
cccctgcagtttggccctgg

SEQ ID NO: 6080924 - DNA, 15 bp, Homo sapiens
cccctgcatgcctgg

SEQ ID NO: 6080925 - DNA, 14 bp, Homo sapiens
cccctgcatggctg

SEQ ID NO: 6080926 - DNA, 12 bp, Homo sapiens
cccctgccaccg

SEQ ID NO: 6080927 - DNA, 15 bp, Homo sapiens
cccctgccacctcct

SEQ ID NO: 6080928 - DNA, 17 bp, Homo sapiens
cccctgccacctcctgc

SEQ ID NO: 6080929 - DNA, 16 bp, Homo sapiens
cccctgccagaggcct

SEQ ID NO: 6080930 - DNA, 11 bp, Homo sapiens
cccctgccagg

SEQ ID NO: 6080931 - DNA, 14 bp, Homo sapiens
cccctgccagggca

SEQ ID NO: 6080932 - DNA, 11 bp, Homo sapiens
cccctgcccaa

SEQ ID NO: 6080933 - DNA, 23 bp, Homo sapiens
cccctgcccagatcagccagaag

SEQ ID NO: 6080934 - DNA, 16 bp, Homo sapiens
cccctgcccagcacct

SEQ ID NO: 6080935 - DNA, 18 bp, Homo sapiens
cccctgcccagcacctcc

SEQ ID NO: 6080936 - DNA, 21 bp, Homo sapiens
cccctgcccagcacctcctcc

SEQ ID NO: 6080937 - DNA, 17 bp, Homo sapiens
cccctgcccagcctgct

SEQ ID NO: 6080938 - DNA, 14 bp, Homo sapiens
cccctgcccatctg

SEQ ID NO: 6080939 - DNA, 18 bp, Homo sapiens
cccctgcccatctgggaa

SEQ ID NO: 6080940 - DNA, 13 bp, Homo sapiens
cccctgccccagc

SEQ ID NO: 6080941 - DNA, 12 bp, Homo sapiens
cccctgccccca

SEQ ID NO: 6080942 - DNA, 16 bp, Homo sapiens
cccctgccccctgcag

SEQ ID NO: 6080943 - DNA, 17 bp, Homo sapiens
cccctgccccgccccca

SEQ ID NO: 6080944 - DNA, 15 bp, Homo sapiens
cccctgccccgtcac

SEQ ID NO: 6080945 - DNA, 13 bp, Homo sapiens
cccctgccccgtt

SEQ ID NO: 6080946 - DNA, 13 bp, Homo sapiens
cccctgcccctcc

SEQ ID NO: 6080947 - DNA, 16 bp, Homo sapiens
cccctgcccctctgtt

SEQ ID NO: 6080948 - DNA, 17 bp, Homo sapiens
cccctgcccctgcccga

SEQ ID NO: 6080949 - DNA, 23 bp, Homo sapiens
cccctgccccttctacactctcc

SEQ ID NO: 6080950 - DNA, 23 bp, Homo sapiens
cccctgcccgagagagctctggc

SEQ ID NO: 6080951 - DNA, 13 bp, Homo sapiens
cccctgcccgccc

SEQ ID NO: 6080952 - DNA, 23 bp, Homo sapiens
cccctgcccggtggtttgccatg

SEQ ID NO: 6080953 - DNA, 12 bp, Homo sapiens
cccctgccctcg

SEQ ID NO: 6080954 - DNA, 14 bp, Homo sapiens
cccctgccctcggc

SEQ ID NO: 6080955 - DNA, 14 bp, Homo sapiens
cccctgccctcgtg

SEQ ID NO: 6080956 - DNA, 19 bp, Homo sapiens
cccctgccctcgtggccag

SEQ ID NO: 6080957 - DNA, 21 bp, Homo sapiens
cccctgccctcgtggccagcc

SEQ ID NO: 6080958 - DNA, 23 bp, Homo sapiens
cccctgccctcgtggccagcccg

SEQ ID NO: 6080959 - DNA, 14 bp, Homo sapiens
cccctgccctgagg

SEQ ID NO: 6080960 - DNA, 16 bp, Homo sapiens
cccctgccctgaggag

SEQ ID NO: 6080961 - DNA, 13 bp, Homo sapiens
cccctgccctgca

SEQ ID NO: 6080962 - DNA, 15 bp, Homo sapiens
cccctgccctgctcc

SEQ ID NO: 6080963 - DNA, 14 bp, Homo sapiens
cccctgccctgctg

SEQ ID NO: 6080964 - DNA, 13 bp, Homo sapiens
cccctgccctggg

SEQ ID NO: 6080965 - DNA, 13 bp, Homo sapiens
cccctgccctggt

SEQ ID NO: 6080966 - DNA, 14 bp, Homo sapiens
cccctgccctgtgc

SEQ ID NO: 6080967 - DNA, 15 bp, Homo sapiens
cccctgccctgtgcc

SEQ ID NO: 6080968 - DNA, 20 bp, Homo sapiens
cccctgccggtgcacaggcc

SEQ ID NO: 6080969 - DNA, 11 bp, Homo sapiens
cccctgcctcc

SEQ ID NO: 6080970 - DNA, 15 bp, Homo sapiens
cccctgcctccaccc

SEQ ID NO: 6080971 - DNA, 13 bp, Homo sapiens
cccctgcctccga

SEQ ID NO: 6080972 - DNA, 23 bp, Homo sapiens
cccctgcctccgaggcctacctg

SEQ ID NO: 6080973 - DNA, 15 bp, Homo sapiens
cccctgcctcctgcc

SEQ ID NO: 6080974 - DNA, 12 bp, Homo sapiens
cccctgcctcga

SEQ ID NO: 6080975 - DNA, 23 bp, Homo sapiens
cccctgcctctatccctggccac

SEQ ID NO: 6080976 - DNA, 14 bp, Homo sapiens
cccctgcctctctg

SEQ ID NO: 6080977 - DNA, 19 bp, Homo sapiens
cccctgcctctctgcaggt

SEQ ID NO: 6080978 - DNA, 10 bp, Homo sapiens
cccctgcctg

SEQ ID NO: 6080979 - DNA, 14 bp, Homo sapiens
cccctgcctgacag

SEQ ID NO: 6080980 - DNA, 17 bp, Homo sapiens
cccctgcctgacagcct

SEQ ID NO: 6080981 - DNA, 13 bp, Homo sapiens
cccctgcctgaga

SEQ ID NO: 6080982 - DNA, 15 bp, Homo sapiens
cccctgcctgccatg

SEQ ID NO: 6080983 - DNA, 13 bp, Homo sapiens
cccctgcctgcct

SEQ ID NO: 6080984 - DNA, 11 bp, Homo sapiens
cccctgcctgg

SEQ ID NO: 6080985 - DNA, 22 bp, Homo sapiens
cccctgcctggatttcttccta

SEQ ID NO: 6080986 - DNA, 13 bp, Homo sapiens
cccctgcctgggt

SEQ ID NO: 6080987 - DNA, 14 bp, Homo sapiens
cccctgcctgggtt

SEQ ID NO: 6080988 - DNA, 12 bp, Homo sapiens
cccctgcctgtg

SEQ ID NO: 6080989 - DNA, 20 bp, Homo sapiens
cccctgccttaacctgggac

SEQ ID NO: 6080990 - DNA, 12 bp, Homo sapiens
cccctgccttcc

SEQ ID NO: 6080991 - DNA, 13 bp, Homo sapiens
cccctgccttcct

SEQ ID NO: 6080992 - DNA, 14 bp, Homo sapiens
cccctgcgccccgc

SEQ ID NO: 6080993 - DNA, 21 bp, Homo sapiens
cccctgcggagctgcatggac

SEQ ID NO: 6080994 - DNA, 18 bp, Homo sapiens
cccctgcggccgtcaccc

SEQ ID NO: 6080995 - DNA, 22 bp, Homo sapiens
cccctgcggccgtcaccccgcc

SEQ ID NO: 6080996 - DNA, 22 bp, Homo sapiens
cccctgcgggcgcgggcagcca

SEQ ID NO: 6080997 - DNA, 22 bp, Homo sapiens
cccctgcggtcaggctgggcag

SEQ ID NO: 6080998 - DNA, 24 bp, Homo sapiens
cccctgcggtcaggctgggcagcc

SEQ ID NO: 6080999 - DNA, 14 bp, Homo sapiens
cccctgcgtggggg

SEQ ID NO: 6081000 - DNA, 18 bp, Homo sapiens
cccctgctactcctgtgc

SEQ ID NO: 6081001 - DNA, 15 bp, Homo sapiens
cccctgctactgcca

SEQ ID NO: 6081002 - DNA, 15 bp, Homo sapiens
cccctgctccaccag

SEQ ID NO: 6081003 - DNA, 19 bp, Homo sapiens
cccctgctccaccagcagc

SEQ ID NO: 6081004 - DNA, 16 bp, Homo sapiens
cccctgctcccagcct

SEQ ID NO: 6081005 - DNA, 14 bp, Homo sapiens
cccctgctcccagg

SEQ ID NO: 6081006 - DNA, 21 bp, Homo sapiens
cccctgctcccattcctccct

SEQ ID NO: 6081007 - DNA, 14 bp, Homo sapiens
cccctgctgacctt

SEQ ID NO: 6081008 - DNA, 15 bp, Homo sapiens
cccctgctgaccttg

SEQ ID NO: 6081009 - DNA, 19 bp, Homo sapiens
cccctgctgcaggggctct

SEQ ID NO: 6081010 - DNA, 22 bp, Homo sapiens
cccctgctgcaggggctctgga

SEQ ID NO: 6081011 - DNA, 23 bp, Homo sapiens
cccctgctgcaggggctctggag

SEQ ID NO: 6081012 - DNA, 12 bp, Homo sapiens
cccctgctgcct

SEQ ID NO: 6081013 - DNA, 20 bp, Homo sapiens
cccctgctgcctccccaacc

SEQ ID NO: 6081014 - DNA, 11 bp, Homo sapiens
cccctgctgct

SEQ ID NO: 6081015 - DNA, 13 bp, Homo sapiens
cccctgctgctca

SEQ ID NO: 6081016 - DNA, 20 bp, Homo sapiens
cccctgctgctgtcacctct

SEQ ID NO: 6081017 - DNA, 12 bp, Homo sapiens
cccctgctgctt

SEQ ID NO: 6081018 - DNA, 22 bp, Homo sapiens
cccctgctgcttaagtgcatgc

SEQ ID NO: 6081019 - DNA, 14 bp, Homo sapiens
cccctgctggctct

SEQ ID NO: 6081020 - DNA, 19 bp, Homo sapiens
cccctgctggctggtgcct

SEQ ID NO: 6081021 - DNA, 11 bp, Homo sapiens
cccctgctgtc

SEQ ID NO: 6081022 - DNA, 17 bp, Homo sapiens
cccctgctgtctctctg

SEQ ID NO: 6081023 - DNA, 18 bp, Homo sapiens
cccctgctgtctctctgg

SEQ ID NO: 6081024 - DNA, 19 bp, Homo sapiens
cccctgctgtctctctggg

SEQ ID NO: 6081025 - DNA, 16 bp, Homo sapiens
cccctgctgtcttccc

SEQ ID NO: 6081026 - DNA, 19 bp, Homo sapiens
cccctgctgtgctgctcaa

SEQ ID NO: 6081027 - DNA, 13 bp, Homo sapiens
cccctgcttcagt

SEQ ID NO: 6081028 - DNA, 16 bp, Homo sapiens
cccctgcttcagtccc

SEQ ID NO: 6081029 - DNA, 19 bp, Homo sapiens
cccctgcttccacctcacc

SEQ ID NO: 6081030 - DNA, 11 bp, Homo sapiens
cccctgcttct

SEQ ID NO: 6081031 - DNA, 13 bp, Homo sapiens
cccctgcttctca

SEQ ID NO: 6081032 - DNA, 13 bp, Homo sapiens
cccctgcttctcc

SEQ ID NO: 6081033 - DNA, 19 bp, Homo sapiens
cccctgcttctccagcctg

SEQ ID NO: 6081034 - DNA, 15 bp, Homo sapiens
cccctgcttctcccg

SEQ ID NO: 6081035 - DNA, 18 bp, Homo sapiens
cccctgcttctcccgcca

SEQ ID NO: 6081036 - DNA, 24 bp, Homo sapiens
cccctgcttctcccgccattggcc

SEQ ID NO: 6081037 - DNA, 21 bp, Homo sapiens
cccctgctttgccccactggg

SEQ ID NO: 6081038 - DNA, 23 bp, Homo sapiens
cccctggaaacccacctctctgg

SEQ ID NO: 6081039 - DNA, 13 bp, Homo sapiens
cccctggaaccag

SEQ ID NO: 6081040 - DNA, 14 bp, Homo sapiens
cccctggaaccagc

SEQ ID NO: 6081041 - DNA, 17 bp, Homo sapiens
cccctggaaccagcaag

SEQ ID NO: 6081042 - DNA, 23 bp, Homo sapiens
cccctggaaccagcaagtcccag

SEQ ID NO: 6081043 - DNA, 17 bp, Homo sapiens
cccctggaacctttccc

SEQ ID NO: 6081044 - DNA, 19 bp, Homo sapiens
cccctggaacctttccctt

SEQ ID NO: 6081045 - DNA, 22 bp, Homo sapiens
cccctggaacctttcccttgtg

SEQ ID NO: 6081046 - DNA, 20 bp, Homo sapiens
cccctggaagagcccagtct

SEQ ID NO: 6081047 - DNA, 17 bp, Homo sapiens
cccctggaagcagtgcc

SEQ ID NO: 6081048 - DNA, 21 bp, Homo sapiens
cccctggaagcagtgcccagg

SEQ ID NO: 6081049 - DNA, 17 bp, Homo sapiens
cccctggacatgcctgt

SEQ ID NO: 6081050 - DNA, 19 bp, Homo sapiens
cccctggacccctggggtg

SEQ ID NO: 6081051 - DNA, 11 bp, Homo sapiens
cccctggagcc

SEQ ID NO: 6081052 - DNA, 17 bp, Homo sapiens
cccctggagccagcagg

SEQ ID NO: 6081053 - DNA, 17 bp, Homo sapiens
cccctggagctcctgct

SEQ ID NO: 6081054 - DNA, 20 bp, Homo sapiens
cccctggaggcactgaagtg

SEQ ID NO: 6081055 - DNA, 15 bp, Homo sapiens
cctcctttgtctttt

SEQ ID NO: 6081056 - DNA, 23 bp, Homo sapiens
cctcctttgtgaggaagccgctg

SEQ ID NO: 6081057 - DNA, 21 bp, Homo sapiens
cctcctttgtttaataaaggc

SEQ ID NO: 6081058 - DNA, 15 bp, Homo sapiens
cctccttttaaaatt

SEQ ID NO: 6081059 - DNA, 15 bp, Homo sapiens
cctccttttcacttt

SEQ ID NO: 6081060 - DNA, 20 bp, Homo sapiens
cctccttttcactttattgc

SEQ ID NO: 6081061 - DNA, 17 bp, Homo sapiens
cctccttttcctgtgtt

SEQ ID NO: 6081062 - DNA, 12 bp, Homo sapiens
cctccttttctt

SEQ ID NO: 6081063 - DNA, 18 bp, Homo sapiens
cctccttttgcttgaaac

SEQ ID NO: 6081064 - DNA, 15 bp, Homo sapiens
cctccttttggcctg

SEQ ID NO: 6081065 - DNA, 20 bp, Homo sapiens
cctccttttggcctggggga

SEQ ID NO: 6081066 - DNA, 20 bp, Homo sapiens
cctccttttggttcctcaca

SEQ ID NO: 6081067 - DNA, 16 bp, Homo sapiens
cctcgaaacacagaaa

SEQ ID NO: 6081068 - DNA, 15 bp, Homo sapiens
cctcgaaagtgtcat

SEQ ID NO: 6081069 - DNA, 17 bp, Homo sapiens
cctcgaaccaaggcagc

SEQ ID NO: 6081070 - DNA, 23 bp, Homo sapiens
cctcgaaccaaggcagcctccag

SEQ ID NO: 6081071 - DNA, 23 bp, Homo sapiens
cctcgaacccacactgcaacagg

SEQ ID NO: 6081072 - DNA, 22 bp, Homo sapiens
cctcgaacccactccggttccc

SEQ ID NO: 6081073 - DNA, 16 bp, Homo sapiens
cctcgaactcctgggc

SEQ ID NO: 6081074 - DNA, 22 bp, Homo sapiens
cctcgaactcctgggctcaagc

SEQ ID NO: 6081075 - DNA, 16 bp, Homo sapiens
cctcgaactggctgca

SEQ ID NO: 6081076 - DNA, 18 bp, Homo sapiens
cctcgaagcgcgccactc

SEQ ID NO: 6081077 - DNA, 20 bp, Homo sapiens
cctcgaagctgttctctgct

SEQ ID NO: 6081078 - DNA, 14 bp, Homo sapiens
cctcgaagtcccgg

SEQ ID NO: 6081079 - DNA, 22 bp, Homo sapiens
cctcgaatgtgtgggcccaagg

SEQ ID NO: 6081080 - DNA, 23 bp, Homo sapiens
cctcgaatgtgtgggcccaaggc

SEQ ID NO: 6081081 - DNA, 13 bp, Homo sapiens
cctcgaattttgt

SEQ ID NO: 6081082 - DNA, 18 bp, Homo sapiens
cctcgaattttgttttct

SEQ ID NO: 6081083 - DNA, 16 bp, Homo sapiens
cctcgacagcgcccct

SEQ ID NO: 6081084 - DNA, 20 bp, Homo sapiens
cctcgacagcgcccctgctg

SEQ ID NO: 6081085 - DNA, 22 bp, Homo sapiens
cctcgacagcgcccctgctgtc

SEQ ID NO: 6081086 - DNA, 15 bp, Homo sapiens
cctcgaccacccccg

SEQ ID NO: 6081087 - DNA, 14 bp, Homo sapiens
cctcgaccctgtgc

SEQ ID NO: 6081088 - DNA, 15 bp, Homo sapiens
cctcgaccctgtgca

SEQ ID NO: 6081089 - DNA, 21 bp, Homo sapiens
cctcgaccctgtgcaggagct

SEQ ID NO: 6081090 - DNA, 18 bp, Homo sapiens
cctcgacctccctggctt

SEQ ID NO: 6081091 - DNA, 19 bp, Homo sapiens
cctcgacttgaccctttcc

SEQ ID NO: 6081092 - DNA, 20 bp, Homo sapiens
cctcgagatgggtgctggtc

SEQ ID NO: 6081093 - DNA, 14 bp, Homo sapiens
cctcgagcagagag

SEQ ID NO: 6081094 - DNA, 14 bp, Homo sapiens
cctcgagccctccc

SEQ ID NO: 6081095 - DNA, 17 bp, Homo sapiens
cctcgagctctgtagcc

SEQ ID NO: 6081096 - DNA, 22 bp, Homo sapiens
cctcgagctctgtagcctggtc

SEQ ID NO: 6081097 - DNA, 22 bp, Homo sapiens
cctcgaggaaggggggccgccg

SEQ ID NO: 6081098 - DNA, 23 bp, Homo sapiens
cctcgaggcaccggcgctgcagg

SEQ ID NO: 6081099 - DNA, 15 bp, Homo sapiens
cctcgaggcctacag

SEQ ID NO: 6081100 - DNA, 14 bp, Homo sapiens
cctcgagggcaggg

SEQ ID NO: 6081101 - DNA, 19 bp, Homo sapiens
cctcgagggccgcctgcct

SEQ ID NO: 6081102 - DNA, 24 bp, Homo sapiens
cctcgagggccgcctgccttagca

SEQ ID NO: 6081103 - DNA, 13 bp, Homo sapiens
cctcgagtactgt

SEQ ID NO: 6081104 - DNA, 21 bp, Homo sapiens
cctcgagtactgtgggcaatt

SEQ ID NO: 6081105 - DNA, 21 bp, Homo sapiens
cctcgagtccccccacccctc

SEQ ID NO: 6081106 - DNA, 19 bp, Homo sapiens
cctcgagtggcgagtccag

SEQ ID NO: 6081107 - DNA, 21 bp, Homo sapiens
cctcgatgggagggatggccc

SEQ ID NO: 6081108 - DNA, 15 bp, Homo sapiens
cctcgatgtcctcct

SEQ ID NO: 6081109 - DNA, 22 bp, Homo sapiens
cctcgatgtcctcctctgtgaa

SEQ ID NO: 6081110 - DNA, 23 bp, Homo sapiens
cctcgcaacccgtgccaagtcca

SEQ ID NO: 6081111 - DNA, 17 bp, Homo sapiens
cctcgcaaccctgcctg

SEQ ID NO: 6081112 - DNA, 15 bp, Homo sapiens
cctcgcacacagggc

SEQ ID NO: 6081113 - DNA, 20 bp, Homo sapiens
cctcgcacacagggctcaca

SEQ ID NO: 6081114 - DNA, 21 bp, Homo sapiens
cctcgcacacagggctcacag

SEQ ID NO: 6081115 - DNA, 18 bp, Homo sapiens
cctcgcacaggccctagc

SEQ ID NO: 6081116 - DNA, 19 bp, Homo sapiens
cctcgcacaggccctagct

SEQ ID NO: 6081117 - DNA, 19 bp, Homo sapiens
cctcgcacagggcatgcct

SEQ ID NO: 6081118 - DNA, 23 bp, Homo sapiens
cctcgcacagggcatgcctggcc

SEQ ID NO: 6081119 - DNA, 18 bp, Homo sapiens
cctcgcacggccccgaag

SEQ ID NO: 6081120 - DNA, 21 bp, Homo sapiens
cctcgcactgcccagggaagc

SEQ ID NO: 6081121 - DNA, 12 bp, Homo sapiens
cctcgcagacct

SEQ ID NO: 6081122 - DNA, 22 bp, Homo sapiens
cctcgcagagaatgtgaacatg

SEQ ID NO: 6081123 - DNA, 14 bp, Homo sapiens
cctcgcagcaggtg

SEQ ID NO: 6081124 - DNA, 22 bp, Homo sapiens
cctcgcagcaggtgcaagagac

SEQ ID NO: 6081125 - DNA, 22 bp, Homo sapiens
cctcgcagcctctcagtgccct

SEQ ID NO: 6081126 - DNA, 15 bp, Homo sapiens
cctcgcaggtctcag

SEQ ID NO: 6081127 - DNA, 20 bp, Homo sapiens
cctcgcatccgcctctgagc

SEQ ID NO: 6081128 - DNA, 23 bp, Homo sapiens
cctcgcatgccagagcctggggc

SEQ ID NO: 6081129 - DNA, 18 bp, Homo sapiens
cctcgccagcttctcctg

SEQ ID NO: 6081130 - DNA, 20 bp, Homo sapiens
cctcgccagcttctcctgcg

SEQ ID NO: 6081131 - DNA, 13 bp, Homo sapiens
cctcgccagcttg

SEQ ID NO: 6081132 - DNA, 14 bp, Homo sapiens
cctcgccagcttgg

SEQ ID NO: 6081133 - DNA, 17 bp, Homo sapiens
cctcgccagcttggctc

SEQ ID NO: 6081134 - DNA, 12 bp, Homo sapiens
cctcgcccaccg

SEQ ID NO: 6081135 - DNA, 13 bp, Homo sapiens
cctcgcccaccgc

SEQ ID NO: 6081136 - DNA, 13 bp, Homo sapiens
cctcgcccagtcc

SEQ ID NO: 6081137 - DNA, 16 bp, Homo sapiens
cctcgcccagtcccag

SEQ ID NO: 6081138 - DNA, 20 bp, Homo sapiens
cctcgcccagtcccagcagc

SEQ ID NO: 6081139 - DNA, 23 bp, Homo sapiens
cctcgccccaaggttccagaggc

SEQ ID NO: 6081140 - DNA, 13 bp, Homo sapiens
cctcgccccagcc

SEQ ID NO: 6081141 - DNA, 20 bp, Homo sapiens
cctcgccccagccaagcctg

SEQ ID NO: 6081142 - DNA, 13 bp, Homo sapiens
cctcgcccccacc

SEQ ID NO: 6081143 - DNA, 23 bp, Homo sapiens
cctcgccccccgcccggcctcct

SEQ ID NO: 6081144 - DNA, 13 bp, Homo sapiens
cctcgcccctcca

SEQ ID NO: 6081145 - DNA, 15 bp, Homo sapiens
cctcgcccctccagt

SEQ ID NO: 6081146 - DNA, 22 bp, Homo sapiens
cctcgcccgcccacacggcccc

SEQ ID NO: 6081147 - DNA, 17 bp, Homo sapiens
cctcgccctctctcacc

SEQ ID NO: 6081148 - DNA, 14 bp, Homo sapiens
cctcgccctgtgag

SEQ ID NO: 6081149 - DNA, 19 bp, Homo sapiens
cctcgcccttcagcccacc

SEQ ID NO: 6081150 - DNA, 15 bp, Homo sapiens
cctcgccctttctta

SEQ ID NO: 6081151 - DNA, 20 bp, Homo sapiens
cctcgccgagctgtcggagg

SEQ ID NO: 6081152 - DNA, 19 bp, Homo sapiens
cctcgccggatctgaggga

SEQ ID NO: 6081153 - DNA, 20 bp, Homo sapiens
cctcgccgtccctcccaggt

SEQ ID NO: 6081154 - DNA, 20 bp, Homo sapiens
cctcgcctccccaccctcct

SEQ ID NO: 6081155 - DNA, 12 bp, Homo sapiens
cctcgcctgccc

SEQ ID NO: 6081156 - DNA, 19 bp, Homo sapiens
cctcgcctgccctcctctc

SEQ ID NO: 6081157 - DNA, 18 bp, Homo sapiens
cctcgcctggcctgaggt

SEQ ID NO: 6081158 - DNA, 12 bp, Homo sapiens
cctcgcctgtgg

SEQ ID NO: 6081159 - DNA, 13 bp, Homo sapiens
cctcgcctgtgga

SEQ ID NO: 6081160 - DNA, 15 bp, Homo sapiens
cctcgcctgtggagc

SEQ ID NO: 6081161 - DNA, 17 bp, Homo sapiens
cctcgcgcccctgtcca

SEQ ID NO: 6081162 - DNA, 20 bp, Homo sapiens
cctcgcggcgcagcccctgg

SEQ ID NO: 6081163 - DNA, 14 bp, Homo sapiens
cctcgctcaccgct

SEQ ID NO: 6081164 - DNA, 15 bp, Homo sapiens
cctcgctcaccgctg

SEQ ID NO: 6081165 - DNA, 15 bp, Homo sapiens
cctcgctcccctctg

SEQ ID NO: 6081166 - DNA, 15 bp, Homo sapiens
cctcgctcctccttc

SEQ ID NO: 6081167 - DNA, 21 bp, Homo sapiens
cctcgctcctccttcccaggg

SEQ ID NO: 6081168 - DNA, 19 bp, Homo sapiens
cctcgctctgttacccagg

SEQ ID NO: 6081169 - DNA, 12 bp, Homo sapiens
cctcgctgccac

SEQ ID NO: 6081170 - DNA, 13 bp, Homo sapiens
cctcgctgccacc

SEQ ID NO: 6081171 - DNA, 14 bp, Homo sapiens
cctcgctgccaccc

SEQ ID NO: 6081172 - DNA, 20 bp, Homo sapiens
cctcgctgccagctctgtat

SEQ ID NO: 6081173 - DNA, 16 bp, Homo sapiens
cctcgctgctgctact

SEQ ID NO: 6081174 - DNA, 12 bp, Homo sapiens
cctcgctgggct

SEQ ID NO: 6081175 - DNA, 19 bp, Homo sapiens
cctcgctgggctctaaggt

SEQ ID NO: 6081176 - DNA, 14 bp, Homo sapiens
cctcgctgtatgat

SEQ ID NO: 6081177 - DNA, 16 bp, Homo sapiens
cctcgctgtcctgctg

SEQ ID NO: 6081178 - DNA, 20 bp, Homo sapiens
cctcgcttcataggcagagc

SEQ ID NO: 6081179 - DNA, 13 bp, Homo sapiens
cctcgctttttca

SEQ ID NO: 6081180 - DNA, 14 bp, Homo sapiens
cctcgctttttcat

SEQ ID NO: 6081181 - DNA, 18 bp, Homo sapiens
cctcggaaccgctcacct

SEQ ID NO: 6081182 - DNA, 16 bp, Homo sapiens
cctcggacacccaggg

SEQ ID NO: 6081183 - DNA, 22 bp, Homo sapiens
cctcggacagagcccccctagc

SEQ ID NO: 6081184 - DNA, 23 bp, Homo sapiens
cctcggacagagcccccctagca

SEQ ID NO: 6081185 - DNA, 14 bp, Homo sapiens
cctcggactaggtt

SEQ ID NO: 6081186 - DNA, 12 bp, Homo sapiens
cctcggagaaga

SEQ ID NO: 6081187 - DNA, 16 bp, Homo sapiens
cctcggagacgggacc

SEQ ID NO: 6081188 - DNA, 18 bp, Homo sapiens
cctcggagagcagcagca

SEQ ID NO: 6081189 - DNA, 21 bp, Homo sapiens
cctcggagagcagcagcacca

SEQ ID NO: 6081190 - DNA, 18 bp, Homo sapiens
cctcggagccaatgaaca

SEQ ID NO: 6081191 - DNA, 13 bp, Homo sapiens
cctcggagccccc

SEQ ID NO: 6081192 - DNA, 16 bp, Homo sapiens
cctcggagcctcatcc

SEQ ID NO: 6081193 - DNA, 23 bp, Homo sapiens
cctcggagctggctgtgcctgct

SEQ ID NO: 6081194 - DNA, 13 bp, Homo sapiens
cctcggaggctcc

SEQ ID NO: 6081195 - DNA, 17 bp, Homo sapiens
cctcggaggctcctccc

SEQ ID NO: 6081196 - DNA, 16 bp, Homo sapiens
cctcggagggatggag

SEQ ID NO: 6081197 - DNA, 15 bp, Homo sapiens
cctcggatcaccgag

SEQ ID NO: 6081198 - DNA, 17 bp, Homo sapiens
cctcggatcaccgagag

SEQ ID NO: 6081199 - DNA, 17 bp, Homo sapiens
cctcggatcagctgagc

SEQ ID NO: 6081200 - DNA, 21 bp, Homo sapiens
cctcggatgaccatactcaga

SEQ ID NO: 6081201 - DNA, 22 bp, Homo sapiens
cctcggcaaccgtggggaggcc

SEQ ID NO: 6081202 - DNA, 14 bp, Homo sapiens
cctcggcagaactc

SEQ ID NO: 6081203 - DNA, 19 bp, Homo sapiens
cctcggcagaactctctgt

SEQ ID NO: 6081204 - DNA, 16 bp, Homo sapiens
cctcggcagatgctgt

SEQ ID NO: 6081205 - DNA, 18 bp, Homo sapiens
cctcggcattcacacaca

SEQ ID NO: 6081206 - DNA, 19 bp, Homo sapiens
cctcggcattcacacacag

SEQ ID NO: 6081207 - DNA, 22 bp, Homo sapiens
cctcggcattcacacacagcct

SEQ ID NO: 6081208 - DNA, 23 bp, Homo sapiens
cctcggcattcacacacagcctg

SEQ ID NO: 6081209 - DNA, 15 bp, Homo sapiens
cctcggccagagctc

SEQ ID NO: 6081210 - DNA, 22 bp, Homo sapiens
cctcggccagagctcccaggac

SEQ ID NO: 6081211 - DNA, 21 bp, Homo sapiens
cctcggcccatctgtccatcc

SEQ ID NO: 6081212 - DNA, 15 bp, Homo sapiens
cctcggccccaccca

SEQ ID NO: 6081213 - DNA, 22 bp, Homo sapiens
cctcggccccacccaccctctg

SEQ ID NO: 6081214 - DNA, 15 bp, Homo sapiens
cctcggcccctcacc

SEQ ID NO: 6081215 - DNA, 18 bp, Homo sapiens
cctcggcccctcaccacc

SEQ ID NO: 6081216 - DNA, 20 bp, Homo sapiens
cctcggcccctcaccacctc

SEQ ID NO: 6081217 - DNA, 16 bp, Homo sapiens
cctcggccctccctgc

SEQ ID NO: 6081218 - DNA, 21 bp, Homo sapiens
cctcggccctgtagccctggc

SEQ ID NO: 6081219 - DNA, 23 bp, Homo sapiens
cctcggccctgtagccctggccc

SEQ ID NO: 6081220 - DNA, 21 bp, Homo sapiens
cctcggccgtacatctctgtg

SEQ ID NO: 6081221 - DNA, 21 bp, Homo sapiens
cctcggcctcccaaagtgctg

SEQ ID NO: 6081222 - DNA, 14 bp, Homo sapiens
cctcggcctctact

SEQ ID NO: 6081223 - DNA, 21 bp, Homo sapiens
cctcggcctggctggccagga

SEQ ID NO: 6081224 - DNA, 16 bp, Homo sapiens
cctcggcctggcttca

SEQ ID NO: 6081225 - DNA, 18 bp, Homo sapiens
cctcggcgttagtcccta

SEQ ID NO: 6081226 - DNA, 20 bp, Homo sapiens
cctcggcgttagtccctagc

SEQ ID NO: 6081227 - DNA, 14 bp, Homo sapiens
cctcggctggctcc

SEQ ID NO: 6081228 - DNA, 16 bp, Homo sapiens
cctcggctggctcccc

SEQ ID NO: 6081229 - DNA, 19 bp, Homo sapiens
cctcggctggctcccctgc

SEQ ID NO: 6081230 - DNA, 21 bp, Homo sapiens
cctcggctggctcccctgcag

SEQ ID NO: 6081231 - DNA, 17 bp, Homo sapiens
cctcggctggctgtcca

SEQ ID NO: 6081232 - DNA, 20 bp, Homo sapiens
cccctggaggctgcctccca

SEQ ID NO: 6081233 - DNA, 21 bp, Homo sapiens
cccctggaggctgcctcccaa

SEQ ID NO: 6081234 - DNA, 15 bp, Homo sapiens
cccctggagggggaa

SEQ ID NO: 6081235 - DNA, 19 bp, Homo sapiens
cccctggagtgtgtcagag

SEQ ID NO: 6081236 - DNA, 20 bp, Homo sapiens
cccctggagtgtgtcagagc

SEQ ID NO: 6081237 - DNA, 22 bp, Homo sapiens
cccctggagtgtgtcagagccc

SEQ ID NO: 6081238 - DNA, 23 bp, Homo sapiens
cccctggagtgtgtcagagccca

SEQ ID NO: 6081239 - DNA, 15 bp, Homo sapiens
cccctggatgcagcc

SEQ ID NO: 6081240 - DNA, 19 bp, Homo sapiens
cccctggatgcagcctcac

SEQ ID NO: 6081241 - DNA, 21 bp, Homo sapiens
cccctggatgtcccctgtccc

SEQ ID NO: 6081242 - DNA, 11 bp, Homo sapiens
cccctggcaaa

SEQ ID NO: 6081243 - DNA, 23 bp, Homo sapiens
cccctggcaatcccaccaaatca

SEQ ID NO: 6081244 - DNA, 20 bp, Homo sapiens
cccctggcagcacagcccag

SEQ ID NO: 6081245 - DNA, 21 bp, Homo sapiens
cccctggcagcacagcccagg

SEQ ID NO: 6081246 - DNA, 14 bp, Homo sapiens
cccctggcagcccc

SEQ ID NO: 6081247 - DNA, 19 bp, Homo sapiens
cccctggcagctgcccctc

SEQ ID NO: 6081248 - DNA, 14 bp, Homo sapiens
cccctggcagggga

SEQ ID NO: 6081249 - DNA, 11 bp, Homo sapiens
cccctggcagt

SEQ ID NO: 6081250 - DNA, 20 bp, Homo sapiens
cccctggccacagaccccca

SEQ ID NO: 6081251 - DNA, 16 bp, Homo sapiens
cccctggccagctctg

SEQ ID NO: 6081252 - DNA, 10 bp, Homo sapiens
cccctggccc

SEQ ID NO: 6081253 - DNA, 14 bp, Homo sapiens
cccctggcccagag

SEQ ID NO: 6081254 - DNA, 13 bp, Homo sapiens
cccctggcccagc

SEQ ID NO: 6081255 - DNA, 15 bp, Homo sapiens
cccctggcccagcgg

SEQ ID NO: 6081256 - DNA, 22 bp, Homo sapiens
cccctggcccagcggcccctcc

SEQ ID NO: 6081257 - DNA, 16 bp, Homo sapiens
cccctggcccaggagg

SEQ ID NO: 6081258 - DNA, 12 bp, Homo sapiens
cccctggccctg

SEQ ID NO: 6081259 - DNA, 16 bp, Homo sapiens
cccctggccctgcctc

SEQ ID NO: 6081260 - DNA, 17 bp, Homo sapiens
cccctggccctgcctca

SEQ ID NO: 6081261 - DNA, 20 bp, Homo sapiens
cccctggccctgcctcactg

SEQ ID NO: 6081262 - DNA, 17 bp, Homo sapiens
cccctggcccttccttc

SEQ ID NO: 6081263 - DNA, 13 bp, Homo sapiens
cccctggcctcag

SEQ ID NO: 6081264 - DNA, 20 bp, Homo sapiens
cccctggcctcagttcccag

SEQ ID NO: 6081265 - DNA, 15 bp, Homo sapiens
cccctggccttggga

SEQ ID NO: 6081266 - DNA, 15 bp, Homo sapiens
cccctggctccttca

SEQ ID NO: 6081267 - DNA, 19 bp, Homo sapiens
cccctggctccttcaccac

SEQ ID NO: 6081268 - DNA, 17 bp, Homo sapiens
cccctggctctgggccg

SEQ ID NO: 6081269 - DNA, 19 bp, Homo sapiens
cccctggctgaacagtgct

SEQ ID NO: 6081270 - DNA, 22 bp, Homo sapiens
cccctggctgggacgtggctca

SEQ ID NO: 6081271 - DNA, 23 bp, Homo sapiens
cccctggctgggacgtggctcag

SEQ ID NO: 6081272 - DNA, 23 bp, Homo sapiens
cccctggctgtactgctcaggct

SEQ ID NO: 6081273 - DNA, 10 bp, Homo sapiens
cccctggctt

SEQ ID NO: 6081274 - DNA, 11 bp, Homo sapiens
cccctggcttg

SEQ ID NO: 6081275 - DNA, 18 bp, Homo sapiens
cccctggctttgcctctt

SEQ ID NO: 6081276 - DNA, 20 bp, Homo sapiens
cccctggctttgcctcttct

SEQ ID NO: 6081277 - DNA, 22 bp, Homo sapiens
cccctggcttttcactgctggc

SEQ ID NO: 6081278 - DNA, 23 bp, Homo sapiens
cccctgggaacacagtgccccag

SEQ ID NO: 6081279 - DNA, 14 bp, Homo sapiens
cccctgggaacagg

SEQ ID NO: 6081280 - DNA, 17 bp, Homo sapiens
cccctgggaacaggccc

SEQ ID NO: 6081281 - DNA, 23 bp, Homo sapiens
cccctgggactaaagccaggaac

SEQ ID NO: 6081282 - DNA, 10 bp, Homo sapiens
cccctgggat

SEQ ID NO: 6081283 - DNA, 13 bp, Homo sapiens
cccctgggcagat

SEQ ID NO: 6081284 - DNA, 12 bp, Homo sapiens
cccctgggcagg

SEQ ID NO: 6081285 - DNA, 22 bp, Homo sapiens
cccctgggcatcttctggcttg

SEQ ID NO: 6081286 - DNA, 23 bp, Homo sapiens
cccctgggcatcttctggcttga

SEQ ID NO: 6081287 - DNA, 16 bp, Homo sapiens
cccctgggccaccctt

SEQ ID NO: 6081288 - DNA, 17 bp, Homo sapiens
cccctgggccacccttc

SEQ ID NO: 6081289 - DNA, 18 bp, Homo sapiens
cccctgggccacccttca

SEQ ID NO: 6081290 - DNA, 19 bp, Homo sapiens
cccctgggcctcatcacag

SEQ ID NO: 6081291 - DNA, 22 bp, Homo sapiens
cccctgggctaccatctgcatg

SEQ ID NO: 6081292 - DNA, 12 bp, Homo sapiens
cccctgggctct

SEQ ID NO: 6081293 - DNA, 15 bp, Homo sapiens
cccctgggctctcac

SEQ ID NO: 6081294 - DNA, 15 bp, Homo sapiens
cccctgggctctgcc

SEQ ID NO: 6081295 - DNA, 21 bp, Homo sapiens
cccctgggcttggcctgctgt

SEQ ID NO: 6081296 - DNA, 14 bp, Homo sapiens
cccctggggacaga

SEQ ID NO: 6081297 - DNA, 19 bp, Homo sapiens
cccctggggacagagccac

SEQ ID NO: 6081298 - DNA, 14 bp, Homo sapiens
cccctggggaccca

SEQ ID NO: 6081299 - DNA, 21 bp, Homo sapiens
cccctggggctgagtctccag

SEQ ID NO: 6081300 - DNA, 23 bp, Homo sapiens
cccctggggctgagtctccaggg

SEQ ID NO: 6081301 - DNA, 20 bp, Homo sapiens
cccctggggcttctcctgac

SEQ ID NO: 6081302 - DNA, 21 bp, Homo sapiens
cccctgggggaggcttccagc

SEQ ID NO: 6081303 - DNA, 22 bp, Homo sapiens
cccctgggggaggcttccagct

SEQ ID NO: 6081304 - DNA, 16 bp, Homo sapiens
cccctggggtgcaggc

SEQ ID NO: 6081305 - DNA, 15 bp, Homo sapiens
cccctggggtggcca

SEQ ID NO: 6081306 - DNA, 20 bp, Homo sapiens
cccctggggtggccaccagt

SEQ ID NO: 6081307 - DNA, 17 bp, Homo sapiens
cccctggggtggccagg

SEQ ID NO: 6081308 - DNA, 18 bp, Homo sapiens
cccctggggtggccaggg

SEQ ID NO: 6081309 - DNA, 21 bp, Homo sapiens
cccctgggtcagtctggtggg

SEQ ID NO: 6081310 - DNA, 21 bp, Homo sapiens
cccctgggtgggtggtgggga

SEQ ID NO: 6081311 - DNA, 17 bp, Homo sapiens
cccctgggttaacaaat

SEQ ID NO: 6081312 - DNA, 16 bp, Homo sapiens
cccctggtaagcagag

SEQ ID NO: 6081313 - DNA, 17 bp, Homo sapiens
cccctggtccctctgca

SEQ ID NO: 6081314 - DNA, 16 bp, Homo sapiens
cccctggtctgccctg

SEQ ID NO: 6081315 - DNA, 23 bp, Homo sapiens
cccctggtgcactggccccaccc

SEQ ID NO: 6081316 - DNA, 17 bp, Homo sapiens
cccctggtgcctgcagg

SEQ ID NO: 6081317 - DNA, 19 bp, Homo sapiens
cccctggtgcctgcaggcc

SEQ ID NO: 6081318 - DNA, 15 bp, Homo sapiens
cccctggtggacagt

SEQ ID NO: 6081319 - DNA, 21 bp, Homo sapiens
cccctggtggacagtcctggg

SEQ ID NO: 6081320 - DNA, 22 bp, Homo sapiens
cccctggtggacagtcctggga

SEQ ID NO: 6081321 - DNA, 23 bp, Homo sapiens
cccctggtggacagtcctgggag

SEQ ID NO: 6081322 - DNA, 20 bp, Homo sapiens
cccctggtggctgcaggcac

SEQ ID NO: 6081323 - DNA, 12 bp, Homo sapiens
cccctggtggtt

SEQ ID NO: 6081324 - DNA, 18 bp, Homo sapiens
cccctggttctcatcttt

SEQ ID NO: 6081325 - DNA, 16 bp, Homo sapiens
cccctgtaaggttcca

SEQ ID NO: 6081326 - DNA, 17 bp, Homo sapiens
cccctgtaaggttccat

SEQ ID NO: 6081327 - DNA, 22 bp, Homo sapiens
cccctgtacccagccaccttcc

SEQ ID NO: 6081328 - DNA, 23 bp, Homo sapiens
cccctgtacccagccaccttcct

SEQ ID NO: 6081329 - DNA, 14 bp, Homo sapiens
cccctgtactccag

SEQ ID NO: 6081330 - DNA, 23 bp, Homo sapiens
cccctgtagggaaaccttggaga

SEQ ID NO: 6081331 - DNA, 13 bp, Homo sapiens
cccctgtcagttt

SEQ ID NO: 6081332 - DNA, 22 bp, Homo sapiens
cccctgtccagattattggctg

SEQ ID NO: 6081333 - DNA, 11 bp, Homo sapiens
cccctgtccca

SEQ ID NO: 6081334 - DNA, 15 bp, Homo sapiens
cccctgtcccacctg

SEQ ID NO: 6081335 - DNA, 18 bp, Homo sapiens
cccctgtcccatgcaggc

SEQ ID NO: 6081336 - DNA, 18 bp, Homo sapiens
cccctgtcccattctaga

SEQ ID NO: 6081337 - DNA, 17 bp, Homo sapiens
cccctgtccccagtccc

SEQ ID NO: 6081338 - DNA, 21 bp, Homo sapiens
cccctgtccccagtccccagc

SEQ ID NO: 6081339 - DNA, 19 bp, Homo sapiens
cccctgtcccctggggctg

SEQ ID NO: 6081340 - DNA, 17 bp, Homo sapiens
cccctgtcctaggtcat

SEQ ID NO: 6081341 - DNA, 23 bp, Homo sapiens
cccctgtctccttattcggcagc

SEQ ID NO: 6081342 - DNA, 22 bp, Homo sapiens
cccctgtctctcagggccaggc

SEQ ID NO: 6081343 - DNA, 21 bp, Homo sapiens
cccctgtcttcacctgccacc

SEQ ID NO: 6081344 - DNA, 13 bp, Homo sapiens
cccctgtgccagc

SEQ ID NO: 6081345 - DNA, 21 bp, Homo sapiens
cccctgtgcccacccagggcc

SEQ ID NO: 6081346 - DNA, 23 bp, Homo sapiens
cccctgtgcctctgtcctagact

SEQ ID NO: 6081347 - DNA, 23 bp, Homo sapiens
cccctgtgcctgctgggcactgg

SEQ ID NO: 6081348 - DNA, 21 bp, Homo sapiens
cccctgtgctcccctgccaca

SEQ ID NO: 6081349 - DNA, 12 bp, Homo sapiens
cccctgtggcca

SEQ ID NO: 6081350 - DNA, 13 bp, Homo sapiens
cccctgtggccaa

SEQ ID NO: 6081351 - DNA, 19 bp, Homo sapiens
cccctgtggccaactgcaa

SEQ ID NO: 6081352 - DNA, 17 bp, Homo sapiens
cccctgtggccctggca

SEQ ID NO: 6081353 - DNA, 12 bp, Homo sapiens
cccctgtgggga

SEQ ID NO: 6081354 - DNA, 19 bp, Homo sapiens
cccctgtggtaactttgca

SEQ ID NO: 6081355 - DNA, 22 bp, Homo sapiens
cccctgtggtaactttgcaggc

SEQ ID NO: 6081356 - DNA, 20 bp, Homo sapiens
cccctgtgtattcaccacca

SEQ ID NO: 6081357 - DNA, 14 bp, Homo sapiens
cccctgtgtgacat

SEQ ID NO: 6081358 - DNA, 15 bp, Homo sapiens
cccctgtgtggccct

SEQ ID NO: 6081359 - DNA, 23 bp, Homo sapiens
cccctgtgtgggagggcgaggcg

SEQ ID NO: 6081360 - DNA, 19 bp, Homo sapiens
cccctgttcccccgctggc

SEQ ID NO: 6081361 - DNA, 19 bp, Homo sapiens
cccctgttcccctctccct

SEQ ID NO: 6081362 - DNA, 20 bp, Homo sapiens
cccctgttctggcagagttg

SEQ ID NO: 6081363 - DNA, 19 bp, Homo sapiens
cccctgtttattcatatgc

SEQ ID NO: 6081364 - DNA, 17 bp, Homo sapiens
cccctgttttctgctgt

SEQ ID NO: 6081365 - DNA, 21 bp, Homo sapiens
ccccttaccccaaagagaaag

SEQ ID NO: 6081366 - DNA, 21 bp, Homo sapiens
ccccttaccccagtcacttct

SEQ ID NO: 6081367 - DNA, 22 bp, Homo sapiens
ccccttactatgatctcaggag

SEQ ID NO: 6081368 - DNA, 23 bp, Homo sapiens
ccccttactatgatctcaggagc

SEQ ID NO: 6081369 - DNA, 13 bp, Homo sapiens
ccccttagacaga

SEQ ID NO: 6081370 - DNA, 15 bp, Homo sapiens
ccccttatccaggac

SEQ ID NO: 6081371 - DNA, 19 bp, Homo sapiens
ccccttatgttgaggtgac

SEQ ID NO: 6081372 - DNA, 15 bp, Homo sapiens
ccccttattgctgcc

SEQ ID NO: 6081373 - DNA, 16 bp, Homo sapiens
ccccttattgctgcca

SEQ ID NO: 6081374 - DNA, 18 bp, Homo sapiens
ccccttcaacaaacagtg

SEQ ID NO: 6081375 - DNA, 19 bp, Homo sapiens
ccccttcaatctcgtttag

SEQ ID NO: 6081376 - DNA, 16 bp, Homo sapiens
ccccttcaccccttca

SEQ ID NO: 6081377 - DNA, 23 bp, Homo sapiens
ccccttcacgtttgcagttgatg

SEQ ID NO: 6081378 - DNA, 21 bp, Homo sapiens
ccccttcagccgagcccagac

SEQ ID NO: 6081379 - DNA, 14 bp, Homo sapiens
ccccttcagctcct

SEQ ID NO: 6081380 - DNA, 14 bp, Homo sapiens
ccccttcaggagcc

SEQ ID NO: 6081381 - DNA, 16 bp, Homo sapiens
ccccttcaggagcctg

SEQ ID NO: 6081382 - DNA, 18 bp, Homo sapiens
ccccttcatccatcctga

SEQ ID NO: 6081383 - DNA, 18 bp, Homo sapiens
ccccttccaaatgtccct

SEQ ID NO: 6081384 - DNA, 14 bp, Homo sapiens
ccccttccactgag

SEQ ID NO: 6081385 - DNA, 10 bp, Homo sapiens
ccccttccca

SEQ ID NO: 6081386 - DNA, 12 bp, Homo sapiens
ccccttcccacg

SEQ ID NO: 6081387 - DNA, 13 bp, Homo sapiens
ccccttcccattt

SEQ ID NO: 6081388 - DNA, 15 bp, Homo sapiens
ccccttccccactgc

SEQ ID NO: 6081389 - DNA, 23 bp, Homo sapiens
ccccttccccactgcctgcccac

SEQ ID NO: 6081390 - DNA, 16 bp, Homo sapiens
ccccttccccaggccc

SEQ ID NO: 6081391 - DNA, 12 bp, Homo sapiens
ccccttccccat

SEQ ID NO: 6081392 - DNA, 17 bp, Homo sapiens
ccccttccccatctcca

SEQ ID NO: 6081393 - DNA, 12 bp, Homo sapiens
ccccttccccct

SEQ ID NO: 6081394 - DNA, 14 bp, Homo sapiens
ccccttccccgtcc

SEQ ID NO: 6081395 - DNA, 15 bp, Homo sapiens
ccccttccccgtccc

SEQ ID NO: 6081396 - DNA, 23 bp, Homo sapiens
ccccttccccgtcccctgcagcc

SEQ ID NO: 6081397 - DNA, 14 bp, Homo sapiens
ccccttcccctccc

SEQ ID NO: 6081398 - DNA, 16 bp, Homo sapiens
ccccttccccttctgt

SEQ ID NO: 6081399 - DNA, 10 bp, Homo sapiens
ccccttccct

SEQ ID NO: 6081400 - DNA, 13 bp, Homo sapiens
ccccttccctgca

SEQ ID NO: 6081401 - DNA, 14 bp, Homo sapiens
ccccttccctgcaa

SEQ ID NO: 6081402 - DNA, 19 bp, Homo sapiens
ccccttcctaaatatccaa

SEQ ID NO: 6081403 - DNA, 13 bp, Homo sapiens
ccccttcctagtg

SEQ ID NO: 6081404 - DNA, 17 bp, Homo sapiens
ccccttcctcagcctgg

SEQ ID NO: 6081405 - DNA, 19 bp, Homo sapiens
ccccttcctcagcctgggg

SEQ ID NO: 6081406 - DNA, 15 bp, Homo sapiens
ccccttcctgcaccc

SEQ ID NO: 6081407 - DNA, 20 bp, Homo sapiens
ccccttcctgcacccgtacc

SEQ ID NO: 6081408 - DNA, 13 bp, Homo sapiens
ccccttcctgggt

SEQ ID NO: 6081409 - DNA, 20 bp, Homo sapiens
ccccttcctgtcctgcctcc

SEQ ID NO: 6081410 - DNA, 13 bp, Homo sapiens
cctcggctgtctc

SEQ ID NO: 6081411 - DNA, 15 bp, Homo sapiens
cctcggctgtctcct

SEQ ID NO: 6081412 - DNA, 16 bp, Homo sapiens
cctcggctgtctcctg

SEQ ID NO: 6081413 - DNA, 19 bp, Homo sapiens
cctcggctgtgtggggagg

SEQ ID NO: 6081414 - DNA, 16 bp, Homo sapiens
cctcggcttgtgggct

SEQ ID NO: 6081415 - DNA, 17 bp, Homo sapiens
cctcggcttgtgggctg

SEQ ID NO: 6081416 - DNA, 19 bp, Homo sapiens
cctcggcttgtgggctggt

SEQ ID NO: 6081417 - DNA, 21 bp, Homo sapiens
cctcggcttgtgggctggtgc

SEQ ID NO: 6081418 - DNA, 20 bp, Homo sapiens
cctcggcttttctcagctgg

SEQ ID NO: 6081419 - DNA, 23 bp, Homo sapiens
cctcgggaacctcactcttgcca

SEQ ID NO: 6081420 - DNA, 21 bp, Homo sapiens
cctcgggaccctcccagtgag

SEQ ID NO: 6081421 - DNA, 20 bp, Homo sapiens
cctcgggatgaaaagccata

SEQ ID NO: 6081422 - DNA, 15 bp, Homo sapiens
cctcgggcccacctg

SEQ ID NO: 6081423 - DNA, 16 bp, Homo sapiens
cctcgggcccacctgg

SEQ ID NO: 6081424 - DNA, 18 bp, Homo sapiens
cctcgggccccatcctca

SEQ ID NO: 6081425 - DNA, 13 bp, Homo sapiens
cctcgggcccctg

SEQ ID NO: 6081426 - DNA, 19 bp, Homo sapiens
cctcgggccctgtggtgct

SEQ ID NO: 6081427 - DNA, 19 bp, Homo sapiens
cctcgggccgaggcccagc

SEQ ID NO: 6081428 - DNA, 22 bp, Homo sapiens
cctcgggcgagtcactgcctct

SEQ ID NO: 6081429 - DNA, 16 bp, Homo sapiens
cctcgggcgcctgcgc

SEQ ID NO: 6081430 - DNA, 20 bp, Homo sapiens
cctcgggctggagcctccga

SEQ ID NO: 6081431 - DNA, 21 bp, Homo sapiens
cctcgggctgttctggtggcc

SEQ ID NO: 6081432 - DNA, 18 bp, Homo sapiens
cctcggggacaccagagc

SEQ ID NO: 6081433 - DNA, 16 bp, Homo sapiens
cctcggggagaggggg

SEQ ID NO: 6081434 - DNA, 16 bp, Homo sapiens
cctcggggcaggaagt

SEQ ID NO: 6081435 - DNA, 19 bp, Homo sapiens
cctcggggcaggaagtccc

SEQ ID NO: 6081436 - DNA, 22 bp, Homo sapiens
cctcggggcaggaagtccctga

SEQ ID NO: 6081437 - DNA, 15 bp, Homo sapiens
cctcggggcagggca

SEQ ID NO: 6081438 - DNA, 16 bp, Homo sapiens
cctcggggcagggcag

SEQ ID NO: 6081439 - DNA, 17 bp, Homo sapiens
cctcgggggcctgtggt

SEQ ID NO: 6081440 - DNA, 17 bp, Homo sapiens
cctcgggggctcttccc

SEQ ID NO: 6081441 - DNA, 17 bp, Homo sapiens
cctcgggtctccccacc

SEQ ID NO: 6081442 - DNA, 21 bp, Homo sapiens
cctcgggtctccccacctgca

SEQ ID NO: 6081443 - DNA, 15 bp, Homo sapiens
cctcgggtctcctca

SEQ ID NO: 6081444 - DNA, 17 bp, Homo sapiens
cctcgggtctcctcact

SEQ ID NO: 6081445 - DNA, 20 bp, Homo sapiens
cctcgggtggggctggtggg

SEQ ID NO: 6081446 - DNA, 23 bp, Homo sapiens
cctcgggtggggctggtgggtct

SEQ ID NO: 6081447 - DNA, 16 bp, Homo sapiens
cctcggtatctggctt

SEQ ID NO: 6081448 - DNA, 18 bp, Homo sapiens
cctcggtatctggcttcc

SEQ ID NO: 6081449 - DNA, 23 bp, Homo sapiens
cctcggtatctggcttccctgga

SEQ ID NO: 6081450 - DNA, 16 bp, Homo sapiens
cctcggtcacctgtgc

SEQ ID NO: 6081451 - DNA, 21 bp, Homo sapiens
cctcggtcgccccgtgtttgc

SEQ ID NO: 6081452 - DNA, 19 bp, Homo sapiens
cctcggtctcccttccgtc

SEQ ID NO: 6081453 - DNA, 13 bp, Homo sapiens
cctcggtcttacc

SEQ ID NO: 6081454 - DNA, 16 bp, Homo sapiens
cctcggtggccatgct

SEQ ID NO: 6081455 - DNA, 17 bp, Homo sapiens
cctcggtggccatgctt

SEQ ID NO: 6081456 - DNA, 20 bp, Homo sapiens
cctcggtggccatgcttctt

SEQ ID NO: 6081457 - DNA, 22 bp, Homo sapiens
cctcggtggccatgcttcttgc

SEQ ID NO: 6081458 - DNA, 18 bp, Homo sapiens
cctcggtggctctggggt

SEQ ID NO: 6081459 - DNA, 17 bp, Homo sapiens
cctcggtggctgcacag

SEQ ID NO: 6081460 - DNA, 13 bp, Homo sapiens
cctcggtgggcca

SEQ ID NO: 6081461 - DNA, 18 bp, Homo sapiens
cctcggtgggccagagct

SEQ ID NO: 6081462 - DNA, 19 bp, Homo sapiens
cctcggtgggccagagctg

SEQ ID NO: 6081463 - DNA, 20 bp, Homo sapiens
cctcggtgggccagagctga

SEQ ID NO: 6081464 - DNA, 14 bp, Homo sapiens
cctcggtgtggaga

SEQ ID NO: 6081465 - DNA, 15 bp, Homo sapiens
cctcgtaccagccag

SEQ ID NO: 6081466 - DNA, 16 bp, Homo sapiens
cctcgtaccagccagg

SEQ ID NO: 6081467 - DNA, 22 bp, Homo sapiens
cctcgtagagtgacctcggaca

SEQ ID NO: 6081468 - DNA, 17 bp, Homo sapiens
cctcgtccacaggggca

SEQ ID NO: 6081469 - DNA, 22 bp, Homo sapiens
cctcgtccacaggggcaggcct

SEQ ID NO: 6081470 - DNA, 23 bp, Homo sapiens
cctcgtccacaggggcaggcctg

SEQ ID NO: 6081471 - DNA, 13 bp, Homo sapiens
cctcgtccacccc

SEQ ID NO: 6081472 - DNA, 18 bp, Homo sapiens
cctcgtccaccccccaca

SEQ ID NO: 6081473 - DNA, 16 bp, Homo sapiens
cctcgtcccatccagc

SEQ ID NO: 6081474 - DNA, 23 bp, Homo sapiens
cctcgtcccatccagctaccacc

SEQ ID NO: 6081475 - DNA, 22 bp, Homo sapiens
cctcgtcccgagggcgcctggg

SEQ ID NO: 6081476 - DNA, 17 bp, Homo sapiens
cctcgtccctccctcac

SEQ ID NO: 6081477 - DNA, 17 bp, Homo sapiens
cctcgtccggcctgcag

SEQ ID NO: 6081478 - DNA, 15 bp, Homo sapiens
cctcgtcctccccct

SEQ ID NO: 6081479 - DNA, 17 bp, Homo sapiens
cctcgtctcttgtgact

SEQ ID NO: 6081480 - DNA, 19 bp, Homo sapiens
cctcgtctttgaactgccg

SEQ ID NO: 6081481 - DNA, 18 bp, Homo sapiens
cctcgtgaaagtgcattt

SEQ ID NO: 6081482 - DNA, 15 bp, Homo sapiens
cctcgtgaggggcaa

SEQ ID NO: 6081483 - DNA, 17 bp, Homo sapiens
cctcgtgcctgggggag

SEQ ID NO: 6081484 - DNA, 13 bp, Homo sapiens
cctcgtgctttaa

SEQ ID NO: 6081485 - DNA, 16 bp, Homo sapiens
cctcgtggacacctgc

SEQ ID NO: 6081486 - DNA, 18 bp, Homo sapiens
cctcgtggacacctgccc

SEQ ID NO: 6081487 - DNA, 21 bp, Homo sapiens
cctcgtggacacctgccctgc

SEQ ID NO: 6081488 - DNA, 14 bp, Homo sapiens
cctcgtggccagcc

SEQ ID NO: 6081489 - DNA, 15 bp, Homo sapiens
cctcgtggccagccc

SEQ ID NO: 6081490 - DNA, 16 bp, Homo sapiens
cctcgtggccagcccg

SEQ ID NO: 6081491 - DNA, 18 bp, Homo sapiens
cctcgtggccttccccag

SEQ ID NO: 6081492 - DNA, 22 bp, Homo sapiens
cctcgtggccttccccagcctc

SEQ ID NO: 6081493 - DNA, 16 bp, Homo sapiens
cctcgtgggtcccaga

SEQ ID NO: 6081494 - DNA, 15 bp, Homo sapiens
cctcgtgtcagctca

SEQ ID NO: 6081495 - DNA, 19 bp, Homo sapiens
cctcgtgtcctgctagctg

SEQ ID NO: 6081496 - DNA, 21 bp, Homo sapiens
cctcgttagagaatggcctga

SEQ ID NO: 6081497 - DNA, 15 bp, Homo sapiens
cctcgttctccctgg

SEQ ID NO: 6081498 - DNA, 16 bp, Homo sapiens
cctcgttctccctggg

SEQ ID NO: 6081499 - DNA, 20 bp, Homo sapiens
cctcgttctccctgggaggc

SEQ ID NO: 6081500 - DNA, 13 bp, Homo sapiens
cctcgttgcccag

SEQ ID NO: 6081501 - DNA, 14 bp, Homo sapiens
cctcgttgcccagc

SEQ ID NO: 6081502 - DNA, 16 bp, Homo sapiens
cctcgttgcccagcac

SEQ ID NO: 6081503 - DNA, 14 bp, Homo sapiens
cctcgttggagagc

SEQ ID NO: 6081504 - DNA, 15 bp, Homo sapiens
cctcgtttgatagtg

SEQ ID NO: 6081505 - DNA, 20 bp, Homo sapiens
cctcgtttgatagtgcttct

SEQ ID NO: 6081506 - DNA, 15 bp, Homo sapiens
cctcgtttgtgttct

SEQ ID NO: 6081507 - DNA, 16 bp, Homo sapiens
cctcgttttcaaagat

SEQ ID NO: 6081508 - DNA, 15 bp, Homo sapiens
cctctaaagaaactt

SEQ ID NO: 6081509 - DNA, 14 bp, Homo sapiens
cctctaaagcagag

SEQ ID NO: 6081510 - DNA, 17 bp, Homo sapiens
cctctaaagcagaggca

SEQ ID NO: 6081511 - DNA, 22 bp, Homo sapiens
cctctaaagcagaggcaacact

SEQ ID NO: 6081512 - DNA, 17 bp, Homo sapiens
cctctaacaccacactg

SEQ ID NO: 6081513 - DNA, 19 bp, Homo sapiens
cctctaacaccacactgac

SEQ ID NO: 6081514 - DNA, 19 bp, Homo sapiens
cctctaacagcacagggaa

SEQ ID NO: 6081515 - DNA, 14 bp, Homo sapiens
cctctaacagcacc

SEQ ID NO: 6081516 - DNA, 16 bp, Homo sapiens
cctctaacagcaccaa

SEQ ID NO: 6081517 - DNA, 21 bp, Homo sapiens
cctctaacaggggctggtggg

SEQ ID NO: 6081518 - DNA, 16 bp, Homo sapiens
cctctaaccccaggcc

SEQ ID NO: 6081519 - DNA, 18 bp, Homo sapiens
cctctaaccccaggcccc

SEQ ID NO: 6081520 - DNA, 23 bp, Homo sapiens
cctctaacccccagtgccacaga

SEQ ID NO: 6081521 - DNA, 18 bp, Homo sapiens
cctctaaccctcattgct

SEQ ID NO: 6081522 - DNA, 24 bp, Homo sapiens
cctctaactcactgcctaggaggc

SEQ ID NO: 6081523 - DNA, 13 bp, Homo sapiens
cctctaactcatt

SEQ ID NO: 6081524 - DNA, 14 bp, Homo sapiens
cctctaactccctc

SEQ ID NO: 6081525 - DNA, 15 bp, Homo sapiens
cctctaactccctcc

SEQ ID NO: 6081526 - DNA, 18 bp, Homo sapiens
cctctaactccctcctca

SEQ ID NO: 6081527 - DNA, 14 bp, Homo sapiens
cctctaactggaca

SEQ ID NO: 6081528 - DNA, 16 bp, Homo sapiens
cctctaactggacagc

SEQ ID NO: 6081529 - DNA, 20 bp, Homo sapiens
cctctaactggacagcctct

SEQ ID NO: 6081530 - DNA, 17 bp, Homo sapiens
cctctaacttggctcac

SEQ ID NO: 6081531 - DNA, 14 bp, Homo sapiens
cctctaagccactc

SEQ ID NO: 6081532 - DNA, 18 bp, Homo sapiens
cctctaagcgtgctgaca

SEQ ID NO: 6081533 - DNA, 23 bp, Homo sapiens
cctctaaggccaaggcctcagga

SEQ ID NO: 6081534 - DNA, 16 bp, Homo sapiens
cctctaagtgctgctg

SEQ ID NO: 6081535 - DNA, 14 bp, Homo sapiens
cctctaatccagca

SEQ ID NO: 6081536 - DNA, 16 bp, Homo sapiens
cctctaatctgagctg

SEQ ID NO: 6081537 - DNA, 15 bp, Homo sapiens
cctctaatgagactg

SEQ ID NO: 6081538 - DNA, 18 bp, Homo sapiens
cctctaatgctcacgctc

SEQ ID NO: 6081539 - DNA, 13 bp, Homo sapiens
cctctaattaaaa

SEQ ID NO: 6081540 - DNA, 13 bp, Homo sapiens
cctctacacaggg

SEQ ID NO: 6081541 - DNA, 19 bp, Homo sapiens
cctctacacaggggccctg

SEQ ID NO: 6081542 - DNA, 21 bp, Homo sapiens
cctctacagagcttccctgac

SEQ ID NO: 6081543 - DNA, 24 bp, Homo sapiens
cctctacagagcttccctgactca

SEQ ID NO: 6081544 - DNA, 14 bp, Homo sapiens
cctctacccaaacc

SEQ ID NO: 6081545 - DNA, 14 bp, Homo sapiens
cctctacctctctc

SEQ ID NO: 6081546 - DNA, 19 bp, Homo sapiens
cctctacgaggccatccag

SEQ ID NO: 6081547 - DNA, 14 bp, Homo sapiens
cctctactaggtct

SEQ ID NO: 6081548 - DNA, 16 bp, Homo sapiens
cctctactgggaaggc

SEQ ID NO: 6081549 - DNA, 11 bp, Homo sapiens
cctctactgtc

SEQ ID NO: 6081550 - DNA, 22 bp, Homo sapiens
cctctactgtctcctccctggg

SEQ ID NO: 6081551 - DNA, 23 bp, Homo sapiens
cctctactgtctcctccctgggc

SEQ ID NO: 6081552 - DNA, 20 bp, Homo sapiens
cctctacttaatgagatagt

SEQ ID NO: 6081553 - DNA, 22 bp, Homo sapiens
cctctagaaacgagttggtgtc

SEQ ID NO: 6081554 - DNA, 16 bp, Homo sapiens
cctctagaaataggtt

SEQ ID NO: 6081555 - DNA, 23 bp, Homo sapiens
cctctagaacacccactggccag

SEQ ID NO: 6081556 - DNA, 16 bp, Homo sapiens
cctctagaacagccag

SEQ ID NO: 6081557 - DNA, 18 bp, Homo sapiens
cctctagaagccaaggga

SEQ ID NO: 6081558 - DNA, 20 bp, Homo sapiens
cctctagaatcccagcagca

SEQ ID NO: 6081559 - DNA, 22 bp, Homo sapiens
cctctagagagatgagaagcca

SEQ ID NO: 6081560 - DNA, 15 bp, Homo sapiens
cctctagagcagact

SEQ ID NO: 6081561 - DNA, 20 bp, Homo sapiens
cctctagaggctttgagaag

SEQ ID NO: 6081562 - DNA, 20 bp, Homo sapiens
cctctagccatcccttgggg

SEQ ID NO: 6081563 - DNA, 19 bp, Homo sapiens
cctctagcccactccctgc

SEQ ID NO: 6081564 - DNA, 13 bp, Homo sapiens
cctctagccctgc

SEQ ID NO: 6081565 - DNA, 17 bp, Homo sapiens
cctctagccctgcccgg

SEQ ID NO: 6081566 - DNA, 15 bp, Homo sapiens
cctctagctaccatt

SEQ ID NO: 6081567 - DNA, 10 bp, Homo sapiens
cctctagctg

SEQ ID NO: 6081568 - DNA, 14 bp, Homo sapiens
cctctagcttttct

SEQ ID NO: 6081569 - DNA, 20 bp, Homo sapiens
cctctagcttttctattttt

SEQ ID NO: 6081570 - DNA, 20 bp, Homo sapiens
cctctaggcaagcaggacct

SEQ ID NO: 6081571 - DNA, 22 bp, Homo sapiens
cctctaggcaagcaggacctgg

SEQ ID NO: 6081572 - DNA, 15 bp, Homo sapiens
cctctaggccctgtg

SEQ ID NO: 6081573 - DNA, 15 bp, Homo sapiens
cctctaggcctcagt

SEQ ID NO: 6081574 - DNA, 17 bp, Homo sapiens
cctctaggcctcagtgt

SEQ ID NO: 6081575 - DNA, 13 bp, Homo sapiens
cctctaggctctg

SEQ ID NO: 6081576 - DNA, 19 bp, Homo sapiens
cctctaggctctgccttcg

SEQ ID NO: 6081577 - DNA, 17 bp, Homo sapiens
cctctaggggcagcctc

SEQ ID NO: 6081578 - DNA, 16 bp, Homo sapiens
cctctaggtaaccagt

SEQ ID NO: 6081579 - DNA, 17 bp, Homo sapiens
cctctagtccccaaggc

SEQ ID NO: 6081580 - DNA, 21 bp, Homo sapiens
cctctagtccccaaggcctct

SEQ ID NO: 6081581 - DNA, 14 bp, Homo sapiens
cctctagtgccctc

SEQ ID NO: 6081582 - DNA, 20 bp, Homo sapiens
cctctatacatctctcccca

SEQ ID NO: 6081583 - DNA, 21 bp, Homo sapiens
cctctatactttgttctgttg

SEQ ID NO: 6081584 - DNA, 22 bp, Homo sapiens
cctctatatctttaaataaatg

SEQ ID NO: 6081585 - DNA, 16 bp, Homo sapiens
cctctatatttgctct

SEQ ID NO: 6081586 - DNA, 13 bp, Homo sapiens
cctctatcccaat

SEQ ID NO: 6081587 - DNA, 16 bp, Homo sapiens
cctctatccctggcca

SEQ ID NO: 6081588 - DNA, 19 bp, Homo sapiens
ccccttcctgtctggccca

SEQ ID NO: 6081589 - DNA, 15 bp, Homo sapiens
ccccttcctgtttca

SEQ ID NO: 6081590 - DNA, 19 bp, Homo sapiens
ccccttccttgctctgcac

SEQ ID NO: 6081591 - DNA, 15 bp, Homo sapiens
ccccttcctttcctc

SEQ ID NO: 6081592 - DNA, 23 bp, Homo sapiens
ccccttcctttcctctgcagcac

SEQ ID NO: 6081593 - DNA, 19 bp, Homo sapiens
ccccttcgacatgctgcca

SEQ ID NO: 6081594 - DNA, 14 bp, Homo sapiens
ccccttcgctcctg

SEQ ID NO: 6081595 - DNA, 21 bp, Homo sapiens
ccccttctacatttcttagac

SEQ ID NO: 6081596 - DNA, 21 bp, Homo sapiens
ccccttctaggggcaggtgaa

SEQ ID NO: 6081597 - DNA, 14 bp, Homo sapiens
ccccttctcagaat

SEQ ID NO: 6081598 - DNA, 15 bp, Homo sapiens
ccccttctcatcact

SEQ ID NO: 6081599 - DNA, 13 bp, Homo sapiens
ccccttctcccac

SEQ ID NO: 6081600 - DNA, 19 bp, Homo sapiens
ccccttctcccctgcactg

SEQ ID NO: 6081601 - DNA, 14 bp, Homo sapiens
ccccttctcccctt

SEQ ID NO: 6081602 - DNA, 16 bp, Homo sapiens
ccccttctccccttcc

SEQ ID NO: 6081603 - DNA, 22 bp, Homo sapiens
ccccttctctcaatccctttgc

SEQ ID NO: 6081604 - DNA, 23 bp, Homo sapiens
ccccttctctcaatccctttgca

SEQ ID NO: 6081605 - DNA, 21 bp, Homo sapiens
ccccttctctccctgccagag

SEQ ID NO: 6081606 - DNA, 19 bp, Homo sapiens
ccccttctctcctccccaa

SEQ ID NO: 6081607 - DNA, 12 bp, Homo sapiens
ccccttctctgc

SEQ ID NO: 6081608 - DNA, 18 bp, Homo sapiens
ccccttctctgcctcacc

SEQ ID NO: 6081609 - DNA, 14 bp, Homo sapiens
ccccttctctgctc

SEQ ID NO: 6081610 - DNA, 12 bp, Homo sapiens
ccccttctctgt

SEQ ID NO: 6081611 - DNA, 13 bp, Homo sapiens
ccccttctctgtg

SEQ ID NO: 6081612 - DNA, 15 bp, Homo sapiens
ccccttctctgtgac

SEQ ID NO: 6081613 - DNA, 14 bp, Homo sapiens
ccccttctgctcag

SEQ ID NO: 6081614 - DNA, 19 bp, Homo sapiens
ccccttctgctcagctctg

SEQ ID NO: 6081615 - DNA, 18 bp, Homo sapiens
ccccttctggccggtgct

SEQ ID NO: 6081616 - DNA, 13 bp, Homo sapiens
ccccttcttcccg

SEQ ID NO: 6081617 - DNA, 14 bp, Homo sapiens
ccccttcttcccgc

SEQ ID NO: 6081618 - DNA, 19 bp, Homo sapiens
ccccttcttcccgccccac

SEQ ID NO: 6081619 - DNA, 15 bp, Homo sapiens
ccccttcttgggccc

SEQ ID NO: 6081620 - DNA, 22 bp, Homo sapiens
ccccttgaagaggggaggggcc

SEQ ID NO: 6081621 - DNA, 15 bp, Homo sapiens
ccccttgaagcaata

SEQ ID NO: 6081622 - DNA, 18 bp, Homo sapiens
ccccttgacaactggcag

SEQ ID NO: 6081623 - DNA, 23 bp, Homo sapiens
ccccttgacaactggcaggcagg

SEQ ID NO: 6081624 - DNA, 20 bp, Homo sapiens
ccccttgaggattgtggaaa

SEQ ID NO: 6081625 - DNA, 19 bp, Homo sapiens
ccccttgaggtctcagccc

SEQ ID NO: 6081626 - DNA, 15 bp, Homo sapiens
ccccttgcagcctgg

SEQ ID NO: 6081627 - DNA, 18 bp, Homo sapiens
ccccttgcagcctggtca

SEQ ID NO: 6081628 - DNA, 22 bp, Homo sapiens
ccccttgccacatcgcagcccc

SEQ ID NO: 6081629 - DNA, 12 bp, Homo sapiens
ccccttgccagc

SEQ ID NO: 6081630 - DNA, 14 bp, Homo sapiens
ccccttgccagctg

SEQ ID NO: 6081631 - DNA, 15 bp, Homo sapiens
ccccttgcccaggcc

SEQ ID NO: 6081632 - DNA, 22 bp, Homo sapiens
ccccttgcccaggcctccccag

SEQ ID NO: 6081633 - DNA, 16 bp, Homo sapiens
ccccttgcccatcagc

SEQ ID NO: 6081634 - DNA, 22 bp, Homo sapiens
ccccttgcccatgcctccagct

SEQ ID NO: 6081635 - DNA, 20 bp, Homo sapiens
ccccttgcccgccagccagt

SEQ ID NO: 6081636 - DNA, 22 bp, Homo sapiens
ccccttgcccgccagccagtgg

SEQ ID NO: 6081637 - DNA, 11 bp, Homo sapiens
ccccttgccct

SEQ ID NO: 6081638 - DNA, 21 bp, Homo sapiens
ccccttgccctccgcctggga

SEQ ID NO: 6081639 - DNA, 23 bp, Homo sapiens
ccccttgccctccgcctgggatc

SEQ ID NO: 6081640 - DNA, 16 bp, Homo sapiens
ccccttgcccttcctg

SEQ ID NO: 6081641 - DNA, 20 bp, Homo sapiens
ccccttgcccttcctgaccc

SEQ ID NO: 6081642 - DNA, 24 bp, Homo sapiens
ccccttgcccttgccctgacctcc

SEQ ID NO: 6081643 - DNA, 16 bp, Homo sapiens
ccccttgcctgtgcca

SEQ ID NO: 6081644 - DNA, 22 bp, Homo sapiens
ccccttgctctcccctgccctg

SEQ ID NO: 6081645 - DNA, 15 bp, Homo sapiens
ccccttgctctctgt

SEQ ID NO: 6081646 - DNA, 20 bp, Homo sapiens
ccccttgctgatgctcctcc

SEQ ID NO: 6081647 - DNA, 17 bp, Homo sapiens
ccccttgctgctggctc

SEQ ID NO: 6081648 - DNA, 18 bp, Homo sapiens
ccccttgctgctggctcc

SEQ ID NO: 6081649 - DNA, 19 bp, Homo sapiens
ccccttgctgctggctccc

SEQ ID NO: 6081650 - DNA, 18 bp, Homo sapiens
ccccttggacctccaggg

SEQ ID NO: 6081651 - DNA, 19 bp, Homo sapiens
ccccttggaggagggctgt

SEQ ID NO: 6081652 - DNA, 17 bp, Homo sapiens
ccccttggatcaagcag

SEQ ID NO: 6081653 - DNA, 17 bp, Homo sapiens
ccccttggcactgtgga

SEQ ID NO: 6081654 - DNA, 16 bp, Homo sapiens
ccccttgggcccacac

SEQ ID NO: 6081655 - DNA, 18 bp, Homo sapiens
ccccttgggcccacacct

SEQ ID NO: 6081656 - DNA, 13 bp, Homo sapiens
ccccttgggcctc

SEQ ID NO: 6081657 - DNA, 17 bp, Homo sapiens
ccccttggtcctggcag

SEQ ID NO: 6081658 - DNA, 19 bp, Homo sapiens
ccccttgtcctgaagccca

SEQ ID NO: 6081659 - DNA, 15 bp, Homo sapiens
ccccttgtcctttcc

SEQ ID NO: 6081660 - DNA, 15 bp, Homo sapiens
ccccttgtctgctgc

SEQ ID NO: 6081661 - DNA, 16 bp, Homo sapiens
ccccttgtctgctgct

SEQ ID NO: 6081662 - DNA, 19 bp, Homo sapiens
ccccttgtgggcaaaggca

SEQ ID NO: 6081663 - DNA, 23 bp, Homo sapiens
ccccttgtgggcaaaggcagggc

SEQ ID NO: 6081664 - DNA, 19 bp, Homo sapiens
ccccttgttgcactgcccc

SEQ ID NO: 6081665 - DNA, 17 bp, Homo sapiens
cccctttactcagccca

SEQ ID NO: 6081666 - DNA, 19 bp, Homo sapiens
cccctttactcagcccagc

SEQ ID NO: 6081667 - DNA, 21 bp, Homo sapiens
cccctttcacaggcagccagt

SEQ ID NO: 6081668 - DNA, 17 bp, Homo sapiens
cccctttccaattccaa

SEQ ID NO: 6081669 - DNA, 20 bp, Homo sapiens
cccctttcccatcacccctt

SEQ ID NO: 6081670 - DNA, 14 bp, Homo sapiens
cccctttccccagc

SEQ ID NO: 6081671 - DNA, 12 bp, Homo sapiens
cccctttccccc

SEQ ID NO: 6081672 - DNA, 21 bp, Homo sapiens
cccctttcccccaccccagag

SEQ ID NO: 6081673 - DNA, 13 bp, Homo sapiens
cccctttcctaaa

SEQ ID NO: 6081674 - DNA, 22 bp, Homo sapiens
cccctttcctctaactcactgc

SEQ ID NO: 6081675 - DNA, 20 bp, Homo sapiens
cccctttccttcactgcccc

SEQ ID NO: 6081676 - DNA, 19 bp, Homo sapiens
cccctttctctgcctggca

SEQ ID NO: 6081677 - DNA, 12 bp, Homo sapiens
cccctttctctt

SEQ ID NO: 6081678 - DNA, 13 bp, Homo sapiens
cccctttcttctc

SEQ ID NO: 6081679 - DNA, 13 bp, Homo sapiens
cccctttgaccct

SEQ ID NO: 6081680 - DNA, 15 bp, Homo sapiens
cccctttgaccttcc

SEQ ID NO: 6081681 - DNA, 20 bp, Homo sapiens
cccctttgatgattaattca

SEQ ID NO: 6081682 - DNA, 13 bp, Homo sapiens
cccctttgcctct

SEQ ID NO: 6081683 - DNA, 20 bp, Homo sapiens
cccctttgcctctgtcctcc

SEQ ID NO: 6081684 - DNA, 15 bp, Homo sapiens
cccctttggacctgc

SEQ ID NO: 6081685 - DNA, 17 bp, Homo sapiens
cccctttgggccctgca

SEQ ID NO: 6081686 - DNA, 19 bp, Homo sapiens
cccctttgggccctgcatg

SEQ ID NO: 6081687 - DNA, 22 bp, Homo sapiens
cccctttggtttggcctccatc

SEQ ID NO: 6081688 - DNA, 17 bp, Homo sapiens
cccctttggttttacta

SEQ ID NO: 6081689 - DNA, 14 bp, Homo sapiens
cccctttgtcctgc

SEQ ID NO: 6081690 - DNA, 12 bp, Homo sapiens
cccctttgtgct

SEQ ID NO: 6081691 - DNA, 15 bp, Homo sapiens
cccctttgtgctgtg

SEQ ID NO: 6081692 - DNA, 18 bp, Homo sapiens
ccccttttaaggtttcaa

SEQ ID NO: 6081693 - DNA, 17 bp, Homo sapiens
ccccttttcagcttctg

SEQ ID NO: 6081694 - DNA, 22 bp, Homo sapiens
ccccttttcagcttctgctggg

SEQ ID NO: 6081695 - DNA, 22 bp, Homo sapiens
ccccttttcggccccatgtatc

SEQ ID NO: 6081696 - DNA, 19 bp, Homo sapiens
ccccttttctatgttgcta

SEQ ID NO: 6081697 - DNA, 20 bp, Homo sapiens
ccccttttctctgctcttgt

SEQ ID NO: 6081698 - DNA, 14 bp, Homo sapiens
ccccttttctgcat

SEQ ID NO: 6081699 - DNA, 19 bp, Homo sapiens
ccccttttcttttctaccc

SEQ ID NO: 6081700 - DNA, 12 bp, Homo sapiens
ccccttttgcat

SEQ ID NO: 6081701 - DNA, 16 bp, Homo sapiens
ccccttttgcctggct

SEQ ID NO: 6081702 - DNA, 17 bp, Homo sapiens
ccccttttgcctggctg

SEQ ID NO: 6081703 - DNA, 20 bp, Homo sapiens
ccccttttttgtcccccaac

SEQ ID NO: 6081704 - DNA, 17 bp, Homo sapiens
cccgaaaaatgtgtggt

SEQ ID NO: 6081705 - DNA, 19 bp, Homo sapiens
cccgaaactccacccgttc

SEQ ID NO: 6081706 - DNA, 21 bp, Homo sapiens
cccgaaagaggcacccttcca

SEQ ID NO: 6081707 - DNA, 19 bp, Homo sapiens
cccgaaagcatcactgcct

SEQ ID NO: 6081708 - DNA, 20 bp, Homo sapiens
cccgaaagcatcactgcctt

SEQ ID NO: 6081709 - DNA, 17 bp, Homo sapiens
cccgaaatcagccccca

SEQ ID NO: 6081710 - DNA, 18 bp, Homo sapiens
cccgaaatcagcccccag

SEQ ID NO: 6081711 - DNA, 20 bp, Homo sapiens
cccgaaatcagcccccagcc

SEQ ID NO: 6081712 - DNA, 19 bp, Homo sapiens
cccgaacctcacctgacct

SEQ ID NO: 6081713 - DNA, 19 bp, Homo sapiens
cccgaactgtgccttcgct

SEQ ID NO: 6081714 - DNA, 17 bp, Homo sapiens
cccgaagagtcagcccc

SEQ ID NO: 6081715 - DNA, 12 bp, Homo sapiens
cccgaagcccag

SEQ ID NO: 6081716 - DNA, 12 bp, Homo sapiens
cccgaagttcag

SEQ ID NO: 6081717 - DNA, 22 bp, Homo sapiens
cccgaatagctgggactacagg

SEQ ID NO: 6081718 - DNA, 17 bp, Homo sapiens
cccgacaccggccagtg

SEQ ID NO: 6081719 - DNA, 15 bp, Homo sapiens
cccgacagcctggca

SEQ ID NO: 6081720 - DNA, 20 bp, Homo sapiens
cccgacaggtgggcctggga

SEQ ID NO: 6081721 - DNA, 17 bp, Homo sapiens
cccgacagtgccatccc

SEQ ID NO: 6081722 - DNA, 23 bp, Homo sapiens
cccgacatggacccggagctaac

SEQ ID NO: 6081723 - DNA, 23 bp, Homo sapiens
cccgaccccacctgaggcaggag

SEQ ID NO: 6081724 - DNA, 17 bp, Homo sapiens
cccgaccccatccacct

SEQ ID NO: 6081725 - DNA, 19 bp, Homo sapiens
cccgacccccgcagaggca

SEQ ID NO: 6081726 - DNA, 14 bp, Homo sapiens
cccgaccccgagtc

SEQ ID NO: 6081727 - DNA, 15 bp, Homo sapiens
cccgaccgggccagg

SEQ ID NO: 6081728 - DNA, 17 bp, Homo sapiens
cccgacctggctgagtg

SEQ ID NO: 6081729 - DNA, 18 bp, Homo sapiens
cccgacgccacagcccag

SEQ ID NO: 6081730 - DNA, 15 bp, Homo sapiens
cccgacggctgtgac

SEQ ID NO: 6081731 - DNA, 13 bp, Homo sapiens
cccgacgtgctcc

SEQ ID NO: 6081732 - DNA, 19 bp, Homo sapiens
cccgacgtgctcccctgct

SEQ ID NO: 6081733 - DNA, 18 bp, Homo sapiens
cccgactcaccttgtgtg

SEQ ID NO: 6081734 - DNA, 20 bp, Homo sapiens
cccgactccagccagcgcct

SEQ ID NO: 6081735 - DNA, 14 bp, Homo sapiens
cccgactctctcca

SEQ ID NO: 6081736 - DNA, 13 bp, Homo sapiens
cccgactgcctgt

SEQ ID NO: 6081737 - DNA, 20 bp, Homo sapiens
cccgactgtgggactcagtt

SEQ ID NO: 6081738 - DNA, 16 bp, Homo sapiens
cccgacttcctgactc

SEQ ID NO: 6081739 - DNA, 13 bp, Homo sapiens
cccgacttgctgt

SEQ ID NO: 6081740 - DNA, 18 bp, Homo sapiens
cccgagaaatttgtcttt

SEQ ID NO: 6081741 - DNA, 15 bp, Homo sapiens
cccgagaaccctgag

SEQ ID NO: 6081742 - DNA, 23 bp, Homo sapiens
cccgagaaggaatggtgcttggc

SEQ ID NO: 6081743 - DNA, 17 bp, Homo sapiens
cccgagacaccatcctg

SEQ ID NO: 6081744 - DNA, 18 bp, Homo sapiens
cccgagacggcactgaga

SEQ ID NO: 6081745 - DNA, 13 bp, Homo sapiens
cccgagagcctcg

SEQ ID NO: 6081746 - DNA, 22 bp, Homo sapiens
cccgagagctcttagtttttaa

SEQ ID NO: 6081747 - DNA, 16 bp, Homo sapiens
cccgagagctgggact

SEQ ID NO: 6081748 - DNA, 23 bp, Homo sapiens
cccgagatgtgacccaccagtgc

SEQ ID NO: 6081749 - DNA, 21 bp, Homo sapiens
cccgagcaatggcgcctgctc

SEQ ID NO: 6081750 - DNA, 12 bp, Homo sapiens
cccgagcccagc

SEQ ID NO: 6081751 - DNA, 17 bp, Homo sapiens
cccgagcccaggcagct

SEQ ID NO: 6081752 - DNA, 17 bp, Homo sapiens
cccgagccccctgtcct

SEQ ID NO: 6081753 - DNA, 19 bp, Homo sapiens
cccgagccccctgtccttc

SEQ ID NO: 6081754 - DNA, 14 bp, Homo sapiens
cccgagcccctgcc

SEQ ID NO: 6081755 - DNA, 19 bp, Homo sapiens
cccgagccgagctctcctg

SEQ ID NO: 6081756 - DNA, 18 bp, Homo sapiens
cccgagcgcgtgccttcc

SEQ ID NO: 6081757 - DNA, 22 bp, Homo sapiens
cccgagctactctcttgccagc

SEQ ID NO: 6081758 - DNA, 17 bp, Homo sapiens
cccgagctcttggcctt

SEQ ID NO: 6081759 - DNA, 15 bp, Homo sapiens
cccgagcttgcctca

SEQ ID NO: 6081760 - DNA, 18 bp, Homo sapiens
cccgaggaagcacagctt

SEQ ID NO: 6081761 - DNA, 22 bp, Homo sapiens
cccgaggagctgggcccctgca

SEQ ID NO: 6081762 - DNA, 21 bp, Homo sapiens
cccgaggaggccgactgggct

SEQ ID NO: 6081763 - DNA, 22 bp, Homo sapiens
cccgaggaggccgactgggctg

SEQ ID NO: 6081764 - DNA, 19 bp, Homo sapiens
cccgaggaggtgtctcagg

SEQ ID NO: 6081765 - DNA, 21 bp, Homo sapiens
cccgaggaggtgtctcaggct

SEQ ID NO: 6081766 - DNA, 19 bp, Homo sapiens
cctctatccctggccacct

SEQ ID NO: 6081767 - DNA, 20 bp, Homo sapiens
cctctatccctggccacctg

SEQ ID NO: 6081768 - DNA, 21 bp, Homo sapiens
cctctatccctggccacctgc

SEQ ID NO: 6081769 - DNA, 18 bp, Homo sapiens
cctctatccttttttcct

SEQ ID NO: 6081770 - DNA, 17 bp, Homo sapiens
cctctatgccctgcaga

SEQ ID NO: 6081771 - DNA, 22 bp, Homo sapiens
cctctatgccctgcagagcaat

SEQ ID NO: 6081772 - DNA, 23 bp, Homo sapiens
cctctatgccctgcagagcaata

SEQ ID NO: 6081773 - DNA, 14 bp, Homo sapiens
cctctatgctggct

SEQ ID NO: 6081774 - DNA, 16 bp, Homo sapiens
cctctatgctggcttt

SEQ ID NO: 6081775 - DNA, 20 bp, Homo sapiens
cctctattaattactgtgtg

SEQ ID NO: 6081776 - DNA, 21 bp, Homo sapiens
cctctattaattactgtgtgt

SEQ ID NO: 6081777 - DNA, 14 bp, Homo sapiens
cctctattgatgta

SEQ ID NO: 6081778 - DNA, 17 bp, Homo sapiens
cctctatttatgtttgc

SEQ ID NO: 6081779 - DNA, 21 bp, Homo sapiens
cctctatttatgtttgcactt

SEQ ID NO: 6081780 - DNA, 22 bp, Homo sapiens
cctctatttcctgaacctggaa

SEQ ID NO: 6081781 - DNA, 14 bp, Homo sapiens
cctctattttaatt

SEQ ID NO: 6081782 - DNA, 13 bp, Homo sapiens
cctctcaaacctg

SEQ ID NO: 6081783 - DNA, 17 bp, Homo sapiens
cctctcaaattcagctc

SEQ ID NO: 6081784 - DNA, 19 bp, Homo sapiens
cctctcaaattcagctctg

SEQ ID NO: 6081785 - DNA, 17 bp, Homo sapiens
cctctcaagctagccag

SEQ ID NO: 6081786 - DNA, 18 bp, Homo sapiens
cctctcaagtagctggga

SEQ ID NO: 6081787 - DNA, 11 bp, Homo sapiens
cctctcacaca

SEQ ID NO: 6081788 - DNA, 13 bp, Homo sapiens
cctctcacacaca

SEQ ID NO: 6081789 - DNA, 14 bp, Homo sapiens
cctctcacacacat

SEQ ID NO: 6081790 - DNA, 20 bp, Homo sapiens
cctctcacaggcagctctga

SEQ ID NO: 6081791 - DNA, 15 bp, Homo sapiens
cctctcaccccactc

SEQ ID NO: 6081792 - DNA, 18 bp, Homo sapiens
cctctcaccccactcctg

SEQ ID NO: 6081793 - DNA, 14 bp, Homo sapiens
cctctcacctcagc

SEQ ID NO: 6081794 - DNA, 20 bp, Homo sapiens
cctctcacctgccgtgcgta

SEQ ID NO: 6081795 - DNA, 17 bp, Homo sapiens
cctctcacctgtactct

SEQ ID NO: 6081796 - DNA, 13 bp, Homo sapiens
cctctcacgccac

SEQ ID NO: 6081797 - DNA, 17 bp, Homo sapiens
cctctcacgccaccccc

SEQ ID NO: 6081798 - DNA, 14 bp, Homo sapiens
cctctcactccagc

SEQ ID NO: 6081799 - DNA, 16 bp, Homo sapiens
cctctcactccagcca

SEQ ID NO: 6081800 - DNA, 17 bp, Homo sapiens
cctctcactccagccaa

SEQ ID NO: 6081801 - DNA, 14 bp, Homo sapiens
cctctcactcccca

SEQ ID NO: 6081802 - DNA, 12 bp, Homo sapiens
cctctcactcct

SEQ ID NO: 6081803 - DNA, 15 bp, Homo sapiens
cctctcactgtctga

SEQ ID NO: 6081804 - DNA, 20 bp, Homo sapiens
cctctcagaacatactgatt

SEQ ID NO: 6081805 - DNA, 14 bp, Homo sapiens
cctctcagacccag

SEQ ID NO: 6081806 - DNA, 13 bp, Homo sapiens
cctctcagagcaa

SEQ ID NO: 6081807 - DNA, 19 bp, Homo sapiens
cctctcagagcaagccttt

SEQ ID NO: 6081808 - DNA, 22 bp, Homo sapiens
cctctcagagcaagcctttgac

SEQ ID NO: 6081809 - DNA, 17 bp, Homo sapiens
cctctcagaggcctgct

SEQ ID NO: 6081810 - DNA, 13 bp, Homo sapiens
cctctcagagtga

SEQ ID NO: 6081811 - DNA, 20 bp, Homo sapiens
cctctcagatacccagtgga

SEQ ID NO: 6081812 - DNA, 19 bp, Homo sapiens
cctctcagatccctcggtc

SEQ ID NO: 6081813 - DNA, 18 bp, Homo sapiens
cctctcagcatagcctgc

SEQ ID NO: 6081814 - DNA, 19 bp, Homo sapiens
cctctcagcatagcctgcc

SEQ ID NO: 6081815 - DNA, 14 bp, Homo sapiens
cctctcagccctca

SEQ ID NO: 6081816 - DNA, 16 bp, Homo sapiens
cctctcagctccaggt

SEQ ID NO: 6081817 - DNA, 13 bp, Homo sapiens
cctctcagctgct

SEQ ID NO: 6081818 - DNA, 19 bp, Homo sapiens
cctctcagctgctggatga

SEQ ID NO: 6081819 - DNA, 23 bp, Homo sapiens
cctctcaggatccaagctaagca

SEQ ID NO: 6081820 - DNA, 14 bp, Homo sapiens
cctctcaggcatgc

SEQ ID NO: 6081821 - DNA, 18 bp, Homo sapiens
cctctcagggccgagagg

SEQ ID NO: 6081822 - DNA, 15 bp, Homo sapiens
cctctcagggcctgg

SEQ ID NO: 6081823 - DNA, 16 bp, Homo sapiens
cctctcagtctgcagt

SEQ ID NO: 6081824 - DNA, 15 bp, Homo sapiens
cctctcagtgccttc

SEQ ID NO: 6081825 - DNA, 16 bp, Homo sapiens
cctctcagtgccttct

SEQ ID NO: 6081826 - DNA, 17 bp, Homo sapiens
cctctcagtgccttctc

SEQ ID NO: 6081827 - DNA, 20 bp, Homo sapiens
cctctcagtgccttctctca

SEQ ID NO: 6081828 - DNA, 21 bp, Homo sapiens
cctctcagtgccttctctcag

SEQ ID NO: 6081829 - DNA, 13 bp, Homo sapiens
cctctcagtgttt

SEQ ID NO: 6081830 - DNA, 17 bp, Homo sapiens
cctctcagttctctccc

SEQ ID NO: 6081831 - DNA, 23 bp, Homo sapiens
cctctcatatatagacagctttg

SEQ ID NO: 6081832 - DNA, 18 bp, Homo sapiens
cctctcatcagcccaggt

SEQ ID NO: 6081833 - DNA, 23 bp, Homo sapiens
cctctcatcagtgtcctcttgct

SEQ ID NO: 6081834 - DNA, 15 bp, Homo sapiens
cctctcatctatgct

SEQ ID NO: 6081835 - DNA, 15 bp, Homo sapiens
cctctcatctcaggt

SEQ ID NO: 6081836 - DNA, 20 bp, Homo sapiens
cctctcatgtccctccaggg

SEQ ID NO: 6081837 - DNA, 18 bp, Homo sapiens
cctctcatttagcctgtc

SEQ ID NO: 6081838 - DNA, 16 bp, Homo sapiens
cctctcatttccagct

SEQ ID NO: 6081839 - DNA, 17 bp, Homo sapiens
cctctcatttccagctt

SEQ ID NO: 6081840 - DNA, 18 bp, Homo sapiens
cctctcatttccagcttc

SEQ ID NO: 6081841 - DNA, 20 bp, Homo sapiens
cctctcatttccagcttctc

SEQ ID NO: 6081842 - DNA, 21 bp, Homo sapiens
cctctcatttccagcttctca

SEQ ID NO: 6081843 - DNA, 15 bp, Homo sapiens
cctctccaaccactg

SEQ ID NO: 6081844 - DNA, 20 bp, Homo sapiens
cctctccaaccactgtgcca

SEQ ID NO: 6081845 - DNA, 23 bp, Homo sapiens
cctctccaaccactgtgccactg

SEQ ID NO: 6081846 - DNA, 12 bp, Homo sapiens
cctctccaagac

SEQ ID NO: 6081847 - DNA, 18 bp, Homo sapiens
cctctccaagacagcagc

SEQ ID NO: 6081848 - DNA, 12 bp, Homo sapiens
cctctccaaggg

SEQ ID NO: 6081849 - DNA, 18 bp, Homo sapiens
cctctccaagggcttctg

SEQ ID NO: 6081850 - DNA, 19 bp, Homo sapiens
cctctccaagggcttctgc

SEQ ID NO: 6081851 - DNA, 23 bp, Homo sapiens
cctctccaagggcttctgcaccc

SEQ ID NO: 6081852 - DNA, 21 bp, Homo sapiens
cctctccaagtctctctgtga

SEQ ID NO: 6081853 - DNA, 18 bp, Homo sapiens
cctctccaattgtaaaaa

SEQ ID NO: 6081854 - DNA, 11 bp, Homo sapiens
cctctccacac

SEQ ID NO: 6081855 - DNA, 17 bp, Homo sapiens
cctctccacacagtgct

SEQ ID NO: 6081856 - DNA, 15 bp, Homo sapiens
cctctccacacccag

SEQ ID NO: 6081857 - DNA, 17 bp, Homo sapiens
cctctccacacccagcc

SEQ ID NO: 6081858 - DNA, 19 bp, Homo sapiens
cctctccacacccagcctg

SEQ ID NO: 6081859 - DNA, 19 bp, Homo sapiens
cctctccacacccatgact

SEQ ID NO: 6081860 - DNA, 21 bp, Homo sapiens
cctctccaccagacgccttcc

SEQ ID NO: 6081861 - DNA, 23 bp, Homo sapiens
cctctccaccagccctactcctg

SEQ ID NO: 6081862 - DNA, 13 bp, Homo sapiens
cctctccacccag

SEQ ID NO: 6081863 - DNA, 15 bp, Homo sapiens
cctctccacccagag

SEQ ID NO: 6081864 - DNA, 16 bp, Homo sapiens
cctctccacccagagg

SEQ ID NO: 6081865 - DNA, 17 bp, Homo sapiens
cctctccacccagaggt

SEQ ID NO: 6081866 - DNA, 21 bp, Homo sapiens
cctctccacccagaggtctcc

SEQ ID NO: 6081867 - DNA, 17 bp, Homo sapiens
cctctccaccctccggc

SEQ ID NO: 6081868 - DNA, 17 bp, Homo sapiens
cctctccacctagtggc

SEQ ID NO: 6081869 - DNA, 22 bp, Homo sapiens
cctctccagcaggcccatggga

SEQ ID NO: 6081870 - DNA, 15 bp, Homo sapiens
cctctccagcatccc

SEQ ID NO: 6081871 - DNA, 14 bp, Homo sapiens
cctctccagcctca

SEQ ID NO: 6081872 - DNA, 16 bp, Homo sapiens
cctctccagcctcagc

SEQ ID NO: 6081873 - DNA, 17 bp, Homo sapiens
cctctccagcctcagcc

SEQ ID NO: 6081874 - DNA, 15 bp, Homo sapiens
cctctccagcctgct

SEQ ID NO: 6081875 - DNA, 17 bp, Homo sapiens
cctctccaggaagggag

SEQ ID NO: 6081876 - DNA, 17 bp, Homo sapiens
cctctccaggcaccctt

SEQ ID NO: 6081877 - DNA, 14 bp, Homo sapiens
cctctccaggccag

SEQ ID NO: 6081878 - DNA, 13 bp, Homo sapiens
cctctccaggcct

SEQ ID NO: 6081879 - DNA, 14 bp, Homo sapiens
cctctccaggcctg

SEQ ID NO: 6081880 - DNA, 18 bp, Homo sapiens
cctctccagtttgcacct

SEQ ID NO: 6081881 - DNA, 20 bp, Homo sapiens
cctctccagtttgcacctgt

SEQ ID NO: 6081882 - DNA, 22 bp, Homo sapiens
cctctccataaccccacccttg

SEQ ID NO: 6081883 - DNA, 17 bp, Homo sapiens
cctctccatatctcctt

SEQ ID NO: 6081884 - DNA, 20 bp, Homo sapiens
cctctccatatctccttccc

SEQ ID NO: 6081885 - DNA, 14 bp, Homo sapiens
cctctccatcttca

SEQ ID NO: 6081886 - DNA, 15 bp, Homo sapiens
cctctccatgcaagt

SEQ ID NO: 6081887 - DNA, 19 bp, Homo sapiens
cctctccatgcaagtgctg

SEQ ID NO: 6081888 - DNA, 13 bp, Homo sapiens
cctctccatgccc

SEQ ID NO: 6081889 - DNA, 14 bp, Homo sapiens
cctctccatgccca

SEQ ID NO: 6081890 - DNA, 15 bp, Homo sapiens
cctctccatgcccaa

SEQ ID NO: 6081891 - DNA, 22 bp, Homo sapiens
cctctccattttagcccagtgt

SEQ ID NO: 6081892 - DNA, 20 bp, Homo sapiens
cctctcccaactataaaact

SEQ ID NO: 6081893 - DNA, 11 bp, Homo sapiens
cctctcccacc

SEQ ID NO: 6081894 - DNA, 13 bp, Homo sapiens
cctctcccaccca

SEQ ID NO: 6081895 - DNA, 17 bp, Homo sapiens
cctctcccacccggcca

SEQ ID NO: 6081896 - DNA, 13 bp, Homo sapiens
cctctcccaccct

SEQ ID NO: 6081897 - DNA, 15 bp, Homo sapiens
cctctcccaccctct

SEQ ID NO: 6081898 - DNA, 16 bp, Homo sapiens
cctctcccaccctctt

SEQ ID NO: 6081899 - DNA, 18 bp, Homo sapiens
cctctcccagccctcagc

SEQ ID NO: 6081900 - DNA, 11 bp, Homo sapiens
cctctcccagg

SEQ ID NO: 6081901 - DNA, 13 bp, Homo sapiens
cctctcccaggac

SEQ ID NO: 6081902 - DNA, 18 bp, Homo sapiens
cctctcccaggccccatg

SEQ ID NO: 6081903 - DNA, 15 bp, Homo sapiens
cctctcccaggctgt

SEQ ID NO: 6081904 - DNA, 18 bp, Homo sapiens
cctctcccagtccatttc

SEQ ID NO: 6081905 - DNA, 14 bp, Homo sapiens
cctctcccatcccc

SEQ ID NO: 6081906 - DNA, 16 bp, Homo sapiens
cctctcccatccccct

SEQ ID NO: 6081907 - DNA, 18 bp, Homo sapiens
cctctcccatccccctgc

SEQ ID NO: 6081908 - DNA, 13 bp, Homo sapiens
cctctcccatgca

SEQ ID NO: 6081909 - DNA, 22 bp, Homo sapiens
cctctccccaagacttggtgtc

SEQ ID NO: 6081910 - DNA, 18 bp, Homo sapiens
cctctccccaccttcttg

SEQ ID NO: 6081911 - DNA, 18 bp, Homo sapiens
cctctccccagagcattt

SEQ ID NO: 6081912 - DNA, 20 bp, Homo sapiens
cctctccccagcaagtgaga

SEQ ID NO: 6081913 - DNA, 17 bp, Homo sapiens
cctctccccagcccaga

SEQ ID NO: 6081914 - DNA, 18 bp, Homo sapiens
cctctccccagcccagag

SEQ ID NO: 6081915 - DNA, 20 bp, Homo sapiens
cctctccccagcccagagac

SEQ ID NO: 6081916 - DNA, 14 bp, Homo sapiens
cctctccccagcct

SEQ ID NO: 6081917 - DNA, 16 bp, Homo sapiens
cctctccccagcctgg

SEQ ID NO: 6081918 - DNA, 19 bp, Homo sapiens
cctctccccagcctggcac

SEQ ID NO: 6081919 - DNA, 13 bp, Homo sapiens
cctctccccagga

SEQ ID NO: 6081920 - DNA, 23 bp, Homo sapiens
cctctccccaggtccagctctgg

SEQ ID NO: 6081921 - DNA, 13 bp, Homo sapiens
cctctcccccagg

SEQ ID NO: 6081922 - DNA, 18 bp, Homo sapiens
cctctccccctcctccag

SEQ ID NO: 6081923 - DNA, 20 bp, Homo sapiens
cctctccccctcctccaggg

SEQ ID NO: 6081924 - DNA, 13 bp, Homo sapiens
cctctcccccttc

SEQ ID NO: 6081925 - DNA, 15 bp, Homo sapiens
cctctcccccttcag

SEQ ID NO: 6081926 - DNA, 22 bp, Homo sapiens
cctctcccccttcagctcctga

SEQ ID NO: 6081927 - DNA, 18 bp, Homo sapiens
cctctccccgcagtgttt

SEQ ID NO: 6081928 - DNA, 18 bp, Homo sapiens
cctctcccctctctgctc

SEQ ID NO: 6081929 - DNA, 13 bp, Homo sapiens
cctctcccctgcc

SEQ ID NO: 6081930 - DNA, 20 bp, Homo sapiens
cctctcccctgccccctgca

SEQ ID NO: 6081931 - DNA, 15 bp, Homo sapiens
cctctcccctgcctg

SEQ ID NO: 6081932 - DNA, 11 bp, Homo sapiens
cctctcccctt

SEQ ID NO: 6081933 - DNA, 12 bp, Homo sapiens
cctctcccggct

SEQ ID NO: 6081934 - DNA, 14 bp, Homo sapiens
cctctcccggctgc

SEQ ID NO: 6081935 - DNA, 16 bp, Homo sapiens
cctctcccggctgcct

SEQ ID NO: 6081936 - DNA, 18 bp, Homo sapiens
cctctcccggctgcctgc

SEQ ID NO: 6081937 - DNA, 23 bp, Homo sapiens
cctctcccgtcagggcccaagtc

SEQ ID NO: 6081938 - DNA, 13 bp, Homo sapiens
cctctccctcagg

SEQ ID NO: 6081939 - DNA, 14 bp, Homo sapiens
cctctccctcctca

SEQ ID NO: 6081940 - DNA, 18 bp, Homo sapiens
cctctccctcctccagga

SEQ ID NO: 6081941 - DNA, 14 bp, Homo sapiens
cctctccctcctgg

SEQ ID NO: 6081942 - DNA, 15 bp, Homo sapiens
cctctccctctctct

SEQ ID NO: 6081943 - DNA, 15 bp, Homo sapiens
cctctccctgaccct

SEQ ID NO: 6081944 - DNA, 12 bp, Homo sapiens
cctctccctgca

SEQ ID NO: 6081945 - DNA, 16 bp, Homo sapiens
cctctccctgcatggc

SEQ ID NO: 6081946 - DNA, 16 bp, Homo sapiens
cctctccctgcctgtg

SEQ ID NO: 6081947 - DNA, 16 bp, Homo sapiens
cccgaggcagcaacag

SEQ ID NO: 6081948 - DNA, 14 bp, Homo sapiens
cccgaggccagggc

SEQ ID NO: 6081949 - DNA, 18 bp, Homo sapiens
cccgaggcccccctctgc

SEQ ID NO: 6081950 - DNA, 12 bp, Homo sapiens
cccgaggcccgc

SEQ ID NO: 6081951 - DNA, 13 bp, Homo sapiens
cccgaggcccgca

SEQ ID NO: 6081952 - DNA, 19 bp, Homo sapiens
cccgaggccgcgtgcgtga

SEQ ID NO: 6081953 - DNA, 19 bp, Homo sapiens
cccgaggctgcccactatg

SEQ ID NO: 6081954 - DNA, 21 bp, Homo sapiens
cccgaggctgccccaggccgg

SEQ ID NO: 6081955 - DNA, 15 bp, Homo sapiens
cccgaggctgctaga

SEQ ID NO: 6081956 - DNA, 16 bp, Homo sapiens
cccgaggctgggacac

SEQ ID NO: 6081957 - DNA, 15 bp, Homo sapiens
cccgagggagctgct

SEQ ID NO: 6081958 - DNA, 18 bp, Homo sapiens
cccgagggagctgctggc

SEQ ID NO: 6081959 - DNA, 13 bp, Homo sapiens
cccgagggcagcc

SEQ ID NO: 6081960 - DNA, 21 bp, Homo sapiens
cccgagggcagccccctccct

SEQ ID NO: 6081961 - DNA, 16 bp, Homo sapiens
cccgagggcgaaggcc

SEQ ID NO: 6081962 - DNA, 17 bp, Homo sapiens
cccgagggctgaggagc

SEQ ID NO: 6081963 - DNA, 19 bp, Homo sapiens
cccgagggctgaggagcag

SEQ ID NO: 6081964 - DNA, 21 bp, Homo sapiens
cccgagggctgaggagcagcc

SEQ ID NO: 6081965 - DNA, 23 bp, Homo sapiens
cccgagggctgaggagcagccag

SEQ ID NO: 6081966 - DNA, 20 bp, Homo sapiens
cccgaggggccggggaagct

SEQ ID NO: 6081967 - DNA, 16 bp, Homo sapiens
cccgagggtggtttac

SEQ ID NO: 6081968 - DNA, 23 bp, Homo sapiens
cccgagggtggtttacctgcacc

SEQ ID NO: 6081969 - DNA, 18 bp, Homo sapiens
cccgaggttgtggggagg

SEQ ID NO: 6081970 - DNA, 15 bp, Homo sapiens
cccgagtagctggga

SEQ ID NO: 6081971 - DNA, 21 bp, Homo sapiens
cccgagtcattcgttctgtgg

SEQ ID NO: 6081972 - DNA, 23 bp, Homo sapiens
cccgagtcattcgttctgtggag

SEQ ID NO: 6081973 - DNA, 14 bp, Homo sapiens
cccgagtcctcagg

SEQ ID NO: 6081974 - DNA, 14 bp, Homo sapiens
cccgagtctccggg

SEQ ID NO: 6081975 - DNA, 15 bp, Homo sapiens
cccgagtgactctgg

SEQ ID NO: 6081976 - DNA, 21 bp, Homo sapiens
cccgagtgaggacgcaccgcc

SEQ ID NO: 6081977 - DNA, 18 bp, Homo sapiens
cccgagtgcggcgtggag

SEQ ID NO: 6081978 - DNA, 17 bp, Homo sapiens
cccgagttcctctgggt

SEQ ID NO: 6081979 - DNA, 13 bp, Homo sapiens
cccgatctttcta

SEQ ID NO: 6081980 - DNA, 17 bp, Homo sapiens
cccgatgattcttaaca

SEQ ID NO: 6081981 - DNA, 17 bp, Homo sapiens
cccgatgcgtggctccc

SEQ ID NO: 6081982 - DNA, 13 bp, Homo sapiens
cccgatggactcc

SEQ ID NO: 6081983 - DNA, 20 bp, Homo sapiens
cccgatggtctctctccctc

SEQ ID NO: 6081984 - DNA, 15 bp, Homo sapiens
cccgatgtcccctgc

SEQ ID NO: 6081985 - DNA, 16 bp, Homo sapiens
cccgatgtcccctgcg

SEQ ID NO: 6081986 - DNA, 20 bp, Homo sapiens
cccgcaagagggacagagcc

SEQ ID NO: 6081987 - DNA, 22 bp, Homo sapiens
cccgcaaggcctctcagaccca

SEQ ID NO: 6081988 - DNA, 22 bp, Homo sapiens
cccgcaatgtgcccccagacgc

SEQ ID NO: 6081989 - DNA, 21 bp, Homo sapiens
cccgcacaccctcactctgcc

SEQ ID NO: 6081990 - DNA, 19 bp, Homo sapiens
cccgcacagagctggggct

SEQ ID NO: 6081991 - DNA, 15 bp, Homo sapiens
cccgcacagccaccc

SEQ ID NO: 6081992 - DNA, 15 bp, Homo sapiens
cccgcaccaagcaga

SEQ ID NO: 6081993 - DNA, 15 bp, Homo sapiens
cccgcaccccagtgc

SEQ ID NO: 6081994 - DNA, 17 bp, Homo sapiens
cccgcacccccaccctt

SEQ ID NO: 6081995 - DNA, 13 bp, Homo sapiens
cccgcacccccgc

SEQ ID NO: 6081996 - DNA, 17 bp, Homo sapiens
cccgcacccccgccagg

SEQ ID NO: 6081997 - DNA, 19 bp, Homo sapiens
cccgcacccccgccaggcg

SEQ ID NO: 6081998 - DNA, 18 bp, Homo sapiens
cccgcaccccggcctcag

SEQ ID NO: 6081999 - DNA, 19 bp, Homo sapiens
cccgcaccccggcctcagg

SEQ ID NO: 6082000 - DNA, 17 bp, Homo sapiens
cccgcacccctcctcct

SEQ ID NO: 6082001 - DNA, 15 bp, Homo sapiens
cccgcaccctggcct

SEQ ID NO: 6082002 - DNA, 13 bp, Homo sapiens
cccgcaccttcct

SEQ ID NO: 6082003 - DNA, 18 bp, Homo sapiens
cccgcaccttcctcctcc

SEQ ID NO: 6082004 - DNA, 20 bp, Homo sapiens
cccgcactcaggagcacagc

SEQ ID NO: 6082005 - DNA, 12 bp, Homo sapiens
cccgcactgcag

SEQ ID NO: 6082006 - DNA, 15 bp, Homo sapiens
cccgcagacaccttg

SEQ ID NO: 6082007 - DNA, 22 bp, Homo sapiens
cccgcagacggtctgtgtgctg

SEQ ID NO: 6082008 - DNA, 22 bp, Homo sapiens
cccgcagagcgcgcccctagcc

SEQ ID NO: 6082009 - DNA, 21 bp, Homo sapiens
cccgcagcaccagcctgagcc

SEQ ID NO: 6082010 - DNA, 16 bp, Homo sapiens
cccgcagccctctcca

SEQ ID NO: 6082011 - DNA, 13 bp, Homo sapiens
cccgcagccctgg

SEQ ID NO: 6082012 - DNA, 20 bp, Homo sapiens
cccgcagcctggcatctgtg

SEQ ID NO: 6082013 - DNA, 17 bp, Homo sapiens
cccgcaggatccctcct

SEQ ID NO: 6082014 - DNA, 18 bp, Homo sapiens
cccgcaggcctgccttct

SEQ ID NO: 6082015 - DNA, 15 bp, Homo sapiens
cccgcagggccatgc

SEQ ID NO: 6082016 - DNA, 22 bp, Homo sapiens
cccgcaggtaccccagctctgc

SEQ ID NO: 6082017 - DNA, 23 bp, Homo sapiens
cccgcaggttatgtcagcagctc

SEQ ID NO: 6082018 - DNA, 22 bp, Homo sapiens
cccgcagtcgtcccaggctgcc

SEQ ID NO: 6082019 - DNA, 15 bp, Homo sapiens
cccgcagtgctggga

SEQ ID NO: 6082020 - DNA, 24 bp, Homo sapiens
cccgcagtgctgggaccagagcca

SEQ ID NO: 6082021 - DNA, 16 bp, Homo sapiens
cccgcatcccctgcct

SEQ ID NO: 6082022 - DNA, 17 bp, Homo sapiens
cccgcatcccctgcctc

SEQ ID NO: 6082023 - DNA, 18 bp, Homo sapiens
cccgcatcccctgcctcc

SEQ ID NO: 6082024 - DNA, 16 bp, Homo sapiens
cccgcatgcagcagct

SEQ ID NO: 6082025 - DNA, 19 bp, Homo sapiens
cccgcatgcagcagcttgc

SEQ ID NO: 6082026 - DNA, 15 bp, Homo sapiens
cccgcatgctgcctg

SEQ ID NO: 6082027 - DNA, 16 bp, Homo sapiens
cccgcatgctgcctgc

SEQ ID NO: 6082028 - DNA, 21 bp, Homo sapiens
cccgcatgtacaaaaacacaa

SEQ ID NO: 6082029 - DNA, 15 bp, Homo sapiens
cccgcattccaggct

SEQ ID NO: 6082030 - DNA, 17 bp, Homo sapiens
cccgccaccctgtctca

SEQ ID NO: 6082031 - DNA, 23 bp, Homo sapiens
cccgccacctatctcgtgggaga

SEQ ID NO: 6082032 - DNA, 19 bp, Homo sapiens
cccgccacggccaccctcc

SEQ ID NO: 6082033 - DNA, 18 bp, Homo sapiens
cccgccactcgccttctt

SEQ ID NO: 6082034 - DNA, 13 bp, Homo sapiens
cccgccagccagt

SEQ ID NO: 6082035 - DNA, 12 bp, Homo sapiens
cccgccagcccc

SEQ ID NO: 6082036 - DNA, 22 bp, Homo sapiens
cccgccagcctacactgccagc

SEQ ID NO: 6082037 - DNA, 13 bp, Homo sapiens
cccgccagcctca

SEQ ID NO: 6082038 - DNA, 15 bp, Homo sapiens
cccgccagcctcagt

SEQ ID NO: 6082039 - DNA, 18 bp, Homo sapiens
cccgccaggagcttcttc

SEQ ID NO: 6082040 - DNA, 11 bp, Homo sapiens
cccgccagggc

SEQ ID NO: 6082041 - DNA, 15 bp, Homo sapiens
cccgccagggctggg

SEQ ID NO: 6082042 - DNA, 11 bp, Homo sapiens
cccgccaggtc

SEQ ID NO: 6082043 - DNA, 13 bp, Homo sapiens
cccgcccaaggct

SEQ ID NO: 6082044 - DNA, 11 bp, Homo sapiens
cccgcccacac

SEQ ID NO: 6082045 - DNA, 16 bp, Homo sapiens
cccgcccacctctgct

SEQ ID NO: 6082046 - DNA, 12 bp, Homo sapiens
cccgcccacctg

SEQ ID NO: 6082047 - DNA, 13 bp, Homo sapiens
cccgcccacctgg

SEQ ID NO: 6082048 - DNA, 18 bp, Homo sapiens
cccgcccactgtcctggg

SEQ ID NO: 6082049 - DNA, 20 bp, Homo sapiens
cccgcccagccccaggtctc

SEQ ID NO: 6082050 - DNA, 18 bp, Homo sapiens
cccgcccaggctggccag

SEQ ID NO: 6082051 - DNA, 20 bp, Homo sapiens
cccgcccaggctggccagcc

SEQ ID NO: 6082052 - DNA, 22 bp, Homo sapiens
cccgcccaggctggccagcccc

SEQ ID NO: 6082053 - DNA, 19 bp, Homo sapiens
cccgccccacattccgaca

SEQ ID NO: 6082054 - DNA, 16 bp, Homo sapiens
cccgccccaccccgtc

SEQ ID NO: 6082055 - DNA, 14 bp, Homo sapiens
cccgccccacctcc

SEQ ID NO: 6082056 - DNA, 15 bp, Homo sapiens
cccgccccagagact

SEQ ID NO: 6082057 - DNA, 20 bp, Homo sapiens
cccgccccagagactgccca

SEQ ID NO: 6082058 - DNA, 13 bp, Homo sapiens
cccgccccagagc

SEQ ID NO: 6082059 - DNA, 14 bp, Homo sapiens
cccgccccagagct

SEQ ID NO: 6082060 - DNA, 11 bp, Homo sapiens
cccgccccagg

SEQ ID NO: 6082061 - DNA, 15 bp, Homo sapiens
cccgccccaggcccc

SEQ ID NO: 6082062 - DNA, 14 bp, Homo sapiens
cccgccccaggctt

SEQ ID NO: 6082063 - DNA, 15 bp, Homo sapiens
cccgccccaggcttc

SEQ ID NO: 6082064 - DNA, 14 bp, Homo sapiens
cccgccccagggtc

SEQ ID NO: 6082065 - DNA, 17 bp, Homo sapiens
cccgcccccacccctac

SEQ ID NO: 6082066 - DNA, 20 bp, Homo sapiens
cccgccccccacacttccct

SEQ ID NO: 6082067 - DNA, 19 bp, Homo sapiens
cccgccccctccctgctcc

SEQ ID NO: 6082068 - DNA, 20 bp, Homo sapiens
cccgccccctcggcccctca

SEQ ID NO: 6082069 - DNA, 22 bp, Homo sapiens
cccgccccctcggcccctcacc

SEQ ID NO: 6082070 - DNA, 17 bp, Homo sapiens
cccgccccctgccctcc

SEQ ID NO: 6082071 - DNA, 13 bp, Homo sapiens
cccgccccgcccc

SEQ ID NO: 6082072 - DNA, 16 bp, Homo sapiens
cccgccccgctgctcc

SEQ ID NO: 6082073 - DNA, 16 bp, Homo sapiens
cccgccccgggctggc

SEQ ID NO: 6082074 - DNA, 21 bp, Homo sapiens
cccgccccgttgtgagctgga

SEQ ID NO: 6082075 - DNA, 16 bp, Homo sapiens
cccgcccctcgcccgc

SEQ ID NO: 6082076 - DNA, 17 bp, Homo sapiens
cccgcccctgcagcacg

SEQ ID NO: 6082077 - DNA, 23 bp, Homo sapiens
cccgcccctgcatgcctggcccc

SEQ ID NO: 6082078 - DNA, 23 bp, Homo sapiens
cccgcccctgggctaccatctgc

SEQ ID NO: 6082079 - DNA, 15 bp, Homo sapiens
cccgcccctgtggcc

SEQ ID NO: 6082080 - DNA, 18 bp, Homo sapiens
cccgcccgagcccctgcc

SEQ ID NO: 6082081 - DNA, 19 bp, Homo sapiens
cccgcccgtagatcatccc

SEQ ID NO: 6082082 - DNA, 13 bp, Homo sapiens
cccgccctcaggg

SEQ ID NO: 6082083 - DNA, 15 bp, Homo sapiens
cccgccctccccctg

SEQ ID NO: 6082084 - DNA, 15 bp, Homo sapiens
cccgccctcctctgc

SEQ ID NO: 6082085 - DNA, 15 bp, Homo sapiens
cccgccctctctcat

SEQ ID NO: 6082086 - DNA, 22 bp, Homo sapiens
cccgccgccctggacagatggc

SEQ ID NO: 6082087 - DNA, 16 bp, Homo sapiens
cccgccgcctcccacg

SEQ ID NO: 6082088 - DNA, 18 bp, Homo sapiens
cccgccgcctcgggccgc

SEQ ID NO: 6082089 - DNA, 20 bp, Homo sapiens
cccgccgcttttctcctctt

SEQ ID NO: 6082090 - DNA, 15 bp, Homo sapiens
cccgccggaggccag

SEQ ID NO: 6082091 - DNA, 23 bp, Homo sapiens
cccgccggcaggggcccctcctc

SEQ ID NO: 6082092 - DNA, 23 bp, Homo sapiens
cccgccggttggccggctggccg

SEQ ID NO: 6082093 - DNA, 16 bp, Homo sapiens
cccgccgtctgcaggg

SEQ ID NO: 6082094 - DNA, 20 bp, Homo sapiens
cccgccgtctgcaggggcct

SEQ ID NO: 6082095 - DNA, 23 bp, Homo sapiens
cccgccgtctgcaggggcctgga

SEQ ID NO: 6082096 - DNA, 15 bp, Homo sapiens
cccgccgtgcctgca

SEQ ID NO: 6082097 - DNA, 16 bp, Homo sapiens
cccgccgtgcctgcat

SEQ ID NO: 6082098 - DNA, 12 bp, Homo sapiens
cccgcctcagcc

SEQ ID NO: 6082099 - DNA, 18 bp, Homo sapiens
cccgcctcagcctcctga

SEQ ID NO: 6082100 - DNA, 15 bp, Homo sapiens
cccgcctcctccctg

SEQ ID NO: 6082101 - DNA, 16 bp, Homo sapiens
cccgcctcctccctgc

SEQ ID NO: 6082102 - DNA, 19 bp, Homo sapiens
cccgcctcctccctgcctg

SEQ ID NO: 6082103 - DNA, 13 bp, Homo sapiens
cccgcctctcccg

SEQ ID NO: 6082104 - DNA, 21 bp, Homo sapiens
cccgcctctcccgtcagggcc

SEQ ID NO: 6082105 - DNA, 16 bp, Homo sapiens
cccgcctgagctcctg

SEQ ID NO: 6082106 - DNA, 13 bp, Homo sapiens
cccgcctgccacc

SEQ ID NO: 6082107 - DNA, 13 bp, Homo sapiens
cccgcctgccagt

SEQ ID NO: 6082108 - DNA, 15 bp, Homo sapiens
cccgcctgcccacct

SEQ ID NO: 6082109 - DNA, 16 bp, Homo sapiens
cccgcctgcccacctg

SEQ ID NO: 6082110 - DNA, 20 bp, Homo sapiens
cccgcctgcccacctgcctg

SEQ ID NO: 6082111 - DNA, 16 bp, Homo sapiens
cccgcctgcccagact

SEQ ID NO: 6082112 - DNA, 21 bp, Homo sapiens
cccgcctgcccagactgatga

SEQ ID NO: 6082113 - DNA, 18 bp, Homo sapiens
cccgcctgccgtgcatgg

SEQ ID NO: 6082114 - DNA, 15 bp, Homo sapiens
cccgcctgcctcctg

SEQ ID NO: 6082115 - DNA, 17 bp, Homo sapiens
cccgcctgcctcctggc

SEQ ID NO: 6082116 - DNA, 14 bp, Homo sapiens
cccgcctgctccca

SEQ ID NO: 6082117 - DNA, 23 bp, Homo sapiens
cccgcctgctcccatcctcaccc

SEQ ID NO: 6082118 - DNA, 22 bp, Homo sapiens
cccgcctggcagaactgagctc

SEQ ID NO: 6082119 - DNA, 16 bp, Homo sapiens
cccgcctggccaggag

SEQ ID NO: 6082120 - DNA, 16 bp, Homo sapiens
cccgcctggccagggc

SEQ ID NO: 6082121 - DNA, 21 bp, Homo sapiens
cccgcctggccagggcagggc

SEQ ID NO: 6082122 - DNA, 20 bp, Homo sapiens
cccgcctgggcaccgggacc

SEQ ID NO: 6082123 - DNA, 15 bp, Homo sapiens
cccgccttagagcct

SEQ ID NO: 6082124 - DNA, 12 bp, Homo sapiens
cccgccttccaa

SEQ ID NO: 6082125 - DNA, 23 bp, Homo sapiens
cccgccttccgccccttcccttc

SEQ ID NO: 6082126 - DNA, 23 bp, Homo sapiens
cccgccttcctcctccacagtgc

SEQ ID NO: 6082127 - DNA, 17 bp, Homo sapiens
cctctccctgctgctcc

SEQ ID NO: 6082128 - DNA, 13 bp, Homo sapiens
cctctccctggcc

SEQ ID NO: 6082129 - DNA, 17 bp, Homo sapiens
cctctcccttaccctgg

SEQ ID NO: 6082130 - DNA, 20 bp, Homo sapiens
cctctcccttgggctctgat

SEQ ID NO: 6082131 - DNA, 22 bp, Homo sapiens
cctctcccttgggctctgatga

SEQ ID NO: 6082132 - DNA, 22 bp, Homo sapiens
cctctccgcacacctctggctg

SEQ ID NO: 6082133 - DNA, 18 bp, Homo sapiens
cctctccgcccctgagcc

SEQ ID NO: 6082134 - DNA, 15 bp, Homo sapiens
cctctccggcctggc

SEQ ID NO: 6082135 - DNA, 15 bp, Homo sapiens
cctctcctactcact

SEQ ID NO: 6082136 - DNA, 15 bp, Homo sapiens
cctctcctagccctc

SEQ ID NO: 6082137 - DNA, 15 bp, Homo sapiens
cctctcctcaatgct

SEQ ID NO: 6082138 - DNA, 20 bp, Homo sapiens
cctctcctcaatgctgggcc

SEQ ID NO: 6082139 - DNA, 18 bp, Homo sapiens
cctctcctcatgttctgc

SEQ ID NO: 6082140 - DNA, 12 bp, Homo sapiens
cctctcctccca

SEQ ID NO: 6082141 - DNA, 16 bp, Homo sapiens
cctctcctccccttcc

SEQ ID NO: 6082142 - DNA, 19 bp, Homo sapiens
cctctcctccccttcctgt

SEQ ID NO: 6082143 - DNA, 13 bp, Homo sapiens
cctctcctccgtg

SEQ ID NO: 6082144 - DNA, 19 bp, Homo sapiens
cctctcctccgtggcacat

SEQ ID NO: 6082145 - DNA, 15 bp, Homo sapiens
cctctcctcctcagc

SEQ ID NO: 6082146 - DNA, 16 bp, Homo sapiens
cctctcctccttgggc

SEQ ID NO: 6082147 - DNA, 17 bp, Homo sapiens
cctctcctctcccccag

SEQ ID NO: 6082148 - DNA, 11 bp, Homo sapiens
cctctcctctg

SEQ ID NO: 6082149 - DNA, 13 bp, Homo sapiens
cctctcctgaagc

SEQ ID NO: 6082150 - DNA, 13 bp, Homo sapiens
cctctcctgaccc

SEQ ID NO: 6082151 - DNA, 16 bp, Homo sapiens
cctctcctgagcctgt

SEQ ID NO: 6082152 - DNA, 11 bp, Homo sapiens
cctctcctgcc

SEQ ID NO: 6082153 - DNA, 22 bp, Homo sapiens
cctctcctgccctctgctctgc

SEQ ID NO: 6082154 - DNA, 16 bp, Homo sapiens
cctctcctgccctgtg

SEQ ID NO: 6082155 - DNA, 13 bp, Homo sapiens
cctctcctgcttc

SEQ ID NO: 6082156 - DNA, 13 bp, Homo sapiens
cctctcctggact

SEQ ID NO: 6082157 - DNA, 15 bp, Homo sapiens
cctctcctggaggat

SEQ ID NO: 6082158 - DNA, 22 bp, Homo sapiens
cctctcctggagggcgcccagc

SEQ ID NO: 6082159 - DNA, 14 bp, Homo sapiens
cctctcctgggcag

SEQ ID NO: 6082160 - DNA, 17 bp, Homo sapiens
cctctcctgggcagctg

SEQ ID NO: 6082161 - DNA, 12 bp, Homo sapiens
cctctcctgggg

SEQ ID NO: 6082162 - DNA, 18 bp, Homo sapiens
cctctccttcccacaaaa

SEQ ID NO: 6082163 - DNA, 13 bp, Homo sapiens
cctctccttcctc

SEQ ID NO: 6082164 - DNA, 15 bp, Homo sapiens
cctctccttccttgt

SEQ ID NO: 6082165 - DNA, 16 bp, Homo sapiens
cctctccttccttgtt

SEQ ID NO: 6082166 - DNA, 11 bp, Homo sapiens
cctctccttct

SEQ ID NO: 6082167 - DNA, 15 bp, Homo sapiens
cctctccttctccta

SEQ ID NO: 6082168 - DNA, 20 bp, Homo sapiens
cctctccttgcccccagtgc

SEQ ID NO: 6082169 - DNA, 22 bp, Homo sapiens
cctctccttgggctcctggctg

SEQ ID NO: 6082170 - DNA, 23 bp, Homo sapiens
cctctccttgggctcctggctgc

SEQ ID NO: 6082171 - DNA, 21 bp, Homo sapiens
cctctccttgtggcctgggcc

SEQ ID NO: 6082172 - DNA, 14 bp, Homo sapiens
cctctcctttgaaa

SEQ ID NO: 6082173 - DNA, 14 bp, Homo sapiens
cctctcctttgtat

SEQ ID NO: 6082174 - DNA, 15 bp, Homo sapiens
cctctcctttgtata

SEQ ID NO: 6082175 - DNA, 22 bp, Homo sapiens
cctctcctttgtatattatttc

SEQ ID NO: 6082176 - DNA, 17 bp, Homo sapiens
cctctcgacggcacgca

SEQ ID NO: 6082177 - DNA, 15 bp, Homo sapiens
cctctcgagcccaga

SEQ ID NO: 6082178 - DNA, 18 bp, Homo sapiens
cctctcgccatgatcaga

SEQ ID NO: 6082179 - DNA, 16 bp, Homo sapiens
cctctcgccccatccc

SEQ ID NO: 6082180 - DNA, 22 bp, Homo sapiens
cctctcgccccatccctgcttg

SEQ ID NO: 6082181 - DNA, 18 bp, Homo sapiens
cctctcgccctggccagg

SEQ ID NO: 6082182 - DNA, 20 bp, Homo sapiens
cctctcgccctggccagggc

SEQ ID NO: 6082183 - DNA, 12 bp, Homo sapiens
cctctcgcctca

SEQ ID NO: 6082184 - DNA, 15 bp, Homo sapiens
cctctcgcctcatta

SEQ ID NO: 6082185 - DNA, 16 bp, Homo sapiens
cctctcgcgcccagca

SEQ ID NO: 6082186 - DNA, 14 bp, Homo sapiens
cctctcgcggccct

SEQ ID NO: 6082187 - DNA, 15 bp, Homo sapiens
cctctcggccaggca

SEQ ID NO: 6082188 - DNA, 15 bp, Homo sapiens
cctctcggccccatc

SEQ ID NO: 6082189 - DNA, 16 bp, Homo sapiens
cctctcggctggaaga

SEQ ID NO: 6082190 - DNA, 16 bp, Homo sapiens
cctctcggtgacctcc

SEQ ID NO: 6082191 - DNA, 17 bp, Homo sapiens
cctctcggtgacctccg

SEQ ID NO: 6082192 - DNA, 21 bp, Homo sapiens
cctctcggtgacctccgtcct

SEQ ID NO: 6082193 - DNA, 18 bp, Homo sapiens
cctctcggtgctccatct

SEQ ID NO: 6082194 - DNA, 22 bp, Homo sapiens
cctctcgtaagatttccttctt

SEQ ID NO: 6082195 - DNA, 20 bp, Homo sapiens
cctctcgtagaacctgcgca

SEQ ID NO: 6082196 - DNA, 19 bp, Homo sapiens
cctctctaacctcctttac

SEQ ID NO: 6082197 - DNA, 20 bp, Homo sapiens
cctctctaacctcctttacc

SEQ ID NO: 6082198 - DNA, 16 bp, Homo sapiens
cctctctaccccccac

SEQ ID NO: 6082199 - DNA, 16 bp, Homo sapiens
cctctctacttcccct

SEQ ID NO: 6082200 - DNA, 21 bp, Homo sapiens
cctctctacttccccttcttg

SEQ ID NO: 6082201 - DNA, 14 bp, Homo sapiens
cctctctagaacct

SEQ ID NO: 6082202 - DNA, 13 bp, Homo sapiens
cctctctagggac

SEQ ID NO: 6082203 - DNA, 18 bp, Homo sapiens
cctctctagggacccctc

SEQ ID NO: 6082204 - DNA, 17 bp, Homo sapiens
cctctctcaccagcctt

SEQ ID NO: 6082205 - DNA, 13 bp, Homo sapiens
cctctctcactcc

SEQ ID NO: 6082206 - DNA, 24 bp, Homo sapiens
cctctctcagagcatctggctgtt

SEQ ID NO: 6082207 - DNA, 18 bp, Homo sapiens
cctctctcagcacagcct

SEQ ID NO: 6082208 - DNA, 21 bp, Homo sapiens
cctctctcagcacagcctggg

SEQ ID NO: 6082209 - DNA, 15 bp, Homo sapiens
cctctctcagcccca

SEQ ID NO: 6082210 - DNA, 18 bp, Homo sapiens
cctctctcaggagcaggg

SEQ ID NO: 6082211 - DNA, 14 bp, Homo sapiens
cctctctcaggcca

SEQ ID NO: 6082212 - DNA, 22 bp, Homo sapiens
cctctctcatatcactgaagga

SEQ ID NO: 6082213 - DNA, 14 bp, Homo sapiens
cctctctcatggct

SEQ ID NO: 6082214 - DNA, 21 bp, Homo sapiens
cctctctccactaccccgact

SEQ ID NO: 6082215 - DNA, 16 bp, Homo sapiens
cctctctccaggcccc

SEQ ID NO: 6082216 - DNA, 18 bp, Homo sapiens
cctctctcccctctgcaa

SEQ ID NO: 6082217 - DNA, 12 bp, Homo sapiens
cctctctccctc

SEQ ID NO: 6082218 - DNA, 14 bp, Homo sapiens
cctctctccctgcc

SEQ ID NO: 6082219 - DNA, 20 bp, Homo sapiens
cctctctccctgcctcacat

SEQ ID NO: 6082220 - DNA, 15 bp, Homo sapiens
cctctctcctctccg

SEQ ID NO: 6082221 - DNA, 19 bp, Homo sapiens
cctctctcctgcctgccct

SEQ ID NO: 6082222 - DNA, 17 bp, Homo sapiens
cctctctcctggactgg

SEQ ID NO: 6082223 - DNA, 18 bp, Homo sapiens
cctctctcctggactggt

SEQ ID NO: 6082224 - DNA, 21 bp, Homo sapiens
cctctctcctggactggttat

SEQ ID NO: 6082225 - DNA, 14 bp, Homo sapiens
cctctctccttctg

SEQ ID NO: 6082226 - DNA, 18 bp, Homo sapiens
cctctctccttggccaca

SEQ ID NO: 6082227 - DNA, 16 bp, Homo sapiens
cctctctcggccccct

SEQ ID NO: 6082228 - DNA, 15 bp, Homo sapiens
cctctctctcactcc

SEQ ID NO: 6082229 - DNA, 16 bp, Homo sapiens
cctctctctcactccc

SEQ ID NO: 6082230 - DNA, 16 bp, Homo sapiens
cctctctctccctcca

SEQ ID NO: 6082231 - DNA, 19 bp, Homo sapiens
cctctctctccctccctct

SEQ ID NO: 6082232 - DNA, 13 bp, Homo sapiens
cctctctctctct

SEQ ID NO: 6082233 - DNA, 21 bp, Homo sapiens
cctctctctctctctctctgt

SEQ ID NO: 6082234 - DNA, 22 bp, Homo sapiens
cctctctctctctctctctgtt

SEQ ID NO: 6082235 - DNA, 17 bp, Homo sapiens
cctctctctgactctca

SEQ ID NO: 6082236 - DNA, 16 bp, Homo sapiens
cctctctctgaggaca

SEQ ID NO: 6082237 - DNA, 14 bp, Homo sapiens
cctctctctgcctg

SEQ ID NO: 6082238 - DNA, 15 bp, Homo sapiens
cctctctctgcctga

SEQ ID NO: 6082239 - DNA, 12 bp, Homo sapiens
cctctctctgct

SEQ ID NO: 6082240 - DNA, 10 bp, Homo sapiens
cctctctctt

SEQ ID NO: 6082241 - DNA, 16 bp, Homo sapiens
cctctctcttcccagc

SEQ ID NO: 6082242 - DNA, 19 bp, Homo sapiens
cctctctcttctgctccac

SEQ ID NO: 6082243 - DNA, 12 bp, Homo sapiens
cctctctctttt

SEQ ID NO: 6082244 - DNA, 13 bp, Homo sapiens
cctctctcttttc

SEQ ID NO: 6082245 - DNA, 20 bp, Homo sapiens
cctctctgaaggaggccacc

SEQ ID NO: 6082246 - DNA, 23 bp, Homo sapiens
cctctctgaaggaggccacctcc

SEQ ID NO: 6082247 - DNA, 19 bp, Homo sapiens
cctctctgagactggcaga

SEQ ID NO: 6082248 - DNA, 13 bp, Homo sapiens
cctctctgagtca

SEQ ID NO: 6082249 - DNA, 21 bp, Homo sapiens
cctctctgatcttgtgctcag

SEQ ID NO: 6082250 - DNA, 19 bp, Homo sapiens
cctctctgatgtcccagtg

SEQ ID NO: 6082251 - DNA, 21 bp, Homo sapiens
cctctctgcagacttcccagc

SEQ ID NO: 6082252 - DNA, 16 bp, Homo sapiens
cctctctgcaggtccc

SEQ ID NO: 6082253 - DNA, 18 bp, Homo sapiens
cctctctgcaggtcccta

SEQ ID NO: 6082254 - DNA, 12 bp, Homo sapiens
cctctctgcagt

SEQ ID NO: 6082255 - DNA, 15 bp, Homo sapiens
cctctctgcagtcct

SEQ ID NO: 6082256 - DNA, 16 bp, Homo sapiens
cctctctgccaccacc

SEQ ID NO: 6082257 - DNA, 13 bp, Homo sapiens
cctctctgccagc

SEQ ID NO: 6082258 - DNA, 15 bp, Homo sapiens
cctctctgcccctga

SEQ ID NO: 6082259 - DNA, 12 bp, Homo sapiens
cctctctgccct

SEQ ID NO: 6082260 - DNA, 13 bp, Homo sapiens
cctctctgcccta

SEQ ID NO: 6082261 - DNA, 22 bp, Homo sapiens
cctctctgccgcaatacaggaa

SEQ ID NO: 6082262 - DNA, 14 bp, Homo sapiens
cctctctgcctctc

SEQ ID NO: 6082263 - DNA, 12 bp, Homo sapiens
cctctctgctct

SEQ ID NO: 6082264 - DNA, 23 bp, Homo sapiens
cctctctggaaggttttgcttct

SEQ ID NO: 6082265 - DNA, 18 bp, Homo sapiens
cctctctggacctcagtt

SEQ ID NO: 6082266 - DNA, 19 bp, Homo sapiens
cctctctggacctcagttt

SEQ ID NO: 6082267 - DNA, 13 bp, Homo sapiens
cctctctggagaa

SEQ ID NO: 6082268 - DNA, 22 bp, Homo sapiens
cctctctggagaaagggccctg

SEQ ID NO: 6082269 - DNA, 23 bp, Homo sapiens
cctctctggagaaagggccctgg

SEQ ID NO: 6082270 - DNA, 21 bp, Homo sapiens
cctctctggccactctgctct

SEQ ID NO: 6082271 - DNA, 17 bp, Homo sapiens
cctctctggcctcccac

SEQ ID NO: 6082272 - DNA, 12 bp, Homo sapiens
cctctctggctg

SEQ ID NO: 6082273 - DNA, 13 bp, Homo sapiens
cctctctgggacc

SEQ ID NO: 6082274 - DNA, 12 bp, Homo sapiens
cctctctgggcc

SEQ ID NO: 6082275 - DNA, 15 bp, Homo sapiens
cctctctgggggagg

SEQ ID NO: 6082276 - DNA, 10 bp, Homo sapiens
cctctctggt

SEQ ID NO: 6082277 - DNA, 16 bp, Homo sapiens
cctctctggtggctgg

SEQ ID NO: 6082278 - DNA, 19 bp, Homo sapiens
cctctctggtggctgggct

SEQ ID NO: 6082279 - DNA, 23 bp, Homo sapiens
cctctctggtggctgggctgctc

SEQ ID NO: 6082280 - DNA, 17 bp, Homo sapiens
cctctctgtcccttgct

SEQ ID NO: 6082281 - DNA, 17 bp, Homo sapiens
cctctctgtctgtctct

SEQ ID NO: 6082282 - DNA, 18 bp, Homo sapiens
cctctctgtctttttcct

SEQ ID NO: 6082283 - DNA, 15 bp, Homo sapiens
cctctctgtggctcc

SEQ ID NO: 6082284 - DNA, 18 bp, Homo sapiens
cctctctgtggctccaac

SEQ ID NO: 6082285 - DNA, 18 bp, Homo sapiens
cctctctgtttaccctcc

SEQ ID NO: 6082286 - DNA, 21 bp, Homo sapiens
cctctctgtttaccctccctg

SEQ ID NO: 6082287 - DNA, 19 bp, Homo sapiens
cctctcttaatgccacggc

SEQ ID NO: 6082288 - DNA, 13 bp, Homo sapiens
cctctcttcactg

SEQ ID NO: 6082289 - DNA, 15 bp, Homo sapiens
cctctcttcactgct

SEQ ID NO: 6082290 - DNA, 15 bp, Homo sapiens
cctctcttccacagt

SEQ ID NO: 6082291 - DNA, 17 bp, Homo sapiens
cctctcttccacagtgg

SEQ ID NO: 6082292 - DNA, 13 bp, Homo sapiens
cctctcttcccct

SEQ ID NO: 6082293 - DNA, 16 bp, Homo sapiens
cctctcttccgggagc

SEQ ID NO: 6082294 - DNA, 20 bp, Homo sapiens
cctctcttccgggagctggt

SEQ ID NO: 6082295 - DNA, 11 bp, Homo sapiens
cctctcttcct

SEQ ID NO: 6082296 - DNA, 14 bp, Homo sapiens
cctctcttcctatc

SEQ ID NO: 6082297 - DNA, 23 bp, Homo sapiens
cctctcttcctatcccatcccat

SEQ ID NO: 6082298 - DNA, 20 bp, Homo sapiens
cctctcttctctattcctga

SEQ ID NO: 6082299 - DNA, 13 bp, Homo sapiens
cctctcttgcacc

SEQ ID NO: 6082300 - DNA, 14 bp, Homo sapiens
cctctcttgcaccc

SEQ ID NO: 6082301 - DNA, 14 bp, Homo sapiens
cctctcttgccaaa

SEQ ID NO: 6082302 - DNA, 23 bp, Homo sapiens
cctctcttgccaaaaagcacaag

SEQ ID NO: 6082303 - DNA, 20 bp, Homo sapiens
cctctcttggctctactcca

SEQ ID NO: 6082304 - DNA, 24 bp, Homo sapiens
cctctctttcaattgcagatgcca

SEQ ID NO: 6082305 - DNA, 13 bp, Homo sapiens
cctctctttctaa

SEQ ID NO: 6082306 - DNA, 13 bp, Homo sapiens
cctctctttgagt

SEQ ID NO: 6082307 - DNA, 21 bp, Homo sapiens
cctctctttgttctcagctcc

SEQ ID NO: 6082308 - DNA, 22 bp, Homo sapiens
cctctctttgttctcagctccc

SEQ ID NO: 6082309 - DNA, 14 bp, Homo sapiens
cccgccttcctggg

SEQ ID NO: 6082310 - DNA, 20 bp, Homo sapiens
cccgcctttagttctccact

SEQ ID NO: 6082311 - DNA, 16 bp, Homo sapiens
cccgccttttccccca

SEQ ID NO: 6082312 - DNA, 19 bp, Homo sapiens
cccgcgaagtccgaggcct

SEQ ID NO: 6082313 - DNA, 19 bp, Homo sapiens
cccgcgaccacccctgtgc

SEQ ID NO: 6082314 - DNA, 22 bp, Homo sapiens
cccgcgatgtggaactgctgcc

SEQ ID NO: 6082315 - DNA, 13 bp, Homo sapiens
cccgcgcacccca

SEQ ID NO: 6082316 - DNA, 18 bp, Homo sapiens
cccgcgcccccaccccag

SEQ ID NO: 6082317 - DNA, 22 bp, Homo sapiens
cccgcgcccgccgcctccctca

SEQ ID NO: 6082318 - DNA, 14 bp, Homo sapiens
cccgcgccctccct

SEQ ID NO: 6082319 - DNA, 16 bp, Homo sapiens
cccgcgctcaggaggt

SEQ ID NO: 6082320 - DNA, 16 bp, Homo sapiens
cccgcgctcgcccagc

SEQ ID NO: 6082321 - DNA, 14 bp, Homo sapiens
cccgcgctctttct

SEQ ID NO: 6082322 - DNA, 21 bp, Homo sapiens
cccgcgcttcgaactccaggc

SEQ ID NO: 6082323 - DNA, 13 bp, Homo sapiens
cccgcggagcccc

SEQ ID NO: 6082324 - DNA, 16 bp, Homo sapiens
cccgcggagcccccgc

SEQ ID NO: 6082325 - DNA, 21 bp, Homo sapiens
cccgcggagcccccgcccctc

SEQ ID NO: 6082326 - DNA, 22 bp, Homo sapiens
cccgcggagcccccgcccctcc

SEQ ID NO: 6082327 - DNA, 21 bp, Homo sapiens
cccgcggatcaaccaggcaga

SEQ ID NO: 6082328 - DNA, 13 bp, Homo sapiens
cccgcggcctgca

SEQ ID NO: 6082329 - DNA, 12 bp, Homo sapiens
cccgcggcctgg

SEQ ID NO: 6082330 - DNA, 19 bp, Homo sapiens
cccgcggcgcgaccctccc

SEQ ID NO: 6082331 - DNA, 21 bp, Homo sapiens
cccgcgggagacagcttctct

SEQ ID NO: 6082332 - DNA, 20 bp, Homo sapiens
cccgcgggcacagccagccc

SEQ ID NO: 6082333 - DNA, 14 bp, Homo sapiens
cccgcgggcctgga

SEQ ID NO: 6082334 - DNA, 16 bp, Homo sapiens
cccgcggtgctctggc

SEQ ID NO: 6082335 - DNA, 17 bp, Homo sapiens
cccgcggtgctgactga

SEQ ID NO: 6082336 - DNA, 14 bp, Homo sapiens
cccgcgtagtgtca

SEQ ID NO: 6082337 - DNA, 21 bp, Homo sapiens
cccgcgtccaaccccggggca

SEQ ID NO: 6082338 - DNA, 21 bp, Homo sapiens
cccgcgtgtccccggggccca

SEQ ID NO: 6082339 - DNA, 17 bp, Homo sapiens
cccgcgttcaagacttg

SEQ ID NO: 6082340 - DNA, 23 bp, Homo sapiens
cccgctaagagggagggagggct

SEQ ID NO: 6082341 - DNA, 19 bp, Homo sapiens
cccgctacaattctgcaga

SEQ ID NO: 6082342 - DNA, 21 bp, Homo sapiens
cccgctaggctcgccttccct

SEQ ID NO: 6082343 - DNA, 14 bp, Homo sapiens
cccgctcagccctc

SEQ ID NO: 6082344 - DNA, 19 bp, Homo sapiens
cccgctcaggggcctggag

SEQ ID NO: 6082345 - DNA, 18 bp, Homo sapiens
cccgctccatggaaaagc

SEQ ID NO: 6082346 - DNA, 23 bp, Homo sapiens
cccgctcccagtgtcttcctgtg

SEQ ID NO: 6082347 - DNA, 16 bp, Homo sapiens
cccgctccgtctctgt

SEQ ID NO: 6082348 - DNA, 21 bp, Homo sapiens
cccgctccgtctctgtcctcg

SEQ ID NO: 6082349 - DNA, 20 bp, Homo sapiens
cccgctcctcccctcttgag

SEQ ID NO: 6082350 - DNA, 16 bp, Homo sapiens
cccgctcctgccgcag

SEQ ID NO: 6082351 - DNA, 11 bp, Homo sapiens
cccgctctccc

SEQ ID NO: 6082352 - DNA, 13 bp, Homo sapiens
cccgctctgcatg

SEQ ID NO: 6082353 - DNA, 22 bp, Homo sapiens
cccgctctgcatgcggcccagc

SEQ ID NO: 6082354 - DNA, 11 bp, Homo sapiens
cccgctctgga

SEQ ID NO: 6082355 - DNA, 14 bp, Homo sapiens
cccgctgagcccac

SEQ ID NO: 6082356 - DNA, 23 bp, Homo sapiens
cccgctgagcccactctactgcc

SEQ ID NO: 6082357 - DNA, 21 bp, Homo sapiens
cccgctgagctgagtggccag

SEQ ID NO: 6082358 - DNA, 18 bp, Homo sapiens
cccgctgagcttggagga

SEQ ID NO: 6082359 - DNA, 21 bp, Homo sapiens
cccgctgagcttggaggaagt

SEQ ID NO: 6082360 - DNA, 20 bp, Homo sapiens
cccgctgatggagccccacc

SEQ ID NO: 6082361 - DNA, 19 bp, Homo sapiens
cccgctgcaatgcctagac

SEQ ID NO: 6082362 - DNA, 20 bp, Homo sapiens
cccgctgcaatgcctagact

SEQ ID NO: 6082363 - DNA, 21 bp, Homo sapiens
cccgctgcagcctctgcctct

SEQ ID NO: 6082364 - DNA, 23 bp, Homo sapiens
cccgctgccctttggccaacagg

SEQ ID NO: 6082365 - DNA, 13 bp, Homo sapiens
cccgctgcctcct

SEQ ID NO: 6082366 - DNA, 15 bp, Homo sapiens
cccgctgcctcctgc

SEQ ID NO: 6082367 - DNA, 16 bp, Homo sapiens
cccgctgcctcctgct

SEQ ID NO: 6082368 - DNA, 13 bp, Homo sapiens
cccgctgcctctt

SEQ ID NO: 6082369 - DNA, 14 bp, Homo sapiens
cccgctgcctcttg

SEQ ID NO: 6082370 - DNA, 15 bp, Homo sapiens
cccgctgcctggcgg

SEQ ID NO: 6082371 - DNA, 19 bp, Homo sapiens
cccgctgcctggcgggcag

SEQ ID NO: 6082372 - DNA, 17 bp, Homo sapiens
cccgctgcgctgccctg

SEQ ID NO: 6082373 - DNA, 17 bp, Homo sapiens
cccgctgctcccggtgt

SEQ ID NO: 6082374 - DNA, 18 bp, Homo sapiens
cccgctgctcccggtgtg

SEQ ID NO: 6082375 - DNA, 16 bp, Homo sapiens
cccgctgctgctgctg

SEQ ID NO: 6082376 - DNA, 15 bp, Homo sapiens
cccgctgctgtgctc

SEQ ID NO: 6082377 - DNA, 14 bp, Homo sapiens
cccgctggagccca

SEQ ID NO: 6082378 - DNA, 17 bp, Homo sapiens
cccgctggagcccacag

SEQ ID NO: 6082379 - DNA, 14 bp, Homo sapiens
cccgctggcagcca

SEQ ID NO: 6082380 - DNA, 21 bp, Homo sapiens
cccgctggcagccaccccctc

SEQ ID NO: 6082381 - DNA, 14 bp, Homo sapiens
cccgctggctcctc

SEQ ID NO: 6082382 - DNA, 18 bp, Homo sapiens
cccgctggctcctccagg

SEQ ID NO: 6082383 - DNA, 15 bp, Homo sapiens
cccgctgggctgagc

SEQ ID NO: 6082384 - DNA, 21 bp, Homo sapiens
cccgctgggctgagcccctac

SEQ ID NO: 6082385 - DNA, 19 bp, Homo sapiens
cccgctgtcagccattcct

SEQ ID NO: 6082386 - DNA, 20 bp, Homo sapiens
cccgctgtcagccattcctg

SEQ ID NO: 6082387 - DNA, 16 bp, Homo sapiens
cccgctgtgtcctccc

SEQ ID NO: 6082388 - DNA, 17 bp, Homo sapiens
cccgctgtgtcctccct

SEQ ID NO: 6082389 - DNA, 17 bp, Homo sapiens
cccgcttagccccgctg

SEQ ID NO: 6082390 - DNA, 12 bp, Homo sapiens
cccgcttagcct

SEQ ID NO: 6082391 - DNA, 22 bp, Homo sapiens
cccgcttagcgctctggacaga

SEQ ID NO: 6082392 - DNA, 17 bp, Homo sapiens
cccgcttattctcctcc

SEQ ID NO: 6082393 - DNA, 22 bp, Homo sapiens
cccgcttattctcctccctgtt

SEQ ID NO: 6082394 - DNA, 16 bp, Homo sapiens
cccgcttcaagctctc

SEQ ID NO: 6082395 - DNA, 17 bp, Homo sapiens
cccgcttccccttgcca

SEQ ID NO: 6082396 - DNA, 15 bp, Homo sapiens
cccgcttcctccggc

SEQ ID NO: 6082397 - DNA, 16 bp, Homo sapiens
cccgcttcctggcctc

SEQ ID NO: 6082398 - DNA, 15 bp, Homo sapiens
cccgcttgcctcggc

SEQ ID NO: 6082399 - DNA, 21 bp, Homo sapiens
cccgcttgctcgcttgctgga

SEQ ID NO: 6082400 - DNA, 22 bp, Homo sapiens
cccgcttgctcgcttgctggaa

SEQ ID NO: 6082401 - DNA, 14 bp, Homo sapiens
cccgcttgctctcc

SEQ ID NO: 6082402 - DNA, 18 bp, Homo sapiens
cccgcttgctctcctgga

SEQ ID NO: 6082403 - DNA, 14 bp, Homo sapiens
cccgcttggccacc

SEQ ID NO: 6082404 - DNA, 15 bp, Homo sapiens
cccgcttgtccagcg

SEQ ID NO: 6082405 - DNA, 20 bp, Homo sapiens
cccgctttcttgctggttgt

SEQ ID NO: 6082406 - DNA, 20 bp, Homo sapiens
cccgctttgcctgcttgaag

SEQ ID NO: 6082407 - DNA, 17 bp, Homo sapiens
cccgcttttgcagcaga

SEQ ID NO: 6082408 - DNA, 14 bp, Homo sapiens
cccggaagaaccag

SEQ ID NO: 6082409 - DNA, 23 bp, Homo sapiens
cccggaagccaaacctctgtgag

SEQ ID NO: 6082410 - DNA, 16 bp, Homo sapiens
cccggaagggctttgg

SEQ ID NO: 6082411 - DNA, 17 bp, Homo sapiens
cccggacaagcccagga

SEQ ID NO: 6082412 - DNA, 13 bp, Homo sapiens
cccggacactcgc

SEQ ID NO: 6082413 - DNA, 22 bp, Homo sapiens
cccggacaggtggggcctcagc

SEQ ID NO: 6082414 - DNA, 23 bp, Homo sapiens
cccggacaggtggggcctcagcc

SEQ ID NO: 6082415 - DNA, 14 bp, Homo sapiens
cccggacctacctc

SEQ ID NO: 6082416 - DNA, 23 bp, Homo sapiens
cccggacctacctccctccctct

SEQ ID NO: 6082417 - DNA, 11 bp, Homo sapiens
cccggacggcg

SEQ ID NO: 6082418 - DNA, 14 bp, Homo sapiens
cccggacgggggag

SEQ ID NO: 6082419 - DNA, 13 bp, Homo sapiens
cccggactgacca

SEQ ID NO: 6082420 - DNA, 13 bp, Homo sapiens
cccggagaaggcc

SEQ ID NO: 6082421 - DNA, 18 bp, Homo sapiens
cccggagaaggccgctgc

SEQ ID NO: 6082422 - DNA, 21 bp, Homo sapiens
cccggagaaggccgctgcccc

SEQ ID NO: 6082423 - DNA, 21 bp, Homo sapiens
cccggagaggtggccgccatg

SEQ ID NO: 6082424 - DNA, 19 bp, Homo sapiens
cccggagattggacggcct

SEQ ID NO: 6082425 - DNA, 14 bp, Homo sapiens
cccggagcaagcag

SEQ ID NO: 6082426 - DNA, 18 bp, Homo sapiens
cccggagcacagccctgg

SEQ ID NO: 6082427 - DNA, 22 bp, Homo sapiens
cccggagcacagccctgggagg

SEQ ID NO: 6082428 - DNA, 20 bp, Homo sapiens
cccggagctaacactggccc

SEQ ID NO: 6082429 - DNA, 21 bp, Homo sapiens
cccggagctaacactggcccc

SEQ ID NO: 6082430 - DNA, 14 bp, Homo sapiens
cccggagctccggc

SEQ ID NO: 6082431 - DNA, 15 bp, Homo sapiens
cccggaggaaatctg

SEQ ID NO: 6082432 - DNA, 16 bp, Homo sapiens
cccggaggaaatctgc

SEQ ID NO: 6082433 - DNA, 22 bp, Homo sapiens
cccggaggaaatctgcagaggg

SEQ ID NO: 6082434 - DNA, 21 bp, Homo sapiens
cccggaggccgaggccatgtg

SEQ ID NO: 6082435 - DNA, 23 bp, Homo sapiens
cccggaggcgcccacctgcccag

SEQ ID NO: 6082436 - DNA, 17 bp, Homo sapiens
cccggagggaaactgtg

SEQ ID NO: 6082437 - DNA, 18 bp, Homo sapiens
cccggaggttgggtgggc

SEQ ID NO: 6082438 - DNA, 15 bp, Homo sapiens
cccggatcagagcag

SEQ ID NO: 6082439 - DNA, 12 bp, Homo sapiens
cccggatccagg

SEQ ID NO: 6082440 - DNA, 16 bp, Homo sapiens
cccggatctccaggcc

SEQ ID NO: 6082441 - DNA, 17 bp, Homo sapiens
cccggatctccaggccc

SEQ ID NO: 6082442 - DNA, 22 bp, Homo sapiens
cccggatctccaggcccagcct

SEQ ID NO: 6082443 - DNA, 22 bp, Homo sapiens
cccggatgcagaggcctgcagg

SEQ ID NO: 6082444 - DNA, 14 bp, Homo sapiens
cccggattctggga

SEQ ID NO: 6082445 - DNA, 17 bp, Homo sapiens
cccggattggccctgcc

SEQ ID NO: 6082446 - DNA, 22 bp, Homo sapiens
cccggattggccctgcccctcc

SEQ ID NO: 6082447 - DNA, 22 bp, Homo sapiens
cccggcaagcgcttctgctgaa

SEQ ID NO: 6082448 - DNA, 13 bp, Homo sapiens
cccggcaccccct

SEQ ID NO: 6082449 - DNA, 16 bp, Homo sapiens
cccggcaccccctgca

SEQ ID NO: 6082450 - DNA, 19 bp, Homo sapiens
cccggcaccccctgcagct

SEQ ID NO: 6082451 - DNA, 17 bp, Homo sapiens
cccggcaccctctggcc

SEQ ID NO: 6082452 - DNA, 20 bp, Homo sapiens
cccggcactgcagtctgcag

SEQ ID NO: 6082453 - DNA, 22 bp, Homo sapiens
cccggcagccccccagtgtccc

SEQ ID NO: 6082454 - DNA, 16 bp, Homo sapiens
cccggcagccccttct

SEQ ID NO: 6082455 - DNA, 20 bp, Homo sapiens
cccggcagcgaggctgggct

SEQ ID NO: 6082456 - DNA, 15 bp, Homo sapiens
cccggcaggccctgc

SEQ ID NO: 6082457 - DNA, 16 bp, Homo sapiens
cccggcaggccctgca

SEQ ID NO: 6082458 - DNA, 17 bp, Homo sapiens
cccggcaggccctgcag

SEQ ID NO: 6082459 - DNA, 19 bp, Homo sapiens
cccggcaggccctgcagtg

SEQ ID NO: 6082460 - DNA, 13 bp, Homo sapiens
cccggcaggcctg

SEQ ID NO: 6082461 - DNA, 15 bp, Homo sapiens
cccggcaggcctgag

SEQ ID NO: 6082462 - DNA, 16 bp, Homo sapiens
cccggcagggtcctag

SEQ ID NO: 6082463 - DNA, 13 bp, Homo sapiens
cccggcagtgcac

SEQ ID NO: 6082464 - DNA, 23 bp, Homo sapiens
cccggcatcatttcccctcccgc

SEQ ID NO: 6082465 - DNA, 23 bp, Homo sapiens
cccggcatgagactcagtgcaga

SEQ ID NO: 6082466 - DNA, 16 bp, Homo sapiens
cccggcatgaggcccc

SEQ ID NO: 6082467 - DNA, 17 bp, Homo sapiens
cccggcattctctgccc

SEQ ID NO: 6082468 - DNA, 21 bp, Homo sapiens
cccggccaaggacccaggcgc

SEQ ID NO: 6082469 - DNA, 13 bp, Homo sapiens
cccggccacagct

SEQ ID NO: 6082470 - DNA, 16 bp, Homo sapiens
cccggccacagctgct

SEQ ID NO: 6082471 - DNA, 20 bp, Homo sapiens
cccggccacctctgcggacc

SEQ ID NO: 6082472 - DNA, 13 bp, Homo sapiens
cccggccacctgc

SEQ ID NO: 6082473 - DNA, 19 bp, Homo sapiens
cccggccactccctgccaa

SEQ ID NO: 6082474 - DNA, 11 bp, Homo sapiens
cccggccagcg

SEQ ID NO: 6082475 - DNA, 13 bp, Homo sapiens
cccggccagcggg

SEQ ID NO: 6082476 - DNA, 18 bp, Homo sapiens
cccggccagcgggcacag

SEQ ID NO: 6082477 - DNA, 19 bp, Homo sapiens
cccggccagcgggcacagg

SEQ ID NO: 6082478 - DNA, 15 bp, Homo sapiens
cccggccagctctgg

SEQ ID NO: 6082479 - DNA, 17 bp, Homo sapiens
cccggccagctctggag

SEQ ID NO: 6082480 - DNA, 16 bp, Homo sapiens
cccggccagggcctgg

SEQ ID NO: 6082481 - DNA, 19 bp, Homo sapiens
cccggccatgtccttagca

SEQ ID NO: 6082482 - DNA, 14 bp, Homo sapiens
cccggcccacgcag

SEQ ID NO: 6082483 - DNA, 17 bp, Homo sapiens
cccggcccacgcagagc

SEQ ID NO: 6082484 - DNA, 18 bp, Homo sapiens
cccggcccacgcagagcc

SEQ ID NO: 6082485 - DNA, 21 bp, Homo sapiens
cccggccccacctccctgcgc

SEQ ID NO: 6082486 - DNA, 15 bp, Homo sapiens
cccggccccagccag

SEQ ID NO: 6082487 - DNA, 17 bp, Homo sapiens
cctctcttttcctctct

SEQ ID NO: 6082488 - DNA, 17 bp, Homo sapiens
cctctgaaaatattttt

SEQ ID NO: 6082489 - DNA, 23 bp, Homo sapiens
cctctgaaaatatttttttctag

SEQ ID NO: 6082490 - DNA, 13 bp, Homo sapiens
cctctgaaacagc

SEQ ID NO: 6082491 - DNA, 18 bp, Homo sapiens
cctctgaaacagctgcct

SEQ ID NO: 6082492 - DNA, 19 bp, Homo sapiens
cctctgaaacagctgcctt

SEQ ID NO: 6082493 - DNA, 17 bp, Homo sapiens
cctctgaaagttgtaca

SEQ ID NO: 6082494 - DNA, 21 bp, Homo sapiens
cctctgaaatttcccacaccc

SEQ ID NO: 6082495 - DNA, 18 bp, Homo sapiens
cctctgaactgctgctgg

SEQ ID NO: 6082496 - DNA, 17 bp, Homo sapiens
cctctgaatgtcccaga

SEQ ID NO: 6082497 - DNA, 20 bp, Homo sapiens
cctctgaatgtcccagaggc

SEQ ID NO: 6082498 - DNA, 19 bp, Homo sapiens
cctctgacacacagctctg

SEQ ID NO: 6082499 - DNA, 12 bp, Homo sapiens
cctctgacagca

SEQ ID NO: 6082500 - DNA, 14 bp, Homo sapiens
cctctgacagcagc

SEQ ID NO: 6082501 - DNA, 17 bp, Homo sapiens
cctctgacagcagcctg

SEQ ID NO: 6082502 - DNA, 18 bp, Homo sapiens
cctctgacagtccacagg

SEQ ID NO: 6082503 - DNA, 19 bp, Homo sapiens
cctctgacagtccacaggg

SEQ ID NO: 6082504 - DNA, 17 bp, Homo sapiens
cctctgacatcaagtgt

SEQ ID NO: 6082505 - DNA, 13 bp, Homo sapiens
cctctgaccaaca

SEQ ID NO: 6082506 - DNA, 18 bp, Homo sapiens
cctctgaccaacaggctg

SEQ ID NO: 6082507 - DNA, 14 bp, Homo sapiens
cctctgacccctcc

SEQ ID NO: 6082508 - DNA, 20 bp, Homo sapiens
cctctgacccctcctcactg

SEQ ID NO: 6082509 - DNA, 22 bp, Homo sapiens
cctctgaccctagctctttcct

SEQ ID NO: 6082510 - DNA, 12 bp, Homo sapiens
cctctgactcag

SEQ ID NO: 6082511 - DNA, 19 bp, Homo sapiens
cctctgactcagggctcct

SEQ ID NO: 6082512 - DNA, 22 bp, Homo sapiens
cctctgactcagggctcctggg

SEQ ID NO: 6082513 - DNA, 14 bp, Homo sapiens
cctctgactccact

SEQ ID NO: 6082514 - DNA, 14 bp, Homo sapiens
cctctgactcccaa

SEQ ID NO: 6082515 - DNA, 24 bp, Homo sapiens
cctctgactctgagtccactgctc

SEQ ID NO: 6082516 - DNA, 11 bp, Homo sapiens
cctctgagaag

SEQ ID NO: 6082517 - DNA, 17 bp, Homo sapiens
cctctgagacagagagc

SEQ ID NO: 6082518 - DNA, 11 bp, Homo sapiens
cctctgagacc

SEQ ID NO: 6082519 - DNA, 13 bp, Homo sapiens
cctctgagatgct

SEQ ID NO: 6082520 - DNA, 14 bp, Homo sapiens
cctctgagatgcta

SEQ ID NO: 6082521 - DNA, 20 bp, Homo sapiens
cctctgagatgctaatttat

SEQ ID NO: 6082522 - DNA, 23 bp, Homo sapiens
cctctgagcacatagtgtcctgc

SEQ ID NO: 6082523 - DNA, 16 bp, Homo sapiens
cctctgagccactgga

SEQ ID NO: 6082524 - DNA, 14 bp, Homo sapiens
cctctgagccagga

SEQ ID NO: 6082525 - DNA, 16 bp, Homo sapiens
cctctgagccaggagc

SEQ ID NO: 6082526 - DNA, 18 bp, Homo sapiens
cctctgagccaggagcct

SEQ ID NO: 6082527 - DNA, 22 bp, Homo sapiens
cctctgagcccagctgcctgga

SEQ ID NO: 6082528 - DNA, 11 bp, Homo sapiens
cctctgagcct

SEQ ID NO: 6082529 - DNA, 15 bp, Homo sapiens
cctctgagctttgca

SEQ ID NO: 6082530 - DNA, 21 bp, Homo sapiens
cctctgaggaagcagttgggg

SEQ ID NO: 6082531 - DNA, 21 bp, Homo sapiens
cctctgaggacagaggccggg

SEQ ID NO: 6082532 - DNA, 12 bp, Homo sapiens
cctctgaggcca

SEQ ID NO: 6082533 - DNA, 14 bp, Homo sapiens
cctctgaggccagc

SEQ ID NO: 6082534 - DNA, 15 bp, Homo sapiens
cctctgaggccagcc

SEQ ID NO: 6082535 - DNA, 17 bp, Homo sapiens
cctctgaggccagcctg

SEQ ID NO: 6082536 - DNA, 18 bp, Homo sapiens
cctctgaggccagcctgg

SEQ ID NO: 6082537 - DNA, 20 bp, Homo sapiens
cctctgaggccagcctggcc

SEQ ID NO: 6082538 - DNA, 21 bp, Homo sapiens
cctctgaggccagcctggcct

SEQ ID NO: 6082539 - DNA, 16 bp, Homo sapiens
cctctgaggctcagcc

SEQ ID NO: 6082540 - DNA, 19 bp, Homo sapiens
cctctgaggctcagccctg

SEQ ID NO: 6082541 - DNA, 22 bp, Homo sapiens
cctctgaggctcagccctgagc

SEQ ID NO: 6082542 - DNA, 18 bp, Homo sapiens
cctctgaggctggatcct

SEQ ID NO: 6082543 - DNA, 21 bp, Homo sapiens
cctctgatcaaagcaccttga

SEQ ID NO: 6082544 - DNA, 21 bp, Homo sapiens
cctctgatcaaattggctaca

SEQ ID NO: 6082545 - DNA, 16 bp, Homo sapiens
cctctgattctatgta

SEQ ID NO: 6082546 - DNA, 22 bp, Homo sapiens
cctctgattctatgtaacttgt

SEQ ID NO: 6082547 - DNA, 15 bp, Homo sapiens
cctctgattgttccc

SEQ ID NO: 6082548 - DNA, 14 bp, Homo sapiens
cctctgatttcaca

SEQ ID NO: 6082549 - DNA, 16 bp, Homo sapiens
cctctgcaactgctca

SEQ ID NO: 6082550 - DNA, 21 bp, Homo sapiens
cctctgcaagcttcttgctga

SEQ ID NO: 6082551 - DNA, 20 bp, Homo sapiens
cctctgcacaccctccagag

SEQ ID NO: 6082552 - DNA, 17 bp, Homo sapiens
cctctgcacccagaaca

SEQ ID NO: 6082553 - DNA, 23 bp, Homo sapiens
cctctgcacgctcaatgcccagt

SEQ ID NO: 6082554 - DNA, 19 bp, Homo sapiens
cctctgcacgtgcacacac

SEQ ID NO: 6082555 - DNA, 24 bp, Homo sapiens
cctctgcacgtgcacacacctgca

SEQ ID NO: 6082556 - DNA, 21 bp, Homo sapiens
cctctgcactactgacatgtg

SEQ ID NO: 6082557 - DNA, 14 bp, Homo sapiens
cctctgcactcccc

SEQ ID NO: 6082558 - DNA, 15 bp, Homo sapiens
cctctgcactcccct

SEQ ID NO: 6082559 - DNA, 16 bp, Homo sapiens
cctctgcactcccctg

SEQ ID NO: 6082560 - DNA, 19 bp, Homo sapiens
cctctgcactcccctgctg

SEQ ID NO: 6082561 - DNA, 22 bp, Homo sapiens
cctctgcactcccctgctgggt

SEQ ID NO: 6082562 - DNA, 14 bp, Homo sapiens
cctctgcagaacag

SEQ ID NO: 6082563 - DNA, 12 bp, Homo sapiens
cctctgcagaag

SEQ ID NO: 6082564 - DNA, 16 bp, Homo sapiens
cctctgcagactcgtt

SEQ ID NO: 6082565 - DNA, 14 bp, Homo sapiens
cctctgcagcaata

SEQ ID NO: 6082566 - DNA, 16 bp, Homo sapiens
cctctgcagcacttta

SEQ ID NO: 6082567 - DNA, 12 bp, Homo sapiens
cctctgcagcct

SEQ ID NO: 6082568 - DNA, 22 bp, Homo sapiens
cctctgcagcctgagctccacc

SEQ ID NO: 6082569 - DNA, 12 bp, Homo sapiens
cctctgcaggac

SEQ ID NO: 6082570 - DNA, 15 bp, Homo sapiens
cctctgcaggacaca

SEQ ID NO: 6082571 - DNA, 17 bp, Homo sapiens
cctctgcaggacacaga

SEQ ID NO: 6082572 - DNA, 17 bp, Homo sapiens
cctctgcagggcagcct

SEQ ID NO: 6082573 - DNA, 17 bp, Homo sapiens
cctctgcagtctctata

SEQ ID NO: 6082574 - DNA, 18 bp, Homo sapiens
cctctgcagtgtggcaag

SEQ ID NO: 6082575 - DNA, 23 bp, Homo sapiens
cctctgcagtgtggcaagcaaga

SEQ ID NO: 6082576 - DNA, 17 bp, Homo sapiens
cctctgcattgacctgg

SEQ ID NO: 6082577 - DNA, 18 bp, Homo sapiens
cctctgcattgacctgga

SEQ ID NO: 6082578 - DNA, 22 bp, Homo sapiens
cctctgccaaaggatgtgatat

SEQ ID NO: 6082579 - DNA, 13 bp, Homo sapiens
cctctgccaccag

SEQ ID NO: 6082580 - DNA, 12 bp, Homo sapiens
cctctgccacct

SEQ ID NO: 6082581 - DNA, 16 bp, Homo sapiens
cctctgccacctcccc

SEQ ID NO: 6082582 - DNA, 14 bp, Homo sapiens
cctctgccagcagg

SEQ ID NO: 6082583 - DNA, 19 bp, Homo sapiens
cctctgccagcaggaataa

SEQ ID NO: 6082584 - DNA, 13 bp, Homo sapiens
cctctgccaggcc

SEQ ID NO: 6082585 - DNA, 19 bp, Homo sapiens
cctctgccagtcgggagag

SEQ ID NO: 6082586 - DNA, 15 bp, Homo sapiens
cctctgccatcctcc

SEQ ID NO: 6082587 - DNA, 18 bp, Homo sapiens
cctctgccatgcccagag

SEQ ID NO: 6082588 - DNA, 11 bp, Homo sapiens
cctctgcccag

SEQ ID NO: 6082589 - DNA, 12 bp, Homo sapiens
cctctgcccagc

SEQ ID NO: 6082590 - DNA, 21 bp, Homo sapiens
cctctgcccagcctgccccag

SEQ ID NO: 6082591 - DNA, 13 bp, Homo sapiens
cctctgcccagct

SEQ ID NO: 6082592 - DNA, 23 bp, Homo sapiens
cctctgcccagcttgggcccagc

SEQ ID NO: 6082593 - DNA, 15 bp, Homo sapiens
cctctgccccaagca

SEQ ID NO: 6082594 - DNA, 20 bp, Homo sapiens
cctctgccccaagcagccag

SEQ ID NO: 6082595 - DNA, 21 bp, Homo sapiens
cctctgccccaagcagccagc

SEQ ID NO: 6082596 - DNA, 23 bp, Homo sapiens
cctctgccccaagcagccagcca

SEQ ID NO: 6082597 - DNA, 14 bp, Homo sapiens
cctctgccccaagg

SEQ ID NO: 6082598 - DNA, 16 bp, Homo sapiens
cctctgccccaagggg

SEQ ID NO: 6082599 - DNA, 16 bp, Homo sapiens
cctctgccccagaaca

SEQ ID NO: 6082600 - DNA, 11 bp, Homo sapiens
cctctgccccc

SEQ ID NO: 6082601 - DNA, 14 bp, Homo sapiens
cctctgccccgtct

SEQ ID NO: 6082602 - DNA, 12 bp, Homo sapiens
cctctgcccctc

SEQ ID NO: 6082603 - DNA, 18 bp, Homo sapiens
cctctgcccctcccccag

SEQ ID NO: 6082604 - DNA, 20 bp, Homo sapiens
cctctgcccctcccccagcc

SEQ ID NO: 6082605 - DNA, 21 bp, Homo sapiens
cctctgcccctcttccctggc

SEQ ID NO: 6082606 - DNA, 13 bp, Homo sapiens
cctctgcccctgc

SEQ ID NO: 6082607 - DNA, 14 bp, Homo sapiens
cctctgcccctgca

SEQ ID NO: 6082608 - DNA, 20 bp, Homo sapiens
cctctgccccttgggcctcc

SEQ ID NO: 6082609 - DNA, 22 bp, Homo sapiens
cctctgccccttgggcctccca

SEQ ID NO: 6082610 - DNA, 23 bp, Homo sapiens
cctctgccccttgggcctcccac

SEQ ID NO: 6082611 - DNA, 18 bp, Homo sapiens
cctctgcccgcagagccc

SEQ ID NO: 6082612 - DNA, 14 bp, Homo sapiens
cctctgccctctgc

SEQ ID NO: 6082613 - DNA, 17 bp, Homo sapiens
cctctgccctctgctct

SEQ ID NO: 6082614 - DNA, 18 bp, Homo sapiens
cctctgccctctgctcta

SEQ ID NO: 6082615 - DNA, 17 bp, Homo sapiens
cctctgccctgcctccc

SEQ ID NO: 6082616 - DNA, 18 bp, Homo sapiens
cctctgccctgcctccct

SEQ ID NO: 6082617 - DNA, 12 bp, Homo sapiens
cctctgccctgg

SEQ ID NO: 6082618 - DNA, 13 bp, Homo sapiens
cctctgccctgga

SEQ ID NO: 6082619 - DNA, 15 bp, Homo sapiens
cctctgcccttcctg

SEQ ID NO: 6082620 - DNA, 14 bp, Homo sapiens
cctctgcccttggg

SEQ ID NO: 6082621 - DNA, 22 bp, Homo sapiens
cctctgccgaccgcctgcttca

SEQ ID NO: 6082622 - DNA, 12 bp, Homo sapiens
cctctgccggct

SEQ ID NO: 6082623 - DNA, 20 bp, Homo sapiens
cctctgccggtcgggcagcc

SEQ ID NO: 6082624 - DNA, 20 bp, Homo sapiens
cctctgcctacccacgtgcc

SEQ ID NO: 6082625 - DNA, 12 bp, Homo sapiens
cctctgcctcaa

SEQ ID NO: 6082626 - DNA, 16 bp, Homo sapiens
cctctgcctccaccct

SEQ ID NO: 6082627 - DNA, 18 bp, Homo sapiens
cctctgcctccaggaggg

SEQ ID NO: 6082628 - DNA, 22 bp, Homo sapiens
cctctgcctccaggagggcatc

SEQ ID NO: 6082629 - DNA, 18 bp, Homo sapiens
cctctgcctcctccccag

SEQ ID NO: 6082630 - DNA, 14 bp, Homo sapiens
cctctgcctcctgg

SEQ ID NO: 6082631 - DNA, 16 bp, Homo sapiens
cctctgcctcctgggt

SEQ ID NO: 6082632 - DNA, 17 bp, Homo sapiens
cctctgcctctagtccc

SEQ ID NO: 6082633 - DNA, 23 bp, Homo sapiens
cctctgcctctgacacacagctc

SEQ ID NO: 6082634 - DNA, 10 bp, Homo sapiens
cctctgcctg

SEQ ID NO: 6082635 - DNA, 21 bp, Homo sapiens
cctctgcctgaagtcacacag

SEQ ID NO: 6082636 - DNA, 16 bp, Homo sapiens
cctctgcctgacagca

SEQ ID NO: 6082637 - DNA, 18 bp, Homo sapiens
cctctgcctgcactccct

SEQ ID NO: 6082638 - DNA, 20 bp, Homo sapiens
cctctgcctgcactccctgg

SEQ ID NO: 6082639 - DNA, 21 bp, Homo sapiens
cctctgcctgcactccctggc

SEQ ID NO: 6082640 - DNA, 13 bp, Homo sapiens
cctctgcctgccc

SEQ ID NO: 6082641 - DNA, 16 bp, Homo sapiens
cctctgcctgccccgc

SEQ ID NO: 6082642 - DNA, 12 bp, Homo sapiens
cctctgcctgct

SEQ ID NO: 6082643 - DNA, 13 bp, Homo sapiens
cctctgcctggga

SEQ ID NO: 6082644 - DNA, 15 bp, Homo sapiens
cctctgcctgggatg

SEQ ID NO: 6082645 - DNA, 16 bp, Homo sapiens
cctctgcctgggatgc

SEQ ID NO: 6082646 - DNA, 13 bp, Homo sapiens
cctctgcctgggc

SEQ ID NO: 6082647 - DNA, 14 bp, Homo sapiens
cctctgcctgggct

SEQ ID NO: 6082648 - DNA, 15 bp, Homo sapiens
cctctgcctgtccct

SEQ ID NO: 6082649 - DNA, 16 bp, Homo sapiens
cctctgcctgtccctc

SEQ ID NO: 6082650 - DNA, 19 bp, Homo sapiens
cctctgcctgtccctctca

SEQ ID NO: 6082651 - DNA, 15 bp, Homo sapiens
cctctgcctgtctcc

SEQ ID NO: 6082652 - DNA, 20 bp, Homo sapiens
cctctgcctgtgcacggcca

SEQ ID NO: 6082653 - DNA, 15 bp, Homo sapiens
cctctgcctgtgccc

SEQ ID NO: 6082654 - DNA, 14 bp, Homo sapiens
cctctgccttcagg

SEQ ID NO: 6082655 - DNA, 19 bp, Homo sapiens
cctctgccttcaggcttct

SEQ ID NO: 6082656 - DNA, 16 bp, Homo sapiens
cctctgccttgccctc

SEQ ID NO: 6082657 - DNA, 12 bp, Homo sapiens
cctctgccttgg

SEQ ID NO: 6082658 - DNA, 13 bp, Homo sapiens
cctctgccttgga

SEQ ID NO: 6082659 - DNA, 14 bp, Homo sapiens
cctctgccttggac

SEQ ID NO: 6082660 - DNA, 15 bp, Homo sapiens
cctctgccttggaca

SEQ ID NO: 6082661 - DNA, 14 bp, Homo sapiens
cctctgcctttgag

SEQ ID NO: 6082662 - DNA, 21 bp, Homo sapiens
cctctgcctttgagcttctcc

SEQ ID NO: 6082663 - DNA, 17 bp, Homo sapiens
cctctgcgccccagcga

SEQ ID NO: 6082664 - DNA, 20 bp, Homo sapiens
cctctgcggaccccagctgt

SEQ ID NO: 6082665 - DNA, 21 bp, Homo sapiens
cctctgcgtcccccagccctc

SEQ ID NO: 6082666 - DNA, 14 bp, Homo sapiens
cctctgctaaattg

SEQ ID NO: 6082667 - DNA, 11 bp, Homo sapiens
cctctgctacg

SEQ ID NO: 6082668 - DNA, 19 bp, Homo sapiens
cccggcccccggccaagga

SEQ ID NO: 6082669 - DNA, 12 bp, Homo sapiens
cccggccccctg

SEQ ID NO: 6082670 - DNA, 13 bp, Homo sapiens
cccggccccctgg

SEQ ID NO: 6082671 - DNA, 21 bp, Homo sapiens
cccggccccctggtctctggt

SEQ ID NO: 6082672 - DNA, 13 bp, Homo sapiens
cccggccccgcgc

SEQ ID NO: 6082673 - DNA, 20 bp, Homo sapiens
cccggccccgcgcgtgcccc

SEQ ID NO: 6082674 - DNA, 18 bp, Homo sapiens
cccggccccggccccagc

SEQ ID NO: 6082675 - DNA, 13 bp, Homo sapiens
cccggcccctcac

SEQ ID NO: 6082676 - DNA, 17 bp, Homo sapiens
cccggcccctcaccctc

SEQ ID NO: 6082677 - DNA, 22 bp, Homo sapiens
cccggccctaccagcgcccgct

SEQ ID NO: 6082678 - DNA, 20 bp, Homo sapiens
cccggccgccccgccccaga

SEQ ID NO: 6082679 - DNA, 17 bp, Homo sapiens
cccggccgctccaccag

SEQ ID NO: 6082680 - DNA, 21 bp, Homo sapiens
cccggccggagaacatctgcc

SEQ ID NO: 6082681 - DNA, 22 bp, Homo sapiens
cccggccggccacccaggaggc

SEQ ID NO: 6082682 - DNA, 16 bp, Homo sapiens
cccggcctaggcacct

SEQ ID NO: 6082683 - DNA, 12 bp, Homo sapiens
cccggcctcagg

SEQ ID NO: 6082684 - DNA, 15 bp, Homo sapiens
cccggcctccaggct

SEQ ID NO: 6082685 - DNA, 23 bp, Homo sapiens
cccggcctcctcggagagcagca

SEQ ID NO: 6082686 - DNA, 13 bp, Homo sapiens
cccggcctctctg

SEQ ID NO: 6082687 - DNA, 11 bp, Homo sapiens
cccggcctctt

SEQ ID NO: 6082688 - DNA, 19 bp, Homo sapiens
cccggcctcttccacccat

SEQ ID NO: 6082689 - DNA, 12 bp, Homo sapiens
cccggcctgatg

SEQ ID NO: 6082690 - DNA, 16 bp, Homo sapiens
cccggcctgatggcca

SEQ ID NO: 6082691 - DNA, 19 bp, Homo sapiens
cccggcctgatggccaggc

SEQ ID NO: 6082692 - DNA, 21 bp, Homo sapiens
cccggcctgctcccagcagcc

SEQ ID NO: 6082693 - DNA, 17 bp, Homo sapiens
cccggcctggatgccag

SEQ ID NO: 6082694 - DNA, 13 bp, Homo sapiens
cccggcctggccc

SEQ ID NO: 6082695 - DNA, 19 bp, Homo sapiens
cccggcgccctctgtcctg

SEQ ID NO: 6082696 - DNA, 15 bp, Homo sapiens
cccggcgccgggcac

SEQ ID NO: 6082697 - DNA, 15 bp, Homo sapiens
cccggcgcctgccct

SEQ ID NO: 6082698 - DNA, 23 bp, Homo sapiens
cccggcgcctgccctgcccaagt

SEQ ID NO: 6082699 - DNA, 20 bp, Homo sapiens
cccggcgcctggcctccagg

SEQ ID NO: 6082700 - DNA, 22 bp, Homo sapiens
cccggcgcggtggctcacgcct

SEQ ID NO: 6082701 - DNA, 17 bp, Homo sapiens
cccggcggccctgctga

SEQ ID NO: 6082702 - DNA, 21 bp, Homo sapiens
cccggcggtgccgcgctccga

SEQ ID NO: 6082703 - DNA, 15 bp, Homo sapiens
cccggctaatgtttg

SEQ ID NO: 6082704 - DNA, 16 bp, Homo sapiens
cccggctccaggctcc

SEQ ID NO: 6082705 - DNA, 14 bp, Homo sapiens
cccggctcccaccg

SEQ ID NO: 6082706 - DNA, 13 bp, Homo sapiens
cccggctccccct

SEQ ID NO: 6082707 - DNA, 19 bp, Homo sapiens
cccggctccccctgccagc

SEQ ID NO: 6082708 - DNA, 18 bp, Homo sapiens
cccggctccccctgcttc

SEQ ID NO: 6082709 - DNA, 14 bp, Homo sapiens
cccggctcggccca

SEQ ID NO: 6082710 - DNA, 15 bp, Homo sapiens
cccggctcggcccag

SEQ ID NO: 6082711 - DNA, 19 bp, Homo sapiens
cccggctcgtgtatttatt

SEQ ID NO: 6082712 - DNA, 20 bp, Homo sapiens
cccggctcttatagaagctt

SEQ ID NO: 6082713 - DNA, 17 bp, Homo sapiens
cccggctgaccctgtgc

SEQ ID NO: 6082714 - DNA, 16 bp, Homo sapiens
cccggctgcagaggcc

SEQ ID NO: 6082715 - DNA, 13 bp, Homo sapiens
cccggctgctgct

SEQ ID NO: 6082716 - DNA, 14 bp, Homo sapiens
cccggctggccggg

SEQ ID NO: 6082717 - DNA, 11 bp, Homo sapiens
cccggctgggc

SEQ ID NO: 6082718 - DNA, 15 bp, Homo sapiens
cccggcttcctgtgc

SEQ ID NO: 6082719 - DNA, 15 bp, Homo sapiens
cccgggaaaggccgg

SEQ ID NO: 6082720 - DNA, 16 bp, Homo sapiens
cccgggaagcatcctc

SEQ ID NO: 6082721 - DNA, 17 bp, Homo sapiens
cccgggaagcatcctcc

SEQ ID NO: 6082722 - DNA, 16 bp, Homo sapiens
cccgggacaccgtggg

SEQ ID NO: 6082723 - DNA, 18 bp, Homo sapiens
cccgggaccacagctgct

SEQ ID NO: 6082724 - DNA, 18 bp, Homo sapiens
cccgggacgcagcaggag

SEQ ID NO: 6082725 - DNA, 23 bp, Homo sapiens
cccgggacgcaggggttgcagtg

SEQ ID NO: 6082726 - DNA, 23 bp, Homo sapiens
cccgggactcactggcagcccca

SEQ ID NO: 6082727 - DNA, 13 bp, Homo sapiens
cccgggactctgc

SEQ ID NO: 6082728 - DNA, 16 bp, Homo sapiens
cccgggagcctaggac

SEQ ID NO: 6082729 - DNA, 15 bp, Homo sapiens
cccgggagctgggcc

SEQ ID NO: 6082730 - DNA, 14 bp, Homo sapiens
cccgggaggaggat

SEQ ID NO: 6082731 - DNA, 23 bp, Homo sapiens
cccgggaggcagaggttgcagtg

SEQ ID NO: 6082732 - DNA, 13 bp, Homo sapiens
cccgggaggggcc

SEQ ID NO: 6082733 - DNA, 17 bp, Homo sapiens
cccgggaggggcccgct

SEQ ID NO: 6082734 - DNA, 18 bp, Homo sapiens
cccgggaggggcccgctt

SEQ ID NO: 6082735 - DNA, 19 bp, Homo sapiens
cccgggataaactgagcct

SEQ ID NO: 6082736 - DNA, 15 bp, Homo sapiens
cccgggatcctgccc

SEQ ID NO: 6082737 - DNA, 19 bp, Homo sapiens
cccgggatgcgaggctcgg

SEQ ID NO: 6082738 - DNA, 18 bp, Homo sapiens
cccgggcactgtcatgcc

SEQ ID NO: 6082739 - DNA, 22 bp, Homo sapiens
cccgggccacgccccagcccga

SEQ ID NO: 6082740 - DNA, 14 bp, Homo sapiens
cccgggccagggct

SEQ ID NO: 6082741 - DNA, 15 bp, Homo sapiens
cccgggccagggctg

SEQ ID NO: 6082742 - DNA, 14 bp, Homo sapiens
cccgggcccagagg

SEQ ID NO: 6082743 - DNA, 15 bp, Homo sapiens
cccgggcccaggcag

SEQ ID NO: 6082744 - DNA, 11 bp, Homo sapiens
cccgggcccca

SEQ ID NO: 6082745 - DNA, 16 bp, Homo sapiens
cccgggccctcagccc

SEQ ID NO: 6082746 - DNA, 17 bp, Homo sapiens
cccgggccctcccttgg

SEQ ID NO: 6082747 - DNA, 18 bp, Homo sapiens
cccgggccctcccttgga

SEQ ID NO: 6082748 - DNA, 14 bp, Homo sapiens
cccgggcctgcaca

SEQ ID NO: 6082749 - DNA, 19 bp, Homo sapiens
cccgggcgggcgtgggagg

SEQ ID NO: 6082750 - DNA, 16 bp, Homo sapiens
cccgggctctgcctcc

SEQ ID NO: 6082751 - DNA, 17 bp, Homo sapiens
cccgggctctggccacc

SEQ ID NO: 6082752 - DNA, 19 bp, Homo sapiens
cccgggctgacccagtgtg

SEQ ID NO: 6082753 - DNA, 13 bp, Homo sapiens
cccgggctggccc

SEQ ID NO: 6082754 - DNA, 15 bp, Homo sapiens
cccgggctggccctg

SEQ ID NO: 6082755 - DNA, 17 bp, Homo sapiens
cccgggctggccctgtg

SEQ ID NO: 6082756 - DNA, 21 bp, Homo sapiens
cccgggcttcccttctcccca

SEQ ID NO: 6082757 - DNA, 16 bp, Homo sapiens
cccggggaactggttt

SEQ ID NO: 6082758 - DNA, 16 bp, Homo sapiens
cccggggacccccaac

SEQ ID NO: 6082759 - DNA, 15 bp, Homo sapiens
cccggggaccctgtg

SEQ ID NO: 6082760 - DNA, 17 bp, Homo sapiens
cccggggaccctgtgac

SEQ ID NO: 6082761 - DNA, 18 bp, Homo sapiens
cccggggcagagctcaga

SEQ ID NO: 6082762 - DNA, 14 bp, Homo sapiens
cccggggcagctgc

SEQ ID NO: 6082763 - DNA, 19 bp, Homo sapiens
cccggggcagctgccagag

SEQ ID NO: 6082764 - DNA, 15 bp, Homo sapiens
cccggggcagctggc

SEQ ID NO: 6082765 - DNA, 18 bp, Homo sapiens
cccggggcagggcagccg

SEQ ID NO: 6082766 - DNA, 20 bp, Homo sapiens
cccggggcatggacagggcc

SEQ ID NO: 6082767 - DNA, 17 bp, Homo sapiens
cccggggccagagacat

SEQ ID NO: 6082768 - DNA, 22 bp, Homo sapiens
cccggggccagcttggcaggga

SEQ ID NO: 6082769 - DNA, 16 bp, Homo sapiens
cccggggcccagggca

SEQ ID NO: 6082770 - DNA, 11 bp, Homo sapiens
cccggggcctg

SEQ ID NO: 6082771 - DNA, 13 bp, Homo sapiens
cccggggcctgga

SEQ ID NO: 6082772 - DNA, 15 bp, Homo sapiens
cccggggcctggaca

SEQ ID NO: 6082773 - DNA, 16 bp, Homo sapiens
cccggggctggcaagc

SEQ ID NO: 6082774 - DNA, 22 bp, Homo sapiens
cccggggctggcaagcagggaa

SEQ ID NO: 6082775 - DNA, 19 bp, Homo sapiens
cccgggggcagacacctgt

SEQ ID NO: 6082776 - DNA, 13 bp, Homo sapiens
cccgggggtgggg

SEQ ID NO: 6082777 - DNA, 19 bp, Homo sapiens
cccgggggtggggggtggg

SEQ ID NO: 6082778 - DNA, 21 bp, Homo sapiens
cccggggtccccgccctctct

SEQ ID NO: 6082779 - DNA, 22 bp, Homo sapiens
cccggggtccccgccctctctc

SEQ ID NO: 6082780 - DNA, 17 bp, Homo sapiens
cccggggtctccacctc

SEQ ID NO: 6082781 - DNA, 14 bp, Homo sapiens
cccggggtctcctg

SEQ ID NO: 6082782 - DNA, 21 bp, Homo sapiens
cccggggtgcccacaggccgc

SEQ ID NO: 6082783 - DNA, 18 bp, Homo sapiens
cccgggtccccagctccc

SEQ ID NO: 6082784 - DNA, 16 bp, Homo sapiens
cccgggtcgtgtcttt

SEQ ID NO: 6082785 - DNA, 17 bp, Homo sapiens
cccgggtctcaggcctc

SEQ ID NO: 6082786 - DNA, 22 bp, Homo sapiens
cccgggtctccttggctgtctg

SEQ ID NO: 6082787 - DNA, 17 bp, Homo sapiens
cccgggtgcctcagagc

SEQ ID NO: 6082788 - DNA, 23 bp, Homo sapiens
cccgggtgcctcagagcaggctc

SEQ ID NO: 6082789 - DNA, 20 bp, Homo sapiens
cccgggtgtgcctgccctgg

SEQ ID NO: 6082790 - DNA, 21 bp, Homo sapiens
cccgggttcacgccattctcc

SEQ ID NO: 6082791 - DNA, 15 bp, Homo sapiens
cccgggttcagcctg

SEQ ID NO: 6082792 - DNA, 13 bp, Homo sapiens
cccggtcccaggc

SEQ ID NO: 6082793 - DNA, 15 bp, Homo sapiens
cccggtcccaggccg

SEQ ID NO: 6082794 - DNA, 17 bp, Homo sapiens
cccggtcccaggccgca

SEQ ID NO: 6082795 - DNA, 22 bp, Homo sapiens
cccggtcccaggccgcatggcc

SEQ ID NO: 6082796 - DNA, 16 bp, Homo sapiens
cccggtcccccagagc

SEQ ID NO: 6082797 - DNA, 17 bp, Homo sapiens
cccggtcccgagtacag

SEQ ID NO: 6082798 - DNA, 15 bp, Homo sapiens
cccggtcctggcccc

SEQ ID NO: 6082799 - DNA, 18 bp, Homo sapiens
cccggtcctggccccagc

SEQ ID NO: 6082800 - DNA, 22 bp, Homo sapiens
cccggtctatgtcgagagctgg

SEQ ID NO: 6082801 - DNA, 15 bp, Homo sapiens
cccggtgcagggcct

SEQ ID NO: 6082802 - DNA, 17 bp, Homo sapiens
cccggtgcagggcctgg

SEQ ID NO: 6082803 - DNA, 16 bp, Homo sapiens
cccggtgccatcttcc

SEQ ID NO: 6082804 - DNA, 14 bp, Homo sapiens
cccggtgctccctc

SEQ ID NO: 6082805 - DNA, 16 bp, Homo sapiens
cccggtgctccctctg

SEQ ID NO: 6082806 - DNA, 12 bp, Homo sapiens
cccggtggcagt

SEQ ID NO: 6082807 - DNA, 18 bp, Homo sapiens
cccggtggcggccccagc

SEQ ID NO: 6082808 - DNA, 19 bp, Homo sapiens
cccggtggcggccccagca

SEQ ID NO: 6082809 - DNA, 20 bp, Homo sapiens
cccggtgggacccccgtggg

SEQ ID NO: 6082810 - DNA, 21 bp, Homo sapiens
cccggtggtgggatccacgct

SEQ ID NO: 6082811 - DNA, 22 bp, Homo sapiens
cccggtggtgggatccacgctg

SEQ ID NO: 6082812 - DNA, 19 bp, Homo sapiens
cccggtgtatcctggccct

SEQ ID NO: 6082813 - DNA, 16 bp, Homo sapiens
cccggtgtatgcagtg

SEQ ID NO: 6082814 - DNA, 19 bp, Homo sapiens
cccggttattcgcccaccc

SEQ ID NO: 6082815 - DNA, 22 bp, Homo sapiens
cccggttccctccccagctcct

SEQ ID NO: 6082816 - DNA, 15 bp, Homo sapiens
cccggttcttccagt

SEQ ID NO: 6082817 - DNA, 15 bp, Homo sapiens
cccggttgccatgga

SEQ ID NO: 6082818 - DNA, 22 bp, Homo sapiens
cccggtttcagaagctgcagct

SEQ ID NO: 6082819 - DNA, 20 bp, Homo sapiens
cccgtacccccgtggtcttt

SEQ ID NO: 6082820 - DNA, 22 bp, Homo sapiens
cccgtacccccgtggtctttga

SEQ ID NO: 6082821 - DNA, 14 bp, Homo sapiens
cccgtacctcttcc

SEQ ID NO: 6082822 - DNA, 21 bp, Homo sapiens
cccgtagccactctctgccca

SEQ ID NO: 6082823 - DNA, 15 bp, Homo sapiens
cccgtatcacagtgt

SEQ ID NO: 6082824 - DNA, 17 bp, Homo sapiens
cccgtcaccatctcagg

SEQ ID NO: 6082825 - DNA, 13 bp, Homo sapiens
cccgtcagcatca

SEQ ID NO: 6082826 - DNA, 17 bp, Homo sapiens
cccgtcagcatcactga

SEQ ID NO: 6082827 - DNA, 18 bp, Homo sapiens
cccgtcagccacacctgt

SEQ ID NO: 6082828 - DNA, 17 bp, Homo sapiens
cccgtcaggccacagcc

SEQ ID NO: 6082829 - DNA, 20 bp, Homo sapiens
cccgtcaggccacagcccct

SEQ ID NO: 6082830 - DNA, 22 bp, Homo sapiens
cccgtcagggcccaagtccctg

SEQ ID NO: 6082831 - DNA, 18 bp, Homo sapiens
cccgtccacggctctagg

SEQ ID NO: 6082832 - DNA, 23 bp, Homo sapiens
cccgtccattcttcagtgtctct

SEQ ID NO: 6082833 - DNA, 13 bp, Homo sapiens
cccgtcccagagg

SEQ ID NO: 6082834 - DNA, 14 bp, Homo sapiens
cccgtcccagaggc

SEQ ID NO: 6082835 - DNA, 16 bp, Homo sapiens
cccgtcccatatcctg

SEQ ID NO: 6082836 - DNA, 13 bp, Homo sapiens
cccgtccccacac

SEQ ID NO: 6082837 - DNA, 15 bp, Homo sapiens
cccgtccccacacga

SEQ ID NO: 6082838 - DNA, 16 bp, Homo sapiens
cccgtccccccatccc

SEQ ID NO: 6082839 - DNA, 23 bp, Homo sapiens
cccgtcccctgcagcctgggtct

SEQ ID NO: 6082840 - DNA, 19 bp, Homo sapiens
cccgtcccctgggccaccc

SEQ ID NO: 6082841 - DNA, 19 bp, Homo sapiens
cccgtccctttccctgcat

SEQ ID NO: 6082842 - DNA, 14 bp, Homo sapiens
cccgtccgtccgcc

SEQ ID NO: 6082843 - DNA, 18 bp, Homo sapiens
cccgtccgtccgcccgcc

SEQ ID NO: 6082844 - DNA, 14 bp, Homo sapiens
cccgtcctccctca

SEQ ID NO: 6082845 - DNA, 16 bp, Homo sapiens
cccgtcctccctcagc

SEQ ID NO: 6082846 - DNA, 16 bp, Homo sapiens
cccgtcctgcctgtgg

SEQ ID NO: 6082847 - DNA, 17 bp, Homo sapiens
cccgtcgacgtagaacc

SEQ ID NO: 6082848 - DNA, 18 bp, Homo sapiens
cctctgctatgtctgtga

SEQ ID NO: 6082849 - DNA, 19 bp, Homo sapiens
cctctgctatgtctgtgat

SEQ ID NO: 6082850 - DNA, 17 bp, Homo sapiens
cctctgctccaacagac

SEQ ID NO: 6082851 - DNA, 14 bp, Homo sapiens
cctctgctccagca

SEQ ID NO: 6082852 - DNA, 15 bp, Homo sapiens
cctctgctccagcaa

SEQ ID NO: 6082853 - DNA, 12 bp, Homo sapiens
cctctgctccct

SEQ ID NO: 6082854 - DNA, 18 bp, Homo sapiens
cctctgctccgtgtgtct

SEQ ID NO: 6082855 - DNA, 12 bp, Homo sapiens
cctctgctctca

SEQ ID NO: 6082856 - DNA, 16 bp, Homo sapiens
cctctgctctgcctgg

SEQ ID NO: 6082857 - DNA, 18 bp, Homo sapiens
cctctgctctgcctggag

SEQ ID NO: 6082858 - DNA, 20 bp, Homo sapiens
cctctgctgaagacttgccc

SEQ ID NO: 6082859 - DNA, 13 bp, Homo sapiens
cctctgctgagtg

SEQ ID NO: 6082860 - DNA, 14 bp, Homo sapiens
cctctgctgagtgc

SEQ ID NO: 6082861 - DNA, 15 bp, Homo sapiens
cctctgctgagtgct

SEQ ID NO: 6082862 - DNA, 21 bp, Homo sapiens
cctctgctgagtgctgggcac

SEQ ID NO: 6082863 - DNA, 10 bp, Homo sapiens
cctctgctgc

SEQ ID NO: 6082864 - DNA, 23 bp, Homo sapiens
cctctgctgcaacaagctcatcc

SEQ ID NO: 6082865 - DNA, 17 bp, Homo sapiens
cctctgctgcacagtag

SEQ ID NO: 6082866 - DNA, 16 bp, Homo sapiens
cctctgctgcatcccc

SEQ ID NO: 6082867 - DNA, 20 bp, Homo sapiens
cctctgctgcatccccttcc

SEQ ID NO: 6082868 - DNA, 22 bp, Homo sapiens
cctctgctgcatccccttccag

SEQ ID NO: 6082869 - DNA, 15 bp, Homo sapiens
cctctgctgccccct

SEQ ID NO: 6082870 - DNA, 12 bp, Homo sapiens
cctctgctgccg

SEQ ID NO: 6082871 - DNA, 13 bp, Homo sapiens
cctctgctgccgg

SEQ ID NO: 6082872 - DNA, 16 bp, Homo sapiens
cctctgctgccggctc

SEQ ID NO: 6082873 - DNA, 22 bp, Homo sapiens
cctctgctgctcccatctgcac

SEQ ID NO: 6082874 - DNA, 17 bp, Homo sapiens
cctctgctgctgcccgg

SEQ ID NO: 6082875 - DNA, 23 bp, Homo sapiens
cctctgctgctgcccggggtggg

SEQ ID NO: 6082876 - DNA, 14 bp, Homo sapiens
cctctgctgctggc

SEQ ID NO: 6082877 - DNA, 15 bp, Homo sapiens
cctctgctgctggct

SEQ ID NO: 6082878 - DNA, 16 bp, Homo sapiens
cctctgctgctggctg

SEQ ID NO: 6082879 - DNA, 14 bp, Homo sapiens
cctctgctgctttt

SEQ ID NO: 6082880 - DNA, 21 bp, Homo sapiens
cctctgctggagaaagccacg

SEQ ID NO: 6082881 - DNA, 19 bp, Homo sapiens
cctctgctggccgggcaca

SEQ ID NO: 6082882 - DNA, 14 bp, Homo sapiens
cctctgctggctca

SEQ ID NO: 6082883 - DNA, 16 bp, Homo sapiens
cctctgctggctcagg

SEQ ID NO: 6082884 - DNA, 21 bp, Homo sapiens
cctctgctgggactcctttgc

SEQ ID NO: 6082885 - DNA, 21 bp, Homo sapiens
cctctgctggtctctggctct

SEQ ID NO: 6082886 - DNA, 17 bp, Homo sapiens
cctctgctggttcctga

SEQ ID NO: 6082887 - DNA, 15 bp, Homo sapiens
cctctgctgtcctgc

SEQ ID NO: 6082888 - DNA, 18 bp, Homo sapiens
cctctgctgtcctgcagt

SEQ ID NO: 6082889 - DNA, 16 bp, Homo sapiens
cctctgcttcctgagc

SEQ ID NO: 6082890 - DNA, 12 bp, Homo sapiens
cctctgcttctc

SEQ ID NO: 6082891 - DNA, 13 bp, Homo sapiens
cctctgcttctga

SEQ ID NO: 6082892 - DNA, 20 bp, Homo sapiens
cctctgcttgcatcacttgg

SEQ ID NO: 6082893 - DNA, 13 bp, Homo sapiens
cctctgcttgcca

SEQ ID NO: 6082894 - DNA, 16 bp, Homo sapiens
cctctgcttgccagcc

SEQ ID NO: 6082895 - DNA, 20 bp, Homo sapiens
cctctgcttgccagccagga

SEQ ID NO: 6082896 - DNA, 20 bp, Homo sapiens
cctctgcttgccatccctcc

SEQ ID NO: 6082897 - DNA, 22 bp, Homo sapiens
cctctgcttgtcattctgctaa

SEQ ID NO: 6082898 - DNA, 16 bp, Homo sapiens
cctctggaacccccca

SEQ ID NO: 6082899 - DNA, 18 bp, Homo sapiens
cctctggaaccccccagg

SEQ ID NO: 6082900 - DNA, 22 bp, Homo sapiens
cctctggacctcggtgatgcct

SEQ ID NO: 6082901 - DNA, 14 bp, Homo sapiens
cctctggactggct

SEQ ID NO: 6082902 - DNA, 16 bp, Homo sapiens
cctctggagccagccg

SEQ ID NO: 6082903 - DNA, 16 bp, Homo sapiens
cctctggaggcctctg

SEQ ID NO: 6082904 - DNA, 22 bp, Homo sapiens
cctctggaggcctctggccctc

SEQ ID NO: 6082905 - DNA, 18 bp, Homo sapiens
cctctggaggcctctggg

SEQ ID NO: 6082906 - DNA, 21 bp, Homo sapiens
cctctggaggcctctgggcct

SEQ ID NO: 6082907 - DNA, 17 bp, Homo sapiens
cctctggaggggtgtgg

SEQ ID NO: 6082908 - DNA, 20 bp, Homo sapiens
cctctggaggggtgtggctc

SEQ ID NO: 6082909 - DNA, 21 bp, Homo sapiens
cctctggatggcaccagaggc

SEQ ID NO: 6082910 - DNA, 14 bp, Homo sapiens
cctctggattccct

SEQ ID NO: 6082911 - DNA, 18 bp, Homo sapiens
cctctggattgtgggaat

SEQ ID NO: 6082912 - DNA, 13 bp, Homo sapiens
cctctggcaggct

SEQ ID NO: 6082913 - DNA, 15 bp, Homo sapiens
cctctggccaggatg

SEQ ID NO: 6082914 - DNA, 10 bp, Homo sapiens
cctctggccc

SEQ ID NO: 6082915 - DNA, 17 bp, Homo sapiens
cctctggcccacacaga

SEQ ID NO: 6082916 - DNA, 15 bp, Homo sapiens
cctctggcccctcac

SEQ ID NO: 6082917 - DNA, 18 bp, Homo sapiens
cctctggccctgccttct

SEQ ID NO: 6082918 - DNA, 13 bp, Homo sapiens
cctctggccctgt

SEQ ID NO: 6082919 - DNA, 17 bp, Homo sapiens
cctctggccctgttgtg

SEQ ID NO: 6082920 - DNA, 12 bp, Homo sapiens
cctctggccctt

SEQ ID NO: 6082921 - DNA, 14 bp, Homo sapiens
cctctggcccttgg

SEQ ID NO: 6082922 - DNA, 15 bp, Homo sapiens
cctctggccgcagag

SEQ ID NO: 6082923 - DNA, 17 bp, Homo sapiens
cctctggccgccacccc

SEQ ID NO: 6082924 - DNA, 13 bp, Homo sapiens
cctctggctagag

SEQ ID NO: 6082925 - DNA, 17 bp, Homo sapiens
cctctggctagagccga

SEQ ID NO: 6082926 - DNA, 18 bp, Homo sapiens
cctctggctccacacctc

SEQ ID NO: 6082927 - DNA, 16 bp, Homo sapiens
cctctggctccagctg

SEQ ID NO: 6082928 - DNA, 16 bp, Homo sapiens
cctctggctctacaca

SEQ ID NO: 6082929 - DNA, 13 bp, Homo sapiens
cctctggctgcct

SEQ ID NO: 6082930 - DNA, 14 bp, Homo sapiens
cctctggctgcctg

SEQ ID NO: 6082931 - DNA, 17 bp, Homo sapiens
cctctggctgcctggcc

SEQ ID NO: 6082932 - DNA, 19 bp, Homo sapiens
cctctggctgcctggccca

SEQ ID NO: 6082933 - DNA, 14 bp, Homo sapiens
cctctggcttccca

SEQ ID NO: 6082934 - DNA, 17 bp, Homo sapiens
cctctggcttccctgcc

SEQ ID NO: 6082935 - DNA, 19 bp, Homo sapiens
cctctggcttccctgccca

SEQ ID NO: 6082936 - DNA, 20 bp, Homo sapiens
cctctggcttccctgcccaa

SEQ ID NO: 6082937 - DNA, 22 bp, Homo sapiens
cctctggcttgggcagggtctg

SEQ ID NO: 6082938 - DNA, 15 bp, Homo sapiens
cctctggctttccca

SEQ ID NO: 6082939 - DNA, 16 bp, Homo sapiens
cctctggctttcccag

SEQ ID NO: 6082940 - DNA, 12 bp, Homo sapiens
cctctgggaacc

SEQ ID NO: 6082941 - DNA, 13 bp, Homo sapiens
cctctgggaacct

SEQ ID NO: 6082942 - DNA, 19 bp, Homo sapiens
cctctgggaacctcccaga

SEQ ID NO: 6082943 - DNA, 21 bp, Homo sapiens
cctctgggaacctcccagagg

SEQ ID NO: 6082944 - DNA, 12 bp, Homo sapiens
cctctgggactg

SEQ ID NO: 6082945 - DNA, 20 bp, Homo sapiens
cctctgggagtccccatccc

SEQ ID NO: 6082946 - DNA, 21 bp, Homo sapiens
cctctgggagtccccatccca

SEQ ID NO: 6082947 - DNA, 23 bp, Homo sapiens
cctctgggcacgcctgctggccg

SEQ ID NO: 6082948 - DNA, 19 bp, Homo sapiens
cctctgggcagcctgcttt

SEQ ID NO: 6082949 - DNA, 14 bp, Homo sapiens
cctctgggcagctg

SEQ ID NO: 6082950 - DNA, 19 bp, Homo sapiens
cctctgggcagtgtggcct

SEQ ID NO: 6082951 - DNA, 21 bp, Homo sapiens
cctctgggccctgcaggaggc

SEQ ID NO: 6082952 - DNA, 15 bp, Homo sapiens
cctctgggcctcctc

SEQ ID NO: 6082953 - DNA, 17 bp, Homo sapiens
cctctgggcctcctcta

SEQ ID NO: 6082954 - DNA, 16 bp, Homo sapiens
cctctgggctcacacc

SEQ ID NO: 6082955 - DNA, 19 bp, Homo sapiens
cctctgggctcacaccagc

SEQ ID NO: 6082956 - DNA, 14 bp, Homo sapiens
cctctgggctctga

SEQ ID NO: 6082957 - DNA, 16 bp, Homo sapiens
cctctgggctctgagt

SEQ ID NO: 6082958 - DNA, 23 bp, Homo sapiens
cctctggggaagggaaccagccc

SEQ ID NO: 6082959 - DNA, 16 bp, Homo sapiens
cctctggggacaggat

SEQ ID NO: 6082960 - DNA, 17 bp, Homo sapiens
cctctggggaccccaac

SEQ ID NO: 6082961 - DNA, 16 bp, Homo sapiens
cctctggggcagagct

SEQ ID NO: 6082962 - DNA, 17 bp, Homo sapiens
cctctggggcagagctt

SEQ ID NO: 6082963 - DNA, 18 bp, Homo sapiens
cctctggggcagagcttg

SEQ ID NO: 6082964 - DNA, 14 bp, Homo sapiens
cctctggggccact

SEQ ID NO: 6082965 - DNA, 15 bp, Homo sapiens
cctctggggccactt

SEQ ID NO: 6082966 - DNA, 21 bp, Homo sapiens
cctctggggccttcgggaccc

SEQ ID NO: 6082967 - DNA, 14 bp, Homo sapiens
cctctggggctcag

SEQ ID NO: 6082968 - DNA, 17 bp, Homo sapiens
cctctggggctcagccc

SEQ ID NO: 6082969 - DNA, 19 bp, Homo sapiens
cctctggggctcagccctg

SEQ ID NO: 6082970 - DNA, 13 bp, Homo sapiens
cctctgggggctc

SEQ ID NO: 6082971 - DNA, 16 bp, Homo sapiens
cctctgggggctctgg

SEQ ID NO: 6082972 - DNA, 21 bp, Homo sapiens
cctctgggggtcctctctgag

SEQ ID NO: 6082973 - DNA, 22 bp, Homo sapiens
cctctgggggttgttgggagga

SEQ ID NO: 6082974 - DNA, 20 bp, Homo sapiens
cctctgggtccttggctccc

SEQ ID NO: 6082975 - DNA, 18 bp, Homo sapiens
cctctgggtgagtggctg

SEQ ID NO: 6082976 - DNA, 19 bp, Homo sapiens
cctctgggttccagcagag

SEQ ID NO: 6082977 - DNA, 11 bp, Homo sapiens
cctctgggttg

SEQ ID NO: 6082978 - DNA, 22 bp, Homo sapiens
cctctggtaaacattcctccag

SEQ ID NO: 6082979 - DNA, 16 bp, Homo sapiens
cctctggtccacacta

SEQ ID NO: 6082980 - DNA, 21 bp, Homo sapiens
cctctggtccttctgacccca

SEQ ID NO: 6082981 - DNA, 16 bp, Homo sapiens
cctctggtcgctcctg

SEQ ID NO: 6082982 - DNA, 20 bp, Homo sapiens
cctctggtctactctagaag

SEQ ID NO: 6082983 - DNA, 23 bp, Homo sapiens
cctctggtgtgtggtgaggggct

SEQ ID NO: 6082984 - DNA, 12 bp, Homo sapiens
cctctggttcct

SEQ ID NO: 6082985 - DNA, 22 bp, Homo sapiens
cctctggttcctttcatctctc

SEQ ID NO: 6082986 - DNA, 19 bp, Homo sapiens
cctctggttcttcatttat

SEQ ID NO: 6082987 - DNA, 16 bp, Homo sapiens
cctctggttgcctccc

SEQ ID NO: 6082988 - DNA, 16 bp, Homo sapiens
cctctggtttctgtgt

SEQ ID NO: 6082989 - DNA, 17 bp, Homo sapiens
cctctggtttctgtgtg

SEQ ID NO: 6082990 - DNA, 24 bp, Homo sapiens
cctctggtttgccggtggtgcagg

SEQ ID NO: 6082991 - DNA, 16 bp, Homo sapiens
cctctggtttggggcg

SEQ ID NO: 6082992 - DNA, 18 bp, Homo sapiens
cctctggtttggggcgag

SEQ ID NO: 6082993 - DNA, 17 bp, Homo sapiens
cctctgtacagagccca

SEQ ID NO: 6082994 - DNA, 23 bp, Homo sapiens
cctctgtacagagcccacgcccc

SEQ ID NO: 6082995 - DNA, 16 bp, Homo sapiens
cctctgtacagcaaga

SEQ ID NO: 6082996 - DNA, 19 bp, Homo sapiens
cctctgtaccccatgacct

SEQ ID NO: 6082997 - DNA, 22 bp, Homo sapiens
cctctgtagctccctcctccca

SEQ ID NO: 6082998 - DNA, 23 bp, Homo sapiens
cctctgtagctccctcctcccat

SEQ ID NO: 6082999 - DNA, 20 bp, Homo sapiens
cctctgtaggcagcagagag

SEQ ID NO: 6083000 - DNA, 18 bp, Homo sapiens
cctctgtatagaaatcta

SEQ ID NO: 6083001 - DNA, 14 bp, Homo sapiens
cctctgtcaggcct

SEQ ID NO: 6083002 - DNA, 18 bp, Homo sapiens
cctctgtcaggccttcag

SEQ ID NO: 6083003 - DNA, 18 bp, Homo sapiens
cctctgtcagtcacagcc

SEQ ID NO: 6083004 - DNA, 21 bp, Homo sapiens
cctctgtcagtcatgcgtcca

SEQ ID NO: 6083005 - DNA, 16 bp, Homo sapiens
cctctgtcatatcttc

SEQ ID NO: 6083006 - DNA, 22 bp, Homo sapiens
cctctgtcatcactccctggat

SEQ ID NO: 6083007 - DNA, 22 bp, Homo sapiens
cctctgtccaaacatttcatcc

SEQ ID NO: 6083008 - DNA, 12 bp, Homo sapiens
cctctgtccaca

SEQ ID NO: 6083009 - DNA, 15 bp, Homo sapiens
cctctgtccacttgt

SEQ ID NO: 6083010 - DNA, 17 bp, Homo sapiens
cctctgtccagccagct

SEQ ID NO: 6083011 - DNA, 22 bp, Homo sapiens
cctctgtccagccagctcctgc

SEQ ID NO: 6083012 - DNA, 20 bp, Homo sapiens
cctctgtccaggcactgaga

SEQ ID NO: 6083013 - DNA, 21 bp, Homo sapiens
cctctgtccaggcactgagat

SEQ ID NO: 6083014 - DNA, 23 bp, Homo sapiens
cctctgtccagggccctgagctc

SEQ ID NO: 6083015 - DNA, 14 bp, Homo sapiens
cctctgtcccaccc

SEQ ID NO: 6083016 - DNA, 19 bp, Homo sapiens
cctctgtcccacccctagc

SEQ ID NO: 6083017 - DNA, 14 bp, Homo sapiens
cctctgtccccacg

SEQ ID NO: 6083018 - DNA, 15 bp, Homo sapiens
cctctgtccccacga

SEQ ID NO: 6083019 - DNA, 16 bp, Homo sapiens
cctctgtccccacgag

SEQ ID NO: 6083020 - DNA, 14 bp, Homo sapiens
cctctgtccccagg

SEQ ID NO: 6083021 - DNA, 23 bp, Homo sapiens
cctctgtccccaggcctggctcc

SEQ ID NO: 6083022 - DNA, 19 bp, Homo sapiens
cctctgtccccttctctca

SEQ ID NO: 6083023 - DNA, 21 bp, Homo sapiens
cctctgtccccttctctcatc

SEQ ID NO: 6083024 - DNA, 22 bp, Homo sapiens
cctctgtccccttctctcatct

SEQ ID NO: 6083025 - DNA, 15 bp, Homo sapiens
cctctgtccctctcc

SEQ ID NO: 6083026 - DNA, 20 bp, Homo sapiens
cctctgtccctctccttgcc

SEQ ID NO: 6083027 - DNA, 20 bp, Homo sapiens
cccgtcgaggggctctcagc

SEQ ID NO: 6083028 - DNA, 16 bp, Homo sapiens
cccgtcggaatggtaa

SEQ ID NO: 6083029 - DNA, 20 bp, Homo sapiens
cccgtcggactgcccccaga

SEQ ID NO: 6083030 - DNA, 15 bp, Homo sapiens
cccgtcggagctgcc

SEQ ID NO: 6083031 - DNA, 18 bp, Homo sapiens
cccgtcggagctgcctgc

SEQ ID NO: 6083032 - DNA, 15 bp, Homo sapiens
cccgtcggccctgcg

SEQ ID NO: 6083033 - DNA, 13 bp, Homo sapiens
cccgtcgtgtgct

SEQ ID NO: 6083034 - DNA, 20 bp, Homo sapiens
cccgtcgtgtgctgaagaca

SEQ ID NO: 6083035 - DNA, 12 bp, Homo sapiens
cccgtctcaggt

SEQ ID NO: 6083036 - DNA, 12 bp, Homo sapiens
cccgtctcagtg

SEQ ID NO: 6083037 - DNA, 14 bp, Homo sapiens
cccgtctctactaa

SEQ ID NO: 6083038 - DNA, 16 bp, Homo sapiens
cccgtctctctcccat

SEQ ID NO: 6083039 - DNA, 19 bp, Homo sapiens
cccgtctctctcccatgga

SEQ ID NO: 6083040 - DNA, 14 bp, Homo sapiens
cccgtctctgccct

SEQ ID NO: 6083041 - DNA, 22 bp, Homo sapiens
cccgtctctggttcctcccctc

SEQ ID NO: 6083042 - DNA, 12 bp, Homo sapiens
cccgtctgcccc

SEQ ID NO: 6083043 - DNA, 20 bp, Homo sapiens
cccgtctgctcctccctccc

SEQ ID NO: 6083044 - DNA, 17 bp, Homo sapiens
cccgtctggcccaccag

SEQ ID NO: 6083045 - DNA, 17 bp, Homo sapiens
cccgtcttcagcctagc

SEQ ID NO: 6083046 - DNA, 20 bp, Homo sapiens
cccgtcttcctcctcccctg

SEQ ID NO: 6083047 - DNA, 22 bp, Homo sapiens
cccgtcttgtaaaaaggggagg

SEQ ID NO: 6083048 - DNA, 18 bp, Homo sapiens
cccgtgacagactcctga

SEQ ID NO: 6083049 - DNA, 22 bp, Homo sapiens
cccgtgacagactcctgaggac

SEQ ID NO: 6083050 - DNA, 21 bp, Homo sapiens
cccgtgacctgagatgtgtga

SEQ ID NO: 6083051 - DNA, 15 bp, Homo sapiens
cccgtgacctggtca

SEQ ID NO: 6083052 - DNA, 16 bp, Homo sapiens
cccgtgacctggtcag

SEQ ID NO: 6083053 - DNA, 21 bp, Homo sapiens
cccgtgaggatgtcactcaga

SEQ ID NO: 6083054 - DNA, 18 bp, Homo sapiens
cccgtgcagactggaggg

SEQ ID NO: 6083055 - DNA, 21 bp, Homo sapiens
cccgtgcatcccccctgctca

SEQ ID NO: 6083056 - DNA, 19 bp, Homo sapiens
cccgtgccaaatcctgggc

SEQ ID NO: 6083057 - DNA, 22 bp, Homo sapiens
cccgtgccaagtccaggtcctg

SEQ ID NO: 6083058 - DNA, 12 bp, Homo sapiens
cccgtgccaccc

SEQ ID NO: 6083059 - DNA, 21 bp, Homo sapiens
cccgtgccacgcgctctgcat

SEQ ID NO: 6083060 - DNA, 24 bp, Homo sapiens
cccgtgccacgcgctctgcatgct

SEQ ID NO: 6083061 - DNA, 21 bp, Homo sapiens
cccgtgcccccgcctgccacc

SEQ ID NO: 6083062 - DNA, 17 bp, Homo sapiens
cccgtgcccctgggatc

SEQ ID NO: 6083063 - DNA, 13 bp, Homo sapiens
cccgtgcctggga

SEQ ID NO: 6083064 - DNA, 13 bp, Homo sapiens
cccgtgcctgggc

SEQ ID NO: 6083065 - DNA, 20 bp, Homo sapiens
cccgtgcctgggcccctccc

SEQ ID NO: 6083066 - DNA, 21 bp, Homo sapiens
cccgtgcctgggcccctcccc

SEQ ID NO: 6083067 - DNA, 22 bp, Homo sapiens
cccgtgcggcccgtgcgcagcc

SEQ ID NO: 6083068 - DNA, 17 bp, Homo sapiens
cccgtgctcctctgccc

SEQ ID NO: 6083069 - DNA, 14 bp, Homo sapiens
cccgtgctggaaga

SEQ ID NO: 6083070 - DNA, 18 bp, Homo sapiens
cccgtggccatccctgtg

SEQ ID NO: 6083071 - DNA, 13 bp, Homo sapiens
cccgtggccccag

SEQ ID NO: 6083072 - DNA, 14 bp, Homo sapiens
cccgtggccccagc

SEQ ID NO: 6083073 - DNA, 17 bp, Homo sapiens
cccgtggccccagcctg

SEQ ID NO: 6083074 - DNA, 20 bp, Homo sapiens
cccgtggcctggcatctgtg

SEQ ID NO: 6083075 - DNA, 21 bp, Homo sapiens
cccgtggcctggcatctgtgt

SEQ ID NO: 6083076 - DNA, 22 bp, Homo sapiens
cccgtggcctggcatctgtgtg

SEQ ID NO: 6083077 - DNA, 14 bp, Homo sapiens
cccgtggctctggg

SEQ ID NO: 6083078 - DNA, 17 bp, Homo sapiens
cccgtgggggcagggga

SEQ ID NO: 6083079 - DNA, 15 bp, Homo sapiens
cccgtggggttcctc

SEQ ID NO: 6083080 - DNA, 19 bp, Homo sapiens
cccgtgggtgggcctggcc

SEQ ID NO: 6083081 - DNA, 23 bp, Homo sapiens
cccgtgggtgggcctggccctgc

SEQ ID NO: 6083082 - DNA, 14 bp, Homo sapiens
cccgtggtgcctgc

SEQ ID NO: 6083083 - DNA, 17 bp, Homo sapiens
cccgtgtaaaaagcctc

SEQ ID NO: 6083084 - DNA, 22 bp, Homo sapiens
cccgtgtaaaaagcctccttgt

SEQ ID NO: 6083085 - DNA, 17 bp, Homo sapiens
cccgtgtccccccaggt

SEQ ID NO: 6083086 - DNA, 19 bp, Homo sapiens
cccgtgtccccggcctcag

SEQ ID NO: 6083087 - DNA, 16 bp, Homo sapiens
cccgtgtcctgccttg

SEQ ID NO: 6083088 - DNA, 20 bp, Homo sapiens
cccgtgtgcacaccaccctc

SEQ ID NO: 6083089 - DNA, 16 bp, Homo sapiens
cccgtgtgccccaaga

SEQ ID NO: 6083090 - DNA, 13 bp, Homo sapiens
cccgtgtgcctga

SEQ ID NO: 6083091 - DNA, 18 bp, Homo sapiens
cccgtgtggccccttcac

SEQ ID NO: 6083092 - DNA, 19 bp, Homo sapiens
cccgtgtggcctgggtcct

SEQ ID NO: 6083093 - DNA, 22 bp, Homo sapiens
cccgtgtggcctgggtcctcgg

SEQ ID NO: 6083094 - DNA, 20 bp, Homo sapiens
cccgtgtggtaccttcagcc

SEQ ID NO: 6083095 - DNA, 16 bp, Homo sapiens
cccgtgtgtatttcta

SEQ ID NO: 6083096 - DNA, 19 bp, Homo sapiens
cccgtgtgtgtgtatgtgt

SEQ ID NO: 6083097 - DNA, 21 bp, Homo sapiens
cccgtgtgtgtgtatgtgtgt

SEQ ID NO: 6083098 - DNA, 16 bp, Homo sapiens
cccgtgttcacaccat

SEQ ID NO: 6083099 - DNA, 22 bp, Homo sapiens
cccgtgtttgcgcttgaccatg

SEQ ID NO: 6083100 - DNA, 19 bp, Homo sapiens
cccgttagcttcctgcagg

SEQ ID NO: 6083101 - DNA, 17 bp, Homo sapiens
cccgttcccagcgcatg

SEQ ID NO: 6083102 - DNA, 15 bp, Homo sapiens
cccgttgaagccgct

SEQ ID NO: 6083103 - DNA, 13 bp, Homo sapiens
cccgttgggtccc

SEQ ID NO: 6083104 - DNA, 17 bp, Homo sapiens
cccgttgtctccctggc

SEQ ID NO: 6083105 - DNA, 19 bp, Homo sapiens
cccgttgtctccctggccc

SEQ ID NO: 6083106 - DNA, 17 bp, Homo sapiens
cccgtttccctccaggt

SEQ ID NO: 6083107 - DNA, 13 bp, Homo sapiens
cccgtttcttgca

SEQ ID NO: 6083108 - DNA, 23 bp, Homo sapiens
cccgtttggggcttttttttcct

SEQ ID NO: 6083109 - DNA, 12 bp, Homo sapiens
cccgttttcccc

SEQ ID NO: 6083110 - DNA, 14 bp, Homo sapiens
ccctaaaaacaaaa

SEQ ID NO: 6083111 - DNA, 21 bp, Homo sapiens
ccctaaaaacaaaacaaacac

SEQ ID NO: 6083112 - DNA, 20 bp, Homo sapiens
ccctaaaagaaaccctgcac

SEQ ID NO: 6083113 - DNA, 20 bp, Homo sapiens
ccctaaaagcactcctgctt

SEQ ID NO: 6083114 - DNA, 11 bp, Homo sapiens
ccctaaaataa

SEQ ID NO: 6083115 - DNA, 18 bp, Homo sapiens
ccctaaaatactattgga

SEQ ID NO: 6083116 - DNA, 20 bp, Homo sapiens
ccctaaaatggcgaacatgt

SEQ ID NO: 6083117 - DNA, 22 bp, Homo sapiens
ccctaaaatggcgaacatgtgt

SEQ ID NO: 6083118 - DNA, 23 bp, Homo sapiens
ccctaaactccaggatttataaa

SEQ ID NO: 6083119 - DNA, 22 bp, Homo sapiens
ccctaaactgcagcctctctgg

SEQ ID NO: 6083120 - DNA, 13 bp, Homo sapiens
ccctaaagccctc

SEQ ID NO: 6083121 - DNA, 17 bp, Homo sapiens
ccctaaagccctcttca

SEQ ID NO: 6083122 - DNA, 13 bp, Homo sapiens
ccctaaagcctca

SEQ ID NO: 6083123 - DNA, 17 bp, Homo sapiens
ccctaaagtctcaggtg

SEQ ID NO: 6083124 - DNA, 17 bp, Homo sapiens
ccctaaagtgtattttt

SEQ ID NO: 6083125 - DNA, 23 bp, Homo sapiens
ccctaaatatacatctgtgtatt

SEQ ID NO: 6083126 - DNA, 21 bp, Homo sapiens
ccctaaccccttccagatcac

SEQ ID NO: 6083127 - DNA, 16 bp, Homo sapiens
ccctaaccccttgtcc

SEQ ID NO: 6083128 - DNA, 14 bp, Homo sapiens
ccctaaccctttgt

SEQ ID NO: 6083129 - DNA, 22 bp, Homo sapiens
ccctaacgggggtgcggcagga

SEQ ID NO: 6083130 - DNA, 23 bp, Homo sapiens
ccctaacgggggtgcggcaggag

SEQ ID NO: 6083131 - DNA, 13 bp, Homo sapiens
ccctaactcctat

SEQ ID NO: 6083132 - DNA, 19 bp, Homo sapiens
ccctaactcctgcctatga

SEQ ID NO: 6083133 - DNA, 13 bp, Homo sapiens
ccctaactcttgc

SEQ ID NO: 6083134 - DNA, 14 bp, Homo sapiens
ccctaactcttgct

SEQ ID NO: 6083135 - DNA, 23 bp, Homo sapiens
ccctaactgagctgccagtgggg

SEQ ID NO: 6083136 - DNA, 20 bp, Homo sapiens
ccctaacttcgtattttttg

SEQ ID NO: 6083137 - DNA, 11 bp, Homo sapiens
ccctaacttct

SEQ ID NO: 6083138 - DNA, 20 bp, Homo sapiens
ccctaacttgtgaagacaat

SEQ ID NO: 6083139 - DNA, 20 bp, Homo sapiens
ccctaactttcttgcttcaa

SEQ ID NO: 6083140 - DNA, 17 bp, Homo sapiens
ccctaagaattcccaga

SEQ ID NO: 6083141 - DNA, 15 bp, Homo sapiens
ccctaagactgcctt

SEQ ID NO: 6083142 - DNA, 17 bp, Homo sapiens
ccctaagccagctgccc

SEQ ID NO: 6083143 - DNA, 23 bp, Homo sapiens
ccctaagcccccagggcctccag

SEQ ID NO: 6083144 - DNA, 17 bp, Homo sapiens
ccctaagcctgtcccca

SEQ ID NO: 6083145 - DNA, 20 bp, Homo sapiens
ccctaagctggctgtacctg

SEQ ID NO: 6083146 - DNA, 21 bp, Homo sapiens
ccctaagctggggacagagaa

SEQ ID NO: 6083147 - DNA, 19 bp, Homo sapiens
ccctaaggatctctcagga

SEQ ID NO: 6083148 - DNA, 20 bp, Homo sapiens
ccctaaggcatgtgtgaaac

SEQ ID NO: 6083149 - DNA, 13 bp, Homo sapiens
ccctaagggcagc

SEQ ID NO: 6083150 - DNA, 15 bp, Homo sapiens
ccctaagggcagccc

SEQ ID NO: 6083151 - DNA, 22 bp, Homo sapiens
ccctaagtcacatatcagaata

SEQ ID NO: 6083152 - DNA, 20 bp, Homo sapiens
ccctaagtccaactactaaa

SEQ ID NO: 6083153 - DNA, 21 bp, Homo sapiens
ccctaagtgatttccacaggt

SEQ ID NO: 6083154 - DNA, 21 bp, Homo sapiens
ccctaagtgcaaacacagcat

SEQ ID NO: 6083155 - DNA, 13 bp, Homo sapiens
ccctaagtgccca

SEQ ID NO: 6083156 - DNA, 17 bp, Homo sapiens
ccctaagtggctgcctt

SEQ ID NO: 6083157 - DNA, 15 bp, Homo sapiens
ccctaataaagctgt

SEQ ID NO: 6083158 - DNA, 15 bp, Homo sapiens
ccctaatctatggtc

SEQ ID NO: 6083159 - DNA, 21 bp, Homo sapiens
ccctaattcagccatgtacag

SEQ ID NO: 6083160 - DNA, 22 bp, Homo sapiens
ccctaattcagccatgtacaga

SEQ ID NO: 6083161 - DNA, 19 bp, Homo sapiens
ccctaattctcttcgctgt

SEQ ID NO: 6083162 - DNA, 20 bp, Homo sapiens
ccctaattctcttcgctgtg

SEQ ID NO: 6083163 - DNA, 19 bp, Homo sapiens
ccctaatttaacccagctc

SEQ ID NO: 6083164 - DNA, 12 bp, Homo sapiens
ccctacacacac

SEQ ID NO: 6083165 - DNA, 16 bp, Homo sapiens
ccctacacacacactc

SEQ ID NO: 6083166 - DNA, 21 bp, Homo sapiens
ccctacacacacactccctgc

SEQ ID NO: 6083167 - DNA, 16 bp, Homo sapiens
ccctacacacacccag

SEQ ID NO: 6083168 - DNA, 15 bp, Homo sapiens
ccctacacacagacc

SEQ ID NO: 6083169 - DNA, 18 bp, Homo sapiens
ccctacacccagacccca

SEQ ID NO: 6083170 - DNA, 18 bp, Homo sapiens
ccctacacccctcccctg

SEQ ID NO: 6083171 - DNA, 19 bp, Homo sapiens
ccctacacctctgggccct

SEQ ID NO: 6083172 - DNA, 13 bp, Homo sapiens
ccctacaccttga

SEQ ID NO: 6083173 - DNA, 13 bp, Homo sapiens
ccctacagcctag

SEQ ID NO: 6083174 - DNA, 23 bp, Homo sapiens
ccctacagcctgcacacacctgc

SEQ ID NO: 6083175 - DNA, 12 bp, Homo sapiens
ccctacaggagg

SEQ ID NO: 6083176 - DNA, 15 bp, Homo sapiens
ccctacatcttcagc

SEQ ID NO: 6083177 - DNA, 20 bp, Homo sapiens
ccctacatcttcagctccca

SEQ ID NO: 6083178 - DNA, 16 bp, Homo sapiens
ccctacattagtaaaa

SEQ ID NO: 6083179 - DNA, 19 bp, Homo sapiens
ccctaccacctccccagcc

SEQ ID NO: 6083180 - DNA, 22 bp, Homo sapiens
ccctaccactgagcccttgcac

SEQ ID NO: 6083181 - DNA, 22 bp, Homo sapiens
ccctaccagcgcccgctgggct

SEQ ID NO: 6083182 - DNA, 23 bp, Homo sapiens
ccctaccagctcctccagccctg

SEQ ID NO: 6083183 - DNA, 19 bp, Homo sapiens
ccctacccaatgtctccca

SEQ ID NO: 6083184 - DNA, 20 bp, Homo sapiens
ccctacccacagggcctgac

SEQ ID NO: 6083185 - DNA, 12 bp, Homo sapiens
ccctacccaccg

SEQ ID NO: 6083186 - DNA, 18 bp, Homo sapiens
ccctacccactctttgct

SEQ ID NO: 6083187 - DNA, 14 bp, Homo sapiens
ccctacccatatcc

SEQ ID NO: 6083188 - DNA, 14 bp, Homo sapiens
ccctaccccaccac

SEQ ID NO: 6083189 - DNA, 12 bp, Homo sapiens
ccctaccccctc

SEQ ID NO: 6083190 - DNA, 21 bp, Homo sapiens
ccctaccccctcatcccccag

SEQ ID NO: 6083191 - DNA, 13 bp, Homo sapiens
ccctacccctgcc

SEQ ID NO: 6083192 - DNA, 23 bp, Homo sapiens
ccctacccctggctgtactgctc

SEQ ID NO: 6083193 - DNA, 17 bp, Homo sapiens
ccctaccctcctgctga

SEQ ID NO: 6083194 - DNA, 20 bp, Homo sapiens
ccctaccctcctgctgagct

SEQ ID NO: 6083195 - DNA, 15 bp, Homo sapiens
ccctaccctgcacat

SEQ ID NO: 6083196 - DNA, 21 bp, Homo sapiens
ccctaccgagtctcttctcca

SEQ ID NO: 6083197 - DNA, 18 bp, Homo sapiens
ccctaccgatggtcccag

SEQ ID NO: 6083198 - DNA, 18 bp, Homo sapiens
ccctaccgcatggcagct

SEQ ID NO: 6083199 - DNA, 15 bp, Homo sapiens
ccctacctccctcct

SEQ ID NO: 6083200 - DNA, 17 bp, Homo sapiens
ccctacctccctcctca

SEQ ID NO: 6083201 - DNA, 14 bp, Homo sapiens
ccctacctgcccca

SEQ ID NO: 6083202 - DNA, 13 bp, Homo sapiens
ccctacctgcctg

SEQ ID NO: 6083203 - DNA, 12 bp, Homo sapiens
ccctacctgctt

SEQ ID NO: 6083204 - DNA, 16 bp, Homo sapiens
cctctgtccctctttg

SEQ ID NO: 6083205 - DNA, 23 bp, Homo sapiens
cctctgtccgcctttacaaggga

SEQ ID NO: 6083206 - DNA, 18 bp, Homo sapiens
cctctgtccgtctgtcct

SEQ ID NO: 6083207 - DNA, 21 bp, Homo sapiens
cctctgtccgtctgtcctgcg

SEQ ID NO: 6083208 - DNA, 17 bp, Homo sapiens
cctctgtcctagactcc

SEQ ID NO: 6083209 - DNA, 11 bp, Homo sapiens
cctctgtcctg

SEQ ID NO: 6083210 - DNA, 13 bp, Homo sapiens
cctctgtcctgac

SEQ ID NO: 6083211 - DNA, 19 bp, Homo sapiens
cctctgtcctggctgtgca

SEQ ID NO: 6083212 - DNA, 13 bp, Homo sapiens
cctctgtccttcc

SEQ ID NO: 6083213 - DNA, 20 bp, Homo sapiens
cctctgtccttcccccagca

SEQ ID NO: 6083214 - DNA, 20 bp, Homo sapiens
cctctgtctagcatgccaac

SEQ ID NO: 6083215 - DNA, 21 bp, Homo sapiens
cctctgtctagcatgccaaca

SEQ ID NO: 6083216 - DNA, 21 bp, Homo sapiens
cctctgtctaggactgcagtg

SEQ ID NO: 6083217 - DNA, 12 bp, Homo sapiens
cctctgtctcat

SEQ ID NO: 6083218 - DNA, 18 bp, Homo sapiens
cctctgtctcatcctcct

SEQ ID NO: 6083219 - DNA, 24 bp, Homo sapiens
cctctgtctcatcctcctggaacc

SEQ ID NO: 6083220 - DNA, 22 bp, Homo sapiens
cctctgtctcgagcgccctgca

SEQ ID NO: 6083221 - DNA, 15 bp, Homo sapiens
cctctgtctctgctc

SEQ ID NO: 6083222 - DNA, 18 bp, Homo sapiens
cctctgtctgagacaggt

SEQ ID NO: 6083223 - DNA, 22 bp, Homo sapiens
cctctgtctgcccttcacccca

SEQ ID NO: 6083224 - DNA, 14 bp, Homo sapiens
cctctgtctggagc

SEQ ID NO: 6083225 - DNA, 20 bp, Homo sapiens
cctctgtcttcagcaccctc

SEQ ID NO: 6083226 - DNA, 15 bp, Homo sapiens
cctctgtcttctgga

SEQ ID NO: 6083227 - DNA, 14 bp, Homo sapiens
cctctgtcttttct

SEQ ID NO: 6083228 - DNA, 22 bp, Homo sapiens
cctctgtgaactgtgtgtgaat

SEQ ID NO: 6083229 - DNA, 18 bp, Homo sapiens
cctctgtgaccaatgtct

SEQ ID NO: 6083230 - DNA, 17 bp, Homo sapiens
cctctgtgacctcaggc

SEQ ID NO: 6083231 - DNA, 15 bp, Homo sapiens
cctctgtgattacat

SEQ ID NO: 6083232 - DNA, 22 bp, Homo sapiens
cctctgtgcagacagtgtcaga

SEQ ID NO: 6083233 - DNA, 11 bp, Homo sapiens
cctctgtgcca

SEQ ID NO: 6083234 - DNA, 14 bp, Homo sapiens
cctctgtgccacgc

SEQ ID NO: 6083235 - DNA, 16 bp, Homo sapiens
cctctgtgcctaataa

SEQ ID NO: 6083236 - DNA, 14 bp, Homo sapiens
cctctgtgctccct

SEQ ID NO: 6083237 - DNA, 20 bp, Homo sapiens
cctctgtgctccctcggtca

SEQ ID NO: 6083238 - DNA, 22 bp, Homo sapiens
cctctgtgctccctcggtcacc

SEQ ID NO: 6083239 - DNA, 21 bp, Homo sapiens
cctctgtgctgtgtatgtgaa

SEQ ID NO: 6083240 - DNA, 15 bp, Homo sapiens
cctctgtgctgtgtg

SEQ ID NO: 6083241 - DNA, 11 bp, Homo sapiens
cctctgtggaa

SEQ ID NO: 6083242 - DNA, 13 bp, Homo sapiens
cctctgtggccag

SEQ ID NO: 6083243 - DNA, 14 bp, Homo sapiens
cctctgtggccagc

SEQ ID NO: 6083244 - DNA, 13 bp, Homo sapiens
cctctgtggcctg

SEQ ID NO: 6083245 - DNA, 19 bp, Homo sapiens
cctctgtggtcacagaggg

SEQ ID NO: 6083246 - DNA, 18 bp, Homo sapiens
cctctgtgtagccgccct

SEQ ID NO: 6083247 - DNA, 22 bp, Homo sapiens
cctctgtgtagccgccctgaga

SEQ ID NO: 6083248 - DNA, 16 bp, Homo sapiens
cctctgtgtcactggc

SEQ ID NO: 6083249 - DNA, 19 bp, Homo sapiens
cctctgtgtcactggctgc

SEQ ID NO: 6083250 - DNA, 14 bp, Homo sapiens
cctctgtgtctgct

SEQ ID NO: 6083251 - DNA, 18 bp, Homo sapiens
cctctgtgtctgctctca

SEQ ID NO: 6083252 - DNA, 23 bp, Homo sapiens
cctctgttaggtccattttctaa

SEQ ID NO: 6083253 - DNA, 16 bp, Homo sapiens
cctctgttagtgccgc

SEQ ID NO: 6083254 - DNA, 21 bp, Homo sapiens
cctctgttcacaaactacctc

SEQ ID NO: 6083255 - DNA, 23 bp, Homo sapiens
cctctgttcagttcattcccaga

SEQ ID NO: 6083256 - DNA, 13 bp, Homo sapiens
cctctgttcattt

SEQ ID NO: 6083257 - DNA, 22 bp, Homo sapiens
cctctgttcctttctctgggct

SEQ ID NO: 6083258 - DNA, 15 bp, Homo sapiens
cctctgttctctccc

SEQ ID NO: 6083259 - DNA, 22 bp, Homo sapiens
cctctgttctctcccctcacat

SEQ ID NO: 6083260 - DNA, 18 bp, Homo sapiens
cctctgttctggtggccc

SEQ ID NO: 6083261 - DNA, 19 bp, Homo sapiens
cctctgttctggtggcccc

SEQ ID NO: 6083262 - DNA, 20 bp, Homo sapiens
cctctgttctggtggcccca

SEQ ID NO: 6083263 - DNA, 20 bp, Homo sapiens
cctctgttgcaaactcagtt

SEQ ID NO: 6083264 - DNA, 19 bp, Homo sapiens
cctctgttgccaaggctgg

SEQ ID NO: 6083265 - DNA, 21 bp, Homo sapiens
cctctgtttgacaaacctcta

SEQ ID NO: 6083266 - DNA, 18 bp, Homo sapiens
cctctgttttctctctgt

SEQ ID NO: 6083267 - DNA, 17 bp, Homo sapiens
cctcttaaaaaataaaa

SEQ ID NO: 6083268 - DNA, 21 bp, Homo sapiens
cctcttaaagaaaacccaccc

SEQ ID NO: 6083269 - DNA, 17 bp, Homo sapiens
cctcttaagacactagt

SEQ ID NO: 6083270 - DNA, 20 bp, Homo sapiens
cctcttaccagtatttaact

SEQ ID NO: 6083271 - DNA, 23 bp, Homo sapiens
cctcttaccagtatttaacttct

SEQ ID NO: 6083272 - DNA, 18 bp, Homo sapiens
cctcttaccgtagcctcc

SEQ ID NO: 6083273 - DNA, 22 bp, Homo sapiens
cctcttaccttcccgcctcggc

SEQ ID NO: 6083274 - DNA, 19 bp, Homo sapiens
cctcttacggtagttagga

SEQ ID NO: 6083275 - DNA, 17 bp, Homo sapiens
cctcttactttgcttga

SEQ ID NO: 6083276 - DNA, 14 bp, Homo sapiens
cctcttagagtcct

SEQ ID NO: 6083277 - DNA, 13 bp, Homo sapiens
cctcttagctcag

SEQ ID NO: 6083278 - DNA, 13 bp, Homo sapiens
cctcttatcaagt

SEQ ID NO: 6083279 - DNA, 19 bp, Homo sapiens
cctcttatcactaagaaag

SEQ ID NO: 6083280 - DNA, 16 bp, Homo sapiens
cctcttcaaagcagag

SEQ ID NO: 6083281 - DNA, 17 bp, Homo sapiens
cctcttcaccaggtgca

SEQ ID NO: 6083282 - DNA, 23 bp, Homo sapiens
cctcttcacccaccccatggaga

SEQ ID NO: 6083283 - DNA, 17 bp, Homo sapiens
cctcttcaccccccact

SEQ ID NO: 6083284 - DNA, 14 bp, Homo sapiens
cctcttcactcccc

SEQ ID NO: 6083285 - DNA, 22 bp, Homo sapiens
cctcttcactgtggccacagcc

SEQ ID NO: 6083286 - DNA, 13 bp, Homo sapiens
cctcttcagaact

SEQ ID NO: 6083287 - DNA, 14 bp, Homo sapiens
cctcttcagaactt

SEQ ID NO: 6083288 - DNA, 16 bp, Homo sapiens
cctcttcagaggccct

SEQ ID NO: 6083289 - DNA, 13 bp, Homo sapiens
cctcttcagctgc

SEQ ID NO: 6083290 - DNA, 19 bp, Homo sapiens
cctcttcaggggtcacctc

SEQ ID NO: 6083291 - DNA, 20 bp, Homo sapiens
cctcttcattccggggaaca

SEQ ID NO: 6083292 - DNA, 18 bp, Homo sapiens
cctcttccaaaggcagcg

SEQ ID NO: 6083293 - DNA, 15 bp, Homo sapiens
cctcttccacccatt

SEQ ID NO: 6083294 - DNA, 14 bp, Homo sapiens
cctcttccagcttc

SEQ ID NO: 6083295 - DNA, 20 bp, Homo sapiens
cctcttccaggaagcacagg

SEQ ID NO: 6083296 - DNA, 22 bp, Homo sapiens
cctcttccaggaagcacaggcc

SEQ ID NO: 6083297 - DNA, 14 bp, Homo sapiens
cctcttccagtctt

SEQ ID NO: 6083298 - DNA, 13 bp, Homo sapiens
cctcttcccatga

SEQ ID NO: 6083299 - DNA, 17 bp, Homo sapiens
cctcttcccatgactgc

SEQ ID NO: 6083300 - DNA, 23 bp, Homo sapiens
cctcttcccatgtcccaccctcc

SEQ ID NO: 6083301 - DNA, 11 bp, Homo sapiens
cctcttcccca

SEQ ID NO: 6083302 - DNA, 12 bp, Homo sapiens
cctcttccccac

SEQ ID NO: 6083303 - DNA, 15 bp, Homo sapiens
cctcttcccccaaga

SEQ ID NO: 6083304 - DNA, 14 bp, Homo sapiens
cctcttcccccttc

SEQ ID NO: 6083305 - DNA, 15 bp, Homo sapiens
cctcttcccccttcc

SEQ ID NO: 6083306 - DNA, 21 bp, Homo sapiens
cctcttcccccttcccctgcg

SEQ ID NO: 6083307 - DNA, 15 bp, Homo sapiens
cctcttccccttgcc

SEQ ID NO: 6083308 - DNA, 14 bp, Homo sapiens
cctcttccctctga

SEQ ID NO: 6083309 - DNA, 15 bp, Homo sapiens
cctcttccctctggg

SEQ ID NO: 6083310 - DNA, 19 bp, Homo sapiens
cctcttccctctgggcctg

SEQ ID NO: 6083311 - DNA, 20 bp, Homo sapiens
cctcttcccttagcctctcc

SEQ ID NO: 6083312 - DNA, 20 bp, Homo sapiens
cctcttcccttcctccattg

SEQ ID NO: 6083313 - DNA, 21 bp, Homo sapiens
cctcttcccttcctccattgc

SEQ ID NO: 6083314 - DNA, 14 bp, Homo sapiens
cctcttcctaccct

SEQ ID NO: 6083315 - DNA, 20 bp, Homo sapiens
cctcttcctaccctgcctcc

SEQ ID NO: 6083316 - DNA, 17 bp, Homo sapiens
cctcttcctccccatgt

SEQ ID NO: 6083317 - DNA, 13 bp, Homo sapiens
cctcttcctcctg

SEQ ID NO: 6083318 - DNA, 15 bp, Homo sapiens
cctcttcctctgagg

SEQ ID NO: 6083319 - DNA, 15 bp, Homo sapiens
cctcttcctctgggc

SEQ ID NO: 6083320 - DNA, 16 bp, Homo sapiens
cctcttcctcttgacc

SEQ ID NO: 6083321 - DNA, 15 bp, Homo sapiens
cctcttcctgccctt

SEQ ID NO: 6083322 - DNA, 16 bp, Homo sapiens
cctcttcctgcccttg

SEQ ID NO: 6083323 - DNA, 20 bp, Homo sapiens
cctcttcctggagccccaga

SEQ ID NO: 6083324 - DNA, 23 bp, Homo sapiens
cctcttccttccctgctgtgaaa

SEQ ID NO: 6083325 - DNA, 13 bp, Homo sapiens
cctcttccttctc

SEQ ID NO: 6083326 - DNA, 15 bp, Homo sapiens
cctcttcggccctca

SEQ ID NO: 6083327 - DNA, 20 bp, Homo sapiens
cctcttctaaaatagcaata

SEQ ID NO: 6083328 - DNA, 14 bp, Homo sapiens
cctcttctaactca

SEQ ID NO: 6083329 - DNA, 23 bp, Homo sapiens
cctcttctaccctcatcatcata

SEQ ID NO: 6083330 - DNA, 21 bp, Homo sapiens
cctcttctactcacttttccc

SEQ ID NO: 6083331 - DNA, 20 bp, Homo sapiens
cctcttctacttgtaaaatg

SEQ ID NO: 6083332 - DNA, 20 bp, Homo sapiens
cctcttctagatggacccca

SEQ ID NO: 6083333 - DNA, 18 bp, Homo sapiens
cctcttctcaactttttt

SEQ ID NO: 6083334 - DNA, 14 bp, Homo sapiens
cctcttctcaagtg

SEQ ID NO: 6083335 - DNA, 18 bp, Homo sapiens
cctcttctcaagtgcctt

SEQ ID NO: 6083336 - DNA, 13 bp, Homo sapiens
cctcttctcagct

SEQ ID NO: 6083337 - DNA, 17 bp, Homo sapiens
cctcttctcagctccac

SEQ ID NO: 6083338 - DNA, 18 bp, Homo sapiens
cctcttctcagctccact

SEQ ID NO: 6083339 - DNA, 12 bp, Homo sapiens
cctcttctcctt

SEQ ID NO: 6083340 - DNA, 20 bp, Homo sapiens
cctcttctccttgccttgct

SEQ ID NO: 6083341 - DNA, 19 bp, Homo sapiens
cctcttctcgtgcctcccc

SEQ ID NO: 6083342 - DNA, 21 bp, Homo sapiens
cctcttctctcctcccctaca

SEQ ID NO: 6083343 - DNA, 12 bp, Homo sapiens
cctcttctcttc

SEQ ID NO: 6083344 - DNA, 14 bp, Homo sapiens
cctcttctcttcct

SEQ ID NO: 6083345 - DNA, 16 bp, Homo sapiens
cctcttctgacactaa

SEQ ID NO: 6083346 - DNA, 18 bp, Homo sapiens
cctcttctgacgtgcctt

SEQ ID NO: 6083347 - DNA, 20 bp, Homo sapiens
cctcttctgacgtgcctttt

SEQ ID NO: 6083348 - DNA, 16 bp, Homo sapiens
cctcttctgccaagag

SEQ ID NO: 6083349 - DNA, 16 bp, Homo sapiens
cctcttctgctctttt

SEQ ID NO: 6083350 - DNA, 21 bp, Homo sapiens
cctcttctgctcttttcctgg

SEQ ID NO: 6083351 - DNA, 13 bp, Homo sapiens
cctcttcttccct

SEQ ID NO: 6083352 - DNA, 21 bp, Homo sapiens
cctcttctttcagacttgcca

SEQ ID NO: 6083353 - DNA, 23 bp, Homo sapiens
cctcttctttcagacttgccatg

SEQ ID NO: 6083354 - DNA, 12 bp, Homo sapiens
cctcttctttgt

SEQ ID NO: 6083355 - DNA, 11 bp, Homo sapiens
cctcttctttt

SEQ ID NO: 6083356 - DNA, 16 bp, Homo sapiens
cctcttgaaacctgat

SEQ ID NO: 6083357 - DNA, 16 bp, Homo sapiens
cctcttgaatttttga

SEQ ID NO: 6083358 - DNA, 13 bp, Homo sapiens
cctcttgaccagg

SEQ ID NO: 6083359 - DNA, 20 bp, Homo sapiens
cctcttgaccaggctgcctc

SEQ ID NO: 6083360 - DNA, 16 bp, Homo sapiens
cctcttgagcagtggc

SEQ ID NO: 6083361 - DNA, 17 bp, Homo sapiens
cctcttgagcagtggct

SEQ ID NO: 6083362 - DNA, 19 bp, Homo sapiens
cctcttgagctgaagtaat

SEQ ID NO: 6083363 - DNA, 19 bp, Homo sapiens
cctcttgagttcctctgca

SEQ ID NO: 6083364 - DNA, 14 bp, Homo sapiens
cctcttgcatttca

SEQ ID NO: 6083365 - DNA, 20 bp, Homo sapiens
cctcttgccagcctccttgc

SEQ ID NO: 6083366 - DNA, 16 bp, Homo sapiens
cctcttgccatcctga

SEQ ID NO: 6083367 - DNA, 12 bp, Homo sapiens
cctcttgcccca

SEQ ID NO: 6083368 - DNA, 16 bp, Homo sapiens
cctcttgccccccacc

SEQ ID NO: 6083369 - DNA, 19 bp, Homo sapiens
cctcttgcccgtcggccct

SEQ ID NO: 6083370 - DNA, 12 bp, Homo sapiens
cctcttgccctt

SEQ ID NO: 6083371 - DNA, 10 bp, Homo sapiens
cctcttgcct

SEQ ID NO: 6083372 - DNA, 17 bp, Homo sapiens
cctcttgcctctctcag

SEQ ID NO: 6083373 - DNA, 18 bp, Homo sapiens
cctcttgcggtcccttct

SEQ ID NO: 6083374 - DNA, 17 bp, Homo sapiens
cctcttgctcagagcta

SEQ ID NO: 6083375 - DNA, 14 bp, Homo sapiens
cctcttgctgccag

SEQ ID NO: 6083376 - DNA, 12 bp, Homo sapiens
cctcttgctgtc

SEQ ID NO: 6083377 - DNA, 13 bp, Homo sapiens
cctcttgctgtct

SEQ ID NO: 6083378 - DNA, 21 bp, Homo sapiens
cctcttggacctctgctctga

SEQ ID NO: 6083379 - DNA, 19 bp, Homo sapiens
cctcttggagaagtctcag

SEQ ID NO: 6083380 - DNA, 12 bp, Homo sapiens
cctcttggagac

SEQ ID NO: 6083381 - DNA, 20 bp, Homo sapiens
cctcttggataccagctcag

SEQ ID NO: 6083382 - DNA, 22 bp, Homo sapiens
cctcttggataccagctcaggg

SEQ ID NO: 6083383 - DNA, 22 bp, Homo sapiens
cctcttggccatccttctgtgt

SEQ ID NO: 6083384 - DNA, 14 bp, Homo sapiens
ccctacctggggaa

SEQ ID NO: 6083385 - DNA, 20 bp, Homo sapiens
ccctacgatgggatcattat

SEQ ID NO: 6083386 - DNA, 14 bp, Homo sapiens
ccctacggaccagg

SEQ ID NO: 6083387 - DNA, 20 bp, Homo sapiens
ccctactacccattgttccc

SEQ ID NO: 6083388 - DNA, 22 bp, Homo sapiens
ccctactcattggggttccgca

SEQ ID NO: 6083389 - DNA, 21 bp, Homo sapiens
ccctactccactgccctggca

SEQ ID NO: 6083390 - DNA, 16 bp, Homo sapiens
ccctactccctgcaga

SEQ ID NO: 6083391 - DNA, 18 bp, Homo sapiens
ccctactgaaccctgcct

SEQ ID NO: 6083392 - DNA, 22 bp, Homo sapiens
ccctactgagtactctttctct

SEQ ID NO: 6083393 - DNA, 14 bp, Homo sapiens
ccctactgctgtga

SEQ ID NO: 6083394 - DNA, 17 bp, Homo sapiens
ccctactgctgtgaacc

SEQ ID NO: 6083395 - DNA, 23 bp, Homo sapiens
ccctacttaggaaatactcagca

SEQ ID NO: 6083396 - DNA, 18 bp, Homo sapiens
ccctacttccaagaaaaa

SEQ ID NO: 6083397 - DNA, 18 bp, Homo sapiens
ccctacttcttttgctct

SEQ ID NO: 6083398 - DNA, 15 bp, Homo sapiens
ccctactttgcttcc

SEQ ID NO: 6083399 - DNA, 22 bp, Homo sapiens
ccctactttgcttccgccactc

SEQ ID NO: 6083400 - DNA, 20 bp, Homo sapiens
ccctagaaagccatattcca

SEQ ID NO: 6083401 - DNA, 17 bp, Homo sapiens
ccctagaaaggagagaa

SEQ ID NO: 6083402 - DNA, 21 bp, Homo sapiens
ccctagaaatatatcctgtgt

SEQ ID NO: 6083403 - DNA, 14 bp, Homo sapiens
ccctagaagaaaac

SEQ ID NO: 6083404 - DNA, 15 bp, Homo sapiens
ccctagaagaaaacc

SEQ ID NO: 6083405 - DNA, 21 bp, Homo sapiens
ccctagaagagcacagagccc

SEQ ID NO: 6083406 - DNA, 21 bp, Homo sapiens
ccctagaataatctcatcccc

SEQ ID NO: 6083407 - DNA, 21 bp, Homo sapiens
ccctagaattccttttataag

SEQ ID NO: 6083408 - DNA, 13 bp, Homo sapiens
ccctagaccctcc

SEQ ID NO: 6083409 - DNA, 20 bp, Homo sapiens
ccctagaccctcccccacca

SEQ ID NO: 6083410 - DNA, 21 bp, Homo sapiens
ccctagagacagtgatgcctg

SEQ ID NO: 6083411 - DNA, 23 bp, Homo sapiens
ccctagagacagtgatgcctgcc

SEQ ID NO: 6083412 - DNA, 13 bp, Homo sapiens
ccctagagagaat

SEQ ID NO: 6083413 - DNA, 17 bp, Homo sapiens
ccctagagagaataaat

SEQ ID NO: 6083414 - DNA, 19 bp, Homo sapiens
ccctagagagaataaattg

SEQ ID NO: 6083415 - DNA, 21 bp, Homo sapiens
ccctagaggcgagccaggcaa

SEQ ID NO: 6083416 - DNA, 19 bp, Homo sapiens
ccctagagggttcctgtag

SEQ ID NO: 6083417 - DNA, 14 bp, Homo sapiens
ccctagagtcccag

SEQ ID NO: 6083418 - DNA, 16 bp, Homo sapiens
ccctagagtgttgttg

SEQ ID NO: 6083419 - DNA, 22 bp, Homo sapiens
ccctagatctttctattccaaa

SEQ ID NO: 6083420 - DNA, 17 bp, Homo sapiens
ccctagatgaagaaaga

SEQ ID NO: 6083421 - DNA, 18 bp, Homo sapiens
ccctagcaatacagggag

SEQ ID NO: 6083422 - DNA, 23 bp, Homo sapiens
ccctagcaggaacttctagctca

SEQ ID NO: 6083423 - DNA, 18 bp, Homo sapiens
ccctagcagtttgcctct

SEQ ID NO: 6083424 - DNA, 13 bp, Homo sapiens
ccctagccaccag

SEQ ID NO: 6083425 - DNA, 16 bp, Homo sapiens
ccctagccaccagtgt

SEQ ID NO: 6083426 - DNA, 17 bp, Homo sapiens
ccctagccagcacttgt

SEQ ID NO: 6083427 - DNA, 14 bp, Homo sapiens
ccctagcccagact

SEQ ID NO: 6083428 - DNA, 21 bp, Homo sapiens
ccctagcccagactctgagct

SEQ ID NO: 6083429 - DNA, 16 bp, Homo sapiens
ccctagcccaggagag

SEQ ID NO: 6083430 - DNA, 17 bp, Homo sapiens
ccctagcccaggagaga

SEQ ID NO: 6083431 - DNA, 18 bp, Homo sapiens
ccctagcccaggagagag

SEQ ID NO: 6083432 - DNA, 14 bp, Homo sapiens
ccctagccctcagc

SEQ ID NO: 6083433 - DNA, 13 bp, Homo sapiens
ccctagccctgct

SEQ ID NO: 6083434 - DNA, 12 bp, Homo sapiens
ccctagccctgg

SEQ ID NO: 6083435 - DNA, 17 bp, Homo sapiens
ccctagcccttccagcc

SEQ ID NO: 6083436 - DNA, 23 bp, Homo sapiens
ccctagcccttccagcctgggac

SEQ ID NO: 6083437 - DNA, 21 bp, Homo sapiens
ccctagcccttctaccccacc

SEQ ID NO: 6083438 - DNA, 19 bp, Homo sapiens
ccctagctcaccaggcctg

SEQ ID NO: 6083439 - DNA, 20 bp, Homo sapiens
ccctagctccacaccctctc

SEQ ID NO: 6083440 - DNA, 14 bp, Homo sapiens
ccctagctcttccc

SEQ ID NO: 6083441 - DNA, 17 bp, Homo sapiens
ccctagctttagaccct

SEQ ID NO: 6083442 - DNA, 21 bp, Homo sapiens
ccctagctttagaccctgggt

SEQ ID NO: 6083443 - DNA, 21 bp, Homo sapiens
ccctagctttatatatggaca

SEQ ID NO: 6083444 - DNA, 21 bp, Homo sapiens
ccctaggactcaggcctgcca

SEQ ID NO: 6083445 - DNA, 23 bp, Homo sapiens
ccctaggactcaggcctgccaat

SEQ ID NO: 6083446 - DNA, 23 bp, Homo sapiens
ccctaggatatgccctcctggtg

SEQ ID NO: 6083447 - DNA, 20 bp, Homo sapiens
ccctaggatcccgtcttcca

SEQ ID NO: 6083448 - DNA, 21 bp, Homo sapiens
ccctaggatcccgtcttccag

SEQ ID NO: 6083449 - DNA, 22 bp, Homo sapiens
ccctaggatcccgtcttccaga

SEQ ID NO: 6083450 - DNA, 16 bp, Homo sapiens
ccctaggatgctgcag

SEQ ID NO: 6083451 - DNA, 18 bp, Homo sapiens
ccctaggatgctgcagca

SEQ ID NO: 6083452 - DNA, 13 bp, Homo sapiens
ccctaggcactga

SEQ ID NO: 6083453 - DNA, 16 bp, Homo sapiens
ccctaggcagcctgca

SEQ ID NO: 6083454 - DNA, 20 bp, Homo sapiens
ccctaggcatactctccagg

SEQ ID NO: 6083455 - DNA, 14 bp, Homo sapiens
ccctaggcgcggtt

SEQ ID NO: 6083456 - DNA, 15 bp, Homo sapiens
ccctaggcgcggttc

SEQ ID NO: 6083457 - DNA, 14 bp, Homo sapiens
ccctaggctgagct

SEQ ID NO: 6083458 - DNA, 20 bp, Homo sapiens
ccctagggactgtcctagcc

SEQ ID NO: 6083459 - DNA, 23 bp, Homo sapiens
ccctagggatttaaagggacacc

SEQ ID NO: 6083460 - DNA, 12 bp, Homo sapiens
ccctagggctca

SEQ ID NO: 6083461 - DNA, 15 bp, Homo sapiens
ccctagggctcagag

SEQ ID NO: 6083462 - DNA, 16 bp, Homo sapiens
ccctagggctgggtgt

SEQ ID NO: 6083463 - DNA, 18 bp, Homo sapiens
ccctaggggacacttccc

SEQ ID NO: 6083464 - DNA, 19 bp, Homo sapiens
ccctaggggacacttccct

SEQ ID NO: 6083465 - DNA, 17 bp, Homo sapiens
ccctagggtgctctgaa

SEQ ID NO: 6083466 - DNA, 21 bp, Homo sapiens
ccctaggtcagcttgctgccc

SEQ ID NO: 6083467 - DNA, 18 bp, Homo sapiens
ccctaggtcatttgtaga

SEQ ID NO: 6083468 - DNA, 19 bp, Homo sapiens
ccctaggtgggtcaactcc

SEQ ID NO: 6083469 - DNA, 24 bp, Homo sapiens
ccctaggtgggtcaactccaaggc

SEQ ID NO: 6083470 - DNA, 12 bp, Homo sapiens
ccctaggttccc

SEQ ID NO: 6083471 - DNA, 15 bp, Homo sapiens
ccctaggttccctgt

SEQ ID NO: 6083472 - DNA, 15 bp, Homo sapiens
ccctagtaaaaatac

SEQ ID NO: 6083473 - DNA, 18 bp, Homo sapiens
ccctagtaagtgccttcc

SEQ ID NO: 6083474 - DNA, 23 bp, Homo sapiens
ccctagtaagtgccttccatgtc

SEQ ID NO: 6083475 - DNA, 18 bp, Homo sapiens
ccctagtatctggctggg

SEQ ID NO: 6083476 - DNA, 22 bp, Homo sapiens
ccctagtatgaaagctgggggt

SEQ ID NO: 6083477 - DNA, 16 bp, Homo sapiens
ccctagtcccttcccc

SEQ ID NO: 6083478 - DNA, 17 bp, Homo sapiens
ccctagtcccttcccct

SEQ ID NO: 6083479 - DNA, 22 bp, Homo sapiens
ccctagtcccttcccctccctg

SEQ ID NO: 6083480 - DNA, 21 bp, Homo sapiens
ccctagtgacccggaggccac

SEQ ID NO: 6083481 - DNA, 22 bp, Homo sapiens
ccctagtggcttcctccgtctg

SEQ ID NO: 6083482 - DNA, 15 bp, Homo sapiens
ccctagttacccacc

SEQ ID NO: 6083483 - DNA, 17 bp, Homo sapiens
ccctagttacccaccct

SEQ ID NO: 6083484 - DNA, 17 bp, Homo sapiens
ccctagttattttctga

SEQ ID NO: 6083485 - DNA, 12 bp, Homo sapiens
ccctagttcagg

SEQ ID NO: 6083486 - DNA, 16 bp, Homo sapiens
ccctagttcaggtcca

SEQ ID NO: 6083487 - DNA, 23 bp, Homo sapiens
ccctagttttctttcctcctttc

SEQ ID NO: 6083488 - DNA, 11 bp, Homo sapiens
ccctataaatc

SEQ ID NO: 6083489 - DNA, 23 bp, Homo sapiens
ccctatactgcttggagctgagc

SEQ ID NO: 6083490 - DNA, 13 bp, Homo sapiens
ccctatagagagg

SEQ ID NO: 6083491 - DNA, 18 bp, Homo sapiens
ccctatagagagggggct

SEQ ID NO: 6083492 - DNA, 23 bp, Homo sapiens
ccctatagtttcaccactcctct

SEQ ID NO: 6083493 - DNA, 20 bp, Homo sapiens
ccctatcaaaacatatcaat

SEQ ID NO: 6083494 - DNA, 18 bp, Homo sapiens
ccctatcagttgattttt

SEQ ID NO: 6083495 - DNA, 16 bp, Homo sapiens
ccctatccacccagcc

SEQ ID NO: 6083496 - DNA, 19 bp, Homo sapiens
ccctatccacccagcccat

SEQ ID NO: 6083497 - DNA, 24 bp, Homo sapiens
ccctatccatggcactaaaccact

SEQ ID NO: 6083498 - DNA, 17 bp, Homo sapiens
ccctatccctgtacaga

SEQ ID NO: 6083499 - DNA, 15 bp, Homo sapiens
ccctatcctgcaccc

SEQ ID NO: 6083500 - DNA, 17 bp, Homo sapiens
ccctatctaaccctccc

SEQ ID NO: 6083501 - DNA, 17 bp, Homo sapiens
ccctatctatgtcctgg

SEQ ID NO: 6083502 - DNA, 20 bp, Homo sapiens
ccctatctattaaagtgact

SEQ ID NO: 6083503 - DNA, 21 bp, Homo sapiens
ccctatctattaaagtgactt

SEQ ID NO: 6083504 - DNA, 13 bp, Homo sapiens
ccctatctcctga

SEQ ID NO: 6083505 - DNA, 20 bp, Homo sapiens
ccctatctccttcccacccc

SEQ ID NO: 6083506 - DNA, 18 bp, Homo sapiens
ccctatcttgtcctggaa

SEQ ID NO: 6083507 - DNA, 14 bp, Homo sapiens
ccctatgctggtag

SEQ ID NO: 6083508 - DNA, 15 bp, Homo sapiens
ccctatgctggtaga

SEQ ID NO: 6083509 - DNA, 13 bp, Homo sapiens
ccctatggagagg

SEQ ID NO: 6083510 - DNA, 18 bp, Homo sapiens
ccctatggctgagccttg

SEQ ID NO: 6083511 - DNA, 17 bp, Homo sapiens
ccctatgggcttccgca

SEQ ID NO: 6083512 - DNA, 17 bp, Homo sapiens
ccctatggggaggccct

SEQ ID NO: 6083513 - DNA, 16 bp, Homo sapiens
ccctatggggatggtc

SEQ ID NO: 6083514 - DNA, 18 bp, Homo sapiens
ccctatggggatggtcca

SEQ ID NO: 6083515 - DNA, 12 bp, Homo sapiens
ccctatgtctgc

SEQ ID NO: 6083516 - DNA, 20 bp, Homo sapiens
ccctattcgtagccatctcc

SEQ ID NO: 6083517 - DNA, 18 bp, Homo sapiens
ccctattctgccatggga

SEQ ID NO: 6083518 - DNA, 22 bp, Homo sapiens
ccctattggcttactgaaagac

SEQ ID NO: 6083519 - DNA, 23 bp, Homo sapiens
ccctattggcttactgaaagaca

SEQ ID NO: 6083520 - DNA, 23 bp, Homo sapiens
ccctatttaacagggtctctagt

SEQ ID NO: 6083521 - DNA, 15 bp, Homo sapiens
ccctatttattgact

SEQ ID NO: 6083522 - DNA, 12 bp, Homo sapiens
ccctattttaag

SEQ ID NO: 6083523 - DNA, 20 bp, Homo sapiens
ccctatttttctctcctgtc

SEQ ID NO: 6083524 - DNA, 17 bp, Homo sapiens
ccctcaaaattgataat

SEQ ID NO: 6083525 - DNA, 15 bp, Homo sapiens
ccctcaaacctcctc

SEQ ID NO: 6083526 - DNA, 20 bp, Homo sapiens
ccctcaaacctcctcttctg

SEQ ID NO: 6083527 - DNA, 18 bp, Homo sapiens
ccctcaaactgcacatct

SEQ ID NO: 6083528 - DNA, 19 bp, Homo sapiens
ccctcaaactgcacatcta

SEQ ID NO: 6083529 - DNA, 15 bp, Homo sapiens
ccctcaaagaggcag

SEQ ID NO: 6083530 - DNA, 15 bp, Homo sapiens
ccctcaaagggagag

SEQ ID NO: 6083531 - DNA, 19 bp, Homo sapiens
ccctcaaagggagagaaaa

SEQ ID NO: 6083532 - DNA, 19 bp, Homo sapiens
ccctcaaatgacccaaaga

SEQ ID NO: 6083533 - DNA, 12 bp, Homo sapiens
ccctcaaatgct

SEQ ID NO: 6083534 - DNA, 18 bp, Homo sapiens
ccctcaacaagggagaga

SEQ ID NO: 6083535 - DNA, 21 bp, Homo sapiens
ccctcaacaagggagagacct

SEQ ID NO: 6083536 - DNA, 17 bp, Homo sapiens
ccctcaagaggaagtga

SEQ ID NO: 6083537 - DNA, 13 bp, Homo sapiens
ccctcaagcccct

SEQ ID NO: 6083538 - DNA, 18 bp, Homo sapiens
ccctcaaggctgtgacct

SEQ ID NO: 6083539 - DNA, 16 bp, Homo sapiens
ccctcaaggggcaggg

SEQ ID NO: 6083540 - DNA, 20 bp, Homo sapiens
ccctcaaggtgcggggagaa

SEQ ID NO: 6083541 - DNA, 17 bp, Homo sapiens
ccctcaatccaccttca

SEQ ID NO: 6083542 - DNA, 18 bp, Homo sapiens
ccctcaatccaccttcag

SEQ ID NO: 6083543 - DNA, 19 bp, Homo sapiens
ccctcaatccaccttcagg

SEQ ID NO: 6083544 - DNA, 22 bp, Homo sapiens
ccctcacacacacccccccaca

SEQ ID NO: 6083545 - DNA, 23 bp, Homo sapiens
ccctcacacacacccccccacaa

SEQ ID NO: 6083546 - DNA, 14 bp, Homo sapiens
ccctcacacaccct

SEQ ID NO: 6083547 - DNA, 13 bp, Homo sapiens
ccctcacactgca

SEQ ID NO: 6083548 - DNA, 15 bp, Homo sapiens
ccctcacactgctcc

SEQ ID NO: 6083549 - DNA, 12 bp, Homo sapiens
ccctcacactgg

SEQ ID NO: 6083550 - DNA, 13 bp, Homo sapiens
ccctcacactggg

SEQ ID NO: 6083551 - DNA, 14 bp, Homo sapiens
ccctcacactggga

SEQ ID NO: 6083552 - DNA, 23 bp, Homo sapiens
ccctcacactttgccatttgctt

SEQ ID NO: 6083553 - DNA, 14 bp, Homo sapiens
ccctcacagactct

SEQ ID NO: 6083554 - DNA, 12 bp, Homo sapiens
ccctcacagcct

SEQ ID NO: 6083555 - DNA, 16 bp, Homo sapiens
ccctcacagcctctga

SEQ ID NO: 6083556 - DNA, 18 bp, Homo sapiens
ccctcacatcctcctgcc

SEQ ID NO: 6083557 - DNA, 12 bp, Homo sapiens
ccctcaccacag

SEQ ID NO: 6083558 - DNA, 14 bp, Homo sapiens
ccctcaccacagcc

SEQ ID NO: 6083559 - DNA, 15 bp, Homo sapiens
ccctcaccacagcct

SEQ ID NO: 6083560 - DNA, 14 bp, Homo sapiens
ccctcaccaccaca

SEQ ID NO: 6083561 - DNA, 14 bp, Homo sapiens
ccctcaccacctct

SEQ ID NO: 6083562 - DNA, 20 bp, Homo sapiens
cctcttggctatttctgtgt

SEQ ID NO: 6083563 - DNA, 21 bp, Homo sapiens
cctcttggctatttctgtgtc

SEQ ID NO: 6083564 - DNA, 23 bp, Homo sapiens
cctcttggctatttctgtgtcca

SEQ ID NO: 6083565 - DNA, 12 bp, Homo sapiens
cctcttggcttt

SEQ ID NO: 6083566 - DNA, 14 bp, Homo sapiens
cctcttggggaagg

SEQ ID NO: 6083567 - DNA, 16 bp, Homo sapiens
cctcttggggaagggg

SEQ ID NO: 6083568 - DNA, 18 bp, Homo sapiens
cctcttgggggcactgct

SEQ ID NO: 6083569 - DNA, 23 bp, Homo sapiens
cctcttggtgtgattgcacagaa

SEQ ID NO: 6083570 - DNA, 17 bp, Homo sapiens
cctcttgtaaagactgg

SEQ ID NO: 6083571 - DNA, 18 bp, Homo sapiens
cctcttgtaaataaagcc

SEQ ID NO: 6083572 - DNA, 18 bp, Homo sapiens
cctcttgtagtcttggct

SEQ ID NO: 6083573 - DNA, 13 bp, Homo sapiens
cctcttgtccctt

SEQ ID NO: 6083574 - DNA, 20 bp, Homo sapiens
cctcttgtcccttggcacac

SEQ ID NO: 6083575 - DNA, 15 bp, Homo sapiens
cctcttgtcctggcc

SEQ ID NO: 6083576 - DNA, 21 bp, Homo sapiens
cctcttgtcctggcccttcag

SEQ ID NO: 6083577 - DNA, 16 bp, Homo sapiens
cctcttgtcctttaat

SEQ ID NO: 6083578 - DNA, 12 bp, Homo sapiens
cctcttgtctcc

SEQ ID NO: 6083579 - DNA, 14 bp, Homo sapiens
cctcttgtctcccc

SEQ ID NO: 6083580 - DNA, 13 bp, Homo sapiens
cctcttgtctgag

SEQ ID NO: 6083581 - DNA, 15 bp, Homo sapiens
cctcttgtgctcagt

SEQ ID NO: 6083582 - DNA, 16 bp, Homo sapiens
cctcttgtgctcagtc

SEQ ID NO: 6083583 - DNA, 14 bp, Homo sapiens
cctcttgtgctgag

SEQ ID NO: 6083584 - DNA, 20 bp, Homo sapiens
cctcttgttcttagggcttg

SEQ ID NO: 6083585 - DNA, 15 bp, Homo sapiens
cctcttgttgcagag

SEQ ID NO: 6083586 - DNA, 22 bp, Homo sapiens
cctcttgtttctgggtccctgc

SEQ ID NO: 6083587 - DNA, 23 bp, Homo sapiens
cctcttgtttctgggtccctgct

SEQ ID NO: 6083588 - DNA, 17 bp, Homo sapiens
cctcttgtttctgtgcc

SEQ ID NO: 6083589 - DNA, 11 bp, Homo sapiens
cctctttaaaa

SEQ ID NO: 6083590 - DNA, 18 bp, Homo sapiens
cctctttaaaacaaaaca

SEQ ID NO: 6083591 - DNA, 18 bp, Homo sapiens
cctctttaacctcatcta

SEQ ID NO: 6083592 - DNA, 22 bp, Homo sapiens
cctctttactcccttcctggcc

SEQ ID NO: 6083593 - DNA, 15 bp, Homo sapiens
cctctttactctggg

SEQ ID NO: 6083594 - DNA, 12 bp, Homo sapiens
cctctttagagt

SEQ ID NO: 6083595 - DNA, 17 bp, Homo sapiens
cctctttagagttagac

SEQ ID NO: 6083596 - DNA, 23 bp, Homo sapiens
cctctttcaagcagtcgtgcctg

SEQ ID NO: 6083597 - DNA, 17 bp, Homo sapiens
cctctttcagaaaacag

SEQ ID NO: 6083598 - DNA, 23 bp, Homo sapiens
cctctttcagaaaacagaaaaaa

SEQ ID NO: 6083599 - DNA, 12 bp, Homo sapiens
cctctttcagct

SEQ ID NO: 6083600 - DNA, 17 bp, Homo sapiens
cctctttccccacctct

SEQ ID NO: 6083601 - DNA, 14 bp, Homo sapiens
cctctttccccact

SEQ ID NO: 6083602 - DNA, 15 bp, Homo sapiens
cctctttcccctcct

SEQ ID NO: 6083603 - DNA, 18 bp, Homo sapiens
cctctttcccctcctttg

SEQ ID NO: 6083604 - DNA, 13 bp, Homo sapiens
cctctttccctcc

SEQ ID NO: 6083605 - DNA, 16 bp, Homo sapiens
cctctttccctccctt

SEQ ID NO: 6083606 - DNA, 15 bp, Homo sapiens
cctctttcccttcca

SEQ ID NO: 6083607 - DNA, 20 bp, Homo sapiens
cctctttcctaacttccttt

SEQ ID NO: 6083608 - DNA, 12 bp, Homo sapiens
cctctttcctct

SEQ ID NO: 6083609 - DNA, 21 bp, Homo sapiens
cctctttcctgtgccaggact

SEQ ID NO: 6083610 - DNA, 22 bp, Homo sapiens
cctctttccttccttcctcctt

SEQ ID NO: 6083611 - DNA, 16 bp, Homo sapiens
cctctttcgtctactg

SEQ ID NO: 6083612 - DNA, 10 bp, Homo sapiens
cctctttcta

SEQ ID NO: 6083613 - DNA, 19 bp, Homo sapiens
cctctttctacagcctaat

SEQ ID NO: 6083614 - DNA, 12 bp, Homo sapiens
cctctttctctc

SEQ ID NO: 6083615 - DNA, 13 bp, Homo sapiens
cctctttctctcc

SEQ ID NO: 6083616 - DNA, 17 bp, Homo sapiens
cctctttctctctgtgt

SEQ ID NO: 6083617 - DNA, 14 bp, Homo sapiens
cctctttcttcaat

SEQ ID NO: 6083618 - DNA, 18 bp, Homo sapiens
cctctttgaatctctgta

SEQ ID NO: 6083619 - DNA, 16 bp, Homo sapiens
cctctttgagtgaagc

SEQ ID NO: 6083620 - DNA, 15 bp, Homo sapiens
cctctttgcatggaa

SEQ ID NO: 6083621 - DNA, 18 bp, Homo sapiens
cctctttgcctgtgtgag

SEQ ID NO: 6083622 - DNA, 17 bp, Homo sapiens
cctctttgcgtttcctt

SEQ ID NO: 6083623 - DNA, 11 bp, Homo sapiens
cctctttgctt

SEQ ID NO: 6083624 - DNA, 13 bp, Homo sapiens
cctctttgctttg

SEQ ID NO: 6083625 - DNA, 14 bp, Homo sapiens
cctctttgctttgc

SEQ ID NO: 6083626 - DNA, 21 bp, Homo sapiens
cctctttgctttgctttctgc

SEQ ID NO: 6083627 - DNA, 18 bp, Homo sapiens
cctctttggcagttgcat

SEQ ID NO: 6083628 - DNA, 14 bp, Homo sapiens
cctctttggctccc

SEQ ID NO: 6083629 - DNA, 18 bp, Homo sapiens
cctctttggctcccctgt

SEQ ID NO: 6083630 - DNA, 20 bp, Homo sapiens
cctctttggctcccctgtac

SEQ ID NO: 6083631 - DNA, 22 bp, Homo sapiens
cctctttggtctacactgtgct

SEQ ID NO: 6083632 - DNA, 16 bp, Homo sapiens
cctctttgtaataaaa

SEQ ID NO: 6083633 - DNA, 22 bp, Homo sapiens
cctctttgtcagtctgggtgtc

SEQ ID NO: 6083634 - DNA, 15 bp, Homo sapiens
cctctttgtctaaaa

SEQ ID NO: 6083635 - DNA, 22 bp, Homo sapiens
cctctttgtctaaaacaataaa

SEQ ID NO: 6083636 - DNA, 23 bp, Homo sapiens
cctctttgtctaaaacaataaaa

SEQ ID NO: 6083637 - DNA, 23 bp, Homo sapiens
cctctttgtgataattctcagta

SEQ ID NO: 6083638 - DNA, 15 bp, Homo sapiens
cctcttttacctgct

SEQ ID NO: 6083639 - DNA, 16 bp, Homo sapiens
cctcttttacctgctg

SEQ ID NO: 6083640 - DNA, 17 bp, Homo sapiens
cctcttttagtcatttt

SEQ ID NO: 6083641 - DNA, 16 bp, Homo sapiens
cctcttttcacatttt

SEQ ID NO: 6083642 - DNA, 16 bp, Homo sapiens
cctcttttccccatga

SEQ ID NO: 6083643 - DNA, 12 bp, Homo sapiens
cctcttttccta

SEQ ID NO: 6083644 - DNA, 13 bp, Homo sapiens
cctcttttcctgc

SEQ ID NO: 6083645 - DNA, 18 bp, Homo sapiens
cctcttttcctggcagct

SEQ ID NO: 6083646 - DNA, 23 bp, Homo sapiens
cctcttttcctggcagctgctgt

SEQ ID NO: 6083647 - DNA, 11 bp, Homo sapiens
cctcttttctt

SEQ ID NO: 6083648 - DNA, 14 bp, Homo sapiens
cctcttttggcctt

SEQ ID NO: 6083649 - DNA, 21 bp, Homo sapiens
cctcttttgttgtccttgccc

SEQ ID NO: 6083650 - DNA, 22 bp, Homo sapiens
cctcttttgttgtccttgcccc

SEQ ID NO: 6083651 - DNA, 19 bp, Homo sapiens
cctctttttaaggacactg

SEQ ID NO: 6083652 - DNA, 17 bp, Homo sapiens
cctctttttcctcctgg

SEQ ID NO: 6083653 - DNA, 13 bp, Homo sapiens
cctctttttcctt

SEQ ID NO: 6083654 - DNA, 14 bp, Homo sapiens
cctctttttccttc

SEQ ID NO: 6083655 - DNA, 18 bp, Homo sapiens
cctctttttctgtgtgag

SEQ ID NO: 6083656 - DNA, 13 bp, Homo sapiens
cctcttttttcgt

SEQ ID NO: 6083657 - DNA, 14 bp, Homo sapiens
cctgaaaaactgat

SEQ ID NO: 6083658 - DNA, 23 bp, Homo sapiens
cctgaaaaactgatcaaaaataa

SEQ ID NO: 6083659 - DNA, 13 bp, Homo sapiens
cctgaaaaaggaa

SEQ ID NO: 6083660 - DNA, 18 bp, Homo sapiens
cctgaaaacactgtgcac

SEQ ID NO: 6083661 - DNA, 19 bp, Homo sapiens
cctgaaaacgaaggggccc

SEQ ID NO: 6083662 - DNA, 14 bp, Homo sapiens
cctgaaaaggaagg

SEQ ID NO: 6083663 - DNA, 15 bp, Homo sapiens
cctgaaaaggaagga

SEQ ID NO: 6083664 - DNA, 20 bp, Homo sapiens
cctgaaaaggaaggaccagg

SEQ ID NO: 6083665 - DNA, 21 bp, Homo sapiens
cctgaaaatgtttttctgcca

SEQ ID NO: 6083666 - DNA, 15 bp, Homo sapiens
cctgaaacaacttgg

SEQ ID NO: 6083667 - DNA, 19 bp, Homo sapiens
cctgaaacacgaaacttgt

SEQ ID NO: 6083668 - DNA, 15 bp, Homo sapiens
cctgaaacactggac

SEQ ID NO: 6083669 - DNA, 16 bp, Homo sapiens
cctgaaacagccatgt

SEQ ID NO: 6083670 - DNA, 20 bp, Homo sapiens
cctgaaacccgccctcaggg

SEQ ID NO: 6083671 - DNA, 23 bp, Homo sapiens
cctgaaacccgccctcaggggcc

SEQ ID NO: 6083672 - DNA, 20 bp, Homo sapiens
cctgaaacgagaagtgccct

SEQ ID NO: 6083673 - DNA, 21 bp, Homo sapiens
cctgaaacgctcctttgtgtg

SEQ ID NO: 6083674 - DNA, 16 bp, Homo sapiens
cctgaaactactgtat

SEQ ID NO: 6083675 - DNA, 14 bp, Homo sapiens
cctgaaactttgag

SEQ ID NO: 6083676 - DNA, 22 bp, Homo sapiens
cctgaaactttgaggataactt

SEQ ID NO: 6083677 - DNA, 23 bp, Homo sapiens
cctgaaactttgaggataacttt

SEQ ID NO: 6083678 - DNA, 14 bp, Homo sapiens
cctgaaagagagga

SEQ ID NO: 6083679 - DNA, 18 bp, Homo sapiens
cctgaaagaggaatgaag

SEQ ID NO: 6083680 - DNA, 15 bp, Homo sapiens
cctgaaagcaacagc

SEQ ID NO: 6083681 - DNA, 22 bp, Homo sapiens
cctgaaagcaacagctggacac

SEQ ID NO: 6083682 - DNA, 14 bp, Homo sapiens
cctgaaagccagca

SEQ ID NO: 6083683 - DNA, 14 bp, Homo sapiens
cctgaaagcctgtc

SEQ ID NO: 6083684 - DNA, 19 bp, Homo sapiens
cctgaaagcctgtctcttt

SEQ ID NO: 6083685 - DNA, 15 bp, Homo sapiens
cctgaaagctgggag

SEQ ID NO: 6083686 - DNA, 16 bp, Homo sapiens
cctgaaagctgggagc

SEQ ID NO: 6083687 - DNA, 19 bp, Homo sapiens
cctgaaagctgggagcgtg

SEQ ID NO: 6083688 - DNA, 12 bp, Homo sapiens
cctgaaagctgt

SEQ ID NO: 6083689 - DNA, 17 bp, Homo sapiens
cctgaaaggaacactgg

SEQ ID NO: 6083690 - DNA, 20 bp, Homo sapiens
cctgaaagggcacttaattt

SEQ ID NO: 6083691 - DNA, 13 bp, Homo sapiens
cctgaaagggccc

SEQ ID NO: 6083692 - DNA, 22 bp, Homo sapiens
cctgaaagggcccttcccctcc

SEQ ID NO: 6083693 - DNA, 24 bp, Homo sapiens
cctgaaagttggggcccagtcctt

SEQ ID NO: 6083694 - DNA, 14 bp, Homo sapiens
cctgaaataaaact

SEQ ID NO: 6083695 - DNA, 22 bp, Homo sapiens
cctgaaataaacactggtgcca

SEQ ID NO: 6083696 - DNA, 15 bp, Homo sapiens
cctgaaataatatat

SEQ ID NO: 6083697 - DNA, 18 bp, Homo sapiens
cctgaaatagtggttctt

SEQ ID NO: 6083698 - DNA, 23 bp, Homo sapiens
cctgaaatatattttaaatgtgg

SEQ ID NO: 6083699 - DNA, 20 bp, Homo sapiens
cctgaaatattttctacttt

SEQ ID NO: 6083700 - DNA, 17 bp, Homo sapiens
cctgaaatgacatttca

SEQ ID NO: 6083701 - DNA, 20 bp, Homo sapiens
cctgaaatgccaagtgcctg

SEQ ID NO: 6083702 - DNA, 20 bp, Homo sapiens
cctgaaattatataaggcat

SEQ ID NO: 6083703 - DNA, 15 bp, Homo sapiens
cctgaaattccaaag

SEQ ID NO: 6083704 - DNA, 16 bp, Homo sapiens
cctgaaattccaaagt

SEQ ID NO: 6083705 - DNA, 18 bp, Homo sapiens
cctgaaattccaaagtct

SEQ ID NO: 6083706 - DNA, 15 bp, Homo sapiens
cctgaaattctgaca

SEQ ID NO: 6083707 - DNA, 14 bp, Homo sapiens
cctgaaatttcacc

SEQ ID NO: 6083708 - DNA, 13 bp, Homo sapiens
cctgaacaagaat

SEQ ID NO: 6083709 - DNA, 16 bp, Homo sapiens
cctgaacactgcttct

SEQ ID NO: 6083710 - DNA, 18 bp, Homo sapiens
cctgaacacttattgctt

SEQ ID NO: 6083711 - DNA, 22 bp, Homo sapiens
cctgaacagcatggcactccct

SEQ ID NO: 6083712 - DNA, 23 bp, Homo sapiens
cctgaacagcatggcactccctc

SEQ ID NO: 6083713 - DNA, 18 bp, Homo sapiens
cctgaacagccctctctc

SEQ ID NO: 6083714 - DNA, 20 bp, Homo sapiens
cctgaacatctgtgtgtgtc

SEQ ID NO: 6083715 - DNA, 13 bp, Homo sapiens
cctgaaccacagc

SEQ ID NO: 6083716 - DNA, 23 bp, Homo sapiens
cctgaaccacaggagaggatggc

SEQ ID NO: 6083717 - DNA, 19 bp, Homo sapiens
cctgaaccacgaggctgcc

SEQ ID NO: 6083718 - DNA, 14 bp, Homo sapiens
cctgaaccatgtgg

SEQ ID NO: 6083719 - DNA, 18 bp, Homo sapiens
cctgaacccacacctggg

SEQ ID NO: 6083720 - DNA, 15 bp, Homo sapiens
cctgaaccccagagg

SEQ ID NO: 6083721 - DNA, 17 bp, Homo sapiens
cctgaaccccagaggca

SEQ ID NO: 6083722 - DNA, 19 bp, Homo sapiens
cctgaaccccagaggcaga

SEQ ID NO: 6083723 - DNA, 21 bp, Homo sapiens
cctgaaccccagaggcagagg

SEQ ID NO: 6083724 - DNA, 17 bp, Homo sapiens
cctgaaccccagggctg

SEQ ID NO: 6083725 - DNA, 15 bp, Homo sapiens
cctgaacccctggcc

SEQ ID NO: 6083726 - DNA, 18 bp, Homo sapiens
cctgaacccctggccagc

SEQ ID NO: 6083727 - DNA, 18 bp, Homo sapiens
cctgaaccgactgaccct

SEQ ID NO: 6083728 - DNA, 16 bp, Homo sapiens
cctgaaccgcacagct

SEQ ID NO: 6083729 - DNA, 18 bp, Homo sapiens
cctgaaccgcacagctca

SEQ ID NO: 6083730 - DNA, 15 bp, Homo sapiens
cctgaacctcagttt

SEQ ID NO: 6083731 - DNA, 22 bp, Homo sapiens
cctgaaccttcctgtctcccag

SEQ ID NO: 6083732 - DNA, 17 bp, Homo sapiens
cctgaaccttgagcaaa

SEQ ID NO: 6083733 - DNA, 18 bp, Homo sapiens
cctgaaccttgagcaaat

SEQ ID NO: 6083734 - DNA, 20 bp, Homo sapiens
cctgaacgttttcttctttc

SEQ ID NO: 6083735 - DNA, 19 bp, Homo sapiens
cctgaactaggtgctggca

SEQ ID NO: 6083736 - DNA, 22 bp, Homo sapiens
cctgaactaggtgctggcatgt

SEQ ID NO: 6083737 - DNA, 23 bp, Homo sapiens
cctgaactatttattaaaaacat

SEQ ID NO: 6083738 - DNA, 13 bp, Homo sapiens
cctgaactccaga

SEQ ID NO: 6083739 - DNA, 20 bp, Homo sapiens
cctgaactcccagtcatgtt

SEQ ID NO: 6083740 - DNA, 14 bp, Homo sapiens
cctgaactcctggc

SEQ ID NO: 6083741 - DNA, 12 bp, Homo sapiens
ccctcacccact

SEQ ID NO: 6083742 - DNA, 17 bp, Homo sapiens
ccctcacccactctggt

SEQ ID NO: 6083743 - DNA, 13 bp, Homo sapiens
ccctcacccatcc

SEQ ID NO: 6083744 - DNA, 17 bp, Homo sapiens
ccctcacccatcctaga

SEQ ID NO: 6083745 - DNA, 14 bp, Homo sapiens
ccctcaccccaatc

SEQ ID NO: 6083746 - DNA, 22 bp, Homo sapiens
ccctcaccccaatccctgccac

SEQ ID NO: 6083747 - DNA, 22 bp, Homo sapiens
ccctcaccccacaatttcttta

SEQ ID NO: 6083748 - DNA, 18 bp, Homo sapiens
ccctcaccccctcctggc

SEQ ID NO: 6083749 - DNA, 22 bp, Homo sapiens
ccctcaccccctcctggcaatc

SEQ ID NO: 6083750 - DNA, 17 bp, Homo sapiens
ccctcaccccctccttc

SEQ ID NO: 6083751 - DNA, 21 bp, Homo sapiens
ccctcaccccctctaagttca

SEQ ID NO: 6083752 - DNA, 17 bp, Homo sapiens
ccctcacccgctgccca

SEQ ID NO: 6083753 - DNA, 16 bp, Homo sapiens
ccctcaccctgcctta

SEQ ID NO: 6083754 - DNA, 15 bp, Homo sapiens
ccctcaccctggggc

SEQ ID NO: 6083755 - DNA, 21 bp, Homo sapiens
ccctcacctacttacccaggt

SEQ ID NO: 6083756 - DNA, 13 bp, Homo sapiens
ccctcacctcagg

SEQ ID NO: 6083757 - DNA, 23 bp, Homo sapiens
ccctcacctcaggaccccagagg

SEQ ID NO: 6083758 - DNA, 15 bp, Homo sapiens
ccctcacctctccag

SEQ ID NO: 6083759 - DNA, 17 bp, Homo sapiens
ccctcacctgcagagaa

SEQ ID NO: 6083760 - DNA, 15 bp, Homo sapiens
ccctcacctgggcac

SEQ ID NO: 6083761 - DNA, 17 bp, Homo sapiens
ccctcacctgggccttt

SEQ ID NO: 6083762 - DNA, 21 bp, Homo sapiens
ccctcaccttggcaccagaca

SEQ ID NO: 6083763 - DNA, 20 bp, Homo sapiens
ccctcacgtttcttccccaa

SEQ ID NO: 6083764 - DNA, 22 bp, Homo sapiens
ccctcactatatattattctcg

SEQ ID NO: 6083765 - DNA, 22 bp, Homo sapiens
ccctcactcaggaaccctggag

SEQ ID NO: 6083766 - DNA, 24 bp, Homo sapiens
ccctcactcaggaaccctggagac

SEQ ID NO: 6083767 - DNA, 14 bp, Homo sapiens
ccctcactccactc

SEQ ID NO: 6083768 - DNA, 17 bp, Homo sapiens
ccctcactccactcccc

SEQ ID NO: 6083769 - DNA, 16 bp, Homo sapiens
ccctcactccccaggg

SEQ ID NO: 6083770 - DNA, 14 bp, Homo sapiens
ccctcactctcagg

SEQ ID NO: 6083771 - DNA, 18 bp, Homo sapiens
ccctcactctgccagggc

SEQ ID NO: 6083772 - DNA, 20 bp, Homo sapiens
ccctcactctgccagggcag

SEQ ID NO: 6083773 - DNA, 16 bp, Homo sapiens
ccctcactctggcctc

SEQ ID NO: 6083774 - DNA, 18 bp, Homo sapiens
ccctcactctgtcagcca

SEQ ID NO: 6083775 - DNA, 17 bp, Homo sapiens
ccctcactgaaggacct

SEQ ID NO: 6083776 - DNA, 16 bp, Homo sapiens
ccctcactggctggac

SEQ ID NO: 6083777 - DNA, 23 bp, Homo sapiens
ccctcactggctggactggaggc

SEQ ID NO: 6083778 - DNA, 13 bp, Homo sapiens
ccctcacttccag

SEQ ID NO: 6083779 - DNA, 17 bp, Homo sapiens
ccctcagaaacactggg

SEQ ID NO: 6083780 - DNA, 18 bp, Homo sapiens
ccctcagaacccttggct

SEQ ID NO: 6083781 - DNA, 23 bp, Homo sapiens
ccctcagaacccttggcttgccc

SEQ ID NO: 6083782 - DNA, 20 bp, Homo sapiens
ccctcagaagaaaacttttg

SEQ ID NO: 6083783 - DNA, 18 bp, Homo sapiens
ccctcagacatctccagt

SEQ ID NO: 6083784 - DNA, 12 bp, Homo sapiens
ccctcagaccca

SEQ ID NO: 6083785 - DNA, 13 bp, Homo sapiens
ccctcagacccag

SEQ ID NO: 6083786 - DNA, 21 bp, Homo sapiens
ccctcagacccaggagtccag

SEQ ID NO: 6083787 - DNA, 13 bp, Homo sapiens
ccctcagagaggc

SEQ ID NO: 6083788 - DNA, 18 bp, Homo sapiens
ccctcagagccctgccct

SEQ ID NO: 6083789 - DNA, 21 bp, Homo sapiens
ccctcagattttatattttct

SEQ ID NO: 6083790 - DNA, 17 bp, Homo sapiens
ccctcagcaccccttcc

SEQ ID NO: 6083791 - DNA, 21 bp, Homo sapiens
ccctcagcaccccttccatgt

SEQ ID NO: 6083792 - DNA, 13 bp, Homo sapiens
ccctcagcagctc

SEQ ID NO: 6083793 - DNA, 21 bp, Homo sapiens
ccctcagccacgcctctctca

SEQ ID NO: 6083794 - DNA, 16 bp, Homo sapiens
ccctcagccccaggag

SEQ ID NO: 6083795 - DNA, 12 bp, Homo sapiens
ccctcagcccct

SEQ ID NO: 6083796 - DNA, 13 bp, Homo sapiens
ccctcagcccctc

SEQ ID NO: 6083797 - DNA, 17 bp, Homo sapiens
ccctcagcccctcttgc

SEQ ID NO: 6083798 - DNA, 21 bp, Homo sapiens
ccctcagcccctcttgccccc

SEQ ID NO: 6083799 - DNA, 13 bp, Homo sapiens
ccctcagccctgg

SEQ ID NO: 6083800 - DNA, 16 bp, Homo sapiens
ccctcagccctggcct

SEQ ID NO: 6083801 - DNA, 18 bp, Homo sapiens
ccctcagccctggccttt

SEQ ID NO: 6083802 - DNA, 12 bp, Homo sapiens
ccctcagccctt

SEQ ID NO: 6083803 - DNA, 13 bp, Homo sapiens
ccctcagcccttg

SEQ ID NO: 6083804 - DNA, 14 bp, Homo sapiens
ccctcagcccttgc

SEQ ID NO: 6083805 - DNA, 19 bp, Homo sapiens
ccctcagccgtcagccatc

SEQ ID NO: 6083806 - DNA, 15 bp, Homo sapiens
ccctcagcctcagag

SEQ ID NO: 6083807 - DNA, 16 bp, Homo sapiens
ccctcagcctcttctc

SEQ ID NO: 6083808 - DNA, 19 bp, Homo sapiens
ccctcagcctgcccacctc

SEQ ID NO: 6083809 - DNA, 22 bp, Homo sapiens
ccctcagcctgcccacctctcc

SEQ ID NO: 6083810 - DNA, 16 bp, Homo sapiens
ccctcagcctgcctga

SEQ ID NO: 6083811 - DNA, 16 bp, Homo sapiens
ccctcagcgcaggctg

SEQ ID NO: 6083812 - DNA, 17 bp, Homo sapiens
ccctcagcgcccccaga

SEQ ID NO: 6083813 - DNA, 15 bp, Homo sapiens
ccctcagcgctccct

SEQ ID NO: 6083814 - DNA, 19 bp, Homo sapiens
ccctcagcgctccctgtcg

SEQ ID NO: 6083815 - DNA, 23 bp, Homo sapiens
ccctcagcgctccctgtcgcctg

SEQ ID NO: 6083816 - DNA, 22 bp, Homo sapiens
ccctcagcgtctccccatgctg

SEQ ID NO: 6083817 - DNA, 12 bp, Homo sapiens
ccctcagctcca

SEQ ID NO: 6083818 - DNA, 19 bp, Homo sapiens
ccctcagctcggctcagct

SEQ ID NO: 6083819 - DNA, 21 bp, Homo sapiens
ccctcagctctgtcctgttag

SEQ ID NO: 6083820 - DNA, 16 bp, Homo sapiens
ccctcagctggtcctg

SEQ ID NO: 6083821 - DNA, 16 bp, Homo sapiens
ccctcagctgtcacct

SEQ ID NO: 6083822 - DNA, 21 bp, Homo sapiens
ccctcaggaattcagtgcctt

SEQ ID NO: 6083823 - DNA, 22 bp, Homo sapiens
ccctcaggattgtttctcggca

SEQ ID NO: 6083824 - DNA, 19 bp, Homo sapiens
ccctcaggcataggcctgg

SEQ ID NO: 6083825 - DNA, 20 bp, Homo sapiens
ccctcaggcataggcctggg

SEQ ID NO: 6083826 - DNA, 14 bp, Homo sapiens
ccctcaggccaccc

SEQ ID NO: 6083827 - DNA, 16 bp, Homo sapiens
ccctcaggccaccctc

SEQ ID NO: 6083828 - DNA, 18 bp, Homo sapiens
ccctcaggccaccctcca

SEQ ID NO: 6083829 - DNA, 21 bp, Homo sapiens
ccctcaggccagtgccaggac

SEQ ID NO: 6083830 - DNA, 23 bp, Homo sapiens
ccctcaggccagtgccaggacag

SEQ ID NO: 6083831 - DNA, 16 bp, Homo sapiens
ccctcaggccattccc

SEQ ID NO: 6083832 - DNA, 13 bp, Homo sapiens
ccctcaggcccag

SEQ ID NO: 6083833 - DNA, 21 bp, Homo sapiens
ccctcaggcccaggagtccag

SEQ ID NO: 6083834 - DNA, 16 bp, Homo sapiens
ccctcaggctccccag

SEQ ID NO: 6083835 - DNA, 14 bp, Homo sapiens
ccctcagggagcct

SEQ ID NO: 6083836 - DNA, 12 bp, Homo sapiens
ccctcagggatc

SEQ ID NO: 6083837 - DNA, 22 bp, Homo sapiens
ccctcagggatcttgcattccc

SEQ ID NO: 6083838 - DNA, 10 bp, Homo sapiens
ccctcagggc

SEQ ID NO: 6083839 - DNA, 22 bp, Homo sapiens
ccctcaggggaaaactgttacc

SEQ ID NO: 6083840 - DNA, 15 bp, Homo sapiens
ccctcaggggaagct

SEQ ID NO: 6083841 - DNA, 15 bp, Homo sapiens
ccctcaggggcaggt

SEQ ID NO: 6083842 - DNA, 18 bp, Homo sapiens
ccctcagggggccagctg

SEQ ID NO: 6083843 - DNA, 17 bp, Homo sapiens
ccctcagggtccctggt

SEQ ID NO: 6083844 - DNA, 21 bp, Homo sapiens
ccctcagggtccctggtggca

SEQ ID NO: 6083845 - DNA, 15 bp, Homo sapiens
ccctcaggtgcctcc

SEQ ID NO: 6083846 - DNA, 19 bp, Homo sapiens
ccctcaggtgtagctgagc

SEQ ID NO: 6083847 - DNA, 20 bp, Homo sapiens
ccctcaggtgtagctgagct

SEQ ID NO: 6083848 - DNA, 15 bp, Homo sapiens
ccctcaggttccttt

SEQ ID NO: 6083849 - DNA, 18 bp, Homo sapiens
ccctcagtactattcctt

SEQ ID NO: 6083850 - DNA, 13 bp, Homo sapiens
ccctcagtcaccc

SEQ ID NO: 6083851 - DNA, 16 bp, Homo sapiens
ccctcagtcaccccca

SEQ ID NO: 6083852 - DNA, 22 bp, Homo sapiens
ccctcagtcagttcccggagca

SEQ ID NO: 6083853 - DNA, 15 bp, Homo sapiens
ccctcagtctacact

SEQ ID NO: 6083854 - DNA, 13 bp, Homo sapiens
ccctcagtgatac

SEQ ID NO: 6083855 - DNA, 13 bp, Homo sapiens
ccctcagttgtgc

SEQ ID NO: 6083856 - DNA, 14 bp, Homo sapiens
ccctcagttgtgca

SEQ ID NO: 6083857 - DNA, 18 bp, Homo sapiens
ccctcagttgtgcagctt

SEQ ID NO: 6083858 - DNA, 20 bp, Homo sapiens
ccctcagtttttcggtggga

SEQ ID NO: 6083859 - DNA, 23 bp, Homo sapiens
ccctcagtttttcggtgggacag

SEQ ID NO: 6083860 - DNA, 16 bp, Homo sapiens
ccctcataccatctgc

SEQ ID NO: 6083861 - DNA, 17 bp, Homo sapiens
ccctcataccatctgct

SEQ ID NO: 6083862 - DNA, 16 bp, Homo sapiens
ccctcatacctacacc

SEQ ID NO: 6083863 - DNA, 13 bp, Homo sapiens
ccctcatagccct

SEQ ID NO: 6083864 - DNA, 22 bp, Homo sapiens
ccctcatcaccaacgtctgtgc

SEQ ID NO: 6083865 - DNA, 19 bp, Homo sapiens
ccctcatcagccttttcag

SEQ ID NO: 6083866 - DNA, 18 bp, Homo sapiens
ccctcatcaggagttcca

SEQ ID NO: 6083867 - DNA, 22 bp, Homo sapiens
ccctcatcaggagttccagtgc

SEQ ID NO: 6083868 - DNA, 18 bp, Homo sapiens
ccctcatcccacttcctt

SEQ ID NO: 6083869 - DNA, 14 bp, Homo sapiens
ccctcatcccccag

SEQ ID NO: 6083870 - DNA, 17 bp, Homo sapiens
ccctcatcctcataccc

SEQ ID NO: 6083871 - DNA, 22 bp, Homo sapiens
ccctcatcctcatacccacccc

SEQ ID NO: 6083872 - DNA, 17 bp, Homo sapiens
ccctcatctatgaggaa

SEQ ID NO: 6083873 - DNA, 14 bp, Homo sapiens
ccctcatctgtccc

SEQ ID NO: 6083874 - DNA, 14 bp, Homo sapiens
ccctcatctgtctg

SEQ ID NO: 6083875 - DNA, 23 bp, Homo sapiens
ccctcatcttgaagggcccagga

SEQ ID NO: 6083876 - DNA, 22 bp, Homo sapiens
ccctcatcttgccccctcatct

SEQ ID NO: 6083877 - DNA, 14 bp, Homo sapiens
ccctcatgccaacc

SEQ ID NO: 6083878 - DNA, 14 bp, Homo sapiens
ccctcatgctgcca

SEQ ID NO: 6083879 - DNA, 20 bp, Homo sapiens
ccctcatggagaaacatcct

SEQ ID NO: 6083880 - DNA, 15 bp, Homo sapiens
ccctcatggccccca

SEQ ID NO: 6083881 - DNA, 21 bp, Homo sapiens
ccctcatggcccccaggggca

SEQ ID NO: 6083882 - DNA, 17 bp, Homo sapiens
ccctcatggcccctctg

SEQ ID NO: 6083883 - DNA, 19 bp, Homo sapiens
ccctcattacggctcctct

SEQ ID NO: 6083884 - DNA, 15 bp, Homo sapiens
ccctcattcaggaaa

SEQ ID NO: 6083885 - DNA, 17 bp, Homo sapiens
ccctcattcatcttgca

SEQ ID NO: 6083886 - DNA, 12 bp, Homo sapiens
ccctcattcccc

SEQ ID NO: 6083887 - DNA, 18 bp, Homo sapiens
ccctcattccctcgggac

SEQ ID NO: 6083888 - DNA, 11 bp, Homo sapiens
ccctcattttt

SEQ ID NO: 6083889 - DNA, 16 bp, Homo sapiens
ccctcatttttccttt

SEQ ID NO: 6083890 - DNA, 15 bp, Homo sapiens
ccctccaaaagcact

SEQ ID NO: 6083891 - DNA, 18 bp, Homo sapiens
ccctccaaaagcacttac

SEQ ID NO: 6083892 - DNA, 21 bp, Homo sapiens
ccctccaaacactgggctctg

SEQ ID NO: 6083893 - DNA, 16 bp, Homo sapiens
ccctccaaacctccag

SEQ ID NO: 6083894 - DNA, 18 bp, Homo sapiens
ccctccaaagccccacct

SEQ ID NO: 6083895 - DNA, 20 bp, Homo sapiens
ccctccaaaggaactctaga

SEQ ID NO: 6083896 - DNA, 21 bp, Homo sapiens
ccctccaaaggaactctagag

SEQ ID NO: 6083897 - DNA, 17 bp, Homo sapiens
ccctccaaaggaagggg

SEQ ID NO: 6083898 - DNA, 18 bp, Homo sapiens
ccctccaaaggaaggggt

SEQ ID NO: 6083899 - DNA, 15 bp, Homo sapiens
ccctccaagcctggc

SEQ ID NO: 6083900 - DNA, 19 bp, Homo sapiens
ccctccaagcctggcaccc

SEQ ID NO: 6083901 - DNA, 22 bp, Homo sapiens
ccctccaagcctggcacccacc

SEQ ID NO: 6083902 - DNA, 16 bp, Homo sapiens
ccctccaaggccaggc

SEQ ID NO: 6083903 - DNA, 20 bp, Homo sapiens
ccctccaatcctccccgctc

SEQ ID NO: 6083904 - DNA, 23 bp, Homo sapiens
ccctccacaaagagaccaggggc

SEQ ID NO: 6083905 - DNA, 13 bp, Homo sapiens
ccctccacaccag

SEQ ID NO: 6083906 - DNA, 17 bp, Homo sapiens
ccctccacaccagtggc

SEQ ID NO: 6083907 - DNA, 19 bp, Homo sapiens
ccctccacacctccacccg

SEQ ID NO: 6083908 - DNA, 13 bp, Homo sapiens
ccctccacacctg

SEQ ID NO: 6083909 - DNA, 16 bp, Homo sapiens
ccctccacagccgcag

SEQ ID NO: 6083910 - DNA, 15 bp, Homo sapiens
ccctccacaggagcc

SEQ ID NO: 6083911 - DNA, 15 bp, Homo sapiens
ccctccacatcccag

SEQ ID NO: 6083912 - DNA, 13 bp, Homo sapiens
ccctccaccagcc

SEQ ID NO: 6083913 - DNA, 10 bp, Homo sapiens
ccctccaccc

SEQ ID NO: 6083914 - DNA, 12 bp, Homo sapiens
ccctccacccac

SEQ ID NO: 6083915 - DNA, 14 bp, Homo sapiens
ccctccaccccaca

SEQ ID NO: 6083916 - DNA, 15 bp, Homo sapiens
ccctccaccccacag

SEQ ID NO: 6083917 - DNA, 14 bp, Homo sapiens
ccctccaccccagt

SEQ ID NO: 6083918 - DNA, 22 bp, Homo sapiens
ccctccaccccccactcagtgc

SEQ ID NO: 6083919 - DNA, 22 bp, Homo sapiens
ccctccaccctgtcccccagct

SEQ ID NO: 6083920 - DNA, 14 bp, Homo sapiens
cctgaactctgcaa

SEQ ID NO: 6083921 - DNA, 16 bp, Homo sapiens
cctgaactctgcaact

SEQ ID NO: 6083922 - DNA, 18 bp, Homo sapiens
cctgaactgagccccagc

SEQ ID NO: 6083923 - DNA, 14 bp, Homo sapiens
cctgaactgaggag

SEQ ID NO: 6083924 - DNA, 14 bp, Homo sapiens
cctgaactgaggcc

SEQ ID NO: 6083925 - DNA, 19 bp, Homo sapiens
cctgaactgaggccttgtg

SEQ ID NO: 6083926 - DNA, 19 bp, Homo sapiens
cctgaactttctccctcat

SEQ ID NO: 6083927 - DNA, 19 bp, Homo sapiens
cctgaagaaaccacaggtt

SEQ ID NO: 6083928 - DNA, 14 bp, Homo sapiens
cctgaagaaatcct

SEQ ID NO: 6083929 - DNA, 14 bp, Homo sapiens
cctgaagaacagta

SEQ ID NO: 6083930 - DNA, 23 bp, Homo sapiens
cctgaagaagcacttctgctgca

SEQ ID NO: 6083931 - DNA, 13 bp, Homo sapiens
cctgaagacccca

SEQ ID NO: 6083932 - DNA, 14 bp, Homo sapiens
cctgaagactgagg

SEQ ID NO: 6083933 - DNA, 17 bp, Homo sapiens
cctgaagagcgctcctc

SEQ ID NO: 6083934 - DNA, 20 bp, Homo sapiens
cctgaagagcgctcctctgc

SEQ ID NO: 6083935 - DNA, 17 bp, Homo sapiens
cctgaagaggcgggcca

SEQ ID NO: 6083936 - DNA, 19 bp, Homo sapiens
cctgaagaggcgggccagc

SEQ ID NO: 6083937 - DNA, 23 bp, Homo sapiens
cctgaagaggcgggccagccagg

SEQ ID NO: 6083938 - DNA, 21 bp, Homo sapiens
cctgaagagtcctctgaatga

SEQ ID NO: 6083939 - DNA, 23 bp, Homo sapiens
cctgaagatcagagctgcagcca

SEQ ID NO: 6083940 - DNA, 14 bp, Homo sapiens
cctgaagatttcag

SEQ ID NO: 6083941 - DNA, 18 bp, Homo sapiens
cctgaagccagctgccct

SEQ ID NO: 6083942 - DNA, 11 bp, Homo sapiens
cctgaagccat

SEQ ID NO: 6083943 - DNA, 17 bp, Homo sapiens
cctgaagcctctgccct

SEQ ID NO: 6083944 - DNA, 22 bp, Homo sapiens
cctgaagctatcgtaaaattaa

SEQ ID NO: 6083945 - DNA, 16 bp, Homo sapiens
cctgaagctgctgtgt

SEQ ID NO: 6083946 - DNA, 17 bp, Homo sapiens
cctgaagctgctgtgtc

SEQ ID NO: 6083947 - DNA, 18 bp, Homo sapiens
cctgaagctgctgtgtcc

SEQ ID NO: 6083948 - DNA, 19 bp, Homo sapiens
cctgaagctgcttaacagt

SEQ ID NO: 6083949 - DNA, 23 bp, Homo sapiens
cctgaagcttcggccgcgccacc

SEQ ID NO: 6083950 - DNA, 21 bp, Homo sapiens
cctgaaggaggcggggctcta

SEQ ID NO: 6083951 - DNA, 17 bp, Homo sapiens
cctgaaggattctggga

SEQ ID NO: 6083952 - DNA, 13 bp, Homo sapiens
cctgaaggcacag

SEQ ID NO: 6083953 - DNA, 15 bp, Homo sapiens
cctgaaggcagggct

SEQ ID NO: 6083954 - DNA, 19 bp, Homo sapiens
cctgaaggcagggctcctc

SEQ ID NO: 6083955 - DNA, 18 bp, Homo sapiens
cctgaaggccccgcccag

SEQ ID NO: 6083956 - DNA, 23 bp, Homo sapiens
cctgaaggcctgaggttactgga

SEQ ID NO: 6083957 - DNA, 18 bp, Homo sapiens
cctgaagggcctcccagc

SEQ ID NO: 6083958 - DNA, 20 bp, Homo sapiens
cctgaaggggccatgatggc

SEQ ID NO: 6083959 - DNA, 22 bp, Homo sapiens
cctgaaggggcgtctgttcccc

SEQ ID NO: 6083960 - DNA, 22 bp, Homo sapiens
cctgaagggtgacatcccagga

SEQ ID NO: 6083961 - DNA, 20 bp, Homo sapiens
cctgaagggtgcctagttga

SEQ ID NO: 6083962 - DNA, 13 bp, Homo sapiens
cctgaagggtgct

SEQ ID NO: 6083963 - DNA, 19 bp, Homo sapiens
cctgaaggtattggcctgt

SEQ ID NO: 6083964 - DNA, 19 bp, Homo sapiens
cctgaaggtcccctggcag

SEQ ID NO: 6083965 - DNA, 19 bp, Homo sapiens
cctgaaggtgccactccag

SEQ ID NO: 6083966 - DNA, 15 bp, Homo sapiens
cctgaaggttcctga

SEQ ID NO: 6083967 - DNA, 16 bp, Homo sapiens
cctgaagtcacacagt

SEQ ID NO: 6083968 - DNA, 22 bp, Homo sapiens
cctgaagtctttgtacagacaa

SEQ ID NO: 6083969 - DNA, 19 bp, Homo sapiens
cctgaagtgaccccagctc

SEQ ID NO: 6083970 - DNA, 21 bp, Homo sapiens
cctgaagtgaccccagctcca

SEQ ID NO: 6083971 - DNA, 20 bp, Homo sapiens
cctgaagtgacctcactggc

SEQ ID NO: 6083972 - DNA, 21 bp, Homo sapiens
cctgaagtgacctcactggcc

SEQ ID NO: 6083973 - DNA, 17 bp, Homo sapiens
cctgaataaaccaagac

SEQ ID NO: 6083974 - DNA, 20 bp, Homo sapiens
cctgaataccacttacctca

SEQ ID NO: 6083975 - DNA, 21 bp, Homo sapiens
cctgaataccacttacctcaa

SEQ ID NO: 6083976 - DNA, 20 bp, Homo sapiens
cctgaatataacaaccttta

SEQ ID NO: 6083977 - DNA, 16 bp, Homo sapiens
cctgaatattaatccc

SEQ ID NO: 6083978 - DNA, 15 bp, Homo sapiens
cctgaatcagaggca

SEQ ID NO: 6083979 - DNA, 17 bp, Homo sapiens
cctgaatcatgagcctg

SEQ ID NO: 6083980 - DNA, 19 bp, Homo sapiens
cctgaatccaaaagaaaaa

SEQ ID NO: 6083981 - DNA, 16 bp, Homo sapiens
cctgaatccacctgca

SEQ ID NO: 6083982 - DNA, 16 bp, Homo sapiens
cctgaatccagcattg

SEQ ID NO: 6083983 - DNA, 19 bp, Homo sapiens
cctgaatcccccttgccac

SEQ ID NO: 6083984 - DNA, 20 bp, Homo sapiens
cctgaatcccccttgccacc

SEQ ID NO: 6083985 - DNA, 13 bp, Homo sapiens
cctgaatcccttt

SEQ ID NO: 6083986 - DNA, 17 bp, Homo sapiens
cctgaatccctttcagt

SEQ ID NO: 6083987 - DNA, 21 bp, Homo sapiens
cctgaatctgaccacagacac

SEQ ID NO: 6083988 - DNA, 22 bp, Homo sapiens
cctgaatctgtgcctgcactga

SEQ ID NO: 6083989 - DNA, 13 bp, Homo sapiens
cctgaatgaaata

SEQ ID NO: 6083990 - DNA, 18 bp, Homo sapiens
cctgaatgacctgcagtc

SEQ ID NO: 6083991 - DNA, 19 bp, Homo sapiens
cctgaatgacctgcagtca

SEQ ID NO: 6083992 - DNA, 18 bp, Homo sapiens
cctgaatgaggcggagct

SEQ ID NO: 6083993 - DNA, 22 bp, Homo sapiens
cctgaatgaggcggagctccag

SEQ ID NO: 6083994 - DNA, 15 bp, Homo sapiens
cctgaatgcttctga

SEQ ID NO: 6083995 - DNA, 14 bp, Homo sapiens
cctgaatggctttg

SEQ ID NO: 6083996 - DNA, 15 bp, Homo sapiens
cctgaatggctttgt

SEQ ID NO: 6083997 - DNA, 21 bp, Homo sapiens
cctgaatggctttgtcttgaa

SEQ ID NO: 6083998 - DNA, 14 bp, Homo sapiens
cctgaattaaagtc

SEQ ID NO: 6083999 - DNA, 18 bp, Homo sapiens
cctgaattaaagtctaca

SEQ ID NO: 6084000 - DNA, 22 bp, Homo sapiens
cctgaattaaagtctacactgc

SEQ ID NO: 6084001 - DNA, 12 bp, Homo sapiens
cctgaattatta

SEQ ID NO: 6084002 - DNA, 17 bp, Homo sapiens
cctgaattcattgtctc

SEQ ID NO: 6084003 - DNA, 14 bp, Homo sapiens
cctgaattctattt

SEQ ID NO: 6084004 - DNA, 12 bp, Homo sapiens
cctgaatttccc

SEQ ID NO: 6084005 - DNA, 16 bp, Homo sapiens
cctgaattttgcttcc

SEQ ID NO: 6084006 - DNA, 15 bp, Homo sapiens
cctgacaaatatttt

SEQ ID NO: 6084007 - DNA, 16 bp, Homo sapiens
cctgacaacagcctga

SEQ ID NO: 6084008 - DNA, 17 bp, Homo sapiens
cctgacaacagcctgag

SEQ ID NO: 6084009 - DNA, 18 bp, Homo sapiens
cctgacaacagcctgaga

SEQ ID NO: 6084010 - DNA, 20 bp, Homo sapiens
cctgacaagcactgctaggc

SEQ ID NO: 6084011 - DNA, 15 bp, Homo sapiens
cctgacaaggccagc

SEQ ID NO: 6084012 - DNA, 17 bp, Homo sapiens
cctgacaaggccagcac

SEQ ID NO: 6084013 - DNA, 23 bp, Homo sapiens
cctgacaagtgaagttgtaaaca

SEQ ID NO: 6084014 - DNA, 17 bp, Homo sapiens
cctgacaatggcagcta

SEQ ID NO: 6084015 - DNA, 17 bp, Homo sapiens
cctgacacaccaggcgc

SEQ ID NO: 6084016 - DNA, 16 bp, Homo sapiens
cctgacacaggccagc

SEQ ID NO: 6084017 - DNA, 14 bp, Homo sapiens
cctgacacattctg

SEQ ID NO: 6084018 - DNA, 19 bp, Homo sapiens
cctgacaccacgctggagc

SEQ ID NO: 6084019 - DNA, 13 bp, Homo sapiens
cctgacaccccct

SEQ ID NO: 6084020 - DNA, 13 bp, Homo sapiens
cctgacacccttc

SEQ ID NO: 6084021 - DNA, 18 bp, Homo sapiens
cctgacacccttctccca

SEQ ID NO: 6084022 - DNA, 19 bp, Homo sapiens
cctgacacgtgatggacca

SEQ ID NO: 6084023 - DNA, 21 bp, Homo sapiens
cctgacacgtgatggaccaaa

SEQ ID NO: 6084024 - DNA, 19 bp, Homo sapiens
cctgacactgagccccacc

SEQ ID NO: 6084025 - DNA, 21 bp, Homo sapiens
cctgacactgagccccacctc

SEQ ID NO: 6084026 - DNA, 14 bp, Homo sapiens
cctgacactgctgg

SEQ ID NO: 6084027 - DNA, 19 bp, Homo sapiens
cctgacactgtctgctgcc

SEQ ID NO: 6084028 - DNA, 20 bp, Homo sapiens
cctgacagatgtcagccgag

SEQ ID NO: 6084029 - DNA, 17 bp, Homo sapiens
cctgacagcatcctctc

SEQ ID NO: 6084030 - DNA, 13 bp, Homo sapiens
cctgacagccaga

SEQ ID NO: 6084031 - DNA, 14 bp, Homo sapiens
cctgacagccagaa

SEQ ID NO: 6084032 - DNA, 15 bp, Homo sapiens
cctgacagccttccc

SEQ ID NO: 6084033 - DNA, 19 bp, Homo sapiens
cctgacagcgccatgtgtg

SEQ ID NO: 6084034 - DNA, 21 bp, Homo sapiens
cctgacagcgccatgtgtgtc

SEQ ID NO: 6084035 - DNA, 14 bp, Homo sapiens
cctgacagctctgt

SEQ ID NO: 6084036 - DNA, 12 bp, Homo sapiens
cctgacaggcct

SEQ ID NO: 6084037 - DNA, 21 bp, Homo sapiens
cctgacaggctgtgactcttc

SEQ ID NO: 6084038 - DNA, 20 bp, Homo sapiens
cctgacaggttcccagcagc

SEQ ID NO: 6084039 - DNA, 18 bp, Homo sapiens
cctgacagtcttgtgctt

SEQ ID NO: 6084040 - DNA, 21 bp, Homo sapiens
cctgacagtgtgggacaggct

SEQ ID NO: 6084041 - DNA, 19 bp, Homo sapiens
cctgacatcaaaaaaggca

SEQ ID NO: 6084042 - DNA, 14 bp, Homo sapiens
cctgacatcacagc

SEQ ID NO: 6084043 - DNA, 19 bp, Homo sapiens
cctgacatcatcattcttg

SEQ ID NO: 6084044 - DNA, 17 bp, Homo sapiens
cctgacatccactgttt

SEQ ID NO: 6084045 - DNA, 21 bp, Homo sapiens
cctgacatgtaccccctttcc

SEQ ID NO: 6084046 - DNA, 17 bp, Homo sapiens
cctgacatgtccttctg

SEQ ID NO: 6084047 - DNA, 23 bp, Homo sapiens
cctgacattaagacacacctctg

SEQ ID NO: 6084048 - DNA, 21 bp, Homo sapiens
cctgacattcacttccagaga

SEQ ID NO: 6084049 - DNA, 17 bp, Homo sapiens
cctgacattccttgctg

SEQ ID NO: 6084050 - DNA, 19 bp, Homo sapiens
cctgaccaagactgagcca

SEQ ID NO: 6084051 - DNA, 21 bp, Homo sapiens
cctgaccaagactgagccagc

SEQ ID NO: 6084052 - DNA, 13 bp, Homo sapiens
cctgaccaccctc

SEQ ID NO: 6084053 - DNA, 20 bp, Homo sapiens
cctgaccaccctcccctctc

SEQ ID NO: 6084054 - DNA, 13 bp, Homo sapiens
cctgaccactcag

SEQ ID NO: 6084055 - DNA, 17 bp, Homo sapiens
cctgaccactcagagac

SEQ ID NO: 6084056 - DNA, 14 bp, Homo sapiens
cctgaccagctccc

SEQ ID NO: 6084057 - DNA, 15 bp, Homo sapiens
cctgaccagctgctc

SEQ ID NO: 6084058 - DNA, 21 bp, Homo sapiens
cctgaccagctgctccgagga

SEQ ID NO: 6084059 - DNA, 22 bp, Homo sapiens
cctgaccagctgctccgaggac

SEQ ID NO: 6084060 - DNA, 13 bp, Homo sapiens
cctgaccagggca

SEQ ID NO: 6084061 - DNA, 14 bp, Homo sapiens
cctgaccaggggcc

SEQ ID NO: 6084062 - DNA, 23 bp, Homo sapiens
cctgaccagggggcccgaacagg

SEQ ID NO: 6084063 - DNA, 17 bp, Homo sapiens
cctgaccagtcagatgg

SEQ ID NO: 6084064 - DNA, 12 bp, Homo sapiens
cctgaccagttg

SEQ ID NO: 6084065 - DNA, 13 bp, Homo sapiens
cctgaccagttgc

SEQ ID NO: 6084066 - DNA, 20 bp, Homo sapiens
cctgaccagttgcagtcact

SEQ ID NO: 6084067 - DNA, 14 bp, Homo sapiens
cctgacccaataaa

SEQ ID NO: 6084068 - DNA, 19 bp, Homo sapiens
cctgacccccatcgctctg

SEQ ID NO: 6084069 - DNA, 22 bp, Homo sapiens
cctgacccccatcgctctgagc

SEQ ID NO: 6084070 - DNA, 13 bp, Homo sapiens
cctgaccccctgt

SEQ ID NO: 6084071 - DNA, 14 bp, Homo sapiens
cctgaccccctgtc

SEQ ID NO: 6084072 - DNA, 21 bp, Homo sapiens
cctgacccccttcctgtcccc

SEQ ID NO: 6084073 - DNA, 13 bp, Homo sapiens
cctgacccctccc

SEQ ID NO: 6084074 - DNA, 22 bp, Homo sapiens
cctgacccctccctgcaggggc

SEQ ID NO: 6084075 - DNA, 14 bp, Homo sapiens
cctgacccctgctc

SEQ ID NO: 6084076 - DNA, 14 bp, Homo sapiens
cctgaccccttgct

SEQ ID NO: 6084077 - DNA, 21 bp, Homo sapiens
cctgacccggcccctaccagc

SEQ ID NO: 6084078 - DNA, 23 bp, Homo sapiens
cctgacccggcccctaccagcca

SEQ ID NO: 6084079 - DNA, 12 bp, Homo sapiens
cctgacccgtct

SEQ ID NO: 6084080 - DNA, 14 bp, Homo sapiens
cctgaccctcactt

SEQ ID NO: 6084081 - DNA, 23 bp, Homo sapiens
cctgaccctccaccgcagaagga

SEQ ID NO: 6084082 - DNA, 16 bp, Homo sapiens
cctgaccctgctccta

SEQ ID NO: 6084083 - DNA, 19 bp, Homo sapiens
cctgaccctgctcctagca

SEQ ID NO: 6084084 - DNA, 14 bp, Homo sapiens
cctgaccctttgag

SEQ ID NO: 6084085 - DNA, 13 bp, Homo sapiens
cctgaccgctgcc

SEQ ID NO: 6084086 - DNA, 14 bp, Homo sapiens
cctgaccgctgccc

SEQ ID NO: 6084087 - DNA, 15 bp, Homo sapiens
cctgaccggcacctg

SEQ ID NO: 6084088 - DNA, 19 bp, Homo sapiens
cctgaccggcacctgcgag

SEQ ID NO: 6084089 - DNA, 19 bp, Homo sapiens
cctgacctaacctaggagg

SEQ ID NO: 6084090 - DNA, 21 bp, Homo sapiens
cctgacctaacctaggagggc

SEQ ID NO: 6084091 - DNA, 17 bp, Homo sapiens
cctgacctaccccagcc

SEQ ID NO: 6084092 - DNA, 21 bp, Homo sapiens
cctgacctaccccagccaggc

SEQ ID NO: 6084093 - DNA, 23 bp, Homo sapiens
cctgacctaccccagccaggctc

SEQ ID NO: 6084094 - DNA, 18 bp, Homo sapiens
cctgacctacttcctcct

SEQ ID NO: 6084095 - DNA, 22 bp, Homo sapiens
cctgacctcaaatgatgtgcct

SEQ ID NO: 6084096 - DNA, 18 bp, Homo sapiens
cctgacctccagtcctgc

SEQ ID NO: 6084097 - DNA, 14 bp, Homo sapiens
cctgacctccatat

SEQ ID NO: 6084098 - DNA, 20 bp, Homo sapiens
ccctccacctatccctaaca

SEQ ID NO: 6084099 - DNA, 15 bp, Homo sapiens
ccctccacctcaaga

SEQ ID NO: 6084100 - DNA, 18 bp, Homo sapiens
ccctccacctctcacggg

SEQ ID NO: 6084101 - DNA, 12 bp, Homo sapiens
ccctccaccttc

SEQ ID NO: 6084102 - DNA, 14 bp, Homo sapiens
ccctccaccttccg

SEQ ID NO: 6084103 - DNA, 24 bp, Homo sapiens
ccctccacgcaaggctgtgctctt

SEQ ID NO: 6084104 - DNA, 18 bp, Homo sapiens
ccctccacgcctcctggc

SEQ ID NO: 6084105 - DNA, 20 bp, Homo sapiens
ccctccacgcctcctggcca

SEQ ID NO: 6084106 - DNA, 14 bp, Homo sapiens
ccctccactaggag

SEQ ID NO: 6084107 - DNA, 14 bp, Homo sapiens
ccctccactccact

SEQ ID NO: 6084108 - DNA, 16 bp, Homo sapiens
ccctccactccactgc

SEQ ID NO: 6084109 - DNA, 13 bp, Homo sapiens
ccctccactcctc

SEQ ID NO: 6084110 - DNA, 18 bp, Homo sapiens
ccctccactcctcatccc

SEQ ID NO: 6084111 - DNA, 19 bp, Homo sapiens
ccctccactcctcccaact

SEQ ID NO: 6084112 - DNA, 22 bp, Homo sapiens
ccctccactcctcccaactctg

SEQ ID NO: 6084113 - DNA, 17 bp, Homo sapiens
ccctccactccttcctg

SEQ ID NO: 6084114 - DNA, 15 bp, Homo sapiens
ccctccactgccctc

SEQ ID NO: 6084115 - DNA, 23 bp, Homo sapiens
ccctccagaatggaactcaagct

SEQ ID NO: 6084116 - DNA, 10 bp, Homo sapiens
ccctccagac

SEQ ID NO: 6084117 - DNA, 20 bp, Homo sapiens
ccctccagacacccagaatg

SEQ ID NO: 6084118 - DNA, 16 bp, Homo sapiens
ccctccagacccctac

SEQ ID NO: 6084119 - DNA, 19 bp, Homo sapiens
ccctccagacccctaccct

SEQ ID NO: 6084120 - DNA, 22 bp, Homo sapiens
ccctccagacccctaccctttc

SEQ ID NO: 6084121 - DNA, 21 bp, Homo sapiens
ccctccagagccccacagccc

SEQ ID NO: 6084122 - DNA, 12 bp, Homo sapiens
ccctccagcaca

SEQ ID NO: 6084123 - DNA, 15 bp, Homo sapiens
ccctccagcacagac

SEQ ID NO: 6084124 - DNA, 16 bp, Homo sapiens
ccctccagcacagact

SEQ ID NO: 6084125 - DNA, 12 bp, Homo sapiens
ccctccagctca

SEQ ID NO: 6084126 - DNA, 14 bp, Homo sapiens
ccctccagctccag

SEQ ID NO: 6084127 - DNA, 15 bp, Homo sapiens
ccctccagctccagt

SEQ ID NO: 6084128 - DNA, 13 bp, Homo sapiens
ccctccagctgga

SEQ ID NO: 6084129 - DNA, 15 bp, Homo sapiens
ccctccagcttgtgg

SEQ ID NO: 6084130 - DNA, 10 bp, Homo sapiens
ccctccagga

SEQ ID NO: 6084131 - DNA, 13 bp, Homo sapiens
ccctccaggaaca

SEQ ID NO: 6084132 - DNA, 21 bp, Homo sapiens
ccctccaggaagaagcagggg

SEQ ID NO: 6084133 - DNA, 23 bp, Homo sapiens
ccctccaggagagagccaggatg

SEQ ID NO: 6084134 - DNA, 17 bp, Homo sapiens
ccctccaggcccatctc

SEQ ID NO: 6084135 - DNA, 19 bp, Homo sapiens
ccctccaggccgacaggag

SEQ ID NO: 6084136 - DNA, 21 bp, Homo sapiens
ccctccaggccgacaggaggc

SEQ ID NO: 6084137 - DNA, 16 bp, Homo sapiens
ccctccagtgcttggc

SEQ ID NO: 6084138 - DNA, 23 bp, Homo sapiens
ccctccagtgcttggctgcccca

SEQ ID NO: 6084139 - DNA, 16 bp, Homo sapiens
ccctccagttttgcct

SEQ ID NO: 6084140 - DNA, 14 bp, Homo sapiens
ccctccatccaccc

SEQ ID NO: 6084141 - DNA, 12 bp, Homo sapiens
ccctccatccca

SEQ ID NO: 6084142 - DNA, 17 bp, Homo sapiens
ccctccatccctggccc

SEQ ID NO: 6084143 - DNA, 15 bp, Homo sapiens
ccctccatccgtgct

SEQ ID NO: 6084144 - DNA, 20 bp, Homo sapiens
ccctccatccgtgctgcatg

SEQ ID NO: 6084145 - DNA, 19 bp, Homo sapiens
ccctccatctaaactgccc

SEQ ID NO: 6084146 - DNA, 23 bp, Homo sapiens
ccctccatgattccaagggccca

SEQ ID NO: 6084147 - DNA, 18 bp, Homo sapiens
ccctccatggtcctgtct

SEQ ID NO: 6084148 - DNA, 20 bp, Homo sapiens
ccctccatggtcctgtctgt

SEQ ID NO: 6084149 - DNA, 24 bp, Homo sapiens
ccctccattgggcacagtccagac

SEQ ID NO: 6084150 - DNA, 21 bp, Homo sapiens
ccctcccaagcgttcctggcc

SEQ ID NO: 6084151 - DNA, 16 bp, Homo sapiens
ccctcccaatcctctc

SEQ ID NO: 6084152 - DNA, 17 bp, Homo sapiens
ccctcccacacttccca

SEQ ID NO: 6084153 - DNA, 17 bp, Homo sapiens
ccctcccacagcctcct

SEQ ID NO: 6084154 - DNA, 15 bp, Homo sapiens
ccctcccaccacccc

SEQ ID NO: 6084155 - DNA, 13 bp, Homo sapiens
ccctcccaccatg

SEQ ID NO: 6084156 - DNA, 15 bp, Homo sapiens
ccctcccacccaccg

SEQ ID NO: 6084157 - DNA, 15 bp, Homo sapiens
ccctcccacccccag

SEQ ID NO: 6084158 - DNA, 16 bp, Homo sapiens
ccctcccacccccagc

SEQ ID NO: 6084159 - DNA, 17 bp, Homo sapiens
ccctcccacccccagcc

SEQ ID NO: 6084160 - DNA, 20 bp, Homo sapiens
ccctcccacccccagccccg

SEQ ID NO: 6084161 - DNA, 18 bp, Homo sapiens
ccctcccaccgctgcctc

SEQ ID NO: 6084162 - DNA, 15 bp, Homo sapiens
ccctcccacctccag

SEQ ID NO: 6084163 - DNA, 13 bp, Homo sapiens
ccctcccacctct

SEQ ID NO: 6084164 - DNA, 19 bp, Homo sapiens
ccctcccacctctgtgacc

SEQ ID NO: 6084165 - DNA, 23 bp, Homo sapiens
ccctcccagaaaaactggctctg

SEQ ID NO: 6084166 - DNA, 18 bp, Homo sapiens
ccctcccagacaggccct

SEQ ID NO: 6084167 - DNA, 20 bp, Homo sapiens
ccctcccagacaggccctcc

SEQ ID NO: 6084168 - DNA, 13 bp, Homo sapiens
ccctcccagatcc

SEQ ID NO: 6084169 - DNA, 15 bp, Homo sapiens
ccctcccagatccag

SEQ ID NO: 6084170 - DNA, 14 bp, Homo sapiens
ccctcccagctctg

SEQ ID NO: 6084171 - DNA, 20 bp, Homo sapiens
ccctcccagctgacagtcct

SEQ ID NO: 6084172 - DNA, 10 bp, Homo sapiens
ccctcccagg

SEQ ID NO: 6084173 - DNA, 20 bp, Homo sapiens
ccctcccaggaccctccact

SEQ ID NO: 6084174 - DNA, 13 bp, Homo sapiens
ccctcccagtctc

SEQ ID NO: 6084175 - DNA, 14 bp, Homo sapiens
ccctcccagttttc

SEQ ID NO: 6084176 - DNA, 14 bp, Homo sapiens
ccctcccatcctcc

SEQ ID NO: 6084177 - DNA, 17 bp, Homo sapiens
ccctcccatcctccagc

SEQ ID NO: 6084178 - DNA, 14 bp, Homo sapiens
ccctcccatctggg

SEQ ID NO: 6084179 - DNA, 21 bp, Homo sapiens
ccctcccatgagactgccctg

SEQ ID NO: 6084180 - DNA, 13 bp, Homo sapiens
ccctcccatggcc

SEQ ID NO: 6084181 - DNA, 13 bp, Homo sapiens
ccctcccattagg

SEQ ID NO: 6084182 - DNA, 15 bp, Homo sapiens
ccctcccattaggac

SEQ ID NO: 6084183 - DNA, 16 bp, Homo sapiens
ccctccccaaagtccc

SEQ ID NO: 6084184 - DNA, 15 bp, Homo sapiens
ccctccccaactccc

SEQ ID NO: 6084185 - DNA, 21 bp, Homo sapiens
ccctccccacagtcctcacag

SEQ ID NO: 6084186 - DNA, 13 bp, Homo sapiens
ccctccccaccca

SEQ ID NO: 6084187 - DNA, 17 bp, Homo sapiens
ccctccccacccaagag

SEQ ID NO: 6084188 - DNA, 13 bp, Homo sapiens
ccctccccacccc

SEQ ID NO: 6084189 - DNA, 20 bp, Homo sapiens
ccctccccacccctgccttt

SEQ ID NO: 6084190 - DNA, 14 bp, Homo sapiens
ccctccccacctgc

SEQ ID NO: 6084191 - DNA, 11 bp, Homo sapiens
ccctccccact

SEQ ID NO: 6084192 - DNA, 18 bp, Homo sapiens
ccctccccagactctcag

SEQ ID NO: 6084193 - DNA, 16 bp, Homo sapiens
ccctccccagagcact

SEQ ID NO: 6084194 - DNA, 14 bp, Homo sapiens
ccctccccagatct

SEQ ID NO: 6084195 - DNA, 21 bp, Homo sapiens
ccctccccagatctgtcctgg

SEQ ID NO: 6084196 - DNA, 23 bp, Homo sapiens
ccctccccagatctgtcctgggg

SEQ ID NO: 6084197 - DNA, 14 bp, Homo sapiens
ccctccccagccct

SEQ ID NO: 6084198 - DNA, 15 bp, Homo sapiens
ccctccccagctcct

SEQ ID NO: 6084199 - DNA, 13 bp, Homo sapiens
ccctccccagtgt

SEQ ID NO: 6084200 - DNA, 16 bp, Homo sapiens
ccctccccatcccatg

SEQ ID NO: 6084201 - DNA, 22 bp, Homo sapiens
ccctccccatgcaggtggtgtc

SEQ ID NO: 6084202 - DNA, 14 bp, Homo sapiens
ccctccccatggag

SEQ ID NO: 6084203 - DNA, 21 bp, Homo sapiens
ccctccccattcacagagcct

SEQ ID NO: 6084204 - DNA, 13 bp, Homo sapiens
ccctcccccacca

SEQ ID NO: 6084205 - DNA, 15 bp, Homo sapiens
ccctcccccacccac

SEQ ID NO: 6084206 - DNA, 19 bp, Homo sapiens
ccctcccccacccacctct

SEQ ID NO: 6084207 - DNA, 14 bp, Homo sapiens
ccctcccccacggc

SEQ ID NO: 6084208 - DNA, 22 bp, Homo sapiens
ccctcccccacgtctctctgcc

SEQ ID NO: 6084209 - DNA, 13 bp, Homo sapiens
ccctcccccactt

SEQ ID NO: 6084210 - DNA, 16 bp, Homo sapiens
ccctcccccagagccc

SEQ ID NO: 6084211 - DNA, 16 bp, Homo sapiens
ccctcccccagctcct

SEQ ID NO: 6084212 - DNA, 15 bp, Homo sapiens
ccctcccccagctgc

SEQ ID NO: 6084213 - DNA, 16 bp, Homo sapiens
ccctccccccagactc

SEQ ID NO: 6084214 - DNA, 17 bp, Homo sapiens
ccctccccccagactct

SEQ ID NO: 6084215 - DNA, 18 bp, Homo sapiens
ccctcccccccatgcact

SEQ ID NO: 6084216 - DNA, 14 bp, Homo sapiens
ccctcccccctgta

SEQ ID NO: 6084217 - DNA, 13 bp, Homo sapiens
ccctcccccgcag

SEQ ID NO: 6084218 - DNA, 14 bp, Homo sapiens
ccctcccccgcaga

SEQ ID NO: 6084219 - DNA, 19 bp, Homo sapiens
ccctcccccggggtctcca

SEQ ID NO: 6084220 - DNA, 22 bp, Homo sapiens
ccctcccccggggtctccacct

SEQ ID NO: 6084221 - DNA, 14 bp, Homo sapiens
ccctccccctaccg

SEQ ID NO: 6084222 - DNA, 18 bp, Homo sapiens
ccctccccctcctgctgt

SEQ ID NO: 6084223 - DNA, 15 bp, Homo sapiens
ccctccccgccccct

SEQ ID NO: 6084224 - DNA, 19 bp, Homo sapiens
ccctccccgccccctgaaa

SEQ ID NO: 6084225 - DNA, 15 bp, Homo sapiens
ccctccccgcctggc

SEQ ID NO: 6084226 - DNA, 16 bp, Homo sapiens
ccctccccgcctggcc

SEQ ID NO: 6084227 - DNA, 20 bp, Homo sapiens
ccctccccgcgcgttccttc

SEQ ID NO: 6084228 - DNA, 17 bp, Homo sapiens
ccctccccggcatcatt

SEQ ID NO: 6084229 - DNA, 19 bp, Homo sapiens
ccctccccggccctaccag

SEQ ID NO: 6084230 - DNA, 22 bp, Homo sapiens
ccctccccggccctaccagcgc

SEQ ID NO: 6084231 - DNA, 22 bp, Homo sapiens
ccctccccgggcagcagagaga

SEQ ID NO: 6084232 - DNA, 21 bp, Homo sapiens
ccctcccctcacccgctgccc

SEQ ID NO: 6084233 - DNA, 12 bp, Homo sapiens
ccctcccctcag

SEQ ID NO: 6084234 - DNA, 21 bp, Homo sapiens
ccctcccctcagcctgcccac

SEQ ID NO: 6084235 - DNA, 12 bp, Homo sapiens
ccctcccctccc

SEQ ID NO: 6084236 - DNA, 17 bp, Homo sapiens
ccctcccctcccagtcc

SEQ ID NO: 6084237 - DNA, 18 bp, Homo sapiens
ccctcccctcccagtcct

SEQ ID NO: 6084238 - DNA, 14 bp, Homo sapiens
ccctcccctcccga

SEQ ID NO: 6084239 - DNA, 12 bp, Homo sapiens
ccctcccctcct

SEQ ID NO: 6084240 - DNA, 14 bp, Homo sapiens
ccctcccctccttg

SEQ ID NO: 6084241 - DNA, 16 bp, Homo sapiens
ccctcccctctcagaa

SEQ ID NO: 6084242 - DNA, 11 bp, Homo sapiens
ccctcccctgc

SEQ ID NO: 6084243 - DNA, 13 bp, Homo sapiens
ccctcccctgcag

SEQ ID NO: 6084244 - DNA, 14 bp, Homo sapiens
ccctcccctgcaga

SEQ ID NO: 6084245 - DNA, 19 bp, Homo sapiens
ccctcccctgcccctgccc

SEQ ID NO: 6084246 - DNA, 16 bp, Homo sapiens
ccctcccctgccctag

SEQ ID NO: 6084247 - DNA, 15 bp, Homo sapiens
ccctcccctgctcag

SEQ ID NO: 6084248 - DNA, 15 bp, Homo sapiens
ccctcccctgctccc

SEQ ID NO: 6084249 - DNA, 13 bp, Homo sapiens
ccctcccctgctg

SEQ ID NO: 6084250 - DNA, 23 bp, Homo sapiens
ccctcccctgggactttcccacc

SEQ ID NO: 6084251 - DNA, 15 bp, Homo sapiens
ccctcccctggggac

SEQ ID NO: 6084252 - DNA, 21 bp, Homo sapiens
ccctccccttgcctgtgccag

SEQ ID NO: 6084253 - DNA, 23 bp, Homo sapiens
ccctccccttgcctgtgccaggt

SEQ ID NO: 6084254 - DNA, 20 bp, Homo sapiens
ccctcccgaacactgagaaa

SEQ ID NO: 6084255 - DNA, 13 bp, Homo sapiens
ccctcccgcttcc

SEQ ID NO: 6084256 - DNA, 19 bp, Homo sapiens
ccctcccgcttcctccggc

SEQ ID NO: 6084257 - DNA, 22 bp, Homo sapiens
ccctcccgtctactcattcccc

SEQ ID NO: 6084258 - DNA, 22 bp, Homo sapiens
ccctcccgtgtgtggttggaaa

SEQ ID NO: 6084259 - DNA, 15 bp, Homo sapiens
ccctccctacacaca

SEQ ID NO: 6084260 - DNA, 17 bp, Homo sapiens
ccctccctacacacaca

SEQ ID NO: 6084261 - DNA, 12 bp, Homo sapiens
ccctccctaccc

SEQ ID NO: 6084262 - DNA, 13 bp, Homo sapiens
ccctccctaccct

SEQ ID NO: 6084263 - DNA, 20 bp, Homo sapiens
ccctccctacctcaacctgt

SEQ ID NO: 6084264 - DNA, 16 bp, Homo sapiens
ccctccctagcccttc

SEQ ID NO: 6084265 - DNA, 14 bp, Homo sapiens
ccctccctagctct

SEQ ID NO: 6084266 - DNA, 20 bp, Homo sapiens
ccctccctatatgcacccct

SEQ ID NO: 6084267 - DNA, 14 bp, Homo sapiens
ccctccctatgtct

SEQ ID NO: 6084268 - DNA, 13 bp, Homo sapiens
ccctccctcagag

SEQ ID NO: 6084269 - DNA, 13 bp, Homo sapiens
ccctccctcagcg

SEQ ID NO: 6084270 - DNA, 12 bp, Homo sapiens
ccctccctccac

SEQ ID NO: 6084271 - DNA, 13 bp, Homo sapiens
ccctccctccaca

SEQ ID NO: 6084272 - DNA, 15 bp, Homo sapiens
ccctccctccacacc

SEQ ID NO: 6084273 - DNA, 20 bp, Homo sapiens
ccctccctccacctccctgc

SEQ ID NO: 6084274 - DNA, 15 bp, Homo sapiens
ccctccctccagggt

SEQ ID NO: 6084275 - DNA, 20 bp, Homo sapiens
ccctccctccagtaccataa

SEQ ID NO: 6084276 - DNA, 11 bp, Homo sapiens
ccctccctccc

SEQ ID NO: 6084277 - DNA, 14 bp, Homo sapiens
ccctccctccctag

SEQ ID NO: 6084278 - DNA, 15 bp, Homo sapiens
ccctccctccctcca

SEQ ID NO: 6084279 - DNA, 16 bp, Homo sapiens
ccctccctccctccac

SEQ ID NO: 6084280 - DNA, 15 bp, Homo sapiens
ccctccctcccttcc

SEQ ID NO: 6084281 - DNA, 12 bp, Homo sapiens
cctgacctccca

SEQ ID NO: 6084282 - DNA, 14 bp, Homo sapiens
cctgacctccccct

SEQ ID NO: 6084283 - DNA, 20 bp, Homo sapiens
cctgacctcctcctgccctc

SEQ ID NO: 6084284 - DNA, 21 bp, Homo sapiens
cctgacctcgtgatttgcctg

SEQ ID NO: 6084285 - DNA, 16 bp, Homo sapiens
cctgacctctgaagag

SEQ ID NO: 6084286 - DNA, 21 bp, Homo sapiens
cctgacctctgaagagctgag

SEQ ID NO: 6084287 - DNA, 13 bp, Homo sapiens
cctgacctctgca

SEQ ID NO: 6084288 - DNA, 14 bp, Homo sapiens
cctgacctctgcaa

SEQ ID NO: 6084289 - DNA, 22 bp, Homo sapiens
cctgacctctgcaagagggggc

SEQ ID NO: 6084290 - DNA, 12 bp, Homo sapiens
cctgacctcttg

SEQ ID NO: 6084291 - DNA, 21 bp, Homo sapiens
cctgacctcttgctgccagct

SEQ ID NO: 6084292 - DNA, 23 bp, Homo sapiens
cctgacctcttgctgtctctgct

SEQ ID NO: 6084293 - DNA, 16 bp, Homo sapiens
cctgacctgtctcacc

SEQ ID NO: 6084294 - DNA, 17 bp, Homo sapiens
cctgaccttagcgttct

SEQ ID NO: 6084295 - DNA, 21 bp, Homo sapiens
cctgaccttagcgttctggac

SEQ ID NO: 6084296 - DNA, 17 bp, Homo sapiens
cctgaccttccttcctg

SEQ ID NO: 6084297 - DNA, 18 bp, Homo sapiens
cctgacgaaactggcccc

SEQ ID NO: 6084298 - DNA, 17 bp, Homo sapiens
cctgacgaaatggaaac

SEQ ID NO: 6084299 - DNA, 19 bp, Homo sapiens
cctgacgagataagcagtt

SEQ ID NO: 6084300 - DNA, 21 bp, Homo sapiens
cctgacgccctgcgttggagc

SEQ ID NO: 6084301 - DNA, 14 bp, Homo sapiens
cctgacgctcagcc

SEQ ID NO: 6084302 - DNA, 24 bp, Homo sapiens
cctgacgctcagccccaggccagc

SEQ ID NO: 6084303 - DNA, 24 bp, Homo sapiens
cctgacggctgccattggtccacc

SEQ ID NO: 6084304 - DNA, 13 bp, Homo sapiens
cctgacggctggg

SEQ ID NO: 6084305 - DNA, 13 bp, Homo sapiens
cctgacgtctgcc

SEQ ID NO: 6084306 - DNA, 20 bp, Homo sapiens
cctgactaaactaccacctc

SEQ ID NO: 6084307 - DNA, 21 bp, Homo sapiens
cctgactaaactaccacctca

SEQ ID NO: 6084308 - DNA, 16 bp, Homo sapiens
cctgactaagcctttg

SEQ ID NO: 6084309 - DNA, 17 bp, Homo sapiens
cctgactagaactcctg

SEQ ID NO: 6084310 - DNA, 16 bp, Homo sapiens
cctgactcatcatttg

SEQ ID NO: 6084311 - DNA, 19 bp, Homo sapiens
cctgactccagtgagctgg

SEQ ID NO: 6084312 - DNA, 20 bp, Homo sapiens
cctgactccagtgagctgga

SEQ ID NO: 6084313 - DNA, 21 bp, Homo sapiens
cctgactccctgtgggggtgg

SEQ ID NO: 6084314 - DNA, 13 bp, Homo sapiens
cctgactcctcta

SEQ ID NO: 6084315 - DNA, 19 bp, Homo sapiens
cctgactcctctggctttc

SEQ ID NO: 6084316 - DNA, 14 bp, Homo sapiens
cctgactcctgact

SEQ ID NO: 6084317 - DNA, 15 bp, Homo sapiens
cctgactcctggact

SEQ ID NO: 6084318 - DNA, 14 bp, Homo sapiens
cctgactcctgggt

SEQ ID NO: 6084319 - DNA, 21 bp, Homo sapiens
cctgactcgtctgactgtgtg

SEQ ID NO: 6084320 - DNA, 16 bp, Homo sapiens
cctgactctgccccct

SEQ ID NO: 6084321 - DNA, 17 bp, Homo sapiens
cctgactctgccccctg

SEQ ID NO: 6084322 - DNA, 14 bp, Homo sapiens
cctgactgacacag

SEQ ID NO: 6084323 - DNA, 17 bp, Homo sapiens
cctgactgacacaggcc

SEQ ID NO: 6084324 - DNA, 19 bp, Homo sapiens
cctgactgacacaggccag

SEQ ID NO: 6084325 - DNA, 22 bp, Homo sapiens
cctgactgacacaggccagccc

SEQ ID NO: 6084326 - DNA, 23 bp, Homo sapiens
cctgactgacacaggccagcccc

SEQ ID NO: 6084327 - DNA, 21 bp, Homo sapiens
cctgactgcacacagctaggc

SEQ ID NO: 6084328 - DNA, 14 bp, Homo sapiens
cctgactgccaagc

SEQ ID NO: 6084329 - DNA, 18 bp, Homo sapiens
cctgactgccaagccatg

SEQ ID NO: 6084330 - DNA, 21 bp, Homo sapiens
cctgactgcccgctcctcggg

SEQ ID NO: 6084331 - DNA, 14 bp, Homo sapiens
cctgactgctcaga

SEQ ID NO: 6084332 - DNA, 12 bp, Homo sapiens
cctgactgggaa

SEQ ID NO: 6084333 - DNA, 15 bp, Homo sapiens
cctgactgggctggg

SEQ ID NO: 6084334 - DNA, 16 bp, Homo sapiens
cctgactgggggcaga

SEQ ID NO: 6084335 - DNA, 12 bp, Homo sapiens
cctgactggtgc

SEQ ID NO: 6084336 - DNA, 23 bp, Homo sapiens
cctgactggttgtcagaatggaa

SEQ ID NO: 6084337 - DNA, 20 bp, Homo sapiens
cctgactgtgttcagtgcct

SEQ ID NO: 6084338 - DNA, 20 bp, Homo sapiens
cctgactgttgccccccagg

SEQ ID NO: 6084339 - DNA, 20 bp, Homo sapiens
cctgacttcaggggctgccc

SEQ ID NO: 6084340 - DNA, 23 bp, Homo sapiens
cctgacttcagtgaatatttttg

SEQ ID NO: 6084341 - DNA, 21 bp, Homo sapiens
cctgacttcccagctggcagc

SEQ ID NO: 6084342 - DNA, 11 bp, Homo sapiens
cctgacttgag

SEQ ID NO: 6084343 - DNA, 17 bp, Homo sapiens
cctgacttgagccactc

SEQ ID NO: 6084344 - DNA, 12 bp, Homo sapiens
cctgacttgagt

SEQ ID NO: 6084345 - DNA, 18 bp, Homo sapiens
cctgacttggctggggag

SEQ ID NO: 6084346 - DNA, 22 bp, Homo sapiens
cctgactttgcccccttgccca

SEQ ID NO: 6084347 - DNA, 23 bp, Homo sapiens
cctgactttgcccccttgcccat

SEQ ID NO: 6084348 - DNA, 15 bp, Homo sapiens
cctgactttggggac

SEQ ID NO: 6084349 - DNA, 14 bp, Homo sapiens
cctgacttttacag

SEQ ID NO: 6084350 - DNA, 18 bp, Homo sapiens
cctgacttttctgtggat

SEQ ID NO: 6084351 - DNA, 18 bp, Homo sapiens
cctgagaaacccaccagc

SEQ ID NO: 6084352 - DNA, 20 bp, Homo sapiens
cctgagaaagcccacctggg

SEQ ID NO: 6084353 - DNA, 22 bp, Homo sapiens
cctgagaaagcccacctgggct

SEQ ID NO: 6084354 - DNA, 15 bp, Homo sapiens
cctgagaaagccctg

SEQ ID NO: 6084355 - DNA, 14 bp, Homo sapiens
cctgagaaatgtta

SEQ ID NO: 6084356 - DNA, 21 bp, Homo sapiens
cctgagaaccttagccatcag

SEQ ID NO: 6084357 - DNA, 12 bp, Homo sapiens
cctgagaagagg

SEQ ID NO: 6084358 - DNA, 16 bp, Homo sapiens
cctgagaagctgctcc

SEQ ID NO: 6084359 - DNA, 19 bp, Homo sapiens
cctgagaagctgctccagg

SEQ ID NO: 6084360 - DNA, 23 bp, Homo sapiens
cctgagaagctgctccaggcctg

SEQ ID NO: 6084361 - DNA, 19 bp, Homo sapiens
cctgagaaggcgaggagag

SEQ ID NO: 6084362 - DNA, 12 bp, Homo sapiens
cctgagaatgac

SEQ ID NO: 6084363 - DNA, 17 bp, Homo sapiens
cctgagaatgcctaggc

SEQ ID NO: 6084364 - DNA, 22 bp, Homo sapiens
cctgagaatgcctaggccagct

SEQ ID NO: 6084365 - DNA, 23 bp, Homo sapiens
cctgagaatgcctaggccagctc

SEQ ID NO: 6084366 - DNA, 13 bp, Homo sapiens
cctgagaatttaa

SEQ ID NO: 6084367 - DNA, 15 bp, Homo sapiens
cctgagacaaatgga

SEQ ID NO: 6084368 - DNA, 21 bp, Homo sapiens
cctgagacaaatggaggcctg

SEQ ID NO: 6084369 - DNA, 12 bp, Homo sapiens
cctgagacacat

SEQ ID NO: 6084370 - DNA, 15 bp, Homo sapiens
cctgagacacatggg

SEQ ID NO: 6084371 - DNA, 20 bp, Homo sapiens
cctgagacacatgggtgcta

SEQ ID NO: 6084372 - DNA, 12 bp, Homo sapiens
cctgagacagaa

SEQ ID NO: 6084373 - DNA, 13 bp, Homo sapiens
cctgagacagcac

SEQ ID NO: 6084374 - DNA, 14 bp, Homo sapiens
cctgagacagcacc

SEQ ID NO: 6084375 - DNA, 22 bp, Homo sapiens
cctgagaccagccaacctgggg

SEQ ID NO: 6084376 - DNA, 23 bp, Homo sapiens
cctgagaccagggtggccacaca

SEQ ID NO: 6084377 - DNA, 24 bp, Homo sapiens
cctgagaccagggtggccacacag

SEQ ID NO: 6084378 - DNA, 18 bp, Homo sapiens
cctgagaccatttaacat

SEQ ID NO: 6084379 - DNA, 13 bp, Homo sapiens
cctgagacccagg

SEQ ID NO: 6084380 - DNA, 15 bp, Homo sapiens
cctgagacccaggac

SEQ ID NO: 6084381 - DNA, 17 bp, Homo sapiens
cctgagacccctggcct

SEQ ID NO: 6084382 - DNA, 20 bp, Homo sapiens
cctgagaccctgggagagaa

SEQ ID NO: 6084383 - DNA, 13 bp, Homo sapiens
cctgagacctcca

SEQ ID NO: 6084384 - DNA, 20 bp, Homo sapiens
cctgagacctcgccggcctt

SEQ ID NO: 6084385 - DNA, 19 bp, Homo sapiens
cctgagacctctagagaaa

SEQ ID NO: 6084386 - DNA, 23 bp, Homo sapiens
cctgagactcacactctctgcag

SEQ ID NO: 6084387 - DNA, 15 bp, Homo sapiens
cctgagactccagaa

SEQ ID NO: 6084388 - DNA, 22 bp, Homo sapiens
cctgagactggaaaaggtggac

SEQ ID NO: 6084389 - DNA, 15 bp, Homo sapiens
cctgagagaattggc

SEQ ID NO: 6084390 - DNA, 21 bp, Homo sapiens
cctgagagagaatagagctgc

SEQ ID NO: 6084391 - DNA, 15 bp, Homo sapiens
cctgagagcagaatg

SEQ ID NO: 6084392 - DNA, 22 bp, Homo sapiens
cctgagagcctgtggaggggct

SEQ ID NO: 6084393 - DNA, 11 bp, Homo sapiens
cctgagagctg

SEQ ID NO: 6084394 - DNA, 12 bp, Homo sapiens
cctgagagctgc

SEQ ID NO: 6084395 - DNA, 13 bp, Homo sapiens
cctgagagctggc

SEQ ID NO: 6084396 - DNA, 16 bp, Homo sapiens
cctgagagctgttccc

SEQ ID NO: 6084397 - DNA, 20 bp, Homo sapiens
cctgagaggagcgtgtccta

SEQ ID NO: 6084398 - DNA, 14 bp, Homo sapiens
cctgagaggcaggc

SEQ ID NO: 6084399 - DNA, 18 bp, Homo sapiens
cctgagagggagagactg

SEQ ID NO: 6084400 - DNA, 20 bp, Homo sapiens
cctgagaggggaagcggccc

SEQ ID NO: 6084401 - DNA, 17 bp, Homo sapiens
cctgagaggtgctgcag

SEQ ID NO: 6084402 - DNA, 12 bp, Homo sapiens
cctgagaggttg

SEQ ID NO: 6084403 - DNA, 22 bp, Homo sapiens
cctgagagtcagctctctgccc

SEQ ID NO: 6084404 - DNA, 18 bp, Homo sapiens
cctgagagtttcctcaga

SEQ ID NO: 6084405 - DNA, 19 bp, Homo sapiens
cctgagagtttcctcagaa

SEQ ID NO: 6084406 - DNA, 22 bp, Homo sapiens
cctgagagtttcctcagaaccc

SEQ ID NO: 6084407 - DNA, 21 bp, Homo sapiens
cctgagatacaaggcccagaa

SEQ ID NO: 6084408 - DNA, 18 bp, Homo sapiens
cctgagatcccctgagcc

SEQ ID NO: 6084409 - DNA, 17 bp, Homo sapiens
cctgagatgcaggtgat

SEQ ID NO: 6084410 - DNA, 16 bp, Homo sapiens
cctgagatgctgggag

SEQ ID NO: 6084411 - DNA, 20 bp, Homo sapiens
cctgagatggatggacagac

SEQ ID NO: 6084412 - DNA, 14 bp, Homo sapiens
cctgagatggccct

SEQ ID NO: 6084413 - DNA, 19 bp, Homo sapiens
cctgagatggccctctggt

SEQ ID NO: 6084414 - DNA, 18 bp, Homo sapiens
cctgagatgggcttccca

SEQ ID NO: 6084415 - DNA, 21 bp, Homo sapiens
cctgagatgtaggctccacct

SEQ ID NO: 6084416 - DNA, 13 bp, Homo sapiens
cctgagattctgg

SEQ ID NO: 6084417 - DNA, 18 bp, Homo sapiens
cctgagattctgggaaag

SEQ ID NO: 6084418 - DNA, 20 bp, Homo sapiens
cctgagattctttaaggaga

SEQ ID NO: 6084419 - DNA, 20 bp, Homo sapiens
cctgagatttaacccctcca

SEQ ID NO: 6084420 - DNA, 14 bp, Homo sapiens
cctgagatttatta

SEQ ID NO: 6084421 - DNA, 21 bp, Homo sapiens
cctgagatttattaaagaaaa

SEQ ID NO: 6084422 - DNA, 22 bp, Homo sapiens
cctgagatttattaaagaaaaa

SEQ ID NO: 6084423 - DNA, 11 bp, Homo sapiens
cctgagatttc

SEQ ID NO: 6084424 - DNA, 18 bp, Homo sapiens
cctgagatttcatctgct

SEQ ID NO: 6084425 - DNA, 22 bp, Homo sapiens
cctgagatttcatctgctctcc

SEQ ID NO: 6084426 - DNA, 17 bp, Homo sapiens
cctgagcacctcccagc

SEQ ID NO: 6084427 - DNA, 23 bp, Homo sapiens
cctgagcacctcccagcccctgc

SEQ ID NO: 6084428 - DNA, 17 bp, Homo sapiens
cctgagcactgccagga

SEQ ID NO: 6084429 - DNA, 19 bp, Homo sapiens
cctgagcactgccaggagg

SEQ ID NO: 6084430 - DNA, 23 bp, Homo sapiens
cctgagcagatcgtgccgtggag

SEQ ID NO: 6084431 - DNA, 13 bp, Homo sapiens
cctgagcaggcag

SEQ ID NO: 6084432 - DNA, 15 bp, Homo sapiens
cctgagcaggcaggg

SEQ ID NO: 6084433 - DNA, 12 bp, Homo sapiens
cctgagcagggc

SEQ ID NO: 6084434 - DNA, 14 bp, Homo sapiens
cctgagcagtccct

SEQ ID NO: 6084435 - DNA, 18 bp, Homo sapiens
cctgagcagtccttggcc

SEQ ID NO: 6084436 - DNA, 22 bp, Homo sapiens
cctgagcagtccttggcctgct

SEQ ID NO: 6084437 - DNA, 21 bp, Homo sapiens
cctgagcatccagacctgagc

SEQ ID NO: 6084438 - DNA, 21 bp, Homo sapiens
cctgagccacagtggggccca

SEQ ID NO: 6084439 - DNA, 12 bp, Homo sapiens
cctgagccagat

SEQ ID NO: 6084440 - DNA, 18 bp, Homo sapiens
cctgagccagatttcact

SEQ ID NO: 6084441 - DNA, 22 bp, Homo sapiens
cctgagccagggaacagcccca

SEQ ID NO: 6084442 - DNA, 23 bp, Homo sapiens
cctgagccagggaacagccccag

SEQ ID NO: 6084443 - DNA, 13 bp, Homo sapiens
cctgagccagggt

SEQ ID NO: 6084444 - DNA, 15 bp, Homo sapiens
cctgagccagggtct

SEQ ID NO: 6084445 - DNA, 20 bp, Homo sapiens
cctgagccagggtctccaga

SEQ ID NO: 6084446 - DNA, 11 bp, Homo sapiens
cctgagcccac

SEQ ID NO: 6084447 - DNA, 12 bp, Homo sapiens
cctgagcccact

SEQ ID NO: 6084448 - DNA, 15 bp, Homo sapiens
cctgagcccactgtg

SEQ ID NO: 6084449 - DNA, 18 bp, Homo sapiens
cctgagcccagggaggcc

SEQ ID NO: 6084450 - DNA, 19 bp, Homo sapiens
cctgagcccagggaggccg

SEQ ID NO: 6084451 - DNA, 15 bp, Homo sapiens
cctgagccccaggga

SEQ ID NO: 6084452 - DNA, 16 bp, Homo sapiens
cctgagccccctgagt

SEQ ID NO: 6084453 - DNA, 20 bp, Homo sapiens
cctgagccccctgcacccac

SEQ ID NO: 6084454 - DNA, 14 bp, Homo sapiens
cctgagccccgccc

SEQ ID NO: 6084455 - DNA, 18 bp, Homo sapiens
cctgagccccgccctctt

SEQ ID NO: 6084456 - DNA, 21 bp, Homo sapiens
cctgagccccgccctcttcct

SEQ ID NO: 6084457 - DNA, 15 bp, Homo sapiens
cctgagcccctcaga

SEQ ID NO: 6084458 - DNA, 15 bp, Homo sapiens
cctgagccccttcct

SEQ ID NO: 6084459 - DNA, 20 bp, Homo sapiens
ccctccctcctgccgctcct

SEQ ID NO: 6084460 - DNA, 13 bp, Homo sapiens
ccctccctcctgg

SEQ ID NO: 6084461 - DNA, 16 bp, Homo sapiens
ccctccctcctgtgtt

SEQ ID NO: 6084462 - DNA, 16 bp, Homo sapiens
ccctccctcgtgggct

SEQ ID NO: 6084463 - DNA, 16 bp, Homo sapiens
ccctccctctgcccca

SEQ ID NO: 6084464 - DNA, 14 bp, Homo sapiens
ccctccctctgctc

SEQ ID NO: 6084465 - DNA, 17 bp, Homo sapiens
ccctccctctgctctca

SEQ ID NO: 6084466 - DNA, 13 bp, Homo sapiens
ccctccctcttcc

SEQ ID NO: 6084467 - DNA, 13 bp, Homo sapiens
ccctccctgactc

SEQ ID NO: 6084468 - DNA, 20 bp, Homo sapiens
ccctccctgactccctgtgg

SEQ ID NO: 6084469 - DNA, 21 bp, Homo sapiens
ccctccctgactccctgtggg

SEQ ID NO: 6084470 - DNA, 22 bp, Homo sapiens
ccctccctgactggcctgggat

SEQ ID NO: 6084471 - DNA, 14 bp, Homo sapiens
ccctccctgaggca

SEQ ID NO: 6084472 - DNA, 14 bp, Homo sapiens
ccctccctgcccaa

SEQ ID NO: 6084473 - DNA, 14 bp, Homo sapiens
ccctccctgcccct

SEQ ID NO: 6084474 - DNA, 17 bp, Homo sapiens
ccctccctgcctgaggg

SEQ ID NO: 6084475 - DNA, 21 bp, Homo sapiens
ccctccctgcctgagggcagt

SEQ ID NO: 6084476 - DNA, 15 bp, Homo sapiens
ccctccctgcctgct

SEQ ID NO: 6084477 - DNA, 18 bp, Homo sapiens
ccctccctgcctgctcct

SEQ ID NO: 6084478 - DNA, 22 bp, Homo sapiens
ccctccctgctagcacagaggc

SEQ ID NO: 6084479 - DNA, 15 bp, Homo sapiens
ccctccctgctccct

SEQ ID NO: 6084480 - DNA, 13 bp, Homo sapiens
ccctccctgctgt

SEQ ID NO: 6084481 - DNA, 12 bp, Homo sapiens
ccctccctggag

SEQ ID NO: 6084482 - DNA, 21 bp, Homo sapiens
ccctccctggcatgtcagagc

SEQ ID NO: 6084483 - DNA, 14 bp, Homo sapiens
ccctccctggcctc

SEQ ID NO: 6084484 - DNA, 14 bp, Homo sapiens
ccctccctggctcc

SEQ ID NO: 6084485 - DNA, 13 bp, Homo sapiens
ccctccctggctg

SEQ ID NO: 6084486 - DNA, 13 bp, Homo sapiens
ccctccctgggtt

SEQ ID NO: 6084487 - DNA, 12 bp, Homo sapiens
ccctccctgtcc

SEQ ID NO: 6084488 - DNA, 16 bp, Homo sapiens
ccctccctgtcccctg

SEQ ID NO: 6084489 - DNA, 16 bp, Homo sapiens
ccctccctgtctccag

SEQ ID NO: 6084490 - DNA, 23 bp, Homo sapiens
ccctccctgtctccagggccccc

SEQ ID NO: 6084491 - DNA, 18 bp, Homo sapiens
ccctcccttgctcagtgc

SEQ ID NO: 6084492 - DNA, 13 bp, Homo sapiens
ccctcccttgctg

SEQ ID NO: 6084493 - DNA, 18 bp, Homo sapiens
ccctcccttgctgaacac

SEQ ID NO: 6084494 - DNA, 21 bp, Homo sapiens
ccctcccttggaaacctgccc

SEQ ID NO: 6084495 - DNA, 18 bp, Homo sapiens
ccctcccttgtccttgaa

SEQ ID NO: 6084496 - DNA, 13 bp, Homo sapiens
ccctccctttctc

SEQ ID NO: 6084497 - DNA, 14 bp, Homo sapiens
ccctccctttctcc

SEQ ID NO: 6084498 - DNA, 16 bp, Homo sapiens
ccctccctttctcccc

SEQ ID NO: 6084499 - DNA, 18 bp, Homo sapiens
ccctccgaccctcatggc

SEQ ID NO: 6084500 - DNA, 15 bp, Homo sapiens
ccctccgagcttggg

SEQ ID NO: 6084501 - DNA, 19 bp, Homo sapiens
ccctccgatgctgaggcca

SEQ ID NO: 6084502 - DNA, 14 bp, Homo sapiens
ccctccgccattct

SEQ ID NO: 6084503 - DNA, 22 bp, Homo sapiens
ccctccgccccgtccccccatc

SEQ ID NO: 6084504 - DNA, 14 bp, Homo sapiens
ccctccgccctgcc

SEQ ID NO: 6084505 - DNA, 15 bp, Homo sapiens
ccctccgccctgcca

SEQ ID NO: 6084506 - DNA, 16 bp, Homo sapiens
ccctccgccctgccac

SEQ ID NO: 6084507 - DNA, 15 bp, Homo sapiens
ccctccgcctgggat

SEQ ID NO: 6084508 - DNA, 18 bp, Homo sapiens
ccctccgcggcgggccct

SEQ ID NO: 6084509 - DNA, 16 bp, Homo sapiens
ccctccgcgggggaca

SEQ ID NO: 6084510 - DNA, 17 bp, Homo sapiens
ccctccgctctgtagtg

SEQ ID NO: 6084511 - DNA, 19 bp, Homo sapiens
ccctccggaggagcagcct

SEQ ID NO: 6084512 - DNA, 18 bp, Homo sapiens
ccctccggcgggtgacag

SEQ ID NO: 6084513 - DNA, 14 bp, Homo sapiens
ccctccgggcaggg

SEQ ID NO: 6084514 - DNA, 17 bp, Homo sapiens
ccctccgggtcttccta

SEQ ID NO: 6084515 - DNA, 19 bp, Homo sapiens
ccctccgtccactacgctc

SEQ ID NO: 6084516 - DNA, 14 bp, Homo sapiens
ccctccgtccccag

SEQ ID NO: 6084517 - DNA, 15 bp, Homo sapiens
ccctccgtccccagg

SEQ ID NO: 6084518 - DNA, 17 bp, Homo sapiens
ccctccgtccccagggt

SEQ ID NO: 6084519 - DNA, 17 bp, Homo sapiens
ccctccgtcctggcagg

SEQ ID NO: 6084520 - DNA, 18 bp, Homo sapiens
ccctccgtcgggcccctg

SEQ ID NO: 6084521 - DNA, 19 bp, Homo sapiens
ccctccgttcctcctcagc

SEQ ID NO: 6084522 - DNA, 21 bp, Homo sapiens
ccctcctacccctcccagctg

SEQ ID NO: 6084523 - DNA, 22 bp, Homo sapiens
ccctcctacccctcccagctga

SEQ ID NO: 6084524 - DNA, 17 bp, Homo sapiens
ccctcctaccctgcgcc

SEQ ID NO: 6084525 - DNA, 18 bp, Homo sapiens
ccctcctaccctgcgccc

SEQ ID NO: 6084526 - DNA, 17 bp, Homo sapiens
ccctcctactgcgcgtt

SEQ ID NO: 6084527 - DNA, 19 bp, Homo sapiens
ccctcctagacccaggtgg

SEQ ID NO: 6084528 - DNA, 18 bp, Homo sapiens
ccctcctagctccaccct

SEQ ID NO: 6084529 - DNA, 15 bp, Homo sapiens
ccctcctcacactcc

SEQ ID NO: 6084530 - DNA, 18 bp, Homo sapiens
ccctcctcacactccaga

SEQ ID NO: 6084531 - DNA, 21 bp, Homo sapiens
ccctcctcactcccacctgca

SEQ ID NO: 6084532 - DNA, 15 bp, Homo sapiens
ccctcctcactccct

SEQ ID NO: 6084533 - DNA, 17 bp, Homo sapiens
ccctcctcactccctag

SEQ ID NO: 6084534 - DNA, 23 bp, Homo sapiens
ccctcctcactccctaggcccaa

SEQ ID NO: 6084535 - DNA, 22 bp, Homo sapiens
ccctcctcagcacggtgcctcc

SEQ ID NO: 6084536 - DNA, 17 bp, Homo sapiens
ccctcctcagccagcct

SEQ ID NO: 6084537 - DNA, 13 bp, Homo sapiens
ccctcctcagctc

SEQ ID NO: 6084538 - DNA, 14 bp, Homo sapiens
ccctcctcagctcc

SEQ ID NO: 6084539 - DNA, 15 bp, Homo sapiens
ccctcctcagctccc

SEQ ID NO: 6084540 - DNA, 16 bp, Homo sapiens
ccctcctccactccac

SEQ ID NO: 6084541 - DNA, 12 bp, Homo sapiens
ccctcctccaga

SEQ ID NO: 6084542 - DNA, 19 bp, Homo sapiens
ccctcctccagagcctggg

SEQ ID NO: 6084543 - DNA, 14 bp, Homo sapiens
ccctcctccagatc

SEQ ID NO: 6084544 - DNA, 15 bp, Homo sapiens
ccctcctccaggcct

SEQ ID NO: 6084545 - DNA, 14 bp, Homo sapiens
ccctcctccatgct

SEQ ID NO: 6084546 - DNA, 15 bp, Homo sapiens
ccctcctccatgctg

SEQ ID NO: 6084547 - DNA, 15 bp, Homo sapiens
ccctcctccccagag

SEQ ID NO: 6084548 - DNA, 14 bp, Homo sapiens
ccctcctcccccag

SEQ ID NO: 6084549 - DNA, 14 bp, Homo sapiens
ccctcctccccttc

SEQ ID NO: 6084550 - DNA, 14 bp, Homo sapiens
ccctcctccctcag

SEQ ID NO: 6084551 - DNA, 15 bp, Homo sapiens
ccctcctccctcaga

SEQ ID NO: 6084552 - DNA, 18 bp, Homo sapiens
ccctcctccctcagaccc

SEQ ID NO: 6084553 - DNA, 23 bp, Homo sapiens
ccctcctccctcagactcagagg

SEQ ID NO: 6084554 - DNA, 23 bp, Homo sapiens
ccctcctccctccaagcctggca

SEQ ID NO: 6084555 - DNA, 16 bp, Homo sapiens
ccctcctccctcccag

SEQ ID NO: 6084556 - DNA, 20 bp, Homo sapiens
ccctcctccctttttccttg

SEQ ID NO: 6084557 - DNA, 18 bp, Homo sapiens
ccctcctccgcatgccaa

SEQ ID NO: 6084558 - DNA, 22 bp, Homo sapiens
ccctcctcctagaaaacccttc

SEQ ID NO: 6084559 - DNA, 13 bp, Homo sapiens
ccctcctcctctt

SEQ ID NO: 6084560 - DNA, 16 bp, Homo sapiens
ccctcctcctcttcac

SEQ ID NO: 6084561 - DNA, 19 bp, Homo sapiens
ccctcctcctcttcaccag

SEQ ID NO: 6084562 - DNA, 22 bp, Homo sapiens
ccctcctcgccgggccattctg

SEQ ID NO: 6084563 - DNA, 16 bp, Homo sapiens
ccctcctcgctgtgcc

SEQ ID NO: 6084564 - DNA, 18 bp, Homo sapiens
ccctcctcgctgtgccac

SEQ ID NO: 6084565 - DNA, 14 bp, Homo sapiens
ccctcctcgggcgc

SEQ ID NO: 6084566 - DNA, 14 bp, Homo sapiens
ccctcctctagaag

SEQ ID NO: 6084567 - DNA, 21 bp, Homo sapiens
ccctcctctagaaggctgagt

SEQ ID NO: 6084568 - DNA, 19 bp, Homo sapiens
ccctcctctagctgtgggg

SEQ ID NO: 6084569 - DNA, 14 bp, Homo sapiens
ccctcctctcccat

SEQ ID NO: 6084570 - DNA, 21 bp, Homo sapiens
ccctcctctcctgcccagctc

SEQ ID NO: 6084571 - DNA, 22 bp, Homo sapiens
ccctcctctcctgcccagctct

SEQ ID NO: 6084572 - DNA, 14 bp, Homo sapiens
ccctcctctctgcc

SEQ ID NO: 6084573 - DNA, 16 bp, Homo sapiens
ccctcctctctgccct

SEQ ID NO: 6084574 - DNA, 10 bp, Homo sapiens
ccctcctctg

SEQ ID NO: 6084575 - DNA, 14 bp, Homo sapiens
ccctcctctgaaac

SEQ ID NO: 6084576 - DNA, 15 bp, Homo sapiens
ccctcctctgaaaca

SEQ ID NO: 6084577 - DNA, 17 bp, Homo sapiens
ccctcctctgagaggcg

SEQ ID NO: 6084578 - DNA, 13 bp, Homo sapiens
ccctcctctgcca

SEQ ID NO: 6084579 - DNA, 13 bp, Homo sapiens
ccctcctctgccc

SEQ ID NO: 6084580 - DNA, 16 bp, Homo sapiens
ccctcctctgccccct

SEQ ID NO: 6084581 - DNA, 15 bp, Homo sapiens
ccctcctctgctggg

SEQ ID NO: 6084582 - DNA, 13 bp, Homo sapiens
ccctcctctgctt

SEQ ID NO: 6084583 - DNA, 22 bp, Homo sapiens
ccctcctgaaccgcacagctca

SEQ ID NO: 6084584 - DNA, 12 bp, Homo sapiens
ccctcctgaccc

SEQ ID NO: 6084585 - DNA, 12 bp, Homo sapiens
ccctcctgagca

SEQ ID NO: 6084586 - DNA, 14 bp, Homo sapiens
ccctcctgagcctc

SEQ ID NO: 6084587 - DNA, 16 bp, Homo sapiens
ccctcctgagcctcac

SEQ ID NO: 6084588 - DNA, 21 bp, Homo sapiens
ccctcctgagggaggacctgg

SEQ ID NO: 6084589 - DNA, 12 bp, Homo sapiens
ccctcctgcagg

SEQ ID NO: 6084590 - DNA, 14 bp, Homo sapiens
ccctcctgcaggct

SEQ ID NO: 6084591 - DNA, 19 bp, Homo sapiens
ccctcctgccccacactcc

SEQ ID NO: 6084592 - DNA, 18 bp, Homo sapiens
ccctcctgccgactcctg

SEQ ID NO: 6084593 - DNA, 19 bp, Homo sapiens
ccctcctgccgactcctgg

SEQ ID NO: 6084594 - DNA, 15 bp, Homo sapiens
ccctcctgcctgcgc

SEQ ID NO: 6084595 - DNA, 12 bp, Homo sapiens
ccctcctgctcc

SEQ ID NO: 6084596 - DNA, 14 bp, Homo sapiens
ccctcctgctcctc

SEQ ID NO: 6084597 - DNA, 23 bp, Homo sapiens
ccctcctgctgagctgcccctgc

SEQ ID NO: 6084598 - DNA, 13 bp, Homo sapiens
ccctcctgctgca

SEQ ID NO: 6084599 - DNA, 15 bp, Homo sapiens
ccctcctgctggctg

SEQ ID NO: 6084600 - DNA, 13 bp, Homo sapiens
ccctcctgctggg

SEQ ID NO: 6084601 - DNA, 12 bp, Homo sapiens
ccctcctgctgt

SEQ ID NO: 6084602 - DNA, 19 bp, Homo sapiens
ccctcctggagctctgtgg

SEQ ID NO: 6084603 - DNA, 16 bp, Homo sapiens
ccctcctggcctcaga

SEQ ID NO: 6084604 - DNA, 13 bp, Homo sapiens
ccctcctggcctt

SEQ ID NO: 6084605 - DNA, 20 bp, Homo sapiens
ccctcctggctcacagccac

SEQ ID NO: 6084606 - DNA, 13 bp, Homo sapiens
ccctcctggctct

SEQ ID NO: 6084607 - DNA, 17 bp, Homo sapiens
ccctcctgggatctgct

SEQ ID NO: 6084608 - DNA, 15 bp, Homo sapiens
ccctcctgggccctg

SEQ ID NO: 6084609 - DNA, 16 bp, Homo sapiens
ccctcctgggccctgg

SEQ ID NO: 6084610 - DNA, 17 bp, Homo sapiens
ccctcctgggccctggg

SEQ ID NO: 6084611 - DNA, 14 bp, Homo sapiens
ccctcctggggcca

SEQ ID NO: 6084612 - DNA, 16 bp, Homo sapiens
ccctcctggggccagg

SEQ ID NO: 6084613 - DNA, 18 bp, Homo sapiens
ccctcctggggccaggcc

SEQ ID NO: 6084614 - DNA, 16 bp, Homo sapiens
ccctcctggtcctgga

SEQ ID NO: 6084615 - DNA, 14 bp, Homo sapiens
ccctcctggtgact

SEQ ID NO: 6084616 - DNA, 14 bp, Homo sapiens
ccctcctgtaaaat

SEQ ID NO: 6084617 - DNA, 18 bp, Homo sapiens
ccctcctgtcttcccagg

SEQ ID NO: 6084618 - DNA, 16 bp, Homo sapiens
ccctcctgtgccccag

SEQ ID NO: 6084619 - DNA, 18 bp, Homo sapiens
ccctcctgtgccccagct

SEQ ID NO: 6084620 - DNA, 18 bp, Homo sapiens
ccctcctgtgctcagccc

SEQ ID NO: 6084621 - DNA, 20 bp, Homo sapiens
ccctcctgtgctcagccctg

SEQ ID NO: 6084622 - DNA, 19 bp, Homo sapiens
ccctcctgtgctgggggaa

SEQ ID NO: 6084623 - DNA, 23 bp, Homo sapiens
ccctcctgtgctgggggaatgag

SEQ ID NO: 6084624 - DNA, 13 bp, Homo sapiens
ccctcctgttgca

SEQ ID NO: 6084625 - DNA, 19 bp, Homo sapiens
ccctcctgttgcacccagc

SEQ ID NO: 6084626 - DNA, 13 bp, Homo sapiens
ccctcctgttgcc

SEQ ID NO: 6084627 - DNA, 12 bp, Homo sapiens
ccctccttcaga

SEQ ID NO: 6084628 - DNA, 13 bp, Homo sapiens
ccctccttcaggg

SEQ ID NO: 6084629 - DNA, 15 bp, Homo sapiens
ccctccttccacatg

SEQ ID NO: 6084630 - DNA, 20 bp, Homo sapiens
ccctccttccacatgtacat

SEQ ID NO: 6084631 - DNA, 15 bp, Homo sapiens
ccctccttccagcct

SEQ ID NO: 6084632 - DNA, 13 bp, Homo sapiens
ccctccttcccaa

SEQ ID NO: 6084633 - DNA, 21 bp, Homo sapiens
ccctccttcccaagtgagtct

SEQ ID NO: 6084634 - DNA, 13 bp, Homo sapiens
ccctccttcccac

SEQ ID NO: 6084635 - DNA, 19 bp, Homo sapiens
ccctccttcccagctgccc

SEQ ID NO: 6084636 - DNA, 13 bp, Homo sapiens
ccctccttcccca

SEQ ID NO: 6084637 - DNA, 18 bp, Homo sapiens
ccctccttccccacccca

SEQ ID NO: 6084638 - DNA, 18 bp, Homo sapiens
ccctccttccccagaccc

SEQ ID NO: 6084639 - DNA, 22 bp, Homo sapiens
ccctccttccctcacccccagc

SEQ ID NO: 6084640 - DNA, 15 bp, Homo sapiens
ccctccttcccttct

SEQ ID NO: 6084641 - DNA, 20 bp, Homo sapiens
ccctccttgcaaccaggcag

SEQ ID NO: 6084642 - DNA, 20 bp, Homo sapiens
cctgagcccgcagcccagac

SEQ ID NO: 6084643 - DNA, 19 bp, Homo sapiens
cctgagccctactccctgc

SEQ ID NO: 6084644 - DNA, 17 bp, Homo sapiens
cctgagcctaactccct

SEQ ID NO: 6084645 - DNA, 21 bp, Homo sapiens
cctgagcctcaaccttctggg

SEQ ID NO: 6084646 - DNA, 14 bp, Homo sapiens
cctgagcctcacct

SEQ ID NO: 6084647 - DNA, 17 bp, Homo sapiens
cctgagcctgcattctg

SEQ ID NO: 6084648 - DNA, 15 bp, Homo sapiens
cctgagcctggcagg

SEQ ID NO: 6084649 - DNA, 17 bp, Homo sapiens
cctgagcctggccatgt

SEQ ID NO: 6084650 - DNA, 15 bp, Homo sapiens
cctgagcctgtgtcc

SEQ ID NO: 6084651 - DNA, 18 bp, Homo sapiens
cctgagcctgtgtcctga

SEQ ID NO: 6084652 - DNA, 21 bp, Homo sapiens
cctgagcctgtgtcctgaaga

SEQ ID NO: 6084653 - DNA, 11 bp, Homo sapiens
cctgagcctta

SEQ ID NO: 6084654 - DNA, 16 bp, Homo sapiens
cctgagccttagaatc

SEQ ID NO: 6084655 - DNA, 15 bp, Homo sapiens
cctgagccttagctc

SEQ ID NO: 6084656 - DNA, 17 bp, Homo sapiens
cctgagccttagctccc

SEQ ID NO: 6084657 - DNA, 13 bp, Homo sapiens
cctgagccttttc

SEQ ID NO: 6084658 - DNA, 15 bp, Homo sapiens
cctgagcgaaaacag

SEQ ID NO: 6084659 - DNA, 16 bp, Homo sapiens
cctgagcgcagcgcct

SEQ ID NO: 6084660 - DNA, 21 bp, Homo sapiens
cctgagcgcagcgcctccacc

SEQ ID NO: 6084661 - DNA, 22 bp, Homo sapiens
cctgagcgcagcgcctccaccc

SEQ ID NO: 6084662 - DNA, 17 bp, Homo sapiens
cctgagcgcctgggtcc

SEQ ID NO: 6084663 - DNA, 21 bp, Homo sapiens
cctgagcgctcctgccgcaga

SEQ ID NO: 6084664 - DNA, 23 bp, Homo sapiens
cctgagcgctcctgccgcagagc

SEQ ID NO: 6084665 - DNA, 15 bp, Homo sapiens
cctgagcgctgtgga

SEQ ID NO: 6084666 - DNA, 16 bp, Homo sapiens
cctgagcgctgtggac

SEQ ID NO: 6084667 - DNA, 24 bp, Homo sapiens
cctgagcgctgtggactgtcctga

SEQ ID NO: 6084668 - DNA, 16 bp, Homo sapiens
cctgagcgtcctccat

SEQ ID NO: 6084669 - DNA, 21 bp, Homo sapiens
cctgagctattttcctctggc

SEQ ID NO: 6084670 - DNA, 22 bp, Homo sapiens
cctgagctattttcctctggcc

SEQ ID NO: 6084671 - DNA, 12 bp, Homo sapiens
cctgagctcagc

SEQ ID NO: 6084672 - DNA, 13 bp, Homo sapiens
cctgagctcagcg

SEQ ID NO: 6084673 - DNA, 13 bp, Homo sapiens
cctgagctccacc

SEQ ID NO: 6084674 - DNA, 17 bp, Homo sapiens
cctgagctccaccctcc

SEQ ID NO: 6084675 - DNA, 21 bp, Homo sapiens
cctgagctcggggggctctgc

SEQ ID NO: 6084676 - DNA, 18 bp, Homo sapiens
cctgagctcggtggaccc

SEQ ID NO: 6084677 - DNA, 17 bp, Homo sapiens
cctgagctgccatccag

SEQ ID NO: 6084678 - DNA, 21 bp, Homo sapiens
cctgagctgcttcactaggga

SEQ ID NO: 6084679 - DNA, 19 bp, Homo sapiens
cctgagctggccaggccct

SEQ ID NO: 6084680 - DNA, 13 bp, Homo sapiens
cctgagctggcct

SEQ ID NO: 6084681 - DNA, 14 bp, Homo sapiens
cctgagctggcctc

SEQ ID NO: 6084682 - DNA, 11 bp, Homo sapiens
cctgagctggg

SEQ ID NO: 6084683 - DNA, 15 bp, Homo sapiens
cctgagctgggatga

SEQ ID NO: 6084684 - DNA, 12 bp, Homo sapiens
cctgagctgggg

SEQ ID NO: 6084685 - DNA, 16 bp, Homo sapiens
cctgagctggggccac

SEQ ID NO: 6084686 - DNA, 21 bp, Homo sapiens
cctgagctggggcctggagag

SEQ ID NO: 6084687 - DNA, 18 bp, Homo sapiens
cctgagctgtcgctgcct

SEQ ID NO: 6084688 - DNA, 19 bp, Homo sapiens
cctgagctgtcgctgcctc

SEQ ID NO: 6084689 - DNA, 20 bp, Homo sapiens
cctgagctttccggggagga

SEQ ID NO: 6084690 - DNA, 21 bp, Homo sapiens
cctgagctttccggggaggag

SEQ ID NO: 6084691 - DNA, 16 bp, Homo sapiens
cctgagctttggacac

SEQ ID NO: 6084692 - DNA, 18 bp, Homo sapiens
cctgagctttggacacac

SEQ ID NO: 6084693 - DNA, 15 bp, Homo sapiens
cctgagctttggacg

SEQ ID NO: 6084694 - DNA, 18 bp, Homo sapiens
cctgagctttggacgcac

SEQ ID NO: 6084695 - DNA, 23 bp, Homo sapiens
cctgagctttggacgcacacagc

SEQ ID NO: 6084696 - DNA, 16 bp, Homo sapiens
cctgagctttggggac

SEQ ID NO: 6084697 - DNA, 17 bp, Homo sapiens
cctgaggaaagcctcct

SEQ ID NO: 6084698 - DNA, 18 bp, Homo sapiens
cctgaggaagatgggggc

SEQ ID NO: 6084699 - DNA, 15 bp, Homo sapiens
cctgaggaataaagc

SEQ ID NO: 6084700 - DNA, 19 bp, Homo sapiens
cctgaggaataaagcttct

SEQ ID NO: 6084701 - DNA, 20 bp, Homo sapiens
cctgaggaataaagcttctc

SEQ ID NO: 6084702 - DNA, 14 bp, Homo sapiens
cctgaggacagaaa

SEQ ID NO: 6084703 - DNA, 19 bp, Homo sapiens
cctgaggacagatgcctcc

SEQ ID NO: 6084704 - DNA, 20 bp, Homo sapiens
cctgaggacatggcttctga

SEQ ID NO: 6084705 - DNA, 22 bp, Homo sapiens
cctgaggaccgccccaaccctc

SEQ ID NO: 6084706 - DNA, 16 bp, Homo sapiens
cctgaggacctttctg

SEQ ID NO: 6084707 - DNA, 19 bp, Homo sapiens
cctgaggactgatttcaga

SEQ ID NO: 6084708 - DNA, 23 bp, Homo sapiens
cctgaggactgatttcagagtga

SEQ ID NO: 6084709 - DNA, 17 bp, Homo sapiens
cctgaggactggagacc

SEQ ID NO: 6084710 - DNA, 17 bp, Homo sapiens
cctgaggagcagcccac

SEQ ID NO: 6084711 - DNA, 22 bp, Homo sapiens
cctgaggaggaggacacagcac

SEQ ID NO: 6084712 - DNA, 20 bp, Homo sapiens
cctgaggaggccgcttagtg

SEQ ID NO: 6084713 - DNA, 14 bp, Homo sapiens
cctgaggagtctga

SEQ ID NO: 6084714 - DNA, 20 bp, Homo sapiens
cctgaggagtctgaggtcct

SEQ ID NO: 6084715 - DNA, 17 bp, Homo sapiens
cctgaggagtggcagga

SEQ ID NO: 6084716 - DNA, 20 bp, Homo sapiens
cctgaggagtgtcctgtctg

SEQ ID NO: 6084717 - DNA, 16 bp, Homo sapiens
cctgaggatcccctgt

SEQ ID NO: 6084718 - DNA, 18 bp, Homo sapiens
cctgaggatcccctgtcc

SEQ ID NO: 6084719 - DNA, 20 bp, Homo sapiens
cctgaggatgagctggaagg

SEQ ID NO: 6084720 - DNA, 20 bp, Homo sapiens
cctgaggatgggtcagagct

SEQ ID NO: 6084721 - DNA, 15 bp, Homo sapiens
cctgaggcagaacct

SEQ ID NO: 6084722 - DNA, 15 bp, Homo sapiens
cctgaggcagcccag

SEQ ID NO: 6084723 - DNA, 12 bp, Homo sapiens
cctgaggcagga

SEQ ID NO: 6084724 - DNA, 19 bp, Homo sapiens
cctgaggcaggagggcatg

SEQ ID NO: 6084725 - DNA, 20 bp, Homo sapiens
cctgaggcaggagggcatgt

SEQ ID NO: 6084726 - DNA, 23 bp, Homo sapiens
cctgaggcaggagggcatgtgca

SEQ ID NO: 6084727 - DNA, 15 bp, Homo sapiens
cctgaggcaggtccc

SEQ ID NO: 6084728 - DNA, 18 bp, Homo sapiens
cctgaggcaggtccccag

SEQ ID NO: 6084729 - DNA, 19 bp, Homo sapiens
cctgaggcaggtccccaga

SEQ ID NO: 6084730 - DNA, 22 bp, Homo sapiens
cctgaggcaggtgagaacccag

SEQ ID NO: 6084731 - DNA, 23 bp, Homo sapiens
cctgaggcaggtgagaacccaga

SEQ ID NO: 6084732 - DNA, 21 bp, Homo sapiens
cctgaggccaaatattgatct

SEQ ID NO: 6084733 - DNA, 23 bp, Homo sapiens
cctgaggccaagaaagaaaccag

SEQ ID NO: 6084734 - DNA, 20 bp, Homo sapiens
cctgaggccagcctgcggga

SEQ ID NO: 6084735 - DNA, 21 bp, Homo sapiens
cctgaggccaggacgtctggg

SEQ ID NO: 6084736 - DNA, 13 bp, Homo sapiens
cctgaggccagtg

SEQ ID NO: 6084737 - DNA, 17 bp, Homo sapiens
cctgaggccagtggccc

SEQ ID NO: 6084738 - DNA, 19 bp, Homo sapiens
cctgaggccagtggccccc

SEQ ID NO: 6084739 - DNA, 13 bp, Homo sapiens
cctgaggcccaga

SEQ ID NO: 6084740 - DNA, 15 bp, Homo sapiens
cctgaggcccagagg

SEQ ID NO: 6084741 - DNA, 18 bp, Homo sapiens
cctgaggcccagcagagc

SEQ ID NO: 6084742 - DNA, 14 bp, Homo sapiens
cctgaggcccttct

SEQ ID NO: 6084743 - DNA, 20 bp, Homo sapiens
cctgaggcccttctctccag

SEQ ID NO: 6084744 - DNA, 22 bp, Homo sapiens
cctgaggcccttctctccagcc

SEQ ID NO: 6084745 - DNA, 23 bp, Homo sapiens
cctgaggcccttctctccagccc

SEQ ID NO: 6084746 - DNA, 21 bp, Homo sapiens
cctgaggcctctggaaagcaa

SEQ ID NO: 6084747 - DNA, 13 bp, Homo sapiens
cctgaggcctgag

SEQ ID NO: 6084748 - DNA, 14 bp, Homo sapiens
cctgaggcctgagg

SEQ ID NO: 6084749 - DNA, 15 bp, Homo sapiens
cctgaggcctgaggc

SEQ ID NO: 6084750 - DNA, 17 bp, Homo sapiens
cctgaggcctgaggcct

SEQ ID NO: 6084751 - DNA, 15 bp, Homo sapiens
cctgaggcctgtgcc

SEQ ID NO: 6084752 - DNA, 18 bp, Homo sapiens
cctgaggcctgtgcctgt

SEQ ID NO: 6084753 - DNA, 22 bp, Homo sapiens
cctgaggcggaggctgtgctcc

SEQ ID NO: 6084754 - DNA, 18 bp, Homo sapiens
cctgaggctcaagaggcc

SEQ ID NO: 6084755 - DNA, 16 bp, Homo sapiens
cctgaggctcagccct

SEQ ID NO: 6084756 - DNA, 17 bp, Homo sapiens
cctgaggctcagcccta

SEQ ID NO: 6084757 - DNA, 14 bp, Homo sapiens
cctgaggctccact

SEQ ID NO: 6084758 - DNA, 20 bp, Homo sapiens
cctgaggctccacttggtct

SEQ ID NO: 6084759 - DNA, 17 bp, Homo sapiens
cctgaggctcctgtgct

SEQ ID NO: 6084760 - DNA, 21 bp, Homo sapiens
cctgaggctgagactgcggga

SEQ ID NO: 6084761 - DNA, 13 bp, Homo sapiens
cctgaggctggca

SEQ ID NO: 6084762 - DNA, 18 bp, Homo sapiens
cctgaggctggcatcctg

SEQ ID NO: 6084763 - DNA, 19 bp, Homo sapiens
cctgaggctggcatcctgg

SEQ ID NO: 6084764 - DNA, 16 bp, Homo sapiens
cctgaggctggctggg

SEQ ID NO: 6084765 - DNA, 13 bp, Homo sapiens
cctgaggctgggc

SEQ ID NO: 6084766 - DNA, 14 bp, Homo sapiens
cctgaggctgggct

SEQ ID NO: 6084767 - DNA, 16 bp, Homo sapiens
cctgaggctgggctcc

SEQ ID NO: 6084768 - DNA, 17 bp, Homo sapiens
cctgaggctgggctccc

SEQ ID NO: 6084769 - DNA, 19 bp, Homo sapiens
cctgaggctgggctccctt

SEQ ID NO: 6084770 - DNA, 17 bp, Homo sapiens
cctgaggctgtggtcac

SEQ ID NO: 6084771 - DNA, 12 bp, Homo sapiens
cctgaggctgtt

SEQ ID NO: 6084772 - DNA, 14 bp, Homo sapiens
cctgaggcttatct

SEQ ID NO: 6084773 - DNA, 13 bp, Homo sapiens
cctgaggcttcac

SEQ ID NO: 6084774 - DNA, 13 bp, Homo sapiens
cctgagggaaagg

SEQ ID NO: 6084775 - DNA, 20 bp, Homo sapiens
cctgagggaagagtagctgt

SEQ ID NO: 6084776 - DNA, 12 bp, Homo sapiens
cctgagggaagc

SEQ ID NO: 6084777 - DNA, 13 bp, Homo sapiens
cctgagggaagcc

SEQ ID NO: 6084778 - DNA, 18 bp, Homo sapiens
cctgagggaagcccaccc

SEQ ID NO: 6084779 - DNA, 19 bp, Homo sapiens
cctgagggaagcccacccg

SEQ ID NO: 6084780 - DNA, 17 bp, Homo sapiens
cctgagggacgagcaga

SEQ ID NO: 6084781 - DNA, 15 bp, Homo sapiens
cctgagggagctcca

SEQ ID NO: 6084782 - DNA, 17 bp, Homo sapiens
cctgagggaggacctgg

SEQ ID NO: 6084783 - DNA, 12 bp, Homo sapiens
cctgagggcagt

SEQ ID NO: 6084784 - DNA, 21 bp, Homo sapiens
cctgagggcagtaccctccat

SEQ ID NO: 6084785 - DNA, 18 bp, Homo sapiens
cctgagggcccctctgcc

SEQ ID NO: 6084786 - DNA, 23 bp, Homo sapiens
cctgagggcccctctgcccagct

SEQ ID NO: 6084787 - DNA, 21 bp, Homo sapiens
cctgagggccggttctaaggc

SEQ ID NO: 6084788 - DNA, 22 bp, Homo sapiens
cctgagggcggggtgtctgtct

SEQ ID NO: 6084789 - DNA, 15 bp, Homo sapiens
cctgagggctcctcc

SEQ ID NO: 6084790 - DNA, 9 bp, Homo sapiens
cctgagggg

SEQ ID NO: 6084791 - DNA, 20 bp, Homo sapiens
cctgaggggagacagagcaa

SEQ ID NO: 6084792 - DNA, 22 bp, Homo sapiens
cctgaggggagacagagcaacc

SEQ ID NO: 6084793 - DNA, 18 bp, Homo sapiens
cctgaggggcatctgccc

SEQ ID NO: 6084794 - DNA, 20 bp, Homo sapiens
cctgaggggcatctgcccct

SEQ ID NO: 6084795 - DNA, 13 bp, Homo sapiens
cctgaggggctgg

SEQ ID NO: 6084796 - DNA, 14 bp, Homo sapiens
cctgaggggctggg

SEQ ID NO: 6084797 - DNA, 17 bp, Homo sapiens
cctgaggggctggggag

SEQ ID NO: 6084798 - DNA, 16 bp, Homo sapiens
cctgagggggaagtga

SEQ ID NO: 6084799 - DNA, 19 bp, Homo sapiens
cctgagggtctgtaggttg

SEQ ID NO: 6084800 - DNA, 17 bp, Homo sapiens
cctgagggtgggctttt

SEQ ID NO: 6084801 - DNA, 23 bp, Homo sapiens
cctgagggtgggcttttccctgg

SEQ ID NO: 6084802 - DNA, 20 bp, Homo sapiens
cctgagggtttccaccttgg

SEQ ID NO: 6084803 - DNA, 23 bp, Homo sapiens
cctgaggtacctttccacccaga

SEQ ID NO: 6084804 - DNA, 15 bp, Homo sapiens
cctgaggtcacctgg

SEQ ID NO: 6084805 - DNA, 21 bp, Homo sapiens
cctgaggtcatctgtaaaata

SEQ ID NO: 6084806 - DNA, 14 bp, Homo sapiens
cctgaggtcccctc

SEQ ID NO: 6084807 - DNA, 23 bp, Homo sapiens
cctgaggtcgggagttggagacc

SEQ ID NO: 6084808 - DNA, 12 bp, Homo sapiens
cctgaggtctgg

SEQ ID NO: 6084809 - DNA, 19 bp, Homo sapiens
cctgaggtctggctgcttg

SEQ ID NO: 6084810 - DNA, 18 bp, Homo sapiens
cctgaggtgcccactccg

SEQ ID NO: 6084811 - DNA, 21 bp, Homo sapiens
cctgaggtggatttactgaga

SEQ ID NO: 6084812 - DNA, 16 bp, Homo sapiens
cctgaggtgggcccag

SEQ ID NO: 6084813 - DNA, 19 bp, Homo sapiens
cctgaggtgggctggggct

SEQ ID NO: 6084814 - DNA, 23 bp, Homo sapiens
cctgaggtgtgggggctgcagca

SEQ ID NO: 6084815 - DNA, 22 bp, Homo sapiens
cctgagtaccttctacaggccc

SEQ ID NO: 6084816 - DNA, 15 bp, Homo sapiens
cctgagtagcagtga

SEQ ID NO: 6084817 - DNA, 13 bp, Homo sapiens
cctgagtagctgg

SEQ ID NO: 6084818 - DNA, 20 bp, Homo sapiens
cctgagtagctggattacag

SEQ ID NO: 6084819 - DNA, 16 bp, Homo sapiens
cctgagtagctgggcc

SEQ ID NO: 6084820 - DNA, 18 bp, Homo sapiens
ccctccttgcctcctgtg

SEQ ID NO: 6084821 - DNA, 19 bp, Homo sapiens
ccctccttgctctgcaggc

SEQ ID NO: 6084822 - DNA, 23 bp, Homo sapiens
ccctccttgctctgcaggcacct

SEQ ID NO: 6084823 - DNA, 14 bp, Homo sapiens
ccctccttgggcac

SEQ ID NO: 6084824 - DNA, 15 bp, Homo sapiens
ccctccttggtgcct

SEQ ID NO: 6084825 - DNA, 19 bp, Homo sapiens
ccctccttggtgcctctgg

SEQ ID NO: 6084826 - DNA, 18 bp, Homo sapiens
ccctccttgtgccttctt

SEQ ID NO: 6084827 - DNA, 11 bp, Homo sapiens
ccctcctttcc

SEQ ID NO: 6084828 - DNA, 17 bp, Homo sapiens
ccctcctttccaaataa

SEQ ID NO: 6084829 - DNA, 13 bp, Homo sapiens
ccctccttttaaa

SEQ ID NO: 6084830 - DNA, 19 bp, Homo sapiens
ccctccttttggcctgggg

SEQ ID NO: 6084831 - DNA, 16 bp, Homo sapiens
ccctcgaaccaaggca

SEQ ID NO: 6084832 - DNA, 19 bp, Homo sapiens
ccctcgaaccaaggcagcc

SEQ ID NO: 6084833 - DNA, 21 bp, Homo sapiens
ccctcgaaccaaggcagcctc

SEQ ID NO: 6084834 - DNA, 20 bp, Homo sapiens
ccctcgacagcgcccctgct

SEQ ID NO: 6084835 - DNA, 15 bp, Homo sapiens
ccctcgacagctctc

SEQ ID NO: 6084836 - DNA, 21 bp, Homo sapiens
ccctcgacttgaccctttcct

SEQ ID NO: 6084837 - DNA, 20 bp, Homo sapiens
ccctcgagctctgtagcctg

SEQ ID NO: 6084838 - DNA, 14 bp, Homo sapiens
ccctcgaggcctac

SEQ ID NO: 6084839 - DNA, 21 bp, Homo sapiens
ccctcgaggcctacagaggag

SEQ ID NO: 6084840 - DNA, 23 bp, Homo sapiens
ccctcgaggcctacagaggaggc

SEQ ID NO: 6084841 - DNA, 23 bp, Homo sapiens
ccctcgaggcggatctttggaca

SEQ ID NO: 6084842 - DNA, 16 bp, Homo sapiens
ccctcgatatttttaa

SEQ ID NO: 6084843 - DNA, 17 bp, Homo sapiens
ccctcgatcatatttcc

SEQ ID NO: 6084844 - DNA, 18 bp, Homo sapiens
ccctcgcaaccctgcctg

SEQ ID NO: 6084845 - DNA, 17 bp, Homo sapiens
ccctcgcacacagggct

SEQ ID NO: 6084846 - DNA, 18 bp, Homo sapiens
ccctcgcacacagggctc

SEQ ID NO: 6084847 - DNA, 20 bp, Homo sapiens
ccctcgcacacagggctcac

SEQ ID NO: 6084848 - DNA, 21 bp, Homo sapiens
ccctcgcacacagggctcaca

SEQ ID NO: 6084849 - DNA, 24 bp, Homo sapiens
ccctcgcatccgcctctgagccag

SEQ ID NO: 6084850 - DNA, 16 bp, Homo sapiens
ccctcgccacctttca

SEQ ID NO: 6084851 - DNA, 12 bp, Homo sapiens
ccctcgccagct

SEQ ID NO: 6084852 - DNA, 19 bp, Homo sapiens
ccctcgccagcttctcctg

SEQ ID NO: 6084853 - DNA, 20 bp, Homo sapiens
ccctcgccagcttctcctgc

SEQ ID NO: 6084854 - DNA, 15 bp, Homo sapiens
ccctcgccagcttgg

SEQ ID NO: 6084855 - DNA, 13 bp, Homo sapiens
ccctcgccccaaa

SEQ ID NO: 6084856 - DNA, 15 bp, Homo sapiens
ccctcgccccaaagt

SEQ ID NO: 6084857 - DNA, 15 bp, Homo sapiens
ccctcgccctgtccc

SEQ ID NO: 6084858 - DNA, 16 bp, Homo sapiens
ccctcgccctgtgagg

SEQ ID NO: 6084859 - DNA, 15 bp, Homo sapiens
ccctcgcctcctcct

SEQ ID NO: 6084860 - DNA, 18 bp, Homo sapiens
ccctcgccttcaggagaa

SEQ ID NO: 6084861 - DNA, 16 bp, Homo sapiens
ccctcgcgcccaaaag

SEQ ID NO: 6084862 - DNA, 13 bp, Homo sapiens
ccctcgcgcccct

SEQ ID NO: 6084863 - DNA, 14 bp, Homo sapiens
ccctcgcgcccctg

SEQ ID NO: 6084864 - DNA, 13 bp, Homo sapiens
ccctcgctggccc

SEQ ID NO: 6084865 - DNA, 19 bp, Homo sapiens
ccctcgcttcataggcaga

SEQ ID NO: 6084866 - DNA, 21 bp, Homo sapiens
ccctcgcttggacggctgggc

SEQ ID NO: 6084867 - DNA, 13 bp, Homo sapiens
ccctcggagcccc

SEQ ID NO: 6084868 - DNA, 18 bp, Homo sapiens
ccctcggagccccccact

SEQ ID NO: 6084869 - DNA, 15 bp, Homo sapiens
ccctcggagcctgtg

SEQ ID NO: 6084870 - DNA, 17 bp, Homo sapiens
ccctcggagcctgtgtt

SEQ ID NO: 6084871 - DNA, 14 bp, Homo sapiens
ccctcggagctggc

SEQ ID NO: 6084872 - DNA, 21 bp, Homo sapiens
ccctcggagctggctgtgcct

SEQ ID NO: 6084873 - DNA, 19 bp, Homo sapiens
ccctcggcaaccgtgggga

SEQ ID NO: 6084874 - DNA, 18 bp, Homo sapiens
ccctcggcattcacacac

SEQ ID NO: 6084875 - DNA, 23 bp, Homo sapiens
ccctcggcattcacacacagcct

SEQ ID NO: 6084876 - DNA, 13 bp, Homo sapiens
ccctcggccattg

SEQ ID NO: 6084877 - DNA, 23 bp, Homo sapiens
ccctcggccattgaacactgcac

SEQ ID NO: 6084878 - DNA, 15 bp, Homo sapiens
ccctcggcctccaga

SEQ ID NO: 6084879 - DNA, 22 bp, Homo sapiens
ccctcggcctccagactgcgga

SEQ ID NO: 6084880 - DNA, 18 bp, Homo sapiens
ccctcggcctctactttg

SEQ ID NO: 6084881 - DNA, 20 bp, Homo sapiens
ccctcgggaagcagccagct

SEQ ID NO: 6084882 - DNA, 20 bp, Homo sapiens
ccctcgggaccccactcgga

SEQ ID NO: 6084883 - DNA, 20 bp, Homo sapiens
ccctcgggcccacctggcca

SEQ ID NO: 6084884 - DNA, 21 bp, Homo sapiens
ccctcgggcccacctggccac

SEQ ID NO: 6084885 - DNA, 22 bp, Homo sapiens
ccctcgggcccagcccccacag

SEQ ID NO: 6084886 - DNA, 17 bp, Homo sapiens
ccctcggggatgtgtcc

SEQ ID NO: 6084887 - DNA, 16 bp, Homo sapiens
ccctcggggcaggaag

SEQ ID NO: 6084888 - DNA, 18 bp, Homo sapiens
ccctcgggggctcttccc

SEQ ID NO: 6084889 - DNA, 21 bp, Homo sapiens
ccctcgggggctcttccccta

SEQ ID NO: 6084890 - DNA, 20 bp, Homo sapiens
ccctcggggggtcacaggcc

SEQ ID NO: 6084891 - DNA, 21 bp, Homo sapiens
ccctcgggtctcctcactccc

SEQ ID NO: 6084892 - DNA, 14 bp, Homo sapiens
ccctcggtcagcac

SEQ ID NO: 6084893 - DNA, 15 bp, Homo sapiens
ccctcggtcagcacc

SEQ ID NO: 6084894 - DNA, 23 bp, Homo sapiens
ccctcggtcagcgactggatgct

SEQ ID NO: 6084895 - DNA, 15 bp, Homo sapiens
ccctcggtcttcggc

SEQ ID NO: 6084896 - DNA, 20 bp, Homo sapiens
ccctcggtgcagaaactacc

SEQ ID NO: 6084897 - DNA, 16 bp, Homo sapiens
ccctcggtggctgcac

SEQ ID NO: 6084898 - DNA, 13 bp, Homo sapiens
ccctcgtccacag

SEQ ID NO: 6084899 - DNA, 24 bp, Homo sapiens
ccctcgtccacaggggcaggcctg

SEQ ID NO: 6084900 - DNA, 16 bp, Homo sapiens
ccctcgtcccatccag

SEQ ID NO: 6084901 - DNA, 20 bp, Homo sapiens
ccctcgtcccatccagctac

SEQ ID NO: 6084902 - DNA, 14 bp, Homo sapiens
ccctcgtctccctg

SEQ ID NO: 6084903 - DNA, 15 bp, Homo sapiens
ccctcgtctccctgg

SEQ ID NO: 6084904 - DNA, 19 bp, Homo sapiens
ccctcgtctccctggccac

SEQ ID NO: 6084905 - DNA, 20 bp, Homo sapiens
ccctcgtctccctggccacc

SEQ ID NO: 6084906 - DNA, 22 bp, Homo sapiens
ccctcgtgacagtggtgtgtgg

SEQ ID NO: 6084907 - DNA, 14 bp, Homo sapiens
ccctcgtgccagtc

SEQ ID NO: 6084908 - DNA, 16 bp, Homo sapiens
ccctcgtgccagtcgc

SEQ ID NO: 6084909 - DNA, 22 bp, Homo sapiens
ccctcgtgccagtcgcgctgcc

SEQ ID NO: 6084910 - DNA, 23 bp, Homo sapiens
ccctcgtgccagtcgcgctgcct

SEQ ID NO: 6084911 - DNA, 18 bp, Homo sapiens
ccctcgtggacacctgcc

SEQ ID NO: 6084912 - DNA, 19 bp, Homo sapiens
ccctcgtggacacctgccc

SEQ ID NO: 6084913 - DNA, 14 bp, Homo sapiens
ccctcgtggccagc

SEQ ID NO: 6084914 - DNA, 15 bp, Homo sapiens
ccctcgtggccagcc

SEQ ID NO: 6084915 - DNA, 20 bp, Homo sapiens
ccctcgtggccagcccggct

SEQ ID NO: 6084916 - DNA, 16 bp, Homo sapiens
ccctcgtggccttccc

SEQ ID NO: 6084917 - DNA, 23 bp, Homo sapiens
ccctcgtgggcttgtgctcggga

SEQ ID NO: 6084918 - DNA, 14 bp, Homo sapiens
ccctcgttgcccag

SEQ ID NO: 6084919 - DNA, 13 bp, Homo sapiens
ccctctaacccag

SEQ ID NO: 6084920 - DNA, 16 bp, Homo sapiens
ccctctaacccagtgg

SEQ ID NO: 6084921 - DNA, 15 bp, Homo sapiens
ccctctaactggaca

SEQ ID NO: 6084922 - DNA, 17 bp, Homo sapiens
ccctctaactggacagc

SEQ ID NO: 6084923 - DNA, 19 bp, Homo sapiens
ccctctaataaagctcctc

SEQ ID NO: 6084924 - DNA, 23 bp, Homo sapiens
ccctctaataaagctcctctgct

SEQ ID NO: 6084925 - DNA, 14 bp, Homo sapiens
ccctctaatttctc

SEQ ID NO: 6084926 - DNA, 13 bp, Homo sapiens
ccctctacctgga

SEQ ID NO: 6084927 - DNA, 16 bp, Homo sapiens
ccctctactcttcctg

SEQ ID NO: 6084928 - DNA, 20 bp, Homo sapiens
ccctctagaggctgcctggg

SEQ ID NO: 6084929 - DNA, 19 bp, Homo sapiens
ccctctaggctctgccttc

SEQ ID NO: 6084930 - DNA, 23 bp, Homo sapiens
ccctctagggcagggtgggagcc

SEQ ID NO: 6084931 - DNA, 17 bp, Homo sapiens
ccctctatttacctgcg

SEQ ID NO: 6084932 - DNA, 15 bp, Homo sapiens
ccctctatttagcat

SEQ ID NO: 6084933 - DNA, 14 bp, Homo sapiens
ccctctatttctct

SEQ ID NO: 6084934 - DNA, 16 bp, Homo sapiens
ccctctcacgccaccc

SEQ ID NO: 6084935 - DNA, 20 bp, Homo sapiens
ccctctcacgccacccccgc

SEQ ID NO: 6084936 - DNA, 12 bp, Homo sapiens
ccctctcactcc

SEQ ID NO: 6084937 - DNA, 14 bp, Homo sapiens
ccctctcactccag

SEQ ID NO: 6084938 - DNA, 17 bp, Homo sapiens
ccctctcactccagcca

SEQ ID NO: 6084939 - DNA, 11 bp, Homo sapiens
ccctctcagaa

SEQ ID NO: 6084940 - DNA, 12 bp, Homo sapiens
ccctctcagagc

SEQ ID NO: 6084941 - DNA, 13 bp, Homo sapiens
ccctctcagctcc

SEQ ID NO: 6084942 - DNA, 12 bp, Homo sapiens
ccctctcaggag

SEQ ID NO: 6084943 - DNA, 13 bp, Homo sapiens
ccctctcaggaga

SEQ ID NO: 6084944 - DNA, 15 bp, Homo sapiens
ccctctcaggagagt

SEQ ID NO: 6084945 - DNA, 16 bp, Homo sapiens
ccctctcaggcatgcc

SEQ ID NO: 6084946 - DNA, 18 bp, Homo sapiens
ccctctcaggctgtccca

SEQ ID NO: 6084947 - DNA, 18 bp, Homo sapiens
ccctctcaggctgtgctt

SEQ ID NO: 6084948 - DNA, 21 bp, Homo sapiens
ccctctcaggtgaccaaaatc

SEQ ID NO: 6084949 - DNA, 20 bp, Homo sapiens
ccctctcatgtccctccagg

SEQ ID NO: 6084950 - DNA, 16 bp, Homo sapiens
ccctctcatttagcct

SEQ ID NO: 6084951 - DNA, 14 bp, Homo sapiens
ccctctccaaatca

SEQ ID NO: 6084952 - DNA, 16 bp, Homo sapiens
ccctctccaaatcaag

SEQ ID NO: 6084953 - DNA, 23 bp, Homo sapiens
ccctctccaactgcctaaggccc

SEQ ID NO: 6084954 - DNA, 23 bp, Homo sapiens
ccctctccaagacagcagcagcc

SEQ ID NO: 6084955 - DNA, 17 bp, Homo sapiens
ccctctccacacccagc

SEQ ID NO: 6084956 - DNA, 18 bp, Homo sapiens
ccctctccacacccagcc

SEQ ID NO: 6084957 - DNA, 23 bp, Homo sapiens
ccctctccacacccatgactgcc

SEQ ID NO: 6084958 - DNA, 14 bp, Homo sapiens
ccctctccacccag

SEQ ID NO: 6084959 - DNA, 17 bp, Homo sapiens
ccctctccacccagagg

SEQ ID NO: 6084960 - DNA, 18 bp, Homo sapiens
ccctctccacccagaggt

SEQ ID NO: 6084961 - DNA, 14 bp, Homo sapiens
ccctctccactctt

SEQ ID NO: 6084962 - DNA, 13 bp, Homo sapiens
ccctctccagcag

SEQ ID NO: 6084963 - DNA, 19 bp, Homo sapiens
ccctctccatctcccaagg

SEQ ID NO: 6084964 - DNA, 23 bp, Homo sapiens
ccctctcccacccaaggagaacg

SEQ ID NO: 6084965 - DNA, 18 bp, Homo sapiens
ccctctcccaccctcttc

SEQ ID NO: 6084966 - DNA, 13 bp, Homo sapiens
ccctctcccagga

SEQ ID NO: 6084967 - DNA, 14 bp, Homo sapiens
ccctctcccaggga

SEQ ID NO: 6084968 - DNA, 17 bp, Homo sapiens
ccctctcccccgcccaa

SEQ ID NO: 6084969 - DNA, 15 bp, Homo sapiens
ccctctccccgggac

SEQ ID NO: 6084970 - DNA, 16 bp, Homo sapiens
ccctctcccctctctg

SEQ ID NO: 6084971 - DNA, 17 bp, Homo sapiens
ccctctcccctctctgc

SEQ ID NO: 6084972 - DNA, 22 bp, Homo sapiens
ccctctcccctgccccctgcag

SEQ ID NO: 6084973 - DNA, 15 bp, Homo sapiens
ccctctccctcagtc

SEQ ID NO: 6084974 - DNA, 17 bp, Homo sapiens
ccctctccctctctctg

SEQ ID NO: 6084975 - DNA, 13 bp, Homo sapiens
ccctctccctgca

SEQ ID NO: 6084976 - DNA, 15 bp, Homo sapiens
ccctctccctgcatg

SEQ ID NO: 6084977 - DNA, 16 bp, Homo sapiens
ccctctccctgcatgg

SEQ ID NO: 6084978 - DNA, 17 bp, Homo sapiens
ccctctccctgtgttct

SEQ ID NO: 6084979 - DNA, 21 bp, Homo sapiens
ccctctccctgtgttctgggc

SEQ ID NO: 6084980 - DNA, 18 bp, Homo sapiens
ccctctcccttccctcct

SEQ ID NO: 6084981 - DNA, 22 bp, Homo sapiens
ccctctcccttgggctctgatg

SEQ ID NO: 6084982 - DNA, 19 bp, Homo sapiens
ccctctcctatgtggcagc

SEQ ID NO: 6084983 - DNA, 16 bp, Homo sapiens
ccctctcctcccagct

SEQ ID NO: 6084984 - DNA, 22 bp, Homo sapiens
ccctctcctcccagctgcttta

SEQ ID NO: 6084985 - DNA, 19 bp, Homo sapiens
ccctctcctccgtggcaca

SEQ ID NO: 6084986 - DNA, 22 bp, Homo sapiens
ccctctcctctcctcctctgtg

SEQ ID NO: 6084987 - DNA, 15 bp, Homo sapiens
ccctctcctctgccc

SEQ ID NO: 6084988 - DNA, 20 bp, Homo sapiens
ccctctcctgagcctgtctc

SEQ ID NO: 6084989 - DNA, 11 bp, Homo sapiens
ccctctcctgc

SEQ ID NO: 6084990 - DNA, 13 bp, Homo sapiens
ccctctcctgcct

SEQ ID NO: 6084991 - DNA, 16 bp, Homo sapiens
ccctctcctggagggc

SEQ ID NO: 6084992 - DNA, 13 bp, Homo sapiens
ccctctcctgggc

SEQ ID NO: 6084993 - DNA, 23 bp, Homo sapiens
ccctctcctgggcagctgcctcc

SEQ ID NO: 6084994 - DNA, 11 bp, Homo sapiens
ccctctcctgt

SEQ ID NO: 6084995 - DNA, 14 bp, Homo sapiens
ccctctcctgtcct

SEQ ID NO: 6084996 - DNA, 14 bp, Homo sapiens
ccctctccttccaa

SEQ ID NO: 6084997 - DNA, 16 bp, Homo sapiens
ccctctcgccccatcc

SEQ ID NO: 6084998 - DNA, 13 bp, Homo sapiens
ccctctcgcctca

SEQ ID NO: 6084999 - DNA, 17 bp, Homo sapiens
cctgagtcaactggagc

SEQ ID NO: 6085000 - DNA, 22 bp, Homo sapiens
cctgagtcacccctctgtccag

SEQ ID NO: 6085001 - DNA, 14 bp, Homo sapiens
cctgagtcactggt

SEQ ID NO: 6085002 - DNA, 16 bp, Homo sapiens
cctgagtcagggccca

SEQ ID NO: 6085003 - DNA, 20 bp, Homo sapiens
cctgagtcagggcccagagg

SEQ ID NO: 6085004 - DNA, 21 bp, Homo sapiens
cctgagtcagggcccagaggc

SEQ ID NO: 6085005 - DNA, 15 bp, Homo sapiens
cctgagtcagtgctc

SEQ ID NO: 6085006 - DNA, 11 bp, Homo sapiens
cctgagtccca

SEQ ID NO: 6085007 - DNA, 17 bp, Homo sapiens
cctgagtccccacctgc

SEQ ID NO: 6085008 - DNA, 14 bp, Homo sapiens
cctgagtccgcctg

SEQ ID NO: 6085009 - DNA, 15 bp, Homo sapiens
cctgagtcctggtcc

SEQ ID NO: 6085010 - DNA, 21 bp, Homo sapiens
cctgagtcctggtttcctggc

SEQ ID NO: 6085011 - DNA, 23 bp, Homo sapiens
cctgagtcctggtttcctggcag

SEQ ID NO: 6085012 - DNA, 22 bp, Homo sapiens
cctgagtcggccccacatggga

SEQ ID NO: 6085013 - DNA, 19 bp, Homo sapiens
cctgagtcgtacagaaagc

SEQ ID NO: 6085014 - DNA, 21 bp, Homo sapiens
cctgagtcgtacagaaagctg

SEQ ID NO: 6085015 - DNA, 22 bp, Homo sapiens
cctgagtcgtacagaaagctgc

SEQ ID NO: 6085016 - DNA, 14 bp, Homo sapiens
cctgagtctcctgt

SEQ ID NO: 6085017 - DNA, 23 bp, Homo sapiens
cctgagtctgctatattttcatg

SEQ ID NO: 6085018 - DNA, 17 bp, Homo sapiens
cctgagtctggacctcc

SEQ ID NO: 6085019 - DNA, 12 bp, Homo sapiens
cctgagtcttgg

SEQ ID NO: 6085020 - DNA, 19 bp, Homo sapiens
cctgagtcttggcctgcct

SEQ ID NO: 6085021 - DNA, 20 bp, Homo sapiens
cctgagtgacctccttctgc

SEQ ID NO: 6085022 - DNA, 17 bp, Homo sapiens
cctgagtgagtgtgtgt

SEQ ID NO: 6085023 - DNA, 17 bp, Homo sapiens
cctgagtgcgggctgag

SEQ ID NO: 6085024 - DNA, 19 bp, Homo sapiens
cctgagtggatctccaagg

SEQ ID NO: 6085025 - DNA, 21 bp, Homo sapiens
cctgagtggccagggaatcta

SEQ ID NO: 6085026 - DNA, 17 bp, Homo sapiens
cctgagtgggctgggcc

SEQ ID NO: 6085027 - DNA, 14 bp, Homo sapiens
cctgagtggggcca

SEQ ID NO: 6085028 - DNA, 15 bp, Homo sapiens
cctgagtggtcactg

SEQ ID NO: 6085029 - DNA, 16 bp, Homo sapiens
cctgagtggtcactgg

SEQ ID NO: 6085030 - DNA, 17 bp, Homo sapiens
cctgagtggtcactggt

SEQ ID NO: 6085031 - DNA, 14 bp, Homo sapiens
cctgagtgtcccaa

SEQ ID NO: 6085032 - DNA, 16 bp, Homo sapiens
cctgagtgtcccaagc

SEQ ID NO: 6085033 - DNA, 16 bp, Homo sapiens
cctgagttcccaaagg

SEQ ID NO: 6085034 - DNA, 17 bp, Homo sapiens
cctgagttcccgggagc

SEQ ID NO: 6085035 - DNA, 19 bp, Homo sapiens
cctgagttcccgggagctg

SEQ ID NO: 6085036 - DNA, 14 bp, Homo sapiens
cctgagttcctagc

SEQ ID NO: 6085037 - DNA, 18 bp, Homo sapiens
cctgagttcctagccacc

SEQ ID NO: 6085038 - DNA, 20 bp, Homo sapiens
cctgagttcctagccaccgc

SEQ ID NO: 6085039 - DNA, 15 bp, Homo sapiens
cctgagttctgacac

SEQ ID NO: 6085040 - DNA, 15 bp, Homo sapiens
cctgagttgaagagg

SEQ ID NO: 6085041 - DNA, 18 bp, Homo sapiens
cctgagttgaagagggga

SEQ ID NO: 6085042 - DNA, 15 bp, Homo sapiens
cctgagttgtataaa

SEQ ID NO: 6085043 - DNA, 17 bp, Homo sapiens
cctgagtttccagcctg

SEQ ID NO: 6085044 - DNA, 16 bp, Homo sapiens
cctgagtttgggagag

SEQ ID NO: 6085045 - DNA, 20 bp, Homo sapiens
cctgataaaacaacagctcg

SEQ ID NO: 6085046 - DNA, 22 bp, Homo sapiens
cctgataaacattaaacactgt

SEQ ID NO: 6085047 - DNA, 23 bp, Homo sapiens
cctgataaacattaaacactgta

SEQ ID NO: 6085048 - DNA, 19 bp, Homo sapiens
cctgataaagaacatctgt

SEQ ID NO: 6085049 - DNA, 17 bp, Homo sapiens
cctgataacaacctgga

SEQ ID NO: 6085050 - DNA, 19 bp, Homo sapiens
cctgataacaacctggaga

SEQ ID NO: 6085051 - DNA, 15 bp, Homo sapiens
cctgataactctgta

SEQ ID NO: 6085052 - DNA, 19 bp, Homo sapiens
cctgataataaagtgactg

SEQ ID NO: 6085053 - DNA, 20 bp, Homo sapiens
cctgatactcctaaaacttt

SEQ ID NO: 6085054 - DNA, 15 bp, Homo sapiens
cctgatactgggtac

SEQ ID NO: 6085055 - DNA, 22 bp, Homo sapiens
cctgatactgggtacaagagcc

SEQ ID NO: 6085056 - DNA, 23 bp, Homo sapiens
cctgatactgggtacaagagcca

SEQ ID NO: 6085057 - DNA, 16 bp, Homo sapiens
cctgatagctacccac

SEQ ID NO: 6085058 - DNA, 22 bp, Homo sapiens
cctgatagtcacctgctggttg

SEQ ID NO: 6085059 - DNA, 21 bp, Homo sapiens
cctgatatagatcacataaca

SEQ ID NO: 6085060 - DNA, 14 bp, Homo sapiens
cctgatcaatgaca

SEQ ID NO: 6085061 - DNA, 17 bp, Homo sapiens
cctgatcaatgacagag

SEQ ID NO: 6085062 - DNA, 24 bp, Homo sapiens
cctgatcacctctggctttgtctc

SEQ ID NO: 6085063 - DNA, 15 bp, Homo sapiens
cctgatcactcccag

SEQ ID NO: 6085064 - DNA, 17 bp, Homo sapiens
cctgatcactcccagca

SEQ ID NO: 6085065 - DNA, 18 bp, Homo sapiens
cctgatcactcccagcac

SEQ ID NO: 6085066 - DNA, 22 bp, Homo sapiens
cctgatcagaggcatttgagca

SEQ ID NO: 6085067 - DNA, 23 bp, Homo sapiens
cctgatcaggcttcctggtgaga

SEQ ID NO: 6085068 - DNA, 15 bp, Homo sapiens
cctgatcatggtcag

SEQ ID NO: 6085069 - DNA, 16 bp, Homo sapiens
cctgatcatggtcagc

SEQ ID NO: 6085070 - DNA, 19 bp, Homo sapiens
cctgatcatggtcagctca

SEQ ID NO: 6085071 - DNA, 21 bp, Homo sapiens
cctgatcatggtcagctcaca

SEQ ID NO: 6085072 - DNA, 15 bp, Homo sapiens
cctgatccagacaag

SEQ ID NO: 6085073 - DNA, 15 bp, Homo sapiens
cctgatccagcctct

SEQ ID NO: 6085074 - DNA, 15 bp, Homo sapiens
cctgatcccaccccc

SEQ ID NO: 6085075 - DNA, 21 bp, Homo sapiens
cctgatcccaccccctcctcc

SEQ ID NO: 6085076 - DNA, 18 bp, Homo sapiens
cctgatcccactcctagg

SEQ ID NO: 6085077 - DNA, 17 bp, Homo sapiens
cctgatcccagacctgt

SEQ ID NO: 6085078 - DNA, 14 bp, Homo sapiens
cctgatcccagaga

SEQ ID NO: 6085079 - DNA, 19 bp, Homo sapiens
cctgatcccagagagcccg

SEQ ID NO: 6085080 - DNA, 13 bp, Homo sapiens
cctgatccctcca

SEQ ID NO: 6085081 - DNA, 14 bp, Homo sapiens
cctgatccctccac

SEQ ID NO: 6085082 - DNA, 21 bp, Homo sapiens
cctgatccgtccgaggctgct

SEQ ID NO: 6085083 - DNA, 17 bp, Homo sapiens
cctgatctctcagcccc

SEQ ID NO: 6085084 - DNA, 18 bp, Homo sapiens
cctgatctctcagcccca

SEQ ID NO: 6085085 - DNA, 20 bp, Homo sapiens
cctgatctctgacctctgct

SEQ ID NO: 6085086 - DNA, 22 bp, Homo sapiens
cctgatctctgacctctgctga

SEQ ID NO: 6085087 - DNA, 20 bp, Homo sapiens
cctgatctctgctccctgca

SEQ ID NO: 6085088 - DNA, 14 bp, Homo sapiens
cctgatctcttcct

SEQ ID NO: 6085089 - DNA, 14 bp, Homo sapiens
cctgatctggccca

SEQ ID NO: 6085090 - DNA, 18 bp, Homo sapiens
cctgatctggcccaagct

SEQ ID NO: 6085091 - DNA, 22 bp, Homo sapiens
cctgatctggcccaagctgggc

SEQ ID NO: 6085092 - DNA, 17 bp, Homo sapiens
cctgatctttctagagc

SEQ ID NO: 6085093 - DNA, 13 bp, Homo sapiens
cctgatgaaaata

SEQ ID NO: 6085094 - DNA, 13 bp, Homo sapiens
cctgatgaacagt

SEQ ID NO: 6085095 - DNA, 15 bp, Homo sapiens
cctgatgacctggga

SEQ ID NO: 6085096 - DNA, 17 bp, Homo sapiens
cctgatgagactccact

SEQ ID NO: 6085097 - DNA, 14 bp, Homo sapiens
cctgatgatgctgg

SEQ ID NO: 6085098 - DNA, 15 bp, Homo sapiens
cctgatgatgctggc

SEQ ID NO: 6085099 - DNA, 16 bp, Homo sapiens
cctgatgatgctggcc

SEQ ID NO: 6085100 - DNA, 13 bp, Homo sapiens
cctgatgattttt

SEQ ID NO: 6085101 - DNA, 15 bp, Homo sapiens
cctgatgcagcctgt

SEQ ID NO: 6085102 - DNA, 18 bp, Homo sapiens
cctgatgcccaggtcacc

SEQ ID NO: 6085103 - DNA, 16 bp, Homo sapiens
cctgatgccccttccc

SEQ ID NO: 6085104 - DNA, 17 bp, Homo sapiens
cctgatgcgtctaccca

SEQ ID NO: 6085105 - DNA, 18 bp, Homo sapiens
cctgatgcgtctacccag

SEQ ID NO: 6085106 - DNA, 17 bp, Homo sapiens
cctgatgctaattttca

SEQ ID NO: 6085107 - DNA, 16 bp, Homo sapiens
cctgatgctcatatca

SEQ ID NO: 6085108 - DNA, 13 bp, Homo sapiens
cctgatgctccct

SEQ ID NO: 6085109 - DNA, 16 bp, Homo sapiens
cctgatgctccctccc

SEQ ID NO: 6085110 - DNA, 23 bp, Homo sapiens
cctgatgctgacattcacctgcc

SEQ ID NO: 6085111 - DNA, 13 bp, Homo sapiens
cctgatgctgccc

SEQ ID NO: 6085112 - DNA, 24 bp, Homo sapiens
cctgatgctggggacacagcatca

SEQ ID NO: 6085113 - DNA, 17 bp, Homo sapiens
cctgatgcttcttcaga

SEQ ID NO: 6085114 - DNA, 18 bp, Homo sapiens
cctgatgcttcttcagag

SEQ ID NO: 6085115 - DNA, 19 bp, Homo sapiens
cctgatgcttcttcagaga

SEQ ID NO: 6085116 - DNA, 16 bp, Homo sapiens
cctgatggagaggaga

SEQ ID NO: 6085117 - DNA, 18 bp, Homo sapiens
cctgatggagaggagaac

SEQ ID NO: 6085118 - DNA, 19 bp, Homo sapiens
cctgatggagagtgagagc

SEQ ID NO: 6085119 - DNA, 20 bp, Homo sapiens
cctgatggagtgtgcagaca

SEQ ID NO: 6085120 - DNA, 22 bp, Homo sapiens
cctgatggagtgtgcagacagc

SEQ ID NO: 6085121 - DNA, 19 bp, Homo sapiens
cctgatggcacccacacag

SEQ ID NO: 6085122 - DNA, 21 bp, Homo sapiens
cctgatggcacttagctatca

SEQ ID NO: 6085123 - DNA, 12 bp, Homo sapiens
cctgatggcaga

SEQ ID NO: 6085124 - DNA, 20 bp, Homo sapiens
cctgatggcaggatggcctg

SEQ ID NO: 6085125 - DNA, 12 bp, Homo sapiens
cctgatggccaa

SEQ ID NO: 6085126 - DNA, 13 bp, Homo sapiens
cctgatggccaag

SEQ ID NO: 6085127 - DNA, 14 bp, Homo sapiens
cctgatggccaaga

SEQ ID NO: 6085128 - DNA, 17 bp, Homo sapiens
cctgatggccaagagca

SEQ ID NO: 6085129 - DNA, 19 bp, Homo sapiens
cctgatggccaagagcatc

SEQ ID NO: 6085130 - DNA, 21 bp, Homo sapiens
cctgatggccaagggggtgga

SEQ ID NO: 6085131 - DNA, 19 bp, Homo sapiens
cctgatgggagtaggctcc

SEQ ID NO: 6085132 - DNA, 16 bp, Homo sapiens
cctgatggggaaggga

SEQ ID NO: 6085133 - DNA, 18 bp, Homo sapiens
cctgatggggaagggact

SEQ ID NO: 6085134 - DNA, 18 bp, Homo sapiens
cctgatggtacaggaaag

SEQ ID NO: 6085135 - DNA, 20 bp, Homo sapiens
cctgatggtcagctcccttc

SEQ ID NO: 6085136 - DNA, 19 bp, Homo sapiens
cctgatggtgaaaccaaac

SEQ ID NO: 6085137 - DNA, 19 bp, Homo sapiens
cctgatggtgctgctcagg

SEQ ID NO: 6085138 - DNA, 20 bp, Homo sapiens
cctgatggtgtcattctgcc

SEQ ID NO: 6085139 - DNA, 16 bp, Homo sapiens
cctgatgtttgaagag

SEQ ID NO: 6085140 - DNA, 20 bp, Homo sapiens
cctgatgttttgccgtggct

SEQ ID NO: 6085141 - DNA, 21 bp, Homo sapiens
cctgattaaggcgtggcttct

SEQ ID NO: 6085142 - DNA, 22 bp, Homo sapiens
cctgattaccagtctgattata

SEQ ID NO: 6085143 - DNA, 18 bp, Homo sapiens
cctgattattgaatgtta

SEQ ID NO: 6085144 - DNA, 14 bp, Homo sapiens
cctgattatttatc

SEQ ID NO: 6085145 - DNA, 15 bp, Homo sapiens
cctgattattttcag

SEQ ID NO: 6085146 - DNA, 19 bp, Homo sapiens
cctgattattttcagaagc

SEQ ID NO: 6085147 - DNA, 16 bp, Homo sapiens
cctgattcaactaaaa

SEQ ID NO: 6085148 - DNA, 18 bp, Homo sapiens
cctgattcactgcctatg

SEQ ID NO: 6085149 - DNA, 20 bp, Homo sapiens
cctgattcatactccttttg

SEQ ID NO: 6085150 - DNA, 23 bp, Homo sapiens
cctgattcatactccttttggct

SEQ ID NO: 6085151 - DNA, 13 bp, Homo sapiens
cctgattccccac

SEQ ID NO: 6085152 - DNA, 13 bp, Homo sapiens
cctgattcctctc

SEQ ID NO: 6085153 - DNA, 20 bp, Homo sapiens
cctgattctaaaatgtctca

SEQ ID NO: 6085154 - DNA, 13 bp, Homo sapiens
cctgattctccct

SEQ ID NO: 6085155 - DNA, 20 bp, Homo sapiens
cctgattcttgattcctggc

SEQ ID NO: 6085156 - DNA, 19 bp, Homo sapiens
cctgattgatcacacagtg

SEQ ID NO: 6085157 - DNA, 17 bp, Homo sapiens
cctgattgccaagctca

SEQ ID NO: 6085158 - DNA, 14 bp, Homo sapiens
cctgattgctctgg

SEQ ID NO: 6085159 - DNA, 21 bp, Homo sapiens
cctgattggccactggatcct

SEQ ID NO: 6085160 - DNA, 22 bp, Homo sapiens
cctgattggggcctcacccaga

SEQ ID NO: 6085161 - DNA, 15 bp, Homo sapiens
cctgattgtattttt

SEQ ID NO: 6085162 - DNA, 22 bp, Homo sapiens
cctgattgtattttttttttaa

SEQ ID NO: 6085163 - DNA, 17 bp, Homo sapiens
cctgattgtgccagtgc

SEQ ID NO: 6085164 - DNA, 18 bp, Homo sapiens
cctgattgtgccagtgca

SEQ ID NO: 6085165 - DNA, 23 bp, Homo sapiens
cctgatttaatatgcaaagtcta

SEQ ID NO: 6085166 - DNA, 21 bp, Homo sapiens
cctgatttaggagaagccagg

SEQ ID NO: 6085167 - DNA, 19 bp, Homo sapiens
cctgatttcagaagagact

SEQ ID NO: 6085168 - DNA, 17 bp, Homo sapiens
cctgatttcagggaaat

SEQ ID NO: 6085169 - DNA, 18 bp, Homo sapiens
cctgatttcttattgaat

SEQ ID NO: 6085170 - DNA, 14 bp, Homo sapiens
cctgatttgctgtt

SEQ ID NO: 6085171 - DNA, 13 bp, Homo sapiens
cctgatttggagc

SEQ ID NO: 6085172 - DNA, 15 bp, Homo sapiens
cctgattttcaaaat

SEQ ID NO: 6085173 - DNA, 22 bp, Homo sapiens
cctgattttttttccttttaat

SEQ ID NO: 6085174 - DNA, 14 bp, Homo sapiens
cctgcaaaaaatac

SEQ ID NO: 6085175 - DNA, 20 bp, Homo sapiens
cctgcaaaaagaaaaaaaga

SEQ ID NO: 6085176 - DNA, 13 bp, Homo sapiens
cctgcaaaaatga

SEQ ID NO: 6085177 - DNA, 16 bp, Homo sapiens
ccctctcgcctcatta

SEQ ID NO: 6085178 - DNA, 15 bp, Homo sapiens
ccctctcgcgcccag

SEQ ID NO: 6085179 - DNA, 16 bp, Homo sapiens
ccctctcggccaggca

SEQ ID NO: 6085180 - DNA, 21 bp, Homo sapiens
ccctctcggccaggcattggc

SEQ ID NO: 6085181 - DNA, 19 bp, Homo sapiens
ccctctcgggctctctcac

SEQ ID NO: 6085182 - DNA, 23 bp, Homo sapiens
ccctctctatacctttcaaagaa

SEQ ID NO: 6085183 - DNA, 12 bp, Homo sapiens
ccctctctcaca

SEQ ID NO: 6085184 - DNA, 15 bp, Homo sapiens
ccctctctcaccagc

SEQ ID NO: 6085185 - DNA, 17 bp, Homo sapiens
ccctctctcaccagcct

SEQ ID NO: 6085186 - DNA, 12 bp, Homo sapiens
ccctctctcagc

SEQ ID NO: 6085187 - DNA, 22 bp, Homo sapiens
ccctctctcatatcactgaagg

SEQ ID NO: 6085188 - DNA, 23 bp, Homo sapiens
ccctctctcatatcactgaagga

SEQ ID NO: 6085189 - DNA, 19 bp, Homo sapiens
ccctctctcccatttcagg

SEQ ID NO: 6085190 - DNA, 16 bp, Homo sapiens
ccctctctccctgcct

SEQ ID NO: 6085191 - DNA, 23 bp, Homo sapiens
ccctctctccgccccggacaggg

SEQ ID NO: 6085192 - DNA, 13 bp, Homo sapiens
ccctctctcctcc

SEQ ID NO: 6085193 - DNA, 12 bp, Homo sapiens
ccctctctcctg

SEQ ID NO: 6085194 - DNA, 22 bp, Homo sapiens
ccctctctcctggactggttat

SEQ ID NO: 6085195 - DNA, 12 bp, Homo sapiens
ccctctctctga

SEQ ID NO: 6085196 - DNA, 15 bp, Homo sapiens
ccctctctctgggtc

SEQ ID NO: 6085197 - DNA, 14 bp, Homo sapiens
ccctctctcttctg

SEQ ID NO: 6085198 - DNA, 15 bp, Homo sapiens
ccctctctcttctgc

SEQ ID NO: 6085199 - DNA, 18 bp, Homo sapiens
ccctctctcttctgctcc

SEQ ID NO: 6085200 - DNA, 23 bp, Homo sapiens
ccctctctgaaggaggccacctc

SEQ ID NO: 6085201 - DNA, 13 bp, Homo sapiens
ccctctctgcacc

SEQ ID NO: 6085202 - DNA, 17 bp, Homo sapiens
ccctctctgcacctgtc

SEQ ID NO: 6085203 - DNA, 12 bp, Homo sapiens
ccctctctgcat

SEQ ID NO: 6085204 - DNA, 20 bp, Homo sapiens
ccctctctgcatctgaccac

SEQ ID NO: 6085205 - DNA, 14 bp, Homo sapiens
ccctctctgcccct

SEQ ID NO: 6085206 - DNA, 12 bp, Homo sapiens
ccctctctgctc

SEQ ID NO: 6085207 - DNA, 15 bp, Homo sapiens
ccctctctgctcctt

SEQ ID NO: 6085208 - DNA, 22 bp, Homo sapiens
ccctctctggctaaggacaggc

SEQ ID NO: 6085209 - DNA, 14 bp, Homo sapiens
ccctctctgggcct

SEQ ID NO: 6085210 - DNA, 15 bp, Homo sapiens
ccctctctggtttcc

SEQ ID NO: 6085211 - DNA, 14 bp, Homo sapiens
ccctctctgtccaa

SEQ ID NO: 6085212 - DNA, 13 bp, Homo sapiens
ccctctctgtgca

SEQ ID NO: 6085213 - DNA, 14 bp, Homo sapiens
ccctctcttcccta

SEQ ID NO: 6085214 - DNA, 14 bp, Homo sapiens
ccctctcttccggg

SEQ ID NO: 6085215 - DNA, 18 bp, Homo sapiens
ccctctcttccgggagct

SEQ ID NO: 6085216 - DNA, 13 bp, Homo sapiens
ccctctcttgcac

SEQ ID NO: 6085217 - DNA, 18 bp, Homo sapiens
ccctctcttgcacccgcc

SEQ ID NO: 6085218 - DNA, 23 bp, Homo sapiens
ccctctcttgcacccgcctctcc

SEQ ID NO: 6085219 - DNA, 13 bp, Homo sapiens
ccctctcttgcct

SEQ ID NO: 6085220 - DNA, 16 bp, Homo sapiens
ccctctctttctctgg

SEQ ID NO: 6085221 - DNA, 14 bp, Homo sapiens
ccctctctttgagt

SEQ ID NO: 6085222 - DNA, 20 bp, Homo sapiens
ccctctgaaagttgtacatg

SEQ ID NO: 6085223 - DNA, 13 bp, Homo sapiens
ccctctgaaatac

SEQ ID NO: 6085224 - DNA, 22 bp, Homo sapiens
ccctctgaatggtccagggttg

SEQ ID NO: 6085225 - DNA, 11 bp, Homo sapiens
ccctctgaccc

SEQ ID NO: 6085226 - DNA, 14 bp, Homo sapiens
ccctctgacctgca

SEQ ID NO: 6085227 - DNA, 21 bp, Homo sapiens
ccctctgagaattccaaggag

SEQ ID NO: 6085228 - DNA, 13 bp, Homo sapiens
ccctctgagccgc

SEQ ID NO: 6085229 - DNA, 10 bp, Homo sapiens
ccctctgagg

SEQ ID NO: 6085230 - DNA, 16 bp, Homo sapiens
ccctctgcagaacagt

SEQ ID NO: 6085231 - DNA, 18 bp, Homo sapiens
ccctctgcattgacctgg

SEQ ID NO: 6085232 - DNA, 13 bp, Homo sapiens
ccctctgcccagc

SEQ ID NO: 6085233 - DNA, 14 bp, Homo sapiens
ccctctgcccagct

SEQ ID NO: 6085234 - DNA, 19 bp, Homo sapiens
ccctctgcccagcttgggc

SEQ ID NO: 6085235 - DNA, 23 bp, Homo sapiens
ccctctgcccagcttgggcccag

SEQ ID NO: 6085236 - DNA, 15 bp, Homo sapiens
ccctctgcccaggga

SEQ ID NO: 6085237 - DNA, 20 bp, Homo sapiens
ccctctgccccaagcagcca

SEQ ID NO: 6085238 - DNA, 15 bp, Homo sapiens
ccctctgccccaccc

SEQ ID NO: 6085239 - DNA, 17 bp, Homo sapiens
ccctctgccccaccctc

SEQ ID NO: 6085240 - DNA, 14 bp, Homo sapiens
ccctctgcccccag

SEQ ID NO: 6085241 - DNA, 15 bp, Homo sapiens
ccctctgcccccagc

SEQ ID NO: 6085242 - DNA, 18 bp, Homo sapiens
ccctctgcccccagctgc

SEQ ID NO: 6085243 - DNA, 23 bp, Homo sapiens
ccctctgccccgccctccttccc

SEQ ID NO: 6085244 - DNA, 12 bp, Homo sapiens
ccctctgccctg

SEQ ID NO: 6085245 - DNA, 14 bp, Homo sapiens
ccctctgccctgcg

SEQ ID NO: 6085246 - DNA, 14 bp, Homo sapiens
ccctctgccctgta

SEQ ID NO: 6085247 - DNA, 19 bp, Homo sapiens
ccctctgccgaccgcctgc

SEQ ID NO: 6085248 - DNA, 16 bp, Homo sapiens
ccctctgcctcatcct

SEQ ID NO: 6085249 - DNA, 12 bp, Homo sapiens
ccctctgcctgc

SEQ ID NO: 6085250 - DNA, 13 bp, Homo sapiens
ccctctgcctgca

SEQ ID NO: 6085251 - DNA, 19 bp, Homo sapiens
ccctctgcctgcactccct

SEQ ID NO: 6085252 - DNA, 21 bp, Homo sapiens
ccctctgcctgcactccctgg

SEQ ID NO: 6085253 - DNA, 14 bp, Homo sapiens
ccctctgcctgtcc

SEQ ID NO: 6085254 - DNA, 23 bp, Homo sapiens
ccctctgcctgtccctctcaggc

SEQ ID NO: 6085255 - DNA, 16 bp, Homo sapiens
ccctctgccttcaggc

SEQ ID NO: 6085256 - DNA, 12 bp, Homo sapiens
ccctctgccttg

SEQ ID NO: 6085257 - DNA, 21 bp, Homo sapiens
ccctctgcctttgagcttctc

SEQ ID NO: 6085258 - DNA, 12 bp, Homo sapiens
ccctctgcgccc

SEQ ID NO: 6085259 - DNA, 15 bp, Homo sapiens
ccctctgcgccccag

SEQ ID NO: 6085260 - DNA, 16 bp, Homo sapiens
ccctctgcgccccagc

SEQ ID NO: 6085261 - DNA, 19 bp, Homo sapiens
ccctctgctatgtctgtga

SEQ ID NO: 6085262 - DNA, 21 bp, Homo sapiens
ccctctgctatgtctgtgatg

SEQ ID NO: 6085263 - DNA, 14 bp, Homo sapiens
ccctctgctcagcc

SEQ ID NO: 6085264 - DNA, 19 bp, Homo sapiens
ccctctgctccgtgtgtct

SEQ ID NO: 6085265 - DNA, 20 bp, Homo sapiens
ccctctgctccgtgtgtctc

SEQ ID NO: 6085266 - DNA, 12 bp, Homo sapiens
ccctctgctctc

SEQ ID NO: 6085267 - DNA, 14 bp, Homo sapiens
ccctctgctgccgg

SEQ ID NO: 6085268 - DNA, 16 bp, Homo sapiens
ccctctgctgctgccc

SEQ ID NO: 6085269 - DNA, 13 bp, Homo sapiens
ccctctgctgctt

SEQ ID NO: 6085270 - DNA, 17 bp, Homo sapiens
ccctctgctgtcctgca

SEQ ID NO: 6085271 - DNA, 15 bp, Homo sapiens
ccctctggaagtggc

SEQ ID NO: 6085272 - DNA, 18 bp, Homo sapiens
ccctctggagaaggcctg

SEQ ID NO: 6085273 - DNA, 23 bp, Homo sapiens
ccctctggagaaggcctggaaga

SEQ ID NO: 6085274 - DNA, 22 bp, Homo sapiens
ccctctggaggggtgtggctcc

SEQ ID NO: 6085275 - DNA, 18 bp, Homo sapiens
ccctctggcccacacaga

SEQ ID NO: 6085276 - DNA, 16 bp, Homo sapiens
ccctctggccctgcct

SEQ ID NO: 6085277 - DNA, 12 bp, Homo sapiens
ccctctggccgc

SEQ ID NO: 6085278 - DNA, 16 bp, Homo sapiens
ccctctggctccagct

SEQ ID NO: 6085279 - DNA, 12 bp, Homo sapiens
ccctctgggaac

SEQ ID NO: 6085280 - DNA, 16 bp, Homo sapiens
ccctctgggaacctcc

SEQ ID NO: 6085281 - DNA, 19 bp, Homo sapiens
ccctctgggaacctcccag

SEQ ID NO: 6085282 - DNA, 20 bp, Homo sapiens
ccctctgggcctgttctctt

SEQ ID NO: 6085283 - DNA, 14 bp, Homo sapiens
ccctctggggccct

SEQ ID NO: 6085284 - DNA, 15 bp, Homo sapiens
ccctctggggccctt

SEQ ID NO: 6085285 - DNA, 12 bp, Homo sapiens
ccctctggggct

SEQ ID NO: 6085286 - DNA, 18 bp, Homo sapiens
ccctctggggctcagccc

SEQ ID NO: 6085287 - DNA, 16 bp, Homo sapiens
ccctctgggggctctg

SEQ ID NO: 6085288 - DNA, 16 bp, Homo sapiens
ccctctgggggtcctc

SEQ ID NO: 6085289 - DNA, 19 bp, Homo sapiens
ccctctgggggtcctctct

SEQ ID NO: 6085290 - DNA, 22 bp, Homo sapiens
ccctctggtccttctgacccca

SEQ ID NO: 6085291 - DNA, 19 bp, Homo sapiens
ccctctggtctactctaga

SEQ ID NO: 6085292 - DNA, 12 bp, Homo sapiens
ccctctggtgtg

SEQ ID NO: 6085293 - DNA, 13 bp, Homo sapiens
ccctctgtagctc

SEQ ID NO: 6085294 - DNA, 14 bp, Homo sapiens
ccctctgtatacaa

SEQ ID NO: 6085295 - DNA, 17 bp, Homo sapiens
ccctctgtcacccagtc

SEQ ID NO: 6085296 - DNA, 19 bp, Homo sapiens
ccctctgtcacccagtctg

SEQ ID NO: 6085297 - DNA, 21 bp, Homo sapiens
ccctctgtccagccagctcct

SEQ ID NO: 6085298 - DNA, 13 bp, Homo sapiens
ccctctgtcccca

SEQ ID NO: 6085299 - DNA, 14 bp, Homo sapiens
ccctctgtccccag

SEQ ID NO: 6085300 - DNA, 17 bp, Homo sapiens
ccctctgtccccaggcc

SEQ ID NO: 6085301 - DNA, 14 bp, Homo sapiens
ccctctgtcctgac

SEQ ID NO: 6085302 - DNA, 10 bp, Homo sapiens
ccctctgtct

SEQ ID NO: 6085303 - DNA, 16 bp, Homo sapiens
ccctctgtctgccctc

SEQ ID NO: 6085304 - DNA, 17 bp, Homo sapiens
ccctctgtctgtcttct

SEQ ID NO: 6085305 - DNA, 20 bp, Homo sapiens
ccctctgtcttttctcctcc

SEQ ID NO: 6085306 - DNA, 12 bp, Homo sapiens
ccctctgtgaaa

SEQ ID NO: 6085307 - DNA, 19 bp, Homo sapiens
ccctctgtgcctaataaag

SEQ ID NO: 6085308 - DNA, 21 bp, Homo sapiens
ccctctgtgcctaataaagtc

SEQ ID NO: 6085309 - DNA, 17 bp, Homo sapiens
ccctctgtggccaggag

SEQ ID NO: 6085310 - DNA, 20 bp, Homo sapiens
ccctctgtgtatttgctttt

SEQ ID NO: 6085311 - DNA, 19 bp, Homo sapiens
ccctctgtgtcctctcccc

SEQ ID NO: 6085312 - DNA, 19 bp, Homo sapiens
ccctctgttaggtccattt

SEQ ID NO: 6085313 - DNA, 23 bp, Homo sapiens
ccctctgttcagtaacagggcct

SEQ ID NO: 6085314 - DNA, 17 bp, Homo sapiens
ccctctgttctctcccc

SEQ ID NO: 6085315 - DNA, 24 bp, Homo sapiens
ccctctgttctctcccctcacatc

SEQ ID NO: 6085316 - DNA, 19 bp, Homo sapiens
ccctctgtttcccctcaga

SEQ ID NO: 6085317 - DNA, 15 bp, Homo sapiens
ccctcttagaagaaa

SEQ ID NO: 6085318 - DNA, 18 bp, Homo sapiens
ccctcttatgtacctctt

SEQ ID NO: 6085319 - DNA, 11 bp, Homo sapiens
ccctcttcaat

SEQ ID NO: 6085320 - DNA, 22 bp, Homo sapiens
ccctcttcaggggtcacctcct

SEQ ID NO: 6085321 - DNA, 18 bp, Homo sapiens
ccctcttccaaaggcagc

SEQ ID NO: 6085322 - DNA, 15 bp, Homo sapiens
ccctcttccagcttc

SEQ ID NO: 6085323 - DNA, 12 bp, Homo sapiens
ccctcttcccag

SEQ ID NO: 6085324 - DNA, 13 bp, Homo sapiens
ccctcttcccagc

SEQ ID NO: 6085325 - DNA, 12 bp, Homo sapiens
ccctcttccccc

SEQ ID NO: 6085326 - DNA, 14 bp, Homo sapiens
ccctcttccccctt

SEQ ID NO: 6085327 - DNA, 15 bp, Homo sapiens
ccctcttcccccttc

SEQ ID NO: 6085328 - DNA, 17 bp, Homo sapiens
ccctcttcccccttccc

SEQ ID NO: 6085329 - DNA, 14 bp, Homo sapiens
ccctcttccctaca

SEQ ID NO: 6085330 - DNA, 14 bp, Homo sapiens
ccctcttccctctc

SEQ ID NO: 6085331 - DNA, 22 bp, Homo sapiens
ccctcttccctggtaagaaaaa

SEQ ID NO: 6085332 - DNA, 16 bp, Homo sapiens
ccctcttcctccaaag

SEQ ID NO: 6085333 - DNA, 13 bp, Homo sapiens
ccctcttcctctt

SEQ ID NO: 6085334 - DNA, 11 bp, Homo sapiens
ccctcttcctg

SEQ ID NO: 6085335 - DNA, 22 bp, Homo sapiens
ccctcttcctggagccccagaa

SEQ ID NO: 6085336 - DNA, 12 bp, Homo sapiens
ccctcttccttg

SEQ ID NO: 6085337 - DNA, 16 bp, Homo sapiens
ccctcttctcaagtgc

SEQ ID NO: 6085338 - DNA, 16 bp, Homo sapiens
ccctcttctcctctgg

SEQ ID NO: 6085339 - DNA, 15 bp, Homo sapiens
ccctcttctccttgc

SEQ ID NO: 6085340 - DNA, 18 bp, Homo sapiens
ccctcttctctcctcagt

SEQ ID NO: 6085341 - DNA, 14 bp, Homo sapiens
ccctcttctctggg

SEQ ID NO: 6085342 - DNA, 21 bp, Homo sapiens
ccctcttctctgggcccagag

SEQ ID NO: 6085343 - DNA, 13 bp, Homo sapiens
ccctcttctgagc

SEQ ID NO: 6085344 - DNA, 13 bp, Homo sapiens
ccctcttctgccc

SEQ ID NO: 6085345 - DNA, 13 bp, Homo sapiens
ccctcttcttccc

SEQ ID NO: 6085346 - DNA, 20 bp, Homo sapiens
ccctcttcttccctggtctg

SEQ ID NO: 6085347 - DNA, 16 bp, Homo sapiens
ccctcttcttctcaag

SEQ ID NO: 6085348 - DNA, 11 bp, Homo sapiens
ccctcttgaga

SEQ ID NO: 6085349 - DNA, 16 bp, Homo sapiens
ccctcttgccagcctc

SEQ ID NO: 6085350 - DNA, 22 bp, Homo sapiens
ccctcttgccagcctccttgct

SEQ ID NO: 6085351 - DNA, 13 bp, Homo sapiens
ccctcttgccatc

SEQ ID NO: 6085352 - DNA, 16 bp, Homo sapiens
ccctcttgccatcctg

SEQ ID NO: 6085353 - DNA, 16 bp, Homo sapiens
ccctcttgcccatcct

SEQ ID NO: 6085354 - DNA, 13 bp, Homo sapiens
ccctcttgcccca

SEQ ID NO: 6085355 - DNA, 18 bp, Homo sapiens
ccctcttgcgggcctgga

SEQ ID NO: 6085356 - DNA, 12 bp, Homo sapiens
ccctcttggggg

SEQ ID NO: 6085357 - DNA, 21 bp, Homo sapiens
ccctcttgggggcactgctcc

SEQ ID NO: 6085358 - DNA, 21 bp, Homo sapiens
ccctcttgtccctttccctac

SEQ ID NO: 6085359 - DNA, 17 bp, Homo sapiens
ccctcttgtctcccctg

SEQ ID NO: 6085360 - DNA, 22 bp, Homo sapiens
cctgcaaaatttgatgccagga

SEQ ID NO: 6085361 - DNA, 14 bp, Homo sapiens
cctgcaaaatttta

SEQ ID NO: 6085362 - DNA, 17 bp, Homo sapiens
cctgcaaacagaacagg

SEQ ID NO: 6085363 - DNA, 20 bp, Homo sapiens
cctgcaaacagaacagggtc

SEQ ID NO: 6085364 - DNA, 21 bp, Homo sapiens
cctgcaaacagaacagggtca

SEQ ID NO: 6085365 - DNA, 19 bp, Homo sapiens
cctgcaaacctgctggtgg

SEQ ID NO: 6085366 - DNA, 15 bp, Homo sapiens
cctgcaaaccttttt

SEQ ID NO: 6085367 - DNA, 22 bp, Homo sapiens
cctgcaaacgctgcctgcccac

SEQ ID NO: 6085368 - DNA, 21 bp, Homo sapiens
cctgcaaacgctgcctgcccg

SEQ ID NO: 6085369 - DNA, 14 bp, Homo sapiens
cctgcaaactcact

SEQ ID NO: 6085370 - DNA, 12 bp, Homo sapiens
cctgcaaactgg

SEQ ID NO: 6085371 - DNA, 13 bp, Homo sapiens
cctgcaaactggg

SEQ ID NO: 6085372 - DNA, 15 bp, Homo sapiens
cctgcaaagacagta

SEQ ID NO: 6085373 - DNA, 21 bp, Homo sapiens
cctgcaaagacagtatttatt

SEQ ID NO: 6085374 - DNA, 18 bp, Homo sapiens
cctgcaacaccttgtttc

SEQ ID NO: 6085375 - DNA, 19 bp, Homo sapiens
cctgcaacaccttgtttcc

SEQ ID NO: 6085376 - DNA, 15 bp, Homo sapiens
cctgcaaccactctg

SEQ ID NO: 6085377 - DNA, 19 bp, Homo sapiens
cctgcaacttccgctgagg

SEQ ID NO: 6085378 - DNA, 20 bp, Homo sapiens
cctgcaacttccgctgaggg

SEQ ID NO: 6085379 - DNA, 22 bp, Homo sapiens
cctgcaacttctatcctttctt

SEQ ID NO: 6085380 - DNA, 23 bp, Homo sapiens
cctgcaacttctatcctttcttc

SEQ ID NO: 6085381 - DNA, 14 bp, Homo sapiens
cctgcaagaacaag

SEQ ID NO: 6085382 - DNA, 17 bp, Homo sapiens
cctgcaagaccacggag

SEQ ID NO: 6085383 - DNA, 15 bp, Homo sapiens
cctgcaagagaatct

SEQ ID NO: 6085384 - DNA, 13 bp, Homo sapiens
cctgcaagcagaa

SEQ ID NO: 6085385 - DNA, 13 bp, Homo sapiens
cctgcaagcccca

SEQ ID NO: 6085386 - DNA, 14 bp, Homo sapiens
cctgcaagccccag

SEQ ID NO: 6085387 - DNA, 19 bp, Homo sapiens
cctgcaagccccagggcct

SEQ ID NO: 6085388 - DNA, 22 bp, Homo sapiens
cctgcaagccccagggcctggg

SEQ ID NO: 6085389 - DNA, 19 bp, Homo sapiens
cctgcaagggacaggaagg

SEQ ID NO: 6085390 - DNA, 17 bp, Homo sapiens
cctgcaagggctcccca

SEQ ID NO: 6085391 - DNA, 16 bp, Homo sapiens
cctgcaaggtgcacct

SEQ ID NO: 6085392 - DNA, 17 bp, Homo sapiens
cctgcaaggtgcacctg

SEQ ID NO: 6085393 - DNA, 21 bp, Homo sapiens
cctgcaagtccatagctgagc

SEQ ID NO: 6085394 - DNA, 17 bp, Homo sapiens
cctgcaagttgctctga

SEQ ID NO: 6085395 - DNA, 16 bp, Homo sapiens
cctgcaatcccagcac

SEQ ID NO: 6085396 - DNA, 15 bp, Homo sapiens
cctgcaatctccagg

SEQ ID NO: 6085397 - DNA, 21 bp, Homo sapiens
cctgcaatctccagggctgcc

SEQ ID NO: 6085398 - DNA, 23 bp, Homo sapiens
cctgcaatctccagggctgcccc

SEQ ID NO: 6085399 - DNA, 14 bp, Homo sapiens
cctgcaatgaaagg

SEQ ID NO: 6085400 - DNA, 22 bp, Homo sapiens
cctgcaatgaaaggtactatat

SEQ ID NO: 6085401 - DNA, 13 bp, Homo sapiens
cctgcaatgcgtc

SEQ ID NO: 6085402 - DNA, 19 bp, Homo sapiens
cctgcaatttcatatgctg

SEQ ID NO: 6085403 - DNA, 15 bp, Homo sapiens
cctgcacaagccagg

SEQ ID NO: 6085404 - DNA, 17 bp, Homo sapiens
cctgcacaagccagggt

SEQ ID NO: 6085405 - DNA, 20 bp, Homo sapiens
cctgcacaataaaaatgttt

SEQ ID NO: 6085406 - DNA, 11 bp, Homo sapiens
cctgcacacaa

SEQ ID NO: 6085407 - DNA, 15 bp, Homo sapiens
cctgcacacacatgc

SEQ ID NO: 6085408 - DNA, 17 bp, Homo sapiens
cctgcacacacatgcat

SEQ ID NO: 6085409 - DNA, 19 bp, Homo sapiens
cctgcacacacctgcctgc

SEQ ID NO: 6085410 - DNA, 21 bp, Homo sapiens
cctgcacacagaatgctcagg

SEQ ID NO: 6085411 - DNA, 12 bp, Homo sapiens
cctgcacacagg

SEQ ID NO: 6085412 - DNA, 18 bp, Homo sapiens
cctgcacacaggacagcg

SEQ ID NO: 6085413 - DNA, 17 bp, Homo sapiens
cctgcacacccctgcac

SEQ ID NO: 6085414 - DNA, 20 bp, Homo sapiens
cctgcacacccctgcacaca

SEQ ID NO: 6085415 - DNA, 21 bp, Homo sapiens
cctgcacaccgtccctctccc

SEQ ID NO: 6085416 - DNA, 21 bp, Homo sapiens
cctgcacacgctccttcctct

SEQ ID NO: 6085417 - DNA, 19 bp, Homo sapiens
cctgcacacggcacagagc

SEQ ID NO: 6085418 - DNA, 12 bp, Homo sapiens
cctgcacactcc

SEQ ID NO: 6085419 - DNA, 20 bp, Homo sapiens
cctgcacactccatctcctg

SEQ ID NO: 6085420 - DNA, 19 bp, Homo sapiens
cctgcacagatatttccat

SEQ ID NO: 6085421 - DNA, 19 bp, Homo sapiens
cctgcacagattcccaggc

SEQ ID NO: 6085422 - DNA, 17 bp, Homo sapiens
cctgcacagcaggctgc

SEQ ID NO: 6085423 - DNA, 20 bp, Homo sapiens
cctgcacagcaggctgccag

SEQ ID NO: 6085424 - DNA, 23 bp, Homo sapiens
cctgcacagcaggctgccagtgc

SEQ ID NO: 6085425 - DNA, 12 bp, Homo sapiens
cctgcacaggct

SEQ ID NO: 6085426 - DNA, 19 bp, Homo sapiens
cctgcacaggtggctgttt

SEQ ID NO: 6085427 - DNA, 15 bp, Homo sapiens
cctgcacagtgactt

SEQ ID NO: 6085428 - DNA, 17 bp, Homo sapiens
cctgcacagtgacttct

SEQ ID NO: 6085429 - DNA, 18 bp, Homo sapiens
cctgcacagtgacttctg

SEQ ID NO: 6085430 - DNA, 20 bp, Homo sapiens
cctgcacagtgacttctgag

SEQ ID NO: 6085431 - DNA, 18 bp, Homo sapiens
cctgcaccagcccttccc

SEQ ID NO: 6085432 - DNA, 12 bp, Homo sapiens
cctgcaccagga

SEQ ID NO: 6085433 - DNA, 19 bp, Homo sapiens
cctgcaccaggccatcagc

SEQ ID NO: 6085434 - DNA, 12 bp, Homo sapiens
cctgcacccacc

SEQ ID NO: 6085435 - DNA, 15 bp, Homo sapiens
cctgcacccacccct

SEQ ID NO: 6085436 - DNA, 17 bp, Homo sapiens
cctgcacccacccctgc

SEQ ID NO: 6085437 - DNA, 20 bp, Homo sapiens
cctgcacccacccctgccca

SEQ ID NO: 6085438 - DNA, 12 bp, Homo sapiens
cctgcacccctc

SEQ ID NO: 6085439 - DNA, 20 bp, Homo sapiens
cctgcacccctccggccccg

SEQ ID NO: 6085440 - DNA, 20 bp, Homo sapiens
cctgcaccctcttctcctct

SEQ ID NO: 6085441 - DNA, 22 bp, Homo sapiens
cctgcacccttccacagctggc

SEQ ID NO: 6085442 - DNA, 14 bp, Homo sapiens
cctgcacccttccc

SEQ ID NO: 6085443 - DNA, 17 bp, Homo sapiens
cctgcacccttcctcct

SEQ ID NO: 6085444 - DNA, 17 bp, Homo sapiens
cctgcaccgaccccggg

SEQ ID NO: 6085445 - DNA, 19 bp, Homo sapiens
cctgcaccgaccccgggcc

SEQ ID NO: 6085446 - DNA, 23 bp, Homo sapiens
cctgcaccgacccgaggcccaga

SEQ ID NO: 6085447 - DNA, 22 bp, Homo sapiens
cctgcaccgccgcagaagcagc

SEQ ID NO: 6085448 - DNA, 21 bp, Homo sapiens
cctgcaccgccgccaccctgc

SEQ ID NO: 6085449 - DNA, 17 bp, Homo sapiens
cctgcaccgtctcactg

SEQ ID NO: 6085450 - DNA, 22 bp, Homo sapiens
cctgcaccgtctcactgtgtgt

SEQ ID NO: 6085451 - DNA, 19 bp, Homo sapiens
cctgcacctccccccactg

SEQ ID NO: 6085452 - DNA, 14 bp, Homo sapiens
cctgcacctctgga

SEQ ID NO: 6085453 - DNA, 19 bp, Homo sapiens
cctgcacctgcgcctggct

SEQ ID NO: 6085454 - DNA, 20 bp, Homo sapiens
cctgcacctgcgcctggctc

SEQ ID NO: 6085455 - DNA, 15 bp, Homo sapiens
cctgcacctgctgcg

SEQ ID NO: 6085456 - DNA, 19 bp, Homo sapiens
cctgcacctgctgcgtccc

SEQ ID NO: 6085457 - DNA, 15 bp, Homo sapiens
cctgcacctggcctg

SEQ ID NO: 6085458 - DNA, 21 bp, Homo sapiens
cctgcacctggcctgggccac

SEQ ID NO: 6085459 - DNA, 23 bp, Homo sapiens
cctgcacctggcctgggccacac

SEQ ID NO: 6085460 - DNA, 13 bp, Homo sapiens
cctgcacctttcg

SEQ ID NO: 6085461 - DNA, 16 bp, Homo sapiens
cctgcacgccaccgct

SEQ ID NO: 6085462 - DNA, 22 bp, Homo sapiens
cctgcacgccaccgctgccttt

SEQ ID NO: 6085463 - DNA, 20 bp, Homo sapiens
cctgcacggtgaatggcttt

SEQ ID NO: 6085464 - DNA, 19 bp, Homo sapiens
cctgcacgttcataaccaa

SEQ ID NO: 6085465 - DNA, 19 bp, Homo sapiens
cctgcactaaagccagcct

SEQ ID NO: 6085466 - DNA, 14 bp, Homo sapiens
cctgcactcacagg

SEQ ID NO: 6085467 - DNA, 14 bp, Homo sapiens
cctgcactccagaa

SEQ ID NO: 6085468 - DNA, 14 bp, Homo sapiens
cctgcactcccgac

SEQ ID NO: 6085469 - DNA, 20 bp, Homo sapiens
cctgcactccctcctggagc

SEQ ID NO: 6085470 - DNA, 15 bp, Homo sapiens
cctgcactccctggc

SEQ ID NO: 6085471 - DNA, 16 bp, Homo sapiens
cctgcactccctggcc

SEQ ID NO: 6085472 - DNA, 18 bp, Homo sapiens
cctgcactccctggcctt

SEQ ID NO: 6085473 - DNA, 15 bp, Homo sapiens
cctgcactgactctg

SEQ ID NO: 6085474 - DNA, 20 bp, Homo sapiens
cctgcactggagtccagtct

SEQ ID NO: 6085475 - DNA, 13 bp, Homo sapiens
cctgcactgggaa

SEQ ID NO: 6085476 - DNA, 18 bp, Homo sapiens
cctgcactgggaaggaaa

SEQ ID NO: 6085477 - DNA, 11 bp, Homo sapiens
cctgcactgta

SEQ ID NO: 6085478 - DNA, 13 bp, Homo sapiens
cctgcactgtaaa

SEQ ID NO: 6085479 - DNA, 15 bp, Homo sapiens
cctgcactgtaaaat

SEQ ID NO: 6085480 - DNA, 20 bp, Homo sapiens
cctgcactgtcccggagctc

SEQ ID NO: 6085481 - DNA, 14 bp, Homo sapiens
cctgcactgtcctg

SEQ ID NO: 6085482 - DNA, 16 bp, Homo sapiens
cctgcactgtcctgct

SEQ ID NO: 6085483 - DNA, 19 bp, Homo sapiens
cctgcactgtcctgctcca

SEQ ID NO: 6085484 - DNA, 23 bp, Homo sapiens
cctgcactgtcctgctccacagt

SEQ ID NO: 6085485 - DNA, 16 bp, Homo sapiens
cctgcacttcatatct

SEQ ID NO: 6085486 - DNA, 21 bp, Homo sapiens
cctgcacttgggggctcagca

SEQ ID NO: 6085487 - DNA, 18 bp, Homo sapiens
cctgcactttgatgtcat

SEQ ID NO: 6085488 - DNA, 23 bp, Homo sapiens
cctgcagacacctggactgagcc

SEQ ID NO: 6085489 - DNA, 16 bp, Homo sapiens
cctgcagactcactgt

SEQ ID NO: 6085490 - DNA, 15 bp, Homo sapiens
cctgcagagagaagc

SEQ ID NO: 6085491 - DNA, 17 bp, Homo sapiens
cctgcagagagggaact

SEQ ID NO: 6085492 - DNA, 13 bp, Homo sapiens
cctgcagagcaat

SEQ ID NO: 6085493 - DNA, 14 bp, Homo sapiens
cctgcagagcaata

SEQ ID NO: 6085494 - DNA, 15 bp, Homo sapiens
cctgcagagcaataa

SEQ ID NO: 6085495 - DNA, 16 bp, Homo sapiens
cctgcagagcaataac

SEQ ID NO: 6085496 - DNA, 18 bp, Homo sapiens
cctgcagagcaataacac

SEQ ID NO: 6085497 - DNA, 16 bp, Homo sapiens
cctgcagagcacacag

SEQ ID NO: 6085498 - DNA, 17 bp, Homo sapiens
cctgcagagcacacagg

SEQ ID NO: 6085499 - DNA, 13 bp, Homo sapiens
cctgcagagctgc

SEQ ID NO: 6085500 - DNA, 18 bp, Homo sapiens
cctgcagaggacagagct

SEQ ID NO: 6085501 - DNA, 19 bp, Homo sapiens
cctgcagaggaccacagtg

SEQ ID NO: 6085502 - DNA, 21 bp, Homo sapiens
cctgcagaggaccacagtggg

SEQ ID NO: 6085503 - DNA, 12 bp, Homo sapiens
cctgcagagggc

SEQ ID NO: 6085504 - DNA, 18 bp, Homo sapiens
cctgcagaggtctgtgct

SEQ ID NO: 6085505 - DNA, 15 bp, Homo sapiens
cctgcagagtagtta

SEQ ID NO: 6085506 - DNA, 16 bp, Homo sapiens
cctgcagagtttggat

SEQ ID NO: 6085507 - DNA, 14 bp, Homo sapiens
cctgcagatgccac

SEQ ID NO: 6085508 - DNA, 19 bp, Homo sapiens
cctgcagcaaacactccac

SEQ ID NO: 6085509 - DNA, 20 bp, Homo sapiens
cctgcagcacatgcgggctc

SEQ ID NO: 6085510 - DNA, 21 bp, Homo sapiens
cctgcagcacatgcgggctcg

SEQ ID NO: 6085511 - DNA, 15 bp, Homo sapiens
cctgcagcacggaca

SEQ ID NO: 6085512 - DNA, 16 bp, Homo sapiens
cctgcagcacggacaa

SEQ ID NO: 6085513 - DNA, 21 bp, Homo sapiens
cctgcagcacggacaataaac

SEQ ID NO: 6085514 - DNA, 14 bp, Homo sapiens
cctgcagcagagcc

SEQ ID NO: 6085515 - DNA, 15 bp, Homo sapiens
cctgcagcagagcct

SEQ ID NO: 6085516 - DNA, 12 bp, Homo sapiens
cctgcagcaggc

SEQ ID NO: 6085517 - DNA, 20 bp, Homo sapiens
cctgcagcaggcagcttcta

SEQ ID NO: 6085518 - DNA, 15 bp, Homo sapiens
cctgcagcagtcgcc

SEQ ID NO: 6085519 - DNA, 18 bp, Homo sapiens
cctgcagcatggtccctg

SEQ ID NO: 6085520 - DNA, 21 bp, Homo sapiens
cctgcagccaaacagagcctt

SEQ ID NO: 6085521 - DNA, 23 bp, Homo sapiens
cctgcagccaaacagagccttca

SEQ ID NO: 6085522 - DNA, 18 bp, Homo sapiens
cctgcagccacatgggag

SEQ ID NO: 6085523 - DNA, 16 bp, Homo sapiens
cctgcagccaccagac

SEQ ID NO: 6085524 - DNA, 13 bp, Homo sapiens
cctgcagccagaa

SEQ ID NO: 6085525 - DNA, 16 bp, Homo sapiens
cctgcagccagggctg

SEQ ID NO: 6085526 - DNA, 15 bp, Homo sapiens
cctgcagccatccca

SEQ ID NO: 6085527 - DNA, 18 bp, Homo sapiens
cctgcagcccaaaaccca

SEQ ID NO: 6085528 - DNA, 23 bp, Homo sapiens
cctgcagcccaccagacgtcagg

SEQ ID NO: 6085529 - DNA, 13 bp, Homo sapiens
cctgcagcccagg

SEQ ID NO: 6085530 - DNA, 14 bp, Homo sapiens
cctgcagcccaggc

SEQ ID NO: 6085531 - DNA, 14 bp, Homo sapiens
cctgcagccccagg

SEQ ID NO: 6085532 - DNA, 16 bp, Homo sapiens
cctgcagccccaggcc

SEQ ID NO: 6085533 - DNA, 17 bp, Homo sapiens
cctgcagccccaggcct

SEQ ID NO: 6085534 - DNA, 13 bp, Homo sapiens
cctgcagccctgg

SEQ ID NO: 6085535 - DNA, 19 bp, Homo sapiens
cctgcagccgtgcaggact

SEQ ID NO: 6085536 - DNA, 17 bp, Homo sapiens
cctgcagcctcccccac

SEQ ID NO: 6085537 - DNA, 14 bp, Homo sapiens
cctgcagcctccct

SEQ ID NO: 6085538 - DNA, 19 bp, Homo sapiens
cctgcagcctcctcctgac

SEQ ID NO: 6085539 - DNA, 21 bp, Homo sapiens
ccctcttgttttgtttgtctc

SEQ ID NO: 6085540 - DNA, 22 bp, Homo sapiens
ccctctttaatgctgtctttgt

SEQ ID NO: 6085541 - DNA, 20 bp, Homo sapiens
ccctctttcatctcctgagt

SEQ ID NO: 6085542 - DNA, 11 bp, Homo sapiens
ccctctttccc

SEQ ID NO: 6085543 - DNA, 18 bp, Homo sapiens
ccctctttcccaccctcc

SEQ ID NO: 6085544 - DNA, 22 bp, Homo sapiens
ccctctttcccaccctccacct

SEQ ID NO: 6085545 - DNA, 12 bp, Homo sapiens
ccctctttccct

SEQ ID NO: 6085546 - DNA, 15 bp, Homo sapiens
ccctctttccctgcg

SEQ ID NO: 6085547 - DNA, 16 bp, Homo sapiens
ccctctttccctgcga

SEQ ID NO: 6085548 - DNA, 19 bp, Homo sapiens
ccctctttcctgtgccagg

SEQ ID NO: 6085549 - DNA, 16 bp, Homo sapiens
ccctctttctagcctg

SEQ ID NO: 6085550 - DNA, 18 bp, Homo sapiens
ccctctttctctctgtgt

SEQ ID NO: 6085551 - DNA, 13 bp, Homo sapiens
ccctctttctctt

SEQ ID NO: 6085552 - DNA, 15 bp, Homo sapiens
ccctctttctctttc

SEQ ID NO: 6085553 - DNA, 16 bp, Homo sapiens
ccctctttctctttct

SEQ ID NO: 6085554 - DNA, 21 bp, Homo sapiens
ccctctttctctttcttcctt

SEQ ID NO: 6085555 - DNA, 19 bp, Homo sapiens
ccctctttgcacagcatga

SEQ ID NO: 6085556 - DNA, 14 bp, Homo sapiens
ccctctttgctgca

SEQ ID NO: 6085557 - DNA, 17 bp, Homo sapiens
ccctctttggctcccct

SEQ ID NO: 6085558 - DNA, 21 bp, Homo sapiens
ccctctttggctcccctgtac

SEQ ID NO: 6085559 - DNA, 19 bp, Homo sapiens
ccctctttgggcagtgcca

SEQ ID NO: 6085560 - DNA, 23 bp, Homo sapiens
ccctcttttcttactcctcctct

SEQ ID NO: 6085561 - DNA, 15 bp, Homo sapiens
ccctcttttggcctt

SEQ ID NO: 6085562 - DNA, 17 bp, Homo sapiens
ccctcttttggccttgt

SEQ ID NO: 6085563 - DNA, 17 bp, Homo sapiens
ccctctttttctctgta

SEQ ID NO: 6085564 - DNA, 18 bp, Homo sapiens
ccctctttttctctgtat

SEQ ID NO: 6085565 - DNA, 20 bp, Homo sapiens
ccctctttttctctgtatat

SEQ ID NO: 6085566 - DNA, 15 bp, Homo sapiens
ccctgaaaaactgat

SEQ ID NO: 6085567 - DNA, 15 bp, Homo sapiens
ccctgaaaacccaga

SEQ ID NO: 6085568 - DNA, 22 bp, Homo sapiens
ccctgaaaagttaggcctctca

SEQ ID NO: 6085569 - DNA, 12 bp, Homo sapiens
ccctgaaaatgt

SEQ ID NO: 6085570 - DNA, 17 bp, Homo sapiens
ccctgaaacatgtgccc

SEQ ID NO: 6085571 - DNA, 20 bp, Homo sapiens
ccctgaaacatgtgcccctg

SEQ ID NO: 6085572 - DNA, 21 bp, Homo sapiens
ccctgaaacatgtgcccctgc

SEQ ID NO: 6085573 - DNA, 15 bp, Homo sapiens
ccctgaaacattgca

SEQ ID NO: 6085574 - DNA, 23 bp, Homo sapiens
ccctgaaagagaagatggccatg

SEQ ID NO: 6085575 - DNA, 18 bp, Homo sapiens
ccctgaaagccctgagct

SEQ ID NO: 6085576 - DNA, 14 bp, Homo sapiens
ccctgaaagcctca

SEQ ID NO: 6085577 - DNA, 15 bp, Homo sapiens
ccctgaaagcctcac

SEQ ID NO: 6085578 - DNA, 21 bp, Homo sapiens
ccctgaaatattttctacttt

SEQ ID NO: 6085579 - DNA, 11 bp, Homo sapiens
ccctgaaatgt

SEQ ID NO: 6085580 - DNA, 20 bp, Homo sapiens
ccctgaaattatataaggca

SEQ ID NO: 6085581 - DNA, 19 bp, Homo sapiens
ccctgaacaaagcacctca

SEQ ID NO: 6085582 - DNA, 16 bp, Homo sapiens
ccctgaacatctgtgt

SEQ ID NO: 6085583 - DNA, 17 bp, Homo sapiens
ccctgaacatctgtgtg

SEQ ID NO: 6085584 - DNA, 22 bp, Homo sapiens
ccctgaacatttagtaccctgc

SEQ ID NO: 6085585 - DNA, 16 bp, Homo sapiens
ccctgaaccacgaggc

SEQ ID NO: 6085586 - DNA, 20 bp, Homo sapiens
ccctgaaccacgaggctgcc

SEQ ID NO: 6085587 - DNA, 16 bp, Homo sapiens
ccctgaacccctggcc

SEQ ID NO: 6085588 - DNA, 17 bp, Homo sapiens
ccctgaacgccctggta

SEQ ID NO: 6085589 - DNA, 22 bp, Homo sapiens
ccctgaacgttttcttctttcc

SEQ ID NO: 6085590 - DNA, 13 bp, Homo sapiens
ccctgaactcaga

SEQ ID NO: 6085591 - DNA, 19 bp, Homo sapiens
ccctgaagagacaggcacc

SEQ ID NO: 6085592 - DNA, 15 bp, Homo sapiens
ccctgaagatttcag

SEQ ID NO: 6085593 - DNA, 21 bp, Homo sapiens
ccctgaagatttcagaggctg

SEQ ID NO: 6085594 - DNA, 13 bp, Homo sapiens
ccctgaagcagag

SEQ ID NO: 6085595 - DNA, 16 bp, Homo sapiens
ccctgaagcctccgtg

SEQ ID NO: 6085596 - DNA, 19 bp, Homo sapiens
ccctgaagctgtgcggagc

SEQ ID NO: 6085597 - DNA, 14 bp, Homo sapiens
ccctgaaggccccg

SEQ ID NO: 6085598 - DNA, 15 bp, Homo sapiens
ccctgaagtcttgca

SEQ ID NO: 6085599 - DNA, 22 bp, Homo sapiens
ccctgaagtgaccccagctcca

SEQ ID NO: 6085600 - DNA, 23 bp, Homo sapiens
ccctgaagtgaccccagctccag

SEQ ID NO: 6085601 - DNA, 23 bp, Homo sapiens
ccctgaatcccccttgccacccc

SEQ ID NO: 6085602 - DNA, 19 bp, Homo sapiens
ccctgaatccgtacttggg

SEQ ID NO: 6085603 - DNA, 22 bp, Homo sapiens
ccctgaatctgctgagaggcac

SEQ ID NO: 6085604 - DNA, 15 bp, Homo sapiens
ccctgaattgtttga

SEQ ID NO: 6085605 - DNA, 20 bp, Homo sapiens
ccctgaatttaaatagcttt

SEQ ID NO: 6085606 - DNA, 20 bp, Homo sapiens
ccctgacacctttaaaaagc

SEQ ID NO: 6085607 - DNA, 16 bp, Homo sapiens
ccctgacaggccttcc

SEQ ID NO: 6085608 - DNA, 23 bp, Homo sapiens
ccctgacaggccttcctcctctc

SEQ ID NO: 6085609 - DNA, 13 bp, Homo sapiens
ccctgacagggcc

SEQ ID NO: 6085610 - DNA, 16 bp, Homo sapiens
ccctgacagggccagt

SEQ ID NO: 6085611 - DNA, 15 bp, Homo sapiens
ccctgacatgctaac

SEQ ID NO: 6085612 - DNA, 16 bp, Homo sapiens
ccctgaccaccctgcc

SEQ ID NO: 6085613 - DNA, 18 bp, Homo sapiens
ccctgaccaccctgcctg

SEQ ID NO: 6085614 - DNA, 21 bp, Homo sapiens
ccctgaccaccctgcctgtgg

SEQ ID NO: 6085615 - DNA, 17 bp, Homo sapiens
ccctgacccccatcgct

SEQ ID NO: 6085616 - DNA, 12 bp, Homo sapiens
ccctgaccctgt

SEQ ID NO: 6085617 - DNA, 15 bp, Homo sapiens
ccctgaccctgtgga

SEQ ID NO: 6085618 - DNA, 19 bp, Homo sapiens
ccctgaccctgtggaagca

SEQ ID NO: 6085619 - DNA, 21 bp, Homo sapiens
ccctgacctaccccagccagg

SEQ ID NO: 6085620 - DNA, 22 bp, Homo sapiens
ccctgacctcccagccctatgg

SEQ ID NO: 6085621 - DNA, 15 bp, Homo sapiens
ccctgacctccgccc

SEQ ID NO: 6085622 - DNA, 19 bp, Homo sapiens
ccctgacctccgcccctgc

SEQ ID NO: 6085623 - DNA, 22 bp, Homo sapiens
ccctgacctccgcccctgcccc

SEQ ID NO: 6085624 - DNA, 19 bp, Homo sapiens
ccctgacctggccccctca

SEQ ID NO: 6085625 - DNA, 14 bp, Homo sapiens
ccctgacctgtcca

SEQ ID NO: 6085626 - DNA, 20 bp, Homo sapiens
ccctgacctgtgagcccagc

SEQ ID NO: 6085627 - DNA, 18 bp, Homo sapiens
ccctgaccttctccaggg

SEQ ID NO: 6085628 - DNA, 15 bp, Homo sapiens
ccctgacgtctgcca

SEQ ID NO: 6085629 - DNA, 16 bp, Homo sapiens
ccctgacgtctgccac

SEQ ID NO: 6085630 - DNA, 17 bp, Homo sapiens
ccctgacgtctgccacc

SEQ ID NO: 6085631 - DNA, 20 bp, Homo sapiens
ccctgactaaactaccacct

SEQ ID NO: 6085632 - DNA, 16 bp, Homo sapiens
ccctgactccctgtgg

SEQ ID NO: 6085633 - DNA, 12 bp, Homo sapiens
ccctgactcctc

SEQ ID NO: 6085634 - DNA, 15 bp, Homo sapiens
ccctgactcctctgg

SEQ ID NO: 6085635 - DNA, 13 bp, Homo sapiens
ccctgactcctgg

SEQ ID NO: 6085636 - DNA, 16 bp, Homo sapiens
ccctgactgtcaggga

SEQ ID NO: 6085637 - DNA, 20 bp, Homo sapiens
ccctgactgtcagggagggc

SEQ ID NO: 6085638 - DNA, 14 bp, Homo sapiens
ccctgactgtgggg

SEQ ID NO: 6085639 - DNA, 17 bp, Homo sapiens
ccctgacttcccagctg

SEQ ID NO: 6085640 - DNA, 13 bp, Homo sapiens
ccctgacttctcc

SEQ ID NO: 6085641 - DNA, 20 bp, Homo sapiens
ccctgagaaacccaccagcc

SEQ ID NO: 6085642 - DNA, 20 bp, Homo sapiens
ccctgagacaaatggaggcc

SEQ ID NO: 6085643 - DNA, 21 bp, Homo sapiens
ccctgagaccacccccaaaca

SEQ ID NO: 6085644 - DNA, 16 bp, Homo sapiens
ccctgagagcatgtgg

SEQ ID NO: 6085645 - DNA, 23 bp, Homo sapiens
ccctgagagcatgtgggggaagg

SEQ ID NO: 6085646 - DNA, 23 bp, Homo sapiens
ccctgagaggaggtcgaatgggt

SEQ ID NO: 6085647 - DNA, 19 bp, Homo sapiens
ccctgagagtggtgccctg

SEQ ID NO: 6085648 - DNA, 23 bp, Homo sapiens
ccctgagagtggtgccctggaac

SEQ ID NO: 6085649 - DNA, 20 bp, Homo sapiens
ccctgagagtttcctcagaa

SEQ ID NO: 6085650 - DNA, 23 bp, Homo sapiens
ccctgagagtttcctcagaaccc

SEQ ID NO: 6085651 - DNA, 17 bp, Homo sapiens
ccctgagcactcctggt

SEQ ID NO: 6085652 - DNA, 21 bp, Homo sapiens
ccctgagcagaatactggtct

SEQ ID NO: 6085653 - DNA, 20 bp, Homo sapiens
ccctgagcagggtccacagc

SEQ ID NO: 6085654 - DNA, 14 bp, Homo sapiens
ccctgagcatcctg

SEQ ID NO: 6085655 - DNA, 18 bp, Homo sapiens
ccctgagccagggtctcc

SEQ ID NO: 6085656 - DNA, 19 bp, Homo sapiens
ccctgagccagggtctcca

SEQ ID NO: 6085657 - DNA, 20 bp, Homo sapiens
ccctgagccagggtctccag

SEQ ID NO: 6085658 - DNA, 17 bp, Homo sapiens
ccctgagccatggcggc

SEQ ID NO: 6085659 - DNA, 12 bp, Homo sapiens
ccctgagcccac

SEQ ID NO: 6085660 - DNA, 17 bp, Homo sapiens
ccctgagccccttcctt

SEQ ID NO: 6085661 - DNA, 21 bp, Homo sapiens
ccctgagccccttccttgctc

SEQ ID NO: 6085662 - DNA, 17 bp, Homo sapiens
ccctgagcccggccctc

SEQ ID NO: 6085663 - DNA, 12 bp, Homo sapiens
ccctgagccggc

SEQ ID NO: 6085664 - DNA, 14 bp, Homo sapiens
ccctgagcctgcat

SEQ ID NO: 6085665 - DNA, 18 bp, Homo sapiens
ccctgagcctgcattctg

SEQ ID NO: 6085666 - DNA, 20 bp, Homo sapiens
ccctgagcctgccccagctg

SEQ ID NO: 6085667 - DNA, 15 bp, Homo sapiens
ccctgagcctggcag

SEQ ID NO: 6085668 - DNA, 14 bp, Homo sapiens
ccctgagcctgtgt

SEQ ID NO: 6085669 - DNA, 20 bp, Homo sapiens
ccctgagctagaaccctctg

SEQ ID NO: 6085670 - DNA, 17 bp, Homo sapiens
ccctgagctagtgtcac

SEQ ID NO: 6085671 - DNA, 13 bp, Homo sapiens
ccctgagctcagg

SEQ ID NO: 6085672 - DNA, 14 bp, Homo sapiens
ccctgagctcaggc

SEQ ID NO: 6085673 - DNA, 17 bp, Homo sapiens
ccctgagctcaggctga

SEQ ID NO: 6085674 - DNA, 22 bp, Homo sapiens
ccctgagctcaggctgagccca

SEQ ID NO: 6085675 - DNA, 13 bp, Homo sapiens
ccctgagctcggg

SEQ ID NO: 6085676 - DNA, 15 bp, Homo sapiens
ccctgagctcgggga

SEQ ID NO: 6085677 - DNA, 16 bp, Homo sapiens
ccctgagctgaggcag

SEQ ID NO: 6085678 - DNA, 17 bp, Homo sapiens
ccctgagctgaggcagc

SEQ ID NO: 6085679 - DNA, 19 bp, Homo sapiens
ccctgagctgaggcagcag

SEQ ID NO: 6085680 - DNA, 15 bp, Homo sapiens
ccctgagctgcagct

SEQ ID NO: 6085681 - DNA, 16 bp, Homo sapiens
ccctgagctggcgtca

SEQ ID NO: 6085682 - DNA, 14 bp, Homo sapiens
ccctgaggaataaa

SEQ ID NO: 6085683 - DNA, 16 bp, Homo sapiens
ccctgaggaataaagc

SEQ ID NO: 6085684 - DNA, 16 bp, Homo sapiens
ccctgaggacctctca

SEQ ID NO: 6085685 - DNA, 16 bp, Homo sapiens
ccctgaggactggaga

SEQ ID NO: 6085686 - DNA, 19 bp, Homo sapiens
ccctgaggagggccctgag

SEQ ID NO: 6085687 - DNA, 20 bp, Homo sapiens
ccctgaggagggccctgagg

SEQ ID NO: 6085688 - DNA, 16 bp, Homo sapiens
ccctgaggagtctgag

SEQ ID NO: 6085689 - DNA, 18 bp, Homo sapiens
ccctgaggagtctgaggt

SEQ ID NO: 6085690 - DNA, 16 bp, Homo sapiens
ccctgaggatcccctg

SEQ ID NO: 6085691 - DNA, 15 bp, Homo sapiens
ccctgaggcccagag

SEQ ID NO: 6085692 - DNA, 20 bp, Homo sapiens
ccctgaggcccagagggcct

SEQ ID NO: 6085693 - DNA, 19 bp, Homo sapiens
ccctgaggcctagactctg

SEQ ID NO: 6085694 - DNA, 13 bp, Homo sapiens
ccctgaggcctga

SEQ ID NO: 6085695 - DNA, 14 bp, Homo sapiens
ccctgaggcctgag

SEQ ID NO: 6085696 - DNA, 20 bp, Homo sapiens
ccctgaggcggaggctgtgc

SEQ ID NO: 6085697 - DNA, 12 bp, Homo sapiens
ccctgaggctca

SEQ ID NO: 6085698 - DNA, 16 bp, Homo sapiens
ccctgaggctggcatc

SEQ ID NO: 6085699 - DNA, 20 bp, Homo sapiens
ccctgagggacgagcagagc

SEQ ID NO: 6085700 - DNA, 16 bp, Homo sapiens
ccctgagggcccttcc

SEQ ID NO: 6085701 - DNA, 13 bp, Homo sapiens
ccctgagggcgga

SEQ ID NO: 6085702 - DNA, 14 bp, Homo sapiens
ccctgagggctcct

SEQ ID NO: 6085703 - DNA, 17 bp, Homo sapiens
ccctgaggggcagtccc

SEQ ID NO: 6085704 - DNA, 14 bp, Homo sapiens
ccctgaggggctgg

SEQ ID NO: 6085705 - DNA, 16 bp, Homo sapiens
ccctgaggggctgggc

SEQ ID NO: 6085706 - DNA, 18 bp, Homo sapiens
ccctgaggggctgggctg

SEQ ID NO: 6085707 - DNA, 21 bp, Homo sapiens
ccctgaggggctggggagggg

SEQ ID NO: 6085708 - DNA, 22 bp, Homo sapiens
ccctgagggtggtcagccaagg

SEQ ID NO: 6085709 - DNA, 23 bp, Homo sapiens
ccctgaggtacctttccacccag

SEQ ID NO: 6085710 - DNA, 18 bp, Homo sapiens
ccctgaggtatctgtgtt

SEQ ID NO: 6085711 - DNA, 15 bp, Homo sapiens
ccctgaggtcacctg

SEQ ID NO: 6085712 - DNA, 15 bp, Homo sapiens
ccctgaggtcactgc

SEQ ID NO: 6085713 - DNA, 17 bp, Homo sapiens
ccctgaggtcactgcta

SEQ ID NO: 6085714 - DNA, 18 bp, Homo sapiens
ccctgaggtcagggagtg

SEQ ID NO: 6085715 - DNA, 19 bp, Homo sapiens
ccctgaggtgtgggggctg

SEQ ID NO: 6085716 - DNA, 23 bp, Homo sapiens
ccctgaggtgtgggggctgcagc

SEQ ID NO: 6085717 - DNA, 19 bp, Homo sapiens
cctgcagcctgaccccagg

SEQ ID NO: 6085718 - DNA, 12 bp, Homo sapiens
cctgcagcctgg

SEQ ID NO: 6085719 - DNA, 13 bp, Homo sapiens
cctgcagcctggg

SEQ ID NO: 6085720 - DNA, 14 bp, Homo sapiens
cctgcagcctgggt

SEQ ID NO: 6085721 - DNA, 16 bp, Homo sapiens
cctgcagcgcctccct

SEQ ID NO: 6085722 - DNA, 18 bp, Homo sapiens
cctgcagcgcctcccttg

SEQ ID NO: 6085723 - DNA, 18 bp, Homo sapiens
cctgcagcgctgggcccc

SEQ ID NO: 6085724 - DNA, 16 bp, Homo sapiens
cctgcagctagtccta

SEQ ID NO: 6085725 - DNA, 22 bp, Homo sapiens
cctgcagctggaatgtgccaca

SEQ ID NO: 6085726 - DNA, 17 bp, Homo sapiens
cctgcagcttgtagcca

SEQ ID NO: 6085727 - DNA, 20 bp, Homo sapiens
cctgcagctttgaggctggc

SEQ ID NO: 6085728 - DNA, 22 bp, Homo sapiens
cctgcagctttgaggctggcgg

SEQ ID NO: 6085729 - DNA, 22 bp, Homo sapiens
cctgcaggaaggagctgcctgg

SEQ ID NO: 6085730 - DNA, 22 bp, Homo sapiens
cctgcaggaccctgtcctgcag

SEQ ID NO: 6085731 - DNA, 18 bp, Homo sapiens
cctgcaggacctcgtgcc

SEQ ID NO: 6085732 - DNA, 15 bp, Homo sapiens
cctgcaggacctgcc

SEQ ID NO: 6085733 - DNA, 16 bp, Homo sapiens
cctgcaggacctgcct

SEQ ID NO: 6085734 - DNA, 17 bp, Homo sapiens
cctgcaggacctgcctg

SEQ ID NO: 6085735 - DNA, 18 bp, Homo sapiens
cctgcaggacctgcctgt

SEQ ID NO: 6085736 - DNA, 16 bp, Homo sapiens
cctgcaggactcgggc

SEQ ID NO: 6085737 - DNA, 17 bp, Homo sapiens
cctgcaggagagagcag

SEQ ID NO: 6085738 - DNA, 14 bp, Homo sapiens
cctgcaggagcagg

SEQ ID NO: 6085739 - DNA, 13 bp, Homo sapiens
cctgcaggaggcc

SEQ ID NO: 6085740 - DNA, 16 bp, Homo sapiens
cctgcaggaggcctgg

SEQ ID NO: 6085741 - DNA, 23 bp, Homo sapiens
cctgcaggaggcctgggagggca

SEQ ID NO: 6085742 - DNA, 17 bp, Homo sapiens
cctgcaggcagagctgg

SEQ ID NO: 6085743 - DNA, 12 bp, Homo sapiens
cctgcaggcagc

SEQ ID NO: 6085744 - DNA, 14 bp, Homo sapiens
cctgcaggcaggca

SEQ ID NO: 6085745 - DNA, 19 bp, Homo sapiens
cctgcaggcaggcagacca

SEQ ID NO: 6085746 - DNA, 15 bp, Homo sapiens
cctgcaggcaggtgg

SEQ ID NO: 6085747 - DNA, 16 bp, Homo sapiens
cctgcaggccaagagc

SEQ ID NO: 6085748 - DNA, 21 bp, Homo sapiens
cctgcaggccaagagcagagg

SEQ ID NO: 6085749 - DNA, 16 bp, Homo sapiens
cctgcaggccaggcca

SEQ ID NO: 6085750 - DNA, 20 bp, Homo sapiens
cctgcaggccaggccagctt

SEQ ID NO: 6085751 - DNA, 15 bp, Homo sapiens
cctgcaggccagtcc

SEQ ID NO: 6085752 - DNA, 12 bp, Homo sapiens
cctgcaggcccc

SEQ ID NO: 6085753 - DNA, 15 bp, Homo sapiens
cctgcaggccccagc

SEQ ID NO: 6085754 - DNA, 19 bp, Homo sapiens
cctgcaggccccagccaag

SEQ ID NO: 6085755 - DNA, 17 bp, Homo sapiens
cctgcaggcggggctcc

SEQ ID NO: 6085756 - DNA, 18 bp, Homo sapiens
cctgcaggcggggctcct

SEQ ID NO: 6085757 - DNA, 23 bp, Homo sapiens
cctgcaggcggggctcctcctga

SEQ ID NO: 6085758 - DNA, 12 bp, Homo sapiens
cctgcaggctcc

SEQ ID NO: 6085759 - DNA, 23 bp, Homo sapiens
cctgcaggctccatgcacctccc

SEQ ID NO: 6085760 - DNA, 15 bp, Homo sapiens
cctgcaggctgagcc

SEQ ID NO: 6085761 - DNA, 16 bp, Homo sapiens
cctgcagggagccttc

SEQ ID NO: 6085762 - DNA, 19 bp, Homo sapiens
cctgcagggccatggctca

SEQ ID NO: 6085763 - DNA, 19 bp, Homo sapiens
cctgcagggccgggcaggg

SEQ ID NO: 6085764 - DNA, 19 bp, Homo sapiens
cctgcagggcctctgtcaa

SEQ ID NO: 6085765 - DNA, 19 bp, Homo sapiens
cctgcagggcgcccctggg

SEQ ID NO: 6085766 - DNA, 20 bp, Homo sapiens
cctgcagggcgcccctggga

SEQ ID NO: 6085767 - DNA, 13 bp, Homo sapiens
cctgcagggctgc

SEQ ID NO: 6085768 - DNA, 15 bp, Homo sapiens
cctgcagggcttctc

SEQ ID NO: 6085769 - DNA, 10 bp, Homo sapiens
cctgcagggg

SEQ ID NO: 6085770 - DNA, 22 bp, Homo sapiens
cctgcaggggcaaggggctggc

SEQ ID NO: 6085771 - DNA, 16 bp, Homo sapiens
cctgcagggtaggggg

SEQ ID NO: 6085772 - DNA, 20 bp, Homo sapiens
cctgcagggtggtgctggga

SEQ ID NO: 6085773 - DNA, 22 bp, Homo sapiens
cctgcagggtggtgctgggact

SEQ ID NO: 6085774 - DNA, 20 bp, Homo sapiens
cctgcaggtcagttgtaata

SEQ ID NO: 6085775 - DNA, 21 bp, Homo sapiens
cctgcaggtcagttgtaataa

SEQ ID NO: 6085776 - DNA, 23 bp, Homo sapiens
cctgcaggtcagttgtaataaat

SEQ ID NO: 6085777 - DNA, 21 bp, Homo sapiens
cctgcaggtccggggaggagg

SEQ ID NO: 6085778 - DNA, 14 bp, Homo sapiens
cctgcaggtgagca

SEQ ID NO: 6085779 - DNA, 20 bp, Homo sapiens
cctgcaggtgagcaggcagg

SEQ ID NO: 6085780 - DNA, 20 bp, Homo sapiens
cctgcaggtgctgctgcgtg

SEQ ID NO: 6085781 - DNA, 22 bp, Homo sapiens
cctgcaggtgtctatccacctg

SEQ ID NO: 6085782 - DNA, 17 bp, Homo sapiens
cctgcagtaatctccag

SEQ ID NO: 6085783 - DNA, 20 bp, Homo sapiens
cctgcagtaatctccagggc

SEQ ID NO: 6085784 - DNA, 18 bp, Homo sapiens
cctgcagtagaaggtgcc

SEQ ID NO: 6085785 - DNA, 22 bp, Homo sapiens
cctgcagtattacagaggtcgt

SEQ ID NO: 6085786 - DNA, 17 bp, Homo sapiens
cctgcagtcagggccca

SEQ ID NO: 6085787 - DNA, 19 bp, Homo sapiens
cctgcagtcagggcccaga

SEQ ID NO: 6085788 - DNA, 17 bp, Homo sapiens
cctgcagtctgtggagc

SEQ ID NO: 6085789 - DNA, 16 bp, Homo sapiens
cctgcagtcttctggg

SEQ ID NO: 6085790 - DNA, 21 bp, Homo sapiens
cctgcagtgaggggccctcca

SEQ ID NO: 6085791 - DNA, 20 bp, Homo sapiens
cctgcagtgattcagcaggc

SEQ ID NO: 6085792 - DNA, 13 bp, Homo sapiens
cctgcagtgccag

SEQ ID NO: 6085793 - DNA, 20 bp, Homo sapiens
cctgcagtgccagctccctc

SEQ ID NO: 6085794 - DNA, 23 bp, Homo sapiens
cctgcagtgtcaaatcgatggcc

SEQ ID NO: 6085795 - DNA, 12 bp, Homo sapiens
cctgcagtgttc

SEQ ID NO: 6085796 - DNA, 20 bp, Homo sapiens
cctgcagtgttcgcttggct

SEQ ID NO: 6085797 - DNA, 19 bp, Homo sapiens
cctgcagttggcctcagca

SEQ ID NO: 6085798 - DNA, 19 bp, Homo sapiens
cctgcagtttcttgtgtag

SEQ ID NO: 6085799 - DNA, 19 bp, Homo sapiens
cctgcagtttggccctgga

SEQ ID NO: 6085800 - DNA, 22 bp, Homo sapiens
cctgcataatgtttctggattt

SEQ ID NO: 6085801 - DNA, 13 bp, Homo sapiens
cctgcatattgtg

SEQ ID NO: 6085802 - DNA, 13 bp, Homo sapiens
cctgcatatttag

SEQ ID NO: 6085803 - DNA, 17 bp, Homo sapiens
cctgcatcagcctctgg

SEQ ID NO: 6085804 - DNA, 20 bp, Homo sapiens
cctgcatcagcctctggcca

SEQ ID NO: 6085805 - DNA, 18 bp, Homo sapiens
cctgcatccccttggctg

SEQ ID NO: 6085806 - DNA, 20 bp, Homo sapiens
cctgcatcccgatacctcag

SEQ ID NO: 6085807 - DNA, 22 bp, Homo sapiens
cctgcatcccgatacctcagcc

SEQ ID NO: 6085808 - DNA, 14 bp, Homo sapiens
cctgcatccctcca

SEQ ID NO: 6085809 - DNA, 19 bp, Homo sapiens
cctgcatccctccacccca

SEQ ID NO: 6085810 - DNA, 21 bp, Homo sapiens
cctgcatcccttggcccctct

SEQ ID NO: 6085811 - DNA, 18 bp, Homo sapiens
cctgcatcctgaggccag

SEQ ID NO: 6085812 - DNA, 17 bp, Homo sapiens
cctgcatccttcctggg

SEQ ID NO: 6085813 - DNA, 22 bp, Homo sapiens
cctgcatctatcgagtttgcaa

SEQ ID NO: 6085814 - DNA, 21 bp, Homo sapiens
cctgcatctctgtgaagcctc

SEQ ID NO: 6085815 - DNA, 18 bp, Homo sapiens
cctgcatctgaccagcag

SEQ ID NO: 6085816 - DNA, 15 bp, Homo sapiens
cctgcatctggggcc

SEQ ID NO: 6085817 - DNA, 14 bp, Homo sapiens
cctgcatctgtctg

SEQ ID NO: 6085818 - DNA, 18 bp, Homo sapiens
cctgcatctttagtgctt

SEQ ID NO: 6085819 - DNA, 17 bp, Homo sapiens
cctgcatctttcatagt

SEQ ID NO: 6085820 - DNA, 22 bp, Homo sapiens
cctgcatctttcatagttctgt

SEQ ID NO: 6085821 - DNA, 15 bp, Homo sapiens
cctgcatgaaagcat

SEQ ID NO: 6085822 - DNA, 15 bp, Homo sapiens
cctgcatgagctggc

SEQ ID NO: 6085823 - DNA, 15 bp, Homo sapiens
cctgcatgcaactaa

SEQ ID NO: 6085824 - DNA, 16 bp, Homo sapiens
cctgcatgcaactaat

SEQ ID NO: 6085825 - DNA, 18 bp, Homo sapiens
cctgcatgcaactaattc

SEQ ID NO: 6085826 - DNA, 16 bp, Homo sapiens
cctgcatgcagcaaca

SEQ ID NO: 6085827 - DNA, 17 bp, Homo sapiens
cctgcatgctgcccagc

SEQ ID NO: 6085828 - DNA, 20 bp, Homo sapiens
cctgcatgctgcccagccac

SEQ ID NO: 6085829 - DNA, 21 bp, Homo sapiens
cctgcatgctgcccagccact

SEQ ID NO: 6085830 - DNA, 15 bp, Homo sapiens
cctgcatggagaagg

SEQ ID NO: 6085831 - DNA, 16 bp, Homo sapiens
cctgcatggcatcctc

SEQ ID NO: 6085832 - DNA, 20 bp, Homo sapiens
cctgcatggtcaagcctctt

SEQ ID NO: 6085833 - DNA, 22 bp, Homo sapiens
cctgcatggtgtttatgcacac

SEQ ID NO: 6085834 - DNA, 20 bp, Homo sapiens
cctgcatgtaaacacgcctg

SEQ ID NO: 6085835 - DNA, 22 bp, Homo sapiens
cctgcatgtaaacacgcctgca

SEQ ID NO: 6085836 - DNA, 23 bp, Homo sapiens
cctgcatgtaaacacgcctgcaa

SEQ ID NO: 6085837 - DNA, 18 bp, Homo sapiens
cctgcatgtgttgtacaa

SEQ ID NO: 6085838 - DNA, 19 bp, Homo sapiens
cctgcatgtgttgtacaat

SEQ ID NO: 6085839 - DNA, 19 bp, Homo sapiens
cctgcattactccttcagc

SEQ ID NO: 6085840 - DNA, 22 bp, Homo sapiens
cctgcattatgcacgtgtctgg

SEQ ID NO: 6085841 - DNA, 17 bp, Homo sapiens
cctgcattcacccagac

SEQ ID NO: 6085842 - DNA, 19 bp, Homo sapiens
cctgcattcacccagacag

SEQ ID NO: 6085843 - DNA, 14 bp, Homo sapiens
cctgcattcatgta

SEQ ID NO: 6085844 - DNA, 18 bp, Homo sapiens
cctgcattcccaggaaaa

SEQ ID NO: 6085845 - DNA, 18 bp, Homo sapiens
cctgcattcgcagcagct

SEQ ID NO: 6085846 - DNA, 22 bp, Homo sapiens
cctgcattctgccgtgtgccct

SEQ ID NO: 6085847 - DNA, 23 bp, Homo sapiens
cctgcattcttccgcaccctccc

SEQ ID NO: 6085848 - DNA, 15 bp, Homo sapiens
cctgcattggcctgg

SEQ ID NO: 6085849 - DNA, 18 bp, Homo sapiens
cctgcattggcctggcct

SEQ ID NO: 6085850 - DNA, 19 bp, Homo sapiens
cctgcattggcctggcctc

SEQ ID NO: 6085851 - DNA, 20 bp, Homo sapiens
cctgcattggcctggcctcc

SEQ ID NO: 6085852 - DNA, 14 bp, Homo sapiens
cctgcattgtaaat

SEQ ID NO: 6085853 - DNA, 12 bp, Homo sapiens
cctgcattgtta

SEQ ID NO: 6085854 - DNA, 14 bp, Homo sapiens
cctgcatttctgag

SEQ ID NO: 6085855 - DNA, 16 bp, Homo sapiens
cctgcattttcctctt

SEQ ID NO: 6085856 - DNA, 17 bp, Homo sapiens
cctgcattttcctcttg

SEQ ID NO: 6085857 - DNA, 22 bp, Homo sapiens
cctgccaaaagatctggggagt

SEQ ID NO: 6085858 - DNA, 21 bp, Homo sapiens
cctgccaaagtagtcctggca

SEQ ID NO: 6085859 - DNA, 23 bp, Homo sapiens
cctgccaaagtgcctgggaagcc

SEQ ID NO: 6085860 - DNA, 12 bp, Homo sapiens
cctgccaaattt

SEQ ID NO: 6085861 - DNA, 22 bp, Homo sapiens
cctgccaactccatgaccaggc

SEQ ID NO: 6085862 - DNA, 14 bp, Homo sapiens
cctgccaactttcc

SEQ ID NO: 6085863 - DNA, 18 bp, Homo sapiens
cctgccaactttccagac

SEQ ID NO: 6085864 - DNA, 17 bp, Homo sapiens
cctgccaagactcctca

SEQ ID NO: 6085865 - DNA, 19 bp, Homo sapiens
cctgccaagactcctcagg

SEQ ID NO: 6085866 - DNA, 14 bp, Homo sapiens
cctgccaagcctgg

SEQ ID NO: 6085867 - DNA, 17 bp, Homo sapiens
cctgccaagcctggagc

SEQ ID NO: 6085868 - DNA, 22 bp, Homo sapiens
cctgccaaggagcatccttggc

SEQ ID NO: 6085869 - DNA, 18 bp, Homo sapiens
cctgccaatgattccaga

SEQ ID NO: 6085870 - DNA, 13 bp, Homo sapiens
cctgccaatgcca

SEQ ID NO: 6085871 - DNA, 16 bp, Homo sapiens
cctgccaatgccacag

SEQ ID NO: 6085872 - DNA, 18 bp, Homo sapiens
cctgccaatgctccagct

SEQ ID NO: 6085873 - DNA, 20 bp, Homo sapiens
cctgccacactcagtccccc

SEQ ID NO: 6085874 - DNA, 15 bp, Homo sapiens
cctgccacagccaga

SEQ ID NO: 6085875 - DNA, 19 bp, Homo sapiens
cctgccacagccagaggag

SEQ ID NO: 6085876 - DNA, 18 bp, Homo sapiens
cctgccacattagaactt

SEQ ID NO: 6085877 - DNA, 14 bp, Homo sapiens
cctgccaccacaca

SEQ ID NO: 6085878 - DNA, 19 bp, Homo sapiens
cctgccaccacgcccggct

SEQ ID NO: 6085879 - DNA, 14 bp, Homo sapiens
cctgccaccagcat

SEQ ID NO: 6085880 - DNA, 15 bp, Homo sapiens
cctgccaccaggcca

SEQ ID NO: 6085881 - DNA, 18 bp, Homo sapiens
cctgccaccaggccacct

SEQ ID NO: 6085882 - DNA, 23 bp, Homo sapiens
cctgccaccagggagcttcctgg

SEQ ID NO: 6085883 - DNA, 14 bp, Homo sapiens
cctgccaccagtca

SEQ ID NO: 6085884 - DNA, 19 bp, Homo sapiens
cctgccaccagtcactgtc

SEQ ID NO: 6085885 - DNA, 14 bp, Homo sapiens
cctgccacccagcc

SEQ ID NO: 6085886 - DNA, 17 bp, Homo sapiens
cctgccacccagcccca

SEQ ID NO: 6085887 - DNA, 18 bp, Homo sapiens
cctgccacccagccccag

SEQ ID NO: 6085888 - DNA, 15 bp, Homo sapiens
cctgccacccccagg

SEQ ID NO: 6085889 - DNA, 21 bp, Homo sapiens
cctgccacccccttccctggg

SEQ ID NO: 6085890 - DNA, 14 bp, Homo sapiens
cctgccaccctggg

SEQ ID NO: 6085891 - DNA, 21 bp, Homo sapiens
cctgccaccctgggcctggca

SEQ ID NO: 6085892 - DNA, 24 bp, Homo sapiens
cctgccaccctgggcctggcagct

SEQ ID NO: 6085893 - DNA, 17 bp, Homo sapiens
cctgccaccgactgccc

SEQ ID NO: 6085894 - DNA, 13 bp, Homo sapiens
ccctgagtccgcc

SEQ ID NO: 6085895 - DNA, 19 bp, Homo sapiens
ccctgagtccgcctgcgcc

SEQ ID NO: 6085896 - DNA, 14 bp, Homo sapiens
ccctgagtcctgag

SEQ ID NO: 6085897 - DNA, 23 bp, Homo sapiens
ccctgagtcctggtttcctggca

SEQ ID NO: 6085898 - DNA, 17 bp, Homo sapiens
ccctgagtctggacctc

SEQ ID NO: 6085899 - DNA, 20 bp, Homo sapiens
ccctgagtctggacctccat

SEQ ID NO: 6085900 - DNA, 15 bp, Homo sapiens
ccctgagtgcgggct

SEQ ID NO: 6085901 - DNA, 23 bp, Homo sapiens
ccctgagtgggctgggccctctg

SEQ ID NO: 6085902 - DNA, 17 bp, Homo sapiens
ccctgagtggtcactgg

SEQ ID NO: 6085903 - DNA, 21 bp, Homo sapiens
ccctgagtggtcactggtcag

SEQ ID NO: 6085904 - DNA, 22 bp, Homo sapiens
ccctgagtggtcactggtcagg

SEQ ID NO: 6085905 - DNA, 14 bp, Homo sapiens
ccctgagtgtccca

SEQ ID NO: 6085906 - DNA, 20 bp, Homo sapiens
ccctgagttcatccaggccc

SEQ ID NO: 6085907 - DNA, 19 bp, Homo sapiens
ccctgagttcccaaaggga

SEQ ID NO: 6085908 - DNA, 16 bp, Homo sapiens
ccctgagttctgacac

SEQ ID NO: 6085909 - DNA, 21 bp, Homo sapiens
ccctgagttgcaccattcttt

SEQ ID NO: 6085910 - DNA, 16 bp, Homo sapiens
ccctgagttggcatca

SEQ ID NO: 6085911 - DNA, 19 bp, Homo sapiens
ccctgataacaacctggag

SEQ ID NO: 6085912 - DNA, 18 bp, Homo sapiens
ccctgatcacctcagggc

SEQ ID NO: 6085913 - DNA, 18 bp, Homo sapiens
ccctgatcactcccagca

SEQ ID NO: 6085914 - DNA, 21 bp, Homo sapiens
ccctgatcactcccagcactc

SEQ ID NO: 6085915 - DNA, 14 bp, Homo sapiens
ccctgatccaggaa

SEQ ID NO: 6085916 - DNA, 15 bp, Homo sapiens
ccctgatccaggaaa

SEQ ID NO: 6085917 - DNA, 20 bp, Homo sapiens
ccctgatcccaccccctcct

SEQ ID NO: 6085918 - DNA, 14 bp, Homo sapiens
ccctgatcccagac

SEQ ID NO: 6085919 - DNA, 15 bp, Homo sapiens
ccctgatcccagacc

SEQ ID NO: 6085920 - DNA, 16 bp, Homo sapiens
ccctgatcccattttc

SEQ ID NO: 6085921 - DNA, 23 bp, Homo sapiens
ccctgatcccttccacctgctct

SEQ ID NO: 6085922 - DNA, 15 bp, Homo sapiens
ccctgatcctgtgaa

SEQ ID NO: 6085923 - DNA, 14 bp, Homo sapiens
ccctgatctctgac

SEQ ID NO: 6085924 - DNA, 21 bp, Homo sapiens
ccctgatctgacatccccact

SEQ ID NO: 6085925 - DNA, 17 bp, Homo sapiens
ccctgatgacacccacc

SEQ ID NO: 6085926 - DNA, 22 bp, Homo sapiens
ccctgatgacacccaccctgtg

SEQ ID NO: 6085927 - DNA, 21 bp, Homo sapiens
ccctgatgacgggatgctctt

SEQ ID NO: 6085928 - DNA, 16 bp, Homo sapiens
ccctgatgcagcctgt

SEQ ID NO: 6085929 - DNA, 19 bp, Homo sapiens
ccctgatgcagcctgtggc

SEQ ID NO: 6085930 - DNA, 15 bp, Homo sapiens
ccctgatgcaggtca

SEQ ID NO: 6085931 - DNA, 16 bp, Homo sapiens
ccctgatgcaggtcag

SEQ ID NO: 6085932 - DNA, 19 bp, Homo sapiens
ccctgatgcgtctacccag

SEQ ID NO: 6085933 - DNA, 13 bp, Homo sapiens
ccctgatggaccc

SEQ ID NO: 6085934 - DNA, 15 bp, Homo sapiens
ccctgatggaccctc

SEQ ID NO: 6085935 - DNA, 13 bp, Homo sapiens
ccctgatggcaga

SEQ ID NO: 6085936 - DNA, 23 bp, Homo sapiens
ccctgatggcagaactcccacaa

SEQ ID NO: 6085937 - DNA, 20 bp, Homo sapiens
ccctgatggcctttggaccc

SEQ ID NO: 6085938 - DNA, 23 bp, Homo sapiens
ccctgatggcctttggacccagg

SEQ ID NO: 6085939 - DNA, 20 bp, Homo sapiens
ccctgatgtgtcctcaggga

SEQ ID NO: 6085940 - DNA, 14 bp, Homo sapiens
ccctgattatttat

SEQ ID NO: 6085941 - DNA, 17 bp, Homo sapiens
ccctgattgacctgctc

SEQ ID NO: 6085942 - DNA, 22 bp, Homo sapiens
ccctgattgacctgctccgctg

SEQ ID NO: 6085943 - DNA, 23 bp, Homo sapiens
ccctgatttaggagaagccagga

SEQ ID NO: 6085944 - DNA, 23 bp, Homo sapiens
ccctgattttatcattctgcttc

SEQ ID NO: 6085945 - DNA, 19 bp, Homo sapiens
ccctgcaaaactccaggca

SEQ ID NO: 6085946 - DNA, 13 bp, Homo sapiens
ccctgcaaacaga

SEQ ID NO: 6085947 - DNA, 18 bp, Homo sapiens
ccctgcaaacagaacagg

SEQ ID NO: 6085948 - DNA, 16 bp, Homo sapiens
ccctgcaaagcccagc

SEQ ID NO: 6085949 - DNA, 22 bp, Homo sapiens
ccctgcaacctgattgtgtctc

SEQ ID NO: 6085950 - DNA, 19 bp, Homo sapiens
ccctgcaacttccgctgag

SEQ ID NO: 6085951 - DNA, 21 bp, Homo sapiens
ccctgcaacttccgctgaggg

SEQ ID NO: 6085952 - DNA, 23 bp, Homo sapiens
ccctgcaacttccgctgaggggt

SEQ ID NO: 6085953 - DNA, 22 bp, Homo sapiens
ccctgcaagaagcgccgactcc

SEQ ID NO: 6085954 - DNA, 21 bp, Homo sapiens
ccctgcaagacacaggctcag

SEQ ID NO: 6085955 - DNA, 19 bp, Homo sapiens
ccctgcaagagtggtccta

SEQ ID NO: 6085956 - DNA, 14 bp, Homo sapiens
ccctgcaaggccca

SEQ ID NO: 6085957 - DNA, 16 bp, Homo sapiens
ccctgcaaggcccaca

SEQ ID NO: 6085958 - DNA, 18 bp, Homo sapiens
ccctgcaaggcccacagg

SEQ ID NO: 6085959 - DNA, 15 bp, Homo sapiens
ccctgcaaggtgcac

SEQ ID NO: 6085960 - DNA, 9 bp, Homo sapiens
ccctgcaat

SEQ ID NO: 6085961 - DNA, 14 bp, Homo sapiens
ccctgcaatgcgtc

SEQ ID NO: 6085962 - DNA, 16 bp, Homo sapiens
ccctgcaatgcgtctt

SEQ ID NO: 6085963 - DNA, 23 bp, Homo sapiens
ccctgcacaaagcccttccatgt

SEQ ID NO: 6085964 - DNA, 17 bp, Homo sapiens
ccctgcacacacatgca

SEQ ID NO: 6085965 - DNA, 13 bp, Homo sapiens
ccctgcacacacc

SEQ ID NO: 6085966 - DNA, 14 bp, Homo sapiens
ccctgcacacacct

SEQ ID NO: 6085967 - DNA, 16 bp, Homo sapiens
ccctgcacacacctgc

SEQ ID NO: 6085968 - DNA, 19 bp, Homo sapiens
ccctgcacagatatttcca

SEQ ID NO: 6085969 - DNA, 13 bp, Homo sapiens
ccctgcacagcag

SEQ ID NO: 6085970 - DNA, 15 bp, Homo sapiens
ccctgcacagcaggc

SEQ ID NO: 6085971 - DNA, 20 bp, Homo sapiens
ccctgcacagcaggctgcca

SEQ ID NO: 6085972 - DNA, 12 bp, Homo sapiens
ccctgcacagcc

SEQ ID NO: 6085973 - DNA, 13 bp, Homo sapiens
ccctgcacagcct

SEQ ID NO: 6085974 - DNA, 15 bp, Homo sapiens
ccctgcacagcctct

SEQ ID NO: 6085975 - DNA, 16 bp, Homo sapiens
ccctgcacaggtggct

SEQ ID NO: 6085976 - DNA, 20 bp, Homo sapiens
ccctgcacagtgacttctga

SEQ ID NO: 6085977 - DNA, 17 bp, Homo sapiens
ccctgcacataaactcc

SEQ ID NO: 6085978 - DNA, 23 bp, Homo sapiens
ccctgcaccagcccttccctgct

SEQ ID NO: 6085979 - DNA, 15 bp, Homo sapiens
ccctgcacccacccc

SEQ ID NO: 6085980 - DNA, 18 bp, Homo sapiens
ccctgcacccacccctgc

SEQ ID NO: 6085981 - DNA, 20 bp, Homo sapiens
ccctgcacccacccctgccc

SEQ ID NO: 6085982 - DNA, 14 bp, Homo sapiens
ccctgcaccctgga

SEQ ID NO: 6085983 - DNA, 18 bp, Homo sapiens
ccctgcaccctggaaagg

SEQ ID NO: 6085984 - DNA, 18 bp, Homo sapiens
ccctgcaccgccgcagaa

SEQ ID NO: 6085985 - DNA, 19 bp, Homo sapiens
ccctgcacctcattccaac

SEQ ID NO: 6085986 - DNA, 22 bp, Homo sapiens
  misc_feature (13)..(13): n is a, c, g or t
ccctgcacctgcnttgtccctg

SEQ ID NO: 6085987 - DNA, 12 bp, Homo sapiens
ccctgcacctgg

SEQ ID NO: 6085988 - DNA, 14 bp, Homo sapiens
ccctgcacctggcc

SEQ ID NO: 6085989 - DNA, 17 bp, Homo sapiens
ccctgcacctggcctgg

SEQ ID NO: 6085990 - DNA, 21 bp, Homo sapiens
ccctgcacctggcctgggcca

SEQ ID NO: 6085991 - DNA, 19 bp, Homo sapiens
ccctgcaccttgggcacgg

SEQ ID NO: 6085992 - DNA, 12 bp, Homo sapiens
ccctgcacgacc

SEQ ID NO: 6085993 - DNA, 19 bp, Homo sapiens
ccctgcactaaagccagcc

SEQ ID NO: 6085994 - DNA, 17 bp, Homo sapiens
ccctgcactaggcaggt

SEQ ID NO: 6085995 - DNA, 17 bp, Homo sapiens
ccctgcactcccgacct

SEQ ID NO: 6085996 - DNA, 23 bp, Homo sapiens
ccctgcactggagtccagtctct

SEQ ID NO: 6085997 - DNA, 15 bp, Homo sapiens
ccctgcactgtcctg

SEQ ID NO: 6085998 - DNA, 16 bp, Homo sapiens
ccctgcactgtcctgc

SEQ ID NO: 6085999 - DNA, 17 bp, Homo sapiens
ccctgcactgtcctgct

SEQ ID NO: 6086000 - DNA, 19 bp, Homo sapiens
ccctgcactgtcctgctcc

SEQ ID NO: 6086001 - DNA, 17 bp, Homo sapiens
ccctgcacttcagacac

SEQ ID NO: 6086002 - DNA, 19 bp, Homo sapiens
ccctgcagacctcaagcca

SEQ ID NO: 6086003 - DNA, 21 bp, Homo sapiens
ccctgcagacctcaagccatc

SEQ ID NO: 6086004 - DNA, 20 bp, Homo sapiens
ccctgcagagatgcggtggc

SEQ ID NO: 6086005 - DNA, 20 bp, Homo sapiens
ccctgcagagggcacagaaa

SEQ ID NO: 6086006 - DNA, 22 bp, Homo sapiens
ccctgcagcacggacaataaac

SEQ ID NO: 6086007 - DNA, 21 bp, Homo sapiens
ccctgcagccaaacagagcct

SEQ ID NO: 6086008 - DNA, 16 bp, Homo sapiens
ccctgcagccatccca

SEQ ID NO: 6086009 - DNA, 22 bp, Homo sapiens
ccctgcagcccaaaacccaggg

SEQ ID NO: 6086010 - DNA, 13 bp, Homo sapiens
ccctgcagcccac

SEQ ID NO: 6086011 - DNA, 17 bp, Homo sapiens
ccctgcagcccaccaga

SEQ ID NO: 6086012 - DNA, 17 bp, Homo sapiens
ccctgcagcccaggcca

SEQ ID NO: 6086013 - DNA, 18 bp, Homo sapiens
ccctgcagccctggccca

SEQ ID NO: 6086014 - DNA, 13 bp, Homo sapiens
ccctgcagccgtg

SEQ ID NO: 6086015 - DNA, 12 bp, Homo sapiens
ccctgcagcctg

SEQ ID NO: 6086016 - DNA, 15 bp, Homo sapiens
ccctgcagcctgggt

SEQ ID NO: 6086017 - DNA, 12 bp, Homo sapiens
ccctgcagctga

SEQ ID NO: 6086018 - DNA, 21 bp, Homo sapiens
ccctgcagctggaatgtgcca

SEQ ID NO: 6086019 - DNA, 21 bp, Homo sapiens
ccctgcagcttgtagccagcc

SEQ ID NO: 6086020 - DNA, 20 bp, Homo sapiens
ccctgcagctttgaggctgg

SEQ ID NO: 6086021 - DNA, 20 bp, Homo sapiens
ccctgcaggaaggagctgcc

SEQ ID NO: 6086022 - DNA, 21 bp, Homo sapiens
ccctgcaggaaggagctgcct

SEQ ID NO: 6086023 - DNA, 23 bp, Homo sapiens
ccctgcaggaaggagctgcctgg

SEQ ID NO: 6086024 - DNA, 14 bp, Homo sapiens
ccctgcaggagcag

SEQ ID NO: 6086025 - DNA, 20 bp, Homo sapiens
ccctgcaggagcagggcggc

SEQ ID NO: 6086026 - DNA, 18 bp, Homo sapiens
ccctgcaggaggcctggg

SEQ ID NO: 6086027 - DNA, 20 bp, Homo sapiens
ccctgcaggaggcctgggag

SEQ ID NO: 6086028 - DNA, 18 bp, Homo sapiens
ccctgcaggcacagagga

SEQ ID NO: 6086029 - DNA, 22 bp, Homo sapiens
ccctgcaggcaggcagaccacg

SEQ ID NO: 6086030 - DNA, 12 bp, Homo sapiens
ccctgcaggcca

SEQ ID NO: 6086031 - DNA, 18 bp, Homo sapiens
ccctgcaggctgagtgca

SEQ ID NO: 6086032 - DNA, 21 bp, Homo sapiens
ccctgcagggcccttatggac

SEQ ID NO: 6086033 - DNA, 21 bp, Homo sapiens
ccctgcagggccgggcagggg

SEQ ID NO: 6086034 - DNA, 23 bp, Homo sapiens
ccctgcagtcacgtgaggcccct

SEQ ID NO: 6086035 - DNA, 18 bp, Homo sapiens
ccctgcagtttggccctg

SEQ ID NO: 6086036 - DNA, 20 bp, Homo sapiens
ccctgcagtttggccctgga

SEQ ID NO: 6086037 - DNA, 24 bp, Homo sapiens
ccctgcagtttggccctggagcca

SEQ ID NO: 6086038 - DNA, 14 bp, Homo sapiens
ccctgcatcccttg

SEQ ID NO: 6086039 - DNA, 16 bp, Homo sapiens
ccctgcatcccttggc

SEQ ID NO: 6086040 - DNA, 16 bp, Homo sapiens
ccctgcatcctgaggc

SEQ ID NO: 6086041 - DNA, 18 bp, Homo sapiens
ccctgcatcctgaggcca

SEQ ID NO: 6086042 - DNA, 16 bp, Homo sapiens
ccctgcatctgaccag

SEQ ID NO: 6086043 - DNA, 14 bp, Homo sapiens
ccctgcatctgtct

SEQ ID NO: 6086044 - DNA, 19 bp, Homo sapiens
ccctgcatctgtctgctct

SEQ ID NO: 6086045 - DNA, 22 bp, Homo sapiens
ccctgcatgcctggcccctcct

SEQ ID NO: 6086046 - DNA, 20 bp, Homo sapiens
ccctgcatggctgagagggt

SEQ ID NO: 6086047 - DNA, 16 bp, Homo sapiens
ccctgcatggctgagc

SEQ ID NO: 6086048 - DNA, 22 bp, Homo sapiens
ccctgcatgggccagcccctcc

SEQ ID NO: 6086049 - DNA, 17 bp, Homo sapiens
ccctgcattcacagcta

SEQ ID NO: 6086050 - DNA, 16 bp, Homo sapiens
ccctgcattggcctgg

SEQ ID NO: 6086051 - DNA, 19 bp, Homo sapiens
ccctgcattggcctggcct

SEQ ID NO: 6086052 - DNA, 21 bp, Homo sapiens
ccctgcattggcctggcctcc

SEQ ID NO: 6086053 - DNA, 18 bp, Homo sapiens
ccctgcattttcctcttg

SEQ ID NO: 6086054 - DNA, 19 bp, Homo sapiens
ccctgcattttcctcttgt

SEQ ID NO: 6086055 - DNA, 21 bp, Homo sapiens
ccctgccaagaactctgggca

SEQ ID NO: 6086056 - DNA, 21 bp, Homo sapiens
ccctgccaagcctggagcccc

SEQ ID NO: 6086057 - DNA, 16 bp, Homo sapiens
ccctgccaatgctcca

SEQ ID NO: 6086058 - DNA, 20 bp, Homo sapiens
ccctgccacactcagtcccc

SEQ ID NO: 6086059 - DNA, 15 bp, Homo sapiens
ccctgccacagccag

SEQ ID NO: 6086060 - DNA, 19 bp, Homo sapiens
ccctgccacagccagagga

SEQ ID NO: 6086061 - DNA, 14 bp, Homo sapiens
ccctgccacataca

SEQ ID NO: 6086062 - DNA, 21 bp, Homo sapiens
ccctgccacatacaggtgctc

SEQ ID NO: 6086063 - DNA, 17 bp, Homo sapiens
ccctgccaccgtcacac

SEQ ID NO: 6086064 - DNA, 13 bp, Homo sapiens
ccctgccacctgt

SEQ ID NO: 6086065 - DNA, 15 bp, Homo sapiens
ccctgccacctgtct

SEQ ID NO: 6086066 - DNA, 16 bp, Homo sapiens
ccctgccactcaccct

SEQ ID NO: 6086067 - DNA, 18 bp, Homo sapiens
ccctgccactcactaggc

SEQ ID NO: 6086068 - DNA, 17 bp, Homo sapiens
ccctgccactgggctct

SEQ ID NO: 6086069 - DNA, 19 bp, Homo sapiens
ccctgccactgggctctgg

SEQ ID NO: 6086070 - DNA, 20 bp, Homo sapiens
ccctgccagaggcctggtgc

SEQ ID NO: 6086071 - DNA, 21 bp, Homo sapiens
cctgccaccgactgcccagcc

SEQ ID NO: 6086072 - DNA, 14 bp, Homo sapiens
cctgccaccgccag

SEQ ID NO: 6086073 - DNA, 15 bp, Homo sapiens
cctgccaccgccaga

SEQ ID NO: 6086074 - DNA, 19 bp, Homo sapiens
cctgccaccgtcacacagt

SEQ ID NO: 6086075 - DNA, 18 bp, Homo sapiens
cctgccacctccccccac

SEQ ID NO: 6086076 - DNA, 14 bp, Homo sapiens
cctgccacctccct

SEQ ID NO: 6086077 - DNA, 12 bp, Homo sapiens
cctgccacctct

SEQ ID NO: 6086078 - DNA, 16 bp, Homo sapiens
cctgccacctgctgct

SEQ ID NO: 6086079 - DNA, 16 bp, Homo sapiens
cctgccacctggaccc

SEQ ID NO: 6086080 - DNA, 22 bp, Homo sapiens
cctgccacctggacccctgcat

SEQ ID NO: 6086081 - DNA, 16 bp, Homo sapiens
cctgccacctgtctgt

SEQ ID NO: 6086082 - DNA, 20 bp, Homo sapiens
cctgccacgtcccgctgcct

SEQ ID NO: 6086083 - DNA, 23 bp, Homo sapiens
cctgccacgtcccgctgcctcct

SEQ ID NO: 6086084 - DNA, 12 bp, Homo sapiens
cctgccactcac

SEQ ID NO: 6086085 - DNA, 14 bp, Homo sapiens
cctgccactcacac

SEQ ID NO: 6086086 - DNA, 17 bp, Homo sapiens
cctgccactcacacagc

SEQ ID NO: 6086087 - DNA, 18 bp, Homo sapiens
cctgccactcacccttcc

SEQ ID NO: 6086088 - DNA, 15 bp, Homo sapiens
cctgccactcctcaa

SEQ ID NO: 6086089 - DNA, 12 bp, Homo sapiens
cctgccactctc

SEQ ID NO: 6086090 - DNA, 21 bp, Homo sapiens
cctgccactctcctgaggagc

SEQ ID NO: 6086091 - DNA, 22 bp, Homo sapiens
cctgccactctcctgaggagca

SEQ ID NO: 6086092 - DNA, 15 bp, Homo sapiens
cctgccactctctgg

SEQ ID NO: 6086093 - DNA, 17 bp, Homo sapiens
cctgccactgacctcac

SEQ ID NO: 6086094 - DNA, 18 bp, Homo sapiens
cctgccactgggctctgg

SEQ ID NO: 6086095 - DNA, 12 bp, Homo sapiens
cctgccactgtg

SEQ ID NO: 6086096 - DNA, 14 bp, Homo sapiens
cctgccagaccccc

SEQ ID NO: 6086097 - DNA, 13 bp, Homo sapiens
cctgccagagcag

SEQ ID NO: 6086098 - DNA, 18 bp, Homo sapiens
cctgccagagctttgttt

SEQ ID NO: 6086099 - DNA, 15 bp, Homo sapiens
cctgccagaggcctg

SEQ ID NO: 6086100 - DNA, 19 bp, Homo sapiens
cctgccagaggcctggtgc

SEQ ID NO: 6086101 - DNA, 13 bp, Homo sapiens
cctgccagccact

SEQ ID NO: 6086102 - DNA, 16 bp, Homo sapiens
cctgccagccactgtc

SEQ ID NO: 6086103 - DNA, 15 bp, Homo sapiens
cctgccagccatcac

SEQ ID NO: 6086104 - DNA, 17 bp, Homo sapiens
cctgccagccatcacaa

SEQ ID NO: 6086105 - DNA, 13 bp, Homo sapiens
cctgccagcccag

SEQ ID NO: 6086106 - DNA, 15 bp, Homo sapiens
cctgccagcccagct

SEQ ID NO: 6086107 - DNA, 16 bp, Homo sapiens
cctgccagcccagctg

SEQ ID NO: 6086108 - DNA, 17 bp, Homo sapiens
cctgccagcccagctgg

SEQ ID NO: 6086109 - DNA, 16 bp, Homo sapiens
cctgccagcccctgcc

SEQ ID NO: 6086110 - DNA, 20 bp, Homo sapiens
cctgccagcccggctcggcc

SEQ ID NO: 6086111 - DNA, 13 bp, Homo sapiens
cctgccagccggt

SEQ ID NO: 6086112 - DNA, 14 bp, Homo sapiens
cctgccagcctggc

SEQ ID NO: 6086113 - DNA, 17 bp, Homo sapiens
cctgccagcctggcttc

SEQ ID NO: 6086114 - DNA, 13 bp, Homo sapiens
cctgccagctctg

SEQ ID NO: 6086115 - DNA, 12 bp, Homo sapiens
cctgccagctgc

SEQ ID NO: 6086116 - DNA, 17 bp, Homo sapiens
cctgccagctgcactga

SEQ ID NO: 6086117 - DNA, 16 bp, Homo sapiens
cctgccagctgccttc

SEQ ID NO: 6086118 - DNA, 15 bp, Homo sapiens
cctgccaggaagcca

SEQ ID NO: 6086119 - DNA, 22 bp, Homo sapiens
cctgccaggaagccagcaggct

SEQ ID NO: 6086120 - DNA, 19 bp, Homo sapiens
cctgccaggagcagcctcc

SEQ ID NO: 6086121 - DNA, 20 bp, Homo sapiens
cctgccaggaggctgcggcc

SEQ ID NO: 6086122 - DNA, 13 bp, Homo sapiens
cctgccaggcaca

SEQ ID NO: 6086123 - DNA, 14 bp, Homo sapiens
cctgccaggcacag

SEQ ID NO: 6086124 - DNA, 20 bp, Homo sapiens
cctgccaggcacaggcaggg

SEQ ID NO: 6086125 - DNA, 15 bp, Homo sapiens
cctgccaggcagggg

SEQ ID NO: 6086126 - DNA, 15 bp, Homo sapiens
cctgccaggcatggt

SEQ ID NO: 6086127 - DNA, 16 bp, Homo sapiens
cctgccaggcatggtg

SEQ ID NO: 6086128 - DNA, 15 bp, Homo sapiens
cctgccaggccctcc

SEQ ID NO: 6086129 - DNA, 20 bp, Homo sapiens
cctgccaggccctccagcag

SEQ ID NO: 6086130 - DNA, 22 bp, Homo sapiens
cctgccagggaactggcctgct

SEQ ID NO: 6086131 - DNA, 23 bp, Homo sapiens
cctgccagggaactggcctgctg

SEQ ID NO: 6086132 - DNA, 12 bp, Homo sapiens
cctgccagggac

SEQ ID NO: 6086133 - DNA, 17 bp, Homo sapiens
cctgccagggagacaga

SEQ ID NO: 6086134 - DNA, 13 bp, Homo sapiens
cctgccagggcag

SEQ ID NO: 6086135 - DNA, 15 bp, Homo sapiens
cctgccagggtgagc

SEQ ID NO: 6086136 - DNA, 13 bp, Homo sapiens
cctgccagtccca

SEQ ID NO: 6086137 - DNA, 16 bp, Homo sapiens
cctgccagtcctagct

SEQ ID NO: 6086138 - DNA, 22 bp, Homo sapiens
cctgccagtcctagctgcacag

SEQ ID NO: 6086139 - DNA, 17 bp, Homo sapiens
cctgccagtgaagtcct

SEQ ID NO: 6086140 - DNA, 21 bp, Homo sapiens
cctgccagtgaagtccttcag

SEQ ID NO: 6086141 - DNA, 16 bp, Homo sapiens
cctgccagtgccaggg

SEQ ID NO: 6086142 - DNA, 17 bp, Homo sapiens
cctgccagtgccagggt

SEQ ID NO: 6086143 - DNA, 19 bp, Homo sapiens
cctgccataccgctgggga

SEQ ID NO: 6086144 - DNA, 20 bp, Homo sapiens
cctgccataccgctggggaa

SEQ ID NO: 6086145 - DNA, 17 bp, Homo sapiens
cctgccatagccaggag

SEQ ID NO: 6086146 - DNA, 20 bp, Homo sapiens
cctgccatcatgtttacaga

SEQ ID NO: 6086147 - DNA, 14 bp, Homo sapiens
cctgccatcttccc

SEQ ID NO: 6086148 - DNA, 18 bp, Homo sapiens
cctgccatcttcccagca

SEQ ID NO: 6086149 - DNA, 19 bp, Homo sapiens
cctgccatcttctccccga

SEQ ID NO: 6086150 - DNA, 16 bp, Homo sapiens
cctgccatgccagtaa

SEQ ID NO: 6086151 - DNA, 16 bp, Homo sapiens
cctgccatggctgtga

SEQ ID NO: 6086152 - DNA, 18 bp, Homo sapiens
cctgccatggctgtgaca

SEQ ID NO: 6086153 - DNA, 17 bp, Homo sapiens
cctgccatgggccagcc

SEQ ID NO: 6086154 - DNA, 18 bp, Homo sapiens
cctgccatgggccagcct

SEQ ID NO: 6086155 - DNA, 20 bp, Homo sapiens
cctgccatgggccagcctag

SEQ ID NO: 6086156 - DNA, 21 bp, Homo sapiens
cctgccatgggccagcctagc

SEQ ID NO: 6086157 - DNA, 22 bp, Homo sapiens
cctgccatgggccagcctagcc

SEQ ID NO: 6086158 - DNA, 17 bp, Homo sapiens
cctgccattcttctggt

SEQ ID NO: 6086159 - DNA, 20 bp, Homo sapiens
cctgccattggcctcttgtc

SEQ ID NO: 6086160 - DNA, 22 bp, Homo sapiens
cctgccattgtagcgtctttct

SEQ ID NO: 6086161 - DNA, 15 bp, Homo sapiens
cctgcccaaaatgtg

SEQ ID NO: 6086162 - DNA, 17 bp, Homo sapiens
cctgcccaaacccttaa

SEQ ID NO: 6086163 - DNA, 18 bp, Homo sapiens
cctgcccaagcccaggcc

SEQ ID NO: 6086164 - DNA, 22 bp, Homo sapiens
cctgcccaaggcctaccccagt

SEQ ID NO: 6086165 - DNA, 23 bp, Homo sapiens
cctgcccaagggcctcccaccag

SEQ ID NO: 6086166 - DNA, 20 bp, Homo sapiens
cctgcccaagtgaccaggga

SEQ ID NO: 6086167 - DNA, 21 bp, Homo sapiens
cctgcccaatcctccctggag

SEQ ID NO: 6086168 - DNA, 22 bp, Homo sapiens
cctgcccaatcctccctggaga

SEQ ID NO: 6086169 - DNA, 23 bp, Homo sapiens
cctgcccaatgagactctagggt

SEQ ID NO: 6086170 - DNA, 17 bp, Homo sapiens
cctgcccacacctcctg

SEQ ID NO: 6086171 - DNA, 12 bp, Homo sapiens
cctgcccacaga

SEQ ID NO: 6086172 - DNA, 21 bp, Homo sapiens
cctgcccacagaaagccagga

SEQ ID NO: 6086173 - DNA, 24 bp, Homo sapiens
cctgcccaccccatccctggctga

SEQ ID NO: 6086174 - DNA, 16 bp, Homo sapiens
cctgcccacccccggg

SEQ ID NO: 6086175 - DNA, 22 bp, Homo sapiens
cctgcccacccgtggagatggg

SEQ ID NO: 6086176 - DNA, 13 bp, Homo sapiens
cctgcccacccta

SEQ ID NO: 6086177 - DNA, 15 bp, Homo sapiens
cctgcccacctgcct

SEQ ID NO: 6086178 - DNA, 15 bp, Homo sapiens
cctgcccacgggagg

SEQ ID NO: 6086179 - DNA, 13 bp, Homo sapiens
cctgcccactccc

SEQ ID NO: 6086180 - DNA, 14 bp, Homo sapiens
cctgcccactccca

SEQ ID NO: 6086181 - DNA, 13 bp, Homo sapiens
cctgcccagacaa

SEQ ID NO: 6086182 - DNA, 15 bp, Homo sapiens
cctgcccagacaaga

SEQ ID NO: 6086183 - DNA, 20 bp, Homo sapiens
cctgcccagagtatgggcac

SEQ ID NO: 6086184 - DNA, 19 bp, Homo sapiens
cctgcccagatcagccaga

SEQ ID NO: 6086185 - DNA, 20 bp, Homo sapiens
cctgcccagatgccctttgg

SEQ ID NO: 6086186 - DNA, 15 bp, Homo sapiens
cctgcccagcacctc

SEQ ID NO: 6086187 - DNA, 13 bp, Homo sapiens
cctgcccagccag

SEQ ID NO: 6086188 - DNA, 15 bp, Homo sapiens
cctgcccagcctcaa

SEQ ID NO: 6086189 - DNA, 16 bp, Homo sapiens
cctgcccagcctcaat

SEQ ID NO: 6086190 - DNA, 21 bp, Homo sapiens
cctgcccagcctcgcatgcca

SEQ ID NO: 6086191 - DNA, 13 bp, Homo sapiens
cctgcccagcctg

SEQ ID NO: 6086192 - DNA, 15 bp, Homo sapiens
cctgcccagcctgct

SEQ ID NO: 6086193 - DNA, 14 bp, Homo sapiens
cctgcccagcctgg

SEQ ID NO: 6086194 - DNA, 12 bp, Homo sapiens
cctgcccagctc

SEQ ID NO: 6086195 - DNA, 19 bp, Homo sapiens
cctgcccagctctgaccct

SEQ ID NO: 6086196 - DNA, 15 bp, Homo sapiens
cctgcccaggactgc

SEQ ID NO: 6086197 - DNA, 16 bp, Homo sapiens
cctgcccaggactgca

SEQ ID NO: 6086198 - DNA, 12 bp, Homo sapiens
cctgcccaggag

SEQ ID NO: 6086199 - DNA, 12 bp, Homo sapiens
cctgcccaggcc

SEQ ID NO: 6086200 - DNA, 18 bp, Homo sapiens
cctgcccaggccacagag

SEQ ID NO: 6086201 - DNA, 19 bp, Homo sapiens
cctgcccaggccacagaga

SEQ ID NO: 6086202 - DNA, 14 bp, Homo sapiens
cctgcccaggcccc

SEQ ID NO: 6086203 - DNA, 15 bp, Homo sapiens
cctgcccaggcccct

SEQ ID NO: 6086204 - DNA, 13 bp, Homo sapiens
cctgcccaggccg

SEQ ID NO: 6086205 - DNA, 23 bp, Homo sapiens
cctgcccaggccggccagcctca

SEQ ID NO: 6086206 - DNA, 21 bp, Homo sapiens
cctgcccaggtatcctggggg

SEQ ID NO: 6086207 - DNA, 22 bp, Homo sapiens
cctgcccaggtggcctcctggc

SEQ ID NO: 6086208 - DNA, 21 bp, Homo sapiens
cctgcccagtcccccaacccc

SEQ ID NO: 6086209 - DNA, 12 bp, Homo sapiens
cctgcccagtgt

SEQ ID NO: 6086210 - DNA, 23 bp, Homo sapiens
cctgcccagtgttgtttgtaaat

SEQ ID NO: 6086211 - DNA, 18 bp, Homo sapiens
cctgcccagttagcccgg

SEQ ID NO: 6086212 - DNA, 19 bp, Homo sapiens
cctgcccatacccctgcct

SEQ ID NO: 6086213 - DNA, 21 bp, Homo sapiens
cctgcccatacccctgcctgg

SEQ ID NO: 6086214 - DNA, 23 bp, Homo sapiens
cctgcccatacccctgcctgggt

SEQ ID NO: 6086215 - DNA, 18 bp, Homo sapiens
cctgcccatactgagcct

SEQ ID NO: 6086216 - DNA, 19 bp, Homo sapiens
cctgcccatactgagcctg

SEQ ID NO: 6086217 - DNA, 20 bp, Homo sapiens
cctgcccatactgagcctgc

SEQ ID NO: 6086218 - DNA, 16 bp, Homo sapiens
cctgcccatccgtctg

SEQ ID NO: 6086219 - DNA, 17 bp, Homo sapiens
cctgcccatgccccagt

SEQ ID NO: 6086220 - DNA, 16 bp, Homo sapiens
cctgcccatgggagct

SEQ ID NO: 6086221 - DNA, 14 bp, Homo sapiens
cctgcccatgtcca

SEQ ID NO: 6086222 - DNA, 15 bp, Homo sapiens
cctgcccatgtccag

SEQ ID NO: 6086223 - DNA, 17 bp, Homo sapiens
cctgcccatgtccagag

SEQ ID NO: 6086224 - DNA, 22 bp, Homo sapiens
cctgcccatgtgtcccctcact

SEQ ID NO: 6086225 - DNA, 21 bp, Homo sapiens
cctgcccattctgccctgtgg

SEQ ID NO: 6086226 - DNA, 12 bp, Homo sapiens
cctgccccaacc

SEQ ID NO: 6086227 - DNA, 18 bp, Homo sapiens
cctgccccaacccccacc

SEQ ID NO: 6086228 - DNA, 18 bp, Homo sapiens
cctgccccaagggcccag

SEQ ID NO: 6086229 - DNA, 20 bp, Homo sapiens
cctgccccaatccctttatt

SEQ ID NO: 6086230 - DNA, 12 bp, Homo sapiens
cctgccccacac

SEQ ID NO: 6086231 - DNA, 20 bp, Homo sapiens
cctgccccacacaggcctgg

SEQ ID NO: 6086232 - DNA, 17 bp, Homo sapiens
cctgccccacacggact

SEQ ID NO: 6086233 - DNA, 15 bp, Homo sapiens
cctgccccacactcc

SEQ ID NO: 6086234 - DNA, 16 bp, Homo sapiens
cctgccccacactccc

SEQ ID NO: 6086235 - DNA, 22 bp, Homo sapiens
cctgccccacccaactccacag

SEQ ID NO: 6086236 - DNA, 24 bp, Homo sapiens
cctgccccacccaactccacaggg

SEQ ID NO: 6086237 - DNA, 21 bp, Homo sapiens
cctgccccacccaccccacag

SEQ ID NO: 6086238 - DNA, 22 bp, Homo sapiens
cctgccccaccccacctcacag

SEQ ID NO: 6086239 - DNA, 20 bp, Homo sapiens
cctgccccaccccacctcca

SEQ ID NO: 6086240 - DNA, 22 bp, Homo sapiens
cctgccccaccccatccagcca

SEQ ID NO: 6086241 - DNA, 12 bp, Homo sapiens
cctgccccagag

SEQ ID NO: 6086242 - DNA, 15 bp, Homo sapiens
cctgccccagagaag

SEQ ID NO: 6086243 - DNA, 17 bp, Homo sapiens
cctgccccagagaagcc

SEQ ID NO: 6086244 - DNA, 23 bp, Homo sapiens
cctgccccagagaagcctcagtc

SEQ ID NO: 6086245 - DNA, 17 bp, Homo sapiens
cctgccccagcactcac

SEQ ID NO: 6086246 - DNA, 12 bp, Homo sapiens
cctgccccagcc

SEQ ID NO: 6086247 - DNA, 13 bp, Homo sapiens
cctgccccagccc

SEQ ID NO: 6086248 - DNA, 19 bp, Homo sapiens
cctgccccagcccaagtcc

SEQ ID NO: 6086249 - DNA, 15 bp, Homo sapiens
cctgccccagcccct

SEQ ID NO: 6086250 - DNA, 18 bp, Homo sapiens
cctgccccagcctcccag

SEQ ID NO: 6086251 - DNA, 18 bp, Homo sapiens
ccctgccagccgaccctc

SEQ ID NO: 6086252 - DNA, 21 bp, Homo sapiens
ccctgccaggaggctgcggcc

SEQ ID NO: 6086253 - DNA, 14 bp, Homo sapiens
ccctgccaggcaca

SEQ ID NO: 6086254 - DNA, 17 bp, Homo sapiens
ccctgccaggcacaggc

SEQ ID NO: 6086255 - DNA, 23 bp, Homo sapiens
ccctgccaggcccccgctggctc

SEQ ID NO: 6086256 - DNA, 16 bp, Homo sapiens
ccctgccaggctgtca

SEQ ID NO: 6086257 - DNA, 16 bp, Homo sapiens
ccctgccagggctcgg

SEQ ID NO: 6086258 - DNA, 17 bp, Homo sapiens
ccctgccagtgccaggg

SEQ ID NO: 6086259 - DNA, 15 bp, Homo sapiens
ccctgccagtgcctt

SEQ ID NO: 6086260 - DNA, 12 bp, Homo sapiens
ccctgccagtgt

SEQ ID NO: 6086261 - DNA, 18 bp, Homo sapiens
ccctgccagttctctgtg

SEQ ID NO: 6086262 - DNA, 22 bp, Homo sapiens
ccctgccagttgaagtgagagt

SEQ ID NO: 6086263 - DNA, 16 bp, Homo sapiens
ccctgccattggcctc

SEQ ID NO: 6086264 - DNA, 19 bp, Homo sapiens
ccctgccattggcctcttg

SEQ ID NO: 6086265 - DNA, 16 bp, Homo sapiens
ccctgcccaaaccctt

SEQ ID NO: 6086266 - DNA, 18 bp, Homo sapiens
ccctgcccaaactcccct

SEQ ID NO: 6086267 - DNA, 21 bp, Homo sapiens
ccctgcccaaactccccttcc

SEQ ID NO: 6086268 - DNA, 16 bp, Homo sapiens
ccctgcccaagggcct

SEQ ID NO: 6086269 - DNA, 12 bp, Homo sapiens
ccctgcccaagt

SEQ ID NO: 6086270 - DNA, 13 bp, Homo sapiens
ccctgcccaagtg

SEQ ID NO: 6086271 - DNA, 20 bp, Homo sapiens
ccctgcccaagtgaccaggg

SEQ ID NO: 6086272 - DNA, 22 bp, Homo sapiens
ccctgcccaatcctccctggag

SEQ ID NO: 6086273 - DNA, 23 bp, Homo sapiens
ccctgcccaatcctccctggaga

SEQ ID NO: 6086274 - DNA, 19 bp, Homo sapiens
ccctgcccacacctcctgg

SEQ ID NO: 6086275 - DNA, 20 bp, Homo sapiens
ccctgcccacagaaagccag

SEQ ID NO: 6086276 - DNA, 17 bp, Homo sapiens
ccctgcccacccccggg

SEQ ID NO: 6086277 - DNA, 23 bp, Homo sapiens
ccctgcccacccccgggatcctg

SEQ ID NO: 6086278 - DNA, 13 bp, Homo sapiens
ccctgcccacctg

SEQ ID NO: 6086279 - DNA, 17 bp, Homo sapiens
ccctgcccacctggcct

SEQ ID NO: 6086280 - DNA, 18 bp, Homo sapiens
ccctgcccacctggcctc

SEQ ID NO: 6086281 - DNA, 18 bp, Homo sapiens
ccctgcccacgcccttgg

SEQ ID NO: 6086282 - DNA, 19 bp, Homo sapiens
ccctgcccacgcccttgga

SEQ ID NO: 6086283 - DNA, 23 bp, Homo sapiens
ccctgcccacgcccttggagcct

SEQ ID NO: 6086284 - DNA, 16 bp, Homo sapiens
ccctgcccactcccat

SEQ ID NO: 6086285 - DNA, 19 bp, Homo sapiens
ccctgcccactcccatccc

SEQ ID NO: 6086286 - DNA, 20 bp, Homo sapiens
ccctgcccacttcagcccag

SEQ ID NO: 6086287 - DNA, 21 bp, Homo sapiens
ccctgcccacttcagcccagc

SEQ ID NO: 6086288 - DNA, 15 bp, Homo sapiens
ccctgcccacttctg

SEQ ID NO: 6086289 - DNA, 14 bp, Homo sapiens
ccctgcccagatca

SEQ ID NO: 6086290 - DNA, 22 bp, Homo sapiens
ccctgcccagatcagccagaag

SEQ ID NO: 6086291 - DNA, 20 bp, Homo sapiens
ccctgcccagcacctcctcc

SEQ ID NO: 6086292 - DNA, 13 bp, Homo sapiens
ccctgcccagcca

SEQ ID NO: 6086293 - DNA, 17 bp, Homo sapiens
ccctgcccagccagcca

SEQ ID NO: 6086294 - DNA, 14 bp, Homo sapiens
ccctgcccagccca

SEQ ID NO: 6086295 - DNA, 21 bp, Homo sapiens
ccctgcccagcctgctctccc

SEQ ID NO: 6086296 - DNA, 20 bp, Homo sapiens
ccctgcccaggtatcctggg

SEQ ID NO: 6086297 - DNA, 23 bp, Homo sapiens
ccctgcccaggtatcctggggga

SEQ ID NO: 6086298 - DNA, 21 bp, Homo sapiens
ccctgcccatacccctgcctg

SEQ ID NO: 6086299 - DNA, 22 bp, Homo sapiens
ccctgcccatacccctgcctgg

SEQ ID NO: 6086300 - DNA, 19 bp, Homo sapiens
ccctgcccatactgagcct

SEQ ID NO: 6086301 - DNA, 20 bp, Homo sapiens
ccctgcccatactgagcctg

SEQ ID NO: 6086302 - DNA, 21 bp, Homo sapiens
ccctgcccatccgtctgtctg

SEQ ID NO: 6086303 - DNA, 13 bp, Homo sapiens
ccctgcccatgct

SEQ ID NO: 6086304 - DNA, 20 bp, Homo sapiens
ccctgccccaacccccaccg

SEQ ID NO: 6086305 - DNA, 20 bp, Homo sapiens
ccctgccccacacaggcctg

SEQ ID NO: 6086306 - DNA, 21 bp, Homo sapiens
ccctgccccacacaggcctgg

SEQ ID NO: 6086307 - DNA, 22 bp, Homo sapiens
ccctgccccacacaggcctggc

SEQ ID NO: 6086308 - DNA, 24 bp, Homo sapiens
ccctgccccaccacgcatgctcag

SEQ ID NO: 6086309 - DNA, 16 bp, Homo sapiens
ccctgccccaccccac

SEQ ID NO: 6086310 - DNA, 22 bp, Homo sapiens
ccctgccccaccccatccagcc

SEQ ID NO: 6086311 - DNA, 12 bp, Homo sapiens
ccctgccccaga

SEQ ID NO: 6086312 - DNA, 14 bp, Homo sapiens
ccctgccccagagg

SEQ ID NO: 6086313 - DNA, 14 bp, Homo sapiens
ccctgccccagccc

SEQ ID NO: 6086314 - DNA, 17 bp, Homo sapiens
ccctgccccagcccaag

SEQ ID NO: 6086315 - DNA, 20 bp, Homo sapiens
ccctgccccagcccaagtcc

SEQ ID NO: 6086316 - DNA, 15 bp, Homo sapiens
ccctgccccagcccc

SEQ ID NO: 6086317 - DNA, 17 bp, Homo sapiens
ccctgccccaggcctgg

SEQ ID NO: 6086318 - DNA, 12 bp, Homo sapiens
ccctgccccatc

SEQ ID NO: 6086319 - DNA, 15 bp, Homo sapiens
ccctgccccatcctg

SEQ ID NO: 6086320 - DNA, 17 bp, Homo sapiens
ccctgccccatcctggg

SEQ ID NO: 6086321 - DNA, 13 bp, Homo sapiens
ccctgcccccacc

SEQ ID NO: 6086322 - DNA, 16 bp, Homo sapiens
ccctgcccccacccct

SEQ ID NO: 6086323 - DNA, 16 bp, Homo sapiens
ccctgcccccacttcc

SEQ ID NO: 6086324 - DNA, 17 bp, Homo sapiens
ccctgcccccaggactg

SEQ ID NO: 6086325 - DNA, 18 bp, Homo sapiens
ccctgcccccaggactgg

SEQ ID NO: 6086326 - DNA, 20 bp, Homo sapiens
ccctgcccccatctccccag

SEQ ID NO: 6086327 - DNA, 21 bp, Homo sapiens
ccctgcccccatctccccagg

SEQ ID NO: 6086328 - DNA, 22 bp, Homo sapiens
ccctgcccccatctccccaggc

SEQ ID NO: 6086329 - DNA, 22 bp, Homo sapiens
ccctgccccccaaggttctggt

SEQ ID NO: 6086330 - DNA, 16 bp, Homo sapiens
ccctgccccccagcct

SEQ ID NO: 6086331 - DNA, 19 bp, Homo sapiens
ccctgccccccagcctctg

SEQ ID NO: 6086332 - DNA, 19 bp, Homo sapiens
ccctgccccctcgggggcc

SEQ ID NO: 6086333 - DNA, 18 bp, Homo sapiens
ccctgccccctgcaggaa

SEQ ID NO: 6086334 - DNA, 15 bp, Homo sapiens
ccctgccccctggct

SEQ ID NO: 6086335 - DNA, 19 bp, Homo sapiens
ccctgccccctggctgact

SEQ ID NO: 6086336 - DNA, 20 bp, Homo sapiens
ccctgccccctggctgactg

SEQ ID NO: 6086337 - DNA, 22 bp, Homo sapiens
ccctgccccgcaggcctgcctt

SEQ ID NO: 6086338 - DNA, 19 bp, Homo sapiens
ccctgccccgcccccaagc

SEQ ID NO: 6086339 - DNA, 23 bp, Homo sapiens
ccctgccccgccccccagagcca

SEQ ID NO: 6086340 - DNA, 23 bp, Homo sapiens
ccctgccccgtcccctgggccac

SEQ ID NO: 6086341 - DNA, 10 bp, Homo sapiens
ccctgcccct

SEQ ID NO: 6086342 - DNA, 21 bp, Homo sapiens
ccctgcccctacgggcgctgc

SEQ ID NO: 6086343 - DNA, 13 bp, Homo sapiens
ccctgcccctccc

SEQ ID NO: 6086344 - DNA, 16 bp, Homo sapiens
ccctgcccctccccct

SEQ ID NO: 6086345 - DNA, 15 bp, Homo sapiens
ccctgcccctcccta

SEQ ID NO: 6086346 - DNA, 18 bp, Homo sapiens
ccctgcccctcccttcaa

SEQ ID NO: 6086347 - DNA, 19 bp, Homo sapiens
ccctgcccctcccttcaac

SEQ ID NO: 6086348 - DNA, 23 bp, Homo sapiens
ccctgcccctcccttcaaccatt

SEQ ID NO: 6086349 - DNA, 11 bp, Homo sapiens
ccctgcccctg

SEQ ID NO: 6086350 - DNA, 19 bp, Homo sapiens
ccctgcccctgccccgtca

SEQ ID NO: 6086351 - DNA, 13 bp, Homo sapiens
ccctgcccctgtg

SEQ ID NO: 6086352 - DNA, 14 bp, Homo sapiens
ccctgcccctgtgc

SEQ ID NO: 6086353 - DNA, 18 bp, Homo sapiens
ccctgcccctgtgggact

SEQ ID NO: 6086354 - DNA, 17 bp, Homo sapiens
ccctgccccttgtcctc

SEQ ID NO: 6086355 - DNA, 21 bp, Homo sapiens
ccctgcccctttcttccccac

SEQ ID NO: 6086356 - DNA, 13 bp, Homo sapiens
ccctgcccgagag

SEQ ID NO: 6086357 - DNA, 20 bp, Homo sapiens
ccctgcccgagagctcttag

SEQ ID NO: 6086358 - DNA, 12 bp, Homo sapiens
ccctgcccgcca

SEQ ID NO: 6086359 - DNA, 14 bp, Homo sapiens
ccctgcccgccaca

SEQ ID NO: 6086360 - DNA, 14 bp, Homo sapiens
ccctgcccggctgc

SEQ ID NO: 6086361 - DNA, 15 bp, Homo sapiens
ccctgcccgggctcc

SEQ ID NO: 6086362 - DNA, 17 bp, Homo sapiens
ccctgcccgggctccca

SEQ ID NO: 6086363 - DNA, 13 bp, Homo sapiens
ccctgcccgggga

SEQ ID NO: 6086364 - DNA, 10 bp, Homo sapiens
ccctgccctc

SEQ ID NO: 6086365 - DNA, 21 bp, Homo sapiens
ccctgccctcactccactccc

SEQ ID NO: 6086366 - DNA, 18 bp, Homo sapiens
ccctgccctcatctctct

SEQ ID NO: 6086367 - DNA, 15 bp, Homo sapiens
ccctgccctcatggg

SEQ ID NO: 6086368 - DNA, 16 bp, Homo sapiens
ccctgccctcatggga

SEQ ID NO: 6086369 - DNA, 12 bp, Homo sapiens
ccctgccctccc

SEQ ID NO: 6086370 - DNA, 16 bp, Homo sapiens
ccctgccctcccccac

SEQ ID NO: 6086371 - DNA, 17 bp, Homo sapiens
ccctgccctcccccacg

SEQ ID NO: 6086372 - DNA, 14 bp, Homo sapiens
ccctgccctcccct

SEQ ID NO: 6086373 - DNA, 15 bp, Homo sapiens
ccctgccctcccctg

SEQ ID NO: 6086374 - DNA, 18 bp, Homo sapiens
ccctgccctcccctgctc

SEQ ID NO: 6086375 - DNA, 21 bp, Homo sapiens
ccctgccctcccctgctccca

SEQ ID NO: 6086376 - DNA, 14 bp, Homo sapiens
ccctgccctcggcc

SEQ ID NO: 6086377 - DNA, 16 bp, Homo sapiens
ccctgccctcgtggcc

SEQ ID NO: 6086378 - DNA, 17 bp, Homo sapiens
ccctgccctcgtggcca

SEQ ID NO: 6086379 - DNA, 21 bp, Homo sapiens
ccctgccctcgtggccagccc

SEQ ID NO: 6086380 - DNA, 22 bp, Homo sapiens
ccctgccctcgtggccagcccg

SEQ ID NO: 6086381 - DNA, 17 bp, Homo sapiens
ccctgccctctccttcc

SEQ ID NO: 6086382 - DNA, 18 bp, Homo sapiens
ccctgccctgaggagggc

SEQ ID NO: 6086383 - DNA, 13 bp, Homo sapiens
ccctgccctgcac

SEQ ID NO: 6086384 - DNA, 15 bp, Homo sapiens
ccctgccctgcacct

SEQ ID NO: 6086385 - DNA, 15 bp, Homo sapiens
ccctgccctgctcct

SEQ ID NO: 6086386 - DNA, 14 bp, Homo sapiens
ccctgccctgctct

SEQ ID NO: 6086387 - DNA, 18 bp, Homo sapiens
ccctgccctgctctgccc

SEQ ID NO: 6086388 - DNA, 15 bp, Homo sapiens
ccctgccctgctgag

SEQ ID NO: 6086389 - DNA, 20 bp, Homo sapiens
ccctgccctggcacttggac

SEQ ID NO: 6086390 - DNA, 13 bp, Homo sapiens
ccctgccctggcc

SEQ ID NO: 6086391 - DNA, 14 bp, Homo sapiens
ccctgccctggcca

SEQ ID NO: 6086392 - DNA, 14 bp, Homo sapiens
ccctgccctggcct

SEQ ID NO: 6086393 - DNA, 11 bp, Homo sapiens
ccctgccctgt

SEQ ID NO: 6086394 - DNA, 15 bp, Homo sapiens
ccctgccctgtgccg

SEQ ID NO: 6086395 - DNA, 21 bp, Homo sapiens
ccctgccctgtgggcccccaa

SEQ ID NO: 6086396 - DNA, 10 bp, Homo sapiens
ccctgccctt

SEQ ID NO: 6086397 - DNA, 21 bp, Homo sapiens
ccctgcccttcctcagggccc

SEQ ID NO: 6086398 - DNA, 22 bp, Homo sapiens
ccctgcccttcctcctgatgga

SEQ ID NO: 6086399 - DNA, 16 bp, Homo sapiens
ccctgcccttctcaag

SEQ ID NO: 6086400 - DNA, 13 bp, Homo sapiens
ccctgcccttggc

SEQ ID NO: 6086401 - DNA, 15 bp, Homo sapiens
ccctgcccttggcac

SEQ ID NO: 6086402 - DNA, 16 bp, Homo sapiens
ccctgcccttggcacc

SEQ ID NO: 6086403 - DNA, 17 bp, Homo sapiens
ccctgcccttggcacca

SEQ ID NO: 6086404 - DNA, 23 bp, Homo sapiens
ccctgcccttgtttggggcagga

SEQ ID NO: 6086405 - DNA, 13 bp, Homo sapiens
ccctgccgagggg

SEQ ID NO: 6086406 - DNA, 18 bp, Homo sapiens
ccctgccgcctcccggga

SEQ ID NO: 6086407 - DNA, 15 bp, Homo sapiens
ccctgccggccttgg

SEQ ID NO: 6086408 - DNA, 19 bp, Homo sapiens
ccctgccgtcaccaccacc

SEQ ID NO: 6086409 - DNA, 20 bp, Homo sapiens
ccctgccgtcaccaccaccc

SEQ ID NO: 6086410 - DNA, 19 bp, Homo sapiens
ccctgcctacgccaggaga

SEQ ID NO: 6086411 - DNA, 20 bp, Homo sapiens
ccctgcctactctttgtttt

SEQ ID NO: 6086412 - DNA, 9 bp, Homo sapiens
ccctgcctc

SEQ ID NO: 6086413 - DNA, 11 bp, Homo sapiens
ccctgcctcac

SEQ ID NO: 6086414 - DNA, 21 bp, Homo sapiens
ccctgcctcactcctccgtga

SEQ ID NO: 6086415 - DNA, 13 bp, Homo sapiens
ccctgcctcagct

SEQ ID NO: 6086416 - DNA, 15 bp, Homo sapiens
ccctgcctcagctgc

SEQ ID NO: 6086417 - DNA, 16 bp, Homo sapiens
ccctgcctcagtggct

SEQ ID NO: 6086418 - DNA, 15 bp, Homo sapiens
ccctgcctccaccct

SEQ ID NO: 6086419 - DNA, 16 bp, Homo sapiens
ccctgcctccaccctc

SEQ ID NO: 6086420 - DNA, 16 bp, Homo sapiens
ccctgcctccagctgt

SEQ ID NO: 6086421 - DNA, 20 bp, Homo sapiens
ccctgcctcccatgcctggt

SEQ ID NO: 6086422 - DNA, 14 bp, Homo sapiens
ccctgcctccggga

SEQ ID NO: 6086423 - DNA, 13 bp, Homo sapiens
ccctgcctcctgc

SEQ ID NO: 6086424 - DNA, 15 bp, Homo sapiens
ccctgcctcctgcca

SEQ ID NO: 6086425 - DNA, 17 bp, Homo sapiens
ccctgcctcctgccggc

SEQ ID NO: 6086426 - DNA, 17 bp, Homo sapiens
ccctgcctcctgcctcc

SEQ ID NO: 6086427 - DNA, 22 bp, Homo sapiens
ccctgcctcctgcctcccgcct

SEQ ID NO: 6086428 - DNA, 14 bp, Homo sapiens
ccctgcctcctggg

SEQ ID NO: 6086429 - DNA, 18 bp, Homo sapiens
ccctgcctcgagggccgc

SEQ ID NO: 6086430 - DNA, 14 bp, Homo sapiens
ccctgcctctccca

SEQ ID NO: 6086431 - DNA, 14 bp, Homo sapiens
cctgccccagctgg

SEQ ID NO: 6086432 - DNA, 12 bp, Homo sapiens
cctgccccaggc

SEQ ID NO: 6086433 - DNA, 14 bp, Homo sapiens
cctgccccaggcct

SEQ ID NO: 6086434 - DNA, 18 bp, Homo sapiens
cctgccccaggcctggac

SEQ ID NO: 6086435 - DNA, 20 bp, Homo sapiens
cctgccccatcctgggcctt

SEQ ID NO: 6086436 - DNA, 14 bp, Homo sapiens
cctgcccccaagtc

SEQ ID NO: 6086437 - DNA, 15 bp, Homo sapiens
cctgcccccaagtca

SEQ ID NO: 6086438 - DNA, 15 bp, Homo sapiens
cctgcccccacaccc

SEQ ID NO: 6086439 - DNA, 18 bp, Homo sapiens
cctgcccccacacctggc

SEQ ID NO: 6086440 - DNA, 13 bp, Homo sapiens
cctgcccccacag

SEQ ID NO: 6086441 - DNA, 17 bp, Homo sapiens
cctgcccccacagctcc

SEQ ID NO: 6086442 - DNA, 22 bp, Homo sapiens
cctgcccccacagctccttgca

SEQ ID NO: 6086443 - DNA, 17 bp, Homo sapiens
cctgcccccaccccagg

SEQ ID NO: 6086444 - DNA, 20 bp, Homo sapiens
cctgcccccaccccaggctg

SEQ ID NO: 6086445 - DNA, 15 bp, Homo sapiens
cctgcccccacccct

SEQ ID NO: 6086446 - DNA, 23 bp, Homo sapiens
cctgcccccagcactcctctgtc

SEQ ID NO: 6086447 - DNA, 14 bp, Homo sapiens
cctgcccccagccc

SEQ ID NO: 6086448 - DNA, 13 bp, Homo sapiens
cctgcccccagcg

SEQ ID NO: 6086449 - DNA, 12 bp, Homo sapiens
cctgcccccagg

SEQ ID NO: 6086450 - DNA, 16 bp, Homo sapiens
cctgcccccaggactg

SEQ ID NO: 6086451 - DNA, 17 bp, Homo sapiens
cctgcccccaggactgg

SEQ ID NO: 6086452 - DNA, 18 bp, Homo sapiens
cctgcccccaggactggg

SEQ ID NO: 6086453 - DNA, 20 bp, Homo sapiens
cctgcccccatctccccagg

SEQ ID NO: 6086454 - DNA, 14 bp, Homo sapiens
cctgccccccagtc

SEQ ID NO: 6086455 - DNA, 19 bp, Homo sapiens
cctgccccccagtctcccc

SEQ ID NO: 6086456 - DNA, 20 bp, Homo sapiens
cctgccccccctaagagaca

SEQ ID NO: 6086457 - DNA, 14 bp, Homo sapiens
cctgccccccttcc

SEQ ID NO: 6086458 - DNA, 19 bp, Homo sapiens
cctgccccccttcccaccc

SEQ ID NO: 6086459 - DNA, 19 bp, Homo sapiens
cctgcccccgacagcccag

SEQ ID NO: 6086460 - DNA, 19 bp, Homo sapiens
cctgcccccgcatcccctg

SEQ ID NO: 6086461 - DNA, 22 bp, Homo sapiens
cctgcccccgcatcccctgcct

SEQ ID NO: 6086462 - DNA, 16 bp, Homo sapiens
cctgcccccgccctgc

SEQ ID NO: 6086463 - DNA, 17 bp, Homo sapiens
cctgcccccgccctgct

SEQ ID NO: 6086464 - DNA, 17 bp, Homo sapiens
cctgcccccgctctgcc

SEQ ID NO: 6086465 - DNA, 18 bp, Homo sapiens
cctgcccccgtcccacct

SEQ ID NO: 6086466 - DNA, 18 bp, Homo sapiens
cctgccccctgaaactta

SEQ ID NO: 6086467 - DNA, 14 bp, Homo sapiens
cctgccccctgcag

SEQ ID NO: 6086468 - DNA, 15 bp, Homo sapiens
cctgccccctgcagg

SEQ ID NO: 6086469 - DNA, 16 bp, Homo sapiens
cctgccccctgccagt

SEQ ID NO: 6086470 - DNA, 14 bp, Homo sapiens
cctgccccctggct

SEQ ID NO: 6086471 - DNA, 13 bp, Homo sapiens
cctgccccctggg

SEQ ID NO: 6086472 - DNA, 23 bp, Homo sapiens
cctgccccctgggctggggcctc

SEQ ID NO: 6086473 - DNA, 15 bp, Homo sapiens
cctgccccctgggga

SEQ ID NO: 6086474 - DNA, 13 bp, Homo sapiens
cctgccccctggt

SEQ ID NO: 6086475 - DNA, 12 bp, Homo sapiens
cctgcccccttc

SEQ ID NO: 6086476 - DNA, 17 bp, Homo sapiens
cctgcccccttctccca

SEQ ID NO: 6086477 - DNA, 18 bp, Homo sapiens
cctgcccccttctcccac

SEQ ID NO: 6086478 - DNA, 21 bp, Homo sapiens
cctgcccccttctcccacact

SEQ ID NO: 6086479 - DNA, 22 bp, Homo sapiens
cctgcccccttctcccacactg

SEQ ID NO: 6086480 - DNA, 17 bp, Homo sapiens
cctgccccgcaggcctg

SEQ ID NO: 6086481 - DNA, 18 bp, Homo sapiens
cctgccccgcaggcctgc

SEQ ID NO: 6086482 - DNA, 16 bp, Homo sapiens
cctgccccgcccagct

SEQ ID NO: 6086483 - DNA, 18 bp, Homo sapiens
cctgccccgcccccagtc

SEQ ID NO: 6086484 - DNA, 18 bp, Homo sapiens
cctgccccgccccccaga

SEQ ID NO: 6086485 - DNA, 22 bp, Homo sapiens
cctgccccgccccccagagcca

SEQ ID NO: 6086486 - DNA, 21 bp, Homo sapiens
cctgccccggacctacctccc

SEQ ID NO: 6086487 - DNA, 22 bp, Homo sapiens
cctgccccggacctacctccct

SEQ ID NO: 6086488 - DNA, 23 bp, Homo sapiens
cctgccccggacctacctccctc

SEQ ID NO: 6086489 - DNA, 19 bp, Homo sapiens
cctgccccgtcccctgggc

SEQ ID NO: 6086490 - DNA, 21 bp, Homo sapiens
cctgccccgtgtgtgtggccg

SEQ ID NO: 6086491 - DNA, 12 bp, Homo sapiens
cctgccccgttg

SEQ ID NO: 6086492 - DNA, 18 bp, Homo sapiens
cctgccccgttgcttccc

SEQ ID NO: 6086493 - DNA, 18 bp, Homo sapiens
cctgcccctagacatgga

SEQ ID NO: 6086494 - DNA, 23 bp, Homo sapiens
cctgcccctcacctgcctgccct

SEQ ID NO: 6086495 - DNA, 15 bp, Homo sapiens
cctgcccctcccaga

SEQ ID NO: 6086496 - DNA, 15 bp, Homo sapiens
cctgcccctccccct

SEQ ID NO: 6086497 - DNA, 19 bp, Homo sapiens
cctgcccctccctagatcc

SEQ ID NO: 6086498 - DNA, 20 bp, Homo sapiens
cctgcccctccctagatcca

SEQ ID NO: 6086499 - DNA, 14 bp, Homo sapiens
cctgcccctccctt

SEQ ID NO: 6086500 - DNA, 22 bp, Homo sapiens
cctgcccctcctctccctcatc

SEQ ID NO: 6086501 - DNA, 16 bp, Homo sapiens
cctgcccctctctctc

SEQ ID NO: 6086502 - DNA, 18 bp, Homo sapiens
cctgcccctcttcccggg

SEQ ID NO: 6086503 - DNA, 15 bp, Homo sapiens
cctgcccctctttct

SEQ ID NO: 6086504 - DNA, 15 bp, Homo sapiens
cctgcccctgcaaag

SEQ ID NO: 6086505 - DNA, 17 bp, Homo sapiens
cctgcccctgcaaagac

SEQ ID NO: 6086506 - DNA, 18 bp, Homo sapiens
cctgcccctgcaaagaca

SEQ ID NO: 6086507 - DNA, 15 bp, Homo sapiens
cctgcccctgcccga

SEQ ID NO: 6086508 - DNA, 17 bp, Homo sapiens
cctgcccctgcccgaga

SEQ ID NO: 6086509 - DNA, 18 bp, Homo sapiens
cctgcccctgcctgacag

SEQ ID NO: 6086510 - DNA, 21 bp, Homo sapiens
cctgcccctggtgccctgaga

SEQ ID NO: 6086511 - DNA, 13 bp, Homo sapiens
cctgcccctgtgc

SEQ ID NO: 6086512 - DNA, 15 bp, Homo sapiens
cctgcccctgtggga

SEQ ID NO: 6086513 - DNA, 16 bp, Homo sapiens
cctgccccttccttta

SEQ ID NO: 6086514 - DNA, 19 bp, Homo sapiens
cctgccccttctacactct

SEQ ID NO: 6086515 - DNA, 20 bp, Homo sapiens
cctgccccttctacactctc

SEQ ID NO: 6086516 - DNA, 22 bp, Homo sapiens
cctgccccttctacactctcct

SEQ ID NO: 6086517 - DNA, 20 bp, Homo sapiens
cctgccccttgtcctctcag

SEQ ID NO: 6086518 - DNA, 14 bp, Homo sapiens
cctgcccctttcag

SEQ ID NO: 6086519 - DNA, 18 bp, Homo sapiens
cctgcccctttcaggcct

SEQ ID NO: 6086520 - DNA, 19 bp, Homo sapiens
cctgcccctttcaggccta

SEQ ID NO: 6086521 - DNA, 19 bp, Homo sapiens
cctgcccctttcttcccca

SEQ ID NO: 6086522 - DNA, 15 bp, Homo sapiens
cctgcccgagggcag

SEQ ID NO: 6086523 - DNA, 16 bp, Homo sapiens
cctgcccgagggcagc

SEQ ID NO: 6086524 - DNA, 17 bp, Homo sapiens
cctgcccgcacagcagc

SEQ ID NO: 6086525 - DNA, 22 bp, Homo sapiens
cctgcccgcacagcagcctgct

SEQ ID NO: 6086526 - DNA, 20 bp, Homo sapiens
cctgcccgcagacctctgga

SEQ ID NO: 6086527 - DNA, 13 bp, Homo sapiens
cctgcccgccaca

SEQ ID NO: 6086528 - DNA, 13 bp, Homo sapiens
cctgcccgcccgc

SEQ ID NO: 6086529 - DNA, 20 bp, Homo sapiens
cctgcccgcgcccgccgcct

SEQ ID NO: 6086530 - DNA, 21 bp, Homo sapiens
cctgcccgcgcccgccgcctc

SEQ ID NO: 6086531 - DNA, 16 bp, Homo sapiens
cctgcccgctgcaatg

SEQ ID NO: 6086532 - DNA, 20 bp, Homo sapiens
cctgcccggatggagcgggg

SEQ ID NO: 6086533 - DNA, 16 bp, Homo sapiens
cctgcccggcccagga

SEQ ID NO: 6086534 - DNA, 19 bp, Homo sapiens
cctgcccggcccaggagcg

SEQ ID NO: 6086535 - DNA, 14 bp, Homo sapiens
cctgcccggctgcg

SEQ ID NO: 6086536 - DNA, 13 bp, Homo sapiens
cctgcccgggctc

SEQ ID NO: 6086537 - DNA, 14 bp, Homo sapiens
cctgcccggggagc

SEQ ID NO: 6086538 - DNA, 17 bp, Homo sapiens
cctgcccggggagctgc

SEQ ID NO: 6086539 - DNA, 22 bp, Homo sapiens
cctgcccggtggtttgccatgt

SEQ ID NO: 6086540 - DNA, 23 bp, Homo sapiens
cctgcccggtggtttgccatgtc

SEQ ID NO: 6086541 - DNA, 20 bp, Homo sapiens
cctgcccgtaaacacgcctg

SEQ ID NO: 6086542 - DNA, 12 bp, Homo sapiens
cctgcccgtctc

SEQ ID NO: 6086543 - DNA, 23 bp, Homo sapiens
cctgcccgtctctctcccatgga

SEQ ID NO: 6086544 - DNA, 16 bp, Homo sapiens
cctgcccgtgtacata

SEQ ID NO: 6086545 - DNA, 17 bp, Homo sapiens
cctgcccgtgtacatag

SEQ ID NO: 6086546 - DNA, 16 bp, Homo sapiens
cctgcccgttgccggg

SEQ ID NO: 6086547 - DNA, 23 bp, Homo sapiens
cctgcccgttgccgggcctggac

SEQ ID NO: 6086548 - DNA, 24 bp, Homo sapiens
cctgccctagagcacactgtagca

SEQ ID NO: 6086549 - DNA, 24 bp, Homo sapiens
cctgccctagcagtttgcctctgc

SEQ ID NO: 6086550 - DNA, 16 bp, Homo sapiens
cctgccctagctccac

SEQ ID NO: 6086551 - DNA, 16 bp, Homo sapiens
cctgccctcacctccc

SEQ ID NO: 6086552 - DNA, 18 bp, Homo sapiens
cctgccctcacctccctt

SEQ ID NO: 6086553 - DNA, 13 bp, Homo sapiens
cctgccctcacgc

SEQ ID NO: 6086554 - DNA, 16 bp, Homo sapiens
cctgccctcactccac

SEQ ID NO: 6086555 - DNA, 18 bp, Homo sapiens
cctgccctcactccctct

SEQ ID NO: 6086556 - DNA, 21 bp, Homo sapiens
cctgccctcactccctctgca

SEQ ID NO: 6086557 - DNA, 23 bp, Homo sapiens
cctgccctcaggctccccagtgc

SEQ ID NO: 6086558 - DNA, 13 bp, Homo sapiens
cctgccctcatgg

SEQ ID NO: 6086559 - DNA, 13 bp, Homo sapiens
cctgccctcccaa

SEQ ID NO: 6086560 - DNA, 16 bp, Homo sapiens
cctgccctcccaagtc

SEQ ID NO: 6086561 - DNA, 16 bp, Homo sapiens
cctgccctcccacccc

SEQ ID NO: 6086562 - DNA, 24 bp, Homo sapiens
cctgccctcccatgttgcatgcct

SEQ ID NO: 6086563 - DNA, 16 bp, Homo sapiens
cctgccctccccagag

SEQ ID NO: 6086564 - DNA, 22 bp, Homo sapiens
cctgccctccccagagcactgg

SEQ ID NO: 6086565 - DNA, 13 bp, Homo sapiens
cctgccctcccct

SEQ ID NO: 6086566 - DNA, 17 bp, Homo sapiens
cctgccctcccctgctc

SEQ ID NO: 6086567 - DNA, 22 bp, Homo sapiens
cctgccctcccctgctcccagg

SEQ ID NO: 6086568 - DNA, 19 bp, Homo sapiens
cctgccctcccgcaccttc

SEQ ID NO: 6086569 - DNA, 14 bp, Homo sapiens
cctgccctccctca

SEQ ID NO: 6086570 - DNA, 13 bp, Homo sapiens
cctgccctccgcc

SEQ ID NO: 6086571 - DNA, 13 bp, Homo sapiens
cctgccctccgga

SEQ ID NO: 6086572 - DNA, 16 bp, Homo sapiens
cctgccctcctctccc

SEQ ID NO: 6086573 - DNA, 17 bp, Homo sapiens
cctgccctcctctcccg

SEQ ID NO: 6086574 - DNA, 18 bp, Homo sapiens
cctgccctcctctcccgt

SEQ ID NO: 6086575 - DNA, 21 bp, Homo sapiens
cctgccctcctctcccgtctc

SEQ ID NO: 6086576 - DNA, 12 bp, Homo sapiens
cctgccctcgtg

SEQ ID NO: 6086577 - DNA, 15 bp, Homo sapiens
cctgccctcgtggcc

SEQ ID NO: 6086578 - DNA, 19 bp, Homo sapiens
cctgccctcgtggccagcc

SEQ ID NO: 6086579 - DNA, 23 bp, Homo sapiens
cctgccctcgtggccagcccggc

SEQ ID NO: 6086580 - DNA, 15 bp, Homo sapiens
cctgccctctattta

SEQ ID NO: 6086581 - DNA, 19 bp, Homo sapiens
cctgccctctatttattag

SEQ ID NO: 6086582 - DNA, 13 bp, Homo sapiens
cctgccctctctc

SEQ ID NO: 6086583 - DNA, 14 bp, Homo sapiens
cctgccctctctgc

SEQ ID NO: 6086584 - DNA, 13 bp, Homo sapiens
cctgccctctgcc

SEQ ID NO: 6086585 - DNA, 16 bp, Homo sapiens
cctgccctctgctctg

SEQ ID NO: 6086586 - DNA, 20 bp, Homo sapiens
cctgccctctgctctgcctg

SEQ ID NO: 6086587 - DNA, 12 bp, Homo sapiens
cctgccctgagg

SEQ ID NO: 6086588 - DNA, 18 bp, Homo sapiens
cctgccctgaggagggcc

SEQ ID NO: 6086589 - DNA, 14 bp, Homo sapiens
cctgccctgccacc

SEQ ID NO: 6086590 - DNA, 13 bp, Homo sapiens
cctgccctgccca

SEQ ID NO: 6086591 - DNA, 15 bp, Homo sapiens
cctgccctgccccct

SEQ ID NO: 6086592 - DNA, 15 bp, Homo sapiens
cctgccctgccctgc

SEQ ID NO: 6086593 - DNA, 15 bp, Homo sapiens
cctgccctgcctcag

SEQ ID NO: 6086594 - DNA, 16 bp, Homo sapiens
cctgccctgcctgggc

SEQ ID NO: 6086595 - DNA, 17 bp, Homo sapiens
cctgccctgccttgccg

SEQ ID NO: 6086596 - DNA, 16 bp, Homo sapiens
cctgccctgctatttc

SEQ ID NO: 6086597 - DNA, 20 bp, Homo sapiens
cctgccctgctgagcacaga

SEQ ID NO: 6086598 - DNA, 12 bp, Homo sapiens
cctgccctggaa

SEQ ID NO: 6086599 - DNA, 16 bp, Homo sapiens
cctgccctggccactg

SEQ ID NO: 6086600 - DNA, 16 bp, Homo sapiens
cctgccctggcctacc

SEQ ID NO: 6086601 - DNA, 19 bp, Homo sapiens
cctgccctggcctaccaca

SEQ ID NO: 6086602 - DNA, 14 bp, Homo sapiens
cctgccctgggagg

SEQ ID NO: 6086603 - DNA, 15 bp, Homo sapiens
cctgccctgggaggc

SEQ ID NO: 6086604 - DNA, 22 bp, Homo sapiens
cctgccctgggaggcagtgatg

SEQ ID NO: 6086605 - DNA, 16 bp, Homo sapiens
cctgccctggggagaa

SEQ ID NO: 6086606 - DNA, 20 bp, Homo sapiens
cctgccctggtttcctgccc

SEQ ID NO: 6086607 - DNA, 23 bp, Homo sapiens
cctgccctggtttcctgccctgg

SEQ ID NO: 6086608 - DNA, 21 bp, Homo sapiens
cctgccctgtacctctctctg

SEQ ID NO: 6086609 - DNA, 23 bp, Homo sapiens
cctgccctgtacctctctctgct

SEQ ID NO: 6086610 - DNA, 15 bp, Homo sapiens
ccctgcctctcccag

SEQ ID NO: 6086611 - DNA, 16 bp, Homo sapiens
ccctgcctctctgcag

SEQ ID NO: 6086612 - DNA, 18 bp, Homo sapiens
ccctgcctctctgcaggt

SEQ ID NO: 6086613 - DNA, 12 bp, Homo sapiens
ccctgcctctgt

SEQ ID NO: 6086614 - DNA, 14 bp, Homo sapiens
ccctgcctctgtgt

SEQ ID NO: 6086615 - DNA, 12 bp, Homo sapiens
ccctgcctgaga

SEQ ID NO: 6086616 - DNA, 16 bp, Homo sapiens
ccctgcctgagcccag

SEQ ID NO: 6086617 - DNA, 22 bp, Homo sapiens
ccctgcctgaggaggaggacac

SEQ ID NO: 6086618 - DNA, 13 bp, Homo sapiens
ccctgcctgaggg

SEQ ID NO: 6086619 - DNA, 19 bp, Homo sapiens
ccctgcctgagggcccctc

SEQ ID NO: 6086620 - DNA, 22 bp, Homo sapiens
ccctgcctgagggcccctctgc

SEQ ID NO: 6086621 - DNA, 23 bp, Homo sapiens
ccctgcctgagggcccctctgcc

SEQ ID NO: 6086622 - DNA, 11 bp, Homo sapiens
ccctgcctgca

SEQ ID NO: 6086623 - DNA, 15 bp, Homo sapiens
ccctgcctgcacctc

SEQ ID NO: 6086624 - DNA, 13 bp, Homo sapiens
ccctgcctgccca

SEQ ID NO: 6086625 - DNA, 15 bp, Homo sapiens
ccctgcctgcccact

SEQ ID NO: 6086626 - DNA, 14 bp, Homo sapiens
ccctgcctgccgct

SEQ ID NO: 6086627 - DNA, 15 bp, Homo sapiens
ccctgcctgccgtct

SEQ ID NO: 6086628 - DNA, 12 bp, Homo sapiens
ccctgcctgcct

SEQ ID NO: 6086629 - DNA, 15 bp, Homo sapiens
ccctgcctgcctctt

SEQ ID NO: 6086630 - DNA, 12 bp, Homo sapiens
ccctgcctgctg

SEQ ID NO: 6086631 - DNA, 14 bp, Homo sapiens
ccctgcctgctgca

SEQ ID NO: 6086632 - DNA, 15 bp, Homo sapiens
ccctgcctgctgtgg

SEQ ID NO: 6086633 - DNA, 18 bp, Homo sapiens
ccctgcctgctgtggagc

SEQ ID NO: 6086634 - DNA, 11 bp, Homo sapiens
ccctgcctgga

SEQ ID NO: 6086635 - DNA, 12 bp, Homo sapiens
ccctgcctggag

SEQ ID NO: 6086636 - DNA, 14 bp, Homo sapiens
ccctgcctggagga

SEQ ID NO: 6086637 - DNA, 16 bp, Homo sapiens
ccctgcctggaggacc

SEQ ID NO: 6086638 - DNA, 17 bp, Homo sapiens
ccctgcctggaggacct

SEQ ID NO: 6086639 - DNA, 21 bp, Homo sapiens
ccctgcctggaggacctgagc

SEQ ID NO: 6086640 - DNA, 22 bp, Homo sapiens
ccctgcctggaggacctgagcc

SEQ ID NO: 6086641 - DNA, 21 bp, Homo sapiens
ccctgcctggatccagctctg

SEQ ID NO: 6086642 - DNA, 12 bp, Homo sapiens
ccctgcctggcc

SEQ ID NO: 6086643 - DNA, 13 bp, Homo sapiens
ccctgcctggccc

SEQ ID NO: 6086644 - DNA, 20 bp, Homo sapiens
ccctgcctggccctcctctg

SEQ ID NO: 6086645 - DNA, 20 bp, Homo sapiens
ccctgcctgggccttggctg

SEQ ID NO: 6086646 - DNA, 22 bp, Homo sapiens
ccctgcctgggccttggctggg

SEQ ID NO: 6086647 - DNA, 23 bp, Homo sapiens
ccctgcctggggcgggcccctca

SEQ ID NO: 6086648 - DNA, 12 bp, Homo sapiens
ccctgcctgggt

SEQ ID NO: 6086649 - DNA, 21 bp, Homo sapiens
ccctgcctgggttttctaact

SEQ ID NO: 6086650 - DNA, 21 bp, Homo sapiens
ccctgcctggttctaggctgc

SEQ ID NO: 6086651 - DNA, 17 bp, Homo sapiens
ccctgcctgtgcccgca

SEQ ID NO: 6086652 - DNA, 14 bp, Homo sapiens
ccctgcctgtggag

SEQ ID NO: 6086653 - DNA, 13 bp, Homo sapiens
ccctgcctgtggc

SEQ ID NO: 6086654 - DNA, 23 bp, Homo sapiens
ccctgcctgttggcaggcccact

SEQ ID NO: 6086655 - DNA, 18 bp, Homo sapiens
ccctgccttaacctggga

SEQ ID NO: 6086656 - DNA, 22 bp, Homo sapiens
ccctgccttatcttgcacccca

SEQ ID NO: 6086657 - DNA, 14 bp, Homo sapiens
ccctgccttcagct

SEQ ID NO: 6086658 - DNA, 12 bp, Homo sapiens
ccctgccttcct

SEQ ID NO: 6086659 - DNA, 14 bp, Homo sapiens
ccctgccttcctct

SEQ ID NO: 6086660 - DNA, 15 bp, Homo sapiens
ccctgccttcctctg

SEQ ID NO: 6086661 - DNA, 12 bp, Homo sapiens
ccctgccttgcc

SEQ ID NO: 6086662 - DNA, 20 bp, Homo sapiens
ccctgccttgccgctcccct

SEQ ID NO: 6086663 - DNA, 20 bp, Homo sapiens
ccctgccttgctgacaataa

SEQ ID NO: 6086664 - DNA, 21 bp, Homo sapiens
ccctgccttgctgacaataaa

SEQ ID NO: 6086665 - DNA, 17 bp, Homo sapiens
ccctgccttgctgcctt

SEQ ID NO: 6086666 - DNA, 24 bp, Homo sapiens
ccctgccttgggccttgctgctgc

SEQ ID NO: 6086667 - DNA, 20 bp, Homo sapiens
ccctgcgaaggggccctggt

SEQ ID NO: 6086668 - DNA, 13 bp, Homo sapiens
ccctgcgcaggcc

SEQ ID NO: 6086669 - DNA, 14 bp, Homo sapiens
ccctgcgcccctgc

SEQ ID NO: 6086670 - DNA, 15 bp, Homo sapiens
ccctgcgcccctgcc

SEQ ID NO: 6086671 - DNA, 16 bp, Homo sapiens
ccctgcgcccctgccc

SEQ ID NO: 6086672 - DNA, 17 bp, Homo sapiens
ccctgcgcccctgccca

SEQ ID NO: 6086673 - DNA, 18 bp, Homo sapiens
ccctgcgcccctgcccag

SEQ ID NO: 6086674 - DNA, 20 bp, Homo sapiens
ccctgcgcccctgcccagca

SEQ ID NO: 6086675 - DNA, 23 bp, Homo sapiens
ccctgcgcccctgcccagcacct

SEQ ID NO: 6086676 - DNA, 15 bp, Homo sapiens
ccctgcgccctgtgc

SEQ ID NO: 6086677 - DNA, 16 bp, Homo sapiens
ccctgcgccctgtgca

SEQ ID NO: 6086678 - DNA, 14 bp, Homo sapiens
ccctgcgcctccag

SEQ ID NO: 6086679 - DNA, 22 bp, Homo sapiens
ccctgcgcctgtgatgctgggc

SEQ ID NO: 6086680 - DNA, 22 bp, Homo sapiens
ccctgcggccccgtctgtggct

SEQ ID NO: 6086681 - DNA, 22 bp, Homo sapiens
ccctgcggccgtcaccccgcca

SEQ ID NO: 6086682 - DNA, 19 bp, Homo sapiens
ccctgcggctctggaaagc

SEQ ID NO: 6086683 - DNA, 14 bp, Homo sapiens
ccctgcgggccagg

SEQ ID NO: 6086684 - DNA, 15 bp, Homo sapiens
ccctgcgggccaggg

SEQ ID NO: 6086685 - DNA, 24 bp, Homo sapiens
ccctgcgggcgcgggcagccaccc

SEQ ID NO: 6086686 - DNA, 22 bp, Homo sapiens
ccctgcgggtgaacaaagcagc

SEQ ID NO: 6086687 - DNA, 18 bp, Homo sapiens
ccctgcgtggcctgagtc

SEQ ID NO: 6086688 - DNA, 17 bp, Homo sapiens
ccctgcgttggagccac

SEQ ID NO: 6086689 - DNA, 20 bp, Homo sapiens
ccctgcgttggagccactcc

SEQ ID NO: 6086690 - DNA, 13 bp, Homo sapiens
ccctgctaagtgt

SEQ ID NO: 6086691 - DNA, 13 bp, Homo sapiens
ccctgctacacct

SEQ ID NO: 6086692 - DNA, 16 bp, Homo sapiens
ccctgctacacctatt

SEQ ID NO: 6086693 - DNA, 11 bp, Homo sapiens
ccctgctacct

SEQ ID NO: 6086694 - DNA, 18 bp, Homo sapiens
ccctgctactcctgtgct

SEQ ID NO: 6086695 - DNA, 22 bp, Homo sapiens
ccctgctagatgagaattcagc

SEQ ID NO: 6086696 - DNA, 14 bp, Homo sapiens
ccctgctagcacag

SEQ ID NO: 6086697 - DNA, 19 bp, Homo sapiens
ccctgctagcacagaggcc

SEQ ID NO: 6086698 - DNA, 18 bp, Homo sapiens
ccctgctatgaaaggaat

SEQ ID NO: 6086699 - DNA, 18 bp, Homo sapiens
ccctgctatttcaggccc

SEQ ID NO: 6086700 - DNA, 15 bp, Homo sapiens
ccctgctcactgggc

SEQ ID NO: 6086701 - DNA, 14 bp, Homo sapiens
ccctgctcagccca

SEQ ID NO: 6086702 - DNA, 12 bp, Homo sapiens
ccctgctcagct

SEQ ID NO: 6086703 - DNA, 15 bp, Homo sapiens
ccctgctcaggcctc

SEQ ID NO: 6086704 - DNA, 16 bp, Homo sapiens
ccctgctcaggcctca

SEQ ID NO: 6086705 - DNA, 16 bp, Homo sapiens
ccctgctcagtaaagc

SEQ ID NO: 6086706 - DNA, 12 bp, Homo sapiens
ccctgctcagtg

SEQ ID NO: 6086707 - DNA, 15 bp, Homo sapiens
ccctgctccaccagc

SEQ ID NO: 6086708 - DNA, 19 bp, Homo sapiens
ccctgctccaccagcagca

SEQ ID NO: 6086709 - DNA, 21 bp, Homo sapiens
ccctgctccacgtctgcgccg

SEQ ID NO: 6086710 - DNA, 12 bp, Homo sapiens
ccctgctcccag

SEQ ID NO: 6086711 - DNA, 14 bp, Homo sapiens
ccctgctcccagct

SEQ ID NO: 6086712 - DNA, 13 bp, Homo sapiens
ccctgctcccagg

SEQ ID NO: 6086713 - DNA, 17 bp, Homo sapiens
ccctgctcccattcctc

SEQ ID NO: 6086714 - DNA, 21 bp, Homo sapiens
ccctgctcccggctctgaggc

SEQ ID NO: 6086715 - DNA, 12 bp, Homo sapiens
ccctgctccctc

SEQ ID NO: 6086716 - DNA, 13 bp, Homo sapiens
ccctgctccctcc

SEQ ID NO: 6086717 - DNA, 23 bp, Homo sapiens
ccctgctccctccgggtcttcct

SEQ ID NO: 6086718 - DNA, 17 bp, Homo sapiens
ccctgctccctgcctcc

SEQ ID NO: 6086719 - DNA, 15 bp, Homo sapiens
ccctgctcctcatgg

SEQ ID NO: 6086720 - DNA, 14 bp, Homo sapiens
ccctgctcctccca

SEQ ID NO: 6086721 - DNA, 16 bp, Homo sapiens
ccctgctcctccctgg

SEQ ID NO: 6086722 - DNA, 17 bp, Homo sapiens
ccctgctcctccctggc

SEQ ID NO: 6086723 - DNA, 20 bp, Homo sapiens
ccctgctcctccctggctgc

SEQ ID NO: 6086724 - DNA, 22 bp, Homo sapiens
ccctgctcctccctggctgccc

SEQ ID NO: 6086725 - DNA, 18 bp, Homo sapiens
ccctgctcctcctgccct

SEQ ID NO: 6086726 - DNA, 18 bp, Homo sapiens
ccctgctcctgcagcatg

SEQ ID NO: 6086727 - DNA, 19 bp, Homo sapiens
ccctgctctacccatgagc

SEQ ID NO: 6086728 - DNA, 15 bp, Homo sapiens
ccctgctctctgagt

SEQ ID NO: 6086729 - DNA, 22 bp, Homo sapiens
ccctgctctggtcccctctctt

SEQ ID NO: 6086730 - DNA, 20 bp, Homo sapiens
ccctgctcttctctccccag

SEQ ID NO: 6086731 - DNA, 18 bp, Homo sapiens
ccctgctctttctctgag

SEQ ID NO: 6086732 - DNA, 19 bp, Homo sapiens
ccctgctgaagctgctgca

SEQ ID NO: 6086733 - DNA, 21 bp, Homo sapiens
ccctgctgaagctgctgcagc

SEQ ID NO: 6086734 - DNA, 19 bp, Homo sapiens
ccctgctgaccttggagga

SEQ ID NO: 6086735 - DNA, 12 bp, Homo sapiens
ccctgctgactc

SEQ ID NO: 6086736 - DNA, 16 bp, Homo sapiens
ccctgctgatcaatct

SEQ ID NO: 6086737 - DNA, 16 bp, Homo sapiens
ccctgctgcactagga

SEQ ID NO: 6086738 - DNA, 15 bp, Homo sapiens
ccctgctgcaggggc

SEQ ID NO: 6086739 - DNA, 16 bp, Homo sapiens
ccctgctgccacagca

SEQ ID NO: 6086740 - DNA, 20 bp, Homo sapiens
ccctgctgcccctccctgcc

SEQ ID NO: 6086741 - DNA, 19 bp, Homo sapiens
ccctgctgccgccactggc

SEQ ID NO: 6086742 - DNA, 20 bp, Homo sapiens
ccctgctgccgcctcccagc

SEQ ID NO: 6086743 - DNA, 10 bp, Homo sapiens
ccctgctgcg

SEQ ID NO: 6086744 - DNA, 12 bp, Homo sapiens
ccctgctgcgct

SEQ ID NO: 6086745 - DNA, 17 bp, Homo sapiens
ccctgctgcgctgcttg

SEQ ID NO: 6086746 - DNA, 22 bp, Homo sapiens
ccctgctgcggccagcctgact

SEQ ID NO: 6086747 - DNA, 12 bp, Homo sapiens
ccctgctgctca

SEQ ID NO: 6086748 - DNA, 15 bp, Homo sapiens
ccctgctgctcatcc

SEQ ID NO: 6086749 - DNA, 12 bp, Homo sapiens
ccctgctgctcc

SEQ ID NO: 6086750 - DNA, 13 bp, Homo sapiens
ccctgctgctcct

SEQ ID NO: 6086751 - DNA, 19 bp, Homo sapiens
ccctgctgctcctcggcca

SEQ ID NO: 6086752 - DNA, 17 bp, Homo sapiens
ccctgctgctgacccag

SEQ ID NO: 6086753 - DNA, 18 bp, Homo sapiens
ccctgctgctgcctgcct

SEQ ID NO: 6086754 - DNA, 13 bp, Homo sapiens
ccctgctgctggt

SEQ ID NO: 6086755 - DNA, 19 bp, Homo sapiens
ccctgctgctggtgcacag

SEQ ID NO: 6086756 - DNA, 17 bp, Homo sapiens
ccctgctgctgtcacct

SEQ ID NO: 6086757 - DNA, 23 bp, Homo sapiens
ccctgctgcttcctaacttattg

SEQ ID NO: 6086758 - DNA, 11 bp, Homo sapiens
ccctgctggcc

SEQ ID NO: 6086759 - DNA, 12 bp, Homo sapiens
ccctgctggccg

SEQ ID NO: 6086760 - DNA, 13 bp, Homo sapiens
ccctgctggccgc

SEQ ID NO: 6086761 - DNA, 15 bp, Homo sapiens
ccctgctggccgcct

SEQ ID NO: 6086762 - DNA, 12 bp, Homo sapiens
ccctgctggcct

SEQ ID NO: 6086763 - DNA, 20 bp, Homo sapiens
ccctgctggctcttctgccc

SEQ ID NO: 6086764 - DNA, 21 bp, Homo sapiens
ccctgctggctcttctgccca

SEQ ID NO: 6086765 - DNA, 15 bp, Homo sapiens
ccctgctggggaaga

SEQ ID NO: 6086766 - DNA, 12 bp, Homo sapiens
ccctgctggggc

SEQ ID NO: 6086767 - DNA, 24 bp, Homo sapiens
ccctgctggggtctcaggtccagc

SEQ ID NO: 6086768 - DNA, 22 bp, Homo sapiens
ccctgctgggtgtggcgcagca

SEQ ID NO: 6086769 - DNA, 16 bp, Homo sapiens
ccctgctggtgcccac

SEQ ID NO: 6086770 - DNA, 23 bp, Homo sapiens
ccctgctggtgcccacccttcgc

SEQ ID NO: 6086771 - DNA, 14 bp, Homo sapiens
ccctgctgtctctc

SEQ ID NO: 6086772 - DNA, 18 bp, Homo sapiens
ccctgctgtctctctggg

SEQ ID NO: 6086773 - DNA, 19 bp, Homo sapiens
ccctgctgtcttccccacc

SEQ ID NO: 6086774 - DNA, 17 bp, Homo sapiens
ccctgctgtgccatgct

SEQ ID NO: 6086775 - DNA, 20 bp, Homo sapiens
ccctgctgtgccatgctggg

SEQ ID NO: 6086776 - DNA, 14 bp, Homo sapiens
ccctgctgtgctgc

SEQ ID NO: 6086777 - DNA, 14 bp, Homo sapiens
ccctgctgtttatc

SEQ ID NO: 6086778 - DNA, 22 bp, Homo sapiens
ccctgcttcagatgtggagcca

SEQ ID NO: 6086779 - DNA, 23 bp, Homo sapiens
ccctgcttcagatgtggagccag

SEQ ID NO: 6086780 - DNA, 22 bp, Homo sapiens
ccctgcttcatatctctccctt

SEQ ID NO: 6086781 - DNA, 15 bp, Homo sapiens
ccctgcttccacctc

SEQ ID NO: 6086782 - DNA, 21 bp, Homo sapiens
ccctgcttccacctcacccca

SEQ ID NO: 6086783 - DNA, 17 bp, Homo sapiens
ccctgcttcccaaactc

SEQ ID NO: 6086784 - DNA, 21 bp, Homo sapiens
ccctgcttcccaaactcccag

SEQ ID NO: 6086785 - DNA, 22 bp, Homo sapiens
ccctgcttctcccgccattggc

SEQ ID NO: 6086786 - DNA, 18 bp, Homo sapiens
ccctgcttctgctgccct

SEQ ID NO: 6086787 - DNA, 17 bp, Homo sapiens
ccctgcttctgctgcct

SEQ ID NO: 6086788 - DNA, 15 bp, Homo sapiens
ccctgcttctggctc

SEQ ID NO: 6086789 - DNA, 16 bp, Homo sapiens
ccctgcttctggctcc

SEQ ID NO: 6086790 - DNA, 14 bp, Homo sapiens
ccctgcttgcagga

SEQ ID NO: 6086791 - DNA, 18 bp, Homo sapiens
cctgccctgtcaggaggc

SEQ ID NO: 6086792 - DNA, 12 bp, Homo sapiens
cctgccctgtcc

SEQ ID NO: 6086793 - DNA, 13 bp, Homo sapiens
cctgccctgtcca

SEQ ID NO: 6086794 - DNA, 11 bp, Homo sapiens
cctgccctgtg

SEQ ID NO: 6086795 - DNA, 21 bp, Homo sapiens
cctgccctgtgatatgtctgc

SEQ ID NO: 6086796 - DNA, 14 bp, Homo sapiens
cctgccctgtgccg

SEQ ID NO: 6086797 - DNA, 16 bp, Homo sapiens
cctgccctgtggccca

SEQ ID NO: 6086798 - DNA, 21 bp, Homo sapiens
cctgccctgtggcccacgggc

SEQ ID NO: 6086799 - DNA, 14 bp, Homo sapiens
cctgcccttccctc

SEQ ID NO: 6086800 - DNA, 17 bp, Homo sapiens
cctgcccttccctctgg

SEQ ID NO: 6086801 - DNA, 19 bp, Homo sapiens
cctgcccttccctctgggc

SEQ ID NO: 6086802 - DNA, 15 bp, Homo sapiens
cctgcccttcctcag

SEQ ID NO: 6086803 - DNA, 16 bp, Homo sapiens
cctgcccttcctcctg

SEQ ID NO: 6086804 - DNA, 15 bp, Homo sapiens
cctgcccttctgacc

SEQ ID NO: 6086805 - DNA, 19 bp, Homo sapiens
cctgcccttgctccagcct

SEQ ID NO: 6086806 - DNA, 17 bp, Homo sapiens
cctgcccttggcaccac

SEQ ID NO: 6086807 - DNA, 15 bp, Homo sapiens
cctgcccttgtccca

SEQ ID NO: 6086808 - DNA, 19 bp, Homo sapiens
cctgcccttgtcccactca

SEQ ID NO: 6086809 - DNA, 16 bp, Homo sapiens
cctgcccttgtctgag

SEQ ID NO: 6086810 - DNA, 20 bp, Homo sapiens
cctgcccttttttctgcctc

SEQ ID NO: 6086811 - DNA, 14 bp, Homo sapiens
cctgccgaacacac

SEQ ID NO: 6086812 - DNA, 15 bp, Homo sapiens
cctgccgaacacaca

SEQ ID NO: 6086813 - DNA, 16 bp, Homo sapiens
cctgccgacacgctcc

SEQ ID NO: 6086814 - DNA, 19 bp, Homo sapiens
cctgccgacggagccactg

SEQ ID NO: 6086815 - DNA, 21 bp, Homo sapiens
cctgccgacggagccactggg

SEQ ID NO: 6086816 - DNA, 22 bp, Homo sapiens
cctgccgagagtccatcagcct

SEQ ID NO: 6086817 - DNA, 22 bp, Homo sapiens
cctgccgagcaaccgtggccct

SEQ ID NO: 6086818 - DNA, 20 bp, Homo sapiens
cctgccgagtgctctgatgc

SEQ ID NO: 6086819 - DNA, 15 bp, Homo sapiens
cctgccgcatgctcc

SEQ ID NO: 6086820 - DNA, 18 bp, Homo sapiens
cctgccgcccccgcctgg

SEQ ID NO: 6086821 - DNA, 19 bp, Homo sapiens
cctgccgcccccgcctggg

SEQ ID NO: 6086822 - DNA, 16 bp, Homo sapiens
cctgccgcctcccggg

SEQ ID NO: 6086823 - DNA, 15 bp, Homo sapiens
cctgccgctgcacct

SEQ ID NO: 6086824 - DNA, 17 bp, Homo sapiens
cctgccggaatgaactg

SEQ ID NO: 6086825 - DNA, 15 bp, Homo sapiens
cctgccggacacagc

SEQ ID NO: 6086826 - DNA, 16 bp, Homo sapiens
cctgccggccccccaa

SEQ ID NO: 6086827 - DNA, 15 bp, Homo sapiens
cctgccggccttggc

SEQ ID NO: 6086828 - DNA, 16 bp, Homo sapiens
cctgccggctctgggc

SEQ ID NO: 6086829 - DNA, 19 bp, Homo sapiens
cctgccggctctgggctgg

SEQ ID NO: 6086830 - DNA, 23 bp, Homo sapiens
cctgccggctctgggctggctgc

SEQ ID NO: 6086831 - DNA, 23 bp, Homo sapiens
cctgccgggcaggtcccaggttg

SEQ ID NO: 6086832 - DNA, 16 bp, Homo sapiens
cctgccgggctgaggg

SEQ ID NO: 6086833 - DNA, 21 bp, Homo sapiens
cctgccgggctgagggcctgc

SEQ ID NO: 6086834 - DNA, 22 bp, Homo sapiens
cctgccggtaaacacgcctgca

SEQ ID NO: 6086835 - DNA, 23 bp, Homo sapiens
cctgccggtgcacaggcctctgc

SEQ ID NO: 6086836 - DNA, 18 bp, Homo sapiens
cctgccggtgggaccctg

SEQ ID NO: 6086837 - DNA, 16 bp, Homo sapiens
cctgccgtcaccacca

SEQ ID NO: 6086838 - DNA, 18 bp, Homo sapiens
cctgccgtccctcctgtt

SEQ ID NO: 6086839 - DNA, 19 bp, Homo sapiens
cctgccgtggtggcagctg

SEQ ID NO: 6086840 - DNA, 17 bp, Homo sapiens
cctgcctaaattaaatt

SEQ ID NO: 6086841 - DNA, 18 bp, Homo sapiens
cctgcctaaccaggccca

SEQ ID NO: 6086842 - DNA, 22 bp, Homo sapiens
cctgcctacacacacagcctat

SEQ ID NO: 6086843 - DNA, 21 bp, Homo sapiens
cctgcctacattccctggcct

SEQ ID NO: 6086844 - DNA, 17 bp, Homo sapiens
cctgcctacgccaggag

SEQ ID NO: 6086845 - DNA, 18 bp, Homo sapiens
cctgcctactgcccctgc

SEQ ID NO: 6086846 - DNA, 15 bp, Homo sapiens
cctgcctagcactca

SEQ ID NO: 6086847 - DNA, 17 bp, Homo sapiens
cctgcctagcatggggt

SEQ ID NO: 6086848 - DNA, 16 bp, Homo sapiens
cctgcctagctcttgg

SEQ ID NO: 6086849 - DNA, 17 bp, Homo sapiens
cctgcctagctcttggg

SEQ ID NO: 6086850 - DNA, 18 bp, Homo sapiens
cctgcctagctcttgggc

SEQ ID NO: 6086851 - DNA, 15 bp, Homo sapiens
cctgcctaggagctg

SEQ ID NO: 6086852 - DNA, 18 bp, Homo sapiens
cctgcctaggagctgggg

SEQ ID NO: 6086853 - DNA, 18 bp, Homo sapiens
cctgcctatccatcctgc

SEQ ID NO: 6086854 - DNA, 16 bp, Homo sapiens
cctgcctatcctctgt

SEQ ID NO: 6086855 - DNA, 21 bp, Homo sapiens
cctgcctcacagctggccgtc

SEQ ID NO: 6086856 - DNA, 17 bp, Homo sapiens
cctgcctcacatctccc

SEQ ID NO: 6086857 - DNA, 13 bp, Homo sapiens
cctgcctcaccca

SEQ ID NO: 6086858 - DNA, 17 bp, Homo sapiens
cctgcctcacccacacc

SEQ ID NO: 6086859 - DNA, 16 bp, Homo sapiens
cctgcctcactcctcc

SEQ ID NO: 6086860 - DNA, 15 bp, Homo sapiens
cctgcctcagcaatt

SEQ ID NO: 6086861 - DNA, 16 bp, Homo sapiens
cctgcctcagccaggc

SEQ ID NO: 6086862 - DNA, 14 bp, Homo sapiens
cctgcctcagcctc

SEQ ID NO: 6086863 - DNA, 20 bp, Homo sapiens
cctgcctcagcctccccagt

SEQ ID NO: 6086864 - DNA, 17 bp, Homo sapiens
cctgcctcagcctcccg

SEQ ID NO: 6086865 - DNA, 16 bp, Homo sapiens
cctgcctcagcctcct

SEQ ID NO: 6086866 - DNA, 15 bp, Homo sapiens
cctgcctcagccttc

SEQ ID NO: 6086867 - DNA, 13 bp, Homo sapiens
cctgcctcagctg

SEQ ID NO: 6086868 - DNA, 14 bp, Homo sapiens
cctgcctcagctga

SEQ ID NO: 6086869 - DNA, 21 bp, Homo sapiens
cctgcctcatcttccttctca

SEQ ID NO: 6086870 - DNA, 16 bp, Homo sapiens
cctgcctccaccagca

SEQ ID NO: 6086871 - DNA, 13 bp, Homo sapiens
cctgcctccaccc

SEQ ID NO: 6086872 - DNA, 18 bp, Homo sapiens
cctgcctccaccctctga

SEQ ID NO: 6086873 - DNA, 21 bp, Homo sapiens
cctgcctccagggctggactg

SEQ ID NO: 6086874 - DNA, 14 bp, Homo sapiens
cctgcctccatcct

SEQ ID NO: 6086875 - DNA, 16 bp, Homo sapiens
cctgcctcccaagcag

SEQ ID NO: 6086876 - DNA, 17 bp, Homo sapiens
cctgcctcccaagcagc

SEQ ID NO: 6086877 - DNA, 18 bp, Homo sapiens
cctgcctcccaagcagct

SEQ ID NO: 6086878 - DNA, 23 bp, Homo sapiens
cctgcctcccaagcagctgaagg

SEQ ID NO: 6086879 - DNA, 16 bp, Homo sapiens
cctgcctcccagccct

SEQ ID NO: 6086880 - DNA, 21 bp, Homo sapiens
cctgcctcccagccctgccag

SEQ ID NO: 6086881 - DNA, 16 bp, Homo sapiens
cctgcctcccatgcct

SEQ ID NO: 6086882 - DNA, 17 bp, Homo sapiens
cctgcctcccatgcctg

SEQ ID NO: 6086883 - DNA, 18 bp, Homo sapiens
cctgcctcccattctgca

SEQ ID NO: 6086884 - DNA, 16 bp, Homo sapiens
cctgcctcccttcatg

SEQ ID NO: 6086885 - DNA, 15 bp, Homo sapiens
cctgcctccctttct

SEQ ID NO: 6086886 - DNA, 18 bp, Homo sapiens
cctgcctccctttctggg

SEQ ID NO: 6086887 - DNA, 19 bp, Homo sapiens
cctgcctccctttctggga

SEQ ID NO: 6086888 - DNA, 19 bp, Homo sapiens
cctgcctccgaggcctacc

SEQ ID NO: 6086889 - DNA, 17 bp, Homo sapiens
cctgcctccggccctgc

SEQ ID NO: 6086890 - DNA, 17 bp, Homo sapiens
cctgcctcctactccag

SEQ ID NO: 6086891 - DNA, 21 bp, Homo sapiens
cctgcctcctccctcccagct

SEQ ID NO: 6086892 - DNA, 11 bp, Homo sapiens
cctgcctcctg

SEQ ID NO: 6086893 - DNA, 13 bp, Homo sapiens
cctgcctcctgcc

SEQ ID NO: 6086894 - DNA, 16 bp, Homo sapiens
cctgcctcctgcctcc

SEQ ID NO: 6086895 - DNA, 14 bp, Homo sapiens
cctgcctcctggct

SEQ ID NO: 6086896 - DNA, 20 bp, Homo sapiens
cctgcctcctggctcaggcc

SEQ ID NO: 6086897 - DNA, 14 bp, Homo sapiens
cctgcctcctggga

SEQ ID NO: 6086898 - DNA, 14 bp, Homo sapiens
cctgcctccttgaa

SEQ ID NO: 6086899 - DNA, 22 bp, Homo sapiens
cctgcctcctttgtgaggaagc

SEQ ID NO: 6086900 - DNA, 19 bp, Homo sapiens
cctgcctcgaactggctgc

SEQ ID NO: 6086901 - DNA, 21 bp, Homo sapiens
cctgcctcgaactggctgcaa

SEQ ID NO: 6086902 - DNA, 16 bp, Homo sapiens
cctgcctcgagggccg

SEQ ID NO: 6086903 - DNA, 20 bp, Homo sapiens
cctgcctcgagggccgcctg

SEQ ID NO: 6086904 - DNA, 13 bp, Homo sapiens
cctgcctcgcctt

SEQ ID NO: 6086905 - DNA, 15 bp, Homo sapiens
cctgcctcgccttgt

SEQ ID NO: 6086906 - DNA, 15 bp, Homo sapiens
cctgcctctacccaa

SEQ ID NO: 6086907 - DNA, 12 bp, Homo sapiens
cctgcctctact

SEQ ID NO: 6086908 - DNA, 21 bp, Homo sapiens
cctgcctctactgggaaggct

SEQ ID NO: 6086909 - DNA, 21 bp, Homo sapiens
cctgcctctatccctggccac

SEQ ID NO: 6086910 - DNA, 22 bp, Homo sapiens
cctgcctctatccctggccacc

SEQ ID NO: 6086911 - DNA, 17 bp, Homo sapiens
cctgcctctcacacaca

SEQ ID NO: 6086912 - DNA, 13 bp, Homo sapiens
cctgcctctcaga

SEQ ID NO: 6086913 - DNA, 14 bp, Homo sapiens
cctgcctctcagag

SEQ ID NO: 6086914 - DNA, 23 bp, Homo sapiens
cctgcctctcatcaactgaatga

SEQ ID NO: 6086915 - DNA, 21 bp, Homo sapiens
cctgcctctcccaggcagggg

SEQ ID NO: 6086916 - DNA, 21 bp, Homo sapiens
cctgcctctccgcccctgagc

SEQ ID NO: 6086917 - DNA, 13 bp, Homo sapiens
cctgcctctctgc

SEQ ID NO: 6086918 - DNA, 15 bp, Homo sapiens
cctgcctctctgcag

SEQ ID NO: 6086919 - DNA, 19 bp, Homo sapiens
cctgcctctgaactgctgc

SEQ ID NO: 6086920 - DNA, 12 bp, Homo sapiens
cctgcctctgcc

SEQ ID NO: 6086921 - DNA, 15 bp, Homo sapiens
cctgcctctgccaca

SEQ ID NO: 6086922 - DNA, 16 bp, Homo sapiens
cctgcctctgccacag

SEQ ID NO: 6086923 - DNA, 14 bp, Homo sapiens
cctgcctcttaaat

SEQ ID NO: 6086924 - DNA, 21 bp, Homo sapiens
cctgcctcttaaataaacctt

SEQ ID NO: 6086925 - DNA, 15 bp, Homo sapiens
cctgcctcttgtttc

SEQ ID NO: 6086926 - DNA, 21 bp, Homo sapiens
cctgcctcttgtttctgtgcc

SEQ ID NO: 6086927 - DNA, 13 bp, Homo sapiens
cctgcctgaagag

SEQ ID NO: 6086928 - DNA, 16 bp, Homo sapiens
cctgcctgaagagagg

SEQ ID NO: 6086929 - DNA, 17 bp, Homo sapiens
cctgcctgacccatccc

SEQ ID NO: 6086930 - DNA, 14 bp, Homo sapiens
cctgcctgagccca

SEQ ID NO: 6086931 - DNA, 17 bp, Homo sapiens
cctgcctgagcccagga

SEQ ID NO: 6086932 - DNA, 19 bp, Homo sapiens
cctgcctgagcccaggagc

SEQ ID NO: 6086933 - DNA, 12 bp, Homo sapiens
cctgcctgagga

SEQ ID NO: 6086934 - DNA, 13 bp, Homo sapiens
cctgcctgaggag

SEQ ID NO: 6086935 - DNA, 16 bp, Homo sapiens
cctgcctgagggcagt

SEQ ID NO: 6086936 - DNA, 20 bp, Homo sapiens
cctgcctgagggcccctctg

SEQ ID NO: 6086937 - DNA, 23 bp, Homo sapiens
cctgcctgataccctgcttggtc

SEQ ID NO: 6086938 - DNA, 18 bp, Homo sapiens
cctgcctgatccctgaac

SEQ ID NO: 6086939 - DNA, 15 bp, Homo sapiens
cctgcctgcacctcc

SEQ ID NO: 6086940 - DNA, 12 bp, Homo sapiens
cctgcctgcagc

SEQ ID NO: 6086941 - DNA, 15 bp, Homo sapiens
cctgcctgcagccag

SEQ ID NO: 6086942 - DNA, 20 bp, Homo sapiens
cctgcctgcatggcatcaga

SEQ ID NO: 6086943 - DNA, 18 bp, Homo sapiens
cctgcctgccctgtcagg

SEQ ID NO: 6086944 - DNA, 16 bp, Homo sapiens
cctgcctgccgctgca

SEQ ID NO: 6086945 - DNA, 18 bp, Homo sapiens
cctgcctgccgctgcacc

SEQ ID NO: 6086946 - DNA, 14 bp, Homo sapiens
cctgcctgcctcca

SEQ ID NO: 6086947 - DNA, 13 bp, Homo sapiens
cctgcctgcctct

SEQ ID NO: 6086948 - DNA, 15 bp, Homo sapiens
cctgcctgcctgtgg

SEQ ID NO: 6086949 - DNA, 15 bp, Homo sapiens
cctgcctgccttctc

SEQ ID NO: 6086950 - DNA, 22 bp, Homo sapiens
cctgcctgcgcagctccttccc

SEQ ID NO: 6086951 - DNA, 18 bp, Homo sapiens
cctgcctgcgtcttccgc

SEQ ID NO: 6086952 - DNA, 12 bp, Homo sapiens
cctgcctgctgt

SEQ ID NO: 6086953 - DNA, 13 bp, Homo sapiens
cctgcctgctgtg

SEQ ID NO: 6086954 - DNA, 12 bp, Homo sapiens
cctgcctggagg

SEQ ID NO: 6086955 - DNA, 14 bp, Homo sapiens
cctgcctggaggac

SEQ ID NO: 6086956 - DNA, 19 bp, Homo sapiens
cctgcctggaggacctgag

SEQ ID NO: 6086957 - DNA, 20 bp, Homo sapiens
cctgcctggaggacctgagc

SEQ ID NO: 6086958 - DNA, 21 bp, Homo sapiens
cctgcctggaggacctgagcc

SEQ ID NO: 6086959 - DNA, 19 bp, Homo sapiens
cctgcctggaggagaagga

SEQ ID NO: 6086960 - DNA, 20 bp, Homo sapiens
cctgcctggaggctcctcta

SEQ ID NO: 6086961 - DNA, 19 bp, Homo sapiens
cctgcctggatttcttcct

SEQ ID NO: 6086962 - DNA, 20 bp, Homo sapiens
cctgcctggatttcttccta

SEQ ID NO: 6086963 - DNA, 14 bp, Homo sapiens
cctgcctggccagg

SEQ ID NO: 6086964 - DNA, 18 bp, Homo sapiens
cctgcctggccaggcaga

SEQ ID NO: 6086965 - DNA, 12 bp, Homo sapiens
cctgcctggccg

SEQ ID NO: 6086966 - DNA, 16 bp, Homo sapiens
cctgcctggccggcca

SEQ ID NO: 6086967 - DNA, 23 bp, Homo sapiens
cctgcctggccggccagccagcc

SEQ ID NO: 6086968 - DNA, 15 bp, Homo sapiens
cctgcctggcggcag

SEQ ID NO: 6086969 - DNA, 10 bp, Homo sapiens
cctgcctggg

SEQ ID NO: 6086970 - DNA, 15 bp, Homo sapiens
cctgcctgggcctcc

SEQ ID NO: 6086971 - DNA, 18 bp, Homo sapiens
cctgcctgggcctcccaa

SEQ ID NO: 6086972 - DNA, 23 bp, Homo sapiens
ccctgcttgctggaaaactgcca

SEQ ID NO: 6086973 - DNA, 14 bp, Homo sapiens
ccctgcttggccca

SEQ ID NO: 6086974 - DNA, 16 bp, Homo sapiens
ccctgcttggcccagg

SEQ ID NO: 6086975 - DNA, 17 bp, Homo sapiens
ccctgcttggggcctgg

SEQ ID NO: 6086976 - DNA, 19 bp, Homo sapiens
ccctgcttggggcctggcg

SEQ ID NO: 6086977 - DNA, 22 bp, Homo sapiens
ccctgctttgcctcgaaagtgt

SEQ ID NO: 6086978 - DNA, 19 bp, Homo sapiens
ccctgctttggcggcccgg

SEQ ID NO: 6086979 - DNA, 18 bp, Homo sapiens
ccctgctttgggctgccc

SEQ ID NO: 6086980 - DNA, 19 bp, Homo sapiens
ccctgctttgggctgccct

SEQ ID NO: 6086981 - DNA, 20 bp, Homo sapiens
ccctgctttgggctgccctg

SEQ ID NO: 6086982 - DNA, 18 bp, Homo sapiens
ccctgctttgggcttggg

SEQ ID NO: 6086983 - DNA, 20 bp, Homo sapiens
ccctgcttttctcccagaag

SEQ ID NO: 6086984 - DNA, 13 bp, Homo sapiens
ccctgcttttgca

SEQ ID NO: 6086985 - DNA, 22 bp, Homo sapiens
ccctgctttttttcttaaaagt

SEQ ID NO: 6086986 - DNA, 16 bp, Homo sapiens
ccctggaaaccttcca

SEQ ID NO: 6086987 - DNA, 22 bp, Homo sapiens
ccctggaaaccttccacccagt

SEQ ID NO: 6086988 - DNA, 16 bp, Homo sapiens
ccctggaaagggggtg

SEQ ID NO: 6086989 - DNA, 19 bp, Homo sapiens
ccctggaaatccctttctg

SEQ ID NO: 6086990 - DNA, 15 bp, Homo sapiens
ccctggaacctttcc

SEQ ID NO: 6086991 - DNA, 18 bp, Homo sapiens
ccctggaactcctggcct

SEQ ID NO: 6086992 - DNA, 20 bp, Homo sapiens
ccctggaactctatctgggc

SEQ ID NO: 6086993 - DNA, 22 bp, Homo sapiens
ccctggaactctatctgggcct

SEQ ID NO: 6086994 - DNA, 17 bp, Homo sapiens
ccctggaagagcccagt

SEQ ID NO: 6086995 - DNA, 15 bp, Homo sapiens
ccctggaagcagtgc

SEQ ID NO: 6086996 - DNA, 17 bp, Homo sapiens
ccctggaagctggaaga

SEQ ID NO: 6086997 - DNA, 18 bp, Homo sapiens
ccctggaagctggaagac

SEQ ID NO: 6086998 - DNA, 23 bp, Homo sapiens
ccctggaagttgtcctttctgat

SEQ ID NO: 6086999 - DNA, 23 bp, Homo sapiens
ccctggaatgagttgaggccact

SEQ ID NO: 6087000 - DNA, 13 bp, Homo sapiens
ccctggaattcac

SEQ ID NO: 6087001 - DNA, 23 bp, Homo sapiens
ccctggaattcagcaccctgggt

SEQ ID NO: 6087002 - DNA, 21 bp, Homo sapiens
ccctggaattgccacataatt

SEQ ID NO: 6087003 - DNA, 13 bp, Homo sapiens
ccctggacacagc

SEQ ID NO: 6087004 - DNA, 19 bp, Homo sapiens
ccctggacacagcccaccc

SEQ ID NO: 6087005 - DNA, 10 bp, Homo sapiens
ccctggacag

SEQ ID NO: 6087006 - DNA, 23 bp, Homo sapiens
ccctggacagatggcccaaggga

SEQ ID NO: 6087007 - DNA, 15 bp, Homo sapiens
ccctggacaggcagc

SEQ ID NO: 6087008 - DNA, 22 bp, Homo sapiens
ccctggacaggcagcctccttt

SEQ ID NO: 6087009 - DNA, 15 bp, Homo sapiens
ccctggacatgcctg

SEQ ID NO: 6087010 - DNA, 19 bp, Homo sapiens
ccctggacatgcctgtcct

SEQ ID NO: 6087011 - DNA, 15 bp, Homo sapiens
ccctggaccacacct

SEQ ID NO: 6087012 - DNA, 23 bp, Homo sapiens
ccctggaccacgaggctgattcc

SEQ ID NO: 6087013 - DNA, 17 bp, Homo sapiens
ccctggaccagatgctg

SEQ ID NO: 6087014 - DNA, 19 bp, Homo sapiens
ccctggaccagcctcctgt

SEQ ID NO: 6087015 - DNA, 17 bp, Homo sapiens
ccctggaccagtggtct

SEQ ID NO: 6087016 - DNA, 21 bp, Homo sapiens
ccctggaccagtggtctcaca

SEQ ID NO: 6087017 - DNA, 23 bp, Homo sapiens
ccctggaccagtggtctcacatg

SEQ ID NO: 6087018 - DNA, 16 bp, Homo sapiens
ccctggacccagccag

SEQ ID NO: 6087019 - DNA, 17 bp, Homo sapiens
ccctggaccccagcctc

SEQ ID NO: 6087020 - DNA, 14 bp, Homo sapiens
ccctggaccccagg

SEQ ID NO: 6087021 - DNA, 16 bp, Homo sapiens
ccctggaccccaggct

SEQ ID NO: 6087022 - DNA, 16 bp, Homo sapiens
ccctggacggggcggg

SEQ ID NO: 6087023 - DNA, 15 bp, Homo sapiens
ccctggactgtgtgc

SEQ ID NO: 6087024 - DNA, 14 bp, Homo sapiens
ccctggactgtttc

SEQ ID NO: 6087025 - DNA, 19 bp, Homo sapiens
ccctggagacagaagtcag

SEQ ID NO: 6087026 - DNA, 22 bp, Homo sapiens
ccctggagaccccaccagcctc

SEQ ID NO: 6087027 - DNA, 13 bp, Homo sapiens
ccctggagagaag

SEQ ID NO: 6087028 - DNA, 21 bp, Homo sapiens
ccctggagaggccctctggag

SEQ ID NO: 6087029 - DNA, 21 bp, Homo sapiens
ccctggagagttcaatggctg

SEQ ID NO: 6087030 - DNA, 16 bp, Homo sapiens
ccctggagcagccacc

SEQ ID NO: 6087031 - DNA, 20 bp, Homo sapiens
ccctggagcagccaccccat

SEQ ID NO: 6087032 - DNA, 12 bp, Homo sapiens
ccctggagccag

SEQ ID NO: 6087033 - DNA, 14 bp, Homo sapiens
ccctggagccagac

SEQ ID NO: 6087034 - DNA, 20 bp, Homo sapiens
ccctggagccagactctggt

SEQ ID NO: 6087035 - DNA, 23 bp, Homo sapiens
ccctggagccagactctggtctt

SEQ ID NO: 6087036 - DNA, 13 bp, Homo sapiens
ccctggagccagg

SEQ ID NO: 6087037 - DNA, 18 bp, Homo sapiens
ccctggagccagggcaga

SEQ ID NO: 6087038 - DNA, 12 bp, Homo sapiens
ccctggagccat

SEQ ID NO: 6087039 - DNA, 14 bp, Homo sapiens
ccctggagccatcc

SEQ ID NO: 6087040 - DNA, 16 bp, Homo sapiens
ccctggagccatccct

SEQ ID NO: 6087041 - DNA, 12 bp, Homo sapiens
ccctggagccca

SEQ ID NO: 6087042 - DNA, 13 bp, Homo sapiens
ccctggagcccct

SEQ ID NO: 6087043 - DNA, 17 bp, Homo sapiens
ccctggagcctcagcag

SEQ ID NO: 6087044 - DNA, 20 bp, Homo sapiens
ccctggagcggctctcctga

SEQ ID NO: 6087045 - DNA, 13 bp, Homo sapiens
ccctggagctagg

SEQ ID NO: 6087046 - DNA, 10 bp, Homo sapiens
ccctggagga

SEQ ID NO: 6087047 - DNA, 18 bp, Homo sapiens
ccctggaggacagaggga

SEQ ID NO: 6087048 - DNA, 15 bp, Homo sapiens
ccctggaggcacctg

SEQ ID NO: 6087049 - DNA, 15 bp, Homo sapiens
ccctggaggcacgca

SEQ ID NO: 6087050 - DNA, 17 bp, Homo sapiens
ccctggaggcacgcacc

SEQ ID NO: 6087051 - DNA, 19 bp, Homo sapiens
ccctggaggcacgcaccac

SEQ ID NO: 6087052 - DNA, 20 bp, Homo sapiens
ccctggaggcacgcaccact

SEQ ID NO: 6087053 - DNA, 23 bp, Homo sapiens
ccctggaggcacgcaccactgct

SEQ ID NO: 6087054 - DNA, 23 bp, Homo sapiens
ccctggaggcggtgcggcaggga

SEQ ID NO: 6087055 - DNA, 17 bp, Homo sapiens
ccctggaggctgacaca

SEQ ID NO: 6087056 - DNA, 19 bp, Homo sapiens
ccctggaggctgacacaga

SEQ ID NO: 6087057 - DNA, 14 bp, Homo sapiens
ccctggagggcaga

SEQ ID NO: 6087058 - DNA, 11 bp, Homo sapiens
ccctggagggg

SEQ ID NO: 6087059 - DNA, 20 bp, Homo sapiens
ccctggaggggcccatgtgg

SEQ ID NO: 6087060 - DNA, 21 bp, Homo sapiens
ccctggagggggaatggcagc

SEQ ID NO: 6087061 - DNA, 19 bp, Homo sapiens
ccctggaggtaaacaaaga

SEQ ID NO: 6087062 - DNA, 18 bp, Homo sapiens
ccctggaggtctccaggg

SEQ ID NO: 6087063 - DNA, 13 bp, Homo sapiens
ccctggaggtgcc

SEQ ID NO: 6087064 - DNA, 14 bp, Homo sapiens
ccctggaggtgcca

SEQ ID NO: 6087065 - DNA, 20 bp, Homo sapiens
ccctggaggtgccagcaaag

SEQ ID NO: 6087066 - DNA, 13 bp, Homo sapiens
ccctggaggtggc

SEQ ID NO: 6087067 - DNA, 19 bp, Homo sapiens
ccctggagtcccctgggcc

SEQ ID NO: 6087068 - DNA, 16 bp, Homo sapiens
ccctggagtggcatgg

SEQ ID NO: 6087069 - DNA, 17 bp, Homo sapiens
ccctggagtggcatggt

SEQ ID NO: 6087070 - DNA, 23 bp, Homo sapiens
ccctggagtggcatggtcctgtg

SEQ ID NO: 6087071 - DNA, 20 bp, Homo sapiens
ccctggagtgtggctgagga

SEQ ID NO: 6087072 - DNA, 20 bp, Homo sapiens
ccctggagtgtgtcagagcc

SEQ ID NO: 6087073 - DNA, 23 bp, Homo sapiens
ccctggagtgtgtcagagcccag

SEQ ID NO: 6087074 - DNA, 21 bp, Homo sapiens
ccctggatagacgagttgatt

SEQ ID NO: 6087075 - DNA, 23 bp, Homo sapiens
ccctggatcacgacgctgcagag

SEQ ID NO: 6087076 - DNA, 17 bp, Homo sapiens
ccctggatcagaacagg

SEQ ID NO: 6087077 - DNA, 16 bp, Homo sapiens
ccctggatcagcgtgg

SEQ ID NO: 6087078 - DNA, 20 bp, Homo sapiens
ccctggatcagcgtggcctt

SEQ ID NO: 6087079 - DNA, 21 bp, Homo sapiens
ccctggatcagcgtggccttg

SEQ ID NO: 6087080 - DNA, 20 bp, Homo sapiens
ccctggatctacctggaggg

SEQ ID NO: 6087081 - DNA, 22 bp, Homo sapiens
ccctggatgaagttatctggct

SEQ ID NO: 6087082 - DNA, 14 bp, Homo sapiens
ccctggatggcctc

SEQ ID NO: 6087083 - DNA, 22 bp, Homo sapiens
ccctggatgggcattgggctga

SEQ ID NO: 6087084 - DNA, 18 bp, Homo sapiens
ccctggatgtcccctgtc

SEQ ID NO: 6087085 - DNA, 22 bp, Homo sapiens
ccctggatgtgcccacagggac

SEQ ID NO: 6087086 - DNA, 20 bp, Homo sapiens
ccctggatgtgtggggcatg

SEQ ID NO: 6087087 - DNA, 21 bp, Homo sapiens
ccctggatgtgtggggcatgg

SEQ ID NO: 6087088 - DNA, 20 bp, Homo sapiens
ccctggatttttaccagtct

SEQ ID NO: 6087089 - DNA, 24 bp, Homo sapiens
ccctggatttttaccagtctcaca

SEQ ID NO: 6087090 - DNA, 18 bp, Homo sapiens
ccctggcacctgggtgct

SEQ ID NO: 6087091 - DNA, 16 bp, Homo sapiens
ccctggcacgtcctcc

SEQ ID NO: 6087092 - DNA, 13 bp, Homo sapiens
ccctggcactggc

SEQ ID NO: 6087093 - DNA, 16 bp, Homo sapiens
ccctggcactggcaaa

SEQ ID NO: 6087094 - DNA, 18 bp, Homo sapiens
ccctggcagacacaaccc

SEQ ID NO: 6087095 - DNA, 12 bp, Homo sapiens
ccctggcagaga

SEQ ID NO: 6087096 - DNA, 20 bp, Homo sapiens
ccctggcagcacagcccagg

SEQ ID NO: 6087097 - DNA, 22 bp, Homo sapiens
ccctggcagcacagcccagggc

SEQ ID NO: 6087098 - DNA, 15 bp, Homo sapiens
ccctggcagcagcag

SEQ ID NO: 6087099 - DNA, 13 bp, Homo sapiens
ccctggcagcccc

SEQ ID NO: 6087100 - DNA, 16 bp, Homo sapiens
ccctggcagcccctgt

SEQ ID NO: 6087101 - DNA, 19 bp, Homo sapiens
ccctggcagctgcccctcc

SEQ ID NO: 6087102 - DNA, 23 bp, Homo sapiens
ccctggcagctgcccctcctgga

SEQ ID NO: 6087103 - DNA, 20 bp, Homo sapiens
ccctggcaggatgaccctgc

SEQ ID NO: 6087104 - DNA, 22 bp, Homo sapiens
ccctggcagggacctgagagca

SEQ ID NO: 6087105 - DNA, 22 bp, Homo sapiens
ccctggcaggggaaactctggt

SEQ ID NO: 6087106 - DNA, 20 bp, Homo sapiens
ccctggcaggtggccaggca

SEQ ID NO: 6087107 - DNA, 18 bp, Homo sapiens
ccctggcatatctctgtt

SEQ ID NO: 6087108 - DNA, 22 bp, Homo sapiens
ccctggcatccaaatggctgct

SEQ ID NO: 6087109 - DNA, 21 bp, Homo sapiens
ccctggcatgaccatcctgtc

SEQ ID NO: 6087110 - DNA, 20 bp, Homo sapiens
ccctggcatgatggacaaag

SEQ ID NO: 6087111 - DNA, 23 bp, Homo sapiens
ccctggcatgatggacaaaggcc

SEQ ID NO: 6087112 - DNA, 21 bp, Homo sapiens
ccctggccaccacccaacctg

SEQ ID NO: 6087113 - DNA, 20 bp, Homo sapiens
ccctggccaccttgtcctgg

SEQ ID NO: 6087114 - DNA, 22 bp, Homo sapiens
ccctggccaccttgtcctggct

SEQ ID NO: 6087115 - DNA, 18 bp, Homo sapiens
ccctggccactaaagctt

SEQ ID NO: 6087116 - DNA, 23 bp, Homo sapiens
ccctggccactaaagcttcagac

SEQ ID NO: 6087117 - DNA, 20 bp, Homo sapiens
ccctggccactggccctgtt

SEQ ID NO: 6087118 - DNA, 14 bp, Homo sapiens
ccctggccagaggc

SEQ ID NO: 6087119 - DNA, 12 bp, Homo sapiens
ccctggccagcc

SEQ ID NO: 6087120 - DNA, 19 bp, Homo sapiens
ccctggccagcccttcctc

SEQ ID NO: 6087121 - DNA, 22 bp, Homo sapiens
ccctggccagcccttcctctca

SEQ ID NO: 6087122 - DNA, 9 bp, Homo sapiens
ccctggccc

SEQ ID NO: 6087123 - DNA, 21 bp, Homo sapiens
ccctggcccaccccccagcct

SEQ ID NO: 6087124 - DNA, 15 bp, Homo sapiens
ccctggcccagcctg

SEQ ID NO: 6087125 - DNA, 13 bp, Homo sapiens
ccctggcccagga

SEQ ID NO: 6087126 - DNA, 15 bp, Homo sapiens
ccctggcccatctca

SEQ ID NO: 6087127 - DNA, 22 bp, Homo sapiens
ccctggcccatctcagcctcct

SEQ ID NO: 6087128 - DNA, 12 bp, Homo sapiens
ccctggccccca

SEQ ID NO: 6087129 - DNA, 19 bp, Homo sapiens
ccctggcccccatcagccc

SEQ ID NO: 6087130 - DNA, 13 bp, Homo sapiens
ccctggccccctc

SEQ ID NO: 6087131 - DNA, 14 bp, Homo sapiens
ccctggcccctcca

SEQ ID NO: 6087132 - DNA, 19 bp, Homo sapiens
ccctggcccggtcccagtc

SEQ ID NO: 6087133 - DNA, 14 bp, Homo sapiens
ccctggccctgagg

SEQ ID NO: 6087134 - DNA, 17 bp, Homo sapiens
ccctggccctgaggtgt

SEQ ID NO: 6087135 - DNA, 18 bp, Homo sapiens
ccctggcccttccttcac

SEQ ID NO: 6087136 - DNA, 12 bp, Homo sapiens
ccctggcccttt

SEQ ID NO: 6087137 - DNA, 18 bp, Homo sapiens
ccctggccctttcccctt

SEQ ID NO: 6087138 - DNA, 20 bp, Homo sapiens
ccctggccctttccccttcc

SEQ ID NO: 6087139 - DNA, 15 bp, Homo sapiens
ccctggccgccccct

SEQ ID NO: 6087140 - DNA, 15 bp, Homo sapiens
ccctggcctaccaca

SEQ ID NO: 6087141 - DNA, 21 bp, Homo sapiens
ccctggcctcacgcccagcct

SEQ ID NO: 6087142 - DNA, 11 bp, Homo sapiens
ccctggcctcc

SEQ ID NO: 6087143 - DNA, 19 bp, Homo sapiens
ccctggcctcccctgccac

SEQ ID NO: 6087144 - DNA, 21 bp, Homo sapiens
ccctggcctccggcgtcagcc

SEQ ID NO: 6087145 - DNA, 19 bp, Homo sapiens
ccctggcctctgtgccttc

SEQ ID NO: 6087146 - DNA, 13 bp, Homo sapiens
ccctggcctgctg

SEQ ID NO: 6087147 - DNA, 15 bp, Homo sapiens
ccctggcctggctct

SEQ ID NO: 6087148 - DNA, 15 bp, Homo sapiens
ccctggcctgttctg

SEQ ID NO: 6087149 - DNA, 14 bp, Homo sapiens
cctgcctgggcctt

SEQ ID NO: 6087150 - DNA, 11 bp, Homo sapiens
cctgcctgggt

SEQ ID NO: 6087151 - DNA, 13 bp, Homo sapiens
cctgcctgggtgg

SEQ ID NO: 6087152 - DNA, 17 bp, Homo sapiens
cctgcctgggtgggaca

SEQ ID NO: 6087153 - DNA, 21 bp, Homo sapiens
cctgcctgggtgggacagcct

SEQ ID NO: 6087154 - DNA, 22 bp, Homo sapiens
cctgcctgggtgggacagcctc

SEQ ID NO: 6087155 - DNA, 23 bp, Homo sapiens
cctgcctgggtgggacagcctct

SEQ ID NO: 6087156 - DNA, 12 bp, Homo sapiens
cctgcctgggtt

SEQ ID NO: 6087157 - DNA, 24 bp, Homo sapiens
cctgcctgggttgggggcactcag

SEQ ID NO: 6087158 - DNA, 13 bp, Homo sapiens
cctgcctgggttt

SEQ ID NO: 6087159 - DNA, 20 bp, Homo sapiens
cctgcctgggttttctaact

SEQ ID NO: 6087160 - DNA, 23 bp, Homo sapiens
cctgcctgggttttctaactgta

SEQ ID NO: 6087161 - DNA, 10 bp, Homo sapiens
cctgcctggt

SEQ ID NO: 6087162 - DNA, 18 bp, Homo sapiens
cctgcctggtcctcacac

SEQ ID NO: 6087163 - DNA, 16 bp, Homo sapiens
cctgcctggtcctccc

SEQ ID NO: 6087164 - DNA, 12 bp, Homo sapiens
cctgcctggtgc

SEQ ID NO: 6087165 - DNA, 13 bp, Homo sapiens
cctgcctggtgca

SEQ ID NO: 6087166 - DNA, 19 bp, Homo sapiens
cctgcctggtgcattgctg

SEQ ID NO: 6087167 - DNA, 16 bp, Homo sapiens
cctgcctgtagcccac

SEQ ID NO: 6087168 - DNA, 18 bp, Homo sapiens
cctgcctgtcacctggga

SEQ ID NO: 6087169 - DNA, 15 bp, Homo sapiens
cctgcctgtctcctt

SEQ ID NO: 6087170 - DNA, 12 bp, Homo sapiens
cctgcctgtctg

SEQ ID NO: 6087171 - DNA, 14 bp, Homo sapiens
cctgcctgtctgcc

SEQ ID NO: 6087172 - DNA, 15 bp, Homo sapiens
cctgcctgtctgccc

SEQ ID NO: 6087173 - DNA, 13 bp, Homo sapiens
cctgcctgtctgt

SEQ ID NO: 6087174 - DNA, 22 bp, Homo sapiens
cctgcctgtctgtctctccatc

SEQ ID NO: 6087175 - DNA, 17 bp, Homo sapiens
cctgcctgtggagacag

SEQ ID NO: 6087176 - DNA, 14 bp, Homo sapiens
cctgcctgtggcca

SEQ ID NO: 6087177 - DNA, 23 bp, Homo sapiens
cctgcctgtggcccctcccctgc

SEQ ID NO: 6087178 - DNA, 14 bp, Homo sapiens
cctgcctgtgtgct

SEQ ID NO: 6087179 - DNA, 16 bp, Homo sapiens
cctgcctgttctccag

SEQ ID NO: 6087180 - DNA, 17 bp, Homo sapiens
cctgcctgttctccaga

SEQ ID NO: 6087181 - DNA, 18 bp, Homo sapiens
cctgcctgttctccagat

SEQ ID NO: 6087182 - DNA, 22 bp, Homo sapiens
cctgcctgttctccagatggag

SEQ ID NO: 6087183 - DNA, 13 bp, Homo sapiens
cctgcctgtttcc

SEQ ID NO: 6087184 - DNA, 19 bp, Homo sapiens
cctgccttaacctgggacc

SEQ ID NO: 6087185 - DNA, 14 bp, Homo sapiens
cctgccttaagtga

SEQ ID NO: 6087186 - DNA, 16 bp, Homo sapiens
cctgccttagcaatgg

SEQ ID NO: 6087187 - DNA, 14 bp, Homo sapiens
cctgccttatgcaa

SEQ ID NO: 6087188 - DNA, 17 bp, Homo sapiens
cctgccttatgcaaggg

SEQ ID NO: 6087189 - DNA, 13 bp, Homo sapiens
cctgccttcagag

SEQ ID NO: 6087190 - DNA, 14 bp, Homo sapiens
cctgccttctcagg

SEQ ID NO: 6087191 - DNA, 15 bp, Homo sapiens
cctgccttctcaggg

SEQ ID NO: 6087192 - DNA, 14 bp, Homo sapiens
cctgccttctcccc

SEQ ID NO: 6087193 - DNA, 18 bp, Homo sapiens
cctgccttctcccctcca

SEQ ID NO: 6087194 - DNA, 20 bp, Homo sapiens
cctgccttctcttctatcct

SEQ ID NO: 6087195 - DNA, 19 bp, Homo sapiens
cctgccttctgtcctggtg

SEQ ID NO: 6087196 - DNA, 23 bp, Homo sapiens
cctgccttcttctttttgctgtt

SEQ ID NO: 6087197 - DNA, 13 bp, Homo sapiens
cctgccttgaagc

SEQ ID NO: 6087198 - DNA, 14 bp, Homo sapiens
cctgccttgctgcc

SEQ ID NO: 6087199 - DNA, 17 bp, Homo sapiens
cctgccttggagagggc

SEQ ID NO: 6087200 - DNA, 23 bp, Homo sapiens
cctgccttggagtcgtctggcat

SEQ ID NO: 6087201 - DNA, 21 bp, Homo sapiens
cctgccttgggccttgctgct

SEQ ID NO: 6087202 - DNA, 20 bp, Homo sapiens
cctgcctttaagccaaagaa

SEQ ID NO: 6087203 - DNA, 22 bp, Homo sapiens
cctgcctttaagccaaagaaac

SEQ ID NO: 6087204 - DNA, 14 bp, Homo sapiens
cctgcctttgcctc

SEQ ID NO: 6087205 - DNA, 18 bp, Homo sapiens
cctgcctttgggagcagg

SEQ ID NO: 6087206 - DNA, 16 bp, Homo sapiens
cctgcctttgtatgtg

SEQ ID NO: 6087207 - DNA, 18 bp, Homo sapiens
cctgcctttgtatgtgga

SEQ ID NO: 6087208 - DNA, 20 bp, Homo sapiens
cctgccttttagttcctgtg

SEQ ID NO: 6087209 - DNA, 15 bp, Homo sapiens
cctgcgaaaaccccc

SEQ ID NO: 6087210 - DNA, 16 bp, Homo sapiens
cctgcgaaacccagcg

SEQ ID NO: 6087211 - DNA, 18 bp, Homo sapiens
cctgcgaaacccagcgtt

SEQ ID NO: 6087212 - DNA, 17 bp, Homo sapiens
cctgcgaaggggccctg

SEQ ID NO: 6087213 - DNA, 17 bp, Homo sapiens
cctgcgaccctgggggc

SEQ ID NO: 6087214 - DNA, 13 bp, Homo sapiens
cctgcgagaccca

SEQ ID NO: 6087215 - DNA, 23 bp, Homo sapiens
cctgcgagacccaaggctcactg

SEQ ID NO: 6087216 - DNA, 20 bp, Homo sapiens
cctgcgagacgcacacagct

SEQ ID NO: 6087217 - DNA, 23 bp, Homo sapiens
cctgcgagagaccctacagacag

SEQ ID NO: 6087218 - DNA, 13 bp, Homo sapiens
cctgcgagggcag

SEQ ID NO: 6087219 - DNA, 16 bp, Homo sapiens
cctgcgatggtgctgc

SEQ ID NO: 6087220 - DNA, 19 bp, Homo sapiens
cctgcgatggtgctgcacc

SEQ ID NO: 6087221 - DNA, 16 bp, Homo sapiens
cctgcgcaaagggcgg

SEQ ID NO: 6087222 - DNA, 18 bp, Homo sapiens
cctgcgcaagtgcctggg

SEQ ID NO: 6087223 - DNA, 13 bp, Homo sapiens
cctgcgcacaggt

SEQ ID NO: 6087224 - DNA, 16 bp, Homo sapiens
cctgcgcacaggtggg

SEQ ID NO: 6087225 - DNA, 13 bp, Homo sapiens
cctgcgcaggccc

SEQ ID NO: 6087226 - DNA, 17 bp, Homo sapiens
cctgcgcaggccctccg

SEQ ID NO: 6087227 - DNA, 23 bp, Homo sapiens
cctgcgcagggccctctggggct

SEQ ID NO: 6087228 - DNA, 16 bp, Homo sapiens
cctgcgccagtcctgc

SEQ ID NO: 6087229 - DNA, 20 bp, Homo sapiens
cctgcgcccaccccgctctg

SEQ ID NO: 6087230 - DNA, 22 bp, Homo sapiens
cctgcgcccaccccgctctgca

SEQ ID NO: 6087231 - DNA, 15 bp, Homo sapiens
cctgcgcccagagct

SEQ ID NO: 6087232 - DNA, 22 bp, Homo sapiens
cctgcgcccagagctggcctcc

SEQ ID NO: 6087233 - DNA, 14 bp, Homo sapiens
cctgcgccccgcac

SEQ ID NO: 6087234 - DNA, 18 bp, Homo sapiens
cctgcgccccgcccacac

SEQ ID NO: 6087235 - DNA, 20 bp, Homo sapiens
cctgcgccccgcccacaccc

SEQ ID NO: 6087236 - DNA, 13 bp, Homo sapiens
cctgcgcccctgc

SEQ ID NO: 6087237 - DNA, 19 bp, Homo sapiens
cctgcgcccctgcccagca

SEQ ID NO: 6087238 - DNA, 14 bp, Homo sapiens
cctgcgcctccaga

SEQ ID NO: 6087239 - DNA, 15 bp, Homo sapiens
cctgcgcctccatcc

SEQ ID NO: 6087240 - DNA, 16 bp, Homo sapiens
cctgcgcctcctcctg

SEQ ID NO: 6087241 - DNA, 18 bp, Homo sapiens
cctgcgcctcctcctgca

SEQ ID NO: 6087242 - DNA, 13 bp, Homo sapiens
cctgcgcctgctg

SEQ ID NO: 6087243 - DNA, 15 bp, Homo sapiens
cctgcgcctgctgcc

SEQ ID NO: 6087244 - DNA, 14 bp, Homo sapiens
cctgcgcctgtgat

SEQ ID NO: 6087245 - DNA, 12 bp, Homo sapiens
cctgcgctcctc

SEQ ID NO: 6087246 - DNA, 16 bp, Homo sapiens
cctgcgctcctctgca

SEQ ID NO: 6087247 - DNA, 17 bp, Homo sapiens
cctgcgctcctctgcag

SEQ ID NO: 6087248 - DNA, 16 bp, Homo sapiens
cctgcgctcggcagga

SEQ ID NO: 6087249 - DNA, 22 bp, Homo sapiens
cctgcgcttcctgagcagtccc

SEQ ID NO: 6087250 - DNA, 20 bp, Homo sapiens
cctgcgcttctgctggagga

SEQ ID NO: 6087251 - DNA, 18 bp, Homo sapiens
cctgcgctttgaacgtgc

SEQ ID NO: 6087252 - DNA, 22 bp, Homo sapiens
cctgcggaagccacagggtgag

SEQ ID NO: 6087253 - DNA, 19 bp, Homo sapiens
cctgcggaggcggtggcag

SEQ ID NO: 6087254 - DNA, 19 bp, Homo sapiens
cctgcggagtgaagagggg

SEQ ID NO: 6087255 - DNA, 22 bp, Homo sapiens
cctgcggagtgaagaggggcag

SEQ ID NO: 6087256 - DNA, 16 bp, Homo sapiens
cctgcggcaggactgc

SEQ ID NO: 6087257 - DNA, 21 bp, Homo sapiens
cctgcggcaggactgcagagc

SEQ ID NO: 6087258 - DNA, 22 bp, Homo sapiens
cctgcggccgtcaccccgccag

SEQ ID NO: 6087259 - DNA, 18 bp, Homo sapiens
cctgcggcgccagcctca

SEQ ID NO: 6087260 - DNA, 15 bp, Homo sapiens
cctgcggctcagcct

SEQ ID NO: 6087261 - DNA, 19 bp, Homo sapiens
cctgcggctcagccttgca

SEQ ID NO: 6087262 - DNA, 20 bp, Homo sapiens
cctgcggctcagccttgcac

SEQ ID NO: 6087263 - DNA, 12 bp, Homo sapiens
cctgcggctctg

SEQ ID NO: 6087264 - DNA, 18 bp, Homo sapiens
cctgcggctgctggcaca

SEQ ID NO: 6087265 - DNA, 21 bp, Homo sapiens
cctgcggctgctggcacagac

SEQ ID NO: 6087266 - DNA, 20 bp, Homo sapiens
cctgcggctgctgtgtgcct

SEQ ID NO: 6087267 - DNA, 15 bp, Homo sapiens
cctgcgggccacagg

SEQ ID NO: 6087268 - DNA, 13 bp, Homo sapiens
cctgcgggccagg

SEQ ID NO: 6087269 - DNA, 17 bp, Homo sapiens
cctgcgggccaggcact

SEQ ID NO: 6087270 - DNA, 15 bp, Homo sapiens
cctgcgggccagggt

SEQ ID NO: 6087271 - DNA, 16 bp, Homo sapiens
cctgcgggccagggtc

SEQ ID NO: 6087272 - DNA, 17 bp, Homo sapiens
cctgcgggcgcgggcag

SEQ ID NO: 6087273 - DNA, 20 bp, Homo sapiens
cctgcgggcgcgggcagcca

SEQ ID NO: 6087274 - DNA, 21 bp, Homo sapiens
cctgcgggcttttccccggtc

SEQ ID NO: 6087275 - DNA, 16 bp, Homo sapiens
cctgcggggcagcagg

SEQ ID NO: 6087276 - DNA, 17 bp, Homo sapiens
cctgcgggggcgaggcc

SEQ ID NO: 6087277 - DNA, 21 bp, Homo sapiens
cctgcgggggcgaggcccctc

SEQ ID NO: 6087278 - DNA, 17 bp, Homo sapiens
cctgcggggttccctgc

SEQ ID NO: 6087279 - DNA, 14 bp, Homo sapiens
cctgcgggtcctca

SEQ ID NO: 6087280 - DNA, 20 bp, Homo sapiens
cctgcgggtggggcttgggg

SEQ ID NO: 6087281 - DNA, 21 bp, Homo sapiens
cctgcgggtggggcttggggc

SEQ ID NO: 6087282 - DNA, 16 bp, Homo sapiens
cctgcgggttttaatt

SEQ ID NO: 6087283 - DNA, 16 bp, Homo sapiens
cctgcggtacaggagt

SEQ ID NO: 6087284 - DNA, 15 bp, Homo sapiens
cctgcggtcaggctg

SEQ ID NO: 6087285 - DNA, 23 bp, Homo sapiens
cctgcggtcaggctgggcagccc

SEQ ID NO: 6087286 - DNA, 15 bp, Homo sapiens
cctgcgtcatggctc

SEQ ID NO: 6087287 - DNA, 16 bp, Homo sapiens
cctgcgtcatggctca

SEQ ID NO: 6087288 - DNA, 21 bp, Homo sapiens
cctgcgtcccagcctgcaccc

SEQ ID NO: 6087289 - DNA, 16 bp, Homo sapiens
cctgcgtcctcctcac

SEQ ID NO: 6087290 - DNA, 19 bp, Homo sapiens
cctgcgtcctctgtccccg

SEQ ID NO: 6087291 - DNA, 17 bp, Homo sapiens
cctgcgtcggccctggg

SEQ ID NO: 6087292 - DNA, 23 bp, Homo sapiens
cctgcgtcttccgcccctgcctg

SEQ ID NO: 6087293 - DNA, 16 bp, Homo sapiens
cctgcgtggcctgagt

SEQ ID NO: 6087294 - DNA, 17 bp, Homo sapiens
cctgcgtggcctgagtc

SEQ ID NO: 6087295 - DNA, 22 bp, Homo sapiens
cctgcgtggcctgagtcctggt

SEQ ID NO: 6087296 - DNA, 23 bp, Homo sapiens
cctgcgtggcctgagtcctggtc

SEQ ID NO: 6087297 - DNA, 16 bp, Homo sapiens
cctgcgtggctgaccc

SEQ ID NO: 6087298 - DNA, 17 bp, Homo sapiens
cctgcgtggctgacccc

SEQ ID NO: 6087299 - DNA, 12 bp, Homo sapiens
cctgcgtgggga

SEQ ID NO: 6087300 - DNA, 13 bp, Homo sapiens
cctgcgtggggac

SEQ ID NO: 6087301 - DNA, 17 bp, Homo sapiens
cctgcgtgtgtctgtgt

SEQ ID NO: 6087302 - DNA, 17 bp, Homo sapiens
cctgcgtgtgttctctc

SEQ ID NO: 6087303 - DNA, 21 bp, Homo sapiens
cctgcgtgtgttctctccgga

SEQ ID NO: 6087304 - DNA, 15 bp, Homo sapiens
cctgcgttcagcccc

SEQ ID NO: 6087305 - DNA, 16 bp, Homo sapiens
cctgcgttcagcccct

SEQ ID NO: 6087306 - DNA, 21 bp, Homo sapiens
cctgcgttcagcccctgatct

SEQ ID NO: 6087307 - DNA, 14 bp, Homo sapiens
cctgcgttcccaga

SEQ ID NO: 6087308 - DNA, 14 bp, Homo sapiens
cctgcgttggagcc

SEQ ID NO: 6087309 - DNA, 15 bp, Homo sapiens
cctgcgttggagcca

SEQ ID NO: 6087310 - DNA, 16 bp, Homo sapiens
cctgcgttggagccac

SEQ ID NO: 6087311 - DNA, 18 bp, Homo sapiens
cctgcgttggtccagagc

SEQ ID NO: 6087312 - DNA, 18 bp, Homo sapiens
cctgcgtttggaggcccc

SEQ ID NO: 6087313 - DNA, 19 bp, Homo sapiens
cctgcgtttggaggcccct

SEQ ID NO: 6087314 - DNA, 18 bp, Homo sapiens
cctgctaaatgacttatt

SEQ ID NO: 6087315 - DNA, 12 bp, Homo sapiens
cctgctaaggaa

SEQ ID NO: 6087316 - DNA, 14 bp, Homo sapiens
cctgctaaggaaca

SEQ ID NO: 6087317 - DNA, 19 bp, Homo sapiens
cctgctaaggaacaatgcc

SEQ ID NO: 6087318 - DNA, 21 bp, Homo sapiens
cctgctaaggaacaatgccgc

SEQ ID NO: 6087319 - DNA, 22 bp, Homo sapiens
cctgctaaggaacaatgccgcc

SEQ ID NO: 6087320 - DNA, 20 bp, Homo sapiens
cctgctacacaggcaggaat

SEQ ID NO: 6087321 - DNA, 20 bp, Homo sapiens
cctgctacacctattatccc

SEQ ID NO: 6087322 - DNA, 14 bp, Homo sapiens
cctgctacaggagg

SEQ ID NO: 6087323 - DNA, 15 bp, Homo sapiens
cctgctacaggaggg

SEQ ID NO: 6087324 - DNA, 19 bp, Homo sapiens
cctgctacctgatttcagc

SEQ ID NO: 6087325 - DNA, 21 bp, Homo sapiens
cctgctactccactgacctgg

SEQ ID NO: 6087326 - DNA, 15 bp, Homo sapiens
cctgctactcctgtg

SEQ ID NO: 6087327 - DNA, 20 bp, Homo sapiens
cctgctactcctgtgctctg

SEQ ID NO: 6087328 - DNA, 19 bp, Homo sapiens
ccctggcctgttctgtttt

SEQ ID NO: 6087329 - DNA, 20 bp, Homo sapiens
ccctggccttaaaaggggcc

SEQ ID NO: 6087330 - DNA, 21 bp, Homo sapiens
ccctggccttgggccctctgg

SEQ ID NO: 6087331 - DNA, 22 bp, Homo sapiens
ccctggccttgggccctctggt

SEQ ID NO: 6087332 - DNA, 17 bp, Homo sapiens
ccctggcctttcatatt

SEQ ID NO: 6087333 - DNA, 22 bp, Homo sapiens
ccctggcggccccaactcgggc

SEQ ID NO: 6087334 - DNA, 15 bp, Homo sapiens
ccctggcgggtggct

SEQ ID NO: 6087335 - DNA, 18 bp, Homo sapiens
ccctggcgggtggctgca

SEQ ID NO: 6087336 - DNA, 20 bp, Homo sapiens
ccctggcgggtggctgcaag

SEQ ID NO: 6087337 - DNA, 15 bp, Homo sapiens
ccctggctaacagtc

SEQ ID NO: 6087338 - DNA, 15 bp, Homo sapiens
ccctggctaagaccc

SEQ ID NO: 6087339 - DNA, 16 bp, Homo sapiens
ccctggctacttccct

SEQ ID NO: 6087340 - DNA, 20 bp, Homo sapiens
ccctggctacttcccttcct

SEQ ID NO: 6087341 - DNA, 16 bp, Homo sapiens
ccctggctcactggca

SEQ ID NO: 6087342 - DNA, 17 bp, Homo sapiens
ccctggctcactggcag

SEQ ID NO: 6087343 - DNA, 10 bp, Homo sapiens
ccctggctcc

SEQ ID NO: 6087344 - DNA, 15 bp, Homo sapiens
ccctggctcccaagg

SEQ ID NO: 6087345 - DNA, 18 bp, Homo sapiens
ccctggctcccaagggag

SEQ ID NO: 6087346 - DNA, 14 bp, Homo sapiens
ccctggctcccacc

SEQ ID NO: 6087347 - DNA, 16 bp, Homo sapiens
ccctggctcctccgtc

SEQ ID NO: 6087348 - DNA, 17 bp, Homo sapiens
ccctggctccttcacca

SEQ ID NO: 6087349 - DNA, 10 bp, Homo sapiens
ccctggctct

SEQ ID NO: 6087350 - DNA, 11 bp, Homo sapiens
ccctggctctg

SEQ ID NO: 6087351 - DNA, 19 bp, Homo sapiens
ccctggctctgcccctcag

SEQ ID NO: 6087352 - DNA, 21 bp, Homo sapiens
ccctggctgaacagtgctctg

SEQ ID NO: 6087353 - DNA, 16 bp, Homo sapiens
ccctggctgacctgct

SEQ ID NO: 6087354 - DNA, 17 bp, Homo sapiens
ccctggctgacctgctg

SEQ ID NO: 6087355 - DNA, 18 bp, Homo sapiens
ccctggctgacctgctgt

SEQ ID NO: 6087356 - DNA, 15 bp, Homo sapiens
ccctggctgactggc

SEQ ID NO: 6087357 - DNA, 12 bp, Homo sapiens
ccctggctgcag

SEQ ID NO: 6087358 - DNA, 13 bp, Homo sapiens
ccctggctgcagc

SEQ ID NO: 6087359 - DNA, 11 bp, Homo sapiens
ccctggctgcc

SEQ ID NO: 6087360 - DNA, 14 bp, Homo sapiens
ccctggctggaatg

SEQ ID NO: 6087361 - DNA, 23 bp, Homo sapiens
ccctggctggaatgggggccagg

SEQ ID NO: 6087362 - DNA, 14 bp, Homo sapiens
ccctggctggctcc

SEQ ID NO: 6087363 - DNA, 16 bp, Homo sapiens
ccctggctggggactt

SEQ ID NO: 6087364 - DNA, 22 bp, Homo sapiens
ccctggctggtaagggccaagt

SEQ ID NO: 6087365 - DNA, 20 bp, Homo sapiens
ccctggctgtgagcagcctc

SEQ ID NO: 6087366 - DNA, 13 bp, Homo sapiens
ccctggctgtggg

SEQ ID NO: 6087367 - DNA, 22 bp, Homo sapiens
ccctggctgttctgtggttcct

SEQ ID NO: 6087368 - DNA, 12 bp, Homo sapiens
ccctggcttcca

SEQ ID NO: 6087369 - DNA, 22 bp, Homo sapiens
ccctggcttccccttcagacct

SEQ ID NO: 6087370 - DNA, 22 bp, Homo sapiens
ccctggcttctgtggggcccct

SEQ ID NO: 6087371 - DNA, 23 bp, Homo sapiens
ccctggcttgaaccttcaaagct

SEQ ID NO: 6087372 - DNA, 15 bp, Homo sapiens
ccctggcttgagtga

SEQ ID NO: 6087373 - DNA, 19 bp, Homo sapiens
ccctggcttgtaactccac

SEQ ID NO: 6087374 - DNA, 20 bp, Homo sapiens
ccctggcttgtaactccacc

SEQ ID NO: 6087375 - DNA, 23 bp, Homo sapiens
ccctggcttgtaactccaccaac

SEQ ID NO: 6087376 - DNA, 23 bp, Homo sapiens
ccctggctttcattttctctcag

SEQ ID NO: 6087377 - DNA, 17 bp, Homo sapiens
ccctggctttgcctctt

SEQ ID NO: 6087378 - DNA, 22 bp, Homo sapiens
ccctggctttgcctcttctttg

SEQ ID NO: 6087379 - DNA, 17 bp, Homo sapiens
ccctggcttttcactgc

SEQ ID NO: 6087380 - DNA, 22 bp, Homo sapiens
ccctggcttttcactgctggct

SEQ ID NO: 6087381 - DNA, 17 bp, Homo sapiens
ccctgggaacacagtgc

SEQ ID NO: 6087382 - DNA, 17 bp, Homo sapiens
ccctgggaacaggcccc

SEQ ID NO: 6087383 - DNA, 18 bp, Homo sapiens
ccctgggaaccactccca

SEQ ID NO: 6087384 - DNA, 18 bp, Homo sapiens
ccctgggaactcatcctg

SEQ ID NO: 6087385 - DNA, 21 bp, Homo sapiens
ccctgggaactctcctggcct

SEQ ID NO: 6087386 - DNA, 21 bp, Homo sapiens
ccctgggaaggcctcttggag

SEQ ID NO: 6087387 - DNA, 14 bp, Homo sapiens
ccctgggacccccc

SEQ ID NO: 6087388 - DNA, 22 bp, Homo sapiens
ccctgggacctatacagaacag

SEQ ID NO: 6087389 - DNA, 21 bp, Homo sapiens
ccctgggactaaagccaggaa

SEQ ID NO: 6087390 - DNA, 23 bp, Homo sapiens
ccctgggactaaagccaggaaca

SEQ ID NO: 6087391 - DNA, 19 bp, Homo sapiens
ccctgggactttcccaccc

SEQ ID NO: 6087392 - DNA, 14 bp, Homo sapiens
ccctgggagacaac

SEQ ID NO: 6087393 - DNA, 14 bp, Homo sapiens
ccctgggagacaga

SEQ ID NO: 6087394 - DNA, 11 bp, Homo sapiens
ccctgggagag

SEQ ID NO: 6087395 - DNA, 14 bp, Homo sapiens
ccctgggagagaag

SEQ ID NO: 6087396 - DNA, 13 bp, Homo sapiens
ccctgggagagtg

SEQ ID NO: 6087397 - DNA, 23 bp, Homo sapiens
ccctgggagagtgaggtcatccc

SEQ ID NO: 6087398 - DNA, 18 bp, Homo sapiens
ccctgggagccgcctgct

SEQ ID NO: 6087399 - DNA, 18 bp, Homo sapiens
ccctgggatccgagggcc

SEQ ID NO: 6087400 - DNA, 12 bp, Homo sapiens
ccctgggatgct

SEQ ID NO: 6087401 - DNA, 16 bp, Homo sapiens
ccctgggatgctgacc

SEQ ID NO: 6087402 - DNA, 19 bp, Homo sapiens
ccctgggatgctgacccag

SEQ ID NO: 6087403 - DNA, 17 bp, Homo sapiens
ccctgggatggaacctc

SEQ ID NO: 6087404 - DNA, 22 bp, Homo sapiens
ccctgggatggacgctgccggg

SEQ ID NO: 6087405 - DNA, 19 bp, Homo sapiens
ccctgggatgggaccaggg

SEQ ID NO: 6087406 - DNA, 22 bp, Homo sapiens
ccctgggcaaacagagctactg

SEQ ID NO: 6087407 - DNA, 21 bp, Homo sapiens
ccctgggcaccctgcaggcag

SEQ ID NO: 6087408 - DNA, 21 bp, Homo sapiens
ccctgggcagatgtcccccac

SEQ ID NO: 6087409 - DNA, 13 bp, Homo sapiens
ccctgggcaggcg

SEQ ID NO: 6087410 - DNA, 15 bp, Homo sapiens
ccctgggcaggcggt

SEQ ID NO: 6087411 - DNA, 13 bp, Homo sapiens
ccctgggcagggc

SEQ ID NO: 6087412 - DNA, 16 bp, Homo sapiens
ccctgggcagtgagtg

SEQ ID NO: 6087413 - DNA, 21 bp, Homo sapiens
ccctgggcatcttctggcttg

SEQ ID NO: 6087414 - DNA, 18 bp, Homo sapiens
ccctgggcatgcccagcc

SEQ ID NO: 6087415 - DNA, 21 bp, Homo sapiens
ccctgggccaaaaccaatgct

SEQ ID NO: 6087416 - DNA, 14 bp, Homo sapiens
ccctgggccaccct

SEQ ID NO: 6087417 - DNA, 16 bp, Homo sapiens
ccctgggccaccgggc

SEQ ID NO: 6087418 - DNA, 15 bp, Homo sapiens
ccctgggccacctcc

SEQ ID NO: 6087419 - DNA, 19 bp, Homo sapiens
ccctgggccacctcctacc

SEQ ID NO: 6087420 - DNA, 19 bp, Homo sapiens
ccctgggccacgccggcca

SEQ ID NO: 6087421 - DNA, 18 bp, Homo sapiens
ccctgggccagcccagga

SEQ ID NO: 6087422 - DNA, 16 bp, Homo sapiens
ccctgggccaggcagg

SEQ ID NO: 6087423 - DNA, 15 bp, Homo sapiens
ccctgggccagggcg

SEQ ID NO: 6087424 - DNA, 22 bp, Homo sapiens
ccctgggccagggcgtggagag

SEQ ID NO: 6087425 - DNA, 22 bp, Homo sapiens
ccctgggccatatgtgctatgg

SEQ ID NO: 6087426 - DNA, 10 bp, Homo sapiens
ccctgggccc

SEQ ID NO: 6087427 - DNA, 14 bp, Homo sapiens
ccctgggccccacc

SEQ ID NO: 6087428 - DNA, 18 bp, Homo sapiens
ccctgggccccaccacct

SEQ ID NO: 6087429 - DNA, 20 bp, Homo sapiens
ccctgggccccaccacctag

SEQ ID NO: 6087430 - DNA, 17 bp, Homo sapiens
ccctgggccccgcctca

SEQ ID NO: 6087431 - DNA, 14 bp, Homo sapiens
ccctgggcccctcc

SEQ ID NO: 6087432 - DNA, 16 bp, Homo sapiens
ccctgggccctgggct

SEQ ID NO: 6087433 - DNA, 12 bp, Homo sapiens
ccctgggcctca

SEQ ID NO: 6087434 - DNA, 21 bp, Homo sapiens
ccctgggcctcagcctccagg

SEQ ID NO: 6087435 - DNA, 23 bp, Homo sapiens
ccctgggcctcagcctccaggca

SEQ ID NO: 6087436 - DNA, 14 bp, Homo sapiens
ccctgggcctccac

SEQ ID NO: 6087437 - DNA, 15 bp, Homo sapiens
ccctgggcctccacc

SEQ ID NO: 6087438 - DNA, 17 bp, Homo sapiens
ccctgggcctccacctc

SEQ ID NO: 6087439 - DNA, 19 bp, Homo sapiens
ccctgggcctccacctctg

SEQ ID NO: 6087440 - DNA, 11 bp, Homo sapiens
ccctgggcctg

SEQ ID NO: 6087441 - DNA, 24 bp, Homo sapiens
ccctgggcctggaccgcttcccag

SEQ ID NO: 6087442 - DNA, 14 bp, Homo sapiens
ccctgggcctgtct

SEQ ID NO: 6087443 - DNA, 17 bp, Homo sapiens
ccctgggcctgtctcag

SEQ ID NO: 6087444 - DNA, 14 bp, Homo sapiens
ccctgggccttggg

SEQ ID NO: 6087445 - DNA, 18 bp, Homo sapiens
ccctgggccttgggctcc

SEQ ID NO: 6087446 - DNA, 23 bp, Homo sapiens
ccctgggcgcagctgaagcctgg

SEQ ID NO: 6087447 - DNA, 17 bp, Homo sapiens
ccctgggctaagcaggg

SEQ ID NO: 6087448 - DNA, 16 bp, Homo sapiens
ccctgggctaccatct

SEQ ID NO: 6087449 - DNA, 18 bp, Homo sapiens
ccctgggctaccatctgc

SEQ ID NO: 6087450 - DNA, 21 bp, Homo sapiens
ccctgggctaccatctgcatg

SEQ ID NO: 6087451 - DNA, 21 bp, Homo sapiens
ccctgggctattgctgctgcc

SEQ ID NO: 6087452 - DNA, 13 bp, Homo sapiens
ccctgggctccac

SEQ ID NO: 6087453 - DNA, 18 bp, Homo sapiens
ccctgggctccacacagc

SEQ ID NO: 6087454 - DNA, 18 bp, Homo sapiens
ccctgggctccctggagg

SEQ ID NO: 6087455 - DNA, 19 bp, Homo sapiens
ccctgggctccctggagga

SEQ ID NO: 6087456 - DNA, 12 bp, Homo sapiens
ccctgggctcct

SEQ ID NO: 6087457 - DNA, 13 bp, Homo sapiens
ccctgggctcctc

SEQ ID NO: 6087458 - DNA, 17 bp, Homo sapiens
ccctgggctctcaccca

SEQ ID NO: 6087459 - DNA, 12 bp, Homo sapiens
ccctgggctctg

SEQ ID NO: 6087460 - DNA, 14 bp, Homo sapiens
ccctgggctctgtg

SEQ ID NO: 6087461 - DNA, 17 bp, Homo sapiens
ccctgggctgaaactga

SEQ ID NO: 6087462 - DNA, 15 bp, Homo sapiens
ccctgggctgatgga

SEQ ID NO: 6087463 - DNA, 13 bp, Homo sapiens
ccctgggctggaa

SEQ ID NO: 6087464 - DNA, 14 bp, Homo sapiens
ccctgggctggcac

SEQ ID NO: 6087465 - DNA, 20 bp, Homo sapiens
ccctgggctggcatggggag

SEQ ID NO: 6087466 - DNA, 23 bp, Homo sapiens
ccctgggctgggcccttcctggc

SEQ ID NO: 6087467 - DNA, 15 bp, Homo sapiens
ccctgggctggggag

SEQ ID NO: 6087468 - DNA, 21 bp, Homo sapiens
ccctgggctggggaggaggag

SEQ ID NO: 6087469 - DNA, 19 bp, Homo sapiens
ccctgggctgtctgtcacc

SEQ ID NO: 6087470 - DNA, 17 bp, Homo sapiens
ccctgggcttggcctgc

SEQ ID NO: 6087471 - DNA, 18 bp, Homo sapiens
ccctgggcttggcctgct

SEQ ID NO: 6087472 - DNA, 20 bp, Homo sapiens
ccctgggcttggcctgctgt

SEQ ID NO: 6087473 - DNA, 22 bp, Homo sapiens
ccctgggcttggcctgctgtga

SEQ ID NO: 6087474 - DNA, 16 bp, Homo sapiens
ccctgggcttggctct

SEQ ID NO: 6087475 - DNA, 17 bp, Homo sapiens
ccctgggcttggctctt

SEQ ID NO: 6087476 - DNA, 22 bp, Homo sapiens
ccctgggctttcacgggcccca

SEQ ID NO: 6087477 - DNA, 19 bp, Homo sapiens
ccctggggaagaggccttg

SEQ ID NO: 6087478 - DNA, 20 bp, Homo sapiens
ccctggggaagaggccttgg

SEQ ID NO: 6087479 - DNA, 22 bp, Homo sapiens
ccctggggaagaggccttgggg

SEQ ID NO: 6087480 - DNA, 18 bp, Homo sapiens
ccctggggaaggagccag

SEQ ID NO: 6087481 - DNA, 10 bp, Homo sapiens
ccctggggac

SEQ ID NO: 6087482 - DNA, 16 bp, Homo sapiens
ccctggggacagagcc

SEQ ID NO: 6087483 - DNA, 17 bp, Homo sapiens
ccctggggacagagcca

SEQ ID NO: 6087484 - DNA, 20 bp, Homo sapiens
ccctggggacagagccaccc

SEQ ID NO: 6087485 - DNA, 19 bp, Homo sapiens
ccctggggacagcaagggc

SEQ ID NO: 6087486 - DNA, 20 bp, Homo sapiens
ccctggggacagcaagggct

SEQ ID NO: 6087487 - DNA, 18 bp, Homo sapiens
ccctggggaccaggagct

SEQ ID NO: 6087488 - DNA, 20 bp, Homo sapiens
ccctggggactctgcttggc

SEQ ID NO: 6087489 - DNA, 21 bp, Homo sapiens
ccctggggacttcaactgccc

SEQ ID NO: 6087490 - DNA, 22 bp, Homo sapiens
ccctggggagaacccttcctgc

SEQ ID NO: 6087491 - DNA, 16 bp, Homo sapiens
ccctggggagccctca

SEQ ID NO: 6087492 - DNA, 22 bp, Homo sapiens
ccctggggagccctcaggctcc

SEQ ID NO: 6087493 - DNA, 22 bp, Homo sapiens
ccctggggaggacccctgccct

SEQ ID NO: 6087494 - DNA, 12 bp, Homo sapiens
ccctggggaggg

SEQ ID NO: 6087495 - DNA, 19 bp, Homo sapiens
ccctggggatatgcaaccc

SEQ ID NO: 6087496 - DNA, 13 bp, Homo sapiens
ccctggggcaggg

SEQ ID NO: 6087497 - DNA, 20 bp, Homo sapiens
ccctggggcagggtgggggg

SEQ ID NO: 6087498 - DNA, 22 bp, Homo sapiens
ccctggggcagggtggggggcc

SEQ ID NO: 6087499 - DNA, 18 bp, Homo sapiens
ccctggggcatcatgggc

SEQ ID NO: 6087500 - DNA, 20 bp, Homo sapiens
ccctggggcatccaccttcc

SEQ ID NO: 6087501 - DNA, 17 bp, Homo sapiens
ccctggggcccagcccc

SEQ ID NO: 6087502 - DNA, 13 bp, Homo sapiens
ccctggggcccca

SEQ ID NO: 6087503 - DNA, 20 bp, Homo sapiens
ccctggggcctgactgctca

SEQ ID NO: 6087504 - DNA, 18 bp, Homo sapiens
ccctggggcctggacctg

SEQ ID NO: 6087505 - DNA, 18 bp, Homo sapiens
ccctggggcctgtactgc

SEQ ID NO: 6087506 - DNA, 23 bp, Homo sapiens
aaatgcccaaaagaggtgtcatg

SEQ ID NO: 6087507 - DNA, 14 bp, Homo sapiens
aaatgcccagcccc

SEQ ID NO: 6087508 - DNA, 11 bp, Homo sapiens
aaatgcccagt

SEQ ID NO: 6087509 - DNA, 17 bp, Homo sapiens
aaatgcccctcccagat

SEQ ID NO: 6087510 - DNA, 18 bp, Homo sapiens
aaatgccctttgatgttt

SEQ ID NO: 6087511 - DNA, 15 bp, Homo sapiens
aaatgcctaagaaga

SEQ ID NO: 6087512 - DNA, 16 bp, Homo sapiens
aaatgcctagttttta

SEQ ID NO: 6087513 - DNA, 19 bp, Homo sapiens
aaatgcctcagtgtatttg

SEQ ID NO: 6087514 - DNA, 14 bp, Homo sapiens
aaatgcctctgcct

SEQ ID NO: 6087515 - DNA, 22 bp, Homo sapiens
aaatgcctcttaaattatatat

SEQ ID NO: 6087516 - DNA, 15 bp, Homo sapiens
aaatgcctgactcag

SEQ ID NO: 6087517 - DNA, 18 bp, Homo sapiens
aaatgccttaaaatggaa

SEQ ID NO: 6087518 - DNA, 15 bp, Homo sapiens
aaatgccttactttg

SEQ ID NO: 6087519 - DNA, 18 bp, Homo sapiens
aaatgccttactttgtat

SEQ ID NO: 6087520 - DNA, 19 bp, Homo sapiens
aaatgccttactttgtatg

SEQ ID NO: 6087521 - DNA, 17 bp, Homo sapiens
aaatgccttagaaatgt

SEQ ID NO: 6087522 - DNA, 18 bp, Homo sapiens
aaatgccttcatgaatct

SEQ ID NO: 6087523 - DNA, 16 bp, Homo sapiens
aaatgccttgtataaa

SEQ ID NO: 6087524 - DNA, 17 bp, Homo sapiens
aaatgcctttgagacag

SEQ ID NO: 6087525 - DNA, 20 bp, Homo sapiens
aaatgcctttgagacagttt

SEQ ID NO: 6087526 - DNA, 22 bp, Homo sapiens
aaatgccttttcaaatgcagca

SEQ ID NO: 6087527 - DNA, 16 bp, Homo sapiens
aaatgccttttcccaa

SEQ ID NO: 6087528 - DNA, 16 bp, Homo sapiens
aaatgcgagactctga

SEQ ID NO: 6087529 - DNA, 21 bp, Homo sapiens
aaatgcggaccaaactacttc

SEQ ID NO: 6087530 - DNA, 12 bp, Homo sapiens
aaatgctaaact

SEQ ID NO: 6087531 - DNA, 22 bp, Homo sapiens
aaatgctaaccttgtagcatgt

SEQ ID NO: 6087532 - DNA, 15 bp, Homo sapiens
aaatgctaatattaa

SEQ ID NO: 6087533 - DNA, 18 bp, Homo sapiens
aaatgctaatattaaaag

SEQ ID NO: 6087534 - DNA, 18 bp, Homo sapiens
aaatgctacctctgatca

SEQ ID NO: 6087535 - DNA, 20 bp, Homo sapiens
aaatgctacctctgatcaaa

SEQ ID NO: 6087536 - DNA, 15 bp, Homo sapiens
aaatgctagaaaaat

SEQ ID NO: 6087537 - DNA, 21 bp, Homo sapiens
aaatgctatgtcatttcatgt

SEQ ID NO: 6087538 - DNA, 13 bp, Homo sapiens
aaatgctattcag

SEQ ID NO: 6087539 - DNA, 13 bp, Homo sapiens
aaatgctatttta

SEQ ID NO: 6087540 - DNA, 17 bp, Homo sapiens
aaatgctattttaaaat

SEQ ID NO: 6087541 - DNA, 14 bp, Homo sapiens
aaatgctatttttt

SEQ ID NO: 6087542 - DNA, 14 bp, Homo sapiens
aaatgctcataaag

SEQ ID NO: 6087543 - DNA, 18 bp, Homo sapiens
aaatgctcataaagatgt

SEQ ID NO: 6087544 - DNA, 23 bp, Homo sapiens
aaatgctcccacctgaatttgta

SEQ ID NO: 6087545 - DNA, 22 bp, Homo sapiens
aaatgctcctagaagtcttaat

SEQ ID NO: 6087546 - DNA, 23 bp, Homo sapiens
aaatgctcctagaagtcttaatt

SEQ ID NO: 6087547 - DNA, 18 bp, Homo sapiens
aaatgctcgtcatacagt

SEQ ID NO: 6087548 - DNA, 21 bp, Homo sapiens
aaatgctcgtcatacagtaaa

SEQ ID NO: 6087549 - DNA, 13 bp, Homo sapiens
aaatgctctgatt

SEQ ID NO: 6087550 - DNA, 18 bp, Homo sapiens
aaatgctcttaaaatatc

SEQ ID NO: 6087551 - DNA, 23 bp, Homo sapiens
aaatgctcttatttcatcattca

SEQ ID NO: 6087552 - DNA, 19 bp, Homo sapiens
aaatgctgacaaaaatatt

SEQ ID NO: 6087553 - DNA, 16 bp, Homo sapiens
aaatgctgacccatgg

SEQ ID NO: 6087554 - DNA, 14 bp, Homo sapiens
aaatgctgcatttt

SEQ ID NO: 6087555 - DNA, 13 bp, Homo sapiens
aaatgctgcctgc

SEQ ID NO: 6087556 - DNA, 20 bp, Homo sapiens
aaatgctgcgcccttcccca

SEQ ID NO: 6087557 - DNA, 10 bp, Homo sapiens
aaatgctgct

SEQ ID NO: 6087558 - DNA, 13 bp, Homo sapiens
aaatgctgcttct

SEQ ID NO: 6087559 - DNA, 16 bp, Homo sapiens
aaatgctgcttctcct

SEQ ID NO: 6087560 - DNA, 20 bp, Homo sapiens
aaatgctgcttctcctccca

SEQ ID NO: 6087561 - DNA, 14 bp, Homo sapiens
aaatgctgctttgt

SEQ ID NO: 6087562 - DNA, 17 bp, Homo sapiens
aaatgctgcttttaaaa

SEQ ID NO: 6087563 - DNA, 20 bp, Homo sapiens
aaatgctggggtcatataaa

SEQ ID NO: 6087564 - DNA, 14 bp, Homo sapiens
aaatgctgtaaata

SEQ ID NO: 6087565 - DNA, 17 bp, Homo sapiens
aaatgctgtaaatattt

SEQ ID NO: 6087566 - DNA, 20 bp, Homo sapiens
aaatgctgtaaatatttcat

SEQ ID NO: 6087567 - DNA, 13 bp, Homo sapiens
aaatgctgtatgt

SEQ ID NO: 6087568 - DNA, 14 bp, Homo sapiens
aaatgctgtatgtc

SEQ ID NO: 6087569 - DNA, 19 bp, Homo sapiens
aaatgctgtatttttacag

SEQ ID NO: 6087570 - DNA, 11 bp, Homo sapiens
aaatgctgtgg

SEQ ID NO: 6087571 - DNA, 23 bp, Homo sapiens
aaatgctgtggttcactgcactg

SEQ ID NO: 6087572 - DNA, 19 bp, Homo sapiens
aaatgctgttggtgagaat

SEQ ID NO: 6087573 - DNA, 15 bp, Homo sapiens
aaatgcttaaaaaat

SEQ ID NO: 6087574 - DNA, 19 bp, Homo sapiens
aaatgcttaaaaaataata

SEQ ID NO: 6087575 - DNA, 19 bp, Homo sapiens
aaatgcttcactgtacgta

SEQ ID NO: 6087576 - DNA, 15 bp, Homo sapiens
aaatgcttcattgaa

SEQ ID NO: 6087577 - DNA, 22 bp, Homo sapiens
aaatgcttccactgcaagtctg

SEQ ID NO: 6087578 - DNA, 11 bp, Homo sapiens
aaatgcttctt

SEQ ID NO: 6087579 - DNA, 18 bp, Homo sapiens
aaatgcttgggtacactt

SEQ ID NO: 6087580 - DNA, 13 bp, Homo sapiens
aaatgctttaaat

SEQ ID NO: 6087581 - DNA, 11 bp, Homo sapiens
aaatgctttct

SEQ ID NO: 6087582 - DNA, 17 bp, Homo sapiens
aaatgctttgaaaatgt

SEQ ID NO: 6087583 - DNA, 19 bp, Homo sapiens
aaatgctttgtgtgattga

SEQ ID NO: 6087584 - DNA, 11 bp, Homo sapiens
aaatgctttta

SEQ ID NO: 6087585 - DNA, 19 bp, Homo sapiens
aaatgcttttatattctaa

SEQ ID NO: 6087586 - DNA, 20 bp, Homo sapiens
aaatgcttttatattctaat

SEQ ID NO: 6087587 - DNA, 21 bp, Homo sapiens
aaatgcttttcactttctgtc

SEQ ID NO: 6087588 - DNA, 20 bp, Homo sapiens
aaatgctttttatttctgca

SEQ ID NO: 6087589 - DNA, 12 bp, Homo sapiens
aaatggaaaaaa

SEQ ID NO: 6087590 - DNA, 16 bp, Homo sapiens
aaatggaaaagagaga

SEQ ID NO: 6087591 - DNA, 16 bp, Homo sapiens
aaatggaaaatataca

SEQ ID NO: 6087592 - DNA, 13 bp, Homo sapiens
aaatggaaaatta

SEQ ID NO: 6087593 - DNA, 10 bp, Homo sapiens
aaatggaaac

SEQ ID NO: 6087594 - DNA, 14 bp, Homo sapiens
aaatggaaagaagg

SEQ ID NO: 6087595 - DNA, 15 bp, Homo sapiens
aaatggaaagaagga

SEQ ID NO: 6087596 - DNA, 17 bp, Homo sapiens
aaatggaaagaaggaaa

SEQ ID NO: 6087597 - DNA, 20 bp, Homo sapiens
aaatggaaagaaggaaaaaa

SEQ ID NO: 6087598 - DNA, 14 bp, Homo sapiens
aaatggaaatgtaa

SEQ ID NO: 6087599 - DNA, 15 bp, Homo sapiens
aaatggaaatgtaat

SEQ ID NO: 6087600 - DNA, 17 bp, Homo sapiens
aaatggaaatgtaataa

SEQ ID NO: 6087601 - DNA, 12 bp, Homo sapiens
aaatggaaattt

SEQ ID NO: 6087602 - DNA, 18 bp, Homo sapiens
aaatggaaatttaaatga

SEQ ID NO: 6087603 - DNA, 19 bp, Homo sapiens
aaatggaacaaacaatgaa

SEQ ID NO: 6087604 - DNA, 22 bp, Homo sapiens
aaatggaactccccagggcctc

SEQ ID NO: 6087605 - DNA, 20 bp, Homo sapiens
aaatggaagacctaaggcag

SEQ ID NO: 6087606 - DNA, 20 bp, Homo sapiens
aaatggaagagaagagaaag

SEQ ID NO: 6087607 - DNA, 16 bp, Homo sapiens
aaatggaataacatat

SEQ ID NO: 6087608 - DNA, 21 bp, Homo sapiens
aaatggacacaaattttcaag

SEQ ID NO: 6087609 - DNA, 15 bp, Homo sapiens
aaatggacatggtgg

SEQ ID NO: 6087610 - DNA, 13 bp, Homo sapiens
aaatggacattga

SEQ ID NO: 6087611 - DNA, 23 bp, Homo sapiens
aaatggacattttcttttattat

SEQ ID NO: 6087612 - DNA, 17 bp, Homo sapiens
aaatggacgtgttatga

SEQ ID NO: 6087613 - DNA, 20 bp, Homo sapiens
aaatggacgtgttatgactc

SEQ ID NO: 6087614 - DNA, 21 bp, Homo sapiens
aaatggacgtgttatgactcc

SEQ ID NO: 6087615 - DNA, 15 bp, Homo sapiens
aaatggactacagta

SEQ ID NO: 6087616 - DNA, 21 bp, Homo sapiens
aaatggactatacatactata

SEQ ID NO: 6087617 - DNA, 23 bp, Homo sapiens
aaatggactggagctcatctgca

SEQ ID NO: 6087618 - DNA, 20 bp, Homo sapiens
aaatggactgtggtgacttt

SEQ ID NO: 6087619 - DNA, 14 bp, Homo sapiens
aaatggacttgctt

SEQ ID NO: 6087620 - DNA, 19 bp, Homo sapiens
aaatggagcttgtacatat

SEQ ID NO: 6087621 - DNA, 20 bp, Homo sapiens
aaatggagcttgtacatatt

SEQ ID NO: 6087622 - DNA, 17 bp, Homo sapiens
aaatggagctttctgta

SEQ ID NO: 6087623 - DNA, 20 bp, Homo sapiens
aaatggaggatctctaaaga

SEQ ID NO: 6087624 - DNA, 22 bp, Homo sapiens
aaatggaggatctctaaagagc

SEQ ID NO: 6087625 - DNA, 17 bp, Homo sapiens
aaatggaggcttttcac

SEQ ID NO: 6087626 - DNA, 13 bp, Homo sapiens
aaatggatactgg

SEQ ID NO: 6087627 - DNA, 16 bp, Homo sapiens
aaatggatagaaaaaa

SEQ ID NO: 6087628 - DNA, 19 bp, Homo sapiens
aaatggatagaaaaaaact

SEQ ID NO: 6087629 - DNA, 21 bp, Homo sapiens
aaatggatagaaaaaaactaa

SEQ ID NO: 6087630 - DNA, 19 bp, Homo sapiens
aaatggatattattagaaa

SEQ ID NO: 6087631 - DNA, 16 bp, Homo sapiens
aaatggatcaagtgcg

SEQ ID NO: 6087632 - DNA, 19 bp, Homo sapiens
aaatggatgacaaagaaaa

SEQ ID NO: 6087633 - DNA, 23 bp, Homo sapiens
aaatggatgacaaagaaaatgag

SEQ ID NO: 6087634 - DNA, 17 bp, Homo sapiens
aaatggatgcaaagtac

SEQ ID NO: 6087635 - DNA, 22 bp, Homo sapiens
aaatggatgccttgaataataa

SEQ ID NO: 6087636 - DNA, 21 bp, Homo sapiens
aaatggattttagtcaaatat

SEQ ID NO: 6087637 - DNA, 18 bp, Homo sapiens
aaatggcaacaaactgca

SEQ ID NO: 6087638 - DNA, 20 bp, Homo sapiens
aaatggcaacaaactgcaca

SEQ ID NO: 6087639 - DNA, 20 bp, Homo sapiens
aaatggcaagagatcatatc

SEQ ID NO: 6087640 - DNA, 13 bp, Homo sapiens
aaatggcagaaag

SEQ ID NO: 6087641 - DNA, 23 bp, Homo sapiens
aaatggcagagaagatgaaattt

SEQ ID NO: 6087642 - DNA, 13 bp, Homo sapiens
aaatggcagtttt

SEQ ID NO: 6087643 - DNA, 22 bp, Homo sapiens
aaatggcatcagcactttaacc

SEQ ID NO: 6087644 - DNA, 14 bp, Homo sapiens
aaatggccagtgct

SEQ ID NO: 6087645 - DNA, 20 bp, Homo sapiens
aaatggccagttttctggta

SEQ ID NO: 6087646 - DNA, 13 bp, Homo sapiens
aaatggccatttg

SEQ ID NO: 6087647 - DNA, 23 bp, Homo sapiens
aaatggccatttgctttttcacc

SEQ ID NO: 6087648 - DNA, 22 bp, Homo sapiens
aaatggcccatttaatgattga

SEQ ID NO: 6087649 - DNA, 15 bp, Homo sapiens
aaatggcctcatgtg

SEQ ID NO: 6087650 - DNA, 13 bp, Homo sapiens
aaatggccttccc

SEQ ID NO: 6087651 - DNA, 21 bp, Homo sapiens
aaatggccttcccgccggagg

SEQ ID NO: 6087652 - DNA, 15 bp, Homo sapiens
aaatggcgaatgtca

SEQ ID NO: 6087653 - DNA, 21 bp, Homo sapiens
aaatggcgtctgctctggtgg

SEQ ID NO: 6087654 - DNA, 17 bp, Homo sapiens
aaatggctaataaactg

SEQ ID NO: 6087655 - DNA, 18 bp, Homo sapiens
aaatggctaataaactgt

SEQ ID NO: 6087656 - DNA, 20 bp, Homo sapiens
aaatggctaataaactgtat

SEQ ID NO: 6087657 - DNA, 20 bp, Homo sapiens
aaatggctctgtgaaatcag

SEQ ID NO: 6087658 - DNA, 11 bp, Homo sapiens
aaatggctgct

SEQ ID NO: 6087659 - DNA, 12 bp, Homo sapiens
aaatggctgggg

SEQ ID NO: 6087660 - DNA, 21 bp, Homo sapiens
aaatggctgtaatcatttgtt

SEQ ID NO: 6087661 - DNA, 18 bp, Homo sapiens
aaatggcttcctggcaat

SEQ ID NO: 6087662 - DNA, 23 bp, Homo sapiens
aaatggcttctatgatcagaact

SEQ ID NO: 6087663 - DNA, 21 bp, Homo sapiens
aaatggctttaatcaattcta

SEQ ID NO: 6087664 - DNA, 22 bp, Homo sapiens
aaatggcttttcttacccagat

SEQ ID NO: 6087665 - DNA, 15 bp, Homo sapiens
aaatggcttttgcca

SEQ ID NO: 6087666 - DNA, 17 bp, Homo sapiens
aaatgggaaaaaaacaa

SEQ ID NO: 6087667 - DNA, 16 bp, Homo sapiens
aaatgggaaaaaactt

SEQ ID NO: 6087668 - DNA, 19 bp, Homo sapiens
aaatgggaaaaataaaaga

SEQ ID NO: 6087669 - DNA, 14 bp, Homo sapiens
aaatgggaaaatat

SEQ ID NO: 6087670 - DNA, 22 bp, Homo sapiens
aaatgggaaatgcctaagaaga

SEQ ID NO: 6087671 - DNA, 13 bp, Homo sapiens
aaatgggaaatgt

SEQ ID NO: 6087672 - DNA, 15 bp, Homo sapiens
aaatgggaatcatgg

SEQ ID NO: 6087673 - DNA, 15 bp, Homo sapiens
aaatgggaatttata

SEQ ID NO: 6087674 - DNA, 19 bp, Homo sapiens
aaatgggactgatgtcatc

SEQ ID NO: 6087675 - DNA, 20 bp, Homo sapiens
aaatgggactgatgtcatct

SEQ ID NO: 6087676 - DNA, 20 bp, Homo sapiens
aaatgggacttcttttcaca

SEQ ID NO: 6087677 - DNA, 15 bp, Homo sapiens
aaatgggagccagga

SEQ ID NO: 6087678 - DNA, 16 bp, Homo sapiens
aaatgggagccaggag

SEQ ID NO: 6087679 - DNA, 16 bp, Homo sapiens
aaatgggaggaggaaa

SEQ ID NO: 6087680 - DNA, 19 bp, Homo sapiens
aaatgggatctaattaaac

SEQ ID NO: 6087681 - DNA, 20 bp, Homo sapiens
aaatgggcacttaaagcttt

SEQ ID NO: 6087682 - DNA, 18 bp, Homo sapiens
aaatgggcagagcagaga

SEQ ID NO: 6087683 - DNA, 11 bp, Homo sapiens
aaatgggcagt

SEQ ID NO: 6087684 - DNA, 14 bp, Homo sapiens
aaatgggcctgcct

SEQ ID NO: 6087685 - DNA, 20 bp, Homo sapiens
ccctggggcgtgcagcaggg

SEQ ID NO: 6087686 - DNA, 23 bp, Homo sapiens
ccctggggctgagtctccagggc

SEQ ID NO: 6087687 - DNA, 14 bp, Homo sapiens
ccctggggctgccc

SEQ ID NO: 6087688 - DNA, 13 bp, Homo sapiens
ccctggggctgct

SEQ ID NO: 6087689 - DNA, 13 bp, Homo sapiens
ccctggggctggc

SEQ ID NO: 6087690 - DNA, 14 bp, Homo sapiens
ccctggggctggct

SEQ ID NO: 6087691 - DNA, 16 bp, Homo sapiens
ccctggggctgggccc

SEQ ID NO: 6087692 - DNA, 13 bp, Homo sapiens
ccctggggctggt

SEQ ID NO: 6087693 - DNA, 16 bp, Homo sapiens
ccctggggctggtgga

SEQ ID NO: 6087694 - DNA, 16 bp, Homo sapiens
ccctggggctgtgcat

SEQ ID NO: 6087695 - DNA, 17 bp, Homo sapiens
ccctggggctgtgcatt

SEQ ID NO: 6087696 - DNA, 18 bp, Homo sapiens
ccctggggcttctcctga

SEQ ID NO: 6087697 - DNA, 16 bp, Homo sapiens
ccctgggggagcctct

SEQ ID NO: 6087698 - DNA, 19 bp, Homo sapiens
ccctgggggaggcttccag

SEQ ID NO: 6087699 - DNA, 21 bp, Homo sapiens
ccctgggggaggcttccagct

SEQ ID NO: 6087700 - DNA, 20 bp, Homo sapiens
ccctgggggataccagctga

SEQ ID NO: 6087701 - DNA, 16 bp, Homo sapiens
ccctgggggcatcctg

SEQ ID NO: 6087702 - DNA, 19 bp, Homo sapiens
ccctgggggcatcctgctt

SEQ ID NO: 6087703 - DNA, 23 bp, Homo sapiens
ccctgggggcatcctgcttcctg

SEQ ID NO: 6087704 - DNA, 13 bp, Homo sapiens
ccctgggggccag

SEQ ID NO: 6087705 - DNA, 14 bp, Homo sapiens
ccctgggggccagc

SEQ ID NO: 6087706 - DNA, 15 bp, Homo sapiens
ccctgggggccagct

SEQ ID NO: 6087707 - DNA, 23 bp, Homo sapiens
ccctgggggccagctggtgctgc

SEQ ID NO: 6087708 - DNA, 22 bp, Homo sapiens
ccctgggggcggccagccctcc

SEQ ID NO: 6087709 - DNA, 13 bp, Homo sapiens
ccctgggggcggg

SEQ ID NO: 6087710 - DNA, 18 bp, Homo sapiens
ccctgggggcgggactcc

SEQ ID NO: 6087711 - DNA, 18 bp, Homo sapiens
ccctgggggctagcagaa

SEQ ID NO: 6087712 - DNA, 18 bp, Homo sapiens
ccctggggggcacagcca

SEQ ID NO: 6087713 - DNA, 17 bp, Homo sapiens
ccctgggggtcccagga

SEQ ID NO: 6087714 - DNA, 18 bp, Homo sapiens
ccctgggggtggggctcc

SEQ ID NO: 6087715 - DNA, 23 bp, Homo sapiens
ccctgggggtttaagctctgccc

SEQ ID NO: 6087716 - DNA, 21 bp, Homo sapiens
ccctgggggtttcacctgggc

SEQ ID NO: 6087717 - DNA, 18 bp, Homo sapiens
ccctggggtatgagctgc

SEQ ID NO: 6087718 - DNA, 14 bp, Homo sapiens
ccctggggtctctg

SEQ ID NO: 6087719 - DNA, 15 bp, Homo sapiens
ccctggggtctctga

SEQ ID NO: 6087720 - DNA, 19 bp, Homo sapiens
ccctggggtctctgagcag

SEQ ID NO: 6087721 - DNA, 22 bp, Homo sapiens
ccctggggtctctgagcagtgg

SEQ ID NO: 6087722 - DNA, 13 bp, Homo sapiens
ccctggggtggcc

SEQ ID NO: 6087723 - DNA, 15 bp, Homo sapiens
ccctggggtggccag

SEQ ID NO: 6087724 - DNA, 24 bp, Homo sapiens
ccctggggtggcgtctgcctagga

SEQ ID NO: 6087725 - DNA, 20 bp, Homo sapiens
ccctggggtttccacacagg

SEQ ID NO: 6087726 - DNA, 23 bp, Homo sapiens
ccctgggtagcgggggagggtag

SEQ ID NO: 6087727 - DNA, 21 bp, Homo sapiens
ccctgggtcctcgggcccctg

SEQ ID NO: 6087728 - DNA, 14 bp, Homo sapiens
ccctgggtcctgcc

SEQ ID NO: 6087729 - DNA, 15 bp, Homo sapiens
ccctgggtctgggga

SEQ ID NO: 6087730 - DNA, 11 bp, Homo sapiens
ccctgggtgga

SEQ ID NO: 6087731 - DNA, 16 bp, Homo sapiens
ccctgggtgggtggtg

SEQ ID NO: 6087732 - DNA, 22 bp, Homo sapiens
ccctgggtgggtggtggggagg

SEQ ID NO: 6087733 - DNA, 23 bp, Homo sapiens
ccctgggtgggtggtggggaggg

SEQ ID NO: 6087734 - DNA, 20 bp, Homo sapiens
ccctgggtgtccccgctgct

SEQ ID NO: 6087735 - DNA, 22 bp, Homo sapiens
ccctgggtgtccccgctgctgt

SEQ ID NO: 6087736 - DNA, 18 bp, Homo sapiens
ccctgggttaacaaatga

SEQ ID NO: 6087737 - DNA, 21 bp, Homo sapiens
ccctgggttagactgccagct

SEQ ID NO: 6087738 - DNA, 22 bp, Homo sapiens
ccctgggttcagaaatgctgcc

SEQ ID NO: 6087739 - DNA, 17 bp, Homo sapiens
ccctgggttcttccaca

SEQ ID NO: 6087740 - DNA, 23 bp, Homo sapiens
ccctgggttcttccacagcacaa

SEQ ID NO: 6087741 - DNA, 19 bp, Homo sapiens
ccctgggtttgggagccag

SEQ ID NO: 6087742 - DNA, 20 bp, Homo sapiens
ccctgggtttgggagccagg

SEQ ID NO: 6087743 - DNA, 20 bp, Homo sapiens
ccctggtaagaaaaagcaaa

SEQ ID NO: 6087744 - DNA, 18 bp, Homo sapiens
ccctggtaagcagaggct

SEQ ID NO: 6087745 - DNA, 14 bp, Homo sapiens
ccctggtaaggctg

SEQ ID NO: 6087746 - DNA, 23 bp, Homo sapiens
ccctggtaagtaatgagggctga

SEQ ID NO: 6087747 - DNA, 22 bp, Homo sapiens
ccctggtcacccgactttggaa

SEQ ID NO: 6087748 - DNA, 11 bp, Homo sapiens
ccctggtccct

SEQ ID NO: 6087749 - DNA, 18 bp, Homo sapiens
ccctggtccctctgcagt

SEQ ID NO: 6087750 - DNA, 15 bp, Homo sapiens
ccctggtcctggcct

SEQ ID NO: 6087751 - DNA, 16 bp, Homo sapiens
ccctggtccttccagg

SEQ ID NO: 6087752 - DNA, 23 bp, Homo sapiens
ccctggtctcctccccgtagcca

SEQ ID NO: 6087753 - DNA, 16 bp, Homo sapiens
ccctggtctggctctg

SEQ ID NO: 6087754 - DNA, 14 bp, Homo sapiens
ccctggtctgtgga

SEQ ID NO: 6087755 - DNA, 21 bp, Homo sapiens
ccctggtgaatcacctggctg

SEQ ID NO: 6087756 - DNA, 13 bp, Homo sapiens
ccctggtgacatc

SEQ ID NO: 6087757 - DNA, 15 bp, Homo sapiens
ccctggtgacctcct

SEQ ID NO: 6087758 - DNA, 16 bp, Homo sapiens
ccctggtgacctcctg

SEQ ID NO: 6087759 - DNA, 21 bp, Homo sapiens
ccctggtgacctcctgtcact

SEQ ID NO: 6087760 - DNA, 19 bp, Homo sapiens
ccctggtgagggagcctcg

SEQ ID NO: 6087761 - DNA, 21 bp, Homo sapiens
ccctggtgcactggccccacc

SEQ ID NO: 6087762 - DNA, 19 bp, Homo sapiens
ccctggtgcagaggtgagc

SEQ ID NO: 6087763 - DNA, 14 bp, Homo sapiens
ccctggtgcctctg

SEQ ID NO: 6087764 - DNA, 17 bp, Homo sapiens
ccctggtgcctctgtgc

SEQ ID NO: 6087765 - DNA, 23 bp, Homo sapiens
ccctggtgcctgcaggccaccca

SEQ ID NO: 6087766 - DNA, 13 bp, Homo sapiens
ccctggtgctcct

SEQ ID NO: 6087767 - DNA, 16 bp, Homo sapiens
ccctggtgctgccaca

SEQ ID NO: 6087768 - DNA, 17 bp, Homo sapiens
ccctggtgctgccacac

SEQ ID NO: 6087769 - DNA, 21 bp, Homo sapiens
ccctggtgctgccacacttca

SEQ ID NO: 6087770 - DNA, 10 bp, Homo sapiens
ccctggtgga

SEQ ID NO: 6087771 - DNA, 20 bp, Homo sapiens
ccctggtggacagtcctggg

SEQ ID NO: 6087772 - DNA, 21 bp, Homo sapiens
ccctggtggacagtcctggga

SEQ ID NO: 6087773 - DNA, 23 bp, Homo sapiens
ccctggtggaggcttcttgccca

SEQ ID NO: 6087774 - DNA, 14 bp, Homo sapiens
ccctggtggcagct

SEQ ID NO: 6087775 - DNA, 14 bp, Homo sapiens
ccctggtggcagtg

SEQ ID NO: 6087776 - DNA, 16 bp, Homo sapiens
ccctggtggcagtggg

SEQ ID NO: 6087777 - DNA, 21 bp, Homo sapiens
ccctggtggcagtgggagctg

SEQ ID NO: 6087778 - DNA, 20 bp, Homo sapiens
ccctggtggccaagcctgcc

SEQ ID NO: 6087779 - DNA, 20 bp, Homo sapiens
ccctggtggccctctcccct

SEQ ID NO: 6087780 - DNA, 20 bp, Homo sapiens
ccctggtggcctgccccagc

SEQ ID NO: 6087781 - DNA, 14 bp, Homo sapiens
ccctggtggctgca

SEQ ID NO: 6087782 - DNA, 17 bp, Homo sapiens
ccctggtggctgcaggc

SEQ ID NO: 6087783 - DNA, 18 bp, Homo sapiens
ccctggtggctgcaggca

SEQ ID NO: 6087784 - DNA, 21 bp, Homo sapiens
ccctggtggctgcaggcaccg

SEQ ID NO: 6087785 - DNA, 17 bp, Homo sapiens
ccctggtgggctgttca

SEQ ID NO: 6087786 - DNA, 20 bp, Homo sapiens
ccctggtggggtgtgcatgc

SEQ ID NO: 6087787 - DNA, 20 bp, Homo sapiens
ccctggtggtattttatttt

SEQ ID NO: 6087788 - DNA, 13 bp, Homo sapiens
ccctggtggttca

SEQ ID NO: 6087789 - DNA, 16 bp, Homo sapiens
ccctggtggttgctgt

SEQ ID NO: 6087790 - DNA, 16 bp, Homo sapiens
ccctggtgtccctgcc

SEQ ID NO: 6087791 - DNA, 18 bp, Homo sapiens
ccctggtgtccctgcctg

SEQ ID NO: 6087792 - DNA, 19 bp, Homo sapiens
ccctggtgtccctgcctgg

SEQ ID NO: 6087793 - DNA, 14 bp, Homo sapiens
ccctggtgtgtttc

SEQ ID NO: 6087794 - DNA, 21 bp, Homo sapiens
ccctggtgtttctagcactgg

SEQ ID NO: 6087795 - DNA, 20 bp, Homo sapiens
ccctggttagctgacagtca

SEQ ID NO: 6087796 - DNA, 17 bp, Homo sapiens
ccctggttcccccagga

SEQ ID NO: 6087797 - DNA, 20 bp, Homo sapiens
ccctggttcctgctgtcctg

SEQ ID NO: 6087798 - DNA, 22 bp, Homo sapiens
ccctggttcctgctgtcctggt

SEQ ID NO: 6087799 - DNA, 21 bp, Homo sapiens
ccctggttctccatccccatg

SEQ ID NO: 6087800 - DNA, 13 bp, Homo sapiens
ccctggttgcctc

SEQ ID NO: 6087801 - DNA, 20 bp, Homo sapiens
ccctggtttcactggcccaa

SEQ ID NO: 6087802 - DNA, 17 bp, Homo sapiens
ccctggtttcctgccct

SEQ ID NO: 6087803 - DNA, 16 bp, Homo sapiens
ccctggtttgaaattt

SEQ ID NO: 6087804 - DNA, 15 bp, Homo sapiens
ccctggtttgcagct

SEQ ID NO: 6087805 - DNA, 20 bp, Homo sapiens
ccctggttttaccccagctc

SEQ ID NO: 6087806 - DNA, 22 bp, Homo sapiens
ccctggttttaccccagctcca

SEQ ID NO: 6087807 - DNA, 19 bp, Homo sapiens
ccctgtaaaagagaggggc

SEQ ID NO: 6087808 - DNA, 20 bp, Homo sapiens
ccctgtaaagggtcagggtg

SEQ ID NO: 6087809 - DNA, 11 bp, Homo sapiens
ccctgtaactt

SEQ ID NO: 6087810 - DNA, 22 bp, Homo sapiens
ccctgtaaggttccatccaccc

SEQ ID NO: 6087811 - DNA, 13 bp, Homo sapiens
ccctgtacagtga

SEQ ID NO: 6087812 - DNA, 15 bp, Homo sapiens
ccctgtacccacccc

SEQ ID NO: 6087813 - DNA, 17 bp, Homo sapiens
ccctgtacccagccacc

SEQ ID NO: 6087814 - DNA, 14 bp, Homo sapiens
ccctgtacccagct

SEQ ID NO: 6087815 - DNA, 20 bp, Homo sapiens
ccctgtacctcatcccatga

SEQ ID NO: 6087816 - DNA, 20 bp, Homo sapiens
ccctgtacctctctctgctc

SEQ ID NO: 6087817 - DNA, 23 bp, Homo sapiens
ccctgtacctctctctgctcctc

SEQ ID NO: 6087818 - DNA, 19 bp, Homo sapiens
ccctgtaccttttgaggag

SEQ ID NO: 6087819 - DNA, 18 bp, Homo sapiens
ccctgtactgttctgtgt

SEQ ID NO: 6087820 - DNA, 19 bp, Homo sapiens
ccctgtagactagtgccgt

SEQ ID NO: 6087821 - DNA, 21 bp, Homo sapiens
ccctgtagagtgggagctgag

SEQ ID NO: 6087822 - DNA, 15 bp, Homo sapiens
ccctgtagatgttct

SEQ ID NO: 6087823 - DNA, 16 bp, Homo sapiens
ccctgtagatgttcta

SEQ ID NO: 6087824 - DNA, 13 bp, Homo sapiens
ccctgtagctcct

SEQ ID NO: 6087825 - DNA, 15 bp, Homo sapiens
ccctgtaggcctcag

SEQ ID NO: 6087826 - DNA, 18 bp, Homo sapiens
ccctgtagttaggcctgg

SEQ ID NO: 6087827 - DNA, 22 bp, Homo sapiens
ccctgtagttgacaattctgca

SEQ ID NO: 6087828 - DNA, 15 bp, Homo sapiens
ccctgtatatagccc

SEQ ID NO: 6087829 - DNA, 16 bp, Homo sapiens
ccctgtatcaccccct

SEQ ID NO: 6087830 - DNA, 14 bp, Homo sapiens
ccctgtatggcact

SEQ ID NO: 6087831 - DNA, 17 bp, Homo sapiens
ccctgtcaagcttctct

SEQ ID NO: 6087832 - DNA, 21 bp, Homo sapiens
ccctgtcaagttaacaaggaa

SEQ ID NO: 6087833 - DNA, 9 bp, Homo sapiens
ccctgtcac

SEQ ID NO: 6087834 - DNA, 12 bp, Homo sapiens
ccctgtcacaca

SEQ ID NO: 6087835 - DNA, 16 bp, Homo sapiens
ccctgtcacacactgg

SEQ ID NO: 6087836 - DNA, 17 bp, Homo sapiens
ccctgtcacacactgga

SEQ ID NO: 6087837 - DNA, 19 bp, Homo sapiens
ccctgtcacacactggacc

SEQ ID NO: 6087838 - DNA, 20 bp, Homo sapiens
ccctgtcacacactggaccc

SEQ ID NO: 6087839 - DNA, 14 bp, Homo sapiens
ccctgtcacctctt

SEQ ID NO: 6087840 - DNA, 13 bp, Homo sapiens
ccctgtcacgctc

SEQ ID NO: 6087841 - DNA, 16 bp, Homo sapiens
ccctgtcactgtccag

SEQ ID NO: 6087842 - DNA, 19 bp, Homo sapiens
ccctgtcagaatcatgctg

SEQ ID NO: 6087843 - DNA, 13 bp, Homo sapiens
ccctgtcagaggc

SEQ ID NO: 6087844 - DNA, 18 bp, Homo sapiens
ccctgtcagcatgaattt

SEQ ID NO: 6087845 - DNA, 14 bp, Homo sapiens
ccctgtcagtgcag

SEQ ID NO: 6087846 - DNA, 21 bp, Homo sapiens
ccctgtcagtttcccctctcg

SEQ ID NO: 6087847 - DNA, 15 bp, Homo sapiens
ccctgtcatcaccag

SEQ ID NO: 6087848 - DNA, 22 bp, Homo sapiens
ccctgtcatttttaacagcatg

SEQ ID NO: 6087849 - DNA, 22 bp, Homo sapiens
ccctgtccaaaagcgccctcac

SEQ ID NO: 6087850 - DNA, 20 bp, Homo sapiens
ccctgtccaggatggagggt

SEQ ID NO: 6087851 - DNA, 16 bp, Homo sapiens
ccctgtccatccccag

SEQ ID NO: 6087852 - DNA, 20 bp, Homo sapiens
ccctgtccatccgtctctgt

SEQ ID NO: 6087853 - DNA, 15 bp, Homo sapiens
ccctgtcccaccaac

SEQ ID NO: 6087854 - DNA, 16 bp, Homo sapiens
ccctgtcccaccaact

SEQ ID NO: 6087855 - DNA, 17 bp, Homo sapiens
ccctgtcccacctggct

SEQ ID NO: 6087856 - DNA, 13 bp, Homo sapiens
ccctgtcccagca

SEQ ID NO: 6087857 - DNA, 12 bp, Homo sapiens
ccctgtcccagg

SEQ ID NO: 6087858 - DNA, 14 bp, Homo sapiens
ccctgtcccaggca

SEQ ID NO: 6087859 - DNA, 16 bp, Homo sapiens
ccctgtcccaggccgg

SEQ ID NO: 6087860 - DNA, 17 bp, Homo sapiens
ccctgtcccagggccct

SEQ ID NO: 6087861 - DNA, 21 bp, Homo sapiens
ccctgtcccagggccctccca

SEQ ID NO: 6087862 - DNA, 23 bp, Homo sapiens
ccctgtcccagggccctcccagc

SEQ ID NO: 6087863 - DNA, 13 bp, Homo sapiens
cctgctactctgt

SEQ ID NO: 6087864 - DNA, 13 bp, Homo sapiens
cctgctactgcca

SEQ ID NO: 6087865 - DNA, 18 bp, Homo sapiens
cctgctactgccaacctc

SEQ ID NO: 6087866 - DNA, 19 bp, Homo sapiens
cctgctacttaaatttgaa

SEQ ID NO: 6087867 - DNA, 22 bp, Homo sapiens
cctgctacttaaatttgaatct

SEQ ID NO: 6087868 - DNA, 13 bp, Homo sapiens
cctgctagaaatg

SEQ ID NO: 6087869 - DNA, 18 bp, Homo sapiens
cctgctagacacattttt

SEQ ID NO: 6087870 - DNA, 19 bp, Homo sapiens
cctgctagacgcaccgcct

SEQ ID NO: 6087871 - DNA, 15 bp, Homo sapiens
cctgctagagcaacc

SEQ ID NO: 6087872 - DNA, 20 bp, Homo sapiens
cctgctagagcaacccctgt

SEQ ID NO: 6087873 - DNA, 23 bp, Homo sapiens
cctgctagagcaacccctgtacc

SEQ ID NO: 6087874 - DNA, 15 bp, Homo sapiens
cctgctagcacagag

SEQ ID NO: 6087875 - DNA, 16 bp, Homo sapiens
cctgctagcacagagg

SEQ ID NO: 6087876 - DNA, 19 bp, Homo sapiens
cctgctagcacagaggcct

SEQ ID NO: 6087877 - DNA, 20 bp, Homo sapiens
cctgctagcacctccccaga

SEQ ID NO: 6087878 - DNA, 18 bp, Homo sapiens
cctgctagcaggccccct

SEQ ID NO: 6087879 - DNA, 15 bp, Homo sapiens
cctgctagcggctga

SEQ ID NO: 6087880 - DNA, 15 bp, Homo sapiens
cctgctagctagctc

SEQ ID NO: 6087881 - DNA, 23 bp, Homo sapiens
cctgctagctagctcaactagtg

SEQ ID NO: 6087882 - DNA, 21 bp, Homo sapiens
cctgctagctgtctctcttgt

SEQ ID NO: 6087883 - DNA, 13 bp, Homo sapiens
cctgctaggccag

SEQ ID NO: 6087884 - DNA, 17 bp, Homo sapiens
cctgctaggccagagcc

SEQ ID NO: 6087885 - DNA, 19 bp, Homo sapiens
cctgctaggccagagccca

SEQ ID NO: 6087886 - DNA, 21 bp, Homo sapiens
cctgctaggccagagcccact

SEQ ID NO: 6087887 - DNA, 13 bp, Homo sapiens
cctgctatccagc

SEQ ID NO: 6087888 - DNA, 22 bp, Homo sapiens
cctgctattactaaggagtaat

SEQ ID NO: 6087889 - DNA, 23 bp, Homo sapiens
cctgctatttcaggccctcagct

SEQ ID NO: 6087890 - DNA, 14 bp, Homo sapiens
cctgctatttccca

SEQ ID NO: 6087891 - DNA, 21 bp, Homo sapiens
cctgctatttcccaagctgga

SEQ ID NO: 6087892 - DNA, 19 bp, Homo sapiens
cctgctcaatccctgagga

SEQ ID NO: 6087893 - DNA, 14 bp, Homo sapiens
cctgctcacaggga

SEQ ID NO: 6087894 - DNA, 23 bp, Homo sapiens
cctgctcaccaattccacttcct

SEQ ID NO: 6087895 - DNA, 13 bp, Homo sapiens
cctgctcaccacc

SEQ ID NO: 6087896 - DNA, 18 bp, Homo sapiens
cctgctcaccacctgcct

SEQ ID NO: 6087897 - DNA, 20 bp, Homo sapiens
cctgctcaccacctgcctct

SEQ ID NO: 6087898 - DNA, 14 bp, Homo sapiens
cctgctcacctgtg

SEQ ID NO: 6087899 - DNA, 18 bp, Homo sapiens
cctgctcacctgtgtgcc

SEQ ID NO: 6087900 - DNA, 20 bp, Homo sapiens
cctgctcacctgtgtgccca

SEQ ID NO: 6087901 - DNA, 21 bp, Homo sapiens
cctgctcacctgtgtgcccag

SEQ ID NO: 6087902 - DNA, 19 bp, Homo sapiens
cctgctcacgtcaaatgca

SEQ ID NO: 6087903 - DNA, 18 bp, Homo sapiens
cctgctcacgtctgtgag

SEQ ID NO: 6087904 - DNA, 15 bp, Homo sapiens
cctgctcagaatctg

SEQ ID NO: 6087905 - DNA, 16 bp, Homo sapiens
cctgctcagcagccag

SEQ ID NO: 6087906 - DNA, 13 bp, Homo sapiens
cctgctcagcagg

SEQ ID NO: 6087907 - DNA, 16 bp, Homo sapiens
cctgctcagcccatcc

SEQ ID NO: 6087908 - DNA, 17 bp, Homo sapiens
cctgctcagcccatccc

SEQ ID NO: 6087909 - DNA, 15 bp, Homo sapiens
cctgctcagctggcc

SEQ ID NO: 6087910 - DNA, 11 bp, Homo sapiens
cctgctcaggc

SEQ ID NO: 6087911 - DNA, 19 bp, Homo sapiens
cctgctcaggcctcacctg

SEQ ID NO: 6087912 - DNA, 15 bp, Homo sapiens
cctgctcagtgcttg

SEQ ID NO: 6087913 - DNA, 23 bp, Homo sapiens
cctgctcagtgcttgggctccac

SEQ ID NO: 6087914 - DNA, 19 bp, Homo sapiens
cctgctcatcacccttccg

SEQ ID NO: 6087915 - DNA, 20 bp, Homo sapiens
cctgctcatcacccttccga

SEQ ID NO: 6087916 - DNA, 19 bp, Homo sapiens
cctgctcatggccctcgga

SEQ ID NO: 6087917 - DNA, 17 bp, Homo sapiens
cctgctcattatgccac

SEQ ID NO: 6087918 - DNA, 13 bp, Homo sapiens
cctgctcattgtg

SEQ ID NO: 6087919 - DNA, 17 bp, Homo sapiens
cctgctcattgtggcca

SEQ ID NO: 6087920 - DNA, 18 bp, Homo sapiens
cctgctcattgtggccag

SEQ ID NO: 6087921 - DNA, 14 bp, Homo sapiens
cctgctccacagtg

SEQ ID NO: 6087922 - DNA, 15 bp, Homo sapiens
cctgctccacagtgt

SEQ ID NO: 6087923 - DNA, 18 bp, Homo sapiens
cctgctccaccagcagca

SEQ ID NO: 6087924 - DNA, 19 bp, Homo sapiens
cctgctccacgaagcctta

SEQ ID NO: 6087925 - DNA, 12 bp, Homo sapiens
cctgctccagaa

SEQ ID NO: 6087926 - DNA, 21 bp, Homo sapiens
cctgctccagaatttggaaat

SEQ ID NO: 6087927 - DNA, 15 bp, Homo sapiens
cctgctccagacctg

SEQ ID NO: 6087928 - DNA, 22 bp, Homo sapiens
cctgctccagacctgatcctgg

SEQ ID NO: 6087929 - DNA, 15 bp, Homo sapiens
cctgctccagatcct

SEQ ID NO: 6087930 - DNA, 16 bp, Homo sapiens
cctgctccagatcctc

SEQ ID NO: 6087931 - DNA, 12 bp, Homo sapiens
cctgctccagca

SEQ ID NO: 6087932 - DNA, 15 bp, Homo sapiens
cctgctccagcagca

SEQ ID NO: 6087933 - DNA, 20 bp, Homo sapiens
cctgctccagcagcacacct

SEQ ID NO: 6087934 - DNA, 22 bp, Homo sapiens
cctgctccagcagcacacctca

SEQ ID NO: 6087935 - DNA, 12 bp, Homo sapiens
cctgctccagct

SEQ ID NO: 6087936 - DNA, 21 bp, Homo sapiens
cctgctcccacgcctgcttct

SEQ ID NO: 6087937 - DNA, 13 bp, Homo sapiens
cctgctcccagca

SEQ ID NO: 6087938 - DNA, 16 bp, Homo sapiens
cctgctcccagcagcc

SEQ ID NO: 6087939 - DNA, 13 bp, Homo sapiens
cctgctcccagct

SEQ ID NO: 6087940 - DNA, 15 bp, Homo sapiens
cctgctcccaggccc

SEQ ID NO: 6087941 - DNA, 17 bp, Homo sapiens
cctgctcccaggcccca

SEQ ID NO: 6087942 - DNA, 13 bp, Homo sapiens
cctgctcccaggg

SEQ ID NO: 6087943 - DNA, 20 bp, Homo sapiens
cctgctcccagtcctgcctg

SEQ ID NO: 6087944 - DNA, 15 bp, Homo sapiens
cctgctcccagtggg

SEQ ID NO: 6087945 - DNA, 23 bp, Homo sapiens
cctgctcccccaccccctcccca

SEQ ID NO: 6087946 - DNA, 11 bp, Homo sapiens
cctgctcccct

SEQ ID NO: 6087947 - DNA, 13 bp, Homo sapiens
cctgctcccctca

SEQ ID NO: 6087948 - DNA, 22 bp, Homo sapiens
cctgctcccctgagaccacccc

SEQ ID NO: 6087949 - DNA, 14 bp, Homo sapiens
cctgctccctccag

SEQ ID NO: 6087950 - DNA, 13 bp, Homo sapiens
cctgctccctccc

SEQ ID NO: 6087951 - DNA, 19 bp, Homo sapiens
cctgctccctccctccacc

SEQ ID NO: 6087952 - DNA, 18 bp, Homo sapiens
cctgctccctctccccct

SEQ ID NO: 6087953 - DNA, 14 bp, Homo sapiens
cctgctccctgcct

SEQ ID NO: 6087954 - DNA, 16 bp, Homo sapiens
cctgctccctgcctcc

SEQ ID NO: 6087955 - DNA, 19 bp, Homo sapiens
cctgctccctgctttggct

SEQ ID NO: 6087956 - DNA, 15 bp, Homo sapiens
cctgctccctgtctg

SEQ ID NO: 6087957 - DNA, 16 bp, Homo sapiens
cctgctccctgtctgt

SEQ ID NO: 6087958 - DNA, 16 bp, Homo sapiens
cctgctccgccaggaa

SEQ ID NO: 6087959 - DNA, 17 bp, Homo sapiens
cctgctccgctgcctgg

SEQ ID NO: 6087960 - DNA, 15 bp, Homo sapiens
cctgctccgctgctc

SEQ ID NO: 6087961 - DNA, 17 bp, Homo sapiens
cctgctccgtggactgc

SEQ ID NO: 6087962 - DNA, 18 bp, Homo sapiens
cctgctccgttggtcagc

SEQ ID NO: 6087963 - DNA, 18 bp, Homo sapiens
cctgctcctaagggtaga

SEQ ID NO: 6087964 - DNA, 14 bp, Homo sapiens
cctgctcctagcac

SEQ ID NO: 6087965 - DNA, 14 bp, Homo sapiens
cctgctcctcactg

SEQ ID NO: 6087966 - DNA, 20 bp, Homo sapiens
cctgctcctcactggaggag

SEQ ID NO: 6087967 - DNA, 14 bp, Homo sapiens
cctgctcctcatgg

SEQ ID NO: 6087968 - DNA, 18 bp, Homo sapiens
cctgctcctcatgggaag

SEQ ID NO: 6087969 - DNA, 12 bp, Homo sapiens
cctgctcctccc

SEQ ID NO: 6087970 - DNA, 19 bp, Homo sapiens
cctgctcctccctggctgc

SEQ ID NO: 6087971 - DNA, 17 bp, Homo sapiens
cctgctcctcctgccct

SEQ ID NO: 6087972 - DNA, 15 bp, Homo sapiens
cctgctcctctgcct

SEQ ID NO: 6087973 - DNA, 17 bp, Homo sapiens
cctgctcctgcagcatg

SEQ ID NO: 6087974 - DNA, 13 bp, Homo sapiens
cctgctcctgccc

SEQ ID NO: 6087975 - DNA, 19 bp, Homo sapiens
cctgctcctgcccacgtgc

SEQ ID NO: 6087976 - DNA, 13 bp, Homo sapiens
cctgctccttccc

SEQ ID NO: 6087977 - DNA, 18 bp, Homo sapiens
cctgctccttcccttgct

SEQ ID NO: 6087978 - DNA, 20 bp, Homo sapiens
cctgctccttggcctagtca

SEQ ID NO: 6087979 - DNA, 22 bp, Homo sapiens
cctgctccttggcctagtcaga

SEQ ID NO: 6087980 - DNA, 20 bp, Homo sapiens
cctgctcctttctgcccagc

SEQ ID NO: 6087981 - DNA, 14 bp, Homo sapiens
cctgctcgccctgt

SEQ ID NO: 6087982 - DNA, 19 bp, Homo sapiens
cctgctcgccctgtgccct

SEQ ID NO: 6087983 - DNA, 21 bp, Homo sapiens
cctgctctaacacctgcctag

SEQ ID NO: 6087984 - DNA, 19 bp, Homo sapiens
cctgctctacccatgagcc

SEQ ID NO: 6087985 - DNA, 22 bp, Homo sapiens
cctgctctacccatgagcctgc

SEQ ID NO: 6087986 - DNA, 23 bp, Homo sapiens
cctgctctacccatgagcctgcc

SEQ ID NO: 6087987 - DNA, 17 bp, Homo sapiens
cctgctctagtgggaca

SEQ ID NO: 6087988 - DNA, 22 bp, Homo sapiens
cctgctctagtgggacagccca

SEQ ID NO: 6087989 - DNA, 21 bp, Homo sapiens
cctgctctccggcgcagacag

SEQ ID NO: 6087990 - DNA, 16 bp, Homo sapiens
cctgctctcctcttgc

SEQ ID NO: 6087991 - DNA, 19 bp, Homo sapiens
cctgctctccttgccctgg

SEQ ID NO: 6087992 - DNA, 20 bp, Homo sapiens
cctgctctctacccagccca

SEQ ID NO: 6087993 - DNA, 12 bp, Homo sapiens
cctgctctctgc

SEQ ID NO: 6087994 - DNA, 15 bp, Homo sapiens
cctgctctcttcagg

SEQ ID NO: 6087995 - DNA, 19 bp, Homo sapiens
cctgctctgcagcccacag

SEQ ID NO: 6087996 - DNA, 12 bp, Homo sapiens
cctgctctgcca

SEQ ID NO: 6087997 - DNA, 14 bp, Homo sapiens
cctgctctgccact

SEQ ID NO: 6087998 - DNA, 15 bp, Homo sapiens
cctgctctgccactg

SEQ ID NO: 6087999 - DNA, 15 bp, Homo sapiens
cctgctctgcccagg

SEQ ID NO: 6088000 - DNA, 16 bp, Homo sapiens
cctgctctgcccaggc

SEQ ID NO: 6088001 - DNA, 13 bp, Homo sapiens
cctgctctgctga

SEQ ID NO: 6088002 - DNA, 12 bp, Homo sapiens
cctgctctgctt

SEQ ID NO: 6088003 - DNA, 14 bp, Homo sapiens
cctgctctgcttcc

SEQ ID NO: 6088004 - DNA, 19 bp, Homo sapiens
cctgctctgcttcctcagg

SEQ ID NO: 6088005 - DNA, 20 bp, Homo sapiens
cctgctctgcttcctcaggg

SEQ ID NO: 6088006 - DNA, 22 bp, Homo sapiens
cctgctctgcttcctcagggcc

SEQ ID NO: 6088007 - DNA, 23 bp, Homo sapiens
cctgctctgcttttcctgtctgt

SEQ ID NO: 6088008 - DNA, 13 bp, Homo sapiens
cctgctctgggac

SEQ ID NO: 6088009 - DNA, 17 bp, Homo sapiens
cctgctctgggacgtgg

SEQ ID NO: 6088010 - DNA, 14 bp, Homo sapiens
cctgctctggtccc

SEQ ID NO: 6088011 - DNA, 14 bp, Homo sapiens
cctgctctgtagcc

SEQ ID NO: 6088012 - DNA, 13 bp, Homo sapiens
cctgctctgtccc

SEQ ID NO: 6088013 - DNA, 18 bp, Homo sapiens
cctgctctgtccccaaag

SEQ ID NO: 6088014 - DNA, 22 bp, Homo sapiens
cctgctctgtgagccccacagc

SEQ ID NO: 6088015 - DNA, 17 bp, Homo sapiens
cctgctcttacttcccc

SEQ ID NO: 6088016 - DNA, 21 bp, Homo sapiens
cctgctcttacttcccccacc

SEQ ID NO: 6088017 - DNA, 13 bp, Homo sapiens
cctgctcttccat

SEQ ID NO: 6088018 - DNA, 16 bp, Homo sapiens
cctgctcttccatttc

SEQ ID NO: 6088019 - DNA, 21 bp, Homo sapiens
cctgctcttccatttcttcca

SEQ ID NO: 6088020 - DNA, 22 bp, Homo sapiens
cctgctcttccatttcttccac

SEQ ID NO: 6088021 - DNA, 19 bp, Homo sapiens
cctgctcttctctccccag

SEQ ID NO: 6088022 - DNA, 12 bp, Homo sapiens
cctgctctttct

SEQ ID NO: 6088023 - DNA, 23 bp, Homo sapiens
cctgctctttctacatgactggg

SEQ ID NO: 6088024 - DNA, 24 bp, Homo sapiens
cctgctctttctacatgactgggc

SEQ ID NO: 6088025 - DNA, 23 bp, Homo sapiens
cctgctcttttgtgatgaacata

SEQ ID NO: 6088026 - DNA, 15 bp, Homo sapiens
cctgctgaaaataac

SEQ ID NO: 6088027 - DNA, 21 bp, Homo sapiens
cctgctgaaacacctcccagg

SEQ ID NO: 6088028 - DNA, 22 bp, Homo sapiens
cctgctgaacacagtgtctgtt

SEQ ID NO: 6088029 - DNA, 16 bp, Homo sapiens
cctgctgacagacact

SEQ ID NO: 6088030 - DNA, 23 bp, Homo sapiens
cctgctgacatagtggatggaca

SEQ ID NO: 6088031 - DNA, 21 bp, Homo sapiens
cctgctgaccataacagtgcc

SEQ ID NO: 6088032 - DNA, 16 bp, Homo sapiens
cctgctgacctcactg

SEQ ID NO: 6088033 - DNA, 13 bp, Homo sapiens
cctgctgacctgt

SEQ ID NO: 6088034 - DNA, 14 bp, Homo sapiens
cctgctgaccttgg

SEQ ID NO: 6088035 - DNA, 13 bp, Homo sapiens
cctgctgagagcc

SEQ ID NO: 6088036 - DNA, 17 bp, Homo sapiens
cctgctgagagccccca

SEQ ID NO: 6088037 - DNA, 23 bp, Homo sapiens
cctgctgagatctgctgtcctgt

SEQ ID NO: 6088038 - DNA, 14 bp, Homo sapiens
cctgctgagcacag

SEQ ID NO: 6088039 - DNA, 12 bp, Homo sapiens
cctgctgagctc

SEQ ID NO: 6088040 - DNA, 14 bp, Homo sapiens
cctgctgagctctg

SEQ ID NO: 6088041 - DNA, 17 bp, Homo sapiens
cctgctgagctctgaga

SEQ ID NO: 6088042 - DNA, 22 bp, Homo sapiens
cctgctgagctctgagaggccc

SEQ ID NO: 6088043 - DNA, 13 bp, Homo sapiens
ccctgtcccatgc

SEQ ID NO: 6088044 - DNA, 21 bp, Homo sapiens
ccctgtcccatgcaggccctt

SEQ ID NO: 6088045 - DNA, 22 bp, Homo sapiens
ccctgtccccaagacacttccc

SEQ ID NO: 6088046 - DNA, 14 bp, Homo sapiens
ccctgtccccagtc

SEQ ID NO: 6088047 - DNA, 16 bp, Homo sapiens
ccctgtcccccagcat

SEQ ID NO: 6088048 - DNA, 16 bp, Homo sapiens
ccctgtcccccagctc

SEQ ID NO: 6088049 - DNA, 14 bp, Homo sapiens
ccctgtcccctagg

SEQ ID NO: 6088050 - DNA, 13 bp, Homo sapiens
ccctgtcccctca

SEQ ID NO: 6088051 - DNA, 14 bp, Homo sapiens
ccctgtcccctgaa

SEQ ID NO: 6088052 - DNA, 16 bp, Homo sapiens
ccctgtcccctggggc

SEQ ID NO: 6088053 - DNA, 12 bp, Homo sapiens
ccctgtccctcc

SEQ ID NO: 6088054 - DNA, 16 bp, Homo sapiens
ccctgtccctcccacc

SEQ ID NO: 6088055 - DNA, 19 bp, Homo sapiens
ccctgtccctcccacctct

SEQ ID NO: 6088056 - DNA, 21 bp, Homo sapiens
ccctgtccctcccacctctgt

SEQ ID NO: 6088057 - DNA, 24 bp, Homo sapiens
ccctgtccctcccacctctgtgac

SEQ ID NO: 6088058 - DNA, 20 bp, Homo sapiens
ccctgtccctcccactccct

SEQ ID NO: 6088059 - DNA, 22 bp, Homo sapiens
ccctgtcccttcgagtccagga

SEQ ID NO: 6088060 - DNA, 13 bp, Homo sapiens
ccctgtcctcact

SEQ ID NO: 6088061 - DNA, 14 bp, Homo sapiens
ccctgtcctcactg

SEQ ID NO: 6088062 - DNA, 16 bp, Homo sapiens
ccctgtcctcactgct

SEQ ID NO: 6088063 - DNA, 22 bp, Homo sapiens
ccctgtcctgatggtcagctcc

SEQ ID NO: 6088064 - DNA, 14 bp, Homo sapiens
ccctgtcctgcaca

SEQ ID NO: 6088065 - DNA, 13 bp, Homo sapiens
ccctgtcctgcag

SEQ ID NO: 6088066 - DNA, 12 bp, Homo sapiens
ccctgtcctggg

SEQ ID NO: 6088067 - DNA, 16 bp, Homo sapiens
ccctgtccttccctgt

SEQ ID NO: 6088068 - DNA, 14 bp, Homo sapiens
ccctgtcctttgca

SEQ ID NO: 6088069 - DNA, 20 bp, Homo sapiens
ccctgtcgagacacttgcct

SEQ ID NO: 6088070 - DNA, 15 bp, Homo sapiens
ccctgtcgcccaccc

SEQ ID NO: 6088071 - DNA, 21 bp, Homo sapiens
ccctgtcgggctttgtgtgaa

SEQ ID NO: 6088072 - DNA, 12 bp, Homo sapiens
ccctgtctagag

SEQ ID NO: 6088073 - DNA, 20 bp, Homo sapiens
ccctgtctagagagggaggc

SEQ ID NO: 6088074 - DNA, 17 bp, Homo sapiens
ccctgtctataaatccc

SEQ ID NO: 6088075 - DNA, 12 bp, Homo sapiens
ccctgtctccag

SEQ ID NO: 6088076 - DNA, 17 bp, Homo sapiens
ccctgtctccagctgcc

SEQ ID NO: 6088077 - DNA, 19 bp, Homo sapiens
ccctgtctccagctgcctg

SEQ ID NO: 6088078 - DNA, 21 bp, Homo sapiens
ccctgtctctcagggccaggc

SEQ ID NO: 6088079 - DNA, 14 bp, Homo sapiens
ccctgtctctgcat

SEQ ID NO: 6088080 - DNA, 17 bp, Homo sapiens
ccctgtctctgcatctg

SEQ ID NO: 6088081 - DNA, 16 bp, Homo sapiens
ccctgtctctggctac

SEQ ID NO: 6088082 - DNA, 16 bp, Homo sapiens
ccctgtctgccagggc

SEQ ID NO: 6088083 - DNA, 14 bp, Homo sapiens
ccctgtctggaaga

SEQ ID NO: 6088084 - DNA, 22 bp, Homo sapiens
ccctgtctgtagagggccctgg

SEQ ID NO: 6088085 - DNA, 23 bp, Homo sapiens
ccctgtctgtagagggccctggt

SEQ ID NO: 6088086 - DNA, 21 bp, Homo sapiens
ccctgtctgtctgtctctctt

SEQ ID NO: 6088087 - DNA, 22 bp, Homo sapiens
ccctgtctgtgtcccagccacg

SEQ ID NO: 6088088 - DNA, 14 bp, Homo sapiens
ccctgtcttcacct

SEQ ID NO: 6088089 - DNA, 18 bp, Homo sapiens
ccctgtcttcacctgcca

SEQ ID NO: 6088090 - DNA, 20 bp, Homo sapiens
ccctgtcttcacctgccacc

SEQ ID NO: 6088091 - DNA, 16 bp, Homo sapiens
ccctgtcttccccacc

SEQ ID NO: 6088092 - DNA, 13 bp, Homo sapiens
ccctgtcttcctc

SEQ ID NO: 6088093 - DNA, 16 bp, Homo sapiens
ccctgtcttcctctgc

SEQ ID NO: 6088094 - DNA, 18 bp, Homo sapiens
ccctgtcttcctctgcaa

SEQ ID NO: 6088095 - DNA, 13 bp, Homo sapiens
ccctgtcttctct

SEQ ID NO: 6088096 - DNA, 17 bp, Homo sapiens
ccctgtcttctgggcac

SEQ ID NO: 6088097 - DNA, 19 bp, Homo sapiens
ccctgtcttctgggcacag

SEQ ID NO: 6088098 - DNA, 20 bp, Homo sapiens
ccctgtcttctgggcacagt

SEQ ID NO: 6088099 - DNA, 21 bp, Homo sapiens
ccctgtcttctgggcacagtg

SEQ ID NO: 6088100 - DNA, 23 bp, Homo sapiens
ccctgtctttgctgtttatatat

SEQ ID NO: 6088101 - DNA, 17 bp, Homo sapiens
ccctgtgacatggtgcc

SEQ ID NO: 6088102 - DNA, 24 bp, Homo sapiens
ccctgtgacatggtgcctgagagg

SEQ ID NO: 6088103 - DNA, 13 bp, Homo sapiens
ccctgtgaccctc

SEQ ID NO: 6088104 - DNA, 17 bp, Homo sapiens
ccctgtgagcacaaaga

SEQ ID NO: 6088105 - DNA, 18 bp, Homo sapiens
ccctgtgagggcgagcgg

SEQ ID NO: 6088106 - DNA, 21 bp, Homo sapiens
ccctgtgagtactacagtcct

SEQ ID NO: 6088107 - DNA, 23 bp, Homo sapiens
ccctgtgagtttgtacagtcttg

SEQ ID NO: 6088108 - DNA, 15 bp, Homo sapiens
ccctgtgatggggcc

SEQ ID NO: 6088109 - DNA, 22 bp, Homo sapiens
ccctgtgcagccgctgagcgag

SEQ ID NO: 6088110 - DNA, 21 bp, Homo sapiens
ccctgtgcagggaaagggatg

SEQ ID NO: 6088111 - DNA, 13 bp, Homo sapiens
ccctgtgccagcc

SEQ ID NO: 6088112 - DNA, 13 bp, Homo sapiens
ccctgtgccagct

SEQ ID NO: 6088113 - DNA, 21 bp, Homo sapiens
ccctgtgccagctcaggtgac

SEQ ID NO: 6088114 - DNA, 16 bp, Homo sapiens
ccctgtgcccacccag

SEQ ID NO: 6088115 - DNA, 20 bp, Homo sapiens
ccctgtgcccacccagggcc

SEQ ID NO: 6088116 - DNA, 14 bp, Homo sapiens
ccctgtgccccagt

SEQ ID NO: 6088117 - DNA, 12 bp, Homo sapiens
ccctgtgccccc

SEQ ID NO: 6088118 - DNA, 18 bp, Homo sapiens
ccctgtgcccccagcctc

SEQ ID NO: 6088119 - DNA, 19 bp, Homo sapiens
ccctgtgcccccagcctca

SEQ ID NO: 6088120 - DNA, 23 bp, Homo sapiens
ccctgtgcccccagcctcagccc

SEQ ID NO: 6088121 - DNA, 19 bp, Homo sapiens
ccctgtgcccccagggtcc

SEQ ID NO: 6088122 - DNA, 13 bp, Homo sapiens
ccctgtgccctct

SEQ ID NO: 6088123 - DNA, 21 bp, Homo sapiens
ccctgtgccctgcacgtatac

SEQ ID NO: 6088124 - DNA, 20 bp, Homo sapiens
ccctgtgcctaacaccagcg

SEQ ID NO: 6088125 - DNA, 21 bp, Homo sapiens
ccctgtgcctaacaccagcgt

SEQ ID NO: 6088126 - DNA, 15 bp, Homo sapiens
ccctgtgcctctgtc

SEQ ID NO: 6088127 - DNA, 22 bp, Homo sapiens
ccctgtgcctctgtcctagact

SEQ ID NO: 6088128 - DNA, 16 bp, Homo sapiens
ccctgtgcctgctggg

SEQ ID NO: 6088129 - DNA, 18 bp, Homo sapiens
ccctgtgctccgtgcctc

SEQ ID NO: 6088130 - DNA, 20 bp, Homo sapiens
ccctgtgctccgtgcctcca

SEQ ID NO: 6088131 - DNA, 16 bp, Homo sapiens
ccctgtgctgatcctg

SEQ ID NO: 6088132 - DNA, 14 bp, Homo sapiens
ccctgtgctggtgt

SEQ ID NO: 6088133 - DNA, 22 bp, Homo sapiens
ccctgtgctggtgtcctgacca

SEQ ID NO: 6088134 - DNA, 22 bp, Homo sapiens
ccctgtggaagcatggctgtct

SEQ ID NO: 6088135 - DNA, 23 bp, Homo sapiens
ccctgtggaagcatggctgtctg

SEQ ID NO: 6088136 - DNA, 14 bp, Homo sapiens
ccctgtggaaggga

SEQ ID NO: 6088137 - DNA, 18 bp, Homo sapiens
ccctgtggaagggactag

SEQ ID NO: 6088138 - DNA, 21 bp, Homo sapiens
ccctgtggaagggactaggag

SEQ ID NO: 6088139 - DNA, 19 bp, Homo sapiens
ccctgtggaatgggctcaa

SEQ ID NO: 6088140 - DNA, 13 bp, Homo sapiens
ccctgtggacagg

SEQ ID NO: 6088141 - DNA, 20 bp, Homo sapiens
ccctgtggatgagccctcag

SEQ ID NO: 6088142 - DNA, 21 bp, Homo sapiens
ccctgtggatgagccctcaga

SEQ ID NO: 6088143 - DNA, 23 bp, Homo sapiens
ccctgtggatgagccctcagaac

SEQ ID NO: 6088144 - DNA, 23 bp, Homo sapiens
ccctgtggcaaatgccaggacag

SEQ ID NO: 6088145 - DNA, 13 bp, Homo sapiens
ccctgtggccaac

SEQ ID NO: 6088146 - DNA, 19 bp, Homo sapiens
ccctgtggctccaggagca

SEQ ID NO: 6088147 - DNA, 18 bp, Homo sapiens
ccctgtgggaccccaggc

SEQ ID NO: 6088148 - DNA, 19 bp, Homo sapiens
ccctgtgggaccccaggcc

SEQ ID NO: 6088149 - DNA, 21 bp, Homo sapiens
ccctgtgggaccgcctggccc

SEQ ID NO: 6088150 - DNA, 23 bp, Homo sapiens
ccctgtgggaccgcctggccctc

SEQ ID NO: 6088151 - DNA, 22 bp, Homo sapiens
ccctgtgggactcatccttgcc

SEQ ID NO: 6088152 - DNA, 17 bp, Homo sapiens
ccctgtgggagtccact

SEQ ID NO: 6088153 - DNA, 16 bp, Homo sapiens
ccctgtgggctcacac

SEQ ID NO: 6088154 - DNA, 21 bp, Homo sapiens
ccctgtgggctcacaccggca

SEQ ID NO: 6088155 - DNA, 21 bp, Homo sapiens
ccctgtgggcttatgtctctg

SEQ ID NO: 6088156 - DNA, 12 bp, Homo sapiens
ccctgtggggat

SEQ ID NO: 6088157 - DNA, 21 bp, Homo sapiens
ccctgtggggcaggagtgcca

SEQ ID NO: 6088158 - DNA, 12 bp, Homo sapiens
ccctgtgggggt

SEQ ID NO: 6088159 - DNA, 18 bp, Homo sapiens
ccctgtgggggtggccat

SEQ ID NO: 6088160 - DNA, 19 bp, Homo sapiens
ccctgtgggggtggccatc

SEQ ID NO: 6088161 - DNA, 24 bp, Homo sapiens
ccctgtgggggtggccatccctgg

SEQ ID NO: 6088162 - DNA, 19 bp, Homo sapiens
ccctgtgggtgtctccctc

SEQ ID NO: 6088163 - DNA, 20 bp, Homo sapiens
ccctgtggtaccctggcaga

SEQ ID NO: 6088164 - DNA, 12 bp, Homo sapiens
ccctgtggtctg

SEQ ID NO: 6088165 - DNA, 15 bp, Homo sapiens
ccctgtggtctgtgt

SEQ ID NO: 6088166 - DNA, 17 bp, Homo sapiens
ccctgtggtctgtgtgt

SEQ ID NO: 6088167 - DNA, 19 bp, Homo sapiens
ccctgtggtgatgtgcctg

SEQ ID NO: 6088168 - DNA, 22 bp, Homo sapiens
ccctgtgtccacagtgattagc

SEQ ID NO: 6088169 - DNA, 19 bp, Homo sapiens
ccctgtgtccacctgtggg

SEQ ID NO: 6088170 - DNA, 21 bp, Homo sapiens
ccctgtgtccacctgtgggtg

SEQ ID NO: 6088171 - DNA, 12 bp, Homo sapiens
ccctgtgtctgt

SEQ ID NO: 6088172 - DNA, 19 bp, Homo sapiens
ccctgtgtctgtcacaggc

SEQ ID NO: 6088173 - DNA, 20 bp, Homo sapiens
ccctgtgtctgtcacaggct

SEQ ID NO: 6088174 - DNA, 13 bp, Homo sapiens
ccctgtgtgaatg

SEQ ID NO: 6088175 - DNA, 13 bp, Homo sapiens
ccctgtgtgcagg

SEQ ID NO: 6088176 - DNA, 17 bp, Homo sapiens
ccctgtgtggccctgga

SEQ ID NO: 6088177 - DNA, 16 bp, Homo sapiens
ccctgtgtgggagggc

SEQ ID NO: 6088178 - DNA, 23 bp, Homo sapiens
ccctgtgtgggagggcgaggcgg

SEQ ID NO: 6088179 - DNA, 20 bp, Homo sapiens
ccctgtgtgtaggctggggc

SEQ ID NO: 6088180 - DNA, 16 bp, Homo sapiens
ccctgtgttaatttaa

SEQ ID NO: 6088181 - DNA, 17 bp, Homo sapiens
ccctgtgttctgcacat

SEQ ID NO: 6088182 - DNA, 22 bp, Homo sapiens
ccctgtgttctgggctggggcc

SEQ ID NO: 6088183 - DNA, 24 bp, Homo sapiens
ccctgtgttctttccccaggggca

SEQ ID NO: 6088184 - DNA, 23 bp, Homo sapiens
ccctgtgttggggggcaaggtgg

SEQ ID NO: 6088185 - DNA, 20 bp, Homo sapiens
ccctgtgttgtcccatctgc

SEQ ID NO: 6088186 - DNA, 16 bp, Homo sapiens
ccctgttacaaagctg

SEQ ID NO: 6088187 - DNA, 16 bp, Homo sapiens
ccctgttatctgctag

SEQ ID NO: 6088188 - DNA, 19 bp, Homo sapiens
ccctgttatttttctgccc

SEQ ID NO: 6088189 - DNA, 16 bp, Homo sapiens
ccctgttcacgctcac

SEQ ID NO: 6088190 - DNA, 22 bp, Homo sapiens
ccctgttcacgctcacccagtc

SEQ ID NO: 6088191 - DNA, 20 bp, Homo sapiens
ccctgttcacggtgacacag

SEQ ID NO: 6088192 - DNA, 19 bp, Homo sapiens
ccctgttcagctactccca

SEQ ID NO: 6088193 - DNA, 20 bp, Homo sapiens
ccctgttcatgtgcctctgc

SEQ ID NO: 6088194 - DNA, 21 bp, Homo sapiens
ccctgttcatgtgcctctgcg

SEQ ID NO: 6088195 - DNA, 13 bp, Homo sapiens
ccctgttcattgt

SEQ ID NO: 6088196 - DNA, 14 bp, Homo sapiens
ccctgttccctgtt

SEQ ID NO: 6088197 - DNA, 14 bp, Homo sapiens
ccctgttcccttcc

SEQ ID NO: 6088198 - DNA, 20 bp, Homo sapiens
ccctgttccgcctcactggg

SEQ ID NO: 6088199 - DNA, 16 bp, Homo sapiens
ccctgttcctgctgct

SEQ ID NO: 6088200 - DNA, 19 bp, Homo sapiens
ccctgttctaactcttaga

SEQ ID NO: 6088201 - DNA, 13 bp, Homo sapiens
ccctgttctcagc

SEQ ID NO: 6088202 - DNA, 14 bp, Homo sapiens
ccctgttctcagct

SEQ ID NO: 6088203 - DNA, 15 bp, Homo sapiens
ccctgttctcagctc

SEQ ID NO: 6088204 - DNA, 21 bp, Homo sapiens
ccctgttctggtatttcccct

SEQ ID NO: 6088205 - DNA, 12 bp, Homo sapiens
ccctgttcttta

SEQ ID NO: 6088206 - DNA, 19 bp, Homo sapiens
ccctgttgaattggtgaat

SEQ ID NO: 6088207 - DNA, 18 bp, Homo sapiens
ccctgttgacctgcccga

SEQ ID NO: 6088208 - DNA, 19 bp, Homo sapiens
ccctgttgagtatttgctg

SEQ ID NO: 6088209 - DNA, 11 bp, Homo sapiens
ccctgttgcta

SEQ ID NO: 6088210 - DNA, 16 bp, Homo sapiens
ccctgttgggggcttc

SEQ ID NO: 6088211 - DNA, 19 bp, Homo sapiens
ccctgttgggggcttcagg

SEQ ID NO: 6088212 - DNA, 13 bp, Homo sapiens
ccctgttgtgcca

SEQ ID NO: 6088213 - DNA, 19 bp, Homo sapiens
ccctgtttaatatttaaac

SEQ ID NO: 6088214 - DNA, 21 bp, Homo sapiens
ccctgtttaatatttaaacag

SEQ ID NO: 6088215 - DNA, 19 bp, Homo sapiens
ccctgtttcaatcactgtc

SEQ ID NO: 6088216 - DNA, 22 bp, Homo sapiens
ccctgtttctggagtcacatca

SEQ ID NO: 6088217 - DNA, 20 bp, Homo sapiens
ccctgtttgaagcctgccct

SEQ ID NO: 6088218 - DNA, 14 bp, Homo sapiens
ccctgttttatact

SEQ ID NO: 6088219 - DNA, 17 bp, Homo sapiens
ccctgttttctgagccc

SEQ ID NO: 6088220 - DNA, 24 bp, Homo sapiens
cctgctgagctctgagaggccctg

SEQ ID NO: 6088221 - DNA, 13 bp, Homo sapiens
cctgctgagctgc

SEQ ID NO: 6088222 - DNA, 20 bp, Homo sapiens
cctgctgagctgcccctgct

SEQ ID NO: 6088223 - DNA, 17 bp, Homo sapiens
cctgctgagctgtgccc

SEQ ID NO: 6088224 - DNA, 14 bp, Homo sapiens
cctgctgaggcagt

SEQ ID NO: 6088225 - DNA, 17 bp, Homo sapiens
cctgctgaggccttctc

SEQ ID NO: 6088226 - DNA, 18 bp, Homo sapiens
cctgctgaggccttctct

SEQ ID NO: 6088227 - DNA, 21 bp, Homo sapiens
cctgctgagggaccagccaag

SEQ ID NO: 6088228 - DNA, 18 bp, Homo sapiens
cctgctgagtcccaggct

SEQ ID NO: 6088229 - DNA, 19 bp, Homo sapiens
cctgctgagtcccaggctg

SEQ ID NO: 6088230 - DNA, 23 bp, Homo sapiens
cctgctgagtggtccacattctg

SEQ ID NO: 6088231 - DNA, 17 bp, Homo sapiens
cctgctgatgtggcaac

SEQ ID NO: 6088232 - DNA, 21 bp, Homo sapiens
cctgctgcaaaggacagtggg

SEQ ID NO: 6088233 - DNA, 16 bp, Homo sapiens
cctgctgcacaggccc

SEQ ID NO: 6088234 - DNA, 19 bp, Homo sapiens
cctgctgcacaggccctgg

SEQ ID NO: 6088235 - DNA, 16 bp, Homo sapiens
cctgctgcaccaaccc

SEQ ID NO: 6088236 - DNA, 12 bp, Homo sapiens
cctgctgcaccc

SEQ ID NO: 6088237 - DNA, 15 bp, Homo sapiens
cctgctgcaccctgc

SEQ ID NO: 6088238 - DNA, 22 bp, Homo sapiens
cctgctgcaccctgcgcctcca

SEQ ID NO: 6088239 - DNA, 21 bp, Homo sapiens
cctgctgcaggggctctggag

SEQ ID NO: 6088240 - DNA, 22 bp, Homo sapiens
cctgctgcaggggctctggaga

SEQ ID NO: 6088241 - DNA, 23 bp, Homo sapiens
cctgctgcatgccctctcaggcc

SEQ ID NO: 6088242 - DNA, 12 bp, Homo sapiens
cctgctgccaca

SEQ ID NO: 6088243 - DNA, 13 bp, Homo sapiens
cctgctgccacag

SEQ ID NO: 6088244 - DNA, 13 bp, Homo sapiens
cctgctgccagct

SEQ ID NO: 6088245 - DNA, 20 bp, Homo sapiens
cctgctgccagtgcagccac

SEQ ID NO: 6088246 - DNA, 22 bp, Homo sapiens
cctgctgccatgtggactggtg

SEQ ID NO: 6088247 - DNA, 13 bp, Homo sapiens
cctgctgcccagt

SEQ ID NO: 6088248 - DNA, 14 bp, Homo sapiens
cctgctgcccccta

SEQ ID NO: 6088249 - DNA, 15 bp, Homo sapiens
cctgctgccccctac

SEQ ID NO: 6088250 - DNA, 19 bp, Homo sapiens
cctgctgcccctccctgcc

SEQ ID NO: 6088251 - DNA, 16 bp, Homo sapiens
cctgctgcccgtgagg

SEQ ID NO: 6088252 - DNA, 22 bp, Homo sapiens
cctgctgcccgtgaggaggggg

SEQ ID NO: 6088253 - DNA, 22 bp, Homo sapiens
cctgctgccctcccacagcctc

SEQ ID NO: 6088254 - DNA, 18 bp, Homo sapiens
cctgctgccctccccctc

SEQ ID NO: 6088255 - DNA, 22 bp, Homo sapiens
cctgctgcctaataaagagact

SEQ ID NO: 6088256 - DNA, 19 bp, Homo sapiens
cctgctgcctccccaaccc

SEQ ID NO: 6088257 - DNA, 11 bp, Homo sapiens
cctgctgcctg

SEQ ID NO: 6088258 - DNA, 13 bp, Homo sapiens
cctgctgcctggg

SEQ ID NO: 6088259 - DNA, 15 bp, Homo sapiens
cctgctgcctgggta

SEQ ID NO: 6088260 - DNA, 20 bp, Homo sapiens
cctgctgcctgggtaggccc

SEQ ID NO: 6088261 - DNA, 19 bp, Homo sapiens
cctgctgccttttctggag

SEQ ID NO: 6088262 - DNA, 21 bp, Homo sapiens
cctgctgcgccccaggccccg

SEQ ID NO: 6088263 - DNA, 16 bp, Homo sapiens
cctgctgcgctgcttg

SEQ ID NO: 6088264 - DNA, 22 bp, Homo sapiens
cctgctgcggaggagctgcctg

SEQ ID NO: 6088265 - DNA, 19 bp, Homo sapiens
cctgctgcgggggagccag

SEQ ID NO: 6088266 - DNA, 23 bp, Homo sapiens
cctgctgcgtcagaccagtactg

SEQ ID NO: 6088267 - DNA, 15 bp, Homo sapiens
cctgctgctcactcc

SEQ ID NO: 6088268 - DNA, 16 bp, Homo sapiens
cctgctgctcactccc

SEQ ID NO: 6088269 - DNA, 15 bp, Homo sapiens
cctgctgctcagtaa

SEQ ID NO: 6088270 - DNA, 14 bp, Homo sapiens
cctgctgctcatcc

SEQ ID NO: 6088271 - DNA, 14 bp, Homo sapiens
cctgctgctccatg

SEQ ID NO: 6088272 - DNA, 16 bp, Homo sapiens
cctgctgctccctcag

SEQ ID NO: 6088273 - DNA, 18 bp, Homo sapiens
cctgctgctccctcagac

SEQ ID NO: 6088274 - DNA, 13 bp, Homo sapiens
cctgctgctccta

SEQ ID NO: 6088275 - DNA, 15 bp, Homo sapiens
cctgctgctcctagg

SEQ ID NO: 6088276 - DNA, 14 bp, Homo sapiens
cctgctgctcctgt

SEQ ID NO: 6088277 - DNA, 15 bp, Homo sapiens
cctgctgctcctgtt

SEQ ID NO: 6088278 - DNA, 19 bp, Homo sapiens
cctgctgctcgggaaggcc

SEQ ID NO: 6088279 - DNA, 14 bp, Homo sapiens
cctgctgctgagaa

SEQ ID NO: 6088280 - DNA, 17 bp, Homo sapiens
cctgctgctgagaacct

SEQ ID NO: 6088281 - DNA, 24 bp, Homo sapiens
cctgctgctgagaacctggccttc

SEQ ID NO: 6088282 - DNA, 13 bp, Homo sapiens
cctgctgctgcca

SEQ ID NO: 6088283 - DNA, 18 bp, Homo sapiens
cctgctgctggtgcacag

SEQ ID NO: 6088284 - DNA, 20 bp, Homo sapiens
cctgctgctgtaactgctga

SEQ ID NO: 6088285 - DNA, 21 bp, Homo sapiens
cctgctgctgtaactgctgag

SEQ ID NO: 6088286 - DNA, 16 bp, Homo sapiens
cctgctgctgtcacct

SEQ ID NO: 6088287 - DNA, 18 bp, Homo sapiens
cctgctgctgtcacctct

SEQ ID NO: 6088288 - DNA, 20 bp, Homo sapiens
cctgctgctgtcacctctcc

SEQ ID NO: 6088289 - DNA, 21 bp, Homo sapiens
cctgctgcttcctaacttatt

SEQ ID NO: 6088290 - DNA, 15 bp, Homo sapiens
cctgctgcttctcca

SEQ ID NO: 6088291 - DNA, 14 bp, Homo sapiens
cctgctgcttggag

SEQ ID NO: 6088292 - DNA, 16 bp, Homo sapiens
cctgctgcttggagtg

SEQ ID NO: 6088293 - DNA, 18 bp, Homo sapiens
cctgctgctttgggctgg

SEQ ID NO: 6088294 - DNA, 20 bp, Homo sapiens
cctgctgctttgttgttctg

SEQ ID NO: 6088295 - DNA, 20 bp, Homo sapiens
cctgctggaaaccacacttc

SEQ ID NO: 6088296 - DNA, 14 bp, Homo sapiens
cctgctggaagccc

SEQ ID NO: 6088297 - DNA, 16 bp, Homo sapiens
cctgctggacagagac

SEQ ID NO: 6088298 - DNA, 13 bp, Homo sapiens
cctgctggatctc

SEQ ID NO: 6088299 - DNA, 21 bp, Homo sapiens
cctgctggatctcccagggct

SEQ ID NO: 6088300 - DNA, 17 bp, Homo sapiens
cctgctggatgtggagg

SEQ ID NO: 6088301 - DNA, 12 bp, Homo sapiens
cctgctggcacc

SEQ ID NO: 6088302 - DNA, 23 bp, Homo sapiens
cctgctggcagggccagggcaat

SEQ ID NO: 6088303 - DNA, 11 bp, Homo sapiens
cctgctggccc

SEQ ID NO: 6088304 - DNA, 17 bp, Homo sapiens
cctgctggcccctcacc

SEQ ID NO: 6088305 - DNA, 13 bp, Homo sapiens
cctgctggccgcc

SEQ ID NO: 6088306 - DNA, 15 bp, Homo sapiens
cctgctggccgcctc

SEQ ID NO: 6088307 - DNA, 21 bp, Homo sapiens
cctgctggccggacacccgac

SEQ ID NO: 6088308 - DNA, 17 bp, Homo sapiens
cctgctggcctgctctt

SEQ ID NO: 6088309 - DNA, 19 bp, Homo sapiens
cctgctggctcttctgccc

SEQ ID NO: 6088310 - DNA, 12 bp, Homo sapiens
cctgctggctga

SEQ ID NO: 6088311 - DNA, 15 bp, Homo sapiens
cctgctggctgaggc

SEQ ID NO: 6088312 - DNA, 16 bp, Homo sapiens
cctgctggctgaggct

SEQ ID NO: 6088313 - DNA, 17 bp, Homo sapiens
cctgctggctgaggctt

SEQ ID NO: 6088314 - DNA, 21 bp, Homo sapiens
cctgctggctgaggcttgggc

SEQ ID NO: 6088315 - DNA, 17 bp, Homo sapiens
cctgctggctgcggccc

SEQ ID NO: 6088316 - DNA, 21 bp, Homo sapiens
cctgctggctgcggccccctc

SEQ ID NO: 6088317 - DNA, 17 bp, Homo sapiens
cctgctgggaagagctc

SEQ ID NO: 6088318 - DNA, 19 bp, Homo sapiens
cctgctgggaagagctccc

SEQ ID NO: 6088319 - DNA, 13 bp, Homo sapiens
cctgctgggactg

SEQ ID NO: 6088320 - DNA, 14 bp, Homo sapiens
cctgctgggactga

SEQ ID NO: 6088321 - DNA, 13 bp, Homo sapiens
cctgctgggcact

SEQ ID NO: 6088322 - DNA, 17 bp, Homo sapiens
cctgctgggcactgggc

SEQ ID NO: 6088323 - DNA, 21 bp, Homo sapiens
cctgctgggctctccacctca

SEQ ID NO: 6088324 - DNA, 18 bp, Homo sapiens
cctgctggggaagaacag

SEQ ID NO: 6088325 - DNA, 13 bp, Homo sapiens
cctgctggggatc

SEQ ID NO: 6088326 - DNA, 21 bp, Homo sapiens
cctgctggggtctcaggtcca

SEQ ID NO: 6088327 - DNA, 20 bp, Homo sapiens
cctgctgggtgccaggtgct

SEQ ID NO: 6088328 - DNA, 15 bp, Homo sapiens
cctgctggtacctgc

SEQ ID NO: 6088329 - DNA, 16 bp, Homo sapiens
cctgctggtacctgcc

SEQ ID NO: 6088330 - DNA, 18 bp, Homo sapiens
cctgctggtacctgccct

SEQ ID NO: 6088331 - DNA, 19 bp, Homo sapiens
cctgctggtacctgccctc

SEQ ID NO: 6088332 - DNA, 22 bp, Homo sapiens
cctgctggtacctgccctctat

SEQ ID NO: 6088333 - DNA, 21 bp, Homo sapiens
cctgctggtgaccggcctgga

SEQ ID NO: 6088334 - DNA, 19 bp, Homo sapiens
cctgctggttgttgccagg

SEQ ID NO: 6088335 - DNA, 20 bp, Homo sapiens
cctgctggttgttgccaggt

SEQ ID NO: 6088336 - DNA, 21 bp, Homo sapiens
cctgctggttgttgccaggtt

SEQ ID NO: 6088337 - DNA, 18 bp, Homo sapiens
cctgctggtttcttcagt

SEQ ID NO: 6088338 - DNA, 13 bp, Homo sapiens
cctgctggtttta

SEQ ID NO: 6088339 - DNA, 21 bp, Homo sapiens
cctgctgtaaatttggcttct

SEQ ID NO: 6088340 - DNA, 14 bp, Homo sapiens
cctgctgtagtcct

SEQ ID NO: 6088341 - DNA, 17 bp, Homo sapiens
cctgctgtagtcctttc

SEQ ID NO: 6088342 - DNA, 19 bp, Homo sapiens
cctgctgtagtcctttctg

SEQ ID NO: 6088343 - DNA, 21 bp, Homo sapiens
cctgctgtagtcctttctgcc

SEQ ID NO: 6088344 - DNA, 15 bp, Homo sapiens
cctgctgtcattgct

SEQ ID NO: 6088345 - DNA, 20 bp, Homo sapiens
cctgctgtcattgcttcttc

SEQ ID NO: 6088346 - DNA, 15 bp, Homo sapiens
cctgctgtcccctct

SEQ ID NO: 6088347 - DNA, 13 bp, Homo sapiens
cctgctgtccctg

SEQ ID NO: 6088348 - DNA, 14 bp, Homo sapiens
cctgctgtccctgt

SEQ ID NO: 6088349 - DNA, 17 bp, Homo sapiens
cctgctgtccctgtcag

SEQ ID NO: 6088350 - DNA, 16 bp, Homo sapiens
cctgctgtcctggtgg

SEQ ID NO: 6088351 - DNA, 12 bp, Homo sapiens
cctgctgtgctg

SEQ ID NO: 6088352 - DNA, 14 bp, Homo sapiens
cctgctgtgctgct

SEQ ID NO: 6088353 - DNA, 17 bp, Homo sapiens
cctgctgtgctgctcaa

SEQ ID NO: 6088354 - DNA, 13 bp, Homo sapiens
cctgctgtgctgg

SEQ ID NO: 6088355 - DNA, 13 bp, Homo sapiens
cctgctgtggagc

SEQ ID NO: 6088356 - DNA, 16 bp, Homo sapiens
cctgctgtggatgtcc

SEQ ID NO: 6088357 - DNA, 18 bp, Homo sapiens
cctgctgtggcctcactt

SEQ ID NO: 6088358 - DNA, 12 bp, Homo sapiens
cctgctgtgggg

SEQ ID NO: 6088359 - DNA, 13 bp, Homo sapiens
cctgctgtggggc

SEQ ID NO: 6088360 - DNA, 16 bp, Homo sapiens
cctgctgtgggtcagt

SEQ ID NO: 6088361 - DNA, 19 bp, Homo sapiens
cctgctgtgggtcagtgtg

SEQ ID NO: 6088362 - DNA, 15 bp, Homo sapiens
cctgcttaaaaatgt

SEQ ID NO: 6088363 - DNA, 17 bp, Homo sapiens
cctgcttacctctgttt

SEQ ID NO: 6088364 - DNA, 16 bp, Homo sapiens
cctgcttacctgccag

SEQ ID NO: 6088365 - DNA, 19 bp, Homo sapiens
cctgcttatgatgggctcc

SEQ ID NO: 6088366 - DNA, 23 bp, Homo sapiens
cctgcttatgatgggctccccag

SEQ ID NO: 6088367 - DNA, 13 bp, Homo sapiens
cctgcttcacacc

SEQ ID NO: 6088368 - DNA, 14 bp, Homo sapiens
cctgcttcacaccc

SEQ ID NO: 6088369 - DNA, 17 bp, Homo sapiens
cctgcttcacacccctc

SEQ ID NO: 6088370 - DNA, 21 bp, Homo sapiens
cctgcttcacacccctcagcg

SEQ ID NO: 6088371 - DNA, 23 bp, Homo sapiens
cctgcttcagcctcccacagtgc

SEQ ID NO: 6088372 - DNA, 22 bp, Homo sapiens
cctgcttcatatctctcccttc

SEQ ID NO: 6088373 - DNA, 14 bp, Homo sapiens
cctgcttcatgctc

SEQ ID NO: 6088374 - DNA, 19 bp, Homo sapiens
cctgcttccacctcacccc

SEQ ID NO: 6088375 - DNA, 15 bp, Homo sapiens
cctgcttccaggcct

SEQ ID NO: 6088376 - DNA, 17 bp, Homo sapiens
cctgcttcccaaactcc

SEQ ID NO: 6088377 - DNA, 20 bp, Homo sapiens
cctgcttcccaaactcccag

SEQ ID NO: 6088378 - DNA, 21 bp, Homo sapiens
cctgcttcccaaactcccagg

SEQ ID NO: 6088379 - DNA, 16 bp, Homo sapiens
cctgcttcccacaact

SEQ ID NO: 6088380 - DNA, 17 bp, Homo sapiens
cctgcttcccccacttc

SEQ ID NO: 6088381 - DNA, 19 bp, Homo sapiens
cctgcttccccctccccct

SEQ ID NO: 6088382 - DNA, 12 bp, Homo sapiens
cctgcttcccct

SEQ ID NO: 6088383 - DNA, 21 bp, Homo sapiens
cctgcttcccctccctaccct

SEQ ID NO: 6088384 - DNA, 13 bp, Homo sapiens
cctgcttccctgt

SEQ ID NO: 6088385 - DNA, 12 bp, Homo sapiens
cctgcttcctag

SEQ ID NO: 6088386 - DNA, 21 bp, Homo sapiens
cctgcttcctaggccccagag

SEQ ID NO: 6088387 - DNA, 15 bp, Homo sapiens
cctgcttcctcagag

SEQ ID NO: 6088388 - DNA, 19 bp, Homo sapiens
cctgcttcctgaaataaac

SEQ ID NO: 6088389 - DNA, 23 bp, Homo sapiens
cctgcttcctgaaataaacactg

SEQ ID NO: 6088390 - DNA, 16 bp, Homo sapiens
cctgcttcctggaccg

SEQ ID NO: 6088391 - DNA, 16 bp, Homo sapiens
cctgcttcctgttacc

SEQ ID NO: 6088392 - DNA, 19 bp, Homo sapiens
cctgcttccttcagtttgt

SEQ ID NO: 6088393 - DNA, 15 bp, Homo sapiens
cctgcttctcagccc

SEQ ID NO: 6088394 - DNA, 13 bp, Homo sapiens
cctgcttctcccg

SEQ ID NO: 6088395 - DNA, 22 bp, Homo sapiens
cctgcttctcccgccattggcc

SEQ ID NO: 6088396 - DNA, 21 bp, Homo sapiens
cctgcttctcccggggacgct

SEQ ID NO: 6088397 - DNA, 15 bp, Homo sapiens
cctgcttctctgccc

SEQ ID NO: 6088398 - DNA, 16 bp, Homo sapiens
cctgcttctcttttcc

SEQ ID NO: 6088399 - DNA, 20 bp, Homo sapiens
ccctgttttctgagcccggg

SEQ ID NO: 6088400 - DNA, 22 bp, Homo sapiens
ccctgttttctgagcccgggct

SEQ ID NO: 6088401 - DNA, 15 bp, Homo sapiens
ccctgttttctgttt

SEQ ID NO: 6088402 - DNA, 20 bp, Homo sapiens
cccttaaacagttgcacagc

SEQ ID NO: 6088403 - DNA, 21 bp, Homo sapiens
cccttaaacagttgcacagca

SEQ ID NO: 6088404 - DNA, 19 bp, Homo sapiens
cccttaaacttccaaagct

SEQ ID NO: 6088405 - DNA, 21 bp, Homo sapiens
cccttaaagggaattcgatgc

SEQ ID NO: 6088406 - DNA, 14 bp, Homo sapiens
cccttaacccaagg

SEQ ID NO: 6088407 - DNA, 17 bp, Homo sapiens
cccttaacccaaggagc

SEQ ID NO: 6088408 - DNA, 17 bp, Homo sapiens
cccttaaccccaaggac

SEQ ID NO: 6088409 - DNA, 16 bp, Homo sapiens
cccttaacctaaattt

SEQ ID NO: 6088410 - DNA, 16 bp, Homo sapiens
cccttaacttttcctt

SEQ ID NO: 6088411 - DNA, 24 bp, Homo sapiens
cccttaagccaaactcaggcccag

SEQ ID NO: 6088412 - DNA, 17 bp, Homo sapiens
cccttaagccctggccc

SEQ ID NO: 6088413 - DNA, 21 bp, Homo sapiens
cccttaatattgaggctgcag

SEQ ID NO: 6088414 - DNA, 15 bp, Homo sapiens
cccttaatcttgctt

SEQ ID NO: 6088415 - DNA, 15 bp, Homo sapiens
cccttacaagacctc

SEQ ID NO: 6088416 - DNA, 13 bp, Homo sapiens
cccttacacactc

SEQ ID NO: 6088417 - DNA, 18 bp, Homo sapiens
cccttacacactcaggcc

SEQ ID NO: 6088418 - DNA, 18 bp, Homo sapiens
cccttacagcctctgact

SEQ ID NO: 6088419 - DNA, 19 bp, Homo sapiens
cccttacagcctctgactt

SEQ ID NO: 6088420 - DNA, 14 bp, Homo sapiens
cccttacagtagga

SEQ ID NO: 6088421 - DNA, 13 bp, Homo sapiens
cccttacccatct

SEQ ID NO: 6088422 - DNA, 18 bp, Homo sapiens
cccttacccatcttgctt

SEQ ID NO: 6088423 - DNA, 17 bp, Homo sapiens
cccttaccccttagcct

SEQ ID NO: 6088424 - DNA, 22 bp, Homo sapiens
cccttaccccttagcctccctg

SEQ ID NO: 6088425 - DNA, 21 bp, Homo sapiens
cccttaccctttcctccttta

SEQ ID NO: 6088426 - DNA, 12 bp, Homo sapiens
cccttacctcaa

SEQ ID NO: 6088427 - DNA, 19 bp, Homo sapiens
cccttacctcggtgccttc

SEQ ID NO: 6088428 - DNA, 20 bp, Homo sapiens
cccttacctgccaggaagcc

SEQ ID NO: 6088429 - DNA, 15 bp, Homo sapiens
cccttacctgtctct

SEQ ID NO: 6088430 - DNA, 22 bp, Homo sapiens
cccttacctgtgaccctctttg

SEQ ID NO: 6088431 - DNA, 13 bp, Homo sapiens
cccttaccttccc

SEQ ID NO: 6088432 - DNA, 17 bp, Homo sapiens
cccttacgtgagtcctg

SEQ ID NO: 6088433 - DNA, 14 bp, Homo sapiens
cccttactgagcgc

SEQ ID NO: 6088434 - DNA, 16 bp, Homo sapiens
cccttacttcttgccc

SEQ ID NO: 6088435 - DNA, 18 bp, Homo sapiens
cccttagaagatctgctt

SEQ ID NO: 6088436 - DNA, 16 bp, Homo sapiens
cccttagaatgtttct

SEQ ID NO: 6088437 - DNA, 12 bp, Homo sapiens
cccttagacaga

SEQ ID NO: 6088438 - DNA, 21 bp, Homo sapiens
cccttagacagaggccctcaa

SEQ ID NO: 6088439 - DNA, 18 bp, Homo sapiens
cccttagagattgcccca

SEQ ID NO: 6088440 - DNA, 22 bp, Homo sapiens
cccttagaggggaatgaaccat

SEQ ID NO: 6088441 - DNA, 19 bp, Homo sapiens
cccttagcacagagaggga

SEQ ID NO: 6088442 - DNA, 16 bp, Homo sapiens
cccttagcaccttcag

SEQ ID NO: 6088443 - DNA, 15 bp, Homo sapiens
cccttagcagcccag

SEQ ID NO: 6088444 - DNA, 14 bp, Homo sapiens
cccttagcagggaa

SEQ ID NO: 6088445 - DNA, 23 bp, Homo sapiens
cccttagcagggaaggctggtct

SEQ ID NO: 6088446 - DNA, 21 bp, Homo sapiens
cccttagcccccacccacttc

SEQ ID NO: 6088447 - DNA, 16 bp, Homo sapiens
cccttagcctctccca

SEQ ID NO: 6088448 - DNA, 17 bp, Homo sapiens
cccttagcctctcccac

SEQ ID NO: 6088449 - DNA, 19 bp, Homo sapiens
cccttagcctctcccaccc

SEQ ID NO: 6088450 - DNA, 12 bp, Homo sapiens
cccttagctctc

SEQ ID NO: 6088451 - DNA, 14 bp, Homo sapiens
cccttagctctccc

SEQ ID NO: 6088452 - DNA, 21 bp, Homo sapiens
cccttagcttttagcctggct

SEQ ID NO: 6088453 - DNA, 20 bp, Homo sapiens
cccttaggatggggctccca

SEQ ID NO: 6088454 - DNA, 21 bp, Homo sapiens
cccttaggatggggctcccag

SEQ ID NO: 6088455 - DNA, 23 bp, Homo sapiens
cccttaggatggggctcccagct

SEQ ID NO: 6088456 - DNA, 21 bp, Homo sapiens
cccttaggccccgtggtgaca

SEQ ID NO: 6088457 - DNA, 23 bp, Homo sapiens
cccttagtcccccaactctgagc

SEQ ID NO: 6088458 - DNA, 13 bp, Homo sapiens
cccttataaaatc

SEQ ID NO: 6088459 - DNA, 15 bp, Homo sapiens
cccttatccaggact

SEQ ID NO: 6088460 - DNA, 14 bp, Homo sapiens
cccttatccctgct

SEQ ID NO: 6088461 - DNA, 16 bp, Homo sapiens
cccttatcctccctgt

SEQ ID NO: 6088462 - DNA, 13 bp, Homo sapiens
cccttatcctgag

SEQ ID NO: 6088463 - DNA, 17 bp, Homo sapiens
cccttatgactgccaag

SEQ ID NO: 6088464 - DNA, 18 bp, Homo sapiens
cccttattcctaatggct

SEQ ID NO: 6088465 - DNA, 21 bp, Homo sapiens
cccttattgcctcccaggcaa

SEQ ID NO: 6088466 - DNA, 16 bp, Homo sapiens
cccttattgctgccaa

SEQ ID NO: 6088467 - DNA, 16 bp, Homo sapiens
cccttcaacaaacagt

SEQ ID NO: 6088468 - DNA, 18 bp, Homo sapiens
cccttcaacttcagaagg

SEQ ID NO: 6088469 - DNA, 20 bp, Homo sapiens
cccttcaagacgaggggcag

SEQ ID NO: 6088470 - DNA, 23 bp, Homo sapiens
cccttcaatgctgcaggatggac

SEQ ID NO: 6088471 - DNA, 15 bp, Homo sapiens
cccttcacaccccag

SEQ ID NO: 6088472 - DNA, 20 bp, Homo sapiens
cccttcacaccccaggccct

SEQ ID NO: 6088473 - DNA, 21 bp, Homo sapiens
cccttcacctttggtgcagag

SEQ ID NO: 6088474 - DNA, 12 bp, Homo sapiens
cccttcacgctg

SEQ ID NO: 6088475 - DNA, 16 bp, Homo sapiens
cccttcactgccatga

SEQ ID NO: 6088476 - DNA, 17 bp, Homo sapiens
cccttcactgcctttgc

SEQ ID NO: 6088477 - DNA, 18 bp, Homo sapiens
cccttcactgcctttgct

SEQ ID NO: 6088478 - DNA, 17 bp, Homo sapiens
cccttcacttctgacca

SEQ ID NO: 6088479 - DNA, 16 bp, Homo sapiens
cccttcagaccttgca

SEQ ID NO: 6088480 - DNA, 15 bp, Homo sapiens
cccttcagccagaag

SEQ ID NO: 6088481 - DNA, 20 bp, Homo sapiens
cccttcagcccaccaccctg

SEQ ID NO: 6088482 - DNA, 12 bp, Homo sapiens
cccttcagcccc

SEQ ID NO: 6088483 - DNA, 24 bp, Homo sapiens
cccttcagccgagcccagacctcc

SEQ ID NO: 6088484 - DNA, 14 bp, Homo sapiens
cccttcagctcctg

SEQ ID NO: 6088485 - DNA, 15 bp, Homo sapiens
cccttcagctcctga

SEQ ID NO: 6088486 - DNA, 16 bp, Homo sapiens
cccttcagctcctgag

SEQ ID NO: 6088487 - DNA, 17 bp, Homo sapiens
cccttcagctcctgagt

SEQ ID NO: 6088488 - DNA, 13 bp, Homo sapiens
cccttcaggaact

SEQ ID NO: 6088489 - DNA, 23 bp, Homo sapiens
cccttcaggaagcaggtgtcctt

SEQ ID NO: 6088490 - DNA, 13 bp, Homo sapiens
cccttcaggagcc

SEQ ID NO: 6088491 - DNA, 19 bp, Homo sapiens
cccttcaggagcctggcca

SEQ ID NO: 6088492 - DNA, 20 bp, Homo sapiens
cccttcaggagcctggccag

SEQ ID NO: 6088493 - DNA, 22 bp, Homo sapiens
cccttcaggagcctggccaggc

SEQ ID NO: 6088494 - DNA, 19 bp, Homo sapiens
cccttcaggcccgctgccc

SEQ ID NO: 6088495 - DNA, 20 bp, Homo sapiens
cccttcagggattccctgtc

SEQ ID NO: 6088496 - DNA, 13 bp, Homo sapiens
cccttcagtctgc

SEQ ID NO: 6088497 - DNA, 19 bp, Homo sapiens
cccttcagtgctacatttt

SEQ ID NO: 6088498 - DNA, 16 bp, Homo sapiens
cccttcatccatcctg

SEQ ID NO: 6088499 - DNA, 12 bp, Homo sapiens
cccttcatccca

SEQ ID NO: 6088500 - DNA, 14 bp, Homo sapiens
cccttcatcccagg

SEQ ID NO: 6088501 - DNA, 18 bp, Homo sapiens
cccttcatccgcctgtgg

SEQ ID NO: 6088502 - DNA, 15 bp, Homo sapiens
cccttcatctccagg

SEQ ID NO: 6088503 - DNA, 14 bp, Homo sapiens
cccttcatctggaa

SEQ ID NO: 6088504 - DNA, 16 bp, Homo sapiens
cccttcatctggaacc

SEQ ID NO: 6088505 - DNA, 14 bp, Homo sapiens
cccttcatcttcct

SEQ ID NO: 6088506 - DNA, 16 bp, Homo sapiens
cccttcatcttcctgt

SEQ ID NO: 6088507 - DNA, 19 bp, Homo sapiens
cccttcattgatttcctgt

SEQ ID NO: 6088508 - DNA, 21 bp, Homo sapiens
cccttcattgatttcctgtgt

SEQ ID NO: 6088509 - DNA, 11 bp, Homo sapiens
cccttccaaag

SEQ ID NO: 6088510 - DNA, 12 bp, Homo sapiens
cccttccaaaga

SEQ ID NO: 6088511 - DNA, 15 bp, Homo sapiens
cccttccaaataata

SEQ ID NO: 6088512 - DNA, 20 bp, Homo sapiens
cccttccaaataataaagtc

SEQ ID NO: 6088513 - DNA, 16 bp, Homo sapiens
cccttccaatgctgtg

SEQ ID NO: 6088514 - DNA, 16 bp, Homo sapiens
cccttccacctgctct

SEQ ID NO: 6088515 - DNA, 13 bp, Homo sapiens
cccttccactgag

SEQ ID NO: 6088516 - DNA, 16 bp, Homo sapiens
cccttccactgcctct

SEQ ID NO: 6088517 - DNA, 20 bp, Homo sapiens
cccttccactgcctctgcct

SEQ ID NO: 6088518 - DNA, 15 bp, Homo sapiens
cccttccagcctggg

SEQ ID NO: 6088519 - DNA, 16 bp, Homo sapiens
cccttccagcctggga

SEQ ID NO: 6088520 - DNA, 17 bp, Homo sapiens
cccttccagcctgggac

SEQ ID NO: 6088521 - DNA, 17 bp, Homo sapiens
cccttccagctccctcc

SEQ ID NO: 6088522 - DNA, 20 bp, Homo sapiens
cccttccaggaatgctgggc

SEQ ID NO: 6088523 - DNA, 14 bp, Homo sapiens
cccttccaggccat

SEQ ID NO: 6088524 - DNA, 17 bp, Homo sapiens
cccttccaggccatcag

SEQ ID NO: 6088525 - DNA, 23 bp, Homo sapiens
cccttccaggccatcagaggcct

SEQ ID NO: 6088526 - DNA, 11 bp, Homo sapiens
cccttccagtg

SEQ ID NO: 6088527 - DNA, 20 bp, Homo sapiens
cccttccagtggtaccagct

SEQ ID NO: 6088528 - DNA, 19 bp, Homo sapiens
cccttccatcagcgggtct

SEQ ID NO: 6088529 - DNA, 18 bp, Homo sapiens
cccttccatgccccagga

SEQ ID NO: 6088530 - DNA, 11 bp, Homo sapiens
cccttcccaac

SEQ ID NO: 6088531 - DNA, 20 bp, Homo sapiens
cccttcccaatcagcactga

SEQ ID NO: 6088532 - DNA, 21 bp, Homo sapiens
cccttcccaatcagcactgaa

SEQ ID NO: 6088533 - DNA, 16 bp, Homo sapiens
cccttcccacatgcct

SEQ ID NO: 6088534 - DNA, 14 bp, Homo sapiens
cccttcccacccct

SEQ ID NO: 6088535 - DNA, 16 bp, Homo sapiens
cccttcccagaccagg

SEQ ID NO: 6088536 - DNA, 14 bp, Homo sapiens
cccttcccaggagg

SEQ ID NO: 6088537 - DNA, 12 bp, Homo sapiens
cccttcccaggg

SEQ ID NO: 6088538 - DNA, 14 bp, Homo sapiens
cccttcccagggca

SEQ ID NO: 6088539 - DNA, 23 bp, Homo sapiens
cccttcccagggcacccaggcag

SEQ ID NO: 6088540 - DNA, 14 bp, Homo sapiens
cccttcccaggggc

SEQ ID NO: 6088541 - DNA, 14 bp, Homo sapiens
cccttcccagtggg

SEQ ID NO: 6088542 - DNA, 22 bp, Homo sapiens
cccttccccaagaaggtgagtg

SEQ ID NO: 6088543 - DNA, 13 bp, Homo sapiens
cccttccccactc

SEQ ID NO: 6088544 - DNA, 15 bp, Homo sapiens
cccttccccactctg

SEQ ID NO: 6088545 - DNA, 22 bp, Homo sapiens
cccttccccagagatggctcct

SEQ ID NO: 6088546 - DNA, 15 bp, Homo sapiens
cccttccccagccct

SEQ ID NO: 6088547 - DNA, 16 bp, Homo sapiens
cccttccccagccctt

SEQ ID NO: 6088548 - DNA, 13 bp, Homo sapiens
cccttccccaggc

SEQ ID NO: 6088549 - DNA, 14 bp, Homo sapiens
cccttccccatggg

SEQ ID NO: 6088550 - DNA, 20 bp, Homo sapiens
cccttccccatttcctcttc

SEQ ID NO: 6088551 - DNA, 22 bp, Homo sapiens
cccttccccatttcctcttcct

SEQ ID NO: 6088552 - DNA, 16 bp, Homo sapiens
cccttccccctttctc

SEQ ID NO: 6088553 - DNA, 23 bp, Homo sapiens
cccttcccctcccgacagcccat

SEQ ID NO: 6088554 - DNA, 17 bp, Homo sapiens
cccttcccctgcgccct

SEQ ID NO: 6088555 - DNA, 20 bp, Homo sapiens
cccttcccctgcgccctccc

SEQ ID NO: 6088556 - DNA, 22 bp, Homo sapiens
cccttcccctgcgccctccctc

SEQ ID NO: 6088557 - DNA, 13 bp, Homo sapiens
cccttcccctgct

SEQ ID NO: 6088558 - DNA, 13 bp, Homo sapiens
cccttcccctggg

SEQ ID NO: 6088559 - DNA, 22 bp, Homo sapiens
cccttcccgccttcaggttcct

SEQ ID NO: 6088560 - DNA, 16 bp, Homo sapiens
cccttcccgccttcca

SEQ ID NO: 6088561 - DNA, 17 bp, Homo sapiens
cccttccctcctcccat

SEQ ID NO: 6088562 - DNA, 17 bp, Homo sapiens
cccttccctctctccct

SEQ ID NO: 6088563 - DNA, 18 bp, Homo sapiens
cccttccctctctccctg

SEQ ID NO: 6088564 - DNA, 14 bp, Homo sapiens
cccttccctcttcc

SEQ ID NO: 6088565 - DNA, 16 bp, Homo sapiens
cccttccctgacactg

SEQ ID NO: 6088566 - DNA, 11 bp, Homo sapiens
cccttccctgc

SEQ ID NO: 6088567 - DNA, 19 bp, Homo sapiens
cccttccctgcctccagct

SEQ ID NO: 6088568 - DNA, 15 bp, Homo sapiens
cccttccctgctttg

SEQ ID NO: 6088569 - DNA, 15 bp, Homo sapiens
cccttccctggcccc

SEQ ID NO: 6088570 - DNA, 15 bp, Homo sapiens
cccttccctgggagg

SEQ ID NO: 6088571 - DNA, 15 bp, Homo sapiens
cccttccctggggag

SEQ ID NO: 6088572 - DNA, 22 bp, Homo sapiens
cccttccctggggagccctcag

SEQ ID NO: 6088573 - DNA, 14 bp, Homo sapiens
cccttcccttccac

SEQ ID NO: 6088574 - DNA, 17 bp, Homo sapiens
cccttcccttccactgc

SEQ ID NO: 6088575 - DNA, 18 bp, Homo sapiens
cccttcccttgagatgag

SEQ ID NO: 6088576 - DNA, 19 bp, Homo sapiens
cccttcccttgagccctct

SEQ ID NO: 6088577 - DNA, 14 bp, Homo sapiens
cccttccgaccctc

SEQ ID NO: 6088578 - DNA, 15 bp, Homo sapiens
cccttccgaccctct

SEQ ID NO: 6088579 - DNA, 18 bp, Homo sapiens
cctgcttctcttttcctc

SEQ ID NO: 6088580 - DNA, 15 bp, Homo sapiens
cctgcttctgaactc

SEQ ID NO: 6088581 - DNA, 19 bp, Homo sapiens
cctgcttctgctgcctgtt

SEQ ID NO: 6088582 - DNA, 23 bp, Homo sapiens
cctgcttctgtgtaccacttctg

SEQ ID NO: 6088583 - DNA, 21 bp, Homo sapiens
cctgcttcttccccagggttc

SEQ ID NO: 6088584 - DNA, 18 bp, Homo sapiens
cctgcttgaactgctgcc

SEQ ID NO: 6088585 - DNA, 20 bp, Homo sapiens
cctgcttgaactgctgccaa

SEQ ID NO: 6088586 - DNA, 21 bp, Homo sapiens
cctgcttgaaggaacagtgct

SEQ ID NO: 6088587 - DNA, 22 bp, Homo sapiens
cctgcttgaaggaacagtgctg

SEQ ID NO: 6088588 - DNA, 17 bp, Homo sapiens
cctgcttgactttccag

SEQ ID NO: 6088589 - DNA, 21 bp, Homo sapiens
cctgcttgactttccagaatg

SEQ ID NO: 6088590 - DNA, 23 bp, Homo sapiens
cctgcttgactttccagaatgac

SEQ ID NO: 6088591 - DNA, 24 bp, Homo sapiens
cctgcttgagctttctgtgcatgt

SEQ ID NO: 6088592 - DNA, 17 bp, Homo sapiens
cctgcttgcaggaggcc

SEQ ID NO: 6088593 - DNA, 19 bp, Homo sapiens
cctgcttgcaggaggccaa

SEQ ID NO: 6088594 - DNA, 15 bp, Homo sapiens
cctgcttgccaaggc

SEQ ID NO: 6088595 - DNA, 15 bp, Homo sapiens
cctgcttgctggaaa

SEQ ID NO: 6088596 - DNA, 15 bp, Homo sapiens
cctgcttggcccagg

SEQ ID NO: 6088597 - DNA, 15 bp, Homo sapiens
cctgcttggggcctg

SEQ ID NO: 6088598 - DNA, 22 bp, Homo sapiens
cctgcttgggtggagaagccat

SEQ ID NO: 6088599 - DNA, 23 bp, Homo sapiens
cctgcttgggtggagaagccatt

SEQ ID NO: 6088600 - DNA, 17 bp, Homo sapiens
cctgcttggtctttcat

SEQ ID NO: 6088601 - DNA, 19 bp, Homo sapiens
cctgcttgtactaagccag

SEQ ID NO: 6088602 - DNA, 22 bp, Homo sapiens
cctgcttgtactaagccaggag

SEQ ID NO: 6088603 - DNA, 15 bp, Homo sapiens
cctgcttgtccctgc

SEQ ID NO: 6088604 - DNA, 17 bp, Homo sapiens
cctgctttaaccacccc

SEQ ID NO: 6088605 - DNA, 18 bp, Homo sapiens
cctgctttccatgggccc

SEQ ID NO: 6088606 - DNA, 22 bp, Homo sapiens
cctgctttccatgggcccgctg

SEQ ID NO: 6088607 - DNA, 14 bp, Homo sapiens
cctgctttccctcc

SEQ ID NO: 6088608 - DNA, 13 bp, Homo sapiens
cctgctttctacg

SEQ ID NO: 6088609 - DNA, 20 bp, Homo sapiens
cctgctttgaataaatgtgt

SEQ ID NO: 6088610 - DNA, 18 bp, Homo sapiens
cctgctttgacgggccag

SEQ ID NO: 6088611 - DNA, 22 bp, Homo sapiens
cctgctttgacgggccaggccc

SEQ ID NO: 6088612 - DNA, 13 bp, Homo sapiens
cctgctttgcaaa

SEQ ID NO: 6088613 - DNA, 21 bp, Homo sapiens
cctgctttgcaaacatcaacc

SEQ ID NO: 6088614 - DNA, 18 bp, Homo sapiens
cctgctttgcatctttgt

SEQ ID NO: 6088615 - DNA, 21 bp, Homo sapiens
cctgctttgccccactgggag

SEQ ID NO: 6088616 - DNA, 19 bp, Homo sapiens
cctgctttgcgtgcccggg

SEQ ID NO: 6088617 - DNA, 14 bp, Homo sapiens
cctgctttggcctt

SEQ ID NO: 6088618 - DNA, 15 bp, Homo sapiens
cctgctttgggaaga

SEQ ID NO: 6088619 - DNA, 18 bp, Homo sapiens
cctgctttgggctgccct

SEQ ID NO: 6088620 - DNA, 20 bp, Homo sapiens
cctgctttgggctgccctgg

SEQ ID NO: 6088621 - DNA, 21 bp, Homo sapiens
cctgctttgggctgccctggt

SEQ ID NO: 6088622 - DNA, 22 bp, Homo sapiens
cctgctttgggctgccctggtg

SEQ ID NO: 6088623 - DNA, 18 bp, Homo sapiens
cctgctttgggcttgggc

SEQ ID NO: 6088624 - DNA, 20 bp, Homo sapiens
cctgcttttaggagaattca

SEQ ID NO: 6088625 - DNA, 13 bp, Homo sapiens
cctgcttttcaat

SEQ ID NO: 6088626 - DNA, 15 bp, Homo sapiens
cctgcttttcactgc

SEQ ID NO: 6088627 - DNA, 19 bp, Homo sapiens
cctgcttttcactgctgca

SEQ ID NO: 6088628 - DNA, 21 bp, Homo sapiens
cctgcttttcactgctgcaag

SEQ ID NO: 6088629 - DNA, 17 bp, Homo sapiens
cctgcttttctgtcctg

SEQ ID NO: 6088630 - DNA, 19 bp, Homo sapiens
cctgcttttctgtcctggg

SEQ ID NO: 6088631 - DNA, 13 bp, Homo sapiens
cctgcttttgcaa

SEQ ID NO: 6088632 - DNA, 13 bp, Homo sapiens
cctgcttttgcat

SEQ ID NO: 6088633 - DNA, 18 bp, Homo sapiens
cctgcttttggggctctt

SEQ ID NO: 6088634 - DNA, 19 bp, Homo sapiens
cctgcttttggggctcttg

SEQ ID NO: 6088635 - DNA, 17 bp, Homo sapiens
cctgcttttgtgtccca

SEQ ID NO: 6088636 - DNA, 20 bp, Homo sapiens
cctgctttttatggcctgtg

SEQ ID NO: 6088637 - DNA, 16 bp, Homo sapiens
cctgctttttgaaatg

SEQ ID NO: 6088638 - DNA, 22 bp, Homo sapiens
cctgctttttgaaatgaaattt

SEQ ID NO: 6088639 - DNA, 23 bp, Homo sapiens
cctgctttttgaaatgaaattta

SEQ ID NO: 6088640 - DNA, 16 bp, Homo sapiens
cctgctttttgtgttt

SEQ ID NO: 6088641 - DNA, 20 bp, Homo sapiens
cctggaaaaacatgcgatgt

SEQ ID NO: 6088642 - DNA, 13 bp, Homo sapiens
cctggaaaaggag

SEQ ID NO: 6088643 - DNA, 20 bp, Homo sapiens
cctggaaaaggagcttcagt

SEQ ID NO: 6088644 - DNA, 15 bp, Homo sapiens
cctggaaaattctat

SEQ ID NO: 6088645 - DNA, 19 bp, Homo sapiens
cctggaaacagaggtaaaa

SEQ ID NO: 6088646 - DNA, 16 bp, Homo sapiens
cctggaaacagcatga

SEQ ID NO: 6088647 - DNA, 17 bp, Homo sapiens
cctggaaacagcatgaa

SEQ ID NO: 6088648 - DNA, 22 bp, Homo sapiens
cctggaaacagcatgaataaaa

SEQ ID NO: 6088649 - DNA, 13 bp, Homo sapiens
cctggaaacccac

SEQ ID NO: 6088650 - DNA, 16 bp, Homo sapiens
cctggaaacccacctc

SEQ ID NO: 6088651 - DNA, 15 bp, Homo sapiens
cctggaaacctgtct

SEQ ID NO: 6088652 - DNA, 17 bp, Homo sapiens
cctggaaaggctcagtc

SEQ ID NO: 6088653 - DNA, 22 bp, Homo sapiens
cctggaaatatcagttactcag

SEQ ID NO: 6088654 - DNA, 19 bp, Homo sapiens
cctggaaattctggaactg

SEQ ID NO: 6088655 - DNA, 17 bp, Homo sapiens
cctggaacatctcacct

SEQ ID NO: 6088656 - DNA, 14 bp, Homo sapiens
cctggaaccaatcc

SEQ ID NO: 6088657 - DNA, 15 bp, Homo sapiens
cctggaaccagagcc

SEQ ID NO: 6088658 - DNA, 22 bp, Homo sapiens
cctggaaccagcaagtcccaga

SEQ ID NO: 6088659 - DNA, 21 bp, Homo sapiens
cctggaaccagggaggagagg

SEQ ID NO: 6088660 - DNA, 12 bp, Homo sapiens
cctggaacctgg

SEQ ID NO: 6088661 - DNA, 16 bp, Homo sapiens
cctggaacctggaccc

SEQ ID NO: 6088662 - DNA, 19 bp, Homo sapiens
cctggaacctggaccccag

SEQ ID NO: 6088663 - DNA, 15 bp, Homo sapiens
cctggaacctggcag

SEQ ID NO: 6088664 - DNA, 16 bp, Homo sapiens
cctggaacctggcagg

SEQ ID NO: 6088665 - DNA, 17 bp, Homo sapiens
cctggaacctggcaggc

SEQ ID NO: 6088666 - DNA, 20 bp, Homo sapiens
cctggaacctggcaggccct

SEQ ID NO: 6088667 - DNA, 15 bp, Homo sapiens
cctggaaccttgctg

SEQ ID NO: 6088668 - DNA, 16 bp, Homo sapiens
cctggaacctttccct

SEQ ID NO: 6088669 - DNA, 15 bp, Homo sapiens
cctggaactcctggc

SEQ ID NO: 6088670 - DNA, 17 bp, Homo sapiens
cctggaactcctggcct

SEQ ID NO: 6088671 - DNA, 20 bp, Homo sapiens
cctggaactctatctgggcc

SEQ ID NO: 6088672 - DNA, 16 bp, Homo sapiens
cctggaacttggggag

SEQ ID NO: 6088673 - DNA, 23 bp, Homo sapiens
cctggaagaacaggcctctccat

SEQ ID NO: 6088674 - DNA, 12 bp, Homo sapiens
cctggaagacaa

SEQ ID NO: 6088675 - DNA, 14 bp, Homo sapiens
cctggaagacagag

SEQ ID NO: 6088676 - DNA, 16 bp, Homo sapiens
cctggaagagcagccc

SEQ ID NO: 6088677 - DNA, 18 bp, Homo sapiens
cctggaagagcccagtct

SEQ ID NO: 6088678 - DNA, 20 bp, Homo sapiens
cctggaagagctgagacctt

SEQ ID NO: 6088679 - DNA, 11 bp, Homo sapiens
cctggaagcac

SEQ ID NO: 6088680 - DNA, 16 bp, Homo sapiens
cctggaagcagagcaa

SEQ ID NO: 6088681 - DNA, 17 bp, Homo sapiens
cctggaagcagagcaaa

SEQ ID NO: 6088682 - DNA, 22 bp, Homo sapiens
cctggaagcagagcaaaatgct

SEQ ID NO: 6088683 - DNA, 23 bp, Homo sapiens
cctggaagcagtgcccaggtggc

SEQ ID NO: 6088684 - DNA, 11 bp, Homo sapiens
cctggaagcca

SEQ ID NO: 6088685 - DNA, 15 bp, Homo sapiens
cctggaagctggaag

SEQ ID NO: 6088686 - DNA, 17 bp, Homo sapiens
cctggaagctggaagac

SEQ ID NO: 6088687 - DNA, 17 bp, Homo sapiens
cctggaagctgtgtcct

SEQ ID NO: 6088688 - DNA, 22 bp, Homo sapiens
cctggaaggacatccatgttcc

SEQ ID NO: 6088689 - DNA, 17 bp, Homo sapiens
cctggaagggaggtggg

SEQ ID NO: 6088690 - DNA, 12 bp, Homo sapiens
cctggaagggct

SEQ ID NO: 6088691 - DNA, 13 bp, Homo sapiens
cctggaagggcta

SEQ ID NO: 6088692 - DNA, 21 bp, Homo sapiens
cctggaagtcaaataaatgtt

SEQ ID NO: 6088693 - DNA, 21 bp, Homo sapiens
cctggaatacgatcctgcagg

SEQ ID NO: 6088694 - DNA, 18 bp, Homo sapiens
cctggaatcaaggaatcc

SEQ ID NO: 6088695 - DNA, 16 bp, Homo sapiens
cctggaatgaagcatg

SEQ ID NO: 6088696 - DNA, 20 bp, Homo sapiens
cctggaatgagttgaggcca

SEQ ID NO: 6088697 - DNA, 12 bp, Homo sapiens
cctggaattcac

SEQ ID NO: 6088698 - DNA, 23 bp, Homo sapiens
cctggaattcagcaccctgggtg

SEQ ID NO: 6088699 - DNA, 20 bp, Homo sapiens
cctggaatttaattcaaagt

SEQ ID NO: 6088700 - DNA, 10 bp, Homo sapiens
cctggacaca

SEQ ID NO: 6088701 - DNA, 12 bp, Homo sapiens
cctggacacact

SEQ ID NO: 6088702 - DNA, 14 bp, Homo sapiens
cctggacacagccc

SEQ ID NO: 6088703 - DNA, 18 bp, Homo sapiens
cctggacacagcccaccc

SEQ ID NO: 6088704 - DNA, 22 bp, Homo sapiens
cctggacacagcccaccctctg

SEQ ID NO: 6088705 - DNA, 23 bp, Homo sapiens
cctggacacagcccaccctctgt

SEQ ID NO: 6088706 - DNA, 13 bp, Homo sapiens
cctggacacagct

SEQ ID NO: 6088707 - DNA, 14 bp, Homo sapiens
cctggacacagctc

SEQ ID NO: 6088708 - DNA, 18 bp, Homo sapiens
cctggacacagctcttca

SEQ ID NO: 6088709 - DNA, 19 bp, Homo sapiens
cctggacacagctcttcat

SEQ ID NO: 6088710 - DNA, 16 bp, Homo sapiens
cctggacacagtcagg

SEQ ID NO: 6088711 - DNA, 11 bp, Homo sapiens
cctggacacat

SEQ ID NO: 6088712 - DNA, 18 bp, Homo sapiens
cctggacacccctgctct

SEQ ID NO: 6088713 - DNA, 20 bp, Homo sapiens
cctggacacctcccagggga

SEQ ID NO: 6088714 - DNA, 14 bp, Homo sapiens
cctggacagaggcg

SEQ ID NO: 6088715 - DNA, 19 bp, Homo sapiens
cctggacagatggcccaag

SEQ ID NO: 6088716 - DNA, 20 bp, Homo sapiens
cctggacagatggcccaagg

SEQ ID NO: 6088717 - DNA, 18 bp, Homo sapiens
cctggacagctgtgcctc

SEQ ID NO: 6088718 - DNA, 22 bp, Homo sapiens
cctggacagctgtgcctcgctc

SEQ ID NO: 6088719 - DNA, 15 bp, Homo sapiens
cctggacagcttagt

SEQ ID NO: 6088720 - DNA, 17 bp, Homo sapiens
cctggacaggcagcctc

SEQ ID NO: 6088721 - DNA, 16 bp, Homo sapiens
cctggacaggcgggct

SEQ ID NO: 6088722 - DNA, 19 bp, Homo sapiens
cctggacagtatcccacat

SEQ ID NO: 6088723 - DNA, 16 bp, Homo sapiens
cctggacatattccca

SEQ ID NO: 6088724 - DNA, 20 bp, Homo sapiens
cctggacatcctcttctgct

SEQ ID NO: 6088725 - DNA, 13 bp, Homo sapiens
cctggacatgcct

SEQ ID NO: 6088726 - DNA, 16 bp, Homo sapiens
cctggacatgcctgtc

SEQ ID NO: 6088727 - DNA, 18 bp, Homo sapiens
cctggacatgcctgtcct

SEQ ID NO: 6088728 - DNA, 19 bp, Homo sapiens
cctggacatgcctgtcctg

SEQ ID NO: 6088729 - DNA, 21 bp, Homo sapiens
cctggacatttgccttgctgg

SEQ ID NO: 6088730 - DNA, 19 bp, Homo sapiens
cctggacattttttcagtc

SEQ ID NO: 6088731 - DNA, 16 bp, Homo sapiens
cctggaccaaagctga

SEQ ID NO: 6088732 - DNA, 18 bp, Homo sapiens
cctggaccaccagcccca

SEQ ID NO: 6088733 - DNA, 13 bp, Homo sapiens
cctggaccagccg

SEQ ID NO: 6088734 - DNA, 22 bp, Homo sapiens
cctggaccagccgcccagatca

SEQ ID NO: 6088735 - DNA, 14 bp, Homo sapiens
cctggaccagcctc

SEQ ID NO: 6088736 - DNA, 15 bp, Homo sapiens
cctggaccagcctct

SEQ ID NO: 6088737 - DNA, 16 bp, Homo sapiens
cctggaccagcctctc

SEQ ID NO: 6088738 - DNA, 14 bp, Homo sapiens
cctggaccattcct

SEQ ID NO: 6088739 - DNA, 17 bp, Homo sapiens
cctggaccattcctgtc

SEQ ID NO: 6088740 - DNA, 20 bp, Homo sapiens
cctggaccattcctgtccct

SEQ ID NO: 6088741 - DNA, 23 bp, Homo sapiens
cctggaccattcctgtccctttg

SEQ ID NO: 6088742 - DNA, 18 bp, Homo sapiens
cctggacccagcaggggc

SEQ ID NO: 6088743 - DNA, 18 bp, Homo sapiens
cctggaccccagccttgg

SEQ ID NO: 6088744 - DNA, 14 bp, Homo sapiens
cctggaccccaggc

SEQ ID NO: 6088745 - DNA, 17 bp, Homo sapiens
cctggacccccagcttt

SEQ ID NO: 6088746 - DNA, 24 bp, Homo sapiens
cctggacccccctttcacaggcag

SEQ ID NO: 6088747 - DNA, 17 bp, Homo sapiens
cctggaccccctgcccg

SEQ ID NO: 6088748 - DNA, 14 bp, Homo sapiens
cctggacccctgca

SEQ ID NO: 6088749 - DNA, 15 bp, Homo sapiens
cctggacccctggac

SEQ ID NO: 6088750 - DNA, 15 bp, Homo sapiens
cctggacccctgggg

SEQ ID NO: 6088751 - DNA, 16 bp, Homo sapiens
cctggaccctggccta

SEQ ID NO: 6088752 - DNA, 14 bp, Homo sapiens
cctggaccctgtgg

SEQ ID NO: 6088753 - DNA, 17 bp, Homo sapiens
cctggaccgagatgtga

SEQ ID NO: 6088754 - DNA, 21 bp, Homo sapiens
cctggaccgcttcccagaggc

SEQ ID NO: 6088755 - DNA, 12 bp, Homo sapiens
cctggacctctg

SEQ ID NO: 6088756 - DNA, 17 bp, Homo sapiens
cctggacctctgacagc

SEQ ID NO: 6088757 - DNA, 16 bp, Homo sapiens
cccttccgaccctctg

SEQ ID NO: 6088758 - DNA, 17 bp, Homo sapiens
cccttccgaccctctgg

SEQ ID NO: 6088759 - DNA, 20 bp, Homo sapiens
cccttccgaccctctgggaa

SEQ ID NO: 6088760 - DNA, 18 bp, Homo sapiens
cccttccgccactggggc

SEQ ID NO: 6088761 - DNA, 15 bp, Homo sapiens
cccttccggtgcgtg

SEQ ID NO: 6088762 - DNA, 23 bp, Homo sapiens
cccttccgtccatcccccttctt

SEQ ID NO: 6088763 - DNA, 13 bp, Homo sapiens
cccttcctagtga

SEQ ID NO: 6088764 - DNA, 22 bp, Homo sapiens
cccttcctattccaagcttcca

SEQ ID NO: 6088765 - DNA, 22 bp, Homo sapiens
cccttcctattctcctgccatg

SEQ ID NO: 6088766 - DNA, 17 bp, Homo sapiens
cccttcctcatctgtgc

SEQ ID NO: 6088767 - DNA, 20 bp, Homo sapiens
cccttcctcatctgtgcctg

SEQ ID NO: 6088768 - DNA, 17 bp, Homo sapiens
cccttcctccccacact

SEQ ID NO: 6088769 - DNA, 21 bp, Homo sapiens
cccttcctccctattaaccta

SEQ ID NO: 6088770 - DNA, 21 bp, Homo sapiens
cccttcctccctgtctctgca

SEQ ID NO: 6088771 - DNA, 23 bp, Homo sapiens
cccttcctcctccaccaccgccc

SEQ ID NO: 6088772 - DNA, 17 bp, Homo sapiens
cccttcctcctctcctg

SEQ ID NO: 6088773 - DNA, 19 bp, Homo sapiens
cccttcctcctctcctgga

SEQ ID NO: 6088774 - DNA, 22 bp, Homo sapiens
cccttcctcctgaagcctctgc

SEQ ID NO: 6088775 - DNA, 18 bp, Homo sapiens
cccttcctcctgcctttc

SEQ ID NO: 6088776 - DNA, 24 bp, Homo sapiens
cccttcctcgcacagggcatgcct

SEQ ID NO: 6088777 - DNA, 19 bp, Homo sapiens
cccttcctcggtggctctg

SEQ ID NO: 6088778 - DNA, 22 bp, Homo sapiens
cccttcctcgtgggtcccagag

SEQ ID NO: 6088779 - DNA, 18 bp, Homo sapiens
cccttcctctccaccctc

SEQ ID NO: 6088780 - DNA, 20 bp, Homo sapiens
cccttcctctccactgcctt

SEQ ID NO: 6088781 - DNA, 16 bp, Homo sapiens
cccttcctctcccatt

SEQ ID NO: 6088782 - DNA, 16 bp, Homo sapiens
cccttcctctctcctt

SEQ ID NO: 6088783 - DNA, 17 bp, Homo sapiens
cccttcctctgtgccac

SEQ ID NO: 6088784 - DNA, 13 bp, Homo sapiens
cccttcctgaccc

SEQ ID NO: 6088785 - DNA, 17 bp, Homo sapiens
cccttcctgaccctccg

SEQ ID NO: 6088786 - DNA, 21 bp, Homo sapiens
cccttcctgcatttctcttct

SEQ ID NO: 6088787 - DNA, 17 bp, Homo sapiens
cccttcctgccctgtgg

SEQ ID NO: 6088788 - DNA, 18 bp, Homo sapiens
cccttcctgccctgtggc

SEQ ID NO: 6088789 - DNA, 13 bp, Homo sapiens
cccttcctggaaa

SEQ ID NO: 6088790 - DNA, 19 bp, Homo sapiens
cccttcctggacacactct

SEQ ID NO: 6088791 - DNA, 14 bp, Homo sapiens
cccttcctggacag

SEQ ID NO: 6088792 - DNA, 20 bp, Homo sapiens
cccttcctggacagctgtgc

SEQ ID NO: 6088793 - DNA, 23 bp, Homo sapiens
cccttcctggacagctgtgcctc

SEQ ID NO: 6088794 - DNA, 13 bp, Homo sapiens
cccttcctggcac

SEQ ID NO: 6088795 - DNA, 14 bp, Homo sapiens
cccttcctggcaca

SEQ ID NO: 6088796 - DNA, 19 bp, Homo sapiens
cccttcctggcccaggcct

SEQ ID NO: 6088797 - DNA, 24 bp, Homo sapiens
cccttcctggcctcactggctggg

SEQ ID NO: 6088798 - DNA, 14 bp, Homo sapiens
cccttcctgggcac

SEQ ID NO: 6088799 - DNA, 22 bp, Homo sapiens
cccttcctgggcacacgctgct

SEQ ID NO: 6088800 - DNA, 12 bp, Homo sapiens
cccttcctgggt

SEQ ID NO: 6088801 - DNA, 16 bp, Homo sapiens
cccttcctgtcctgcc

SEQ ID NO: 6088802 - DNA, 16 bp, Homo sapiens
cccttcctgtcctgct

SEQ ID NO: 6088803 - DNA, 16 bp, Homo sapiens
cccttcctgtgcctgt

SEQ ID NO: 6088804 - DNA, 19 bp, Homo sapiens
cccttcctgttccctcctg

SEQ ID NO: 6088805 - DNA, 12 bp, Homo sapiens
cccttccttcac

SEQ ID NO: 6088806 - DNA, 12 bp, Homo sapiens
cccttccttctt

SEQ ID NO: 6088807 - DNA, 15 bp, Homo sapiens
cccttccttgggcag

SEQ ID NO: 6088808 - DNA, 18 bp, Homo sapiens
cccttccttgggcgtctc

SEQ ID NO: 6088809 - DNA, 13 bp, Homo sapiens
cccttcctttcct

SEQ ID NO: 6088810 - DNA, 16 bp, Homo sapiens
cccttcctttcctctg

SEQ ID NO: 6088811 - DNA, 21 bp, Homo sapiens
cccttccttttccctgcttcc

SEQ ID NO: 6088812 - DNA, 17 bp, Homo sapiens
cccttcgacatgctgcc

SEQ ID NO: 6088813 - DNA, 17 bp, Homo sapiens
cccttcgcgtatttcag

SEQ ID NO: 6088814 - DNA, 12 bp, Homo sapiens
cccttcgctcct

SEQ ID NO: 6088815 - DNA, 16 bp, Homo sapiens
cccttcgctcctgtgt

SEQ ID NO: 6088816 - DNA, 17 bp, Homo sapiens
cccttcgctctgctgga

SEQ ID NO: 6088817 - DNA, 15 bp, Homo sapiens
cccttcgctgccagg

SEQ ID NO: 6088818 - DNA, 16 bp, Homo sapiens
cccttcgctgccagga

SEQ ID NO: 6088819 - DNA, 17 bp, Homo sapiens
cccttcgctgccaggac

SEQ ID NO: 6088820 - DNA, 22 bp, Homo sapiens
cccttcgctgccaggacacctg

SEQ ID NO: 6088821 - DNA, 15 bp, Homo sapiens
cccttcggccaaaca

SEQ ID NO: 6088822 - DNA, 15 bp, Homo sapiens
cccttctacactctc

SEQ ID NO: 6088823 - DNA, 16 bp, Homo sapiens
cccttctaccttcctg

SEQ ID NO: 6088824 - DNA, 22 bp, Homo sapiens
cccttctactttttccttcctg

SEQ ID NO: 6088825 - DNA, 18 bp, Homo sapiens
cccttctatacccaccca

SEQ ID NO: 6088826 - DNA, 16 bp, Homo sapiens
cccttctcagaatcta

SEQ ID NO: 6088827 - DNA, 17 bp, Homo sapiens
cccttctcatctcccca

SEQ ID NO: 6088828 - DNA, 23 bp, Homo sapiens
cccttctcattccaacagtgagt

SEQ ID NO: 6088829 - DNA, 15 bp, Homo sapiens
cccttctccaaaggc

SEQ ID NO: 6088830 - DNA, 15 bp, Homo sapiens
cccttctccatggag

SEQ ID NO: 6088831 - DNA, 13 bp, Homo sapiens
cccttctcccaca

SEQ ID NO: 6088832 - DNA, 14 bp, Homo sapiens
cccttctcccacac

SEQ ID NO: 6088833 - DNA, 14 bp, Homo sapiens
cccttctcccactc

SEQ ID NO: 6088834 - DNA, 14 bp, Homo sapiens
cccttctcccatga

SEQ ID NO: 6088835 - DNA, 13 bp, Homo sapiens
cccttctccccct

SEQ ID NO: 6088836 - DNA, 15 bp, Homo sapiens
cccttctcccccttg

SEQ ID NO: 6088837 - DNA, 13 bp, Homo sapiens
cccttctcccctg

SEQ ID NO: 6088838 - DNA, 18 bp, Homo sapiens
cccttctcccctgcactg

SEQ ID NO: 6088839 - DNA, 13 bp, Homo sapiens
cccttctcccctt

SEQ ID NO: 6088840 - DNA, 15 bp, Homo sapiens
cccttctccctggat

SEQ ID NO: 6088841 - DNA, 17 bp, Homo sapiens
cccttctcctcttgtaa

SEQ ID NO: 6088842 - DNA, 15 bp, Homo sapiens
cccttctccttccaa

SEQ ID NO: 6088843 - DNA, 12 bp, Homo sapiens
cccttctccttt

SEQ ID NO: 6088844 - DNA, 20 bp, Homo sapiens
cccttctcgtgtttgcttaa

SEQ ID NO: 6088845 - DNA, 18 bp, Homo sapiens
cccttctctcagcctcca

SEQ ID NO: 6088846 - DNA, 14 bp, Homo sapiens
cccttctctccagc

SEQ ID NO: 6088847 - DNA, 22 bp, Homo sapiens
cccttctctccagcccctggat

SEQ ID NO: 6088848 - DNA, 21 bp, Homo sapiens
cccttctctccctgccagagg

SEQ ID NO: 6088849 - DNA, 11 bp, Homo sapiens
cccttctctct

SEQ ID NO: 6088850 - DNA, 21 bp, Homo sapiens
cccttctctcttttcttctca

SEQ ID NO: 6088851 - DNA, 19 bp, Homo sapiens
cccttctctgcccattccc

SEQ ID NO: 6088852 - DNA, 15 bp, Homo sapiens
cccttctctgcctca

SEQ ID NO: 6088853 - DNA, 16 bp, Homo sapiens
cccttctctgcctcac

SEQ ID NO: 6088854 - DNA, 22 bp, Homo sapiens
cccttctctgcctcacctggtc

SEQ ID NO: 6088855 - DNA, 15 bp, Homo sapiens
cccttctctgcctcc

SEQ ID NO: 6088856 - DNA, 13 bp, Homo sapiens
cccttctctgctc

SEQ ID NO: 6088857 - DNA, 18 bp, Homo sapiens
cccttctctggtctcctt

SEQ ID NO: 6088858 - DNA, 20 bp, Homo sapiens
cccttctctggtctccttga

SEQ ID NO: 6088859 - DNA, 16 bp, Homo sapiens
cccttctctgtagctg

SEQ ID NO: 6088860 - DNA, 19 bp, Homo sapiens
cccttctctgtagctgcta

SEQ ID NO: 6088861 - DNA, 12 bp, Homo sapiens
cccttctctgtg

SEQ ID NO: 6088862 - DNA, 21 bp, Homo sapiens
cccttctctgtgacccacttc

SEQ ID NO: 6088863 - DNA, 13 bp, Homo sapiens
cccttctcttcca

SEQ ID NO: 6088864 - DNA, 19 bp, Homo sapiens
cccttctctttggggctcc

SEQ ID NO: 6088865 - DNA, 23 bp, Homo sapiens
cccttctgacccatgctgccctg

SEQ ID NO: 6088866 - DNA, 21 bp, Homo sapiens
cccttctgactgtttatttaa

SEQ ID NO: 6088867 - DNA, 22 bp, Homo sapiens
cccttctgactgtttatttaag

SEQ ID NO: 6088868 - DNA, 14 bp, Homo sapiens
cccttctgctcagc

SEQ ID NO: 6088869 - DNA, 13 bp, Homo sapiens
cccttctgctttc

SEQ ID NO: 6088870 - DNA, 12 bp, Homo sapiens
cccttctgggca

SEQ ID NO: 6088871 - DNA, 14 bp, Homo sapiens
cccttctgggtcca

SEQ ID NO: 6088872 - DNA, 15 bp, Homo sapiens
cccttctgtgcccag

SEQ ID NO: 6088873 - DNA, 17 bp, Homo sapiens
cccttctgtgtcacagt

SEQ ID NO: 6088874 - DNA, 14 bp, Homo sapiens
cccttcttcccgcc

SEQ ID NO: 6088875 - DNA, 20 bp, Homo sapiens
cccttcttcccgccccacct

SEQ ID NO: 6088876 - DNA, 12 bp, Homo sapiens
cccttcttccct

SEQ ID NO: 6088877 - DNA, 17 bp, Homo sapiens
cccttcttcctcccctc

SEQ ID NO: 6088878 - DNA, 18 bp, Homo sapiens
cccttcttcctcccctca

SEQ ID NO: 6088879 - DNA, 17 bp, Homo sapiens
cccttcttgcctgctgg

SEQ ID NO: 6088880 - DNA, 14 bp, Homo sapiens
cccttcttgggccc

SEQ ID NO: 6088881 - DNA, 18 bp, Homo sapiens
cccttcttgggccccaga

SEQ ID NO: 6088882 - DNA, 19 bp, Homo sapiens
cccttcttgggccccagac

SEQ ID NO: 6088883 - DNA, 15 bp, Homo sapiens
cccttctttaaatca

SEQ ID NO: 6088884 - DNA, 16 bp, Homo sapiens
cccttctttccttcct

SEQ ID NO: 6088885 - DNA, 13 bp, Homo sapiens
cccttcttttcct

SEQ ID NO: 6088886 - DNA, 22 bp, Homo sapiens
cccttcttttgaccccttcctg

SEQ ID NO: 6088887 - DNA, 14 bp, Homo sapiens
cccttctttttccc

SEQ ID NO: 6088888 - DNA, 19 bp, Homo sapiens
cccttctttttcttctttt

SEQ ID NO: 6088889 - DNA, 19 bp, Homo sapiens
cccttgaaatttagatcaa

SEQ ID NO: 6088890 - DNA, 18 bp, Homo sapiens
cccttgaaccccctccct

SEQ ID NO: 6088891 - DNA, 20 bp, Homo sapiens
cccttgaagaggggaggggc

SEQ ID NO: 6088892 - DNA, 21 bp, Homo sapiens
cccttgaagaggggaggggcc

SEQ ID NO: 6088893 - DNA, 14 bp, Homo sapiens
cccttgaagcaata

SEQ ID NO: 6088894 - DNA, 15 bp, Homo sapiens
cccttgaagcaataa

SEQ ID NO: 6088895 - DNA, 20 bp, Homo sapiens
cccttgaagcaataactcca

SEQ ID NO: 6088896 - DNA, 21 bp, Homo sapiens
cccttgaagcaataactccaa

SEQ ID NO: 6088897 - DNA, 16 bp, Homo sapiens
cccttgaaggaagagg

SEQ ID NO: 6088898 - DNA, 16 bp, Homo sapiens
cccttgaatctgcagg

SEQ ID NO: 6088899 - DNA, 19 bp, Homo sapiens
cccttgaatctgcagggag

SEQ ID NO: 6088900 - DNA, 17 bp, Homo sapiens
cccttgacaactggcag

SEQ ID NO: 6088901 - DNA, 19 bp, Homo sapiens
cccttgacaactggcaggc

SEQ ID NO: 6088902 - DNA, 15 bp, Homo sapiens
cccttgacacctgct

SEQ ID NO: 6088903 - DNA, 15 bp, Homo sapiens
cccttgaccattggc

SEQ ID NO: 6088904 - DNA, 15 bp, Homo sapiens
cccttgaccccacac

SEQ ID NO: 6088905 - DNA, 12 bp, Homo sapiens
cccttgacctgc

SEQ ID NO: 6088906 - DNA, 23 bp, Homo sapiens
cccttgacgtcaagtctccttcc

SEQ ID NO: 6088907 - DNA, 12 bp, Homo sapiens
cccttgactgtt

SEQ ID NO: 6088908 - DNA, 18 bp, Homo sapiens
cccttgagaccaaaattt

SEQ ID NO: 6088909 - DNA, 17 bp, Homo sapiens
cccttgagacctcagcc

SEQ ID NO: 6088910 - DNA, 15 bp, Homo sapiens
cccttgagccctccc

SEQ ID NO: 6088911 - DNA, 18 bp, Homo sapiens
cccttgagccctccccag

SEQ ID NO: 6088912 - DNA, 17 bp, Homo sapiens
cccttgagggctgcagt

SEQ ID NO: 6088913 - DNA, 16 bp, Homo sapiens
cccttgaggggcccca

SEQ ID NO: 6088914 - DNA, 22 bp, Homo sapiens
cccttgaggggccccagcgtct

SEQ ID NO: 6088915 - DNA, 15 bp, Homo sapiens
cccttgatgcacaga

SEQ ID NO: 6088916 - DNA, 16 bp, Homo sapiens
cccttgatgcacagag

SEQ ID NO: 6088917 - DNA, 22 bp, Homo sapiens
cccttgatgcccagctcagtgc

SEQ ID NO: 6088918 - DNA, 16 bp, Homo sapiens
cccttgattcattctg

SEQ ID NO: 6088919 - DNA, 19 bp, Homo sapiens
cccttgatttaaacacaca

SEQ ID NO: 6088920 - DNA, 13 bp, Homo sapiens
cccttgcaagcca

SEQ ID NO: 6088921 - DNA, 14 bp, Homo sapiens
cccttgcaagccat

SEQ ID NO: 6088922 - DNA, 15 bp, Homo sapiens
cccttgcacgtaaac

SEQ ID NO: 6088923 - DNA, 12 bp, Homo sapiens
cccttgcagccg

SEQ ID NO: 6088924 - DNA, 13 bp, Homo sapiens
cccttgcagcctg

SEQ ID NO: 6088925 - DNA, 22 bp, Homo sapiens
cccttgcagggtgggtgagctc

SEQ ID NO: 6088926 - DNA, 19 bp, Homo sapiens
cccttgcagttatgttatc

SEQ ID NO: 6088927 - DNA, 13 bp, Homo sapiens
cccttgccacccc

SEQ ID NO: 6088928 - DNA, 14 bp, Homo sapiens
cccttgcccaggcc

SEQ ID NO: 6088929 - DNA, 14 bp, Homo sapiens
cccttgcccagggc

SEQ ID NO: 6088930 - DNA, 21 bp, Homo sapiens
cccttgcccagggctcagcct

SEQ ID NO: 6088931 - DNA, 22 bp, Homo sapiens
cccttgcccagggctcagcctg

SEQ ID NO: 6088932 - DNA, 18 bp, Homo sapiens
cccttgcccatgcctcca

SEQ ID NO: 6088933 - DNA, 16 bp, Homo sapiens
cccttgccccaggcca

SEQ ID NO: 6088934 - DNA, 17 bp, Homo sapiens
cccttgcccccctggcc

SEQ ID NO: 6088935 - DNA, 17 bp, Homo sapiens
cccttgcccgccagcca

SEQ ID NO: 6088936 - DNA, 16 bp, Homo sapiens
cccttgccctagatag

SEQ ID NO: 6088937 - DNA, 20 bp, Homo sapiens
cctggacctgagtcggcccc

SEQ ID NO: 6088938 - DNA, 21 bp, Homo sapiens
cctggacctgccctgggccac

SEQ ID NO: 6088939 - DNA, 23 bp, Homo sapiens
cctggacctgcctcctgcctgcc

SEQ ID NO: 6088940 - DNA, 14 bp, Homo sapiens
cctggacctggaac

SEQ ID NO: 6088941 - DNA, 15 bp, Homo sapiens
cctggaccttgacag

SEQ ID NO: 6088942 - DNA, 23 bp, Homo sapiens
cctggaccttgacagagcagcta

SEQ ID NO: 6088943 - DNA, 20 bp, Homo sapiens
cctggaccttttgttttctg

SEQ ID NO: 6088944 - DNA, 18 bp, Homo sapiens
cctggacgaagagcaggc

SEQ ID NO: 6088945 - DNA, 19 bp, Homo sapiens
cctggacgaagagcaggcc

SEQ ID NO: 6088946 - DNA, 19 bp, Homo sapiens
cctggacgcagccacacag

SEQ ID NO: 6088947 - DNA, 19 bp, Homo sapiens
cctggacgcatgcagggcc

SEQ ID NO: 6088948 - DNA, 20 bp, Homo sapiens
cctggacgcatgcagggccc

SEQ ID NO: 6088949 - DNA, 21 bp, Homo sapiens
cctggacgcccccgcccgcac

SEQ ID NO: 6088950 - DNA, 14 bp, Homo sapiens
cctggacgggccct

SEQ ID NO: 6088951 - DNA, 19 bp, Homo sapiens
cctggacgggccctccttc

SEQ ID NO: 6088952 - DNA, 20 bp, Homo sapiens
cctggacggggcgggccctg

SEQ ID NO: 6088953 - DNA, 22 bp, Homo sapiens
cctggacggggcgggccctgcc

SEQ ID NO: 6088954 - DNA, 20 bp, Homo sapiens
cctggactaaaggcatcctt

SEQ ID NO: 6088955 - DNA, 22 bp, Homo sapiens
cctggactagggcctcggaggc

SEQ ID NO: 6088956 - DNA, 14 bp, Homo sapiens
cctggactcctgca

SEQ ID NO: 6088957 - DNA, 22 bp, Homo sapiens
cctggactctgtggggccacac

SEQ ID NO: 6088958 - DNA, 18 bp, Homo sapiens
cctggactgaccctgcag

SEQ ID NO: 6088959 - DNA, 19 bp, Homo sapiens
cctggactgactgcagccc

SEQ ID NO: 6088960 - DNA, 17 bp, Homo sapiens
cctggactgagccaagg

SEQ ID NO: 6088961 - DNA, 21 bp, Homo sapiens
cctggactgagccaaggaggc

SEQ ID NO: 6088962 - DNA, 14 bp, Homo sapiens
cctggactgagggg

SEQ ID NO: 6088963 - DNA, 17 bp, Homo sapiens
cctggactggcccttgc

SEQ ID NO: 6088964 - DNA, 13 bp, Homo sapiens
cctggactgggag

SEQ ID NO: 6088965 - DNA, 17 bp, Homo sapiens
cctggactgggaggtag

SEQ ID NO: 6088966 - DNA, 19 bp, Homo sapiens
cctggactggttatcttgt

SEQ ID NO: 6088967 - DNA, 21 bp, Homo sapiens
cctggactggttatcttgtta

SEQ ID NO: 6088968 - DNA, 14 bp, Homo sapiens
cctggactgtccta

SEQ ID NO: 6088969 - DNA, 15 bp, Homo sapiens
cctggacttcctgtc

SEQ ID NO: 6088970 - DNA, 13 bp, Homo sapiens
cctggacttgcct

SEQ ID NO: 6088971 - DNA, 13 bp, Homo sapiens
cctggactttcct

SEQ ID NO: 6088972 - DNA, 16 bp, Homo sapiens
cctggactttcctgca

SEQ ID NO: 6088973 - DNA, 17 bp, Homo sapiens
cctggagaaaggatggc

SEQ ID NO: 6088974 - DNA, 13 bp, Homo sapiens
cctggagaactag

SEQ ID NO: 6088975 - DNA, 19 bp, Homo sapiens
cctggagaagaatggcttt

SEQ ID NO: 6088976 - DNA, 15 bp, Homo sapiens
cctggagaagcacca

SEQ ID NO: 6088977 - DNA, 17 bp, Homo sapiens
cctggagaagctgatgc

SEQ ID NO: 6088978 - DNA, 20 bp, Homo sapiens
cctggagaaggaagctgcct

SEQ ID NO: 6088979 - DNA, 15 bp, Homo sapiens
cctggagaagggaca

SEQ ID NO: 6088980 - DNA, 14 bp, Homo sapiens
cctggagaagtggg

SEQ ID NO: 6088981 - DNA, 19 bp, Homo sapiens
cctggagaagtgggtgggg

SEQ ID NO: 6088982 - DNA, 18 bp, Homo sapiens
cctggagacaaggtgcta

SEQ ID NO: 6088983 - DNA, 19 bp, Homo sapiens
cctggagacaaggtgctaa

SEQ ID NO: 6088984 - DNA, 20 bp, Homo sapiens
cctggagacagaagtcaggt

SEQ ID NO: 6088985 - DNA, 16 bp, Homo sapiens
cctggagacccacccc

SEQ ID NO: 6088986 - DNA, 15 bp, Homo sapiens
cctggagaccccacc

SEQ ID NO: 6088987 - DNA, 19 bp, Homo sapiens
cctggagacttagggcacc

SEQ ID NO: 6088988 - DNA, 23 bp, Homo sapiens
cctggagacttagggcaccaggg

SEQ ID NO: 6088989 - DNA, 21 bp, Homo sapiens
cctggagagccagaacctgga

SEQ ID NO: 6088990 - DNA, 16 bp, Homo sapiens
cctggagagcgaggag

SEQ ID NO: 6088991 - DNA, 20 bp, Homo sapiens
cctggagagcgaggaggcgc

SEQ ID NO: 6088992 - DNA, 13 bp, Homo sapiens
cctggagagctag

SEQ ID NO: 6088993 - DNA, 16 bp, Homo sapiens
cctggagaggcctggg

SEQ ID NO: 6088994 - DNA, 12 bp, Homo sapiens
cctggagagggg

SEQ ID NO: 6088995 - DNA, 14 bp, Homo sapiens
cctggagaggggcc

SEQ ID NO: 6088996 - DNA, 14 bp, Homo sapiens
cctggagagggtct

SEQ ID NO: 6088997 - DNA, 15 bp, Homo sapiens
cctggagagggtctc

SEQ ID NO: 6088998 - DNA, 20 bp, Homo sapiens
cctggagagggtctcgctgt

SEQ ID NO: 6088999 - DNA, 22 bp, Homo sapiens
cctggagagtacatttgcttta

SEQ ID NO: 6089000 - DNA, 17 bp, Homo sapiens
cctggagagtctcactc

SEQ ID NO: 6089001 - DNA, 22 bp, Homo sapiens
cctggagagttcaatggctgct

SEQ ID NO: 6089002 - DNA, 15 bp, Homo sapiens
cctggagatagctgg

SEQ ID NO: 6089003 - DNA, 23 bp, Homo sapiens
cctggagatattataagggagag

SEQ ID NO: 6089004 - DNA, 18 bp, Homo sapiens
cctggagatcctcctgca

SEQ ID NO: 6089005 - DNA, 13 bp, Homo sapiens
cctggagatgatg

SEQ ID NO: 6089006 - DNA, 16 bp, Homo sapiens
cctggagatgatgatg

SEQ ID NO: 6089007 - DNA, 15 bp, Homo sapiens
cctggagatggggag

SEQ ID NO: 6089008 - DNA, 14 bp, Homo sapiens
cctggagcaagctc

SEQ ID NO: 6089009 - DNA, 15 bp, Homo sapiens
cctggagcaagctct

SEQ ID NO: 6089010 - DNA, 17 bp, Homo sapiens
cctggagcaagctctgc

SEQ ID NO: 6089011 - DNA, 20 bp, Homo sapiens
cctggagcaatcacagatga

SEQ ID NO: 6089012 - DNA, 13 bp, Homo sapiens
cctggagcagaag

SEQ ID NO: 6089013 - DNA, 23 bp, Homo sapiens
cctggagcagaggaggggaaagt

SEQ ID NO: 6089014 - DNA, 14 bp, Homo sapiens
cctggagcaggcct

SEQ ID NO: 6089015 - DNA, 19 bp, Homo sapiens
cctggagccaatggcccgg

SEQ ID NO: 6089016 - DNA, 22 bp, Homo sapiens
cctggagccagactctggtctt

SEQ ID NO: 6089017 - DNA, 20 bp, Homo sapiens
cctggagccagcagggctgt

SEQ ID NO: 6089018 - DNA, 13 bp, Homo sapiens
cctggagccaggg

SEQ ID NO: 6089019 - DNA, 17 bp, Homo sapiens
cctggagcccacaacct

SEQ ID NO: 6089020 - DNA, 21 bp, Homo sapiens
cctggagcccacaaccttcgg

SEQ ID NO: 6089021 - DNA, 13 bp, Homo sapiens
cctggagccccac

SEQ ID NO: 6089022 - DNA, 17 bp, Homo sapiens
cctggagccccactgcc

SEQ ID NO: 6089023 - DNA, 22 bp, Homo sapiens
cctggagccccatcggccaaga

SEQ ID NO: 6089024 - DNA, 12 bp, Homo sapiens
cctggagcccct

SEQ ID NO: 6089025 - DNA, 20 bp, Homo sapiens
cctggagcccgaggcaccag

SEQ ID NO: 6089026 - DNA, 15 bp, Homo sapiens
cctggagccctgggc

SEQ ID NO: 6089027 - DNA, 19 bp, Homo sapiens
cctggagccctgggcggag

SEQ ID NO: 6089028 - DNA, 12 bp, Homo sapiens
cctggagcctca

SEQ ID NO: 6089029 - DNA, 17 bp, Homo sapiens
cctggagcctcagcagc

SEQ ID NO: 6089030 - DNA, 18 bp, Homo sapiens
cctggagcctcagcagca

SEQ ID NO: 6089031 - DNA, 17 bp, Homo sapiens
cctggagcctgggcagc

SEQ ID NO: 6089032 - DNA, 18 bp, Homo sapiens
cctggagcctgggcagca

SEQ ID NO: 6089033 - DNA, 19 bp, Homo sapiens
cctggagcggagcttgcct

SEQ ID NO: 6089034 - DNA, 22 bp, Homo sapiens
cctggagcggagcttgcctgcc

SEQ ID NO: 6089035 - DNA, 18 bp, Homo sapiens
cctggagcgtttgctgtg

SEQ ID NO: 6089036 - DNA, 15 bp, Homo sapiens
cctggagctcaagcc

SEQ ID NO: 6089037 - DNA, 13 bp, Homo sapiens
cctggagctgagg

SEQ ID NO: 6089038 - DNA, 14 bp, Homo sapiens
cctggagctgagga

SEQ ID NO: 6089039 - DNA, 13 bp, Homo sapiens
cctggagctgcca

SEQ ID NO: 6089040 - DNA, 16 bp, Homo sapiens
cctggagctgccagca

SEQ ID NO: 6089041 - DNA, 13 bp, Homo sapiens
cctggagctgtcc

SEQ ID NO: 6089042 - DNA, 18 bp, Homo sapiens
cctggagctgtccttcat

SEQ ID NO: 6089043 - DNA, 12 bp, Homo sapiens
cctggaggacct

SEQ ID NO: 6089044 - DNA, 16 bp, Homo sapiens
cctggaggacctgagc

SEQ ID NO: 6089045 - DNA, 17 bp, Homo sapiens
cctggaggacctgagcc

SEQ ID NO: 6089046 - DNA, 19 bp, Homo sapiens
cctggaggacctgagcctg

SEQ ID NO: 6089047 - DNA, 19 bp, Homo sapiens
cctggaggagaaggaggaa

SEQ ID NO: 6089048 - DNA, 15 bp, Homo sapiens
cctggaggagcagag

SEQ ID NO: 6089049 - DNA, 23 bp, Homo sapiens
cctggaggcaaaggcctggacag

SEQ ID NO: 6089050 - DNA, 14 bp, Homo sapiens
cctggaggcaagag

SEQ ID NO: 6089051 - DNA, 15 bp, Homo sapiens
cctggaggcaagagg

SEQ ID NO: 6089052 - DNA, 19 bp, Homo sapiens
cctggaggcaagagggagg

SEQ ID NO: 6089053 - DNA, 22 bp, Homo sapiens
cctggaggcacgcaccactgct

SEQ ID NO: 6089054 - DNA, 16 bp, Homo sapiens
cctggaggcaggggct

SEQ ID NO: 6089055 - DNA, 18 bp, Homo sapiens
cctggaggcaggggctgc

SEQ ID NO: 6089056 - DNA, 20 bp, Homo sapiens
cctggaggcagggggtgagg

SEQ ID NO: 6089057 - DNA, 15 bp, Homo sapiens
cctggaggcccagat

SEQ ID NO: 6089058 - DNA, 14 bp, Homo sapiens
cctggaggcccagt

SEQ ID NO: 6089059 - DNA, 23 bp, Homo sapiens
cctggaggccccaaccctgtcct

SEQ ID NO: 6089060 - DNA, 20 bp, Homo sapiens
cctggaggcggtgcggcagg

SEQ ID NO: 6089061 - DNA, 19 bp, Homo sapiens
cctggaggctcaaattttg

SEQ ID NO: 6089062 - DNA, 22 bp, Homo sapiens
cctggaggctcctctaggccct

SEQ ID NO: 6089063 - DNA, 16 bp, Homo sapiens
cctggaggctgacaca

SEQ ID NO: 6089064 - DNA, 18 bp, Homo sapiens
cctggaggctgacacaga

SEQ ID NO: 6089065 - DNA, 18 bp, Homo sapiens
cctggaggctgcctatgt

SEQ ID NO: 6089066 - DNA, 21 bp, Homo sapiens
cctggaggctgcctcccaaca

SEQ ID NO: 6089067 - DNA, 13 bp, Homo sapiens
cctggaggctgga

SEQ ID NO: 6089068 - DNA, 14 bp, Homo sapiens
cctggagggaagga

SEQ ID NO: 6089069 - DNA, 21 bp, Homo sapiens
cctggagggaaggacagtccc

SEQ ID NO: 6089070 - DNA, 24 bp, Homo sapiens
cctggagggaaggacagtccctgc

SEQ ID NO: 6089071 - DNA, 18 bp, Homo sapiens
cctggagggatgccccca

SEQ ID NO: 6089072 - DNA, 19 bp, Homo sapiens
cctggagggatgcccccag

SEQ ID NO: 6089073 - DNA, 22 bp, Homo sapiens
cctggagggatgcccccaggca

SEQ ID NO: 6089074 - DNA, 19 bp, Homo sapiens
cctggagggcaagccctgc

SEQ ID NO: 6089075 - DNA, 20 bp, Homo sapiens
cctggagggcaagccctgcc

SEQ ID NO: 6089076 - DNA, 22 bp, Homo sapiens
cctggagggcaagccctgccca

SEQ ID NO: 6089077 - DNA, 18 bp, Homo sapiens
cctggagggcacttcctc

SEQ ID NO: 6089078 - DNA, 15 bp, Homo sapiens
cctggagggcagaga

SEQ ID NO: 6089079 - DNA, 16 bp, Homo sapiens
cctggagggcgcccag

SEQ ID NO: 6089080 - DNA, 18 bp, Homo sapiens
cctggagggcgcccagca

SEQ ID NO: 6089081 - DNA, 12 bp, Homo sapiens
cctggagggcta

SEQ ID NO: 6089082 - DNA, 21 bp, Homo sapiens
cctggagggctagaacctgga

SEQ ID NO: 6089083 - DNA, 18 bp, Homo sapiens
cctggagggctagaactg

SEQ ID NO: 6089084 - DNA, 15 bp, Homo sapiens
cctggaggggagagg

SEQ ID NO: 6089085 - DNA, 18 bp, Homo sapiens
cctggaggggcaccaggt

SEQ ID NO: 6089086 - DNA, 13 bp, Homo sapiens
cctggaggggccc

SEQ ID NO: 6089087 - DNA, 14 bp, Homo sapiens
cctggaggggccca

SEQ ID NO: 6089088 - DNA, 17 bp, Homo sapiens
cctggaggggcccatgt

SEQ ID NO: 6089089 - DNA, 20 bp, Homo sapiens
cctggaggggctagaaccta

SEQ ID NO: 6089090 - DNA, 18 bp, Homo sapiens
cctggaggggctgaatgt

SEQ ID NO: 6089091 - DNA, 23 bp, Homo sapiens
cctggagggtaactggggggcca

SEQ ID NO: 6089092 - DNA, 21 bp, Homo sapiens
cctggaggtctccaggggcct

SEQ ID NO: 6089093 - DNA, 14 bp, Homo sapiens
cctggaggtgccag

SEQ ID NO: 6089094 - DNA, 18 bp, Homo sapiens
cctggaggtgccagcaaa

SEQ ID NO: 6089095 - DNA, 16 bp, Homo sapiens
cctggagtatttggaa

SEQ ID NO: 6089096 - DNA, 20 bp, Homo sapiens
cctggagtcactgcagaggg

SEQ ID NO: 6089097 - DNA, 13 bp, Homo sapiens
cctggagtcaggt

SEQ ID NO: 6089098 - DNA, 17 bp, Homo sapiens
cctggagtcagtagcca

SEQ ID NO: 6089099 - DNA, 20 bp, Homo sapiens
cctggagtcagtagccagag

SEQ ID NO: 6089100 - DNA, 21 bp, Homo sapiens
cctggagtcagtagccagagt

SEQ ID NO: 6089101 - DNA, 23 bp, Homo sapiens
cctggagtcccgtccctgcccag

SEQ ID NO: 6089102 - DNA, 24 bp, Homo sapiens
cctggagtcggatctagccatggc

SEQ ID NO: 6089103 - DNA, 19 bp, Homo sapiens
cctggagtcgtgggaagga

SEQ ID NO: 6089104 - DNA, 20 bp, Homo sapiens
cctggagtcgtgggaaggag

SEQ ID NO: 6089105 - DNA, 16 bp, Homo sapiens
cctggagtctgaagcc

SEQ ID NO: 6089106 - DNA, 19 bp, Homo sapiens
cctggagtctgaagcctgc

SEQ ID NO: 6089107 - DNA, 14 bp, Homo sapiens
cctggagtgaagaa

SEQ ID NO: 6089108 - DNA, 14 bp, Homo sapiens
cctggagtgcagtt

SEQ ID NO: 6089109 - DNA, 14 bp, Homo sapiens
cctggagtgccctg

SEQ ID NO: 6089110 - DNA, 15 bp, Homo sapiens
cctggagtgccctgc

SEQ ID NO: 6089111 - DNA, 14 bp, Homo sapiens
cctggagtggcatg

SEQ ID NO: 6089112 - DNA, 15 bp, Homo sapiens
cctggagtggcatgg

SEQ ID NO: 6089113 - DNA, 23 bp, Homo sapiens
cctggagtggcatggtcctgtgc

SEQ ID NO: 6089114 - DNA, 22 bp, Homo sapiens
cctggagtgtatgactgcacat

SEQ ID NO: 6089115 - DNA, 22 bp, Homo sapiens
cccttgccctccctttctctct

SEQ ID NO: 6089116 - DNA, 13 bp, Homo sapiens
cccttgccctccg

SEQ ID NO: 6089117 - DNA, 15 bp, Homo sapiens
cccttgccctgacct

SEQ ID NO: 6089118 - DNA, 14 bp, Homo sapiens
cccttgcccttcct

SEQ ID NO: 6089119 - DNA, 18 bp, Homo sapiens
cccttgcccttcctgacc

SEQ ID NO: 6089120 - DNA, 16 bp, Homo sapiens
cccttgcccttgccct

SEQ ID NO: 6089121 - DNA, 17 bp, Homo sapiens
cccttgcccttgccctg

SEQ ID NO: 6089122 - DNA, 18 bp, Homo sapiens
cccttgcccttgccctga

SEQ ID NO: 6089123 - DNA, 17 bp, Homo sapiens
cccttgccgtctacctg

SEQ ID NO: 6089124 - DNA, 18 bp, Homo sapiens
cccttgcctccccatttc

SEQ ID NO: 6089125 - DNA, 13 bp, Homo sapiens
cccttgcctctgc

SEQ ID NO: 6089126 - DNA, 15 bp, Homo sapiens
cccttgcctgcctcc

SEQ ID NO: 6089127 - DNA, 19 bp, Homo sapiens
cccttgcctgtgccaggtg

SEQ ID NO: 6089128 - DNA, 16 bp, Homo sapiens
cccttgccttcccctg

SEQ ID NO: 6089129 - DNA, 13 bp, Homo sapiens
cccttgccttcct

SEQ ID NO: 6089130 - DNA, 19 bp, Homo sapiens
cccttgctcagtgcctcct

SEQ ID NO: 6089131 - DNA, 22 bp, Homo sapiens
cccttgctcagtgcctcctggc

SEQ ID NO: 6089132 - DNA, 16 bp, Homo sapiens
cccttgctccagcctg

SEQ ID NO: 6089133 - DNA, 19 bp, Homo sapiens
cccttgctctacctggccg

SEQ ID NO: 6089134 - DNA, 19 bp, Homo sapiens
cccttgctctctgttctct

SEQ ID NO: 6089135 - DNA, 23 bp, Homo sapiens
cccttgctctctgttctcttgct

SEQ ID NO: 6089136 - DNA, 17 bp, Homo sapiens
cccttgctgaacacaca

SEQ ID NO: 6089137 - DNA, 19 bp, Homo sapiens
cccttgctgaacacacaca

SEQ ID NO: 6089138 - DNA, 22 bp, Homo sapiens
cccttgctgatgctcctccggg

SEQ ID NO: 6089139 - DNA, 23 bp, Homo sapiens
cccttgctgatgctcctccgggt

SEQ ID NO: 6089140 - DNA, 23 bp, Homo sapiens
cccttgctgcaaacccatgaagc

SEQ ID NO: 6089141 - DNA, 12 bp, Homo sapiens
cccttgctgccc

SEQ ID NO: 6089142 - DNA, 17 bp, Homo sapiens
cccttgctgctggctcc

SEQ ID NO: 6089143 - DNA, 12 bp, Homo sapiens
cccttgctgctt

SEQ ID NO: 6089144 - DNA, 22 bp, Homo sapiens
cccttgctggagtcatgtgcct

SEQ ID NO: 6089145 - DNA, 20 bp, Homo sapiens
cccttgctggccccagccct

SEQ ID NO: 6089146 - DNA, 12 bp, Homo sapiens
cccttgctgtac

SEQ ID NO: 6089147 - DNA, 14 bp, Homo sapiens
cccttgcttagcct

SEQ ID NO: 6089148 - DNA, 18 bp, Homo sapiens
cccttgcttgcctgcagg

SEQ ID NO: 6089149 - DNA, 19 bp, Homo sapiens
cccttgcttgcctgcaggg

SEQ ID NO: 6089150 - DNA, 13 bp, Homo sapiens
cccttgctttcct

SEQ ID NO: 6089151 - DNA, 20 bp, Homo sapiens
cccttgctttcctgggcctt

SEQ ID NO: 6089152 - DNA, 17 bp, Homo sapiens
cccttgcttttccctct

SEQ ID NO: 6089153 - DNA, 19 bp, Homo sapiens
cccttggaaacctgccctg

SEQ ID NO: 6089154 - DNA, 14 bp, Homo sapiens
cccttggaaagaaa

SEQ ID NO: 6089155 - DNA, 21 bp, Homo sapiens
cccttggaaatgtctgctggt

SEQ ID NO: 6089156 - DNA, 16 bp, Homo sapiens
cccttggaacaccctg

SEQ ID NO: 6089157 - DNA, 12 bp, Homo sapiens
cccttggaagag

SEQ ID NO: 6089158 - DNA, 15 bp, Homo sapiens
cccttggacacttgg

SEQ ID NO: 6089159 - DNA, 16 bp, Homo sapiens
cccttggacattttat

SEQ ID NO: 6089160 - DNA, 15 bp, Homo sapiens
cccttggagccttcc

SEQ ID NO: 6089161 - DNA, 19 bp, Homo sapiens
cccttggagcgtggactgg

SEQ ID NO: 6089162 - DNA, 18 bp, Homo sapiens
cccttggagctgccgtgc

SEQ ID NO: 6089163 - DNA, 15 bp, Homo sapiens
cccttggaggagggc

SEQ ID NO: 6089164 - DNA, 15 bp, Homo sapiens
cccttggaggccagc

SEQ ID NO: 6089165 - DNA, 17 bp, Homo sapiens
cccttggatcagaggtc

SEQ ID NO: 6089166 - DNA, 17 bp, Homo sapiens
cccttggattgtccccg

SEQ ID NO: 6089167 - DNA, 12 bp, Homo sapiens
cccttggcacca

SEQ ID NO: 6089168 - DNA, 20 bp, Homo sapiens
cccttggcaggtcctggcca

SEQ ID NO: 6089169 - DNA, 14 bp, Homo sapiens
cccttggcagtgtc

SEQ ID NO: 6089170 - DNA, 14 bp, Homo sapiens
cccttggcccctct

SEQ ID NO: 6089171 - DNA, 12 bp, Homo sapiens
cccttggcctca

SEQ ID NO: 6089172 - DNA, 16 bp, Homo sapiens
cccttggcctgtctca

SEQ ID NO: 6089173 - DNA, 18 bp, Homo sapiens
cccttggcgggcagccca

SEQ ID NO: 6089174 - DNA, 14 bp, Homo sapiens
cccttggctcctgt

SEQ ID NO: 6089175 - DNA, 12 bp, Homo sapiens
cccttggctctc

SEQ ID NO: 6089176 - DNA, 14 bp, Homo sapiens
cccttggctgggac

SEQ ID NO: 6089177 - DNA, 16 bp, Homo sapiens
cccttggcttctgtga

SEQ ID NO: 6089178 - DNA, 18 bp, Homo sapiens
cccttggcttctgtgatg

SEQ ID NO: 6089179 - DNA, 16 bp, Homo sapiens
cccttgggacagccag

SEQ ID NO: 6089180 - DNA, 17 bp, Homo sapiens
cccttgggatgggcaca

SEQ ID NO: 6089181 - DNA, 19 bp, Homo sapiens
cccttgggatgggcacagg

SEQ ID NO: 6089182 - DNA, 19 bp, Homo sapiens
cccttgggcagagtcctgc

SEQ ID NO: 6089183 - DNA, 22 bp, Homo sapiens
cccttgggcagttctcactcct

SEQ ID NO: 6089184 - DNA, 15 bp, Homo sapiens
cccttgggcctccca

SEQ ID NO: 6089185 - DNA, 19 bp, Homo sapiens
cccttgggcctcccactcc

SEQ ID NO: 6089186 - DNA, 21 bp, Homo sapiens
cccttgggcctcccactccca

SEQ ID NO: 6089187 - DNA, 23 bp, Homo sapiens
cccttgggcctcccactcccatg

SEQ ID NO: 6089188 - DNA, 16 bp, Homo sapiens
cccttgggctctgatg

SEQ ID NO: 6089189 - DNA, 23 bp, Homo sapiens
cccttggggaaatgctatcagaa

SEQ ID NO: 6089190 - DNA, 20 bp, Homo sapiens
cccttggggaagggtgggga

SEQ ID NO: 6089191 - DNA, 16 bp, Homo sapiens
cccttggggcctggct

SEQ ID NO: 6089192 - DNA, 12 bp, Homo sapiens
cccttgggggtc

SEQ ID NO: 6089193 - DNA, 20 bp, Homo sapiens
cccttggggtaagccagagc

SEQ ID NO: 6089194 - DNA, 15 bp, Homo sapiens
cccttggtagagttt

SEQ ID NO: 6089195 - DNA, 19 bp, Homo sapiens
cccttggtagcagcctggg

SEQ ID NO: 6089196 - DNA, 17 bp, Homo sapiens
cccttggtttctggggg

SEQ ID NO: 6089197 - DNA, 21 bp, Homo sapiens
cccttggtttctgggggctgg

SEQ ID NO: 6089198 - DNA, 11 bp, Homo sapiens
cccttgtattt

SEQ ID NO: 6089199 - DNA, 14 bp, Homo sapiens
cccttgtccctggg

SEQ ID NO: 6089200 - DNA, 15 bp, Homo sapiens
cccttgtccctgggg

SEQ ID NO: 6089201 - DNA, 22 bp, Homo sapiens
cccttgtcctctcagagcctca

SEQ ID NO: 6089202 - DNA, 22 bp, Homo sapiens
cccttgtcctgccagctgcctt

SEQ ID NO: 6089203 - DNA, 23 bp, Homo sapiens
cccttgtcgcgcgtctcccatcc

SEQ ID NO: 6089204 - DNA, 18 bp, Homo sapiens
cccttgtctccctggttg

SEQ ID NO: 6089205 - DNA, 12 bp, Homo sapiens
cccttgtctgag

SEQ ID NO: 6089206 - DNA, 13 bp, Homo sapiens
cccttgtctgaga

SEQ ID NO: 6089207 - DNA, 15 bp, Homo sapiens
cccttgtcttccccc

SEQ ID NO: 6089208 - DNA, 19 bp, Homo sapiens
cccttgtcttcccccctct

SEQ ID NO: 6089209 - DNA, 23 bp, Homo sapiens
cccttgtcttcccccctctcctc

SEQ ID NO: 6089210 - DNA, 18 bp, Homo sapiens
cccttgtgctcctctcgc

SEQ ID NO: 6089211 - DNA, 14 bp, Homo sapiens
cccttgtggtccca

SEQ ID NO: 6089212 - DNA, 20 bp, Homo sapiens
cccttgtggtcccaccccac

SEQ ID NO: 6089213 - DNA, 22 bp, Homo sapiens
cccttgtggtcccaccccacac

SEQ ID NO: 6089214 - DNA, 20 bp, Homo sapiens
cccttgtgtgtaccacaccc

SEQ ID NO: 6089215 - DNA, 21 bp, Homo sapiens
cccttgtgtgtaccacaccct

SEQ ID NO: 6089216 - DNA, 18 bp, Homo sapiens
cccttgtgtgtgccctgg

SEQ ID NO: 6089217 - DNA, 19 bp, Homo sapiens
cccttgtgtgtgccctggg

SEQ ID NO: 6089218 - DNA, 21 bp, Homo sapiens
cccttgtgtgtgccctgggcc

SEQ ID NO: 6089219 - DNA, 22 bp, Homo sapiens
cccttgtgtgtgccctgggcca

SEQ ID NO: 6089220 - DNA, 13 bp, Homo sapiens
cccttgtgttcct

SEQ ID NO: 6089221 - DNA, 19 bp, Homo sapiens
cccttgttctaatgctgca

SEQ ID NO: 6089222 - DNA, 21 bp, Homo sapiens
cccttgttgcactgccccctg

SEQ ID NO: 6089223 - DNA, 23 bp, Homo sapiens
cccttgttgcactgccccctgct

SEQ ID NO: 6089224 - DNA, 15 bp, Homo sapiens
cccttgttgcctgca

SEQ ID NO: 6089225 - DNA, 15 bp, Homo sapiens
cccttgtttacagtg

SEQ ID NO: 6089226 - DNA, 22 bp, Homo sapiens
cccttgtttacagtgaggactc

SEQ ID NO: 6089227 - DNA, 19 bp, Homo sapiens
cccttgtttgtcccttcta

SEQ ID NO: 6089228 - DNA, 23 bp, Homo sapiens
ccctttaaaggtcgcacctcctt

SEQ ID NO: 6089229 - DNA, 21 bp, Homo sapiens
ccctttaagccaagagagcct

SEQ ID NO: 6089230 - DNA, 13 bp, Homo sapiens
ccctttaatattt

SEQ ID NO: 6089231 - DNA, 16 bp, Homo sapiens
ccctttacaatgtgaa

SEQ ID NO: 6089232 - DNA, 21 bp, Homo sapiens
ccctttacattttgtgcagtg

SEQ ID NO: 6089233 - DNA, 16 bp, Homo sapiens
ccctttagggctgttg

SEQ ID NO: 6089234 - DNA, 14 bp, Homo sapiens
ccctttagtgcttt

SEQ ID NO: 6089235 - DNA, 23 bp, Homo sapiens
ccctttattaattcattaaattt

SEQ ID NO: 6089236 - DNA, 15 bp, Homo sapiens
ccctttatttcacat

SEQ ID NO: 6089237 - DNA, 17 bp, Homo sapiens
ccctttcaaattgcctt

SEQ ID NO: 6089238 - DNA, 11 bp, Homo sapiens
ccctttcacac

SEQ ID NO: 6089239 - DNA, 20 bp, Homo sapiens
ccctttcacaggcagccagt

SEQ ID NO: 6089240 - DNA, 20 bp, Homo sapiens
ccctttcacccctcttccca

SEQ ID NO: 6089241 - DNA, 17 bp, Homo sapiens
ccctttcagatgtcttc

SEQ ID NO: 6089242 - DNA, 19 bp, Homo sapiens
ccctttcagatgtcttctg

SEQ ID NO: 6089243 - DNA, 12 bp, Homo sapiens
ccctttcaggcc

SEQ ID NO: 6089244 - DNA, 17 bp, Homo sapiens
ccctttcagtatgtccc

SEQ ID NO: 6089245 - DNA, 21 bp, Homo sapiens
ccctttcatcggtgcctggta

SEQ ID NO: 6089246 - DNA, 15 bp, Homo sapiens
ccctttccaacctca

SEQ ID NO: 6089247 - DNA, 14 bp, Homo sapiens
ccctttcccacccc

SEQ ID NO: 6089248 - DNA, 11 bp, Homo sapiens
ccctttcccca

SEQ ID NO: 6089249 - DNA, 16 bp, Homo sapiens
ccctttccccacgccc

SEQ ID NO: 6089250 - DNA, 22 bp, Homo sapiens
ccctttccccagcatcactccc

SEQ ID NO: 6089251 - DNA, 13 bp, Homo sapiens
ccctttcccccac

SEQ ID NO: 6089252 - DNA, 18 bp, Homo sapiens
ccctttcccctagatcca

SEQ ID NO: 6089253 - DNA, 17 bp, Homo sapiens
ccctttccctgcatccc

SEQ ID NO: 6089254 - DNA, 19 bp, Homo sapiens
ccctttccggcacactgcc

SEQ ID NO: 6089255 - DNA, 20 bp, Homo sapiens
ccctttccggcacactgcca

SEQ ID NO: 6089256 - DNA, 9 bp, Homo sapiens
ccctttcct

SEQ ID NO: 6089257 - DNA, 14 bp, Homo sapiens
ccctttcctcaggc

SEQ ID NO: 6089258 - DNA, 18 bp, Homo sapiens
ccctttcctccccataca

SEQ ID NO: 6089259 - DNA, 20 bp, Homo sapiens
ccctttcctccccatacaca

SEQ ID NO: 6089260 - DNA, 16 bp, Homo sapiens
ccctttcctgagtccc

SEQ ID NO: 6089261 - DNA, 13 bp, Homo sapiens
ccctttcctgcgg

SEQ ID NO: 6089262 - DNA, 16 bp, Homo sapiens
ccctttccttcactgc

SEQ ID NO: 6089263 - DNA, 15 bp, Homo sapiens
ccctttccttccatc

SEQ ID NO: 6089264 - DNA, 12 bp, Homo sapiens
ccctttcctttc

SEQ ID NO: 6089265 - DNA, 14 bp, Homo sapiens
ccctttctaagcaa

SEQ ID NO: 6089266 - DNA, 18 bp, Homo sapiens
ccctttctacttccaaga

SEQ ID NO: 6089267 - DNA, 22 bp, Homo sapiens
ccctttctcccctgcccccagg

SEQ ID NO: 6089268 - DNA, 17 bp, Homo sapiens
ccctttctctctccacc

SEQ ID NO: 6089269 - DNA, 14 bp, Homo sapiens
ccctttctctgcct

SEQ ID NO: 6089270 - DNA, 15 bp, Homo sapiens
ccctttctctgcctg

SEQ ID NO: 6089271 - DNA, 13 bp, Homo sapiens
ccctttctcttgc

SEQ ID NO: 6089272 - DNA, 14 bp, Homo sapiens
ccctttctggctct

SEQ ID NO: 6089273 - DNA, 14 bp, Homo sapiens
ccctttctgtccca

SEQ ID NO: 6089274 - DNA, 13 bp, Homo sapiens
ccctttctgttcg

SEQ ID NO: 6089275 - DNA, 16 bp, Homo sapiens
ccctttcttggccagt

SEQ ID NO: 6089276 - DNA, 17 bp, Homo sapiens
ccctttcttggccagtt

SEQ ID NO: 6089277 - DNA, 21 bp, Homo sapiens
ccctttctttaaaagaaactt

SEQ ID NO: 6089278 - DNA, 23 bp, Homo sapiens
ccctttgaagataataatcttgg

SEQ ID NO: 6089279 - DNA, 18 bp, Homo sapiens
ccctttgaagcctcagct

SEQ ID NO: 6089280 - DNA, 19 bp, Homo sapiens
ccctttgagatctggggag

SEQ ID NO: 6089281 - DNA, 14 bp, Homo sapiens
ccctttgagtgcag

SEQ ID NO: 6089282 - DNA, 17 bp, Homo sapiens
ccctttgccagccaccc

SEQ ID NO: 6089283 - DNA, 22 bp, Homo sapiens
ccctttgccttaaacctgaaga

SEQ ID NO: 6089284 - DNA, 22 bp, Homo sapiens
ccctttgcctttcttctgccct

SEQ ID NO: 6089285 - DNA, 23 bp, Homo sapiens
ccctttgcctttcttctgccctt

SEQ ID NO: 6089286 - DNA, 18 bp, Homo sapiens
ccctttgcgtcaggagca

SEQ ID NO: 6089287 - DNA, 19 bp, Homo sapiens
ccctttgcgtcaggagcag

SEQ ID NO: 6089288 - DNA, 13 bp, Homo sapiens
ccctttgctccac

SEQ ID NO: 6089289 - DNA, 13 bp, Homo sapiens
ccctttgctcccg

SEQ ID NO: 6089290 - DNA, 15 bp, Homo sapiens
ccctttgctgaccct

SEQ ID NO: 6089291 - DNA, 17 bp, Homo sapiens
ccctttgctgcatggca

SEQ ID NO: 6089292 - DNA, 14 bp, Homo sapiens
ccctttgctgctga

SEQ ID NO: 6089293 - DNA, 13 bp, Homo sapiens
ccctttgctgtcc

SEQ ID NO: 6089294 - DNA, 23 bp, Homo sapiens
ccctttgctgtgaggctgtcctg

SEQ ID NO: 6089295 - DNA, 23 bp, Homo sapiens
cctggagtgtgtcagagcccagg

SEQ ID NO: 6089296 - DNA, 23 bp, Homo sapiens
cctggagttgactgactgagcag

SEQ ID NO: 6089297 - DNA, 16 bp, Homo sapiens
cctggagttgggctgg

SEQ ID NO: 6089298 - DNA, 17 bp, Homo sapiens
cctggagttgggctggt

SEQ ID NO: 6089299 - DNA, 20 bp, Homo sapiens
cctggagtttaatacagtga

SEQ ID NO: 6089300 - DNA, 17 bp, Homo sapiens
cctggataaaaaagaaa

SEQ ID NO: 6089301 - DNA, 14 bp, Homo sapiens
cctggatagccttg

SEQ ID NO: 6089302 - DNA, 17 bp, Homo sapiens
cctggatagccttgaaa

SEQ ID NO: 6089303 - DNA, 21 bp, Homo sapiens
cctggatcacgacgctgcaga

SEQ ID NO: 6089304 - DNA, 17 bp, Homo sapiens
cctggatcagaacagga

SEQ ID NO: 6089305 - DNA, 14 bp, Homo sapiens
cctggatcagcgtg

SEQ ID NO: 6089306 - DNA, 16 bp, Homo sapiens
cctggatcagcgtggc

SEQ ID NO: 6089307 - DNA, 12 bp, Homo sapiens
cctggatccagc

SEQ ID NO: 6089308 - DNA, 20 bp, Homo sapiens
cctggatccagccattcctg

SEQ ID NO: 6089309 - DNA, 21 bp, Homo sapiens
cctggatccagctctgggagc

SEQ ID NO: 6089310 - DNA, 17 bp, Homo sapiens
cctggatccatcctgct

SEQ ID NO: 6089311 - DNA, 22 bp, Homo sapiens
cctggatccatcctgctagcac

SEQ ID NO: 6089312 - DNA, 17 bp, Homo sapiens
cctggatccctttcact

SEQ ID NO: 6089313 - DNA, 16 bp, Homo sapiens
cctggatctaccagca

SEQ ID NO: 6089314 - DNA, 18 bp, Homo sapiens
cctggatctacctggagg

SEQ ID NO: 6089315 - DNA, 19 bp, Homo sapiens
cctggatctccccactcta

SEQ ID NO: 6089316 - DNA, 22 bp, Homo sapiens
cctggatgaagttatctggctt

SEQ ID NO: 6089317 - DNA, 22 bp, Homo sapiens
cctggatgagaaacagctcagc

SEQ ID NO: 6089318 - DNA, 15 bp, Homo sapiens
cctggatgcacagtg

SEQ ID NO: 6089319 - DNA, 20 bp, Homo sapiens
cctggatgcacagtgcctga

SEQ ID NO: 6089320 - DNA, 17 bp, Homo sapiens
cctggatgcagcctcac

SEQ ID NO: 6089321 - DNA, 14 bp, Homo sapiens
cctggatgccagct

SEQ ID NO: 6089322 - DNA, 17 bp, Homo sapiens
cctggatgccagctgtg

SEQ ID NO: 6089323 - DNA, 18 bp, Homo sapiens
cctggatgccccctgtgg

SEQ ID NO: 6089324 - DNA, 14 bp, Homo sapiens
cctggatggcccct

SEQ ID NO: 6089325 - DNA, 13 bp, Homo sapiens
cctggatggcctc

SEQ ID NO: 6089326 - DNA, 15 bp, Homo sapiens
cctggatggcctctg

SEQ ID NO: 6089327 - DNA, 20 bp, Homo sapiens
cctggatgggcattgggctg

SEQ ID NO: 6089328 - DNA, 22 bp, Homo sapiens
cctggatgggcctttgagcctg

SEQ ID NO: 6089329 - DNA, 18 bp, Homo sapiens
cctggatggggcagagct

SEQ ID NO: 6089330 - DNA, 19 bp, Homo sapiens
cctggatggggcagagctt

SEQ ID NO: 6089331 - DNA, 20 bp, Homo sapiens
cctggatggggcagagcttc

SEQ ID NO: 6089332 - DNA, 14 bp, Homo sapiens
cctggatgggggtg

SEQ ID NO: 6089333 - DNA, 22 bp, Homo sapiens
cctggatgggggtgcaggcagc

SEQ ID NO: 6089334 - DNA, 15 bp, Homo sapiens
cctggatgtcccctg

SEQ ID NO: 6089335 - DNA, 20 bp, Homo sapiens
cctggatgtcccctgtccca

SEQ ID NO: 6089336 - DNA, 22 bp, Homo sapiens
cctggatgtcccctgtcccacc

SEQ ID NO: 6089337 - DNA, 18 bp, Homo sapiens
cctggatgtctgaacttt

SEQ ID NO: 6089338 - DNA, 17 bp, Homo sapiens
cctggatgtgcccacag

SEQ ID NO: 6089339 - DNA, 14 bp, Homo sapiens
cctggatgttgctg

SEQ ID NO: 6089340 - DNA, 12 bp, Homo sapiens
cctggatgtttg

SEQ ID NO: 6089341 - DNA, 18 bp, Homo sapiens
cctggattcatttcctgc

SEQ ID NO: 6089342 - DNA, 19 bp, Homo sapiens
cctggattcatttcctgcc

SEQ ID NO: 6089343 - DNA, 18 bp, Homo sapiens
cctggattcctctaagat

SEQ ID NO: 6089344 - DNA, 20 bp, Homo sapiens
cctggattgcgcctaatgtg

SEQ ID NO: 6089345 - DNA, 13 bp, Homo sapiens
cctggattgggag

SEQ ID NO: 6089346 - DNA, 13 bp, Homo sapiens
cctggatttaaat

SEQ ID NO: 6089347 - DNA, 14 bp, Homo sapiens
cctggatttctggt

SEQ ID NO: 6089348 - DNA, 17 bp, Homo sapiens
cctggattttgccctct

SEQ ID NO: 6089349 - DNA, 18 bp, Homo sapiens
cctggattttttaaatca

SEQ ID NO: 6089350 - DNA, 20 bp, Homo sapiens
cctggattttttaaatcata

SEQ ID NO: 6089351 - DNA, 23 bp, Homo sapiens
cctggcaaagggagcagaactga

SEQ ID NO: 6089352 - DNA, 16 bp, Homo sapiens
cctggcaaataatact

SEQ ID NO: 6089353 - DNA, 16 bp, Homo sapiens
cctggcaacagagcga

SEQ ID NO: 6089354 - DNA, 23 bp, Homo sapiens
cctggcaacagagcgagattcca

SEQ ID NO: 6089355 - DNA, 21 bp, Homo sapiens
cctggcaacatcttacttgtc

SEQ ID NO: 6089356 - DNA, 14 bp, Homo sapiens
cctggcaagaaagc

SEQ ID NO: 6089357 - DNA, 12 bp, Homo sapiens
cctggcaatagt

SEQ ID NO: 6089358 - DNA, 16 bp, Homo sapiens
cctggcaatcccacca

SEQ ID NO: 6089359 - DNA, 12 bp, Homo sapiens
cctggcacacat

SEQ ID NO: 6089360 - DNA, 13 bp, Homo sapiens
cctggcacacatc

SEQ ID NO: 6089361 - DNA, 21 bp, Homo sapiens
cctggcacagaaagggcagct

SEQ ID NO: 6089362 - DNA, 21 bp, Homo sapiens
cctggcacagaagaggagtca

SEQ ID NO: 6089363 - DNA, 16 bp, Homo sapiens
cctggcacaggactga

SEQ ID NO: 6089364 - DNA, 24 bp, Homo sapiens
cctggcacaggactgattctggga

SEQ ID NO: 6089365 - DNA, 20 bp, Homo sapiens
cctggcacagtgtctgggct

SEQ ID NO: 6089366 - DNA, 21 bp, Homo sapiens
cctggcacagtgtctgggctg

SEQ ID NO: 6089367 - DNA, 22 bp, Homo sapiens
cctggcacagtgtctgggctga

SEQ ID NO: 6089368 - DNA, 13 bp, Homo sapiens
cctggcacattca

SEQ ID NO: 6089369 - DNA, 18 bp, Homo sapiens
cctggcacattgcccctc

SEQ ID NO: 6089370 - DNA, 22 bp, Homo sapiens
cctggcacattgcccctctgcc

SEQ ID NO: 6089371 - DNA, 23 bp, Homo sapiens
cctggcacattgcccctctgcct

SEQ ID NO: 6089372 - DNA, 14 bp, Homo sapiens
cctggcacatttca

SEQ ID NO: 6089373 - DNA, 12 bp, Homo sapiens
cctggcacccac

SEQ ID NO: 6089374 - DNA, 14 bp, Homo sapiens
cctggcacccactc

SEQ ID NO: 6089375 - DNA, 18 bp, Homo sapiens
cctggcacccccacaagc

SEQ ID NO: 6089376 - DNA, 21 bp, Homo sapiens
cctggcacccggcccctgctg

SEQ ID NO: 6089377 - DNA, 12 bp, Homo sapiens
cctggcacctga

SEQ ID NO: 6089378 - DNA, 15 bp, Homo sapiens
cctggcacctgagtg

SEQ ID NO: 6089379 - DNA, 12 bp, Homo sapiens
cctggcacctgt

SEQ ID NO: 6089380 - DNA, 15 bp, Homo sapiens
cctggcacgagggga

SEQ ID NO: 6089381 - DNA, 16 bp, Homo sapiens
cctggcacgccctact

SEQ ID NO: 6089382 - DNA, 21 bp, Homo sapiens
cctggcacgccctactccact

SEQ ID NO: 6089383 - DNA, 10 bp, Homo sapiens
cctggcacta

SEQ ID NO: 6089384 - DNA, 14 bp, Homo sapiens
cctggcactgcagg

SEQ ID NO: 6089385 - DNA, 21 bp, Homo sapiens
cctggcactgcaggtggcctc

SEQ ID NO: 6089386 - DNA, 15 bp, Homo sapiens
cctggcactggaccc

SEQ ID NO: 6089387 - DNA, 16 bp, Homo sapiens
cctggcactggacccc

SEQ ID NO: 6089388 - DNA, 20 bp, Homo sapiens
cctggcactggaccccagca

SEQ ID NO: 6089389 - DNA, 13 bp, Homo sapiens
cctggcactggga

SEQ ID NO: 6089390 - DNA, 12 bp, Homo sapiens
cctggcagacac

SEQ ID NO: 6089391 - DNA, 19 bp, Homo sapiens
cctggcagacacaacccaa

SEQ ID NO: 6089392 - DNA, 14 bp, Homo sapiens
cctggcagagaaga

SEQ ID NO: 6089393 - DNA, 12 bp, Homo sapiens
cctggcagagat

SEQ ID NO: 6089394 - DNA, 20 bp, Homo sapiens
cctggcagatgggggcctct

SEQ ID NO: 6089395 - DNA, 13 bp, Homo sapiens
cctggcagcacag

SEQ ID NO: 6089396 - DNA, 15 bp, Homo sapiens
cctggcagcacagcc

SEQ ID NO: 6089397 - DNA, 17 bp, Homo sapiens
cctggcagcacagccca

SEQ ID NO: 6089398 - DNA, 18 bp, Homo sapiens
cctggcagcacagcccag

SEQ ID NO: 6089399 - DNA, 14 bp, Homo sapiens
cctggcagcagcag

SEQ ID NO: 6089400 - DNA, 16 bp, Homo sapiens
cctggcagcagcaggt

SEQ ID NO: 6089401 - DNA, 21 bp, Homo sapiens
cctggcagccatttctccatg

SEQ ID NO: 6089402 - DNA, 13 bp, Homo sapiens
cctggcagcccct

SEQ ID NO: 6089403 - DNA, 17 bp, Homo sapiens
cctggcagctctggaca

SEQ ID NO: 6089404 - DNA, 13 bp, Homo sapiens
cctggcagctgcc

SEQ ID NO: 6089405 - DNA, 16 bp, Homo sapiens
cctggcagctgcccct

SEQ ID NO: 6089406 - DNA, 14 bp, Homo sapiens
cctggcagctgctg

SEQ ID NO: 6089407 - DNA, 16 bp, Homo sapiens
cctggcagctgctgtg

SEQ ID NO: 6089408 - DNA, 23 bp, Homo sapiens
cctggcagctggaccatctctgt

SEQ ID NO: 6089409 - DNA, 22 bp, Homo sapiens
cctggcaggatgaccctgcgaa

SEQ ID NO: 6089410 - DNA, 14 bp, Homo sapiens
cctggcaggcaggg

SEQ ID NO: 6089411 - DNA, 21 bp, Homo sapiens
cctggcaggcaggggccctgc

SEQ ID NO: 6089412 - DNA, 15 bp, Homo sapiens
cctggcaggccctgc

SEQ ID NO: 6089413 - DNA, 20 bp, Homo sapiens
cctggcaggccctgcccagc

SEQ ID NO: 6089414 - DNA, 21 bp, Homo sapiens
cctggcaggccctgcccagcc

SEQ ID NO: 6089415 - DNA, 17 bp, Homo sapiens
cctggcagggccacctg

SEQ ID NO: 6089416 - DNA, 22 bp, Homo sapiens
cctggcagggccacctgcagga

SEQ ID NO: 6089417 - DNA, 22 bp, Homo sapiens
cctggcagggcgccaagtctgg

SEQ ID NO: 6089418 - DNA, 16 bp, Homo sapiens
cctggcaggggatcca

SEQ ID NO: 6089419 - DNA, 18 bp, Homo sapiens
cctggcaggtcccctgcc

SEQ ID NO: 6089420 - DNA, 16 bp, Homo sapiens
cctggcaggtggaact

SEQ ID NO: 6089421 - DNA, 20 bp, Homo sapiens
cctggcaggttagaacctag

SEQ ID NO: 6089422 - DNA, 21 bp, Homo sapiens
cctggcaggttgttagaaaaa

SEQ ID NO: 6089423 - DNA, 20 bp, Homo sapiens
cctggcagtgctgagggacc

SEQ ID NO: 6089424 - DNA, 18 bp, Homo sapiens
cctggcagtggctctcag

SEQ ID NO: 6089425 - DNA, 19 bp, Homo sapiens
cctggcagtggctctcaga

SEQ ID NO: 6089426 - DNA, 20 bp, Homo sapiens
cctggcagtggctctcagag

SEQ ID NO: 6089427 - DNA, 23 bp, Homo sapiens
cctggcagtggctctcagagcag

SEQ ID NO: 6089428 - DNA, 17 bp, Homo sapiens
cctggcatatctctgtt

SEQ ID NO: 6089429 - DNA, 16 bp, Homo sapiens
cctggcatctgtgtgc

SEQ ID NO: 6089430 - DNA, 22 bp, Homo sapiens
cctggcatggacaccttgtgtt

SEQ ID NO: 6089431 - DNA, 14 bp, Homo sapiens
cctggcatgggaat

SEQ ID NO: 6089432 - DNA, 18 bp, Homo sapiens
cctggcatgggaatgaat

SEQ ID NO: 6089433 - DNA, 16 bp, Homo sapiens
cctggcatgtcagagc

SEQ ID NO: 6089434 - DNA, 17 bp, Homo sapiens
cctggcatgtcagagcc

SEQ ID NO: 6089435 - DNA, 19 bp, Homo sapiens
cctggcattatgtccactg

SEQ ID NO: 6089436 - DNA, 18 bp, Homo sapiens
cctggcattcttgtacag

SEQ ID NO: 6089437 - DNA, 20 bp, Homo sapiens
cctggcattcttgtacagtg

SEQ ID NO: 6089438 - DNA, 19 bp, Homo sapiens
cctggcattgtttccaccc

SEQ ID NO: 6089439 - DNA, 23 bp, Homo sapiens
cctggcatttgctgatttctagt

SEQ ID NO: 6089440 - DNA, 16 bp, Homo sapiens
cctggccaacatggca

SEQ ID NO: 6089441 - DNA, 18 bp, Homo sapiens
cctggccaatgcggccca

SEQ ID NO: 6089442 - DNA, 16 bp, Homo sapiens
cctggccacagccttc

SEQ ID NO: 6089443 - DNA, 19 bp, Homo sapiens
cctggccaccacccaacct

SEQ ID NO: 6089444 - DNA, 22 bp, Homo sapiens
cctggccaccacccaacctgtc

SEQ ID NO: 6089445 - DNA, 17 bp, Homo sapiens
cctggccaccacccccc

SEQ ID NO: 6089446 - DNA, 21 bp, Homo sapiens
cctggccaccaccccccactc

SEQ ID NO: 6089447 - DNA, 22 bp, Homo sapiens
cctggccaccagccatcctccc

SEQ ID NO: 6089448 - DNA, 13 bp, Homo sapiens
cctggccacctct

SEQ ID NO: 6089449 - DNA, 13 bp, Homo sapiens
cctggccacctga

SEQ ID NO: 6089450 - DNA, 17 bp, Homo sapiens
cctggccacctgaggtg

SEQ ID NO: 6089451 - DNA, 19 bp, Homo sapiens
cctggccacgcagccagga

SEQ ID NO: 6089452 - DNA, 14 bp, Homo sapiens
cctggccactggcc

SEQ ID NO: 6089453 - DNA, 15 bp, Homo sapiens
cctggccactggccc

SEQ ID NO: 6089454 - DNA, 22 bp, Homo sapiens
cctggccactgtccctgtcctt

SEQ ID NO: 6089455 - DNA, 14 bp, Homo sapiens
cctggccagacaca

SEQ ID NO: 6089456 - DNA, 15 bp, Homo sapiens
cctggccagacacag

SEQ ID NO: 6089457 - DNA, 18 bp, Homo sapiens
cctggccagacacaggcc

SEQ ID NO: 6089458 - DNA, 13 bp, Homo sapiens
cctggccagacgc

SEQ ID NO: 6089459 - DNA, 15 bp, Homo sapiens
cctggccagatgcac

SEQ ID NO: 6089460 - DNA, 23 bp, Homo sapiens
cctggccagatgtcgctgggtcc

SEQ ID NO: 6089461 - DNA, 12 bp, Homo sapiens
cctggccagatt

SEQ ID NO: 6089462 - DNA, 17 bp, Homo sapiens
cctggccagcccttcct

SEQ ID NO: 6089463 - DNA, 11 bp, Homo sapiens
cctggccagga

SEQ ID NO: 6089464 - DNA, 12 bp, Homo sapiens
cctggccaggag

SEQ ID NO: 6089465 - DNA, 19 bp, Homo sapiens
cctggccaggagctcttca

SEQ ID NO: 6089466 - DNA, 22 bp, Homo sapiens
cctggccaggagctcttcaggc

SEQ ID NO: 6089467 - DNA, 22 bp, Homo sapiens
cctggccaggcagatctgtgcc

SEQ ID NO: 6089468 - DNA, 16 bp, Homo sapiens
cctggccaggcaggga

SEQ ID NO: 6089469 - DNA, 17 bp, Homo sapiens
cctggccaggcagggag

SEQ ID NO: 6089470 - DNA, 18 bp, Homo sapiens
cctggccagggcagggcc

SEQ ID NO: 6089471 - DNA, 21 bp, Homo sapiens
cctggccagggcagggccacc

SEQ ID NO: 6089472 - DNA, 17 bp, Homo sapiens
cctggccatcccacaag

SEQ ID NO: 6089473 - DNA, 16 bp, Homo sapiens
ccctttggcactggat

SEQ ID NO: 6089474 - DNA, 15 bp, Homo sapiens
ccctttgggcccagg

SEQ ID NO: 6089475 - DNA, 13 bp, Homo sapiens
ccctttgggccct

SEQ ID NO: 6089476 - DNA, 22 bp, Homo sapiens
ccctttggtttgacaattttgt

SEQ ID NO: 6089477 - DNA, 23 bp, Homo sapiens
ccctttgtctgtcaatcacagtc

SEQ ID NO: 6089478 - DNA, 15 bp, Homo sapiens
ccctttgtgctgtgg

SEQ ID NO: 6089479 - DNA, 21 bp, Homo sapiens
ccctttgtggactttatttaa

SEQ ID NO: 6089480 - DNA, 23 bp, Homo sapiens
ccctttgtggactttatttaatt

SEQ ID NO: 6089481 - DNA, 19 bp, Homo sapiens
ccctttgtttcttgtttat

SEQ ID NO: 6089482 - DNA, 16 bp, Homo sapiens
cccttttacagctctt

SEQ ID NO: 6089483 - DNA, 15 bp, Homo sapiens
cccttttaccactcc

SEQ ID NO: 6089484 - DNA, 23 bp, Homo sapiens
cccttttagtggtggtgtctcac

SEQ ID NO: 6089485 - DNA, 13 bp, Homo sapiens
cccttttatacta

SEQ ID NO: 6089486 - DNA, 14 bp, Homo sapiens
cccttttatcttct

SEQ ID NO: 6089487 - DNA, 16 bp, Homo sapiens
cccttttcagctgagc

SEQ ID NO: 6089488 - DNA, 23 bp, Homo sapiens
cccttttcagctgagccctgggg

SEQ ID NO: 6089489 - DNA, 18 bp, Homo sapiens
cccttttcagcttctgct

SEQ ID NO: 6089490 - DNA, 15 bp, Homo sapiens
cccttttccagcctc

SEQ ID NO: 6089491 - DNA, 19 bp, Homo sapiens
cccttttccatcctccaaa

SEQ ID NO: 6089492 - DNA, 12 bp, Homo sapiens
cccttttcccct

SEQ ID NO: 6089493 - DNA, 14 bp, Homo sapiens
cccttttcctccag

SEQ ID NO: 6089494 - DNA, 19 bp, Homo sapiens
cccttttcctccagacaga

SEQ ID NO: 6089495 - DNA, 19 bp, Homo sapiens
cccttttcctttctggccc

SEQ ID NO: 6089496 - DNA, 14 bp, Homo sapiens
cccttttctctcac

SEQ ID NO: 6089497 - DNA, 17 bp, Homo sapiens
cccttttctctgctctt

SEQ ID NO: 6089498 - DNA, 14 bp, Homo sapiens
cccttttctttgac

SEQ ID NO: 6089499 - DNA, 16 bp, Homo sapiens
cccttttgcccactgt

SEQ ID NO: 6089500 - DNA, 17 bp, Homo sapiens
cccttttgcctggctgt

SEQ ID NO: 6089501 - DNA, 19 bp, Homo sapiens
cccttttgcctggctgtgg

SEQ ID NO: 6089502 - DNA, 20 bp, Homo sapiens
cccttttggcccccgagctg

SEQ ID NO: 6089503 - DNA, 21 bp, Homo sapiens
cccttttgtgggtttctctgt

SEQ ID NO: 6089504 - DNA, 23 bp, Homo sapiens
cccttttgtgggtttctctgtgc

SEQ ID NO: 6089505 - DNA, 16 bp, Homo sapiens
cccttttgttccccag

SEQ ID NO: 6089506 - DNA, 17 bp, Homo sapiens
ccctttttaaaaaatac

SEQ ID NO: 6089507 - DNA, 16 bp, Homo sapiens
ccctttttactcccct

SEQ ID NO: 6089508 - DNA, 18 bp, Homo sapiens
ccctttttactccccttg

SEQ ID NO: 6089509 - DNA, 16 bp, Homo sapiens
ccctttttctccacac

SEQ ID NO: 6089510 - DNA, 14 bp, Homo sapiens
ccctttttctttcc

SEQ ID NO: 6089511 - DNA, 21 bp, Homo sapiens
ccctttttgagtaattttctg

SEQ ID NO: 6089512 - DNA, 15 bp, Homo sapiens
ccctttttggactag

SEQ ID NO: 6089513 - DNA, 19 bp, Homo sapiens
cccttttttctgcctcctt

SEQ ID NO: 6089514 - DNA, 16 bp, Homo sapiens
cccttttttcttcccc

SEQ ID NO: 6089515 - DNA, 18 bp, Homo sapiens
cccttttttggctgctga

SEQ ID NO: 6089516 - DNA, 16 bp, Homo sapiens
cccttttttgtccccc

SEQ ID NO: 6089517 - DNA, 18 bp, Homo sapiens
cccttttttgtcccccaa

SEQ ID NO: 6089518 - DNA, 21 bp, Homo sapiens
ccctttttttcctttttctga

SEQ ID NO: 6089519 - DNA, 23 bp, Homo sapiens
ccctttttttcctttttctgatt

SEQ ID NO: 6089520 - DNA, 15 bp, Homo sapiens
ccgaaaaatcctctt

SEQ ID NO: 6089521 - DNA, 17 bp, Homo sapiens
ccgaaaaatcctcttcc

SEQ ID NO: 6089522 - DNA, 21 bp, Homo sapiens
ccgaaatcagcccccagcctt

SEQ ID NO: 6089523 - DNA, 12 bp, Homo sapiens
ccgaaatgccac

SEQ ID NO: 6089524 - DNA, 15 bp, Homo sapiens
ccgaaatgctgtctt

SEQ ID NO: 6089525 - DNA, 20 bp, Homo sapiens
ccgaacatatcatttgtgaa

SEQ ID NO: 6089526 - DNA, 21 bp, Homo sapiens
ccgaacatatcatttgtgaag

SEQ ID NO: 6089527 - DNA, 23 bp, Homo sapiens
ccgaacatcaccgacgcgtctcc

SEQ ID NO: 6089528 - DNA, 15 bp, Homo sapiens
ccgaacatgaccaaa

SEQ ID NO: 6089529 - DNA, 12 bp, Homo sapiens
ccgaaccccggg

SEQ ID NO: 6089530 - DNA, 15 bp, Homo sapiens
ccgaacctcctctgt

SEQ ID NO: 6089531 - DNA, 16 bp, Homo sapiens
ccgaacctcctctgtg

SEQ ID NO: 6089532 - DNA, 20 bp, Homo sapiens
ccgaacctgatacctgcctg

SEQ ID NO: 6089533 - DNA, 21 bp, Homo sapiens
ccgaacgctgctccatgcaca

SEQ ID NO: 6089534 - DNA, 18 bp, Homo sapiens
ccgaactgggcatatttc

SEQ ID NO: 6089535 - DNA, 21 bp, Homo sapiens
ccgaactgttcaagtgtcccc

SEQ ID NO: 6089536 - DNA, 18 bp, Homo sapiens
ccgaagaagggtccttcc

SEQ ID NO: 6089537 - DNA, 20 bp, Homo sapiens
ccgaagaagggtccttccct

SEQ ID NO: 6089538 - DNA, 17 bp, Homo sapiens
ccgaagaccgaatttta

SEQ ID NO: 6089539 - DNA, 23 bp, Homo sapiens
ccgaagaccttctgaagatctca

SEQ ID NO: 6089540 - DNA, 17 bp, Homo sapiens
ccgaagagcaaacaaaa

SEQ ID NO: 6089541 - DNA, 15 bp, Homo sapiens
ccgaagagccctgag

SEQ ID NO: 6089542 - DNA, 18 bp, Homo sapiens
ccgaagagccctgagctc

SEQ ID NO: 6089543 - DNA, 19 bp, Homo sapiens
ccgaagagccctgagctca

SEQ ID NO: 6089544 - DNA, 22 bp, Homo sapiens
ccgaagagccctgagctcaggc

SEQ ID NO: 6089545 - DNA, 22 bp, Homo sapiens
ccgaagatggtggccacagact

SEQ ID NO: 6089546 - DNA, 13 bp, Homo sapiens
ccgaagccatcac

SEQ ID NO: 6089547 - DNA, 21 bp, Homo sapiens
ccgaagccatcacttctcccc

SEQ ID NO: 6089548 - DNA, 20 bp, Homo sapiens
ccgaagcccaccactggcca

SEQ ID NO: 6089549 - DNA, 17 bp, Homo sapiens
ccgaagcccaggggccg

SEQ ID NO: 6089550 - DNA, 19 bp, Homo sapiens
ccgaagccccttggagaga

SEQ ID NO: 6089551 - DNA, 22 bp, Homo sapiens
ccgaagccccttggagagagag

SEQ ID NO: 6089552 - DNA, 21 bp, Homo sapiens
ccgaagctgcgggggcaggcc

SEQ ID NO: 6089553 - DNA, 16 bp, Homo sapiens
ccgaaggtctctctgg

SEQ ID NO: 6089554 - DNA, 20 bp, Homo sapiens
ccgaaggtctctctggctct

SEQ ID NO: 6089555 - DNA, 23 bp, Homo sapiens
ccgaaggtgaggagcttgaaacc

SEQ ID NO: 6089556 - DNA, 19 bp, Homo sapiens
ccgaaggtgtctctggtct

SEQ ID NO: 6089557 - DNA, 21 bp, Homo sapiens
ccgaaggttatggtcaatccc

SEQ ID NO: 6089558 - DNA, 18 bp, Homo sapiens
ccgaagtcctctgtggcc

SEQ ID NO: 6089559 - DNA, 14 bp, Homo sapiens
ccgaagtctctgat

SEQ ID NO: 6089560 - DNA, 16 bp, Homo sapiens
ccgaatagctgggact

SEQ ID NO: 6089561 - DNA, 20 bp, Homo sapiens
ccgaatatattactgattta

SEQ ID NO: 6089562 - DNA, 16 bp, Homo sapiens
ccgaatcccccaggga

SEQ ID NO: 6089563 - DNA, 16 bp, Homo sapiens
ccgaatctctttccct

SEQ ID NO: 6089564 - DNA, 23 bp, Homo sapiens
ccgaatctctttttgctttcgaa

SEQ ID NO: 6089565 - DNA, 13 bp, Homo sapiens
ccgaatgcctgtc

SEQ ID NO: 6089566 - DNA, 17 bp, Homo sapiens
ccgaatggagtccagac

SEQ ID NO: 6089567 - DNA, 15 bp, Homo sapiens
ccgaattgagcacaa

SEQ ID NO: 6089568 - DNA, 19 bp, Homo sapiens
ccgaatttagtcacaccat

SEQ ID NO: 6089569 - DNA, 17 bp, Homo sapiens
ccgaatttggtacacat

SEQ ID NO: 6089570 - DNA, 21 bp, Homo sapiens
ccgaatttggtacacatgtgt

SEQ ID NO: 6089571 - DNA, 23 bp, Homo sapiens
ccgaatttggtacacatgtgtta

SEQ ID NO: 6089572 - DNA, 15 bp, Homo sapiens
ccgacaaaattccag

SEQ ID NO: 6089573 - DNA, 22 bp, Homo sapiens
ccgacaactatttcggcctttt

SEQ ID NO: 6089574 - DNA, 20 bp, Homo sapiens
ccgacaatgccctgctggcc

SEQ ID NO: 6089575 - DNA, 15 bp, Homo sapiens
ccgacaccactcctg

SEQ ID NO: 6089576 - DNA, 18 bp, Homo sapiens
ccgacaccactcctgcca

SEQ ID NO: 6089577 - DNA, 19 bp, Homo sapiens
ccgacaccactcctgccag

SEQ ID NO: 6089578 - DNA, 20 bp, Homo sapiens
ccgacaccactcctgccagc

SEQ ID NO: 6089579 - DNA, 17 bp, Homo sapiens
ccgacacgctccctccc

SEQ ID NO: 6089580 - DNA, 12 bp, Homo sapiens
ccgacactgttc

SEQ ID NO: 6089581 - DNA, 14 bp, Homo sapiens
ccgacactgttctc

SEQ ID NO: 6089582 - DNA, 12 bp, Homo sapiens
ccgacagagaga

SEQ ID NO: 6089583 - DNA, 14 bp, Homo sapiens
ccgacagcctggca

SEQ ID NO: 6089584 - DNA, 15 bp, Homo sapiens
ccgacagctcttact

SEQ ID NO: 6089585 - DNA, 15 bp, Homo sapiens
ccgacaggaggccat

SEQ ID NO: 6089586 - DNA, 20 bp, Homo sapiens
ccgacaggcatgcaccagtg

SEQ ID NO: 6089587 - DNA, 14 bp, Homo sapiens
ccgacaggccctgg

SEQ ID NO: 6089588 - DNA, 14 bp, Homo sapiens
ccgacattgtctcc

SEQ ID NO: 6089589 - DNA, 17 bp, Homo sapiens
ccgacattgtctcccgc

SEQ ID NO: 6089590 - DNA, 14 bp, Homo sapiens
ccgaccaactgccc

SEQ ID NO: 6089591 - DNA, 18 bp, Homo sapiens
ccgaccaatccccagcct

SEQ ID NO: 6089592 - DNA, 17 bp, Homo sapiens
ccgaccagacaccttga

SEQ ID NO: 6089593 - DNA, 17 bp, Homo sapiens
ccgaccatcgtccagcc

SEQ ID NO: 6089594 - DNA, 20 bp, Homo sapiens
ccgaccatcgtccagccctc

SEQ ID NO: 6089595 - DNA, 21 bp, Homo sapiens
ccgaccatcgtccagccctcc

SEQ ID NO: 6089596 - DNA, 14 bp, Homo sapiens
ccgacccagccagc

SEQ ID NO: 6089597 - DNA, 21 bp, Homo sapiens
ccgacccagggttcccgcggg

SEQ ID NO: 6089598 - DNA, 19 bp, Homo sapiens
ccgaccccacctgaggcag

SEQ ID NO: 6089599 - DNA, 20 bp, Homo sapiens
ccgacccccgcagaggcaga

SEQ ID NO: 6089600 - DNA, 16 bp, Homo sapiens
ccgaccccgggccgga

SEQ ID NO: 6089601 - DNA, 12 bp, Homo sapiens
ccgacccctgtc

SEQ ID NO: 6089602 - DNA, 15 bp, Homo sapiens
ccgacccctgtccag

SEQ ID NO: 6089603 - DNA, 23 bp, Homo sapiens
ccgaccctcatggcccccagggg

SEQ ID NO: 6089604 - DNA, 18 bp, Homo sapiens
ccgaccctcctggccttc

SEQ ID NO: 6089605 - DNA, 19 bp, Homo sapiens
ccgaccctctgggaacctc

SEQ ID NO: 6089606 - DNA, 21 bp, Homo sapiens
ccgaccgaggctggagctggc

SEQ ID NO: 6089607 - DNA, 15 bp, Homo sapiens
ccgaccgcctgcttc

SEQ ID NO: 6089608 - DNA, 16 bp, Homo sapiens
ccgaccgcctgcttca

SEQ ID NO: 6089609 - DNA, 23 bp, Homo sapiens
ccgacctcgtcctccccctgcca

SEQ ID NO: 6089610 - DNA, 12 bp, Homo sapiens
ccgacctctctc

SEQ ID NO: 6089611 - DNA, 14 bp, Homo sapiens
ccgacctctctcct

SEQ ID NO: 6089612 - DNA, 13 bp, Homo sapiens
ccgacctctctcg

SEQ ID NO: 6089613 - DNA, 18 bp, Homo sapiens
ccgacctctctcggcccc

SEQ ID NO: 6089614 - DNA, 13 bp, Homo sapiens
ccgacctggctga

SEQ ID NO: 6089615 - DNA, 22 bp, Homo sapiens
ccgacgacacatatacatatga

SEQ ID NO: 6089616 - DNA, 15 bp, Homo sapiens
ccgacgcccctccgg

SEQ ID NO: 6089617 - DNA, 16 bp, Homo sapiens
ccgacgcccctccggg

SEQ ID NO: 6089618 - DNA, 23 bp, Homo sapiens
ccgacgccgtcccaccagcttca

SEQ ID NO: 6089619 - DNA, 17 bp, Homo sapiens
ccgacgcgtctcctgtt

SEQ ID NO: 6089620 - DNA, 19 bp, Homo sapiens
ccgacggagccactggggt

SEQ ID NO: 6089621 - DNA, 13 bp, Homo sapiens
ccgacggcctcca

SEQ ID NO: 6089622 - DNA, 14 bp, Homo sapiens
ccgacgtcatgtat

SEQ ID NO: 6089623 - DNA, 17 bp, Homo sapiens
ccgactaccccagtccc

SEQ ID NO: 6089624 - DNA, 16 bp, Homo sapiens
ccgactagacacacaa

SEQ ID NO: 6089625 - DNA, 14 bp, Homo sapiens
ccgactagcaggca

SEQ ID NO: 6089626 - DNA, 23 bp, Homo sapiens
ccgactcacaccactagcctcag

SEQ ID NO: 6089627 - DNA, 14 bp, Homo sapiens
ccgactcacctgcg

SEQ ID NO: 6089628 - DNA, 10 bp, Homo sapiens
ccgactcagg

SEQ ID NO: 6089629 - DNA, 12 bp, Homo sapiens
ccgactccagat

SEQ ID NO: 6089630 - DNA, 16 bp, Homo sapiens
ccgactccagccagcg

SEQ ID NO: 6089631 - DNA, 11 bp, Homo sapiens
ccgactccccc

SEQ ID NO: 6089632 - DNA, 14 bp, Homo sapiens
ccgactccccctcc

SEQ ID NO: 6089633 - DNA, 20 bp, Homo sapiens
ccgactccccctccccggca

SEQ ID NO: 6089634 - DNA, 12 bp, Homo sapiens
ccgactccctga

SEQ ID NO: 6089635 - DNA, 20 bp, Homo sapiens
ccgactcctgggttgagctg

SEQ ID NO: 6089636 - DNA, 19 bp, Homo sapiens
ccgactctaagctgtgtgc

SEQ ID NO: 6089637 - DNA, 13 bp, Homo sapiens
ccgactctggccc

SEQ ID NO: 6089638 - DNA, 14 bp, Homo sapiens
ccgactctggccct

SEQ ID NO: 6089639 - DNA, 19 bp, Homo sapiens
ccgactctggccctggccc

SEQ ID NO: 6089640 - DNA, 14 bp, Homo sapiens
ccgactgaccactg

SEQ ID NO: 6089641 - DNA, 18 bp, Homo sapiens
ccgactgaccactggcct

SEQ ID NO: 6089642 - DNA, 23 bp, Homo sapiens
ccgactgcacagcggcccctgca

SEQ ID NO: 6089643 - DNA, 18 bp, Homo sapiens
ccgactgcccctgctgtg

SEQ ID NO: 6089644 - DNA, 22 bp, Homo sapiens
ccgactgcgctgctttttcaaa

SEQ ID NO: 6089645 - DNA, 14 bp, Homo sapiens
ccgactgctttgga

SEQ ID NO: 6089646 - DNA, 16 bp, Homo sapiens
ccgactgctttggacc

SEQ ID NO: 6089647 - DNA, 17 bp, Homo sapiens
ccgactgctttggacct

SEQ ID NO: 6089648 - DNA, 20 bp, Homo sapiens
ccgacttcaatttcccaccc

SEQ ID NO: 6089649 - DNA, 16 bp, Homo sapiens
ccgacttcccctgggc

SEQ ID NO: 6089650 - DNA, 20 bp, Homo sapiens
ccgacttctttggtgttctg

SEQ ID NO: 6089651 - DNA, 13 bp, Homo sapiens
ccgacttgaatat

SEQ ID NO: 6089652 - DNA, 13 bp, Homo sapiens
cctggccatctct

SEQ ID NO: 6089653 - DNA, 12 bp, Homo sapiens
cctggccatgct

SEQ ID NO: 6089654 - DNA, 14 bp, Homo sapiens
cctggccatgctgt

SEQ ID NO: 6089655 - DNA, 18 bp, Homo sapiens
cctggccatgctgtccct

SEQ ID NO: 6089656 - DNA, 20 bp, Homo sapiens
cctggccatgctgtccctgc

SEQ ID NO: 6089657 - DNA, 15 bp, Homo sapiens
cctggccatgtcctc

SEQ ID NO: 6089658 - DNA, 16 bp, Homo sapiens
cctggccatgtcctca

SEQ ID NO: 6089659 - DNA, 23 bp, Homo sapiens
cctggccatttccaagaggctgt

SEQ ID NO: 6089660 - DNA, 17 bp, Homo sapiens
cctggccatttggcccc

SEQ ID NO: 6089661 - DNA, 20 bp, Homo sapiens
cctggccatttggccccagg

SEQ ID NO: 6089662 - DNA, 21 bp, Homo sapiens
cctggccatttggccccaggg

SEQ ID NO: 6089663 - DNA, 15 bp, Homo sapiens
cctggcccaaagcag

SEQ ID NO: 6089664 - DNA, 21 bp, Homo sapiens
cctggcccaccccacccactt

SEQ ID NO: 6089665 - DNA, 14 bp, Homo sapiens
cctggcccactgca

SEQ ID NO: 6089666 - DNA, 16 bp, Homo sapiens
cctggcccactgcatc

SEQ ID NO: 6089667 - DNA, 19 bp, Homo sapiens
cctggcccagccagcaggt

SEQ ID NO: 6089668 - DNA, 21 bp, Homo sapiens
cctggcccagcggcccctccc

SEQ ID NO: 6089669 - DNA, 15 bp, Homo sapiens
cctggcccaggagga

SEQ ID NO: 6089670 - DNA, 14 bp, Homo sapiens
cctggcccaggcct

SEQ ID NO: 6089671 - DNA, 18 bp, Homo sapiens
cctggcccaggccttgct

SEQ ID NO: 6089672 - DNA, 13 bp, Homo sapiens
cctggcccaggga

SEQ ID NO: 6089673 - DNA, 16 bp, Homo sapiens
cctggcccagggcatc

SEQ ID NO: 6089674 - DNA, 22 bp, Homo sapiens
cctggcccatctcagcctcctg

SEQ ID NO: 6089675 - DNA, 23 bp, Homo sapiens
cctggcccatctcagcctcctga

SEQ ID NO: 6089676 - DNA, 19 bp, Homo sapiens
cctggcccattcttgagtt

SEQ ID NO: 6089677 - DNA, 17 bp, Homo sapiens
cctggccccagccccca

SEQ ID NO: 6089678 - DNA, 16 bp, Homo sapiens
cctggccccagcccta

SEQ ID NO: 6089679 - DNA, 13 bp, Homo sapiens
cctggccccaggc

SEQ ID NO: 6089680 - DNA, 16 bp, Homo sapiens
cctggccccagtgacc

SEQ ID NO: 6089681 - DNA, 19 bp, Homo sapiens
cctggccccagtgaccggg

SEQ ID NO: 6089682 - DNA, 20 bp, Homo sapiens
cctggccccatgtctctcag

SEQ ID NO: 6089683 - DNA, 16 bp, Homo sapiens
cctggcccccacagcg

SEQ ID NO: 6089684 - DNA, 13 bp, Homo sapiens
cctggcccccagc

SEQ ID NO: 6089685 - DNA, 19 bp, Homo sapiens
cctggcccccctccaggca

SEQ ID NO: 6089686 - DNA, 20 bp, Homo sapiens
cctggcccccctccaggcat

SEQ ID NO: 6089687 - DNA, 23 bp, Homo sapiens
cctggcccccctccaggcatgct

SEQ ID NO: 6089688 - DNA, 20 bp, Homo sapiens
cctggcccccgacccagctc

SEQ ID NO: 6089689 - DNA, 17 bp, Homo sapiens
cctggccccctcattca

SEQ ID NO: 6089690 - DNA, 20 bp, Homo sapiens
cctggccccctccctggatg

SEQ ID NO: 6089691 - DNA, 20 bp, Homo sapiens
cctggccccctcgcgcccct

SEQ ID NO: 6089692 - DNA, 21 bp, Homo sapiens
cctggccccgggctctggcca

SEQ ID NO: 6089693 - DNA, 18 bp, Homo sapiens
cctggcccctcaacctcc

SEQ ID NO: 6089694 - DNA, 18 bp, Homo sapiens
cctggcccctccaatcct

SEQ ID NO: 6089695 - DNA, 21 bp, Homo sapiens
cctggcccctccagaccctgc

SEQ ID NO: 6089696 - DNA, 23 bp, Homo sapiens
cctggcccctccagaccctgcct

SEQ ID NO: 6089697 - DNA, 18 bp, Homo sapiens
cctggcccctcccacatc

SEQ ID NO: 6089698 - DNA, 19 bp, Homo sapiens
cctggcccctcccacatcc

SEQ ID NO: 6089699 - DNA, 20 bp, Homo sapiens
cctggcccctcccacatccc

SEQ ID NO: 6089700 - DNA, 15 bp, Homo sapiens
cctggcccctcgcct

SEQ ID NO: 6089701 - DNA, 14 bp, Homo sapiens
cctggcccctctcc

SEQ ID NO: 6089702 - DNA, 17 bp, Homo sapiens
cctggcccctctccctt

SEQ ID NO: 6089703 - DNA, 15 bp, Homo sapiens
cctggcccctgtggg

SEQ ID NO: 6089704 - DNA, 18 bp, Homo sapiens
cctggccccttctccagc

SEQ ID NO: 6089705 - DNA, 16 bp, Homo sapiens
cctggcccgccctcac

SEQ ID NO: 6089706 - DNA, 21 bp, Homo sapiens
cctggcccgccctcacctctg

SEQ ID NO: 6089707 - DNA, 17 bp, Homo sapiens
cctggcccggtcccagt

SEQ ID NO: 6089708 - DNA, 13 bp, Homo sapiens
cctggccctcact

SEQ ID NO: 6089709 - DNA, 14 bp, Homo sapiens
cctggccctcttct

SEQ ID NO: 6089710 - DNA, 16 bp, Homo sapiens
cctggccctgaggtgt

SEQ ID NO: 6089711 - DNA, 12 bp, Homo sapiens
cctggccctgcc

SEQ ID NO: 6089712 - DNA, 13 bp, Homo sapiens
cctggccctgcct

SEQ ID NO: 6089713 - DNA, 14 bp, Homo sapiens
cctggccctgcctc

SEQ ID NO: 6089714 - DNA, 15 bp, Homo sapiens
cctggccctgcctca

SEQ ID NO: 6089715 - DNA, 17 bp, Homo sapiens
cctggccctgcttcctg

SEQ ID NO: 6089716 - DNA, 21 bp, Homo sapiens
cctggccctgcttcctgcttg

SEQ ID NO: 6089717 - DNA, 18 bp, Homo sapiens
cctggcccttacttgctt

SEQ ID NO: 6089718 - DNA, 15 bp, Homo sapiens
cctggcccttcagtc

SEQ ID NO: 6089719 - DNA, 17 bp, Homo sapiens
cctggcccttcagtctg

SEQ ID NO: 6089720 - DNA, 19 bp, Homo sapiens
cctggcccttcagtctgct

SEQ ID NO: 6089721 - DNA, 15 bp, Homo sapiens
cctggcccttccttc

SEQ ID NO: 6089722 - DNA, 16 bp, Homo sapiens
cctggcccttccttca

SEQ ID NO: 6089723 - DNA, 21 bp, Homo sapiens
cctggcccttccttcacccac

SEQ ID NO: 6089724 - DNA, 19 bp, Homo sapiens
cctggccctttcacccctc

SEQ ID NO: 6089725 - DNA, 21 bp, Homo sapiens
cctggccctttcacccctctt

SEQ ID NO: 6089726 - DNA, 17 bp, Homo sapiens
cctggccctttcccctt

SEQ ID NO: 6089727 - DNA, 18 bp, Homo sapiens
cctggccgagtccaagct

SEQ ID NO: 6089728 - DNA, 12 bp, Homo sapiens
cctggccgcccc

SEQ ID NO: 6089729 - DNA, 14 bp, Homo sapiens
cctggccgccccct

SEQ ID NO: 6089730 - DNA, 21 bp, Homo sapiens
cctggccgccccctgcccccc

SEQ ID NO: 6089731 - DNA, 16 bp, Homo sapiens
cctggccgcctccagg

SEQ ID NO: 6089732 - DNA, 21 bp, Homo sapiens
cctggccgcgtttagaccaag

SEQ ID NO: 6089733 - DNA, 19 bp, Homo sapiens
cctggccggcaaccccagt

SEQ ID NO: 6089734 - DNA, 23 bp, Homo sapiens
cctggccggccagccagccactc

SEQ ID NO: 6089735 - DNA, 18 bp, Homo sapiens
cctggccggccgcccaca

SEQ ID NO: 6089736 - DNA, 13 bp, Homo sapiens
cctggccggctcc

SEQ ID NO: 6089737 - DNA, 15 bp, Homo sapiens
cctggccggctccag

SEQ ID NO: 6089738 - DNA, 16 bp, Homo sapiens
cctggccggctccagt

SEQ ID NO: 6089739 - DNA, 19 bp, Homo sapiens
cctggccgggtcaccctgt

SEQ ID NO: 6089740 - DNA, 17 bp, Homo sapiens
cctggccggtaggctgc

SEQ ID NO: 6089741 - DNA, 21 bp, Homo sapiens
cctggccggtaggctgctggc

SEQ ID NO: 6089742 - DNA, 18 bp, Homo sapiens
cctggccgttcagcctgt

SEQ ID NO: 6089743 - DNA, 17 bp, Homo sapiens
cctggcctaccacagct

SEQ ID NO: 6089744 - DNA, 20 bp, Homo sapiens
cctggcctaccacagctgcc

SEQ ID NO: 6089745 - DNA, 16 bp, Homo sapiens
cctggcctagaccagc

SEQ ID NO: 6089746 - DNA, 20 bp, Homo sapiens
cctggcctagaccagcagac

SEQ ID NO: 6089747 - DNA, 22 bp, Homo sapiens
cctggcctagcatacgtacaca

SEQ ID NO: 6089748 - DNA, 23 bp, Homo sapiens
cctggcctatccgctgccagcct

SEQ ID NO: 6089749 - DNA, 14 bp, Homo sapiens
cctggcctatttaa

SEQ ID NO: 6089750 - DNA, 20 bp, Homo sapiens
cctggcctatttaagccccc

SEQ ID NO: 6089751 - DNA, 16 bp, Homo sapiens
cctggcctcaagcaat

SEQ ID NO: 6089752 - DNA, 13 bp, Homo sapiens
cctggcctcaagt

SEQ ID NO: 6089753 - DNA, 22 bp, Homo sapiens
cctggcctcaagtgattctcct

SEQ ID NO: 6089754 - DNA, 20 bp, Homo sapiens
cctggcctcacgcccagcct

SEQ ID NO: 6089755 - DNA, 16 bp, Homo sapiens
cctggcctcactggct

SEQ ID NO: 6089756 - DNA, 18 bp, Homo sapiens
cctggcctcactggctgg

SEQ ID NO: 6089757 - DNA, 20 bp, Homo sapiens
cctggcctcagactgcaccc

SEQ ID NO: 6089758 - DNA, 22 bp, Homo sapiens
cctggcctcagactgcacccag

SEQ ID NO: 6089759 - DNA, 16 bp, Homo sapiens
cctggcctcagagctt

SEQ ID NO: 6089760 - DNA, 18 bp, Homo sapiens
cctggcctcagagcttcc

SEQ ID NO: 6089761 - DNA, 12 bp, Homo sapiens
cctggcctcagc

SEQ ID NO: 6089762 - DNA, 17 bp, Homo sapiens
cctggcctcatctcaga

SEQ ID NO: 6089763 - DNA, 16 bp, Homo sapiens
cctggcctccagctcc

SEQ ID NO: 6089764 - DNA, 16 bp, Homo sapiens
cctggcctccaggccc

SEQ ID NO: 6089765 - DNA, 15 bp, Homo sapiens
cctggcctcccctgc

SEQ ID NO: 6089766 - DNA, 16 bp, Homo sapiens
cctggcctcccctgcg

SEQ ID NO: 6089767 - DNA, 13 bp, Homo sapiens
cctggcctcccgc

SEQ ID NO: 6089768 - DNA, 15 bp, Homo sapiens
cctggcctcccgcca

SEQ ID NO: 6089769 - DNA, 23 bp, Homo sapiens
cctggcctccggcgtcagcctcc

SEQ ID NO: 6089770 - DNA, 14 bp, Homo sapiens
cctggcctcctgcc

SEQ ID NO: 6089771 - DNA, 15 bp, Homo sapiens
cctggcctcctgcct

SEQ ID NO: 6089772 - DNA, 16 bp, Homo sapiens
cctggcctcgcctgcc

SEQ ID NO: 6089773 - DNA, 17 bp, Homo sapiens
cctggcctcgcctgcct

SEQ ID NO: 6089774 - DNA, 11 bp, Homo sapiens
cctggcctctg

SEQ ID NO: 6089775 - DNA, 14 bp, Homo sapiens
cctggcctctgcac

SEQ ID NO: 6089776 - DNA, 20 bp, Homo sapiens
cctggcctctgcactcccct

SEQ ID NO: 6089777 - DNA, 19 bp, Homo sapiens
cctggcctctgccatcctc

SEQ ID NO: 6089778 - DNA, 20 bp, Homo sapiens
cctggcctctgcttactttt

SEQ ID NO: 6089779 - DNA, 18 bp, Homo sapiens
cctggcctctgggcagtg

SEQ ID NO: 6089780 - DNA, 20 bp, Homo sapiens
cctggcctgaactgaggaga

SEQ ID NO: 6089781 - DNA, 21 bp, Homo sapiens
cctggcctgaactgaggagat

SEQ ID NO: 6089782 - DNA, 13 bp, Homo sapiens
cctggcctgagag

SEQ ID NO: 6089783 - DNA, 16 bp, Homo sapiens
cctggcctgagagtca

SEQ ID NO: 6089784 - DNA, 22 bp, Homo sapiens
cctggcctgagctggggccaca

SEQ ID NO: 6089785 - DNA, 17 bp, Homo sapiens
cctggcctgccagacac

SEQ ID NO: 6089786 - DNA, 21 bp, Homo sapiens
cctggcctgcccgtgccctgg

SEQ ID NO: 6089787 - DNA, 14 bp, Homo sapiens
cctggcctgctggg

SEQ ID NO: 6089788 - DNA, 15 bp, Homo sapiens
cctggcctgctggga

SEQ ID NO: 6089789 - DNA, 12 bp, Homo sapiens
cctggcctggca

SEQ ID NO: 6089790 - DNA, 14 bp, Homo sapiens
cctggcctggccct

SEQ ID NO: 6089791 - DNA, 16 bp, Homo sapiens
cctggcctggccctgc

SEQ ID NO: 6089792 - DNA, 12 bp, Homo sapiens
cctggcctggct

SEQ ID NO: 6089793 - DNA, 13 bp, Homo sapiens
cctggcctggctc

SEQ ID NO: 6089794 - DNA, 14 bp, Homo sapiens
cctggcctggctcc

SEQ ID NO: 6089795 - DNA, 17 bp, Homo sapiens
cctggcctggctgggtg

SEQ ID NO: 6089796 - DNA, 15 bp, Homo sapiens
cctggcctggtccct

SEQ ID NO: 6089797 - DNA, 21 bp, Homo sapiens
cctggcctgtggagagaaagc

SEQ ID NO: 6089798 - DNA, 19 bp, Homo sapiens
cctggcctgttctgttttg

SEQ ID NO: 6089799 - DNA, 11 bp, Homo sapiens
cctggccttca

SEQ ID NO: 6089800 - DNA, 15 bp, Homo sapiens
cctggccttcctgtc

SEQ ID NO: 6089801 - DNA, 20 bp, Homo sapiens
cctggccttctaggaatgga

SEQ ID NO: 6089802 - DNA, 23 bp, Homo sapiens
cctggccttgcccgtcgtgtgct

SEQ ID NO: 6089803 - DNA, 21 bp, Homo sapiens
cctggccttgtcaggacccag

SEQ ID NO: 6089804 - DNA, 22 bp, Homo sapiens
cctggccttgtcctcagccagt

SEQ ID NO: 6089805 - DNA, 21 bp, Homo sapiens
cctggccttgtgtcactggct

SEQ ID NO: 6089806 - DNA, 14 bp, Homo sapiens
cctggcctttcata

SEQ ID NO: 6089807 - DNA, 15 bp, Homo sapiens
cctggcctttcatat

SEQ ID NO: 6089808 - DNA, 16 bp, Homo sapiens
cctggcctttcctggt

SEQ ID NO: 6089809 - DNA, 20 bp, Homo sapiens
cctggcgactgcccctgcct

SEQ ID NO: 6089810 - DNA, 19 bp, Homo sapiens
cctggcgcaggtgggctgg

SEQ ID NO: 6089811 - DNA, 23 bp, Homo sapiens
cctggcgcaggtgggctggactt

SEQ ID NO: 6089812 - DNA, 13 bp, Homo sapiens
cctggcgccccct

SEQ ID NO: 6089813 - DNA, 15 bp, Homo sapiens
cctggcgcctggcag

SEQ ID NO: 6089814 - DNA, 20 bp, Homo sapiens
cctggcggaggtggagtggc

SEQ ID NO: 6089815 - DNA, 18 bp, Homo sapiens
cctggcggccccaactcg

SEQ ID NO: 6089816 - DNA, 14 bp, Homo sapiens
cctggcgggcagcc

SEQ ID NO: 6089817 - DNA, 17 bp, Homo sapiens
cctggcgggcagcccct

SEQ ID NO: 6089818 - DNA, 18 bp, Homo sapiens
cctggcgggcagcccctg

SEQ ID NO: 6089819 - DNA, 18 bp, Homo sapiens
cctggcggggcaggaggc

SEQ ID NO: 6089820 - DNA, 12 bp, Homo sapiens
cctggcggggtg

SEQ ID NO: 6089821 - DNA, 18 bp, Homo sapiens
cctggcggggttggccct

SEQ ID NO: 6089822 - DNA, 17 bp, Homo sapiens
cctggctaacacggtga

SEQ ID NO: 6089823 - DNA, 12 bp, Homo sapiens
cctggctaagcc

SEQ ID NO: 6089824 - DNA, 15 bp, Homo sapiens
cctggctaagcctct

SEQ ID NO: 6089825 - DNA, 20 bp, Homo sapiens
cctggctaatttttgtattt

SEQ ID NO: 6089826 - DNA, 23 bp, Homo sapiens
cctggctacagggcgagactctg

SEQ ID NO: 6089827 - DNA, 18 bp, Homo sapiens
cctggctacatcccagcc

SEQ ID NO: 6089828 - DNA, 19 bp, Homo sapiens
cctggctacatcccagcct

SEQ ID NO: 6089829 - DNA, 23 bp, Homo sapiens
cctggctacatcccagcctgtgg

SEQ ID NO: 6089830 - DNA, 22 bp, Homo sapiens
cctggctaccttgtgggaataa

SEQ ID NO: 6089831 - DNA, 24 bp, Homo sapiens
ccgacttggagactcctggtctgt

SEQ ID NO: 6089832 - DNA, 22 bp, Homo sapiens
ccgacttgggaggacaggtcct

SEQ ID NO: 6089833 - DNA, 14 bp, Homo sapiens
ccgacttgtccctc

SEQ ID NO: 6089834 - DNA, 18 bp, Homo sapiens
ccgacttgtgcacaggca

SEQ ID NO: 6089835 - DNA, 19 bp, Homo sapiens
ccgacttgtgcacaggcag

SEQ ID NO: 6089836 - DNA, 20 bp, Homo sapiens
ccgacttgtgcacaggcaga

SEQ ID NO: 6089837 - DNA, 13 bp, Homo sapiens
ccgactttggaat

SEQ ID NO: 6089838 - DNA, 13 bp, Homo sapiens
ccgacttttctaa

SEQ ID NO: 6089839 - DNA, 12 bp, Homo sapiens
ccgagaacaaca

SEQ ID NO: 6089840 - DNA, 14 bp, Homo sapiens
ccgagaagccagtg

SEQ ID NO: 6089841 - DNA, 14 bp, Homo sapiens
ccgagaaggaatgg

SEQ ID NO: 6089842 - DNA, 22 bp, Homo sapiens
ccgagaaggaatggtgcttggc

SEQ ID NO: 6089843 - DNA, 20 bp, Homo sapiens
ccgagacaccatcctgagcc

SEQ ID NO: 6089844 - DNA, 22 bp, Homo sapiens
ccgagacaccatcctgagccag

SEQ ID NO: 6089845 - DNA, 20 bp, Homo sapiens
ccgagacagaccctctgccg

SEQ ID NO: 6089846 - DNA, 13 bp, Homo sapiens
ccgagacagtcca

SEQ ID NO: 6089847 - DNA, 20 bp, Homo sapiens
ccgagacccaccatccttcc

SEQ ID NO: 6089848 - DNA, 22 bp, Homo sapiens
ccgagaccccatcttccagcca

SEQ ID NO: 6089849 - DNA, 21 bp, Homo sapiens
ccgagacctcaagccctgagg

SEQ ID NO: 6089850 - DNA, 13 bp, Homo sapiens
ccgagactcagcc

SEQ ID NO: 6089851 - DNA, 16 bp, Homo sapiens
ccgagactcagcctct

SEQ ID NO: 6089852 - DNA, 17 bp, Homo sapiens
ccgagactcagcctctg

SEQ ID NO: 6089853 - DNA, 18 bp, Homo sapiens
ccgagactcagcctctgc

SEQ ID NO: 6089854 - DNA, 15 bp, Homo sapiens
ccgagagagacccca

SEQ ID NO: 6089855 - DNA, 23 bp, Homo sapiens
ccgagagagcacccctctctgca

SEQ ID NO: 6089856 - DNA, 13 bp, Homo sapiens
ccgagagaggcgc

SEQ ID NO: 6089857 - DNA, 12 bp, Homo sapiens
ccgagagctctt

SEQ ID NO: 6089858 - DNA, 13 bp, Homo sapiens
ccgagaggacaga

SEQ ID NO: 6089859 - DNA, 17 bp, Homo sapiens
ccgagaggccagttgat

SEQ ID NO: 6089860 - DNA, 15 bp, Homo sapiens
ccgagaggtgggcca

SEQ ID NO: 6089861 - DNA, 21 bp, Homo sapiens
ccgagaggtgggccagtctgt

SEQ ID NO: 6089862 - DNA, 22 bp, Homo sapiens
ccgagagtagccgagagcctgc

SEQ ID NO: 6089863 - DNA, 22 bp, Homo sapiens
ccgagatagccaaggccaaagg

SEQ ID NO: 6089864 - DNA, 19 bp, Homo sapiens
ccgagatcggggtggcaga

SEQ ID NO: 6089865 - DNA, 20 bp, Homo sapiens
ccgagatcgtgccattgcac

SEQ ID NO: 6089866 - DNA, 22 bp, Homo sapiens
ccgagatgtgacccaccagtgc

SEQ ID NO: 6089867 - DNA, 13 bp, Homo sapiens
ccgagattcagac

SEQ ID NO: 6089868 - DNA, 16 bp, Homo sapiens
ccgagattgcgccact

SEQ ID NO: 6089869 - DNA, 18 bp, Homo sapiens
ccgagcaaagtctaaagt

SEQ ID NO: 6089870 - DNA, 16 bp, Homo sapiens
ccgagcaaccctctga

SEQ ID NO: 6089871 - DNA, 16 bp, Homo sapiens
ccgagcaaccgtggcc

SEQ ID NO: 6089872 - DNA, 23 bp, Homo sapiens
ccgagcaaccgtggcccttcctg

SEQ ID NO: 6089873 - DNA, 20 bp, Homo sapiens
ccgagcaatggcgcctgctc

SEQ ID NO: 6089874 - DNA, 21 bp, Homo sapiens
ccgagcaccgtgtcgggcagg

SEQ ID NO: 6089875 - DNA, 15 bp, Homo sapiens
ccgagcagctgagca

SEQ ID NO: 6089876 - DNA, 17 bp, Homo sapiens
ccgagcagctgagcagg

SEQ ID NO: 6089877 - DNA, 21 bp, Homo sapiens
ccgagcatgcttccctaggat

SEQ ID NO: 6089878 - DNA, 13 bp, Homo sapiens
ccgagccagcaag

SEQ ID NO: 6089879 - DNA, 12 bp, Homo sapiens
ccgagccagctt

SEQ ID NO: 6089880 - DNA, 22 bp, Homo sapiens
ccgagccaggttcacactcaga

SEQ ID NO: 6089881 - DNA, 17 bp, Homo sapiens
ccgagccatgtgtcttt

SEQ ID NO: 6089882 - DNA, 16 bp, Homo sapiens
ccgagcccacaccatc

SEQ ID NO: 6089883 - DNA, 15 bp, Homo sapiens
ccgagcccagacctc

SEQ ID NO: 6089884 - DNA, 14 bp, Homo sapiens
ccgagccccctgtc

SEQ ID NO: 6089885 - DNA, 15 bp, Homo sapiens
ccgagccccctgtcc

SEQ ID NO: 6089886 - DNA, 13 bp, Homo sapiens
ccgagcccctgtt

SEQ ID NO: 6089887 - DNA, 17 bp, Homo sapiens
ccgagccctacttccag

SEQ ID NO: 6089888 - DNA, 13 bp, Homo sapiens
ccgagccctgact

SEQ ID NO: 6089889 - DNA, 15 bp, Homo sapiens
ccgagccctgactcc

SEQ ID NO: 6089890 - DNA, 23 bp, Homo sapiens
ccgagccctgactcctggactcc

SEQ ID NO: 6089891 - DNA, 15 bp, Homo sapiens
ccgagccctggagag

SEQ ID NO: 6089892 - DNA, 14 bp, Homo sapiens
ccgagcctaatgaa

SEQ ID NO: 6089893 - DNA, 19 bp, Homo sapiens
ccgagcctgaactgagccc

SEQ ID NO: 6089894 - DNA, 19 bp, Homo sapiens
ccgagcgctttctggaaaa

SEQ ID NO: 6089895 - DNA, 22 bp, Homo sapiens
ccgagcgggtgcaagcactcgg

SEQ ID NO: 6089896 - DNA, 18 bp, Homo sapiens
ccgagcggtgtggggacc

SEQ ID NO: 6089897 - DNA, 17 bp, Homo sapiens
ccgagcgttcccagcag

SEQ ID NO: 6089898 - DNA, 16 bp, Homo sapiens
ccgagctactctcttg

SEQ ID NO: 6089899 - DNA, 21 bp, Homo sapiens
ccgagctactctcttgccagc

SEQ ID NO: 6089900 - DNA, 23 bp, Homo sapiens
ccgagctactctcttgccagcat

SEQ ID NO: 6089901 - DNA, 20 bp, Homo sapiens
ccgagctcctggggagctcc

SEQ ID NO: 6089902 - DNA, 20 bp, Homo sapiens
ccgagctcgtgtatcctggg

SEQ ID NO: 6089903 - DNA, 17 bp, Homo sapiens
ccgagctctcctgggcc

SEQ ID NO: 6089904 - DNA, 20 bp, Homo sapiens
ccgagctctcctgggccagg

SEQ ID NO: 6089905 - DNA, 15 bp, Homo sapiens
ccgagctctggtgct

SEQ ID NO: 6089906 - DNA, 22 bp, Homo sapiens
ccgagctctggtgctttagtta

SEQ ID NO: 6089907 - DNA, 23 bp, Homo sapiens
ccgagctctgtgggaaaaaagaa

SEQ ID NO: 6089908 - DNA, 16 bp, Homo sapiens
ccgagctgaggactct

SEQ ID NO: 6089909 - DNA, 14 bp, Homo sapiens
ccgagctgcctggc

SEQ ID NO: 6089910 - DNA, 11 bp, Homo sapiens
ccgagctgggg

SEQ ID NO: 6089911 - DNA, 19 bp, Homo sapiens
ccgagctgggggccatgag

SEQ ID NO: 6089912 - DNA, 22 bp, Homo sapiens
ccgagctggggggttggcagcc

SEQ ID NO: 6089913 - DNA, 16 bp, Homo sapiens
ccgagctgtaggagag

SEQ ID NO: 6089914 - DNA, 15 bp, Homo sapiens
ccgagctgtcggagg

SEQ ID NO: 6089915 - DNA, 23 bp, Homo sapiens
ccgagctgtcggagggctggaca

SEQ ID NO: 6089916 - DNA, 21 bp, Homo sapiens
ccgagcttgcctcagggccaa

SEQ ID NO: 6089917 - DNA, 19 bp, Homo sapiens
ccgaggaactcgcctcagc

SEQ ID NO: 6089918 - DNA, 21 bp, Homo sapiens
ccgaggaagggccagagcctg

SEQ ID NO: 6089919 - DNA, 23 bp, Homo sapiens
ccgaggaatgtgaagccagatct

SEQ ID NO: 6089920 - DNA, 23 bp, Homo sapiens
ccgaggacagcctgcctctgcca

SEQ ID NO: 6089921 - DNA, 18 bp, Homo sapiens
ccgaggaccaccagcagg

SEQ ID NO: 6089922 - DNA, 21 bp, Homo sapiens
ccgaggaccaccagcaggcag

SEQ ID NO: 6089923 - DNA, 13 bp, Homo sapiens
ccgaggacccaga

SEQ ID NO: 6089924 - DNA, 16 bp, Homo sapiens
ccgaggacccagaccc

SEQ ID NO: 6089925 - DNA, 17 bp, Homo sapiens
ccgaggacccagaccca

SEQ ID NO: 6089926 - DNA, 15 bp, Homo sapiens
ccgaggagccccagc

SEQ ID NO: 6089927 - DNA, 21 bp, Homo sapiens
ccgaggagccccagccccgtc

SEQ ID NO: 6089928 - DNA, 13 bp, Homo sapiens
ccgaggagctggg

SEQ ID NO: 6089929 - DNA, 23 bp, Homo sapiens
ccgaggagctgggcccctgcaca

SEQ ID NO: 6089930 - DNA, 12 bp, Homo sapiens
ccgaggaggccg

SEQ ID NO: 6089931 - DNA, 18 bp, Homo sapiens
ccgaggaggtgtctcagg

SEQ ID NO: 6089932 - DNA, 18 bp, Homo sapiens
ccgaggagttgtcgtttt

SEQ ID NO: 6089933 - DNA, 16 bp, Homo sapiens
ccgaggatgctgtcag

SEQ ID NO: 6089934 - DNA, 21 bp, Homo sapiens
ccgaggcagcaacaggaccag

SEQ ID NO: 6089935 - DNA, 22 bp, Homo sapiens
ccgaggcagcaacaggaccagg

SEQ ID NO: 6089936 - DNA, 23 bp, Homo sapiens
ccgaggcagcaacaggaccagga

SEQ ID NO: 6089937 - DNA, 15 bp, Homo sapiens
ccgaggcaggcagat

SEQ ID NO: 6089938 - DNA, 15 bp, Homo sapiens
ccgaggcagggaagg

SEQ ID NO: 6089939 - DNA, 15 bp, Homo sapiens
ccgaggcaggggctg

SEQ ID NO: 6089940 - DNA, 11 bp, Homo sapiens
ccgaggccagt

SEQ ID NO: 6089941 - DNA, 21 bp, Homo sapiens
ccgaggcccagatccaaggcc

SEQ ID NO: 6089942 - DNA, 13 bp, Homo sapiens
ccgaggcccccct

SEQ ID NO: 6089943 - DNA, 23 bp, Homo sapiens
ccgaggcccccctctgcctttga

SEQ ID NO: 6089944 - DNA, 18 bp, Homo sapiens
ccgaggccctcccaaaga

SEQ ID NO: 6089945 - DNA, 17 bp, Homo sapiens
ccgaggcctacctgctc

SEQ ID NO: 6089946 - DNA, 18 bp, Homo sapiens
ccgaggcctacctgctcc

SEQ ID NO: 6089947 - DNA, 19 bp, Homo sapiens
ccgaggcctggctctggag

SEQ ID NO: 6089948 - DNA, 17 bp, Homo sapiens
ccgaggccttctctgaa

SEQ ID NO: 6089949 - DNA, 18 bp, Homo sapiens
ccgaggcgatgccacgct

SEQ ID NO: 6089950 - DNA, 20 bp, Homo sapiens
ccgaggcgggtggatcacga

SEQ ID NO: 6089951 - DNA, 14 bp, Homo sapiens
ccgaggctacagct

SEQ ID NO: 6089952 - DNA, 16 bp, Homo sapiens
ccgaggctacagctcc

SEQ ID NO: 6089953 - DNA, 22 bp, Homo sapiens
ccgaggctcgagctcggggctg

SEQ ID NO: 6089954 - DNA, 13 bp, Homo sapiens
ccgaggctgcccc

SEQ ID NO: 6089955 - DNA, 17 bp, Homo sapiens
ccgaggctggagctggc

SEQ ID NO: 6089956 - DNA, 20 bp, Homo sapiens
ccgagggagctgctggctga

SEQ ID NO: 6089957 - DNA, 20 bp, Homo sapiens
ccgagggatgatgccacacc

SEQ ID NO: 6089958 - DNA, 17 bp, Homo sapiens
ccgagggatggtgcccc

SEQ ID NO: 6089959 - DNA, 21 bp, Homo sapiens
ccgagggatgtccttggggag

SEQ ID NO: 6089960 - DNA, 20 bp, Homo sapiens
ccgagggcagccccctccct

SEQ ID NO: 6089961 - DNA, 12 bp, Homo sapiens
ccgagggccagg

SEQ ID NO: 6089962 - DNA, 16 bp, Homo sapiens
ccgagggcgaaggcca

SEQ ID NO: 6089963 - DNA, 19 bp, Homo sapiens
ccgagggcgaaggccattg

SEQ ID NO: 6089964 - DNA, 16 bp, Homo sapiens
ccgagggcgaccccgt

SEQ ID NO: 6089965 - DNA, 17 bp, Homo sapiens
ccgagggcgcctgggtc

SEQ ID NO: 6089966 - DNA, 12 bp, Homo sapiens
ccgagggcggcc

SEQ ID NO: 6089967 - DNA, 16 bp, Homo sapiens
ccgagggcggccaggg

SEQ ID NO: 6089968 - DNA, 17 bp, Homo sapiens
ccgagggcggccaggga

SEQ ID NO: 6089969 - DNA, 19 bp, Homo sapiens
ccgagggctcagaagagca

SEQ ID NO: 6089970 - DNA, 11 bp, Homo sapiens
ccgagggctga

SEQ ID NO: 6089971 - DNA, 15 bp, Homo sapiens
ccgagggctgaggag

SEQ ID NO: 6089972 - DNA, 19 bp, Homo sapiens
ccgagggctgaggagcagc

SEQ ID NO: 6089973 - DNA, 13 bp, Homo sapiens
ccgagggctggcc

SEQ ID NO: 6089974 - DNA, 18 bp, Homo sapiens
ccgaggggctcaggaaaa

SEQ ID NO: 6089975 - DNA, 16 bp, Homo sapiens
ccgagggggctgctcc

SEQ ID NO: 6089976 - DNA, 18 bp, Homo sapiens
ccgagggggctgctccca

SEQ ID NO: 6089977 - DNA, 23 bp, Homo sapiens
ccgagggtcctggctcctgaggg

SEQ ID NO: 6089978 - DNA, 14 bp, Homo sapiens
ccgagggtgaaaca

SEQ ID NO: 6089979 - DNA, 19 bp, Homo sapiens
ccgaggtgagcggatcaca

SEQ ID NO: 6089980 - DNA, 21 bp, Homo sapiens
ccgaggtggctgcctggagcc

SEQ ID NO: 6089981 - DNA, 13 bp, Homo sapiens
ccgaggtgggcag

SEQ ID NO: 6089982 - DNA, 15 bp, Homo sapiens
ccgaggtggttcaga

SEQ ID NO: 6089983 - DNA, 18 bp, Homo sapiens
ccgaggtgttgccagtgc

SEQ ID NO: 6089984 - DNA, 15 bp, Homo sapiens
ccgaggttttgaggc

SEQ ID NO: 6089985 - DNA, 14 bp, Homo sapiens
ccgagtacctccag

SEQ ID NO: 6089986 - DNA, 21 bp, Homo sapiens
ccgagtagaaaatgtgaccct

SEQ ID NO: 6089987 - DNA, 17 bp, Homo sapiens
ccgagtagctgggacta

SEQ ID NO: 6089988 - DNA, 15 bp, Homo sapiens
ccgagtagctgggat

SEQ ID NO: 6089989 - DNA, 16 bp, Homo sapiens
ccgagtagctgggatt

SEQ ID NO: 6089990 - DNA, 19 bp, Homo sapiens
ccgagtagctgggattaca

SEQ ID NO: 6089991 - DNA, 20 bp, Homo sapiens
ccgagtagctgggattacag

SEQ ID NO: 6089992 - DNA, 22 bp, Homo sapiens
ccgagtatctgtaacccttgaa

SEQ ID NO: 6089993 - DNA, 22 bp, Homo sapiens
ccgagtcaattaaacagctggt

SEQ ID NO: 6089994 - DNA, 13 bp, Homo sapiens
ccgagtccaagct

SEQ ID NO: 6089995 - DNA, 19 bp, Homo sapiens
ccgagtccaggagccccag

SEQ ID NO: 6089996 - DNA, 22 bp, Homo sapiens
ccgagtccaggagccccagcca

SEQ ID NO: 6089997 - DNA, 19 bp, Homo sapiens
ccgagtccgcccatccctg

SEQ ID NO: 6089998 - DNA, 18 bp, Homo sapiens
ccgagtcctcaggtacag

SEQ ID NO: 6089999 - DNA, 14 bp, Homo sapiens
ccgagtctccggga

SEQ ID NO: 6090000 - DNA, 20 bp, Homo sapiens
ccgagtctcttctccactgg

SEQ ID NO: 6090001 - DNA, 21 bp, Homo sapiens
ccgagtctcttctccactgga

SEQ ID NO: 6090002 - DNA, 22 bp, Homo sapiens
ccgagtctgggacacaaaactc

SEQ ID NO: 6090003 - DNA, 11 bp, Homo sapiens
ccgagtcttgc

SEQ ID NO: 6090004 - DNA, 21 bp, Homo sapiens
ccgagtctttctcactgcctt

SEQ ID NO: 6090005 - DNA, 19 bp, Homo sapiens
ccgagtgatttccatctct

SEQ ID NO: 6090006 - DNA, 23 bp, Homo sapiens
ccgagtggaccacgacctcgtcc

SEQ ID NO: 6090007 - DNA, 12 bp, Homo sapiens
ccgagtggctgc

SEQ ID NO: 6090008 - DNA, 16 bp, Homo sapiens
ccgagtggctgccgga

SEQ ID NO: 6090009 - DNA, 20 bp, Homo sapiens
cctggctaggactgtggagg

SEQ ID NO: 6090010 - DNA, 22 bp, Homo sapiens
cctggctaggactgtggagggg

SEQ ID NO: 6090011 - DNA, 23 bp, Homo sapiens
cctggctaggactgtggagggga

SEQ ID NO: 6090012 - DNA, 16 bp, Homo sapiens
cctggctatgtcctaa

SEQ ID NO: 6090013 - DNA, 12 bp, Homo sapiens
cctggctcacag

SEQ ID NO: 6090014 - DNA, 13 bp, Homo sapiens
cctggctcacagc

SEQ ID NO: 6090015 - DNA, 14 bp, Homo sapiens
cctggctcacagcc

SEQ ID NO: 6090016 - DNA, 17 bp, Homo sapiens
cctggctcacagccacc

SEQ ID NO: 6090017 - DNA, 17 bp, Homo sapiens
cctggctcactggcagg

SEQ ID NO: 6090018 - DNA, 13 bp, Homo sapiens
cctggctcaggcc

SEQ ID NO: 6090019 - DNA, 12 bp, Homo sapiens
cctggctcaggg

SEQ ID NO: 6090020 - DNA, 22 bp, Homo sapiens
cctggctcagggatcttctccc

SEQ ID NO: 6090021 - DNA, 14 bp, Homo sapiens
cctggctccactct

SEQ ID NO: 6090022 - DNA, 17 bp, Homo sapiens
cctggctccaggctcca

SEQ ID NO: 6090023 - DNA, 12 bp, Homo sapiens
cctggctccagt

SEQ ID NO: 6090024 - DNA, 18 bp, Homo sapiens
cctggctcccaagggagg

SEQ ID NO: 6090025 - DNA, 16 bp, Homo sapiens
cctggctcccagggtc

SEQ ID NO: 6090026 - DNA, 21 bp, Homo sapiens
cctggctcccatgaccatact

SEQ ID NO: 6090027 - DNA, 11 bp, Homo sapiens
cctggctcccc

SEQ ID NO: 6090028 - DNA, 23 bp, Homo sapiens
cctggctccccacgagtcacctg

SEQ ID NO: 6090029 - DNA, 21 bp, Homo sapiens
cctggctccccgagggctcag

SEQ ID NO: 6090030 - DNA, 22 bp, Homo sapiens
cctggctccccgagggctcaga

SEQ ID NO: 6090031 - DNA, 13 bp, Homo sapiens
cctggctcccctg

SEQ ID NO: 6090032 - DNA, 14 bp, Homo sapiens
cctggctcccctgg

SEQ ID NO: 6090033 - DNA, 15 bp, Homo sapiens
cctggctcccctggg

SEQ ID NO: 6090034 - DNA, 14 bp, Homo sapiens
cctggctccctcac

SEQ ID NO: 6090035 - DNA, 22 bp, Homo sapiens
cctggctccctcccacccaacc

SEQ ID NO: 6090036 - DNA, 18 bp, Homo sapiens
cctggctccctcccgtag

SEQ ID NO: 6090037 - DNA, 13 bp, Homo sapiens
cctggctccctga

SEQ ID NO: 6090038 - DNA, 17 bp, Homo sapiens
cctggctccctgatggg

SEQ ID NO: 6090039 - DNA, 18 bp, Homo sapiens
cctggctcctacccaccg

SEQ ID NO: 6090040 - DNA, 16 bp, Homo sapiens
cctggctcctccgtct

SEQ ID NO: 6090041 - DNA, 17 bp, Homo sapiens
cctggctcctccgtctg

SEQ ID NO: 6090042 - DNA, 15 bp, Homo sapiens
cctggctcctgaggg

SEQ ID NO: 6090043 - DNA, 23 bp, Homo sapiens
cctggctcctgaggggcatctgc

SEQ ID NO: 6090044 - DNA, 15 bp, Homo sapiens
cctggctccttcacc

SEQ ID NO: 6090045 - DNA, 14 bp, Homo sapiens
cctggctccttgca

SEQ ID NO: 6090046 - DNA, 16 bp, Homo sapiens
cctggctccttgcagc

SEQ ID NO: 6090047 - DNA, 22 bp, Homo sapiens
cctggctccttgtgccagagaa

SEQ ID NO: 6090048 - DNA, 13 bp, Homo sapiens
cctggctctcacc

SEQ ID NO: 6090049 - DNA, 17 bp, Homo sapiens
cctggctctcacctcta

SEQ ID NO: 6090050 - DNA, 14 bp, Homo sapiens
cctggctctcagag

SEQ ID NO: 6090051 - DNA, 16 bp, Homo sapiens
cctggctctcagagga

SEQ ID NO: 6090052 - DNA, 17 bp, Homo sapiens
cctggctctcagaggaa

SEQ ID NO: 6090053 - DNA, 14 bp, Homo sapiens
cctggctctgattc

SEQ ID NO: 6090054 - DNA, 14 bp, Homo sapiens
cctggctctgccag

SEQ ID NO: 6090055 - DNA, 13 bp, Homo sapiens
cctggctctgccc

SEQ ID NO: 6090056 - DNA, 15 bp, Homo sapiens
cctggctctgccccc

SEQ ID NO: 6090057 - DNA, 19 bp, Homo sapiens
cctggctctgccccctccc

SEQ ID NO: 6090058 - DNA, 15 bp, Homo sapiens
cctggctctgctgtc

SEQ ID NO: 6090059 - DNA, 14 bp, Homo sapiens
cctggctctggagc

SEQ ID NO: 6090060 - DNA, 14 bp, Homo sapiens
cctggctctggccc

SEQ ID NO: 6090061 - DNA, 23 bp, Homo sapiens
cctggctctgggccgggcctggg

SEQ ID NO: 6090062 - DNA, 11 bp, Homo sapiens
cctggctctgt

SEQ ID NO: 6090063 - DNA, 12 bp, Homo sapiens
cctggctctgtg

SEQ ID NO: 6090064 - DNA, 12 bp, Homo sapiens
cctggctcttct

SEQ ID NO: 6090065 - DNA, 13 bp, Homo sapiens
cctggctgaagga

SEQ ID NO: 6090066 - DNA, 19 bp, Homo sapiens
cctggctgaaggactgtga

SEQ ID NO: 6090067 - DNA, 13 bp, Homo sapiens
cctggctgacccc

SEQ ID NO: 6090068 - DNA, 18 bp, Homo sapiens
cctggctgacccctggcc

SEQ ID NO: 6090069 - DNA, 20 bp, Homo sapiens
cctggctgactggccagttg

SEQ ID NO: 6090070 - DNA, 20 bp, Homo sapiens
cctggctgaggttcctctgc

SEQ ID NO: 6090071 - DNA, 22 bp, Homo sapiens
cctggctgaggttcctctgcct

SEQ ID NO: 6090072 - DNA, 23 bp, Homo sapiens
cctggctgagtgcgaccaccact

SEQ ID NO: 6090073 - DNA, 19 bp, Homo sapiens
cctggctgatgatccagaa

SEQ ID NO: 6090074 - DNA, 19 bp, Homo sapiens
cctggctgattcagcattt

SEQ ID NO: 6090075 - DNA, 13 bp, Homo sapiens
cctggctgcactc

SEQ ID NO: 6090076 - DNA, 15 bp, Homo sapiens
cctggctgcagcctc

SEQ ID NO: 6090077 - DNA, 12 bp, Homo sapiens
cctggctgccag

SEQ ID NO: 6090078 - DNA, 14 bp, Homo sapiens
cctggctgccaggc

SEQ ID NO: 6090079 - DNA, 12 bp, Homo sapiens
cctggctgcccc

SEQ ID NO: 6090080 - DNA, 17 bp, Homo sapiens
cctggctgcccctcacc

SEQ ID NO: 6090081 - DNA, 19 bp, Homo sapiens
cctggctgcccctcacctt

SEQ ID NO: 6090082 - DNA, 17 bp, Homo sapiens
cctggctgccctggccc

SEQ ID NO: 6090083 - DNA, 20 bp, Homo sapiens
cctggctgccctggccctga

SEQ ID NO: 6090084 - DNA, 13 bp, Homo sapiens
cctggctgccggc

SEQ ID NO: 6090085 - DNA, 15 bp, Homo sapiens
cctggctgccggcac

SEQ ID NO: 6090086 - DNA, 19 bp, Homo sapiens
cctggctgcgaactgtgca

SEQ ID NO: 6090087 - DNA, 14 bp, Homo sapiens
cctggctgctaggc

SEQ ID NO: 6090088 - DNA, 23 bp, Homo sapiens
cctggctgctgatcgccttcccc

SEQ ID NO: 6090089 - DNA, 18 bp, Homo sapiens
cctggctggagagctgct

SEQ ID NO: 6090090 - DNA, 13 bp, Homo sapiens
cctggctggagga

SEQ ID NO: 6090091 - DNA, 21 bp, Homo sapiens
cctggctggaggagcagcagc

SEQ ID NO: 6090092 - DNA, 17 bp, Homo sapiens
cctggctggccaggaca

SEQ ID NO: 6090093 - DNA, 15 bp, Homo sapiens
cctggctggctccta

SEQ ID NO: 6090094 - DNA, 13 bp, Homo sapiens
cctggctggctga

SEQ ID NO: 6090095 - DNA, 17 bp, Homo sapiens
cctggctggctgagggc

SEQ ID NO: 6090096 - DNA, 18 bp, Homo sapiens
cctggctggctgagggca

SEQ ID NO: 6090097 - DNA, 23 bp, Homo sapiens
cctggctggctgggatgctggtg

SEQ ID NO: 6090098 - DNA, 13 bp, Homo sapiens
cctggctggctgt

SEQ ID NO: 6090099 - DNA, 20 bp, Homo sapiens
cctggctgggacgtggctca

SEQ ID NO: 6090100 - DNA, 22 bp, Homo sapiens
cctggctgggacgtggctcagc

SEQ ID NO: 6090101 - DNA, 12 bp, Homo sapiens
cctggctgggct

SEQ ID NO: 6090102 - DNA, 19 bp, Homo sapiens
cctggctgggttcaggtcc

SEQ ID NO: 6090103 - DNA, 14 bp, Homo sapiens
cctggctggtcctc

SEQ ID NO: 6090104 - DNA, 18 bp, Homo sapiens
cctggctggtcctcccat

SEQ ID NO: 6090105 - DNA, 19 bp, Homo sapiens
cctggctggtgggaaggcc

SEQ ID NO: 6090106 - DNA, 12 bp, Homo sapiens
cctggctgtaaa

SEQ ID NO: 6090107 - DNA, 13 bp, Homo sapiens
cctggctgtccaa

SEQ ID NO: 6090108 - DNA, 14 bp, Homo sapiens
cctggctgtgagca

SEQ ID NO: 6090109 - DNA, 16 bp, Homo sapiens
cctggctgtgagcagc

SEQ ID NO: 6090110 - DNA, 20 bp, Homo sapiens
cctggctgtgagcagcctcc

SEQ ID NO: 6090111 - DNA, 21 bp, Homo sapiens
cctggctgtgagcagcctcca

SEQ ID NO: 6090112 - DNA, 21 bp, Homo sapiens
cctggctgtgatgagtgtcct

SEQ ID NO: 6090113 - DNA, 12 bp, Homo sapiens
cctggctgtgca

SEQ ID NO: 6090114 - DNA, 19 bp, Homo sapiens
cctggctgtgcccagcagg

SEQ ID NO: 6090115 - DNA, 21 bp, Homo sapiens
cctggctgtgcccagcaggcc

SEQ ID NO: 6090116 - DNA, 22 bp, Homo sapiens
cctggctgtgcccagcaggccc

SEQ ID NO: 6090117 - DNA, 24 bp, Homo sapiens
cctggctgtgcccagcaggcccag

SEQ ID NO: 6090118 - DNA, 12 bp, Homo sapiens
cctggctgtgga

SEQ ID NO: 6090119 - DNA, 13 bp, Homo sapiens
cctggctgtggag

SEQ ID NO: 6090120 - DNA, 22 bp, Homo sapiens
cctggctgtggaggcctgatgc

SEQ ID NO: 6090121 - DNA, 14 bp, Homo sapiens
cctggcttcaccgc

SEQ ID NO: 6090122 - DNA, 23 bp, Homo sapiens
cctggcttcactctccctgacgg

SEQ ID NO: 6090123 - DNA, 12 bp, Homo sapiens
cctggcttccaa

SEQ ID NO: 6090124 - DNA, 15 bp, Homo sapiens
cctggcttccaaggc

SEQ ID NO: 6090125 - DNA, 14 bp, Homo sapiens
cctggcttcccagg

SEQ ID NO: 6090126 - DNA, 18 bp, Homo sapiens
cctggcttcccaggaccc

SEQ ID NO: 6090127 - DNA, 22 bp, Homo sapiens
cctggcttcccaggaccctggg

SEQ ID NO: 6090128 - DNA, 19 bp, Homo sapiens
cctggcttcccatccccag

SEQ ID NO: 6090129 - DNA, 15 bp, Homo sapiens
cctggcttccttact

SEQ ID NO: 6090130 - DNA, 13 bp, Homo sapiens
cctggcttctaga

SEQ ID NO: 6090131 - DNA, 15 bp, Homo sapiens
cctggcttctggagc

SEQ ID NO: 6090132 - DNA, 21 bp, Homo sapiens
cctggcttctggagcccttgg

SEQ ID NO: 6090133 - DNA, 22 bp, Homo sapiens
cctggcttctggagcccttggg

SEQ ID NO: 6090134 - DNA, 16 bp, Homo sapiens
cctggcttctgggaca

SEQ ID NO: 6090135 - DNA, 18 bp, Homo sapiens
cctggcttctgggacagg

SEQ ID NO: 6090136 - DNA, 22 bp, Homo sapiens
cctggcttctgggacaggcacc

SEQ ID NO: 6090137 - DNA, 14 bp, Homo sapiens
cctggcttctgtgg

SEQ ID NO: 6090138 - DNA, 13 bp, Homo sapiens
cctggcttgagtg

SEQ ID NO: 6090139 - DNA, 19 bp, Homo sapiens
cctggcttgagtgatcctc

SEQ ID NO: 6090140 - DNA, 20 bp, Homo sapiens
cctggcttgccttctacctt

SEQ ID NO: 6090141 - DNA, 17 bp, Homo sapiens
cctggcttgctccaggg

SEQ ID NO: 6090142 - DNA, 20 bp, Homo sapiens
cctggcttgctccagggtct

SEQ ID NO: 6090143 - DNA, 17 bp, Homo sapiens
cctggcttgctgtggct

SEQ ID NO: 6090144 - DNA, 20 bp, Homo sapiens
cctggcttgctgtggctatg

SEQ ID NO: 6090145 - DNA, 16 bp, Homo sapiens
cctggcttgcttgccg

SEQ ID NO: 6090146 - DNA, 21 bp, Homo sapiens
cctggcttgcttgccgagcct

SEQ ID NO: 6090147 - DNA, 15 bp, Homo sapiens
cctggcttggaggct

SEQ ID NO: 6090148 - DNA, 20 bp, Homo sapiens
cctggcttgtaactccacca

SEQ ID NO: 6090149 - DNA, 19 bp, Homo sapiens
cctggcttgtcggagcaag

SEQ ID NO: 6090150 - DNA, 21 bp, Homo sapiens
cctggctttcattttctctca

SEQ ID NO: 6090151 - DNA, 20 bp, Homo sapiens
cctggctttcccttccagtt

SEQ ID NO: 6090152 - DNA, 15 bp, Homo sapiens
cctggctttgcctct

SEQ ID NO: 6090153 - DNA, 16 bp, Homo sapiens
cctggctttggcgccc

SEQ ID NO: 6090154 - DNA, 16 bp, Homo sapiens
cctggcttttcactgc

SEQ ID NO: 6090155 - DNA, 17 bp, Homo sapiens
cctggcttttcactgct

SEQ ID NO: 6090156 - DNA, 21 bp, Homo sapiens
cctggcttttcactgctggct

SEQ ID NO: 6090157 - DNA, 22 bp, Homo sapiens
cctggcttttcactgctggctg

SEQ ID NO: 6090158 - DNA, 23 bp, Homo sapiens
cctggcttttcactgctggctgc

SEQ ID NO: 6090159 - DNA, 24 bp, Homo sapiens
cctggcttttcactgctggctgcc

SEQ ID NO: 6090160 - DNA, 14 bp, Homo sapiens
cctggcttttctgg

SEQ ID NO: 6090161 - DNA, 16 bp, Homo sapiens
cctggctttttaaaat

SEQ ID NO: 6090162 - DNA, 17 bp, Homo sapiens
cctgggaaaacagagga

SEQ ID NO: 6090163 - DNA, 19 bp, Homo sapiens
cctgggaaaagggcaggag

SEQ ID NO: 6090164 - DNA, 19 bp, Homo sapiens
cctgggaaagagatttaaa

SEQ ID NO: 6090165 - DNA, 22 bp, Homo sapiens
cctgggaaaggaaaaccaggga

SEQ ID NO: 6090166 - DNA, 18 bp, Homo sapiens
cctgggaaaggacccacc

SEQ ID NO: 6090167 - DNA, 21 bp, Homo sapiens
cctgggaaaggacccacccat

SEQ ID NO: 6090168 - DNA, 18 bp, Homo sapiens
cctgggaacacagtgccc

SEQ ID NO: 6090169 - DNA, 17 bp, Homo sapiens
cctgggaacacatctgg

SEQ ID NO: 6090170 - DNA, 19 bp, Homo sapiens
cctgggaacacatctggct

SEQ ID NO: 6090171 - DNA, 14 bp, Homo sapiens
cctgggaacaggcc

SEQ ID NO: 6090172 - DNA, 18 bp, Homo sapiens
cctgggaaccgccctcct

SEQ ID NO: 6090173 - DNA, 21 bp, Homo sapiens
cctgggaacggggtggacgag

SEQ ID NO: 6090174 - DNA, 15 bp, Homo sapiens
cctgggaaggaagct

SEQ ID NO: 6090175 - DNA, 21 bp, Homo sapiens
cctgggaaggagggagctgct

SEQ ID NO: 6090176 - DNA, 22 bp, Homo sapiens
cctgggaaggagggagctgctc

SEQ ID NO: 6090177 - DNA, 17 bp, Homo sapiens
cctgggaatcctgctgc

SEQ ID NO: 6090178 - DNA, 21 bp, Homo sapiens
cctgggaatcctgctgccaga

SEQ ID NO: 6090179 - DNA, 15 bp, Homo sapiens
cctgggaatctaagt

SEQ ID NO: 6090180 - DNA, 22 bp, Homo sapiens
cctgggacaagcaggccgccct

SEQ ID NO: 6090181 - DNA, 23 bp, Homo sapiens
cctgggacaagcaggccgccctc

SEQ ID NO: 6090182 - DNA, 15 bp, Homo sapiens
cctgggacacagacc

SEQ ID NO: 6090183 - DNA, 19 bp, Homo sapiens
cctgggacacagacccagg

SEQ ID NO: 6090184 - DNA, 18 bp, Homo sapiens
cctgggacagccactgga

SEQ ID NO: 6090185 - DNA, 18 bp, Homo sapiens
cctgggaccaacctgacc

SEQ ID NO: 6090186 - DNA, 16 bp, Homo sapiens
cctgggaccagggcat

SEQ ID NO: 6090187 - DNA, 15 bp, Homo sapiens
cctgggacccagcta

SEQ ID NO: 6090188 - DNA, 11 bp, Homo sapiens
cctgggacccc

SEQ ID NO: 6090189 - DNA, 18 bp, Homo sapiens
cctgggaccccctcgcca

SEQ ID NO: 6090190 - DNA, 21 bp, Homo sapiens
cctgggaccccctcgccagct

SEQ ID NO: 6090191 - DNA, 22 bp, Homo sapiens
cctgggaccccctcgccagctt

SEQ ID NO: 6090192 - DNA, 23 bp, Homo sapiens
cctgggacctccccagcccagga

SEQ ID NO: 6090193 - DNA, 17 bp, Homo sapiens
cctgggacctcccctga

SEQ ID NO: 6090194 - DNA, 21 bp, Homo sapiens
cctgggacctgtggtcatgtg

SEQ ID NO: 6090195 - DNA, 20 bp, Homo sapiens
cctgggactaaagccaggaa

SEQ ID NO: 6090196 - DNA, 21 bp, Homo sapiens
cctgggactaaagccaggaac

SEQ ID NO: 6090197 - DNA, 14 bp, Homo sapiens
cctgggacttccat

SEQ ID NO: 6090198 - DNA, 20 bp, Homo sapiens
cctgggacttccatgcctta

SEQ ID NO: 6090199 - DNA, 22 bp, Homo sapiens
cctgggagaaatctggcttctg

SEQ ID NO: 6090200 - DNA, 21 bp, Homo sapiens
cctgggagaaggtctccaagg

SEQ ID NO: 6090201 - DNA, 22 bp, Homo sapiens
cctgggagaaggtctccaaggg

SEQ ID NO: 6090202 - DNA, 15 bp, Homo sapiens
cctgggagacagacc

SEQ ID NO: 6090203 - DNA, 12 bp, Homo sapiens
cctgggagagaa

SEQ ID NO: 6090204 - DNA, 18 bp, Homo sapiens
cctgggagagtggacctg

SEQ ID NO: 6090205 - DNA, 23 bp, Homo sapiens
cctgggagatgctgggaccctcg

SEQ ID NO: 6090206 - DNA, 13 bp, Homo sapiens
cctgggagcaagt

SEQ ID NO: 6090207 - DNA, 17 bp, Homo sapiens
cctgggagcaagttgca

SEQ ID NO: 6090208 - DNA, 14 bp, Homo sapiens
cctgggagcccaga

SEQ ID NO: 6090209 - DNA, 17 bp, Homo sapiens
cctgggaggacaggcag

SEQ ID NO: 6090210 - DNA, 15 bp, Homo sapiens
cctgggaggagtggc

SEQ ID NO: 6090211 - DNA, 20 bp, Homo sapiens
cctgggaggatcctgagctg

SEQ ID NO: 6090212 - DNA, 13 bp, Homo sapiens
cctgggaggcaca

SEQ ID NO: 6090213 - DNA, 16 bp, Homo sapiens
cctgggaggcacagca

SEQ ID NO: 6090214 - DNA, 20 bp, Homo sapiens
cctgggaggcagaggttgca

SEQ ID NO: 6090215 - DNA, 12 bp, Homo sapiens
cctgggaggccc

SEQ ID NO: 6090216 - DNA, 20 bp, Homo sapiens
cctgggaggccctggcagaa

SEQ ID NO: 6090217 - DNA, 16 bp, Homo sapiens
cctgggaggcggagag

SEQ ID NO: 6090218 - DNA, 23 bp, Homo sapiens
cctgggaggcggagagtacagtg

SEQ ID NO: 6090219 - DNA, 13 bp, Homo sapiens
cctgggaggctct

SEQ ID NO: 6090220 - DNA, 21 bp, Homo sapiens
cctgggaggctctggagccca

SEQ ID NO: 6090221 - DNA, 15 bp, Homo sapiens
cctgggaggctgcag

SEQ ID NO: 6090222 - DNA, 21 bp, Homo sapiens
cctgggaggctgcagccaggc

SEQ ID NO: 6090223 - DNA, 22 bp, Homo sapiens
cctgggaggctgcagccaggcc

SEQ ID NO: 6090224 - DNA, 23 bp, Homo sapiens
cctgggaggctgcagccaggcct

SEQ ID NO: 6090225 - DNA, 13 bp, Homo sapiens
cctgggaggcttt

SEQ ID NO: 6090226 - DNA, 14 bp, Homo sapiens
cctgggagggaggt

SEQ ID NO: 6090227 - DNA, 20 bp, Homo sapiens
cctgggagggaggtggtcct

SEQ ID NO: 6090228 - DNA, 22 bp, Homo sapiens
cctgggagggaggtggtcctcc

SEQ ID NO: 6090229 - DNA, 20 bp, Homo sapiens
cctgggagggcaagggtcct

SEQ ID NO: 6090230 - DNA, 13 bp, Homo sapiens
cctgggagggttc

SEQ ID NO: 6090231 - DNA, 20 bp, Homo sapiens
cctgggagggttcccctggc

SEQ ID NO: 6090232 - DNA, 20 bp, Homo sapiens
cctgggagtgagggtgggtg

SEQ ID NO: 6090233 - DNA, 18 bp, Homo sapiens
cctgggagtgggtggagg

SEQ ID NO: 6090234 - DNA, 23 bp, Homo sapiens
cctgggagttttgtattcatctt

SEQ ID NO: 6090235 - DNA, 23 bp, Homo sapiens
cctgggataggggcagaggaggc

SEQ ID NO: 6090236 - DNA, 16 bp, Homo sapiens
cctgggatccctcatc

SEQ ID NO: 6090237 - DNA, 24 bp, Homo sapiens
cctgggatccgagggcccctctcc

SEQ ID NO: 6090238 - DNA, 20 bp, Homo sapiens
cctgggatctggtggtcagc

SEQ ID NO: 6090239 - DNA, 22 bp, Homo sapiens
cctgggatgaggggtgctgggt

SEQ ID NO: 6090240 - DNA, 18 bp, Homo sapiens
cctgggatgcccttcccc

SEQ ID NO: 6090241 - DNA, 20 bp, Homo sapiens
cctgggatgcccttccccct

SEQ ID NO: 6090242 - DNA, 16 bp, Homo sapiens
cctgggatgcctcacc

SEQ ID NO: 6090243 - DNA, 14 bp, Homo sapiens
cctgggatgctagc

SEQ ID NO: 6090244 - DNA, 17 bp, Homo sapiens
cctgggatgctagcccc

SEQ ID NO: 6090245 - DNA, 22 bp, Homo sapiens
cctgggatgctagccccagaga

SEQ ID NO: 6090246 - DNA, 16 bp, Homo sapiens
cctgggatgctgaccc

SEQ ID NO: 6090247 - DNA, 20 bp, Homo sapiens
cctgggatgctgacccagga

SEQ ID NO: 6090248 - DNA, 21 bp, Homo sapiens
cctgggatgctgacccaggaa

SEQ ID NO: 6090249 - DNA, 22 bp, Homo sapiens
cctgggatgtccacagatgcct

SEQ ID NO: 6090250 - DNA, 21 bp, Homo sapiens
cctgggcaaacagagctactg

SEQ ID NO: 6090251 - DNA, 19 bp, Homo sapiens
cctgggcaacatggtgaaa

SEQ ID NO: 6090252 - DNA, 15 bp, Homo sapiens
cctgggcaagagatg

SEQ ID NO: 6090253 - DNA, 21 bp, Homo sapiens
cctgggcaaggaagctttgga

SEQ ID NO: 6090254 - DNA, 21 bp, Homo sapiens
cctgggcaagtgaggcaagag

SEQ ID NO: 6090255 - DNA, 23 bp, Homo sapiens
cctgggcaagtggatggcccagc

SEQ ID NO: 6090256 - DNA, 18 bp, Homo sapiens
cctgggcaatgcagtgca

SEQ ID NO: 6090257 - DNA, 17 bp, Homo sapiens
cctgggcacacgctgct

SEQ ID NO: 6090258 - DNA, 23 bp, Homo sapiens
cctgggcacacgctgctctgccc

SEQ ID NO: 6090259 - DNA, 23 bp, Homo sapiens
cctgggcacatagcataggctgg

SEQ ID NO: 6090260 - DNA, 19 bp, Homo sapiens
cctgggcacccacctccac

SEQ ID NO: 6090261 - DNA, 20 bp, Homo sapiens
cctgggcacccacctccacc

SEQ ID NO: 6090262 - DNA, 14 bp, Homo sapiens
cctgggcaccccag

SEQ ID NO: 6090263 - DNA, 22 bp, Homo sapiens
cctgggcaccccaggcagctcc

SEQ ID NO: 6090264 - DNA, 23 bp, Homo sapiens
cctgggcaccccaggcagctcct

SEQ ID NO: 6090265 - DNA, 17 bp, Homo sapiens
cctgggcaccctgcagg

SEQ ID NO: 6090266 - DNA, 19 bp, Homo sapiens
cctgggcaccctgcaggca

SEQ ID NO: 6090267 - DNA, 22 bp, Homo sapiens
cctgggcaccctgcaggcaggc

SEQ ID NO: 6090268 - DNA, 17 bp, Homo sapiens
cctgggcaccgggaccc

SEQ ID NO: 6090269 - DNA, 17 bp, Homo sapiens
cctgggcacctggggag

SEQ ID NO: 6090270 - DNA, 17 bp, Homo sapiens
cctgggcagccaggctg

SEQ ID NO: 6090271 - DNA, 23 bp, Homo sapiens
cctgggcagccaggctgccaagg

SEQ ID NO: 6090272 - DNA, 15 bp, Homo sapiens
cctgggcagcccaga

SEQ ID NO: 6090273 - DNA, 14 bp, Homo sapiens
cctgggcagcccca

SEQ ID NO: 6090274 - DNA, 15 bp, Homo sapiens
cctgggcagccccac

SEQ ID NO: 6090275 - DNA, 21 bp, Homo sapiens
cctgggcagccgttttcctca

SEQ ID NO: 6090276 - DNA, 15 bp, Homo sapiens
cctgggcagctcctc

SEQ ID NO: 6090277 - DNA, 17 bp, Homo sapiens
cctgggcagctgcctcc

SEQ ID NO: 6090278 - DNA, 20 bp, Homo sapiens
cctgggcagctgcctcccct

SEQ ID NO: 6090279 - DNA, 22 bp, Homo sapiens
cctgggcagctgcctcccctcc

SEQ ID NO: 6090280 - DNA, 20 bp, Homo sapiens
cctgggcagcttctgttggc

SEQ ID NO: 6090281 - DNA, 21 bp, Homo sapiens
cctgggcagcttctgttggca

SEQ ID NO: 6090282 - DNA, 14 bp, Homo sapiens
cctgggcaggaccc

SEQ ID NO: 6090283 - DNA, 17 bp, Homo sapiens
cctgggcaggtgggagc

SEQ ID NO: 6090284 - DNA, 17 bp, Homo sapiens
cctgggcagtgagtgcc

SEQ ID NO: 6090285 - DNA, 12 bp, Homo sapiens
cctgggcagtgc

SEQ ID NO: 6090286 - DNA, 14 bp, Homo sapiens
cctgggcagtgccc

SEQ ID NO: 6090287 - DNA, 19 bp, Homo sapiens
cctgggcagtgcccaccat

SEQ ID NO: 6090288 - DNA, 14 bp, Homo sapiens
cctgggcagtgctc

SEQ ID NO: 6090289 - DNA, 17 bp, Homo sapiens
cctgggcatactaataa

SEQ ID NO: 6090290 - DNA, 23 bp, Homo sapiens
cctgggcatatccaccacctccc

SEQ ID NO: 6090291 - DNA, 19 bp, Homo sapiens
cctgggcatccccagcccc

SEQ ID NO: 6090292 - DNA, 20 bp, Homo sapiens
cctgggcatccccagccccc

SEQ ID NO: 6090293 - DNA, 21 bp, Homo sapiens
cctgggcatccccagccccct

SEQ ID NO: 6090294 - DNA, 13 bp, Homo sapiens
cctgggcatctgg

SEQ ID NO: 6090295 - DNA, 20 bp, Homo sapiens
cctgggcatctggccctgct

SEQ ID NO: 6090296 - DNA, 21 bp, Homo sapiens
cctgggcatctggccctgctg

SEQ ID NO: 6090297 - DNA, 17 bp, Homo sapiens
cctgggcatgggtccag

SEQ ID NO: 6090298 - DNA, 21 bp, Homo sapiens
cctgggcatgggtccagggcc

SEQ ID NO: 6090299 - DNA, 17 bp, Homo sapiens
cctgggcatgtccccag

SEQ ID NO: 6090300 - DNA, 22 bp, Homo sapiens
cctgggcatgtttgtctgtgtg

SEQ ID NO: 6090301 - DNA, 18 bp, Homo sapiens
cctgggcattagcaaggc

SEQ ID NO: 6090302 - DNA, 20 bp, Homo sapiens
cctgggcattagcaaggcag

SEQ ID NO: 6090303 - DNA, 21 bp, Homo sapiens
cctgggcattagcaaggcaga

SEQ ID NO: 6090304 - DNA, 22 bp, Homo sapiens
cctgggcattagcaaggcagag

SEQ ID NO: 6090305 - DNA, 13 bp, Homo sapiens
cctgggccaaaag

SEQ ID NO: 6090306 - DNA, 23 bp, Homo sapiens
cctgggccaaaagggcagccagg

SEQ ID NO: 6090307 - DNA, 14 bp, Homo sapiens
cctgggccaaggac

SEQ ID NO: 6090308 - DNA, 23 bp, Homo sapiens
cctgggccacagggcgagactcc

SEQ ID NO: 6090309 - DNA, 15 bp, Homo sapiens
cctgggccacccttc

SEQ ID NO: 6090310 - DNA, 15 bp, Homo sapiens
cctgggccacctcct

SEQ ID NO: 6090311 - DNA, 16 bp, Homo sapiens
cctgggccacctccta

SEQ ID NO: 6090312 - DNA, 16 bp, Homo sapiens
cctgggccactggcat

SEQ ID NO: 6090313 - DNA, 17 bp, Homo sapiens
cctgggccactggcatc

SEQ ID NO: 6090314 - DNA, 21 bp, Homo sapiens
cctgggccagcggggctgctc

SEQ ID NO: 6090315 - DNA, 22 bp, Homo sapiens
cctgggccagcggggctgctca

SEQ ID NO: 6090316 - DNA, 13 bp, Homo sapiens
cctgggccaggca

SEQ ID NO: 6090317 - DNA, 16 bp, Homo sapiens
cctgggccaggcaggc

SEQ ID NO: 6090318 - DNA, 17 bp, Homo sapiens
cctgggccaggcaggcg

SEQ ID NO: 6090319 - DNA, 13 bp, Homo sapiens
cctgggccagggc

SEQ ID NO: 6090320 - DNA, 19 bp, Homo sapiens
cctgggccagggcgtggag

SEQ ID NO: 6090321 - DNA, 15 bp, Homo sapiens
cctgggcccacagag

SEQ ID NO: 6090322 - DNA, 14 bp, Homo sapiens
cctgggcccaggca

SEQ ID NO: 6090323 - DNA, 23 bp, Homo sapiens
cctgggcccaggcagcacctgga

SEQ ID NO: 6090324 - DNA, 18 bp, Homo sapiens
cctgggcccaggcccagc

SEQ ID NO: 6090325 - DNA, 19 bp, Homo sapiens
cctgggcccaggcccagcc

SEQ ID NO: 6090326 - DNA, 22 bp, Homo sapiens
cctgggcccaggcccagcctct

SEQ ID NO: 6090327 - DNA, 23 bp, Homo sapiens
cctgggcccaggcccagcctctt

SEQ ID NO: 6090328 - DNA, 14 bp, Homo sapiens
cctgggcccaggct

SEQ ID NO: 6090329 - DNA, 15 bp, Homo sapiens
cctgggcccaggctc

SEQ ID NO: 6090330 - DNA, 16 bp, Homo sapiens
cctgggcccaggctct

SEQ ID NO: 6090331 - DNA, 18 bp, Homo sapiens
cctgggcccaggctctgg

SEQ ID NO: 6090332 - DNA, 19 bp, Homo sapiens
cctgggcccaggctctggg

SEQ ID NO: 6090333 - DNA, 20 bp, Homo sapiens
cctgggcccaggctctggga

SEQ ID NO: 6090334 - DNA, 17 bp, Homo sapiens
cctgggcccatctccct

SEQ ID NO: 6090335 - DNA, 19 bp, Homo sapiens
cctgggcccatctctccct

SEQ ID NO: 6090336 - DNA, 13 bp, Homo sapiens
cctgggccccacc

SEQ ID NO: 6090337 - DNA, 23 bp, Homo sapiens
cctgggccccagaaagcctcaga

SEQ ID NO: 6090338 - DNA, 12 bp, Homo sapiens
cctgggccccca

SEQ ID NO: 6090339 - DNA, 23 bp, Homo sapiens
cctgggcccccagagacctttgc

SEQ ID NO: 6090340 - DNA, 16 bp, Homo sapiens
cctgggccccgcctca

SEQ ID NO: 6090341 - DNA, 18 bp, Homo sapiens
cctgggcccctcagccac

SEQ ID NO: 6090342 - DNA, 13 bp, Homo sapiens
cctgggcccctcc

SEQ ID NO: 6090343 - DNA, 18 bp, Homo sapiens
cctgggccctctctgctc

SEQ ID NO: 6090344 - DNA, 13 bp, Homo sapiens
cctgggccctggg

SEQ ID NO: 6090345 - DNA, 14 bp, Homo sapiens
cctgggccctgggc

SEQ ID NO: 6090346 - DNA, 16 bp, Homo sapiens
cctgggccctgggctg

SEQ ID NO: 6090347 - DNA, 15 bp, Homo sapiens
cctgggccctggggc

SEQ ID NO: 6090348 - DNA, 18 bp, Homo sapiens
cctgggccctggggcctg

SEQ ID NO: 6090349 - DNA, 21 bp, Homo sapiens
cctgggccctggggcctgtac

SEQ ID NO: 6090350 - DNA, 14 bp, Homo sapiens
cctgggccctggtt

SEQ ID NO: 6090351 - DNA, 19 bp, Homo sapiens
cctgggcccttgtgctcct

SEQ ID NO: 6090352 - DNA, 17 bp, Homo sapiens
cctgggccgctgccacg

SEQ ID NO: 6090353 - DNA, 22 bp, Homo sapiens
cctgggccgtggcacagctggg

SEQ ID NO: 6090354 - DNA, 23 bp, Homo sapiens
cctgggccgttacatctgtgcag

SEQ ID NO: 6090355 - DNA, 17 bp, Homo sapiens
cctgggcctatggagag

SEQ ID NO: 6090356 - DNA, 20 bp, Homo sapiens
cctgggcctatggagagccc

SEQ ID NO: 6090357 - DNA, 21 bp, Homo sapiens
cctgggcctatggagagccct

SEQ ID NO: 6090358 - DNA, 22 bp, Homo sapiens
cctgggcctatggagagccctg

SEQ ID NO: 6090359 - DNA, 15 bp, Homo sapiens
cctgggcctcatggc

SEQ ID NO: 6090360 - DNA, 16 bp, Homo sapiens
cctgggcctcatggct

SEQ ID NO: 6090361 - DNA, 19 bp, Homo sapiens
cctgggcctccacctctgt

SEQ ID NO: 6090362 - DNA, 22 bp, Homo sapiens
cctgggcctccacctctgtgca

SEQ ID NO: 6090363 - DNA, 18 bp, Homo sapiens
ccgagtggggcctgcctg

SEQ ID NO: 6090364 - DNA, 22 bp, Homo sapiens
ccgagtgtgtttcatccttccc

SEQ ID NO: 6090365 - DNA, 23 bp, Homo sapiens
ccgagtgtgtttcatccttccca

SEQ ID NO: 6090366 - DNA, 22 bp, Homo sapiens
ccgagttaaggtgggcccggcc

SEQ ID NO: 6090367 - DNA, 15 bp, Homo sapiens
ccgagtttccccaga

SEQ ID NO: 6090368 - DNA, 17 bp, Homo sapiens
ccgagtttgggccactg

SEQ ID NO: 6090369 - DNA, 21 bp, Homo sapiens
ccgagtttgggccactgcact

SEQ ID NO: 6090370 - DNA, 23 bp, Homo sapiens
ccgataaagacggattctaagga

SEQ ID NO: 6090371 - DNA, 15 bp, Homo sapiens
ccgatacctcagccc

SEQ ID NO: 6090372 - DNA, 19 bp, Homo sapiens
ccgatataagccatagccc

SEQ ID NO: 6090373 - DNA, 13 bp, Homo sapiens
ccgatgagctggt

SEQ ID NO: 6090374 - DNA, 20 bp, Homo sapiens
ccgatgcaaacattggaaga

SEQ ID NO: 6090375 - DNA, 19 bp, Homo sapiens
ccgatgccaccggcctgtg

SEQ ID NO: 6090376 - DNA, 20 bp, Homo sapiens
ccgatgcccaatccaggccc

SEQ ID NO: 6090377 - DNA, 21 bp, Homo sapiens
ccgatgctgacctcacctggt

SEQ ID NO: 6090378 - DNA, 15 bp, Homo sapiens
ccgatgctgaggcca

SEQ ID NO: 6090379 - DNA, 17 bp, Homo sapiens
ccgatgctgctttcccc

SEQ ID NO: 6090380 - DNA, 20 bp, Homo sapiens
ccgatgctgctttcccctgt

SEQ ID NO: 6090381 - DNA, 14 bp, Homo sapiens
ccgatggactcctg

SEQ ID NO: 6090382 - DNA, 17 bp, Homo sapiens
ccgatggactcctgacc

SEQ ID NO: 6090383 - DNA, 20 bp, Homo sapiens
ccgatggggaaaaaaaaact

SEQ ID NO: 6090384 - DNA, 17 bp, Homo sapiens
ccgatggggcccacatt

SEQ ID NO: 6090385 - DNA, 22 bp, Homo sapiens
ccgatgtgagccgcctcggagt

SEQ ID NO: 6090386 - DNA, 21 bp, Homo sapiens
ccgatgtgggtccctctcttg

SEQ ID NO: 6090387 - DNA, 18 bp, Homo sapiens
ccgatgtgtctcccagaa

SEQ ID NO: 6090388 - DNA, 20 bp, Homo sapiens
ccgatgtgtctcccagaact

SEQ ID NO: 6090389 - DNA, 14 bp, Homo sapiens
ccgattaatttatg

SEQ ID NO: 6090390 - DNA, 16 bp, Homo sapiens
ccgattaatttatggt

SEQ ID NO: 6090391 - DNA, 21 bp, Homo sapiens
ccgattcatctctcagaaggg

SEQ ID NO: 6090392 - DNA, 13 bp, Homo sapiens
ccgattcttcctt

SEQ ID NO: 6090393 - DNA, 15 bp, Homo sapiens
ccgattcttccttgc

SEQ ID NO: 6090394 - DNA, 17 bp, Homo sapiens
ccgattcttccttgcca

SEQ ID NO: 6090395 - DNA, 15 bp, Homo sapiens
ccgattgggagaaag

SEQ ID NO: 6090396 - DNA, 16 bp, Homo sapiens
ccgattgtaactcaaa

SEQ ID NO: 6090397 - DNA, 14 bp, Homo sapiens
ccgatttcccaggc

SEQ ID NO: 6090398 - DNA, 12 bp, Homo sapiens
ccgatttctgct

SEQ ID NO: 6090399 - DNA, 13 bp, Homo sapiens
ccgatttctgcta

SEQ ID NO: 6090400 - DNA, 14 bp, Homo sapiens
ccgatttctgtaaa

SEQ ID NO: 6090401 - DNA, 12 bp, Homo sapiens
ccgatttttcca

SEQ ID NO: 6090402 - DNA, 15 bp, Homo sapiens
ccgcaaaccacactg

SEQ ID NO: 6090403 - DNA, 16 bp, Homo sapiens
ccgcaaaccacactgg

SEQ ID NO: 6090404 - DNA, 14 bp, Homo sapiens
ccgcaacccacagc

SEQ ID NO: 6090405 - DNA, 15 bp, Homo sapiens
ccgcaacccacagct

SEQ ID NO: 6090406 - DNA, 23 bp, Homo sapiens
ccgcaacccacagctcagctgcc

SEQ ID NO: 6090407 - DNA, 21 bp, Homo sapiens
ccgcaacccatgccctggacc

SEQ ID NO: 6090408 - DNA, 14 bp, Homo sapiens
ccgcaactcacaca

SEQ ID NO: 6090409 - DNA, 15 bp, Homo sapiens
ccgcaactctccagc

SEQ ID NO: 6090410 - DNA, 21 bp, Homo sapiens
ccgcaagagggacagagcccg

SEQ ID NO: 6090411 - DNA, 15 bp, Homo sapiens
ccgcaagcgcaggga

SEQ ID NO: 6090412 - DNA, 18 bp, Homo sapiens
ccgcaagcgcagggagga

SEQ ID NO: 6090413 - DNA, 13 bp, Homo sapiens
ccgcaagggcctg

SEQ ID NO: 6090414 - DNA, 15 bp, Homo sapiens
ccgcaatctggctcc

SEQ ID NO: 6090415 - DNA, 13 bp, Homo sapiens
ccgcacaccctca

SEQ ID NO: 6090416 - DNA, 23 bp, Homo sapiens
ccgcacaccctcactctgccagg

SEQ ID NO: 6090417 - DNA, 15 bp, Homo sapiens
ccgcacagcagcctg

SEQ ID NO: 6090418 - DNA, 22 bp, Homo sapiens
ccgcacagcagcctgcttccca

SEQ ID NO: 6090419 - DNA, 18 bp, Homo sapiens
ccgcacagctcaggaggc

SEQ ID NO: 6090420 - DNA, 22 bp, Homo sapiens
ccgcacatgtgccactgttcag

SEQ ID NO: 6090421 - DNA, 16 bp, Homo sapiens
ccgcaccagctgctct

SEQ ID NO: 6090422 - DNA, 14 bp, Homo sapiens
ccgcaccccatccc

SEQ ID NO: 6090423 - DNA, 15 bp, Homo sapiens
ccgcacccccaccct

SEQ ID NO: 6090424 - DNA, 11 bp, Homo sapiens
ccgcacccccg

SEQ ID NO: 6090425 - DNA, 17 bp, Homo sapiens
ccgcacccccgccaggc

SEQ ID NO: 6090426 - DNA, 19 bp, Homo sapiens
ccgcaccccggcctcaggg

SEQ ID NO: 6090427 - DNA, 20 bp, Homo sapiens
ccgcaccccggcctcagggc

SEQ ID NO: 6090428 - DNA, 11 bp, Homo sapiens
ccgcacccctc

SEQ ID NO: 6090429 - DNA, 16 bp, Homo sapiens
ccgcacccctccctgc

SEQ ID NO: 6090430 - DNA, 14 bp, Homo sapiens
ccgcacccctcctc

SEQ ID NO: 6090431 - DNA, 14 bp, Homo sapiens
ccgcaccctgcacc

SEQ ID NO: 6090432 - DNA, 21 bp, Homo sapiens
ccgcaccctgcacctgctgcg

SEQ ID NO: 6090433 - DNA, 14 bp, Homo sapiens
ccgcaccctggcct

SEQ ID NO: 6090434 - DNA, 18 bp, Homo sapiens
ccgcaccctggcctggtc

SEQ ID NO: 6090435 - DNA, 15 bp, Homo sapiens
ccgcaccctggctgg

SEQ ID NO: 6090436 - DNA, 17 bp, Homo sapiens
ccgcaccctgtcctgca

SEQ ID NO: 6090437 - DNA, 14 bp, Homo sapiens
ccgcacctgtacag

SEQ ID NO: 6090438 - DNA, 22 bp, Homo sapiens
ccgcacctgtacagtggaaccg

SEQ ID NO: 6090439 - DNA, 22 bp, Homo sapiens
ccgcacctgtcggtggctgcct

SEQ ID NO: 6090440 - DNA, 20 bp, Homo sapiens
ccgcaccttcctcctccccg

SEQ ID NO: 6090441 - DNA, 23 bp, Homo sapiens
ccgcaccttcctcctccccgctc

SEQ ID NO: 6090442 - DNA, 23 bp, Homo sapiens
ccgcacgactgcgggagccagac

SEQ ID NO: 6090443 - DNA, 22 bp, Homo sapiens
ccgcactcaggagcacagccat

SEQ ID NO: 6090444 - DNA, 15 bp, Homo sapiens
ccgcactctggcggt

SEQ ID NO: 6090445 - DNA, 14 bp, Homo sapiens
ccgcagaagcagac

SEQ ID NO: 6090446 - DNA, 18 bp, Homo sapiens
ccgcagaaggaaggcagg

SEQ ID NO: 6090447 - DNA, 15 bp, Homo sapiens
ccgcagacaccttgg

SEQ ID NO: 6090448 - DNA, 18 bp, Homo sapiens
ccgcagacctccccagcc

SEQ ID NO: 6090449 - DNA, 19 bp, Homo sapiens
ccgcagacctccccagccc

SEQ ID NO: 6090450 - DNA, 15 bp, Homo sapiens
ccgcagacctggagc

SEQ ID NO: 6090451 - DNA, 16 bp, Homo sapiens
ccgcagacgggcacag

SEQ ID NO: 6090452 - DNA, 17 bp, Homo sapiens
ccgcagacggtctgtgt

SEQ ID NO: 6090453 - DNA, 20 bp, Homo sapiens
ccgcagacggtctgtgtgct

SEQ ID NO: 6090454 - DNA, 12 bp, Homo sapiens
ccgcagactgct

SEQ ID NO: 6090455 - DNA, 21 bp, Homo sapiens
ccgcagactgcttggccagat

SEQ ID NO: 6090456 - DNA, 17 bp, Homo sapiens
ccgcagagaaatgcccc

SEQ ID NO: 6090457 - DNA, 19 bp, Homo sapiens
ccgcagagaaatgccccag

SEQ ID NO: 6090458 - DNA, 20 bp, Homo sapiens
ccgcagagaaatgccccagt

SEQ ID NO: 6090459 - DNA, 12 bp, Homo sapiens
ccgcagagactg

SEQ ID NO: 6090460 - DNA, 14 bp, Homo sapiens
ccgcagaggcagaa

SEQ ID NO: 6090461 - DNA, 13 bp, Homo sapiens
ccgcagaggtggg

SEQ ID NO: 6090462 - DNA, 21 bp, Homo sapiens
ccgcagaggtggggtgctggg

SEQ ID NO: 6090463 - DNA, 18 bp, Homo sapiens
ccgcagcaccagcctgag

SEQ ID NO: 6090464 - DNA, 21 bp, Homo sapiens
ccgcagcaccagcctgagcca

SEQ ID NO: 6090465 - DNA, 20 bp, Homo sapiens
ccgcagcacgcctctcccca

SEQ ID NO: 6090466 - DNA, 14 bp, Homo sapiens
ccgcagcagggaag

SEQ ID NO: 6090467 - DNA, 14 bp, Homo sapiens
ccgcagccacaccg

SEQ ID NO: 6090468 - DNA, 21 bp, Homo sapiens
ccgcagccacaccgctggctc

SEQ ID NO: 6090469 - DNA, 23 bp, Homo sapiens
ccgcagccacaccgctggctccg

SEQ ID NO: 6090470 - DNA, 12 bp, Homo sapiens
ccgcagccccca

SEQ ID NO: 6090471 - DNA, 16 bp, Homo sapiens
ccgcagcccccactga

SEQ ID NO: 6090472 - DNA, 19 bp, Homo sapiens
ccgcagcccccactgacct

SEQ ID NO: 6090473 - DNA, 16 bp, Homo sapiens
ccgcagcccgcctgcc

SEQ ID NO: 6090474 - DNA, 13 bp, Homo sapiens
ccgcagccctctc

SEQ ID NO: 6090475 - DNA, 16 bp, Homo sapiens
ccgcagccctctccac

SEQ ID NO: 6090476 - DNA, 17 bp, Homo sapiens
ccgcagccctctccacc

SEQ ID NO: 6090477 - DNA, 23 bp, Homo sapiens
ccgcagccctgcagagggcacag

SEQ ID NO: 6090478 - DNA, 11 bp, Homo sapiens
ccgcagcctct

SEQ ID NO: 6090479 - DNA, 17 bp, Homo sapiens
ccgcagcctctgcccca

SEQ ID NO: 6090480 - DNA, 20 bp, Homo sapiens
ccgcagcgcccccatctgtc

SEQ ID NO: 6090481 - DNA, 21 bp, Homo sapiens
ccgcagcgcccccatctgtct

SEQ ID NO: 6090482 - DNA, 20 bp, Homo sapiens
ccgcagcgggcgcgggacag

SEQ ID NO: 6090483 - DNA, 21 bp, Homo sapiens
ccgcagcgggcgcgggacagg

SEQ ID NO: 6090484 - DNA, 18 bp, Homo sapiens
ccgcagcggtgggaagga

SEQ ID NO: 6090485 - DNA, 22 bp, Homo sapiens
ccgcagcggtgggaaggaaagg

SEQ ID NO: 6090486 - DNA, 18 bp, Homo sapiens
ccgcagctcttgcccttc

SEQ ID NO: 6090487 - DNA, 18 bp, Homo sapiens
ccgcaggaactgggctgg

SEQ ID NO: 6090488 - DNA, 14 bp, Homo sapiens
ccgcaggagggagg

SEQ ID NO: 6090489 - DNA, 13 bp, Homo sapiens
ccgcaggatccct

SEQ ID NO: 6090490 - DNA, 18 bp, Homo sapiens
ccgcaggatccctcctga

SEQ ID NO: 6090491 - DNA, 21 bp, Homo sapiens
ccgcaggcccggactcaccaa

SEQ ID NO: 6090492 - DNA, 21 bp, Homo sapiens
ccgcaggcctgccttctcagg

SEQ ID NO: 6090493 - DNA, 17 bp, Homo sapiens
ccgcagggacagaactg

SEQ ID NO: 6090494 - DNA, 15 bp, Homo sapiens
ccgcagggacgggga

SEQ ID NO: 6090495 - DNA, 11 bp, Homo sapiens
ccgcagggcca

SEQ ID NO: 6090496 - DNA, 14 bp, Homo sapiens
ccgcagggcccacc

SEQ ID NO: 6090497 - DNA, 16 bp, Homo sapiens
ccgcagggcccacctt

SEQ ID NO: 6090498 - DNA, 20 bp, Homo sapiens
ccgcagggcgcccagcgccg

SEQ ID NO: 6090499 - DNA, 20 bp, Homo sapiens
ccgcagggcgctccggcaga

SEQ ID NO: 6090500 - DNA, 12 bp, Homo sapiens
ccgcagggcggg

SEQ ID NO: 6090501 - DNA, 14 bp, Homo sapiens
ccgcaggggcccct

SEQ ID NO: 6090502 - DNA, 19 bp, Homo sapiens
ccgcaggggtttgggtggg

SEQ ID NO: 6090503 - DNA, 21 bp, Homo sapiens
ccgcaggtgctcatgctgctc

SEQ ID NO: 6090504 - DNA, 18 bp, Homo sapiens
ccgcagtcgtcagcctcc

SEQ ID NO: 6090505 - DNA, 19 bp, Homo sapiens
ccgcagtcgtcagcctccc

SEQ ID NO: 6090506 - DNA, 16 bp, Homo sapiens
ccgcagtgaggcggat

SEQ ID NO: 6090507 - DNA, 16 bp, Homo sapiens
ccgcagtgggagcaaa

SEQ ID NO: 6090508 - DNA, 15 bp, Homo sapiens
ccgcagtgtgcacta

SEQ ID NO: 6090509 - DNA, 22 bp, Homo sapiens
ccgcagtgtgcactaaggggcc

SEQ ID NO: 6090510 - DNA, 18 bp, Homo sapiens
ccgcataagaaaaagaat

SEQ ID NO: 6090511 - DNA, 22 bp, Homo sapiens
ccgcataggcccagccagggtg

SEQ ID NO: 6090512 - DNA, 13 bp, Homo sapiens
ccgcatatgcatg

SEQ ID NO: 6090513 - DNA, 13 bp, Homo sapiens
ccgcatcccctgc

SEQ ID NO: 6090514 - DNA, 16 bp, Homo sapiens
ccgcatcctagtctct

SEQ ID NO: 6090515 - DNA, 13 bp, Homo sapiens
ccgcatcctccag

SEQ ID NO: 6090516 - DNA, 14 bp, Homo sapiens
ccgcatcctccagg

SEQ ID NO: 6090517 - DNA, 14 bp, Homo sapiens
ccgcatctgcctgg

SEQ ID NO: 6090518 - DNA, 16 bp, Homo sapiens
ccgcatctgcctggag

SEQ ID NO: 6090519 - DNA, 17 bp, Homo sapiens
ccgcatctgcctggagc

SEQ ID NO: 6090520 - DNA, 18 bp, Homo sapiens
ccgcatctgcctggagcc

SEQ ID NO: 6090521 - DNA, 22 bp, Homo sapiens
ccgcatctgcctggagcctggg

SEQ ID NO: 6090522 - DNA, 14 bp, Homo sapiens
ccgcatctgctcat

SEQ ID NO: 6090523 - DNA, 19 bp, Homo sapiens
ccgcatcttctccatctgg

SEQ ID NO: 6090524 - DNA, 20 bp, Homo sapiens
ccgcatgatgtttccctctc

SEQ ID NO: 6090525 - DNA, 20 bp, Homo sapiens
ccgcatgcagcagcttgctg

SEQ ID NO: 6090526 - DNA, 12 bp, Homo sapiens
ccgcatgccccc

SEQ ID NO: 6090527 - DNA, 13 bp, Homo sapiens
ccgcatgccccct

SEQ ID NO: 6090528 - DNA, 21 bp, Homo sapiens
ccgcatgctcttacccacact

SEQ ID NO: 6090529 - DNA, 16 bp, Homo sapiens
ccgcatgctgcctgcc

SEQ ID NO: 6090530 - DNA, 19 bp, Homo sapiens
ccgcatgctgcctgcctcc

SEQ ID NO: 6090531 - DNA, 14 bp, Homo sapiens
ccgcatggcagctg

SEQ ID NO: 6090532 - DNA, 15 bp, Homo sapiens
ccgcatggcagctgg

SEQ ID NO: 6090533 - DNA, 19 bp, Homo sapiens
ccgcatggcagctgggccc

SEQ ID NO: 6090534 - DNA, 20 bp, Homo sapiens
ccgcatggcagctgggccca

SEQ ID NO: 6090535 - DNA, 18 bp, Homo sapiens
ccgcatggcccctccagg

SEQ ID NO: 6090536 - DNA, 20 bp, Homo sapiens
ccgcatggtttttataatat

SEQ ID NO: 6090537 - DNA, 14 bp, Homo sapiens
ccgcatgtctgcat

SEQ ID NO: 6090538 - DNA, 15 bp, Homo sapiens
ccgcatgtgtctgta

SEQ ID NO: 6090539 - DNA, 17 bp, Homo sapiens
ccgcatgtgtctgtatt

SEQ ID NO: 6090540 - DNA, 18 bp, Homo sapiens
ccgcatgtgtctgtattc

SEQ ID NO: 6090541 - DNA, 19 bp, Homo sapiens
ccgcatgtgtctgtattca

SEQ ID NO: 6090542 - DNA, 18 bp, Homo sapiens
ccgcatgtgtgcctggcc

SEQ ID NO: 6090543 - DNA, 17 bp, Homo sapiens
cctgggcctcccatagt

SEQ ID NO: 6090544 - DNA, 14 bp, Homo sapiens
cctgggcctcctcc

SEQ ID NO: 6090545 - DNA, 19 bp, Homo sapiens
cctgggcctctgcccctcc

SEQ ID NO: 6090546 - DNA, 16 bp, Homo sapiens
cctgggcctgatggtg

SEQ ID NO: 6090547 - DNA, 16 bp, Homo sapiens
cctgggcctgcccctg

SEQ ID NO: 6090548 - DNA, 13 bp, Homo sapiens
cctgggcctgcct

SEQ ID NO: 6090549 - DNA, 15 bp, Homo sapiens
cctgggcctgctgct

SEQ ID NO: 6090550 - DNA, 16 bp, Homo sapiens
cctgggcctgctgctg

SEQ ID NO: 6090551 - DNA, 18 bp, Homo sapiens
cctgggcctgctgctgag

SEQ ID NO: 6090552 - DNA, 20 bp, Homo sapiens
cctgggcctgctgctgagaa

SEQ ID NO: 6090553 - DNA, 12 bp, Homo sapiens
cctgggcctggc

SEQ ID NO: 6090554 - DNA, 14 bp, Homo sapiens
cctgggcctgtccc

SEQ ID NO: 6090555 - DNA, 15 bp, Homo sapiens
cctgggcctgtctca

SEQ ID NO: 6090556 - DNA, 14 bp, Homo sapiens
cctgggcctgtgca

SEQ ID NO: 6090557 - DNA, 16 bp, Homo sapiens
cctgggcctgtgcagc

SEQ ID NO: 6090558 - DNA, 17 bp, Homo sapiens
cctgggcctgtgcagca

SEQ ID NO: 6090559 - DNA, 18 bp, Homo sapiens
cctgggcctgtgcagcag

SEQ ID NO: 6090560 - DNA, 21 bp, Homo sapiens
cctgggcctgtgcagcagccc

SEQ ID NO: 6090561 - DNA, 22 bp, Homo sapiens
cctgggcctgtgcagcagccca

SEQ ID NO: 6090562 - DNA, 13 bp, Homo sapiens
cctgggccttggg

SEQ ID NO: 6090563 - DNA, 17 bp, Homo sapiens
cctgggcgagcccctcc

SEQ ID NO: 6090564 - DNA, 20 bp, Homo sapiens
cctgggcgagcccctccttc

SEQ ID NO: 6090565 - DNA, 21 bp, Homo sapiens
cctgggcgagcccctccttct

SEQ ID NO: 6090566 - DNA, 22 bp, Homo sapiens
cctgggcgagcccctccttctc

SEQ ID NO: 6090567 - DNA, 22 bp, Homo sapiens
cctgggcgcaagcgacacaggc

SEQ ID NO: 6090568 - DNA, 18 bp, Homo sapiens
cctgggcgcagctgaagc

SEQ ID NO: 6090569 - DNA, 23 bp, Homo sapiens
cctgggcgcagctgaagcctgga

SEQ ID NO: 6090570 - DNA, 15 bp, Homo sapiens
cctgggcgctggtcc

SEQ ID NO: 6090571 - DNA, 16 bp, Homo sapiens
cctgggcgctggtcct

SEQ ID NO: 6090572 - DNA, 19 bp, Homo sapiens
cctgggcggggccgcagcc

SEQ ID NO: 6090573 - DNA, 17 bp, Homo sapiens
cctgggctaccatctgc

SEQ ID NO: 6090574 - DNA, 23 bp, Homo sapiens
cctgggctcaagcaatcctcctg

SEQ ID NO: 6090575 - DNA, 16 bp, Homo sapiens
cctgggctcactgtgc

SEQ ID NO: 6090576 - DNA, 17 bp, Homo sapiens
cctgggctcactgtgct

SEQ ID NO: 6090577 - DNA, 18 bp, Homo sapiens
cctgggctcactgtgctg

SEQ ID NO: 6090578 - DNA, 22 bp, Homo sapiens
cctgggctcactgtgctggggc

SEQ ID NO: 6090579 - DNA, 23 bp, Homo sapiens
cctgggctcagcctggtttctgg

SEQ ID NO: 6090580 - DNA, 18 bp, Homo sapiens
cctgggctccacacagca

SEQ ID NO: 6090581 - DNA, 19 bp, Homo sapiens
cctgggctccacacagcag

SEQ ID NO: 6090582 - DNA, 23 bp, Homo sapiens
cctgggctccacacagcagtgtc

SEQ ID NO: 6090583 - DNA, 18 bp, Homo sapiens
cctgggctccctggagga

SEQ ID NO: 6090584 - DNA, 21 bp, Homo sapiens
cctgggctcctcttagctcag

SEQ ID NO: 6090585 - DNA, 17 bp, Homo sapiens
cctgggctctcacccag

SEQ ID NO: 6090586 - DNA, 14 bp, Homo sapiens
cctgggctctgaac

SEQ ID NO: 6090587 - DNA, 12 bp, Homo sapiens
cctgggctctgc

SEQ ID NO: 6090588 - DNA, 13 bp, Homo sapiens
cctgggctctgga

SEQ ID NO: 6090589 - DNA, 16 bp, Homo sapiens
cctgggctctgggagc

SEQ ID NO: 6090590 - DNA, 13 bp, Homo sapiens
cctgggctctggt

SEQ ID NO: 6090591 - DNA, 16 bp, Homo sapiens
cctgggctctggtctg

SEQ ID NO: 6090592 - DNA, 22 bp, Homo sapiens
cctgggctctgtgggctgcact

SEQ ID NO: 6090593 - DNA, 22 bp, Homo sapiens
cctgggctgagagaacctcacg

SEQ ID NO: 6090594 - DNA, 12 bp, Homo sapiens
cctgggctgcca

SEQ ID NO: 6090595 - DNA, 18 bp, Homo sapiens
cctgggctggcacagccc

SEQ ID NO: 6090596 - DNA, 21 bp, Homo sapiens
cctgggctggcacagcccctg

SEQ ID NO: 6090597 - DNA, 22 bp, Homo sapiens
cctgggctggcacagcccctgg

SEQ ID NO: 6090598 - DNA, 14 bp, Homo sapiens
cctgggctggcatg

SEQ ID NO: 6090599 - DNA, 15 bp, Homo sapiens
cctgggctggcatgg

SEQ ID NO: 6090600 - DNA, 13 bp, Homo sapiens
cctgggctgggaa

SEQ ID NO: 6090601 - DNA, 17 bp, Homo sapiens
cctgggctgggagaagg

SEQ ID NO: 6090602 - DNA, 22 bp, Homo sapiens
cctgggctgggagaaggtgctt

SEQ ID NO: 6090603 - DNA, 14 bp, Homo sapiens
cctgggctgggcag

SEQ ID NO: 6090604 - DNA, 15 bp, Homo sapiens
cctgggctgggcagc

SEQ ID NO: 6090605 - DNA, 16 bp, Homo sapiens
cctgggctgggcagcc

SEQ ID NO: 6090606 - DNA, 23 bp, Homo sapiens
cctgggctgggcccttcctggct

SEQ ID NO: 6090607 - DNA, 15 bp, Homo sapiens
cctgggctggggagg

SEQ ID NO: 6090608 - DNA, 19 bp, Homo sapiens
cctgggctggggaggagga

SEQ ID NO: 6090609 - DNA, 20 bp, Homo sapiens
cctgggctggggaggaggag

SEQ ID NO: 6090610 - DNA, 22 bp, Homo sapiens
cctgggctggggaggaggagag

SEQ ID NO: 6090611 - DNA, 15 bp, Homo sapiens
cctgggctggggcca

SEQ ID NO: 6090612 - DNA, 17 bp, Homo sapiens
cctgggctggggccacc

SEQ ID NO: 6090613 - DNA, 20 bp, Homo sapiens
cctgggctggggccaccatc

SEQ ID NO: 6090614 - DNA, 24 bp, Homo sapiens
cctgggctggggccaccatccctg

SEQ ID NO: 6090615 - DNA, 17 bp, Homo sapiens
cctgggctggttggaga

SEQ ID NO: 6090616 - DNA, 20 bp, Homo sapiens
cctgggctggttggagaagg

SEQ ID NO: 6090617 - DNA, 10 bp, Homo sapiens
cctgggctgt

SEQ ID NO: 6090618 - DNA, 13 bp, Homo sapiens
cctgggctgtcca

SEQ ID NO: 6090619 - DNA, 18 bp, Homo sapiens
cctgggctgtctgtcacc

SEQ ID NO: 6090620 - DNA, 14 bp, Homo sapiens
cctgggctgtgcta

SEQ ID NO: 6090621 - DNA, 16 bp, Homo sapiens
cctgggctgtgctgct

SEQ ID NO: 6090622 - DNA, 23 bp, Homo sapiens
cctgggctgttgtgtctggagcc

SEQ ID NO: 6090623 - DNA, 15 bp, Homo sapiens
cctgggcttaagttt

SEQ ID NO: 6090624 - DNA, 13 bp, Homo sapiens
cctgggcttccac

SEQ ID NO: 6090625 - DNA, 22 bp, Homo sapiens
cctgggcttccacagtgtgaag

SEQ ID NO: 6090626 - DNA, 15 bp, Homo sapiens
cctgggcttggcctg

SEQ ID NO: 6090627 - DNA, 16 bp, Homo sapiens
cctgggcttggcctgc

SEQ ID NO: 6090628 - DNA, 19 bp, Homo sapiens
cctgggcttggcctgctgt

SEQ ID NO: 6090629 - DNA, 20 bp, Homo sapiens
cctgggcttggcctgctgtg

SEQ ID NO: 6090630 - DNA, 20 bp, Homo sapiens
cctgggcttggctcttggct

SEQ ID NO: 6090631 - DNA, 13 bp, Homo sapiens
cctgggctttctg

SEQ ID NO: 6090632 - DNA, 22 bp, Homo sapiens
cctgggcttttgttttgctttt

SEQ ID NO: 6090633 - DNA, 18 bp, Homo sapiens
cctggggaagaggccttg

SEQ ID NO: 6090634 - DNA, 17 bp, Homo sapiens
cctggggaaggagccag

SEQ ID NO: 6090635 - DNA, 12 bp, Homo sapiens
cctggggacaga

SEQ ID NO: 6090636 - DNA, 16 bp, Homo sapiens
cctggggacagagcca

SEQ ID NO: 6090637 - DNA, 20 bp, Homo sapiens
cctggggacagagccacccc

SEQ ID NO: 6090638 - DNA, 12 bp, Homo sapiens
cctggggaccaa

SEQ ID NO: 6090639 - DNA, 17 bp, Homo sapiens
cctggggaccaggagct

SEQ ID NO: 6090640 - DNA, 21 bp, Homo sapiens
cctggggacccaaaccccctg

SEQ ID NO: 6090641 - DNA, 13 bp, Homo sapiens
cctggggacccac

SEQ ID NO: 6090642 - DNA, 17 bp, Homo sapiens
cctggggacccacgtgg

SEQ ID NO: 6090643 - DNA, 21 bp, Homo sapiens
cctggggaccccactccctgc

SEQ ID NO: 6090644 - DNA, 16 bp, Homo sapiens
cctggggaccccactt

SEQ ID NO: 6090645 - DNA, 19 bp, Homo sapiens
cctggggacgaattccact

SEQ ID NO: 6090646 - DNA, 21 bp, Homo sapiens
cctggggacgaattccactcg

SEQ ID NO: 6090647 - DNA, 19 bp, Homo sapiens
cctggggacggggctcccc

SEQ ID NO: 6090648 - DNA, 13 bp, Homo sapiens
cctggggactcct

SEQ ID NO: 6090649 - DNA, 19 bp, Homo sapiens
cctggggactctgcttggc

SEQ ID NO: 6090650 - DNA, 18 bp, Homo sapiens
cctggggactgttccaaa

SEQ ID NO: 6090651 - DNA, 23 bp, Homo sapiens
cctggggactgttccaaagccag

SEQ ID NO: 6090652 - DNA, 21 bp, Homo sapiens
cctggggagaaagaggggcct

SEQ ID NO: 6090653 - DNA, 20 bp, Homo sapiens
cctggggagaacccttcctg

SEQ ID NO: 6090654 - DNA, 10 bp, Homo sapiens
cctggggagc

SEQ ID NO: 6090655 - DNA, 14 bp, Homo sapiens
cctggggagcccac

SEQ ID NO: 6090656 - DNA, 18 bp, Homo sapiens
cctggggagcccactgag

SEQ ID NO: 6090657 - DNA, 16 bp, Homo sapiens
cctggggagccctcag

SEQ ID NO: 6090658 - DNA, 15 bp, Homo sapiens
cctggggagctcctg

SEQ ID NO: 6090659 - DNA, 20 bp, Homo sapiens
cctggggagctcctgggacc

SEQ ID NO: 6090660 - DNA, 22 bp, Homo sapiens
cctggggagctcctgggaccct

SEQ ID NO: 6090661 - DNA, 21 bp, Homo sapiens
cctggggagcttttgcccaca

SEQ ID NO: 6090662 - DNA, 15 bp, Homo sapiens
cctggggaggacccc

SEQ ID NO: 6090663 - DNA, 20 bp, Homo sapiens
cctggggaggacccctgccc

SEQ ID NO: 6090664 - DNA, 21 bp, Homo sapiens
cctggggagtggttaggcagc

SEQ ID NO: 6090665 - DNA, 15 bp, Homo sapiens
cctggggatcacagc

SEQ ID NO: 6090666 - DNA, 19 bp, Homo sapiens
cctggggatcttgccccct

SEQ ID NO: 6090667 - DNA, 18 bp, Homo sapiens
cctggggatgtggctgga

SEQ ID NO: 6090668 - DNA, 20 bp, Homo sapiens
cctggggattgggagggaca

SEQ ID NO: 6090669 - DNA, 14 bp, Homo sapiens
cctggggcactccc

SEQ ID NO: 6090670 - DNA, 12 bp, Homo sapiens
cctggggcagag

SEQ ID NO: 6090671 - DNA, 15 bp, Homo sapiens
cctggggcagcactc

SEQ ID NO: 6090672 - DNA, 17 bp, Homo sapiens
cctggggcatccatggg

SEQ ID NO: 6090673 - DNA, 12 bp, Homo sapiens
cctggggccagg

SEQ ID NO: 6090674 - DNA, 14 bp, Homo sapiens
cctggggccaggcc

SEQ ID NO: 6090675 - DNA, 15 bp, Homo sapiens
cctggggccaggccg

SEQ ID NO: 6090676 - DNA, 16 bp, Homo sapiens
cctggggcccaaatgc

SEQ ID NO: 6090677 - DNA, 14 bp, Homo sapiens
cctggggcccaagt

SEQ ID NO: 6090678 - DNA, 19 bp, Homo sapiens
cctggggcccagcccctgt

SEQ ID NO: 6090679 - DNA, 12 bp, Homo sapiens
cctggggccccg

SEQ ID NO: 6090680 - DNA, 13 bp, Homo sapiens
cctggggccccgc

SEQ ID NO: 6090681 - DNA, 14 bp, Homo sapiens
cctggggccgcctg

SEQ ID NO: 6090682 - DNA, 16 bp, Homo sapiens
cctggggccgcctgcc

SEQ ID NO: 6090683 - DNA, 23 bp, Homo sapiens
cctggggccgcctgccctgcctt

SEQ ID NO: 6090684 - DNA, 24 bp, Homo sapiens
cctggggccgcctgccctgccttg

SEQ ID NO: 6090685 - DNA, 12 bp, Homo sapiens
cctggggcctcg

SEQ ID NO: 6090686 - DNA, 22 bp, Homo sapiens
cctggggcctcggagcctcatc

SEQ ID NO: 6090687 - DNA, 17 bp, Homo sapiens
cctggggcctgactgct

SEQ ID NO: 6090688 - DNA, 17 bp, Homo sapiens
cctggggcctggacctg

SEQ ID NO: 6090689 - DNA, 14 bp, Homo sapiens
cctggggcctgtac

SEQ ID NO: 6090690 - DNA, 21 bp, Homo sapiens
cctggggcctgtactgcctgc

SEQ ID NO: 6090691 - DNA, 19 bp, Homo sapiens
cctggggccttcctggctt

SEQ ID NO: 6090692 - DNA, 13 bp, Homo sapiens
cctggggctatgc

SEQ ID NO: 6090693 - DNA, 13 bp, Homo sapiens
cctggggctccct

SEQ ID NO: 6090694 - DNA, 15 bp, Homo sapiens
cctggggctccctct

SEQ ID NO: 6090695 - DNA, 20 bp, Homo sapiens
cctggggctccctctctggt

SEQ ID NO: 6090696 - DNA, 14 bp, Homo sapiens
cctggggctccggt

SEQ ID NO: 6090697 - DNA, 16 bp, Homo sapiens
cctggggctcctttct

SEQ ID NO: 6090698 - DNA, 21 bp, Homo sapiens
cctggggctcctttctccagc

SEQ ID NO: 6090699 - DNA, 12 bp, Homo sapiens
cctggggctcta

SEQ ID NO: 6090700 - DNA, 23 bp, Homo sapiens
cctggggctctaacgcctgagcc

SEQ ID NO: 6090701 - DNA, 18 bp, Homo sapiens
cctggggctctgtgcagg

SEQ ID NO: 6090702 - DNA, 20 bp, Homo sapiens
cctggggctgatctcaggga

SEQ ID NO: 6090703 - DNA, 18 bp, Homo sapiens
cctggggctgccctcggc

SEQ ID NO: 6090704 - DNA, 15 bp, Homo sapiens
cctggggctgctggc

SEQ ID NO: 6090705 - DNA, 21 bp, Homo sapiens
cctggggctgcttaggaaacc

SEQ ID NO: 6090706 - DNA, 17 bp, Homo sapiens
cctggggctggcctccc

SEQ ID NO: 6090707 - DNA, 15 bp, Homo sapiens
cctggggctggctgc

SEQ ID NO: 6090708 - DNA, 14 bp, Homo sapiens
cctggggctggctt

SEQ ID NO: 6090709 - DNA, 12 bp, Homo sapiens
cctggggctggt

SEQ ID NO: 6090710 - DNA, 15 bp, Homo sapiens
cctggggctggtcct

SEQ ID NO: 6090711 - DNA, 19 bp, Homo sapiens
cctggggctggtcctggga

SEQ ID NO: 6090712 - DNA, 14 bp, Homo sapiens
cctggggctggtgg

SEQ ID NO: 6090713 - DNA, 15 bp, Homo sapiens
cctggggctggtgga

SEQ ID NO: 6090714 - DNA, 20 bp, Homo sapiens
cctggggcttgaatttgcat

SEQ ID NO: 6090715 - DNA, 16 bp, Homo sapiens
cctgggggaagccctg

SEQ ID NO: 6090716 - DNA, 19 bp, Homo sapiens
cctgggggacccctggctc

SEQ ID NO: 6090717 - DNA, 18 bp, Homo sapiens
cctgggggagttttcctc

SEQ ID NO: 6090718 - DNA, 18 bp, Homo sapiens
cctgggggataccagctg

SEQ ID NO: 6090719 - DNA, 16 bp, Homo sapiens
cctgggggcagtgact

SEQ ID NO: 6090720 - DNA, 18 bp, Homo sapiens
cctgggggcagtgactgg

SEQ ID NO: 6090721 - DNA, 20 bp, Homo sapiens
cctgggggcagtgactggca

SEQ ID NO: 6090722 - DNA, 22 bp, Homo sapiens
cctgggggcagtgactggcagg

SEQ ID NO: 6090723 - DNA, 19 bp, Homo sapiens
cctgggggcatcctgcttc

SEQ ID NO: 6090724 - DNA, 22 bp, Homo sapiens
cctgggggcatcctgcttcctg

SEQ ID NO: 6090725 - DNA, 13 bp, Homo sapiens
cctgggggccagc

SEQ ID NO: 6090726 - DNA, 14 bp, Homo sapiens
cctgggggccagct

SEQ ID NO: 6090727 - DNA, 18 bp, Homo sapiens
cctgggggccagctggtg

SEQ ID NO: 6090728 - DNA, 19 bp, Homo sapiens
cctgggggccccaggatgg

SEQ ID NO: 6090729 - DNA, 16 bp, Homo sapiens
cctgggggcctgacct

SEQ ID NO: 6090730 - DNA, 17 bp, Homo sapiens
cctgggggcctgacctc

SEQ ID NO: 6090731 - DNA, 22 bp, Homo sapiens
cctgggggcctgacctccccct

SEQ ID NO: 6090732 - DNA, 23 bp, Homo sapiens
cctgggggcctgacctccccctc

SEQ ID NO: 6090733 - DNA, 17 bp, Homo sapiens
cctgggggcctggctgg

SEQ ID NO: 6090734 - DNA, 13 bp, Homo sapiens
cctgggggcggcc

SEQ ID NO: 6090735 - DNA, 19 bp, Homo sapiens
cctgggggcgggactcctc

SEQ ID NO: 6090736 - DNA, 15 bp, Homo sapiens
cctgggggctccctg

SEQ ID NO: 6090737 - DNA, 14 bp, Homo sapiens
cctgggggctcctc

SEQ ID NO: 6090738 - DNA, 12 bp, Homo sapiens
cctgggggctct

SEQ ID NO: 6090739 - DNA, 13 bp, Homo sapiens
cctgggggctgct

SEQ ID NO: 6090740 - DNA, 16 bp, Homo sapiens
cctgggggctgctgca

SEQ ID NO: 6090741 - DNA, 13 bp, Homo sapiens
cctgggggctggc

SEQ ID NO: 6090742 - DNA, 21 bp, Homo sapiens
cctgggggctgggaggatcct

SEQ ID NO: 6090743 - DNA, 21 bp, Homo sapiens
cctgggggcttttgccactcc

SEQ ID NO: 6090744 - DNA, 17 bp, Homo sapiens
cctggggggagggacag

SEQ ID NO: 6090745 - DNA, 19 bp, Homo sapiens
cctggggggagggacaggg

SEQ ID NO: 6090746 - DNA, 17 bp, Homo sapiens
cctggggggcacagcca

SEQ ID NO: 6090747 - DNA, 12 bp, Homo sapiens
cctggggggcag

SEQ ID NO: 6090748 - DNA, 23 bp, Homo sapiens
cctggggggcctgaaagcaacag

SEQ ID NO: 6090749 - DNA, 13 bp, Homo sapiens
cctggggggggca

SEQ ID NO: 6090750 - DNA, 18 bp, Homo sapiens
cctgggggtcccaggatc

SEQ ID NO: 6090751 - DNA, 23 bp, Homo sapiens
cctgggggtcccaggatcccctg

SEQ ID NO: 6090752 - DNA, 22 bp, Homo sapiens
cctgggggtggcaggcacacag

SEQ ID NO: 6090753 - DNA, 15 bp, Homo sapiens
cctgggggtggggct

SEQ ID NO: 6090754 - DNA, 17 bp, Homo sapiens
cctgggggtggggctcc

SEQ ID NO: 6090755 - DNA, 22 bp, Homo sapiens
cctgggggtggggctcctacct

SEQ ID NO: 6090756 - DNA, 23 bp, Homo sapiens
cctgggggtggggctcctacctg

SEQ ID NO: 6090757 - DNA, 22 bp, Homo sapiens
cctgggggtttaagctctgccc

SEQ ID NO: 6090758 - DNA, 20 bp, Homo sapiens
cctggggtaggaggaacagg

SEQ ID NO: 6090759 - DNA, 20 bp, Homo sapiens
cctggggtcaggccgggcag

SEQ ID NO: 6090760 - DNA, 14 bp, Homo sapiens
cctggggtcccccc

SEQ ID NO: 6090761 - DNA, 15 bp, Homo sapiens
cctggggtccctctg

SEQ ID NO: 6090762 - DNA, 18 bp, Homo sapiens
cctggggtccctctgaag

SEQ ID NO: 6090763 - DNA, 15 bp, Homo sapiens
cctggggtctctctc

SEQ ID NO: 6090764 - DNA, 14 bp, Homo sapiens
cctggggtctctga

SEQ ID NO: 6090765 - DNA, 17 bp, Homo sapiens
cctggggtctctgagca

SEQ ID NO: 6090766 - DNA, 23 bp, Homo sapiens
cctggggtctctgagcagtgggg

SEQ ID NO: 6090767 - DNA, 15 bp, Homo sapiens
cctggggtctgagca

SEQ ID NO: 6090768 - DNA, 14 bp, Homo sapiens
cctggggtctggag

SEQ ID NO: 6090769 - DNA, 15 bp, Homo sapiens
cctggggtgcatctc

SEQ ID NO: 6090770 - DNA, 22 bp, Homo sapiens
cctggggtgccctccactgccc

SEQ ID NO: 6090771 - DNA, 23 bp, Homo sapiens
cctggggtggaggctaagcctgg

SEQ ID NO: 6090772 - DNA, 14 bp, Homo sapiens
cctggggtggccag

SEQ ID NO: 6090773 - DNA, 17 bp, Homo sapiens
cctggggtggccagggc

SEQ ID NO: 6090774 - DNA, 21 bp, Homo sapiens
cctggggtggcctggccctcc

SEQ ID NO: 6090775 - DNA, 15 bp, Homo sapiens
cctggggtgggacag

SEQ ID NO: 6090776 - DNA, 20 bp, Homo sapiens
cctggggtgggacagggagg

SEQ ID NO: 6090777 - DNA, 13 bp, Homo sapiens
cctggggtgggga

SEQ ID NO: 6090778 - DNA, 24 bp, Homo sapiens
cctggggtggggaggcagagggtc

SEQ ID NO: 6090779 - DNA, 21 bp, Homo sapiens
cctggggtggggatagggagc

SEQ ID NO: 6090780 - DNA, 18 bp, Homo sapiens
cctggggtgggtgtgagc

SEQ ID NO: 6090781 - DNA, 22 bp, Homo sapiens
cctggggtgggtgtgagcaggg

SEQ ID NO: 6090782 - DNA, 22 bp, Homo sapiens
cctggggtgggtttagcaggct

SEQ ID NO: 6090783 - DNA, 22 bp, Homo sapiens
cctggggtggttggaggcctgg

SEQ ID NO: 6090784 - DNA, 21 bp, Homo sapiens
cctggggtgttagtggcaccg

SEQ ID NO: 6090785 - DNA, 16 bp, Homo sapiens
cctggggttgccctgg

SEQ ID NO: 6090786 - DNA, 13 bp, Homo sapiens
cctggggttgtca

SEQ ID NO: 6090787 - DNA, 16 bp, Homo sapiens
cctggggttgtccccg

SEQ ID NO: 6090788 - DNA, 18 bp, Homo sapiens
cctggggttgtccccgct

SEQ ID NO: 6090789 - DNA, 24 bp, Homo sapiens
cctggggtttagaaccccaggtga

SEQ ID NO: 6090790 - DNA, 17 bp, Homo sapiens
cctggggtttccacaca

SEQ ID NO: 6090791 - DNA, 20 bp, Homo sapiens
cctggggtttccacacaggc

SEQ ID NO: 6090792 - DNA, 21 bp, Homo sapiens
cctggggtttccacacaggcc

SEQ ID NO: 6090793 - DNA, 22 bp, Homo sapiens
cctggggtttccacacaggccc

SEQ ID NO: 6090794 - DNA, 21 bp, Homo sapiens
cctggggtttgaagctgactt

SEQ ID NO: 6090795 - DNA, 23 bp, Homo sapiens
cctggggtttgaccacccacctg

SEQ ID NO: 6090796 - DNA, 17 bp, Homo sapiens
cctgggtaagaagggtg

SEQ ID NO: 6090797 - DNA, 22 bp, Homo sapiens
cctgggtaagaagggtgggagt

SEQ ID NO: 6090798 - DNA, 22 bp, Homo sapiens
cctgggtactgaggtgctatga

SEQ ID NO: 6090799 - DNA, 15 bp, Homo sapiens
cctgggtaggaaaat

SEQ ID NO: 6090800 - DNA, 15 bp, Homo sapiens
cctgggtaggcccca

SEQ ID NO: 6090801 - DNA, 17 bp, Homo sapiens
cctgggtatcccctgcc

SEQ ID NO: 6090802 - DNA, 21 bp, Homo sapiens
cctgggtatcccctgcctcct

SEQ ID NO: 6090803 - DNA, 18 bp, Homo sapiens
cctgggtatgttcctaag

SEQ ID NO: 6090804 - DNA, 18 bp, Homo sapiens
cctgggtcacgctcaagg

SEQ ID NO: 6090805 - DNA, 23 bp, Homo sapiens
cctgggtcacgctcaaggaagga

SEQ ID NO: 6090806 - DNA, 20 bp, Homo sapiens
cctgggtcatgggcctgtgg

SEQ ID NO: 6090807 - DNA, 14 bp, Homo sapiens
cctgggtcccaggg

SEQ ID NO: 6090808 - DNA, 15 bp, Homo sapiens
cctgggtccccctcc

SEQ ID NO: 6090809 - DNA, 18 bp, Homo sapiens
cctgggtccccctcctgc

SEQ ID NO: 6090810 - DNA, 21 bp, Homo sapiens
cctgggtccccctcctgcacg

SEQ ID NO: 6090811 - DNA, 19 bp, Homo sapiens
cctgggtcctcccagctga

SEQ ID NO: 6090812 - DNA, 21 bp, Homo sapiens
cctgggtcctcggccctgtag

SEQ ID NO: 6090813 - DNA, 22 bp, Homo sapiens
cctgggtcctcgggcccctgag

SEQ ID NO: 6090814 - DNA, 15 bp, Homo sapiens
cctgggtcctgcctg

SEQ ID NO: 6090815 - DNA, 20 bp, Homo sapiens
cctgggtcctgttccctacc

SEQ ID NO: 6090816 - DNA, 21 bp, Homo sapiens
cctgggtctggggacaggccc

SEQ ID NO: 6090817 - DNA, 20 bp, Homo sapiens
cctgggtctgtgtcagcggg

SEQ ID NO: 6090818 - DNA, 13 bp, Homo sapiens
cctgggtgacaga

SEQ ID NO: 6090819 - DNA, 19 bp, Homo sapiens
cctgggtgacagagcgaga

SEQ ID NO: 6090820 - DNA, 13 bp, Homo sapiens
cctgggtgacatt

SEQ ID NO: 6090821 - DNA, 16 bp, Homo sapiens
cctgggtgacttcagg

SEQ ID NO: 6090822 - DNA, 22 bp, Homo sapiens
cctgggtgagaatcctgcctct

SEQ ID NO: 6090823 - DNA, 17 bp, Homo sapiens
cctgggtgccctggctc

SEQ ID NO: 6090824 - DNA, 18 bp, Homo sapiens
cctgggtgctcaccgcct

SEQ ID NO: 6090825 - DNA, 21 bp, Homo sapiens
cctgggtgctcaccgcctgct

SEQ ID NO: 6090826 - DNA, 13 bp, Homo sapiens
cctgggtgctcag

SEQ ID NO: 6090827 - DNA, 16 bp, Homo sapiens
cctgggtgctggctgc

SEQ ID NO: 6090828 - DNA, 13 bp, Homo sapiens
cctgggtggagca

SEQ ID NO: 6090829 - DNA, 18 bp, Homo sapiens
cctgggtggatcggcctc

SEQ ID NO: 6090830 - DNA, 15 bp, Homo sapiens
cctgggtggctactc

SEQ ID NO: 6090831 - DNA, 17 bp, Homo sapiens
cctgggtggctactctg

SEQ ID NO: 6090832 - DNA, 21 bp, Homo sapiens
cctgggtggctactctgtgcc

SEQ ID NO: 6090833 - DNA, 13 bp, Homo sapiens
cctgggtggctca

SEQ ID NO: 6090834 - DNA, 16 bp, Homo sapiens
cctgggtgggacagcc

SEQ ID NO: 6090835 - DNA, 19 bp, Homo sapiens
cctgggtgggacagcctct

SEQ ID NO: 6090836 - DNA, 23 bp, Homo sapiens
cctgggtggggcagggcctggcc

SEQ ID NO: 6090837 - DNA, 19 bp, Homo sapiens
cctgggtggggctgctcct

SEQ ID NO: 6090838 - DNA, 21 bp, Homo sapiens
cctgggtggggctgctcctcc

SEQ ID NO: 6090839 - DNA, 23 bp, Homo sapiens
cctgggtggggtcagggaaagtc

SEQ ID NO: 6090840 - DNA, 13 bp, Homo sapiens
cctgggtgggtgg

SEQ ID NO: 6090841 - DNA, 17 bp, Homo sapiens
cctgggtgggtggtggg

SEQ ID NO: 6090842 - DNA, 18 bp, Homo sapiens
cctgggtggtctgcaggc

SEQ ID NO: 6090843 - DNA, 20 bp, Homo sapiens
cctgggtgtgacctgacacc

SEQ ID NO: 6090844 - DNA, 17 bp, Homo sapiens
cctgggtgtgctccagg

SEQ ID NO: 6090845 - DNA, 17 bp, Homo sapiens
cctgggttaacaaatga

SEQ ID NO: 6090846 - DNA, 22 bp, Homo sapiens
cctgggttagactgccagctct

SEQ ID NO: 6090847 - DNA, 18 bp, Homo sapiens
cctgggttatttattgac

SEQ ID NO: 6090848 - DNA, 22 bp, Homo sapiens
cctgggttcagaaatgctgcct

SEQ ID NO: 6090849 - DNA, 18 bp, Homo sapiens
cctgggttccaatcctgg

SEQ ID NO: 6090850 - DNA, 15 bp, Homo sapiens
cctgggttccccacc

SEQ ID NO: 6090851 - DNA, 22 bp, Homo sapiens
cctgggttgctgctgtccagtg

SEQ ID NO: 6090852 - DNA, 20 bp, Homo sapiens
cctgggttggagggaaccac

SEQ ID NO: 6090853 - DNA, 21 bp, Homo sapiens
cctgggttgtttccaggagaa

SEQ ID NO: 6090854 - DNA, 16 bp, Homo sapiens
cctgggtttaagggga

SEQ ID NO: 6090855 - DNA, 19 bp, Homo sapiens
cctgggtttggcccctgga

SEQ ID NO: 6090856 - DNA, 22 bp, Homo sapiens
cctgggtttgggagccaggact

SEQ ID NO: 6090857 - DNA, 17 bp, Homo sapiens
cctgggttttctaactg

SEQ ID NO: 6090858 - DNA, 19 bp, Homo sapiens
cctgggttttctaactgta

SEQ ID NO: 6090859 - DNA, 12 bp, Homo sapiens
cctgggttttgt

SEQ ID NO: 6090860 - DNA, 19 bp, Homo sapiens
cctgggttttgtattctct

SEQ ID NO: 6090861 - DNA, 22 bp, Homo sapiens
cctgggttttgtattctctgag

SEQ ID NO: 6090862 - DNA, 21 bp, Homo sapiens
cctggtaaagaaaagcctcag

SEQ ID NO: 6090863 - DNA, 22 bp, Homo sapiens
cctggtaaccaaatattaaaga

SEQ ID NO: 6090864 - DNA, 17 bp, Homo sapiens
cctggtaagcagaggct

SEQ ID NO: 6090865 - DNA, 20 bp, Homo sapiens
cctggtaagtaatgagggct

SEQ ID NO: 6090866 - DNA, 21 bp, Homo sapiens
cctggtaattcctctccaggc

SEQ ID NO: 6090867 - DNA, 16 bp, Homo sapiens
cctggtacagcagggt

SEQ ID NO: 6090868 - DNA, 13 bp, Homo sapiens
cctggtacccagc

SEQ ID NO: 6090869 - DNA, 22 bp, Homo sapiens
cctggtacccagccatctgccc

SEQ ID NO: 6090870 - DNA, 14 bp, Homo sapiens
cctggtaccctcct

SEQ ID NO: 6090871 - DNA, 13 bp, Homo sapiens
cctggtacctgga

SEQ ID NO: 6090872 - DNA, 15 bp, Homo sapiens
cctggtactcaagcc

SEQ ID NO: 6090873 - DNA, 19 bp, Homo sapiens
cctggtactcaagcccgcg

SEQ ID NO: 6090874 - DNA, 19 bp, Homo sapiens
cctggtactgacccaggac

SEQ ID NO: 6090875 - DNA, 17 bp, Homo sapiens
cctggtagaatagatat

SEQ ID NO: 6090876 - DNA, 18 bp, Homo sapiens
cctggtagaattgggaag

SEQ ID NO: 6090877 - DNA, 20 bp, Homo sapiens
cctggtagaccactgccata

SEQ ID NO: 6090878 - DNA, 19 bp, Homo sapiens
cctggtaggagtgtgtgat

SEQ ID NO: 6090879 - DNA, 13 bp, Homo sapiens
cctggtagggcag

SEQ ID NO: 6090880 - DNA, 20 bp, Homo sapiens
cctggtatatccaaaagctt

SEQ ID NO: 6090881 - DNA, 17 bp, Homo sapiens
cctggtattatttttct

SEQ ID NO: 6090882 - DNA, 21 bp, Homo sapiens
cctggtcaacccgctgcttcc

SEQ ID NO: 6090883 - DNA, 22 bp, Homo sapiens
cctggtcacaggactctgcctc

SEQ ID NO: 6090884 - DNA, 20 bp, Homo sapiens
cctggtcacagggcatgccc

SEQ ID NO: 6090885 - DNA, 20 bp, Homo sapiens
cctggtcaccaaggcagtgc

SEQ ID NO: 6090886 - DNA, 23 bp, Homo sapiens
cctggtcaccaaggcagtgcatg

SEQ ID NO: 6090887 - DNA, 13 bp, Homo sapiens
cctggtcagcaga

SEQ ID NO: 6090888 - DNA, 17 bp, Homo sapiens
cctggtcagcagagccg

SEQ ID NO: 6090889 - DNA, 22 bp, Homo sapiens
cctggtcagttttcacagaggc

SEQ ID NO: 6090890 - DNA, 14 bp, Homo sapiens
cctggtccagattg

SEQ ID NO: 6090891 - DNA, 19 bp, Homo sapiens
cctggtccatgcagggggc

SEQ ID NO: 6090892 - DNA, 13 bp, Homo sapiens
cctggtccccact

SEQ ID NO: 6090893 - DNA, 20 bp, Homo sapiens
cctggtccccactgctgagc

SEQ ID NO: 6090894 - DNA, 21 bp, Homo sapiens
cctggtccccactgctgagct

SEQ ID NO: 6090895 - DNA, 21 bp, Homo sapiens
cctggtccctcgtccacaggg

SEQ ID NO: 6090896 - DNA, 16 bp, Homo sapiens
cctggtccctctgagg

SEQ ID NO: 6090897 - DNA, 22 bp, Homo sapiens
ccgcatgtgtgcctggccgcag

SEQ ID NO: 6090898 - DNA, 23 bp, Homo sapiens
ccgcattcagtgcacctgcctca

SEQ ID NO: 6090899 - DNA, 15 bp, Homo sapiens
ccgcattccaggggc

SEQ ID NO: 6090900 - DNA, 15 bp, Homo sapiens
ccgcattccctgagt

SEQ ID NO: 6090901 - DNA, 19 bp, Homo sapiens
ccgcattggaagagcccgc

SEQ ID NO: 6090902 - DNA, 13 bp, Homo sapiens
ccgcatttctcat

SEQ ID NO: 6090903 - DNA, 21 bp, Homo sapiens
ccgccaagatctacaggacaa

SEQ ID NO: 6090904 - DNA, 17 bp, Homo sapiens
ccgccaaggctggggga

SEQ ID NO: 6090905 - DNA, 11 bp, Homo sapiens
ccgccacagcc

SEQ ID NO: 6090906 - DNA, 14 bp, Homo sapiens
ccgccacagccttc

SEQ ID NO: 6090907 - DNA, 13 bp, Homo sapiens
ccgccaccagccc

SEQ ID NO: 6090908 - DNA, 15 bp, Homo sapiens
ccgccacccccatct

SEQ ID NO: 6090909 - DNA, 16 bp, Homo sapiens
ccgccacccccatctt

SEQ ID NO: 6090910 - DNA, 17 bp, Homo sapiens
ccgccacccccatcttc

SEQ ID NO: 6090911 - DNA, 14 bp, Homo sapiens
ccgccaccctgtct

SEQ ID NO: 6090912 - DNA, 13 bp, Homo sapiens
ccgccacctcagg

SEQ ID NO: 6090913 - DNA, 15 bp, Homo sapiens
ccgccacctccccac

SEQ ID NO: 6090914 - DNA, 12 bp, Homo sapiens
ccgccacggcca

SEQ ID NO: 6090915 - DNA, 13 bp, Homo sapiens
ccgccacggccac

SEQ ID NO: 6090916 - DNA, 15 bp, Homo sapiens
ccgccacggccaccc

SEQ ID NO: 6090917 - DNA, 15 bp, Homo sapiens
ccgccacggcctggc

SEQ ID NO: 6090918 - DNA, 20 bp, Homo sapiens
ccgccacggcctggctggtg

SEQ ID NO: 6090919 - DNA, 18 bp, Homo sapiens
ccgccactcagccatttc

SEQ ID NO: 6090920 - DNA, 21 bp, Homo sapiens
ccgccactcccgggccaagac

SEQ ID NO: 6090921 - DNA, 16 bp, Homo sapiens
ccgccactcgccttct

SEQ ID NO: 6090922 - DNA, 13 bp, Homo sapiens
ccgccactggggc

SEQ ID NO: 6090923 - DNA, 14 bp, Homo sapiens
ccgccactggggct

SEQ ID NO: 6090924 - DNA, 16 bp, Homo sapiens
ccgccagactgttaga

SEQ ID NO: 6090925 - DNA, 15 bp, Homo sapiens
ccgccagagggcttg

SEQ ID NO: 6090926 - DNA, 17 bp, Homo sapiens
ccgccagagtgtcctgc

SEQ ID NO: 6090927 - DNA, 16 bp, Homo sapiens
ccgccagatggggcct

SEQ ID NO: 6090928 - DNA, 13 bp, Homo sapiens
ccgccagccacag

SEQ ID NO: 6090929 - DNA, 18 bp, Homo sapiens
ccgccagccagtggccga

SEQ ID NO: 6090930 - DNA, 22 bp, Homo sapiens
ccgccagccccgctcccaccta

SEQ ID NO: 6090931 - DNA, 12 bp, Homo sapiens
ccgccagccctg

SEQ ID NO: 6090932 - DNA, 15 bp, Homo sapiens
ccgccagcctacact

SEQ ID NO: 6090933 - DNA, 21 bp, Homo sapiens
ccgccagcctacactgccagc

SEQ ID NO: 6090934 - DNA, 22 bp, Homo sapiens
ccgccagcctacactgccagcc

SEQ ID NO: 6090935 - DNA, 14 bp, Homo sapiens
ccgccagcctcctc

SEQ ID NO: 6090936 - DNA, 18 bp, Homo sapiens
ccgccagcctcctctgga

SEQ ID NO: 6090937 - DNA, 17 bp, Homo sapiens
ccgccagcgtgtggagc

SEQ ID NO: 6090938 - DNA, 22 bp, Homo sapiens
ccgccagcgtgtggagcagagc

SEQ ID NO: 6090939 - DNA, 15 bp, Homo sapiens
ccgccagctgccgca

SEQ ID NO: 6090940 - DNA, 15 bp, Homo sapiens
ccgccagctgggagc

SEQ ID NO: 6090941 - DNA, 19 bp, Homo sapiens
ccgccaggaggtcctcctc

SEQ ID NO: 6090942 - DNA, 12 bp, Homo sapiens
ccgccaggcgag

SEQ ID NO: 6090943 - DNA, 18 bp, Homo sapiens
ccgccaggcgcatgtctg

SEQ ID NO: 6090944 - DNA, 20 bp, Homo sapiens
ccgccaggcgctgcagggcc

SEQ ID NO: 6090945 - DNA, 11 bp, Homo sapiens
ccgccagggct

SEQ ID NO: 6090946 - DNA, 13 bp, Homo sapiens
ccgccagggctgg

SEQ ID NO: 6090947 - DNA, 14 bp, Homo sapiens
ccgccagggctggg

SEQ ID NO: 6090948 - DNA, 15 bp, Homo sapiens
ccgccagggctgggg

SEQ ID NO: 6090949 - DNA, 16 bp, Homo sapiens
ccgccagtgcacaggg

SEQ ID NO: 6090950 - DNA, 23 bp, Homo sapiens
ccgccagtgtttctgaatgtttg

SEQ ID NO: 6090951 - DNA, 16 bp, Homo sapiens
ccgccatccagggtct

SEQ ID NO: 6090952 - DNA, 23 bp, Homo sapiens
ccgccatccagggtctggcagag

SEQ ID NO: 6090953 - DNA, 21 bp, Homo sapiens
ccgccatccgggacgcttcca

SEQ ID NO: 6090954 - DNA, 14 bp, Homo sapiens
ccgccatccttcac

SEQ ID NO: 6090955 - DNA, 22 bp, Homo sapiens
ccgccatccttcaccagagccc

SEQ ID NO: 6090956 - DNA, 12 bp, Homo sapiens
ccgccatctgcg

SEQ ID NO: 6090957 - DNA, 16 bp, Homo sapiens
ccgccatggtgtcccg

SEQ ID NO: 6090958 - DNA, 16 bp, Homo sapiens
ccgccattgccaccag

SEQ ID NO: 6090959 - DNA, 12 bp, Homo sapiens
ccgcccaaggcc

SEQ ID NO: 6090960 - DNA, 14 bp, Homo sapiens
ccgcccaaggcctt

SEQ ID NO: 6090961 - DNA, 19 bp, Homo sapiens
ccgcccaaggggacttgtg

SEQ ID NO: 6090962 - DNA, 15 bp, Homo sapiens
ccgcccacccacacc

SEQ ID NO: 6090963 - DNA, 20 bp, Homo sapiens
ccgcccacccagcagcgccc

SEQ ID NO: 6090964 - DNA, 16 bp, Homo sapiens
ccgcccaccccgctgc

SEQ ID NO: 6090965 - DNA, 14 bp, Homo sapiens
ccgcccacccgcct

SEQ ID NO: 6090966 - DNA, 15 bp, Homo sapiens
ccgcccacctcagcc

SEQ ID NO: 6090967 - DNA, 16 bp, Homo sapiens
ccgcccacctcagcct

SEQ ID NO: 6090968 - DNA, 12 bp, Homo sapiens
ccgcccacctcg

SEQ ID NO: 6090969 - DNA, 20 bp, Homo sapiens
ccgcccacctcgctcccctc

SEQ ID NO: 6090970 - DNA, 17 bp, Homo sapiens
ccgcccacctgcatcag

SEQ ID NO: 6090971 - DNA, 12 bp, Homo sapiens
ccgcccacctgg

SEQ ID NO: 6090972 - DNA, 14 bp, Homo sapiens
ccgcccacctgggc

SEQ ID NO: 6090973 - DNA, 22 bp, Homo sapiens
ccgcccacgccggcctctgctg

SEQ ID NO: 6090974 - DNA, 11 bp, Homo sapiens
ccgcccactct

SEQ ID NO: 6090975 - DNA, 16 bp, Homo sapiens
ccgcccactgtcctgg

SEQ ID NO: 6090976 - DNA, 16 bp, Homo sapiens
ccgcccagacaccaca

SEQ ID NO: 6090977 - DNA, 14 bp, Homo sapiens
ccgcccagcctctc

SEQ ID NO: 6090978 - DNA, 23 bp, Homo sapiens
ccgcccagcggcttgcctgcctg

SEQ ID NO: 6090979 - DNA, 12 bp, Homo sapiens
ccgcccagctct

SEQ ID NO: 6090980 - DNA, 16 bp, Homo sapiens
ccgcccaggctggcca

SEQ ID NO: 6090981 - DNA, 13 bp, Homo sapiens
ccgcccatgcact

SEQ ID NO: 6090982 - DNA, 14 bp, Homo sapiens
ccgcccatgcactg

SEQ ID NO: 6090983 - DNA, 19 bp, Homo sapiens
ccgcccatgcactggggac

SEQ ID NO: 6090984 - DNA, 13 bp, Homo sapiens
ccgccccacctcc

SEQ ID NO: 6090985 - DNA, 14 bp, Homo sapiens
ccgccccagacaca

SEQ ID NO: 6090986 - DNA, 13 bp, Homo sapiens
ccgccccagagac

SEQ ID NO: 6090987 - DNA, 15 bp, Homo sapiens
ccgccccagagactg

SEQ ID NO: 6090988 - DNA, 12 bp, Homo sapiens
ccgccccagagc

SEQ ID NO: 6090989 - DNA, 17 bp, Homo sapiens
ccgccccagagctccga

SEQ ID NO: 6090990 - DNA, 14 bp, Homo sapiens
ccgccccagcccct

SEQ ID NO: 6090991 - DNA, 14 bp, Homo sapiens
ccgccccagccctc

SEQ ID NO: 6090992 - DNA, 15 bp, Homo sapiens
ccgccccagcctctg

SEQ ID NO: 6090993 - DNA, 13 bp, Homo sapiens
ccgccccaggcac

SEQ ID NO: 6090994 - DNA, 18 bp, Homo sapiens
ccgccccaggcaccgcca

SEQ ID NO: 6090995 - DNA, 13 bp, Homo sapiens
ccgccccagggtc

SEQ ID NO: 6090996 - DNA, 15 bp, Homo sapiens
ccgccccagggtctg

SEQ ID NO: 6090997 - DNA, 15 bp, Homo sapiens
ccgcccccaccccta

SEQ ID NO: 6090998 - DNA, 17 bp, Homo sapiens
ccgcccccaccgggctg

SEQ ID NO: 6090999 - DNA, 20 bp, Homo sapiens
ccgcccccaccgggctgcag

SEQ ID NO: 6091000 - DNA, 19 bp, Homo sapiens
ccgcccccagtccccaccc

SEQ ID NO: 6091001 - DNA, 13 bp, Homo sapiens
ccgccccccagag

SEQ ID NO: 6091002 - DNA, 18 bp, Homo sapiens
ccgccccccagagccagg

SEQ ID NO: 6091003 - DNA, 14 bp, Homo sapiens
ccgcccccgccccg

SEQ ID NO: 6091004 - DNA, 15 bp, Homo sapiens
ccgcccccgcctggg

SEQ ID NO: 6091005 - DNA, 19 bp, Homo sapiens
ccgcccccgcctgggcacc

SEQ ID NO: 6091006 - DNA, 22 bp, Homo sapiens
ccgccccctgaaacatgtgccc

SEQ ID NO: 6091007 - DNA, 11 bp, Homo sapiens
ccgccccctgc

SEQ ID NO: 6091008 - DNA, 14 bp, Homo sapiens
ccgccccgccccac

SEQ ID NO: 6091009 - DNA, 15 bp, Homo sapiens
ccgccccgcccctcc

SEQ ID NO: 6091010 - DNA, 18 bp, Homo sapiens
ccgccccgggctggccct

SEQ ID NO: 6091011 - DNA, 11 bp, Homo sapiens
ccgcccctccc

SEQ ID NO: 6091012 - DNA, 14 bp, Homo sapiens
ccgcccctccccct

SEQ ID NO: 6091013 - DNA, 13 bp, Homo sapiens
ccgcccctgagcc

SEQ ID NO: 6091014 - DNA, 14 bp, Homo sapiens
ccgcccctgagccc

SEQ ID NO: 6091015 - DNA, 13 bp, Homo sapiens
ccgcccctggaca

SEQ ID NO: 6091016 - DNA, 18 bp, Homo sapiens
ccgcccctgtggccctgg

SEQ ID NO: 6091017 - DNA, 19 bp, Homo sapiens
ccgccccttccccgaggga

SEQ ID NO: 6091018 - DNA, 13 bp, Homo sapiens
ccgcccgcccacc

SEQ ID NO: 6091019 - DNA, 16 bp, Homo sapiens
ccgcccggcagcccct

SEQ ID NO: 6091020 - DNA, 14 bp, Homo sapiens
ccgcccgggcccag

SEQ ID NO: 6091021 - DNA, 13 bp, Homo sapiens
ccgcccggggagt

SEQ ID NO: 6091022 - DNA, 14 bp, Homo sapiens
ccgccctcaggggc

SEQ ID NO: 6091023 - DNA, 16 bp, Homo sapiens
ccgccctccacccact

SEQ ID NO: 6091024 - DNA, 11 bp, Homo sapiens
ccgccctccat

SEQ ID NO: 6091025 - DNA, 20 bp, Homo sapiens
ccgccctccccctgccagag

SEQ ID NO: 6091026 - DNA, 20 bp, Homo sapiens
ccgccctcctcgctgtgcca

SEQ ID NO: 6091027 - DNA, 17 bp, Homo sapiens
ccgccctcctctgcccc

SEQ ID NO: 6091028 - DNA, 22 bp, Homo sapiens
ccgccctctgcgtcccccagcc

SEQ ID NO: 6091029 - DNA, 17 bp, Homo sapiens
ccgccctgagcatcctg

SEQ ID NO: 6091030 - DNA, 19 bp, Homo sapiens
ccgccctgatttgctgttt

SEQ ID NO: 6091031 - DNA, 13 bp, Homo sapiens
ccgccctgcagca

SEQ ID NO: 6091032 - DNA, 13 bp, Homo sapiens
ccgccctgccccg

SEQ ID NO: 6091033 - DNA, 16 bp, Homo sapiens
ccgccctgcccgggct

SEQ ID NO: 6091034 - DNA, 16 bp, Homo sapiens
ccgccctgcgggccac

SEQ ID NO: 6091035 - DNA, 18 bp, Homo sapiens
ccgccctgcgggccacag

SEQ ID NO: 6091036 - DNA, 18 bp, Homo sapiens
ccgccctgctcctccctg

SEQ ID NO: 6091037 - DNA, 22 bp, Homo sapiens
ccgccctgctcctccctggctg

SEQ ID NO: 6091038 - DNA, 12 bp, Homo sapiens
ccgccctgctgt

SEQ ID NO: 6091039 - DNA, 13 bp, Homo sapiens
ccgccctggcagt

SEQ ID NO: 6091040 - DNA, 17 bp, Homo sapiens
ccgccctgggctctggg

SEQ ID NO: 6091041 - DNA, 13 bp, Homo sapiens
ccgccctgggctg

SEQ ID NO: 6091042 - DNA, 17 bp, Homo sapiens
ccgccctgggctggact

SEQ ID NO: 6091043 - DNA, 22 bp, Homo sapiens
ccgccctgggctggactggagg

SEQ ID NO: 6091044 - DNA, 16 bp, Homo sapiens
ccgccctgtaccctct

SEQ ID NO: 6091045 - DNA, 18 bp, Homo sapiens
ccgcccttccgagcggcg

SEQ ID NO: 6091046 - DNA, 16 bp, Homo sapiens
ccgcccttcctggagg

SEQ ID NO: 6091047 - DNA, 16 bp, Homo sapiens
ccgccctttccttgcc

SEQ ID NO: 6091048 - DNA, 15 bp, Homo sapiens
ccgccgaagggcagc

SEQ ID NO: 6091049 - DNA, 18 bp, Homo sapiens
ccgccgaagggcagcccc

SEQ ID NO: 6091050 - DNA, 15 bp, Homo sapiens
ccgccgactttgtac

SEQ ID NO: 6091051 - DNA, 14 bp, Homo sapiens
ccgccgccaccagc

SEQ ID NO: 6091052 - DNA, 15 bp, Homo sapiens
ccgccgccaccagcc

SEQ ID NO: 6091053 - DNA, 19 bp, Homo sapiens
ccgccgccaccagcccgca

SEQ ID NO: 6091054 - DNA, 17 bp, Homo sapiens
ccgccgcccgcccctca

SEQ ID NO: 6091055 - DNA, 12 bp, Homo sapiens
ccgccgcccgct

SEQ ID NO: 6091056 - DNA, 14 bp, Homo sapiens
ccgccgcccgctgg

SEQ ID NO: 6091057 - DNA, 14 bp, Homo sapiens
ccgccgccgccgct

SEQ ID NO: 6091058 - DNA, 16 bp, Homo sapiens
ccgccgccgccgctgc

SEQ ID NO: 6091059 - DNA, 17 bp, Homo sapiens
ccgccgcctcccacggc

SEQ ID NO: 6091060 - DNA, 14 bp, Homo sapiens
ccgccgcctcgccc

SEQ ID NO: 6091061 - DNA, 15 bp, Homo sapiens
ccgccgcctcgccca

SEQ ID NO: 6091062 - DNA, 16 bp, Homo sapiens
ccgccgcctcgcccac

SEQ ID NO: 6091063 - DNA, 15 bp, Homo sapiens
ccgccggcaggggcc

SEQ ID NO: 6091064 - DNA, 19 bp, Homo sapiens
ccgccggcaggggcccctc

SEQ ID NO: 6091065 - DNA, 19 bp, Homo sapiens
ccgccggggtcctgggagg

SEQ ID NO: 6091066 - DNA, 19 bp, Homo sapiens
ccgccggttcattttgcac

SEQ ID NO: 6091067 - DNA, 16 bp, Homo sapiens
ccgccggttggccggc

SEQ ID NO: 6091068 - DNA, 17 bp, Homo sapiens
ccgccgtgccggcggca

SEQ ID NO: 6091069 - DNA, 16 bp, Homo sapiens
ccgccgtggtgacccc

SEQ ID NO: 6091070 - DNA, 17 bp, Homo sapiens
ccgccgtggtgacccct

SEQ ID NO: 6091071 - DNA, 19 bp, Homo sapiens
ccgccgtgtctgtggccct

SEQ ID NO: 6091072 - DNA, 22 bp, Homo sapiens
ccgccgtgtctgtggccctctc

SEQ ID NO: 6091073 - DNA, 15 bp, Homo sapiens
ccgccgttttcatga

SEQ ID NO: 6091074 - DNA, 18 bp, Homo sapiens
ccgcctaagaccctgaat

SEQ ID NO: 6091075 - DNA, 22 bp, Homo sapiens
ccgcctactggacgctgccctg

SEQ ID NO: 6091076 - DNA, 13 bp, Homo sapiens
ccgcctagtgcag

SEQ ID NO: 6091077 - DNA, 19 bp, Homo sapiens
ccgcctcaaggaagagcca

SEQ ID NO: 6091078 - DNA, 18 bp, Homo sapiens
ccgcctcaccccctcggg

SEQ ID NO: 6091079 - DNA, 18 bp, Homo sapiens
ccgcctcagcctcccaaa

SEQ ID NO: 6091080 - DNA, 18 bp, Homo sapiens
ccgcctcagcctcctgag

SEQ ID NO: 6091081 - DNA, 14 bp, Homo sapiens
ccgcctcagggcca

SEQ ID NO: 6091082 - DNA, 14 bp, Homo sapiens
cctggtccctggga

SEQ ID NO: 6091083 - DNA, 19 bp, Homo sapiens
cctggtcctaggctggaag

SEQ ID NO: 6091084 - DNA, 24 bp, Homo sapiens
cctggtcctaggctggaaggagga

SEQ ID NO: 6091085 - DNA, 16 bp, Homo sapiens
cctggtcctccctccc

SEQ ID NO: 6091086 - DNA, 20 bp, Homo sapiens
cctggtcctccgcctactgt

SEQ ID NO: 6091087 - DNA, 20 bp, Homo sapiens
cctggtcctgcactgtcccg

SEQ ID NO: 6091088 - DNA, 13 bp, Homo sapiens
cctggtcctggac

SEQ ID NO: 6091089 - DNA, 19 bp, Homo sapiens
cctggtcctggacacctcc

SEQ ID NO: 6091090 - DNA, 20 bp, Homo sapiens
cctggtcctggacacctccc

SEQ ID NO: 6091091 - DNA, 22 bp, Homo sapiens
cctggtcctggacacctcccag

SEQ ID NO: 6091092 - DNA, 23 bp, Homo sapiens
cctggtcctggcctccttccccg

SEQ ID NO: 6091093 - DNA, 13 bp, Homo sapiens
cctggtcctggct

SEQ ID NO: 6091094 - DNA, 14 bp, Homo sapiens
cctggtcctggctg

SEQ ID NO: 6091095 - DNA, 18 bp, Homo sapiens
cctggtcctggctgcact

SEQ ID NO: 6091096 - DNA, 16 bp, Homo sapiens
cctggtccttcactgg

SEQ ID NO: 6091097 - DNA, 20 bp, Homo sapiens
cctggtccttcactggcgcc

SEQ ID NO: 6091098 - DNA, 15 bp, Homo sapiens
cctggtccttccagg

SEQ ID NO: 6091099 - DNA, 13 bp, Homo sapiens
cctggtctcaccc

SEQ ID NO: 6091100 - DNA, 18 bp, Homo sapiens
cctggtctcaccctggag

SEQ ID NO: 6091101 - DNA, 21 bp, Homo sapiens
cctggtctcaccctggaggca

SEQ ID NO: 6091102 - DNA, 23 bp, Homo sapiens
cctggtctcagcagcgaccaccc

SEQ ID NO: 6091103 - DNA, 14 bp, Homo sapiens
cctggtctccgtgg

SEQ ID NO: 6091104 - DNA, 14 bp, Homo sapiens
cctggtctctggtc

SEQ ID NO: 6091105 - DNA, 18 bp, Homo sapiens
cctggtctggagccccta

SEQ ID NO: 6091106 - DNA, 21 bp, Homo sapiens
cctggtctggagcccctatcc

SEQ ID NO: 6091107 - DNA, 17 bp, Homo sapiens
cctggtctggtcaggca

SEQ ID NO: 6091108 - DNA, 14 bp, Homo sapiens
cctggtctgtagaa

SEQ ID NO: 6091109 - DNA, 12 bp, Homo sapiens
cctggtcttctc

SEQ ID NO: 6091110 - DNA, 17 bp, Homo sapiens
cctggtcttctctacag

SEQ ID NO: 6091111 - DNA, 13 bp, Homo sapiens
cctggtctttgag

SEQ ID NO: 6091112 - DNA, 20 bp, Homo sapiens
cctggtctttgagctcccac

SEQ ID NO: 6091113 - DNA, 12 bp, Homo sapiens
cctggtctttgt

SEQ ID NO: 6091114 - DNA, 17 bp, Homo sapiens
cctggtgaatcacctgg

SEQ ID NO: 6091115 - DNA, 14 bp, Homo sapiens
cctggtgacccctt

SEQ ID NO: 6091116 - DNA, 16 bp, Homo sapiens
cctggtgacctcctgt

SEQ ID NO: 6091117 - DNA, 20 bp, Homo sapiens
cctggtgacctcctgtcact

SEQ ID NO: 6091118 - DNA, 14 bp, Homo sapiens
cctggtgagaactg

SEQ ID NO: 6091119 - DNA, 16 bp, Homo sapiens
cctggtgagctcagat

SEQ ID NO: 6091120 - DNA, 21 bp, Homo sapiens
cctggtgaggaagctccagtc

SEQ ID NO: 6091121 - DNA, 23 bp, Homo sapiens
cctggtgaggaagctccagtcct

SEQ ID NO: 6091122 - DNA, 20 bp, Homo sapiens
cctggtgaggcccagcctgt

SEQ ID NO: 6091123 - DNA, 15 bp, Homo sapiens
cctggtgcacagggc

SEQ ID NO: 6091124 - DNA, 22 bp, Homo sapiens
cctggtgcacgcaggcacagca

SEQ ID NO: 6091125 - DNA, 17 bp, Homo sapiens
cctggtgcactggcccc

SEQ ID NO: 6091126 - DNA, 20 bp, Homo sapiens
cctggtgcaggtctccacct

SEQ ID NO: 6091127 - DNA, 15 bp, Homo sapiens
cctggtgcattgctg

SEQ ID NO: 6091128 - DNA, 13 bp, Homo sapiens
cctggtgccacct

SEQ ID NO: 6091129 - DNA, 10 bp, Homo sapiens
cctggtgccc

SEQ ID NO: 6091130 - DNA, 17 bp, Homo sapiens
cctggtgcccacagcag

SEQ ID NO: 6091131 - DNA, 12 bp, Homo sapiens
cctggtgcccct

SEQ ID NO: 6091132 - DNA, 15 bp, Homo sapiens
cctggtgcccctgct

SEQ ID NO: 6091133 - DNA, 22 bp, Homo sapiens
cctggtgcccctgctcactggg

SEQ ID NO: 6091134 - DNA, 13 bp, Homo sapiens
cctggtgccctga

SEQ ID NO: 6091135 - DNA, 16 bp, Homo sapiens
cctggtgccctgagac

SEQ ID NO: 6091136 - DNA, 19 bp, Homo sapiens
cctggtgccctgagacaga

SEQ ID NO: 6091137 - DNA, 18 bp, Homo sapiens
cctggtgccctggatgcc

SEQ ID NO: 6091138 - DNA, 20 bp, Homo sapiens
cctggtgccctggatgccca

SEQ ID NO: 6091139 - DNA, 15 bp, Homo sapiens
cctggtgccctggcc

SEQ ID NO: 6091140 - DNA, 17 bp, Homo sapiens
cctggtgccctggccca

SEQ ID NO: 6091141 - DNA, 16 bp, Homo sapiens
cctggtgcctctgtgc

SEQ ID NO: 6091142 - DNA, 16 bp, Homo sapiens
cctggtgcgggcctgg

SEQ ID NO: 6091143 - DNA, 17 bp, Homo sapiens
cctggtgctacttgctt

SEQ ID NO: 6091144 - DNA, 22 bp, Homo sapiens
cctggtgctcctgcccagccac

SEQ ID NO: 6091145 - DNA, 13 bp, Homo sapiens
cctggtgctctct

SEQ ID NO: 6091146 - DNA, 16 bp, Homo sapiens
cctggtgctctctgcc

SEQ ID NO: 6091147 - DNA, 12 bp, Homo sapiens
cctggtgctgcc

SEQ ID NO: 6091148 - DNA, 15 bp, Homo sapiens
cctggtgctgccaca

SEQ ID NO: 6091149 - DNA, 18 bp, Homo sapiens
cctggtgctgccacactt

SEQ ID NO: 6091150 - DNA, 15 bp, Homo sapiens
cctggtgctgcctct

SEQ ID NO: 6091151 - DNA, 13 bp, Homo sapiens
cctggtgctggag

SEQ ID NO: 6091152 - DNA, 14 bp, Homo sapiens
cctggtgctggagg

SEQ ID NO: 6091153 - DNA, 16 bp, Homo sapiens
cctggtgcttctcctc

SEQ ID NO: 6091154 - DNA, 17 bp, Homo sapiens
cctggtgctttccttca

SEQ ID NO: 6091155 - DNA, 14 bp, Homo sapiens
cctggtggacagtc

SEQ ID NO: 6091156 - DNA, 17 bp, Homo sapiens
cctggtggacagtcctg

SEQ ID NO: 6091157 - DNA, 18 bp, Homo sapiens
cctggtggacagtcctgg

SEQ ID NO: 6091158 - DNA, 17 bp, Homo sapiens
cctggtggagaggcctc

SEQ ID NO: 6091159 - DNA, 12 bp, Homo sapiens
cctggtggcagc

SEQ ID NO: 6091160 - DNA, 13 bp, Homo sapiens
cctggtggcagct

SEQ ID NO: 6091161 - DNA, 18 bp, Homo sapiens
cctggtggcagctcacct

SEQ ID NO: 6091162 - DNA, 21 bp, Homo sapiens
cctggtggcagctcacctctc

SEQ ID NO: 6091163 - DNA, 16 bp, Homo sapiens
cctggtggcagctgcg

SEQ ID NO: 6091164 - DNA, 18 bp, Homo sapiens
cctggtggcagctgcggt

SEQ ID NO: 6091165 - DNA, 19 bp, Homo sapiens
cctggtggcatggaagagg

SEQ ID NO: 6091166 - DNA, 19 bp, Homo sapiens
cctggtggccaagcctgcc

SEQ ID NO: 6091167 - DNA, 20 bp, Homo sapiens
cctggtggccaagcctgccc

SEQ ID NO: 6091168 - DNA, 16 bp, Homo sapiens
cctggtggccatgctc

SEQ ID NO: 6091169 - DNA, 18 bp, Homo sapiens
cctggtggccatgctcct

SEQ ID NO: 6091170 - DNA, 14 bp, Homo sapiens
cctggtggcccagc

SEQ ID NO: 6091171 - DNA, 15 bp, Homo sapiens
cctggtggcccagct

SEQ ID NO: 6091172 - DNA, 13 bp, Homo sapiens
cctggtggccctg

SEQ ID NO: 6091173 - DNA, 15 bp, Homo sapiens
cctggtggccttctg

SEQ ID NO: 6091174 - DNA, 17 bp, Homo sapiens
cctggtggccttctgct

SEQ ID NO: 6091175 - DNA, 23 bp, Homo sapiens
cctggtggccttctgctgcccag

SEQ ID NO: 6091176 - DNA, 16 bp, Homo sapiens
cctggtggctgcaggc

SEQ ID NO: 6091177 - DNA, 21 bp, Homo sapiens
cctggtggctggaggcattcc

SEQ ID NO: 6091178 - DNA, 18 bp, Homo sapiens
cctggtggctgggcccag

SEQ ID NO: 6091179 - DNA, 23 bp, Homo sapiens
cctggtgggccaacaaagaacac

SEQ ID NO: 6091180 - DNA, 14 bp, Homo sapiens
cctggtgggcctcc

SEQ ID NO: 6091181 - DNA, 18 bp, Homo sapiens
cctggtgggcctcctctg

SEQ ID NO: 6091182 - DNA, 13 bp, Homo sapiens
cctggtggggcag

SEQ ID NO: 6091183 - DNA, 20 bp, Homo sapiens
cctggtggggcagaaaggct

SEQ ID NO: 6091184 - DNA, 16 bp, Homo sapiens
cctggtggggcagctc

SEQ ID NO: 6091185 - DNA, 19 bp, Homo sapiens
cctggtggggcagctcctc

SEQ ID NO: 6091186 - DNA, 23 bp, Homo sapiens
cctggtggggcagctcctctgtc

SEQ ID NO: 6091187 - DNA, 13 bp, Homo sapiens
cctggtggggctg

SEQ ID NO: 6091188 - DNA, 19 bp, Homo sapiens
cctggtggggctgagcctg

SEQ ID NO: 6091189 - DNA, 20 bp, Homo sapiens
cctggtggggtgtgcatgcc

SEQ ID NO: 6091190 - DNA, 17 bp, Homo sapiens
cctggtgggtcagccca

SEQ ID NO: 6091191 - DNA, 14 bp, Homo sapiens
cctggtgggtcagg

SEQ ID NO: 6091192 - DNA, 18 bp, Homo sapiens
cctggtgggtccaggggc

SEQ ID NO: 6091193 - DNA, 16 bp, Homo sapiens
cctggtggtattttca

SEQ ID NO: 6091194 - DNA, 15 bp, Homo sapiens
cctggtggtcacagg

SEQ ID NO: 6091195 - DNA, 22 bp, Homo sapiens
cctggtggttcactcttggagc

SEQ ID NO: 6091196 - DNA, 13 bp, Homo sapiens
cctggtgtcaccc

SEQ ID NO: 6091197 - DNA, 14 bp, Homo sapiens
cctggtgtcaggca

SEQ ID NO: 6091198 - DNA, 15 bp, Homo sapiens
cctggtgtccctgcc

SEQ ID NO: 6091199 - DNA, 17 bp, Homo sapiens
cctggtgtccctgcctg

SEQ ID NO: 6091200 - DNA, 14 bp, Homo sapiens
cctggtgtctagtt

SEQ ID NO: 6091201 - DNA, 20 bp, Homo sapiens
cctggtgtgaaggtcctgct

SEQ ID NO: 6091202 - DNA, 13 bp, Homo sapiens
cctggtgtgaggc

SEQ ID NO: 6091203 - DNA, 17 bp, Homo sapiens
cctggtgtgcggaggca

SEQ ID NO: 6091204 - DNA, 19 bp, Homo sapiens
cctggtgtgcggaggcagg

SEQ ID NO: 6091205 - DNA, 23 bp, Homo sapiens
cctggtgtgcggaggcaggagca

SEQ ID NO: 6091206 - DNA, 22 bp, Homo sapiens
cctggtgtgggtaaagggacag

SEQ ID NO: 6091207 - DNA, 14 bp, Homo sapiens
cctggtgttctgaa

SEQ ID NO: 6091208 - DNA, 22 bp, Homo sapiens
cctggtgtttctagcactggcc

SEQ ID NO: 6091209 - DNA, 14 bp, Homo sapiens
cctggtgtttttct

SEQ ID NO: 6091210 - DNA, 15 bp, Homo sapiens
cctggtgtttttctc

SEQ ID NO: 6091211 - DNA, 20 bp, Homo sapiens
cctggtgtttttctctctgg

SEQ ID NO: 6091212 - DNA, 21 bp, Homo sapiens
cctggtgtttttctctctgga

SEQ ID NO: 6091213 - DNA, 20 bp, Homo sapiens
cctggttagctgacagtcag

SEQ ID NO: 6091214 - DNA, 18 bp, Homo sapiens
cctggttattgatgtggc

SEQ ID NO: 6091215 - DNA, 23 bp, Homo sapiens
cctggttattgatgtggccctgg

SEQ ID NO: 6091216 - DNA, 23 bp, Homo sapiens
cctggttcaagcgattctcttgc

SEQ ID NO: 6091217 - DNA, 15 bp, Homo sapiens
cctggttcagacaca

SEQ ID NO: 6091218 - DNA, 14 bp, Homo sapiens
cctggttcatattt

SEQ ID NO: 6091219 - DNA, 17 bp, Homo sapiens
cctggttccctccccaa

SEQ ID NO: 6091220 - DNA, 20 bp, Homo sapiens
cctggttccggaatcctgtc

SEQ ID NO: 6091221 - DNA, 13 bp, Homo sapiens
cctggttcctgct

SEQ ID NO: 6091222 - DNA, 17 bp, Homo sapiens
cctggttcctgctgtcc

SEQ ID NO: 6091223 - DNA, 18 bp, Homo sapiens
cctggttcctgctgtcct

SEQ ID NO: 6091224 - DNA, 20 bp, Homo sapiens
cctggttcctgctgtcctgg

SEQ ID NO: 6091225 - DNA, 20 bp, Homo sapiens
cctggttccttcctatgccc

SEQ ID NO: 6091226 - DNA, 19 bp, Homo sapiens
cctggttcgtgccatgccc

SEQ ID NO: 6091227 - DNA, 13 bp, Homo sapiens
cctggttctaggc

SEQ ID NO: 6091228 - DNA, 20 bp, Homo sapiens
cctggttctaggctgctgca

SEQ ID NO: 6091229 - DNA, 14 bp, Homo sapiens
cctggttctcatct

SEQ ID NO: 6091230 - DNA, 22 bp, Homo sapiens
cctggttctgtctagactggcc

SEQ ID NO: 6091231 - DNA, 23 bp, Homo sapiens
cctggttctgtctagactggcct

SEQ ID NO: 6091232 - DNA, 16 bp, Homo sapiens
cctggttgcctctctt

SEQ ID NO: 6091233 - DNA, 22 bp, Homo sapiens
cctggttgcctctcttgcccct

SEQ ID NO: 6091234 - DNA, 15 bp, Homo sapiens
cctggttgggtggca

SEQ ID NO: 6091235 - DNA, 14 bp, Homo sapiens
cctggttgtccagg

SEQ ID NO: 6091236 - DNA, 21 bp, Homo sapiens
cctggttgtctgaacccaggc

SEQ ID NO: 6091237 - DNA, 22 bp, Homo sapiens
cctggttgtctgaacccaggca

SEQ ID NO: 6091238 - DNA, 23 bp, Homo sapiens
cctggttgtctgaacccaggcag

SEQ ID NO: 6091239 - DNA, 16 bp, Homo sapiens
cctggttgtgtgtccc

SEQ ID NO: 6091240 - DNA, 19 bp, Homo sapiens
cctggtttaattcagcaga

SEQ ID NO: 6091241 - DNA, 20 bp, Homo sapiens
cctggtttaattcagcagag

SEQ ID NO: 6091242 - DNA, 21 bp, Homo sapiens
cctggtttacttctttagcat

SEQ ID NO: 6091243 - DNA, 15 bp, Homo sapiens
cctggtttagcctgg

SEQ ID NO: 6091244 - DNA, 17 bp, Homo sapiens
cctggtttcactggccc

SEQ ID NO: 6091245 - DNA, 13 bp, Homo sapiens
cctggtttcctgc

SEQ ID NO: 6091246 - DNA, 15 bp, Homo sapiens
cctggtttcctgccc

SEQ ID NO: 6091247 - DNA, 16 bp, Homo sapiens
cctggtttcctgccct

SEQ ID NO: 6091248 - DNA, 14 bp, Homo sapiens
cctggtttcctttc

SEQ ID NO: 6091249 - DNA, 18 bp, Homo sapiens
cctggtttctgttctgtt

SEQ ID NO: 6091250 - DNA, 15 bp, Homo sapiens
cctggtttgactcag

SEQ ID NO: 6091251 - DNA, 19 bp, Homo sapiens
cctggtttgcaaagaccac

SEQ ID NO: 6091252 - DNA, 21 bp, Homo sapiens
cctggtttgcaaagaccacct

SEQ ID NO: 6091253 - DNA, 19 bp, Homo sapiens
cctggttttaccccagctc

SEQ ID NO: 6091254 - DNA, 23 bp, Homo sapiens
cctggttttctcttactgcagta

SEQ ID NO: 6091255 - DNA, 22 bp, Homo sapiens
cctggtttttaaatagagtttg

SEQ ID NO: 6091256 - DNA, 19 bp, Homo sapiens
cctggtttttggattaaat

SEQ ID NO: 6091257 - DNA, 22 bp, Homo sapiens
cctggtttttggattaaattag

SEQ ID NO: 6091258 - DNA, 19 bp, Homo sapiens
cctggtttttgtagccttc

SEQ ID NO: 6091259 - DNA, 22 bp, Homo sapiens
cctggtttttgtagccttcctc

SEQ ID NO: 6091260 - DNA, 20 bp, Homo sapiens
cctgtaaaactttattttat

SEQ ID NO: 6091261 - DNA, 17 bp, Homo sapiens
ccgcctcagggccaggc

SEQ ID NO: 6091262 - DNA, 13 bp, Homo sapiens
ccgcctccactct

SEQ ID NO: 6091263 - DNA, 12 bp, Homo sapiens
ccgcctccagga

SEQ ID NO: 6091264 - DNA, 15 bp, Homo sapiens
ccgcctcccacggca

SEQ ID NO: 6091265 - DNA, 15 bp, Homo sapiens
ccgcctcccagcccc

SEQ ID NO: 6091266 - DNA, 15 bp, Homo sapiens
ccgcctcccatcccg

SEQ ID NO: 6091267 - DNA, 16 bp, Homo sapiens
ccgcctcccggggtgc

SEQ ID NO: 6091268 - DNA, 13 bp, Homo sapiens
ccgcctccctcac

SEQ ID NO: 6091269 - DNA, 18 bp, Homo sapiens
ccgcctccgggaccccca

SEQ ID NO: 6091270 - DNA, 17 bp, Homo sapiens
ccgcctcctacagccca

SEQ ID NO: 6091271 - DNA, 19 bp, Homo sapiens
ccgcctcctccctgcctgg

SEQ ID NO: 6091272 - DNA, 19 bp, Homo sapiens
ccgcctcgacctccccacc

SEQ ID NO: 6091273 - DNA, 20 bp, Homo sapiens
ccgcctcgacctccccaccc

SEQ ID NO: 6091274 - DNA, 19 bp, Homo sapiens
ccgcctcgcccaccgcatg

SEQ ID NO: 6091275 - DNA, 17 bp, Homo sapiens
ccgcctcgggccgcctc

SEQ ID NO: 6091276 - DNA, 20 bp, Homo sapiens
ccgcctcgggccgcctcctc

SEQ ID NO: 6091277 - DNA, 21 bp, Homo sapiens
ccgcctcgtgccagcagcctc

SEQ ID NO: 6091278 - DNA, 17 bp, Homo sapiens
ccgcctctcctccatct

SEQ ID NO: 6091279 - DNA, 14 bp, Homo sapiens
ccgcctctgctggc

SEQ ID NO: 6091280 - DNA, 22 bp, Homo sapiens
ccgcctctgggctcacaccagc

SEQ ID NO: 6091281 - DNA, 16 bp, Homo sapiens
ccgcctctgtctggag

SEQ ID NO: 6091282 - DNA, 16 bp, Homo sapiens
ccgcctgaaagccaca

SEQ ID NO: 6091283 - DNA, 18 bp, Homo sapiens
ccgcctgaaggcacagct

SEQ ID NO: 6091284 - DNA, 20 bp, Homo sapiens
ccgcctgaggccagcctgcg

SEQ ID NO: 6091285 - DNA, 14 bp, Homo sapiens
ccgcctgcagagga

SEQ ID NO: 6091286 - DNA, 15 bp, Homo sapiens
ccgcctgcagaggac

SEQ ID NO: 6091287 - DNA, 13 bp, Homo sapiens
ccgcctgccaccg

SEQ ID NO: 6091288 - DNA, 14 bp, Homo sapiens
ccgcctgccagtcc

SEQ ID NO: 6091289 - DNA, 21 bp, Homo sapiens
ccgcctgccagtcctagctgc

SEQ ID NO: 6091290 - DNA, 22 bp, Homo sapiens
ccgcctgcccacctgcctggcc

SEQ ID NO: 6091291 - DNA, 12 bp, Homo sapiens
ccgcctgcccag

SEQ ID NO: 6091292 - DNA, 19 bp, Homo sapiens
ccgcctgcccagactgatg

SEQ ID NO: 6091293 - DNA, 20 bp, Homo sapiens
ccgcctgcccagactgatga

SEQ ID NO: 6091294 - DNA, 18 bp, Homo sapiens
ccgcctgcccccagcgtg

SEQ ID NO: 6091295 - DNA, 12 bp, Homo sapiens
ccgcctgccctg

SEQ ID NO: 6091296 - DNA, 16 bp, Homo sapiens
ccgcctgccctgcctt

SEQ ID NO: 6091297 - DNA, 16 bp, Homo sapiens
ccgcctgcctctgcct

SEQ ID NO: 6091298 - DNA, 22 bp, Homo sapiens
ccgcctgcctctgcctcccaaa

SEQ ID NO: 6091299 - DNA, 15 bp, Homo sapiens
ccgcctgcctgccac

SEQ ID NO: 6091300 - DNA, 21 bp, Homo sapiens
ccgcctgctacacaggcagga

SEQ ID NO: 6091301 - DNA, 13 bp, Homo sapiens
ccgcctgctcctc

SEQ ID NO: 6091302 - DNA, 16 bp, Homo sapiens
ccgcctgctcctcact

SEQ ID NO: 6091303 - DNA, 18 bp, Homo sapiens
ccgcctgctcctcactgg

SEQ ID NO: 6091304 - DNA, 16 bp, Homo sapiens
ccgcctgcttcacacc

SEQ ID NO: 6091305 - DNA, 22 bp, Homo sapiens
ccgcctggatgcggatggccgg

SEQ ID NO: 6091306 - DNA, 21 bp, Homo sapiens
ccgcctggcagaactgagctc

SEQ ID NO: 6091307 - DNA, 13 bp, Homo sapiens
ccgcctggcaggt

SEQ ID NO: 6091308 - DNA, 14 bp, Homo sapiens
ccgcctggcaggtg

SEQ ID NO: 6091309 - DNA, 13 bp, Homo sapiens
ccgcctggccagg

SEQ ID NO: 6091310 - DNA, 16 bp, Homo sapiens
ccgcctggccaggagc

SEQ ID NO: 6091311 - DNA, 16 bp, Homo sapiens
ccgcctggccagggca

SEQ ID NO: 6091312 - DNA, 23 bp, Homo sapiens
ccgcctggccagggcagggccac

SEQ ID NO: 6091313 - DNA, 12 bp, Homo sapiens
ccgcctggccct

SEQ ID NO: 6091314 - DNA, 14 bp, Homo sapiens
ccgcctggccctcc

SEQ ID NO: 6091315 - DNA, 16 bp, Homo sapiens
ccgcctgggatctgag

SEQ ID NO: 6091316 - DNA, 22 bp, Homo sapiens
ccgcctgggcaccgggaccccc

SEQ ID NO: 6091317 - DNA, 21 bp, Homo sapiens
ccgcctgggtcatgggcctgt

SEQ ID NO: 6091318 - DNA, 14 bp, Homo sapiens
ccgcctgtcaataa

SEQ ID NO: 6091319 - DNA, 15 bp, Homo sapiens
ccgcctgtcaataaa

SEQ ID NO: 6091320 - DNA, 22 bp, Homo sapiens
ccgcctgtcaataaatgttgaa

SEQ ID NO: 6091321 - DNA, 16 bp, Homo sapiens
ccgcctgtcctgcctc

SEQ ID NO: 6091322 - DNA, 12 bp, Homo sapiens
ccgcctgtcctt

SEQ ID NO: 6091323 - DNA, 22 bp, Homo sapiens
ccgcctgtgcccttgctgggtc

SEQ ID NO: 6091324 - DNA, 17 bp, Homo sapiens
ccgcctgttcccccgcc

SEQ ID NO: 6091325 - DNA, 16 bp, Homo sapiens
ccgccttaagctgatc

SEQ ID NO: 6091326 - DNA, 19 bp, Homo sapiens
ccgccttcaggttcctcct

SEQ ID NO: 6091327 - DNA, 22 bp, Homo sapiens
ccgccttcaggttcctcctagg

SEQ ID NO: 6091328 - DNA, 23 bp, Homo sapiens
ccgccttcaggttcctcctaggc

SEQ ID NO: 6091329 - DNA, 12 bp, Homo sapiens
ccgccttccttg

SEQ ID NO: 6091330 - DNA, 21 bp, Homo sapiens
ccgccttcgtgtgctgctgct

SEQ ID NO: 6091331 - DNA, 13 bp, Homo sapiens
ccgccttctccag

SEQ ID NO: 6091332 - DNA, 14 bp, Homo sapiens
ccgccttctccagg

SEQ ID NO: 6091333 - DNA, 15 bp, Homo sapiens
ccgccttgcccagcc

SEQ ID NO: 6091334 - DNA, 22 bp, Homo sapiens
ccgccttggccttgcagctggc

SEQ ID NO: 6091335 - DNA, 17 bp, Homo sapiens
ccgcctttacaagggag

SEQ ID NO: 6091336 - DNA, 23 bp, Homo sapiens
ccgcctttacaagggagaagaca

SEQ ID NO: 6091337 - DNA, 17 bp, Homo sapiens
ccgcctttccggggctg

SEQ ID NO: 6091338 - DNA, 15 bp, Homo sapiens
ccgcgaactgggttc

SEQ ID NO: 6091339 - DNA, 12 bp, Homo sapiens
ccgcgaccaccc

SEQ ID NO: 6091340 - DNA, 14 bp, Homo sapiens
ccgcgaccacccct

SEQ ID NO: 6091341 - DNA, 19 bp, Homo sapiens
ccgcgaccacccctgtgcg

SEQ ID NO: 6091342 - DNA, 20 bp, Homo sapiens
ccgcgagggctactcagcag

SEQ ID NO: 6091343 - DNA, 21 bp, Homo sapiens
ccgcgatgggtcaggtagggg

SEQ ID NO: 6091344 - DNA, 20 bp, Homo sapiens
ccgcgcaccccacgccctgt

SEQ ID NO: 6091345 - DNA, 19 bp, Homo sapiens
ccgcgcaccgccatgcatg

SEQ ID NO: 6091346 - DNA, 14 bp, Homo sapiens
ccgcgcagctgcct

SEQ ID NO: 6091347 - DNA, 15 bp, Homo sapiens
ccgcgcagctgccta

SEQ ID NO: 6091348 - DNA, 12 bp, Homo sapiens
ccgcgcaggctc

SEQ ID NO: 6091349 - DNA, 13 bp, Homo sapiens
ccgcgcatctctt

SEQ ID NO: 6091350 - DNA, 16 bp, Homo sapiens
ccgcgccaggccctca

SEQ ID NO: 6091351 - DNA, 15 bp, Homo sapiens
ccgcgccagtccccg

SEQ ID NO: 6091352 - DNA, 22 bp, Homo sapiens
ccgcgccagtccccgctagtgg

SEQ ID NO: 6091353 - DNA, 17 bp, Homo sapiens
ccgcgcccagcagaggc

SEQ ID NO: 6091354 - DNA, 16 bp, Homo sapiens
ccgcgcccctctgcgc

SEQ ID NO: 6091355 - DNA, 19 bp, Homo sapiens
ccgcgcccgccgcctccct

SEQ ID NO: 6091356 - DNA, 14 bp, Homo sapiens
ccgcgccctccctc

SEQ ID NO: 6091357 - DNA, 23 bp, Homo sapiens
ccgcgccctccctccgcctccca

SEQ ID NO: 6091358 - DNA, 13 bp, Homo sapiens
ccgcgccctccga

SEQ ID NO: 6091359 - DNA, 21 bp, Homo sapiens
ccgcgccctccgacctctctc

SEQ ID NO: 6091360 - DNA, 16 bp, Homo sapiens
ccgcgccgatgccacc

SEQ ID NO: 6091361 - DNA, 17 bp, Homo sapiens
ccgcgccgatgccaccg

SEQ ID NO: 6091362 - DNA, 12 bp, Homo sapiens
ccgcgcctggcc

SEQ ID NO: 6091363 - DNA, 14 bp, Homo sapiens
ccgcgcctggccca

SEQ ID NO: 6091364 - DNA, 14 bp, Homo sapiens
ccgcgcgcccaccc

SEQ ID NO: 6091365 - DNA, 17 bp, Homo sapiens
ccgcgcgcccaccctcc

SEQ ID NO: 6091366 - DNA, 13 bp, Homo sapiens
ccgcgcgcccctg

SEQ ID NO: 6091367 - DNA, 19 bp, Homo sapiens
ccgcgcggagacctcctga

SEQ ID NO: 6091368 - DNA, 17 bp, Homo sapiens
ccgcgcgtccagctgcc

SEQ ID NO: 6091369 - DNA, 15 bp, Homo sapiens
ccgcgcgtgccccca

SEQ ID NO: 6091370 - DNA, 21 bp, Homo sapiens
ccgcgctccgggctttcacgg

SEQ ID NO: 6091371 - DNA, 15 bp, Homo sapiens
ccgcgctcggggctg

SEQ ID NO: 6091372 - DNA, 21 bp, Homo sapiens
ccgcggaaaactgctcctgtg

SEQ ID NO: 6091373 - DNA, 12 bp, Homo sapiens
ccgcggagcccc

SEQ ID NO: 6091374 - DNA, 16 bp, Homo sapiens
ccgcggagcccccgcc

SEQ ID NO: 6091375 - DNA, 15 bp, Homo sapiens
ccgcggagcccttgg

SEQ ID NO: 6091376 - DNA, 16 bp, Homo sapiens
ccgcggaggcccctga

SEQ ID NO: 6091377 - DNA, 19 bp, Homo sapiens
ccgcggatcaaccaggcag

SEQ ID NO: 6091378 - DNA, 12 bp, Homo sapiens
ccgcggccaggc

SEQ ID NO: 6091379 - DNA, 14 bp, Homo sapiens
ccgcggccctgggg

SEQ ID NO: 6091380 - DNA, 15 bp, Homo sapiens
ccgcggccgcccgca

SEQ ID NO: 6091381 - DNA, 15 bp, Homo sapiens
ccgcggcctccccga

SEQ ID NO: 6091382 - DNA, 16 bp, Homo sapiens
ccgcggcctccccgag

SEQ ID NO: 6091383 - DNA, 18 bp, Homo sapiens
ccgcggctggatgggggc

SEQ ID NO: 6091384 - DNA, 20 bp, Homo sapiens
ccgcgggagacagcttctct

SEQ ID NO: 6091385 - DNA, 17 bp, Homo sapiens
ccgcgggcacagccagc

SEQ ID NO: 6091386 - DNA, 16 bp, Homo sapiens
ccgcgggcactgccgc

SEQ ID NO: 6091387 - DNA, 16 bp, Homo sapiens
ccgcgggccaggaggc

SEQ ID NO: 6091388 - DNA, 19 bp, Homo sapiens
ccgcgggcgagaagggcgc

SEQ ID NO: 6091389 - DNA, 18 bp, Homo sapiens
ccgcgggcggccaggcaa

SEQ ID NO: 6091390 - DNA, 20 bp, Homo sapiens
ccgcggggaagctggctttg

SEQ ID NO: 6091391 - DNA, 18 bp, Homo sapiens
ccgcgggggacaggaaca

SEQ ID NO: 6091392 - DNA, 20 bp, Homo sapiens
ccgcgggtggctggagcccc

SEQ ID NO: 6091393 - DNA, 17 bp, Homo sapiens
ccgcgggttccgcaggc

SEQ ID NO: 6091394 - DNA, 14 bp, Homo sapiens
ccgcgggttctaga

SEQ ID NO: 6091395 - DNA, 15 bp, Homo sapiens
ccgcgggttctagac

SEQ ID NO: 6091396 - DNA, 16 bp, Homo sapiens
ccgcgggttctagacg

SEQ ID NO: 6091397 - DNA, 14 bp, Homo sapiens
ccgcggtgctctgg

SEQ ID NO: 6091398 - DNA, 16 bp, Homo sapiens
ccgcggtgctctggcg

SEQ ID NO: 6091399 - DNA, 19 bp, Homo sapiens
ccgcggtgctgactgaggc

SEQ ID NO: 6091400 - DNA, 15 bp, Homo sapiens
ccgcgtccaaccccg

SEQ ID NO: 6091401 - DNA, 14 bp, Homo sapiens
ccgcgtcccagctc

SEQ ID NO: 6091402 - DNA, 15 bp, Homo sapiens
ccgcgtcccagctcc

SEQ ID NO: 6091403 - DNA, 16 bp, Homo sapiens
ccgcgtcccagctccc

SEQ ID NO: 6091404 - DNA, 16 bp, Homo sapiens
ccgcgtccctgccccg

SEQ ID NO: 6091405 - DNA, 14 bp, Homo sapiens
ccgcgtcctttcct

SEQ ID NO: 6091406 - DNA, 13 bp, Homo sapiens
ccgcgtctaccct

SEQ ID NO: 6091407 - DNA, 16 bp, Homo sapiens
ccgcgtctaccctggg

SEQ ID NO: 6091408 - DNA, 18 bp, Homo sapiens
ccgcgtgattgtggcatt

SEQ ID NO: 6091409 - DNA, 17 bp, Homo sapiens
ccgcgtggttctgccac

SEQ ID NO: 6091410 - DNA, 18 bp, Homo sapiens
ccgcgtggttctgccact

SEQ ID NO: 6091411 - DNA, 17 bp, Homo sapiens
ccgcgtgtgcctgtgtg

SEQ ID NO: 6091412 - DNA, 15 bp, Homo sapiens
ccgctaaatatttac

SEQ ID NO: 6091413 - DNA, 18 bp, Homo sapiens
ccgctaagacctccccac

SEQ ID NO: 6091414 - DNA, 21 bp, Homo sapiens
ccgctaagagggagggagggc

SEQ ID NO: 6091415 - DNA, 23 bp, Homo sapiens
ccgctaagagggagggagggctc

SEQ ID NO: 6091416 - DNA, 20 bp, Homo sapiens
ccgctagagcagcccaaatt

SEQ ID NO: 6091417 - DNA, 21 bp, Homo sapiens
ccgctaggagagactgaaagc

SEQ ID NO: 6091418 - DNA, 22 bp, Homo sapiens
ccgctagtggtagtatctcgta

SEQ ID NO: 6091419 - DNA, 15 bp, Homo sapiens
ccgctcaacctctca

SEQ ID NO: 6091420 - DNA, 17 bp, Homo sapiens
ccgctcacctagagcca

SEQ ID NO: 6091421 - DNA, 22 bp, Homo sapiens
ccgctcacgctgacagcctcct

SEQ ID NO: 6091422 - DNA, 22 bp, Homo sapiens
ccgctcagtgtcagcgggtgac

SEQ ID NO: 6091423 - DNA, 13 bp, Homo sapiens
ccgctccagatct

SEQ ID NO: 6091424 - DNA, 13 bp, Homo sapiens
ccgctcccacagc

SEQ ID NO: 6091425 - DNA, 15 bp, Homo sapiens
ccgctcccacctagt

SEQ ID NO: 6091426 - DNA, 12 bp, Homo sapiens
ccgctcccagtg

SEQ ID NO: 6091427 - DNA, 20 bp, Homo sapiens
ccgctcccagtgtcttcctg

SEQ ID NO: 6091428 - DNA, 13 bp, Homo sapiens
ccgctccccagcc

SEQ ID NO: 6091429 - DNA, 21 bp, Homo sapiens
ccgctccccttggacctccag

SEQ ID NO: 6091430 - DNA, 13 bp, Homo sapiens
ccgctcccgcggg

SEQ ID NO: 6091431 - DNA, 18 bp, Homo sapiens
ccgctccgtctctgtcct

SEQ ID NO: 6091432 - DNA, 19 bp, Homo sapiens
ccgctccgtctctgtcctc

SEQ ID NO: 6091433 - DNA, 15 bp, Homo sapiens
ccgctcctccctgct

SEQ ID NO: 6091434 - DNA, 17 bp, Homo sapiens
ccgctcctccctgctcc

SEQ ID NO: 6091435 - DNA, 13 bp, Homo sapiens
ccgctcctgctga

SEQ ID NO: 6091436 - DNA, 15 bp, Homo sapiens
ccgctcctgcttccc

SEQ ID NO: 6091437 - DNA, 16 bp, Homo sapiens
ccgctcgatgcctttg

SEQ ID NO: 6091438 - DNA, 20 bp, Homo sapiens
ccgctcggacttactgcctg

SEQ ID NO: 6091439 - DNA, 19 bp, Homo sapiens
ccgctctacatcttctgcc

SEQ ID NO: 6091440 - DNA, 21 bp, Homo sapiens
ccgctctccccctgcagccgt

SEQ ID NO: 6091441 - DNA, 14 bp, Homo sapiens
ccgctctccctgtc

SEQ ID NO: 6091442 - DNA, 14 bp, Homo sapiens
cctgtaaaagagag

SEQ ID NO: 6091443 - DNA, 16 bp, Homo sapiens
cctgtaaacactcagc

SEQ ID NO: 6091444 - DNA, 19 bp, Homo sapiens
cctgtaaacactcagctgt

SEQ ID NO: 6091445 - DNA, 19 bp, Homo sapiens
cctgtaaacggtgctattt

SEQ ID NO: 6091446 - DNA, 12 bp, Homo sapiens
cctgtaaacttt

SEQ ID NO: 6091447 - DNA, 19 bp, Homo sapiens
cctgtaaactttatcactt

SEQ ID NO: 6091448 - DNA, 22 bp, Homo sapiens
cctgtaaatacatcctttttct

SEQ ID NO: 6091449 - DNA, 13 bp, Homo sapiens
cctgtaaatatat

SEQ ID NO: 6091450 - DNA, 21 bp, Homo sapiens
cctgtaaatgtcctgaatcca

SEQ ID NO: 6091451 - DNA, 18 bp, Homo sapiens
cctgtaaattattttaaa

SEQ ID NO: 6091452 - DNA, 19 bp, Homo sapiens
cctgtaacacaagccacag

SEQ ID NO: 6091453 - DNA, 20 bp, Homo sapiens
cctgtaacacaagccacaga

SEQ ID NO: 6091454 - DNA, 18 bp, Homo sapiens
cctgtaacttgagagtag

SEQ ID NO: 6091455 - DNA, 21 bp, Homo sapiens
cctgtaagaagcggcatagca

SEQ ID NO: 6091456 - DNA, 20 bp, Homo sapiens
cctgtaagagtattaacaaa

SEQ ID NO: 6091457 - DNA, 14 bp, Homo sapiens
cctgtaagcctgca

SEQ ID NO: 6091458 - DNA, 16 bp, Homo sapiens
cctgtaagcctgcaag

SEQ ID NO: 6091459 - DNA, 18 bp, Homo sapiens
cctgtaaggggccagagc

SEQ ID NO: 6091460 - DNA, 21 bp, Homo sapiens
cctgtaaggttccatccaccc

SEQ ID NO: 6091461 - DNA, 13 bp, Homo sapiens
cctgtaataaata

SEQ ID NO: 6091462 - DNA, 16 bp, Homo sapiens
cctgtaataaatatga

SEQ ID NO: 6091463 - DNA, 19 bp, Homo sapiens
cctgtaatagcctcacctt

SEQ ID NO: 6091464 - DNA, 17 bp, Homo sapiens
cctgtaatatatttata

SEQ ID NO: 6091465 - DNA, 23 bp, Homo sapiens
cctgtaatatatttatatacttt

SEQ ID NO: 6091466 - DNA, 15 bp, Homo sapiens
cctgtaatattatat

SEQ ID NO: 6091467 - DNA, 21 bp, Homo sapiens
cctgtaatcacaactcagcat

SEQ ID NO: 6091468 - DNA, 18 bp, Homo sapiens
cctgtaatcaggcaagga

SEQ ID NO: 6091469 - DNA, 19 bp, Homo sapiens
cctgtaatcaggcaaggag

SEQ ID NO: 6091470 - DNA, 22 bp, Homo sapiens
cctgtaatcaggcaaggaggag

SEQ ID NO: 6091471 - DNA, 20 bp, Homo sapiens
cctgtaatcatataataaat

SEQ ID NO: 6091472 - DNA, 18 bp, Homo sapiens
cctgtaatcccagcactt

SEQ ID NO: 6091473 - DNA, 20 bp, Homo sapiens
cctgtaatcccagcacttgg

SEQ ID NO: 6091474 - DNA, 19 bp, Homo sapiens
cctgtaatcccagcacttt

SEQ ID NO: 6091475 - DNA, 17 bp, Homo sapiens
cctgtaatcccagctac

SEQ ID NO: 6091476 - DNA, 23 bp, Homo sapiens
cctgtaatcccagctactcagga

SEQ ID NO: 6091477 - DNA, 19 bp, Homo sapiens
cctgtaatcccagtacttt

SEQ ID NO: 6091478 - DNA, 18 bp, Homo sapiens
cctgtaatctcagctact

SEQ ID NO: 6091479 - DNA, 16 bp, Homo sapiens
cctgtaatctttttct

SEQ ID NO: 6091480 - DNA, 21 bp, Homo sapiens
cctgtaatctttttctccacc

SEQ ID NO: 6091481 - DNA, 20 bp, Homo sapiens
cctgtaatgcactcctgccc

SEQ ID NO: 6091482 - DNA, 23 bp, Homo sapiens
cctgtaatggttgggaccaggcc

SEQ ID NO: 6091483 - DNA, 20 bp, Homo sapiens
cctgtaatgtacaattttat

SEQ ID NO: 6091484 - DNA, 14 bp, Homo sapiens
cctgtaattcagtg

SEQ ID NO: 6091485 - DNA, 17 bp, Homo sapiens
cctgtaattcagtgtat

SEQ ID NO: 6091486 - DNA, 21 bp, Homo sapiens
cctgtacaaaagggacatgaa

SEQ ID NO: 6091487 - DNA, 13 bp, Homo sapiens
cctgtacacacac

SEQ ID NO: 6091488 - DNA, 15 bp, Homo sapiens
cctgtacacacacag

SEQ ID NO: 6091489 - DNA, 19 bp, Homo sapiens
cctgtacacagtgccccct

SEQ ID NO: 6091490 - DNA, 21 bp, Homo sapiens
cctgtacactgaatatttata

SEQ ID NO: 6091491 - DNA, 20 bp, Homo sapiens
cctgtacagtagattttcca

SEQ ID NO: 6091492 - DNA, 23 bp, Homo sapiens
cctgtacatacgtgttctataga

SEQ ID NO: 6091493 - DNA, 14 bp, Homo sapiens
cctgtacatatctt

SEQ ID NO: 6091494 - DNA, 19 bp, Homo sapiens
cctgtacccaccccagcac

SEQ ID NO: 6091495 - DNA, 15 bp, Homo sapiens
cctgtacccagccac

SEQ ID NO: 6091496 - DNA, 16 bp, Homo sapiens
cctgtacccagccacc

SEQ ID NO: 6091497 - DNA, 15 bp, Homo sapiens
cctgtacccagctcc

SEQ ID NO: 6091498 - DNA, 14 bp, Homo sapiens
cctgtaccccagca

SEQ ID NO: 6091499 - DNA, 16 bp, Homo sapiens
cctgtacctcatccca

SEQ ID NO: 6091500 - DNA, 12 bp, Homo sapiens
cctgtacctctt

SEQ ID NO: 6091501 - DNA, 22 bp, Homo sapiens
cctgtaccttttgaggagcccc

SEQ ID NO: 6091502 - DNA, 15 bp, Homo sapiens
cctgtactaaggagc

SEQ ID NO: 6091503 - DNA, 22 bp, Homo sapiens
cctgtactaggattagaaaatt

SEQ ID NO: 6091504 - DNA, 19 bp, Homo sapiens
cctgtactatgatgggctt

SEQ ID NO: 6091505 - DNA, 21 bp, Homo sapiens
cctgtactatgatgggcttct

SEQ ID NO: 6091506 - DNA, 22 bp, Homo sapiens
cctgtactcaggaggctgaggg

SEQ ID NO: 6091507 - DNA, 23 bp, Homo sapiens
cctgtactcaggaggctgagggg

SEQ ID NO: 6091508 - DNA, 15 bp, Homo sapiens
cctgtactcatcggc

SEQ ID NO: 6091509 - DNA, 17 bp, Homo sapiens
cctgtactcgcttgtgc

SEQ ID NO: 6091510 - DNA, 15 bp, Homo sapiens
cctgtactcttccga

SEQ ID NO: 6091511 - DNA, 23 bp, Homo sapiens
cctgtactgaagaaaaggggagc

SEQ ID NO: 6091512 - DNA, 13 bp, Homo sapiens
cctgtactgcctg

SEQ ID NO: 6091513 - DNA, 16 bp, Homo sapiens
cctgtactgcctgctt

SEQ ID NO: 6091514 - DNA, 14 bp, Homo sapiens
cctgtactggagag

SEQ ID NO: 6091515 - DNA, 23 bp, Homo sapiens
cctgtactgtatggaaacactga

SEQ ID NO: 6091516 - DNA, 12 bp, Homo sapiens
cctgtacttttt

SEQ ID NO: 6091517 - DNA, 23 bp, Homo sapiens
cctgtagaactcaacctctacag

SEQ ID NO: 6091518 - DNA, 21 bp, Homo sapiens
cctgtagaatagcctgtggcc

SEQ ID NO: 6091519 - DNA, 23 bp, Homo sapiens
cctgtagacctagggaggacctt

SEQ ID NO: 6091520 - DNA, 20 bp, Homo sapiens
cctgtagagagagacctaga

SEQ ID NO: 6091521 - DNA, 18 bp, Homo sapiens
cctgtagagccagccttg

SEQ ID NO: 6091522 - DNA, 14 bp, Homo sapiens
cctgtagagctaga

SEQ ID NO: 6091523 - DNA, 21 bp, Homo sapiens
cctgtagagtgggagctgagt

SEQ ID NO: 6091524 - DNA, 16 bp, Homo sapiens
cctgtagagttgctga

SEQ ID NO: 6091525 - DNA, 22 bp, Homo sapiens
cctgtagatcagggatagcgct

SEQ ID NO: 6091526 - DNA, 15 bp, Homo sapiens
cctgtagatgcagaa

SEQ ID NO: 6091527 - DNA, 19 bp, Homo sapiens
cctgtagatgcagaaaaag

SEQ ID NO: 6091528 - DNA, 16 bp, Homo sapiens
cctgtagatgttctag

SEQ ID NO: 6091529 - DNA, 19 bp, Homo sapiens
cctgtagatgttctaggat

SEQ ID NO: 6091530 - DNA, 18 bp, Homo sapiens
cctgtagcaatggccaga

SEQ ID NO: 6091531 - DNA, 13 bp, Homo sapiens
cctgtagcacaaa

SEQ ID NO: 6091532 - DNA, 17 bp, Homo sapiens
cctgtagcacttactgg

SEQ ID NO: 6091533 - DNA, 13 bp, Homo sapiens
cctgtagcagtga

SEQ ID NO: 6091534 - DNA, 18 bp, Homo sapiens
cctgtagcatcttctgga

SEQ ID NO: 6091535 - DNA, 21 bp, Homo sapiens
cctgtagcatcttctggagtc

SEQ ID NO: 6091536 - DNA, 14 bp, Homo sapiens
cctgtagccctggc

SEQ ID NO: 6091537 - DNA, 15 bp, Homo sapiens
cctgtagccctggcc

SEQ ID NO: 6091538 - DNA, 15 bp, Homo sapiens
cctgtagcctataca

SEQ ID NO: 6091539 - DNA, 15 bp, Homo sapiens
cctgtagctcagtca

SEQ ID NO: 6091540 - DNA, 16 bp, Homo sapiens
cctgtagctcagtcat

SEQ ID NO: 6091541 - DNA, 13 bp, Homo sapiens
cctgtagctctgc

SEQ ID NO: 6091542 - DNA, 15 bp, Homo sapiens
cctgtagctctgcct

SEQ ID NO: 6091543 - DNA, 22 bp, Homo sapiens
cctgtagctttcctggtccctc

SEQ ID NO: 6091544 - DNA, 19 bp, Homo sapiens
cctgtaggaaggtactgta

SEQ ID NO: 6091545 - DNA, 18 bp, Homo sapiens
cctgtaggatttttttct

SEQ ID NO: 6091546 - DNA, 23 bp, Homo sapiens
cctgtagggaaaccttggagagg

SEQ ID NO: 6091547 - DNA, 15 bp, Homo sapiens
cctgtaggtcaggac

SEQ ID NO: 6091548 - DNA, 13 bp, Homo sapiens
cctgtagtcccag

SEQ ID NO: 6091549 - DNA, 14 bp, Homo sapiens
cctgtagtcccagc

SEQ ID NO: 6091550 - DNA, 15 bp, Homo sapiens
cctgtagtcccagct

SEQ ID NO: 6091551 - DNA, 13 bp, Homo sapiens
cctgtagtcctag

SEQ ID NO: 6091552 - DNA, 16 bp, Homo sapiens
cctgtagtctcagcta

SEQ ID NO: 6091553 - DNA, 18 bp, Homo sapiens
cctgtagtctcagctact

SEQ ID NO: 6091554 - DNA, 19 bp, Homo sapiens
cctgtagtgaatcctctgt

SEQ ID NO: 6091555 - DNA, 16 bp, Homo sapiens
cctgtagtgcccctcc

SEQ ID NO: 6091556 - DNA, 22 bp, Homo sapiens
cctgtagtgcccctcccatggc

SEQ ID NO: 6091557 - DNA, 14 bp, Homo sapiens
cctgtagttaggaa

SEQ ID NO: 6091558 - DNA, 14 bp, Homo sapiens
cctgtagttaggcc

SEQ ID NO: 6091559 - DNA, 20 bp, Homo sapiens
cctgtagttgacaattctgc

SEQ ID NO: 6091560 - DNA, 17 bp, Homo sapiens
cctgtagttttatttta

SEQ ID NO: 6091561 - DNA, 18 bp, Homo sapiens
cctgtataagtggaggca

SEQ ID NO: 6091562 - DNA, 16 bp, Homo sapiens
cctgtatacagtgcag

SEQ ID NO: 6091563 - DNA, 16 bp, Homo sapiens
cctgtatactcttgaa

SEQ ID NO: 6091564 - DNA, 21 bp, Homo sapiens
cctgtatactcttgaattcct

SEQ ID NO: 6091565 - DNA, 14 bp, Homo sapiens
cctgtatactttag

SEQ ID NO: 6091566 - DNA, 17 bp, Homo sapiens
cctgtatataatactaa

SEQ ID NO: 6091567 - DNA, 13 bp, Homo sapiens
cctgtatatagcc

SEQ ID NO: 6091568 - DNA, 21 bp, Homo sapiens
cctgtatatagcccagccagg

SEQ ID NO: 6091569 - DNA, 17 bp, Homo sapiens
cctgtatattatggtgt

SEQ ID NO: 6091570 - DNA, 22 bp, Homo sapiens
cctgtatcctccctggcagaca

SEQ ID NO: 6091571 - DNA, 22 bp, Homo sapiens
cctgtatgtctacctctgactt

SEQ ID NO: 6091572 - DNA, 15 bp, Homo sapiens
cctgtatgtctgtca

SEQ ID NO: 6091573 - DNA, 15 bp, Homo sapiens
cctgtatgtggtgtg

SEQ ID NO: 6091574 - DNA, 19 bp, Homo sapiens
cctgtatgtggtgtggggc

SEQ ID NO: 6091575 - DNA, 20 bp, Homo sapiens
cctgtatgttgtacaatcaa

SEQ ID NO: 6091576 - DNA, 13 bp, Homo sapiens
cctgtatgttgtc

SEQ ID NO: 6091577 - DNA, 14 bp, Homo sapiens
cctgtatgttgtcc

SEQ ID NO: 6091578 - DNA, 18 bp, Homo sapiens
cctgtatttaaaaataga

SEQ ID NO: 6091579 - DNA, 23 bp, Homo sapiens
cctgtatttaaaaatagaaacat

SEQ ID NO: 6091580 - DNA, 16 bp, Homo sapiens
cctgtatttaactcat

SEQ ID NO: 6091581 - DNA, 17 bp, Homo sapiens
cctgtatttgagagact

SEQ ID NO: 6091582 - DNA, 18 bp, Homo sapiens
cctgtcaaacaaagccag

SEQ ID NO: 6091583 - DNA, 19 bp, Homo sapiens
cctgtcaaacaaagccaga

SEQ ID NO: 6091584 - DNA, 14 bp, Homo sapiens
cctgtcaaacatta

SEQ ID NO: 6091585 - DNA, 21 bp, Homo sapiens
cctgtcaacaaggggtcaatg

SEQ ID NO: 6091586 - DNA, 15 bp, Homo sapiens
cctgtcaacctgaat

SEQ ID NO: 6091587 - DNA, 18 bp, Homo sapiens
cctgtcaacctgaattaa

SEQ ID NO: 6091588 - DNA, 13 bp, Homo sapiens
cctgtcaatatat

SEQ ID NO: 6091589 - DNA, 17 bp, Homo sapiens
cctgtcacacactggac

SEQ ID NO: 6091590 - DNA, 14 bp, Homo sapiens
cctgtcaccagagc

SEQ ID NO: 6091591 - DNA, 15 bp, Homo sapiens
cctgtcaccccagtc

SEQ ID NO: 6091592 - DNA, 16 bp, Homo sapiens
cctgtcaccccagtca

SEQ ID NO: 6091593 - DNA, 22 bp, Homo sapiens
cctgtcacccccactcccgcct

SEQ ID NO: 6091594 - DNA, 17 bp, Homo sapiens
cctgtcaccctgcagga

SEQ ID NO: 6091595 - DNA, 18 bp, Homo sapiens
cctgtcaccctgcaggac

SEQ ID NO: 6091596 - DNA, 13 bp, Homo sapiens
cctgtcaccctgg

SEQ ID NO: 6091597 - DNA, 14 bp, Homo sapiens
cctgtcacctcttc

SEQ ID NO: 6091598 - DNA, 16 bp, Homo sapiens
cctgtcacctcttccg

SEQ ID NO: 6091599 - DNA, 17 bp, Homo sapiens
cctgtcacctcttccga

SEQ ID NO: 6091600 - DNA, 16 bp, Homo sapiens
cctgtcacctggcctg

SEQ ID NO: 6091601 - DNA, 15 bp, Homo sapiens
cctgtcacgctctgg

SEQ ID NO: 6091602 - DNA, 14 bp, Homo sapiens
cctgtcactactgg

SEQ ID NO: 6091603 - DNA, 17 bp, Homo sapiens
cctgtcactcactgagg

SEQ ID NO: 6091604 - DNA, 19 bp, Homo sapiens
cctgtcactcagctgagaa

SEQ ID NO: 6091605 - DNA, 19 bp, Homo sapiens
cctgtcactgagcacagtc

SEQ ID NO: 6091606 - DNA, 15 bp, Homo sapiens
cctgtcactgatgga

SEQ ID NO: 6091607 - DNA, 19 bp, Homo sapiens
cctgtcacttgcacagagg

SEQ ID NO: 6091608 - DNA, 15 bp, Homo sapiens
cctgtcacttgctgg

SEQ ID NO: 6091609 - DNA, 14 bp, Homo sapiens
cctgtcagaataaa

SEQ ID NO: 6091610 - DNA, 20 bp, Homo sapiens
cctgtcagaataataaatat

SEQ ID NO: 6091611 - DNA, 21 bp, Homo sapiens
cctgtcagaataataaatatt

SEQ ID NO: 6091612 - DNA, 22 bp, Homo sapiens
cctgtcagaatcatgctgttct

SEQ ID NO: 6091613 - DNA, 20 bp, Homo sapiens
cctgtcagacgttggtccca

SEQ ID NO: 6091614 - DNA, 13 bp, Homo sapiens
cctgtcagagatc

SEQ ID NO: 6091615 - DNA, 19 bp, Homo sapiens
cctgtcagatccaggagct

SEQ ID NO: 6091616 - DNA, 23 bp, Homo sapiens
cctgtcagatccaggagctccag

SEQ ID NO: 6091617 - DNA, 16 bp, Homo sapiens
cctgtcagcatgaatt

SEQ ID NO: 6091618 - DNA, 17 bp, Homo sapiens
cctgtcagcatgaattt

SEQ ID NO: 6091619 - DNA, 19 bp, Homo sapiens
cctgtcagccaacattgcc

SEQ ID NO: 6091620 - DNA, 15 bp, Homo sapiens
ccgctctccctgtca

SEQ ID NO: 6091621 - DNA, 22 bp, Homo sapiens
ccgctctccctgtcacgctcat

SEQ ID NO: 6091622 - DNA, 14 bp, Homo sapiens
ccgctctccgcccc

SEQ ID NO: 6091623 - DNA, 16 bp, Homo sapiens
ccgctctcctgccaca

SEQ ID NO: 6091624 - DNA, 19 bp, Homo sapiens
ccgctctctctgagggggt

SEQ ID NO: 6091625 - DNA, 15 bp, Homo sapiens
ccgctctcttcctgc

SEQ ID NO: 6091626 - DNA, 16 bp, Homo sapiens
ccgctctcttcctgcc

SEQ ID NO: 6091627 - DNA, 20 bp, Homo sapiens
ccgctctgcatgcggcccag

SEQ ID NO: 6091628 - DNA, 22 bp, Homo sapiens
ccgctctgccatcagcccctgc

SEQ ID NO: 6091629 - DNA, 18 bp, Homo sapiens
ccgctctggatcctgcac

SEQ ID NO: 6091630 - DNA, 19 bp, Homo sapiens
ccgctctggatcctgcact

SEQ ID NO: 6091631 - DNA, 20 bp, Homo sapiens
ccgctgaagatggagggggc

SEQ ID NO: 6091632 - DNA, 13 bp, Homo sapiens
ccgctgaccctgg

SEQ ID NO: 6091633 - DNA, 17 bp, Homo sapiens
ccgctgaccctgggcct

SEQ ID NO: 6091634 - DNA, 18 bp, Homo sapiens
ccgctgacgcttcccttg

SEQ ID NO: 6091635 - DNA, 11 bp, Homo sapiens
ccgctgagccc

SEQ ID NO: 6091636 - DNA, 16 bp, Homo sapiens
ccgctgagcccactct

SEQ ID NO: 6091637 - DNA, 15 bp, Homo sapiens
ccgctgagcttggag

SEQ ID NO: 6091638 - DNA, 19 bp, Homo sapiens
ccgctgagtggactggagt

SEQ ID NO: 6091639 - DNA, 15 bp, Homo sapiens
ccgctgcacacagac

SEQ ID NO: 6091640 - DNA, 20 bp, Homo sapiens
ccgctgcacacagacggcct

SEQ ID NO: 6091641 - DNA, 13 bp, Homo sapiens
ccgctgcacctgc

SEQ ID NO: 6091642 - DNA, 19 bp, Homo sapiens
ccgctgcagtcagcacaga

SEQ ID NO: 6091643 - DNA, 20 bp, Homo sapiens
ccgctgccaccacgtctgcc

SEQ ID NO: 6091644 - DNA, 15 bp, Homo sapiens
ccgctgccacccacc

SEQ ID NO: 6091645 - DNA, 16 bp, Homo sapiens
ccgctgccacccacct

SEQ ID NO: 6091646 - DNA, 19 bp, Homo sapiens
ccgctgccacccgcccacc

SEQ ID NO: 6091647 - DNA, 20 bp, Homo sapiens
ccgctgccacccgcccaccc

SEQ ID NO: 6091648 - DNA, 15 bp, Homo sapiens
ccgctgccagcacag

SEQ ID NO: 6091649 - DNA, 16 bp, Homo sapiens
ccgctgccagcacaga

SEQ ID NO: 6091650 - DNA, 19 bp, Homo sapiens
ccgctgccatgctttgagt

SEQ ID NO: 6091651 - DNA, 19 bp, Homo sapiens
ccgctgcccagccctccca

SEQ ID NO: 6091652 - DNA, 12 bp, Homo sapiens
ccgctgcccagg

SEQ ID NO: 6091653 - DNA, 16 bp, Homo sapiens
ccgctgccccagcccc

SEQ ID NO: 6091654 - DNA, 17 bp, Homo sapiens
ccgctgcccccaccctg

SEQ ID NO: 6091655 - DNA, 18 bp, Homo sapiens
ccgctgcccccaccctgc

SEQ ID NO: 6091656 - DNA, 20 bp, Homo sapiens
ccgctgcccccaccctgctt

SEQ ID NO: 6091657 - DNA, 23 bp, Homo sapiens
ccgctgcccctccccgtccctgt

SEQ ID NO: 6091658 - DNA, 15 bp, Homo sapiens
ccgctgcccctgagt

SEQ ID NO: 6091659 - DNA, 15 bp, Homo sapiens
ccgctgccctgggtc

SEQ ID NO: 6091660 - DNA, 20 bp, Homo sapiens
ccgctgccctgggtcctgcc

SEQ ID NO: 6091661 - DNA, 15 bp, Homo sapiens
ccgctgccctttggc

SEQ ID NO: 6091662 - DNA, 21 bp, Homo sapiens
ccgctgccctttggccaacag

SEQ ID NO: 6091663 - DNA, 23 bp, Homo sapiens
ccgctgccgtgccgcctgcactc

SEQ ID NO: 6091664 - DNA, 11 bp, Homo sapiens
ccgctgcctct

SEQ ID NO: 6091665 - DNA, 14 bp, Homo sapiens
ccgctgcctcttgg

SEQ ID NO: 6091666 - DNA, 23 bp, Homo sapiens
ccgctgcctcttggcttctcagc

SEQ ID NO: 6091667 - DNA, 14 bp, Homo sapiens
ccgctgcctgcact

SEQ ID NO: 6091668 - DNA, 14 bp, Homo sapiens
ccgctgcctggaac

SEQ ID NO: 6091669 - DNA, 13 bp, Homo sapiens
ccgctgcctggcg

SEQ ID NO: 6091670 - DNA, 19 bp, Homo sapiens
ccgctgcctggcgggcagc

SEQ ID NO: 6091671 - DNA, 23 bp, Homo sapiens
ccgctgcctggcgggcagcccct

SEQ ID NO: 6091672 - DNA, 14 bp, Homo sapiens
ccgctgcgctgccc

SEQ ID NO: 6091673 - DNA, 15 bp, Homo sapiens
ccgctgcgctgccct

SEQ ID NO: 6091674 - DNA, 19 bp, Homo sapiens
ccgctgcgctgccctgcaa

SEQ ID NO: 6091675 - DNA, 21 bp, Homo sapiens
ccgctgcgctgccctgcaaac

SEQ ID NO: 6091676 - DNA, 17 bp, Homo sapiens
ccgctgctgtgacaggc

SEQ ID NO: 6091677 - DNA, 14 bp, Homo sapiens
ccgctgctgtgcaa

SEQ ID NO: 6091678 - DNA, 13 bp, Homo sapiens
ccgctgctgtgct

SEQ ID NO: 6091679 - DNA, 20 bp, Homo sapiens
ccgctgctgtgctctgggga

SEQ ID NO: 6091680 - DNA, 16 bp, Homo sapiens
ccgctggagcatgagc

SEQ ID NO: 6091681 - DNA, 21 bp, Homo sapiens
ccgctggagcccacagcgagc

SEQ ID NO: 6091682 - DNA, 19 bp, Homo sapiens
ccgctggaggtggggcctg

SEQ ID NO: 6091683 - DNA, 12 bp, Homo sapiens
ccgctggcccag

SEQ ID NO: 6091684 - DNA, 13 bp, Homo sapiens
ccgctggcccagg

SEQ ID NO: 6091685 - DNA, 15 bp, Homo sapiens
ccgctggcccagggt

SEQ ID NO: 6091686 - DNA, 14 bp, Homo sapiens
ccgctggcccttag

SEQ ID NO: 6091687 - DNA, 15 bp, Homo sapiens
ccgctggcccttaga

SEQ ID NO: 6091688 - DNA, 22 bp, Homo sapiens
ccgctggcccttagagaccccg

SEQ ID NO: 6091689 - DNA, 22 bp, Homo sapiens
ccgctggccgagctgaagaact

SEQ ID NO: 6091690 - DNA, 15 bp, Homo sapiens
ccgctggctcctcca

SEQ ID NO: 6091691 - DNA, 20 bp, Homo sapiens
ccgctggctcctccaggcac

SEQ ID NO: 6091692 - DNA, 18 bp, Homo sapiens
ccgctggctgggggcctc

SEQ ID NO: 6091693 - DNA, 22 bp, Homo sapiens
ccgctggctgggggcctcactc

SEQ ID NO: 6091694 - DNA, 18 bp, Homo sapiens
ccgctggctggtgggccc

SEQ ID NO: 6091695 - DNA, 19 bp, Homo sapiens
ccgctgggagaaaagccag

SEQ ID NO: 6091696 - DNA, 21 bp, Homo sapiens
ccgctgggagaaaagccagat

SEQ ID NO: 6091697 - DNA, 22 bp, Homo sapiens
ccgctgggagaaaagccagatg

SEQ ID NO: 6091698 - DNA, 12 bp, Homo sapiens
ccgctgggcttc

SEQ ID NO: 6091699 - DNA, 23 bp, Homo sapiens
ccgctgggcttcattccggactg

SEQ ID NO: 6091700 - DNA, 18 bp, Homo sapiens
ccgctggggaacagagcg

SEQ ID NO: 6091701 - DNA, 20 bp, Homo sapiens
ccgctggggaccggttccca

SEQ ID NO: 6091702 - DNA, 17 bp, Homo sapiens
ccgctgggggctggcag

SEQ ID NO: 6091703 - DNA, 21 bp, Homo sapiens
ccgctgggggctggcagaggg

SEQ ID NO: 6091704 - DNA, 13 bp, Homo sapiens
ccgctgggttctg

SEQ ID NO: 6091705 - DNA, 23 bp, Homo sapiens
ccgctgggttctgactctggacc

SEQ ID NO: 6091706 - DNA, 15 bp, Homo sapiens
ccgctggtccctgcc

SEQ ID NO: 6091707 - DNA, 22 bp, Homo sapiens
ccgctggtccctgccctcccct

SEQ ID NO: 6091708 - DNA, 12 bp, Homo sapiens
ccgctgtaattc

SEQ ID NO: 6091709 - DNA, 15 bp, Homo sapiens
ccgctgtcacccagc

SEQ ID NO: 6091710 - DNA, 15 bp, Homo sapiens
ccgctgtcccagggg

SEQ ID NO: 6091711 - DNA, 16 bp, Homo sapiens
ccgctgtcgccccagg

SEQ ID NO: 6091712 - DNA, 20 bp, Homo sapiens
ccgctgtcgccccaggccct

SEQ ID NO: 6091713 - DNA, 18 bp, Homo sapiens
ccgctgtctccctcctga

SEQ ID NO: 6091714 - DNA, 13 bp, Homo sapiens
ccgctgtgccagg

SEQ ID NO: 6091715 - DNA, 17 bp, Homo sapiens
ccgctgtgcccccctcc

SEQ ID NO: 6091716 - DNA, 12 bp, Homo sapiens
ccgctgtgcccg

SEQ ID NO: 6091717 - DNA, 18 bp, Homo sapiens
ccgctgtgcccgccctgg

SEQ ID NO: 6091718 - DNA, 21 bp, Homo sapiens
ccgctgtggccgcacgcctct

SEQ ID NO: 6091719 - DNA, 19 bp, Homo sapiens
ccgctgtggccggtgccag

SEQ ID NO: 6091720 - DNA, 14 bp, Homo sapiens
ccgctgttcaccca

SEQ ID NO: 6091721 - DNA, 18 bp, Homo sapiens
ccgctgttcacccacagg

SEQ ID NO: 6091722 - DNA, 16 bp, Homo sapiens
ccgcttagcgctctgg

SEQ ID NO: 6091723 - DNA, 19 bp, Homo sapiens
ccgcttagcgctctggaca

SEQ ID NO: 6091724 - DNA, 12 bp, Homo sapiens
ccgcttcaagct

SEQ ID NO: 6091725 - DNA, 16 bp, Homo sapiens
ccgcttcaagctctct

SEQ ID NO: 6091726 - DNA, 17 bp, Homo sapiens
ccgcttcaagctctctg

SEQ ID NO: 6091727 - DNA, 19 bp, Homo sapiens
ccgcttcaagctctctgtt

SEQ ID NO: 6091728 - DNA, 15 bp, Homo sapiens
ccgcttccagcttcc

SEQ ID NO: 6091729 - DNA, 18 bp, Homo sapiens
ccgcttccagcttcctct

SEQ ID NO: 6091730 - DNA, 18 bp, Homo sapiens
ccgcttccccacagaact

SEQ ID NO: 6091731 - DNA, 19 bp, Homo sapiens
ccgcttccccacagaactg

SEQ ID NO: 6091732 - DNA, 15 bp, Homo sapiens
ccgcttccctattta

SEQ ID NO: 6091733 - DNA, 13 bp, Homo sapiens
ccgcttcctccgg

SEQ ID NO: 6091734 - DNA, 13 bp, Homo sapiens
ccgcttcctggcc

SEQ ID NO: 6091735 - DNA, 13 bp, Homo sapiens
ccgcttcctgttt

SEQ ID NO: 6091736 - DNA, 16 bp, Homo sapiens
ccgcttcgccatgtgc

SEQ ID NO: 6091737 - DNA, 15 bp, Homo sapiens
ccgcttctcctgcag

SEQ ID NO: 6091738 - DNA, 18 bp, Homo sapiens
ccgcttctctcggtgtgg

SEQ ID NO: 6091739 - DNA, 23 bp, Homo sapiens
ccgcttgaaaagctagtgtacct

SEQ ID NO: 6091740 - DNA, 18 bp, Homo sapiens
ccgcttgcctcggctcct

SEQ ID NO: 6091741 - DNA, 14 bp, Homo sapiens
ccgcttgctcgctt

SEQ ID NO: 6091742 - DNA, 17 bp, Homo sapiens
ccgcttgctctcctgga

SEQ ID NO: 6091743 - DNA, 18 bp, Homo sapiens
ccgcttgctctcctggag

SEQ ID NO: 6091744 - DNA, 15 bp, Homo sapiens
ccgcttggagcagag

SEQ ID NO: 6091745 - DNA, 17 bp, Homo sapiens
ccgcttggagcagaggg

SEQ ID NO: 6091746 - DNA, 20 bp, Homo sapiens
ccgcttggagctattttcca

SEQ ID NO: 6091747 - DNA, 17 bp, Homo sapiens
ccgcttggtggcctggg

SEQ ID NO: 6091748 - DNA, 16 bp, Homo sapiens
ccgcttgtccagcgcc

SEQ ID NO: 6091749 - DNA, 17 bp, Homo sapiens
ccgcttgtccagcgcct

SEQ ID NO: 6091750 - DNA, 18 bp, Homo sapiens
ccgcttgtccagcgccta

SEQ ID NO: 6091751 - DNA, 19 bp, Homo sapiens
ccgcttgtccagcgcctag

SEQ ID NO: 6091752 - DNA, 16 bp, Homo sapiens
ccgcttgtggggaccc

SEQ ID NO: 6091753 - DNA, 19 bp, Homo sapiens
ccgcttgtggggacccagg

SEQ ID NO: 6091754 - DNA, 16 bp, Homo sapiens
ccgctttcctggagcc

SEQ ID NO: 6091755 - DNA, 19 bp, Homo sapiens
ccgctttctctgagggggt

SEQ ID NO: 6091756 - DNA, 17 bp, Homo sapiens
ccgctttgaaagaagca

SEQ ID NO: 6091757 - DNA, 14 bp, Homo sapiens
ccgctttgcctgct

SEQ ID NO: 6091758 - DNA, 15 bp, Homo sapiens
ccgcttttgcagcag

SEQ ID NO: 6091759 - DNA, 19 bp, Homo sapiens
ccgcttttgcagcagagga

SEQ ID NO: 6091760 - DNA, 22 bp, Homo sapiens
ccggaacagccaaagaaactca

SEQ ID NO: 6091761 - DNA, 14 bp, Homo sapiens
ccggaaccacaggg

SEQ ID NO: 6091762 - DNA, 13 bp, Homo sapiens
ccggaactgggct

SEQ ID NO: 6091763 - DNA, 14 bp, Homo sapiens
ccggaactgggctg

SEQ ID NO: 6091764 - DNA, 17 bp, Homo sapiens
ccggaagatcagatgca

SEQ ID NO: 6091765 - DNA, 21 bp, Homo sapiens
ccggaaggggcgctcctccca

SEQ ID NO: 6091766 - DNA, 14 bp, Homo sapiens
ccggaatagagcct

SEQ ID NO: 6091767 - DNA, 20 bp, Homo sapiens
ccggaatgccacccacatct

SEQ ID NO: 6091768 - DNA, 14 bp, Homo sapiens
ccggaattgtattt

SEQ ID NO: 6091769 - DNA, 22 bp, Homo sapiens
ccggacaagcccaggacactgc

SEQ ID NO: 6091770 - DNA, 12 bp, Homo sapiens
ccggacacaagc

SEQ ID NO: 6091771 - DNA, 22 bp, Homo sapiens
ccggacacacctctgctccaaa

SEQ ID NO: 6091772 - DNA, 17 bp, Homo sapiens
ccggacacttctcagga

SEQ ID NO: 6091773 - DNA, 11 bp, Homo sapiens
ccggacagagg

SEQ ID NO: 6091774 - DNA, 16 bp, Homo sapiens
ccggacagctgcccag

SEQ ID NO: 6091775 - DNA, 18 bp, Homo sapiens
ccggacagctgcccagac

SEQ ID NO: 6091776 - DNA, 14 bp, Homo sapiens
ccggacagggtggc

SEQ ID NO: 6091777 - DNA, 13 bp, Homo sapiens
ccggacaggtggg

SEQ ID NO: 6091778 - DNA, 15 bp, Homo sapiens
ccggacaggtggggc

SEQ ID NO: 6091779 - DNA, 18 bp, Homo sapiens
ccggacatactctctgcc

SEQ ID NO: 6091780 - DNA, 15 bp, Homo sapiens
ccggaccagcctggc

SEQ ID NO: 6091781 - DNA, 22 bp, Homo sapiens
ccggacccggccgccgccagga

SEQ ID NO: 6091782 - DNA, 21 bp, Homo sapiens
ccggaccctctaacctcgccc

SEQ ID NO: 6091783 - DNA, 19 bp, Homo sapiens
ccggaccgccgatcccagg

SEQ ID NO: 6091784 - DNA, 16 bp, Homo sapiens
ccggacctacctccct

SEQ ID NO: 6091785 - DNA, 12 bp, Homo sapiens
ccggacctctga

SEQ ID NO: 6091786 - DNA, 14 bp, Homo sapiens
ccggacgcaggtgc

SEQ ID NO: 6091787 - DNA, 19 bp, Homo sapiens
ccggacgctggagaccctg

SEQ ID NO: 6091788 - DNA, 23 bp, Homo sapiens
ccggacggacgttggttctgcac

SEQ ID NO: 6091789 - DNA, 20 bp, Homo sapiens
ccggacgggggagctttccc

SEQ ID NO: 6091790 - DNA, 16 bp, Homo sapiens
ccggactctgatctct

SEQ ID NO: 6091791 - DNA, 17 bp, Homo sapiens
ccggactggcagaagca

SEQ ID NO: 6091792 - DNA, 12 bp, Homo sapiens
ccggactggtgc

SEQ ID NO: 6091793 - DNA, 13 bp, Homo sapiens
ccggactggtgcc

SEQ ID NO: 6091794 - DNA, 17 bp, Homo sapiens
ccggactggtgccctcc

SEQ ID NO: 6091795 - DNA, 20 bp, Homo sapiens
ccggactttcggagttgggg

SEQ ID NO: 6091796 - DNA, 15 bp, Homo sapiens
ccggacttttctgca

SEQ ID NO: 6091797 - DNA, 16 bp, Homo sapiens
ccggagacccacagcc

SEQ ID NO: 6091798 - DNA, 20 bp, Homo sapiens
ccggagacccacagccctga

SEQ ID NO: 6091799 - DNA, 13 bp, Homo sapiens
ccggagagccagc

SEQ ID NO: 6091800 - DNA, 16 bp, Homo sapiens
cctgtcagctccttga

SEQ ID NO: 6091801 - DNA, 13 bp, Homo sapiens
cctgtcaggaggc

SEQ ID NO: 6091802 - DNA, 16 bp, Homo sapiens
cctgtcaggctctggc

SEQ ID NO: 6091803 - DNA, 23 bp, Homo sapiens
cctgtcaggctctggcccttgcc

SEQ ID NO: 6091804 - DNA, 13 bp, Homo sapiens
cctgtcagtgccg

SEQ ID NO: 6091805 - DNA, 14 bp, Homo sapiens
cctgtcagtgccgc

SEQ ID NO: 6091806 - DNA, 19 bp, Homo sapiens
cctgtcagtgtcaccttgg

SEQ ID NO: 6091807 - DNA, 14 bp, Homo sapiens
cctgtcagtttccc

SEQ ID NO: 6091808 - DNA, 18 bp, Homo sapiens
cctgtcagtttcccctct

SEQ ID NO: 6091809 - DNA, 20 bp, Homo sapiens
cctgtcatagagctgcaggg

SEQ ID NO: 6091810 - DNA, 21 bp, Homo sapiens
cctgtcatctgagaatgaaca

SEQ ID NO: 6091811 - DNA, 19 bp, Homo sapiens
cctgtcatgcccccctcaa

SEQ ID NO: 6091812 - DNA, 21 bp, Homo sapiens
cctgtcatgcccccctcaaac

SEQ ID NO: 6091813 - DNA, 19 bp, Homo sapiens
cctgtcatggctctgaact

SEQ ID NO: 6091814 - DNA, 14 bp, Homo sapiens
cctgtcattcctct

SEQ ID NO: 6091815 - DNA, 23 bp, Homo sapiens
cctgtcattcgtggttgatttca

SEQ ID NO: 6091816 - DNA, 20 bp, Homo sapiens
cctgtcattgtattcagata

SEQ ID NO: 6091817 - DNA, 19 bp, Homo sapiens
cctgtcattttgcactgta

SEQ ID NO: 6091818 - DNA, 22 bp, Homo sapiens
cctgtccaaaagcgccctcact

SEQ ID NO: 6091819 - DNA, 23 bp, Homo sapiens
cctgtccaaactgcctaagccct

SEQ ID NO: 6091820 - DNA, 19 bp, Homo sapiens
cctgtccaacctaacccct

SEQ ID NO: 6091821 - DNA, 16 bp, Homo sapiens
cctgtccaatctttga

SEQ ID NO: 6091822 - DNA, 19 bp, Homo sapiens
cctgtccacctgtgctgct

SEQ ID NO: 6091823 - DNA, 13 bp, Homo sapiens
cctgtccactctg

SEQ ID NO: 6091824 - DNA, 19 bp, Homo sapiens
cctgtccactctgctcagg

SEQ ID NO: 6091825 - DNA, 21 bp, Homo sapiens
cctgtccactctgctcagggc

SEQ ID NO: 6091826 - DNA, 13 bp, Homo sapiens
cctgtccagagag

SEQ ID NO: 6091827 - DNA, 12 bp, Homo sapiens
cctgtccagcct

SEQ ID NO: 6091828 - DNA, 16 bp, Homo sapiens
cctgtccagcctgggc

SEQ ID NO: 6091829 - DNA, 14 bp, Homo sapiens
cctgtccataaagt

SEQ ID NO: 6091830 - DNA, 15 bp, Homo sapiens
cctgtccatccccag

SEQ ID NO: 6091831 - DNA, 18 bp, Homo sapiens
cctgtccatccccagttg

SEQ ID NO: 6091832 - DNA, 11 bp, Homo sapiens
cctgtcccacc

SEQ ID NO: 6091833 - DNA, 20 bp, Homo sapiens
cctgtcccaccaactctgca

SEQ ID NO: 6091834 - DNA, 21 bp, Homo sapiens
cctgtcccaccaactctgcac

SEQ ID NO: 6091835 - DNA, 16 bp, Homo sapiens
cctgtcccacccacac

SEQ ID NO: 6091836 - DNA, 21 bp, Homo sapiens
cctgtcccacccacacagctg

SEQ ID NO: 6091837 - DNA, 13 bp, Homo sapiens
cctgtcccacccc

SEQ ID NO: 6091838 - DNA, 17 bp, Homo sapiens
cctgtcccacccccacc

SEQ ID NO: 6091839 - DNA, 22 bp, Homo sapiens
cctgtcccacccccttccccca

SEQ ID NO: 6091840 - DNA, 12 bp, Homo sapiens
cctgtcccacct

SEQ ID NO: 6091841 - DNA, 14 bp, Homo sapiens
cctgtcccacctct

SEQ ID NO: 6091842 - DNA, 15 bp, Homo sapiens
cctgtcccacctggc

SEQ ID NO: 6091843 - DNA, 15 bp, Homo sapiens
cctgtcccactggct

SEQ ID NO: 6091844 - DNA, 16 bp, Homo sapiens
cctgtcccactggctc

SEQ ID NO: 6091845 - DNA, 12 bp, Homo sapiens
cctgtcccagca

SEQ ID NO: 6091846 - DNA, 12 bp, Homo sapiens
cctgtcccagga

SEQ ID NO: 6091847 - DNA, 14 bp, Homo sapiens
cctgtcccaggcag

SEQ ID NO: 6091848 - DNA, 15 bp, Homo sapiens
cctgtcccaggcagc

SEQ ID NO: 6091849 - DNA, 22 bp, Homo sapiens
cctgtcccaggcagcgccactg

SEQ ID NO: 6091850 - DNA, 14 bp, Homo sapiens
cctgtcccaggccg

SEQ ID NO: 6091851 - DNA, 21 bp, Homo sapiens
cctgtcccaggccggcccaga

SEQ ID NO: 6091852 - DNA, 16 bp, Homo sapiens
cctgtcccagggccct

SEQ ID NO: 6091853 - DNA, 16 bp, Homo sapiens
cctgtcccatggacac

SEQ ID NO: 6091854 - DNA, 19 bp, Homo sapiens
cctgtcccatgggctctgg

SEQ ID NO: 6091855 - DNA, 17 bp, Homo sapiens
cctgtcccattctagat

SEQ ID NO: 6091856 - DNA, 18 bp, Homo sapiens
cctgtcccattctagatc

SEQ ID NO: 6091857 - DNA, 20 bp, Homo sapiens
cctgtccccaaaatgtgatg

SEQ ID NO: 6091858 - DNA, 20 bp, Homo sapiens
cctgtccccaaacaggacag

SEQ ID NO: 6091859 - DNA, 14 bp, Homo sapiens
cctgtccccaccct

SEQ ID NO: 6091860 - DNA, 18 bp, Homo sapiens
cctgtccccaggcccagc

SEQ ID NO: 6091861 - DNA, 19 bp, Homo sapiens
cctgtccccaggcccagcc

SEQ ID NO: 6091862 - DNA, 20 bp, Homo sapiens
cctgtccccaggcccagccc

SEQ ID NO: 6091863 - DNA, 18 bp, Homo sapiens
cctgtccccagtccccag

SEQ ID NO: 6091864 - DNA, 19 bp, Homo sapiens
cctgtccccagtccccagc

SEQ ID NO: 6091865 - DNA, 20 bp, Homo sapiens
cctgtccccagtccccagcc

SEQ ID NO: 6091866 - DNA, 21 bp, Homo sapiens
cctgtccccagtccccagccc

SEQ ID NO: 6091867 - DNA, 14 bp, Homo sapiens
cctgtcccccaagg

SEQ ID NO: 6091868 - DNA, 15 bp, Homo sapiens
cctgtcccccaaggt

SEQ ID NO: 6091869 - DNA, 16 bp, Homo sapiens
cctgtcccccactctc

SEQ ID NO: 6091870 - DNA, 13 bp, Homo sapiens
cctgtcccccagc

SEQ ID NO: 6091871 - DNA, 14 bp, Homo sapiens
cctgtcccccagca

SEQ ID NO: 6091872 - DNA, 15 bp, Homo sapiens
cctgtcccccagcat

SEQ ID NO: 6091873 - DNA, 17 bp, Homo sapiens
cctgtcccccagctctg

SEQ ID NO: 6091874 - DNA, 16 bp, Homo sapiens
cctgtccccctcccct

SEQ ID NO: 6091875 - DNA, 17 bp, Homo sapiens
cctgtccccctcccctc

SEQ ID NO: 6091876 - DNA, 13 bp, Homo sapiens
cctgtccccctga

SEQ ID NO: 6091877 - DNA, 14 bp, Homo sapiens
cctgtccccctgac

SEQ ID NO: 6091878 - DNA, 22 bp, Homo sapiens
cctgtccccgccttccctcact

SEQ ID NO: 6091879 - DNA, 14 bp, Homo sapiens
cctgtcccctaggg

SEQ ID NO: 6091880 - DNA, 15 bp, Homo sapiens
cctgtcccctatgcc

SEQ ID NO: 6091881 - DNA, 14 bp, Homo sapiens
cctgtcccctcaca

SEQ ID NO: 6091882 - DNA, 14 bp, Homo sapiens
cctgtcccctcagc

SEQ ID NO: 6091883 - DNA, 19 bp, Homo sapiens
cctgtcccctccttccagc

SEQ ID NO: 6091884 - DNA, 22 bp, Homo sapiens
cctgtcccctccttccagcctg

SEQ ID NO: 6091885 - DNA, 18 bp, Homo sapiens
cctgtcccctgaaaaact

SEQ ID NO: 6091886 - DNA, 13 bp, Homo sapiens
cctgtcccctgga

SEQ ID NO: 6091887 - DNA, 13 bp, Homo sapiens
cctgtcccgcctt

SEQ ID NO: 6091888 - DNA, 16 bp, Homo sapiens
cctgtccctacccact

SEQ ID NO: 6091889 - DNA, 20 bp, Homo sapiens
cctgtccctagctcacactc

SEQ ID NO: 6091890 - DNA, 12 bp, Homo sapiens
cctgtccctagg

SEQ ID NO: 6091891 - DNA, 17 bp, Homo sapiens
cctgtccctccaggccc

SEQ ID NO: 6091892 - DNA, 18 bp, Homo sapiens
cctgtccctcccacctct

SEQ ID NO: 6091893 - DNA, 19 bp, Homo sapiens
cctgtccctcccacctctg

SEQ ID NO: 6091894 - DNA, 15 bp, Homo sapiens
cctgtccctcccact

SEQ ID NO: 6091895 - DNA, 16 bp, Homo sapiens
cctgtccctcccactc

SEQ ID NO: 6091896 - DNA, 15 bp, Homo sapiens
cctgtccctctcagg

SEQ ID NO: 6091897 - DNA, 16 bp, Homo sapiens
cctgtccctctcaggc

SEQ ID NO: 6091898 - DNA, 23 bp, Homo sapiens
cctgtccctctcgccctggccag

SEQ ID NO: 6091899 - DNA, 11 bp, Homo sapiens
cctgtccctgc

SEQ ID NO: 6091900 - DNA, 14 bp, Homo sapiens
cctgtccctgcccc

SEQ ID NO: 6091901 - DNA, 23 bp, Homo sapiens
cctgtccctgccccgccccccag

SEQ ID NO: 6091902 - DNA, 15 bp, Homo sapiens
cctgtccctggccat

SEQ ID NO: 6091903 - DNA, 17 bp, Homo sapiens
cctgtccctggccatct

SEQ ID NO: 6091904 - DNA, 19 bp, Homo sapiens
cctgtccctggccatctct

SEQ ID NO: 6091905 - DNA, 12 bp, Homo sapiens
cctgtccctggg

SEQ ID NO: 6091906 - DNA, 13 bp, Homo sapiens
cctgtccctggga

SEQ ID NO: 6091907 - DNA, 14 bp, Homo sapiens
cctgtcccttcttg

SEQ ID NO: 6091908 - DNA, 14 bp, Homo sapiens
cctgtcccttgcct

SEQ ID NO: 6091909 - DNA, 16 bp, Homo sapiens
cctgtcccttgcctct

SEQ ID NO: 6091910 - DNA, 23 bp, Homo sapiens
cctgtcccttgcctctgccctgg

SEQ ID NO: 6091911 - DNA, 15 bp, Homo sapiens
cctgtcccttttccc

SEQ ID NO: 6091912 - DNA, 18 bp, Homo sapiens
cctgtcccttttccctta

SEQ ID NO: 6091913 - DNA, 14 bp, Homo sapiens
cctgtccggaccgc

SEQ ID NO: 6091914 - DNA, 18 bp, Homo sapiens
cctgtccggagcgaccct

SEQ ID NO: 6091915 - DNA, 16 bp, Homo sapiens
cctgtccggcccagtg

SEQ ID NO: 6091916 - DNA, 17 bp, Homo sapiens
cctgtccggcccagtgc

SEQ ID NO: 6091917 - DNA, 17 bp, Homo sapiens
cctgtcctaaggaacct

SEQ ID NO: 6091918 - DNA, 20 bp, Homo sapiens
cctgtcctagcaggatctgc

SEQ ID NO: 6091919 - DNA, 21 bp, Homo sapiens
cctgtcctagcaggatctgcc

SEQ ID NO: 6091920 - DNA, 17 bp, Homo sapiens
cctgtcctcaccgtctc

SEQ ID NO: 6091921 - DNA, 16 bp, Homo sapiens
cctgtcctcactgctc

SEQ ID NO: 6091922 - DNA, 22 bp, Homo sapiens
cctgtcctcactgctccctgaa

SEQ ID NO: 6091923 - DNA, 13 bp, Homo sapiens
cctgtcctccaac

SEQ ID NO: 6091924 - DNA, 17 bp, Homo sapiens
cctgtcctcccacccct

SEQ ID NO: 6091925 - DNA, 22 bp, Homo sapiens
cctgtcctcccatcccctggac

SEQ ID NO: 6091926 - DNA, 15 bp, Homo sapiens
cctgtcctcctcgga

SEQ ID NO: 6091927 - DNA, 16 bp, Homo sapiens
cctgtcctctttcagc

SEQ ID NO: 6091928 - DNA, 22 bp, Homo sapiens
cctgtcctctttcagctcctga

SEQ ID NO: 6091929 - DNA, 13 bp, Homo sapiens
cctgtcctgaaag

SEQ ID NO: 6091930 - DNA, 22 bp, Homo sapiens
cctgtcctgaaagcggctgcct

SEQ ID NO: 6091931 - DNA, 23 bp, Homo sapiens
cctgtcctgaaagcggctgcctc

SEQ ID NO: 6091932 - DNA, 19 bp, Homo sapiens
cctgtcctgacctgtctca

SEQ ID NO: 6091933 - DNA, 13 bp, Homo sapiens
cctgtcctgatgg

SEQ ID NO: 6091934 - DNA, 12 bp, Homo sapiens
cctgtcctgcac

SEQ ID NO: 6091935 - DNA, 14 bp, Homo sapiens
cctgtcctgcacac

SEQ ID NO: 6091936 - DNA, 14 bp, Homo sapiens
cctgtcctgcctcc

SEQ ID NO: 6091937 - DNA, 15 bp, Homo sapiens
cctgtcctgcctcct

SEQ ID NO: 6091938 - DNA, 16 bp, Homo sapiens
cctgtcctgcctcctc

SEQ ID NO: 6091939 - DNA, 22 bp, Homo sapiens
cctgtcctgcctctctgctcca

SEQ ID NO: 6091940 - DNA, 14 bp, Homo sapiens
cctgtcctgctcac

SEQ ID NO: 6091941 - DNA, 18 bp, Homo sapiens
cctgtcctgggctggtgg

SEQ ID NO: 6091942 - DNA, 15 bp, Homo sapiens
cctgtcctgtgaatg

SEQ ID NO: 6091943 - DNA, 19 bp, Homo sapiens
cctgtcctgtgaatggaag

SEQ ID NO: 6091944 - DNA, 19 bp, Homo sapiens
cctgtccttactcagagct

SEQ ID NO: 6091945 - DNA, 20 bp, Homo sapiens
cctgtccttactcagagctg

SEQ ID NO: 6091946 - DNA, 19 bp, Homo sapiens
cctgtccttagcctaggcc

SEQ ID NO: 6091947 - DNA, 10 bp, Homo sapiens
cctgtccttc

SEQ ID NO: 6091948 - DNA, 22 bp, Homo sapiens
cctgtccttctacagaacctga

SEQ ID NO: 6091949 - DNA, 21 bp, Homo sapiens
cctgtccttctctcacctcct

SEQ ID NO: 6091950 - DNA, 23 bp, Homo sapiens
cctgtccttgtcacgatcacagg

SEQ ID NO: 6091951 - DNA, 15 bp, Homo sapiens
cctgtcctttcttgc

SEQ ID NO: 6091952 - DNA, 17 bp, Homo sapiens
cctgtcctttgttatta

SEQ ID NO: 6091953 - DNA, 15 bp, Homo sapiens
cctgtcgagacactt

SEQ ID NO: 6091954 - DNA, 20 bp, Homo sapiens
cctgtcgagacacttgcctt

SEQ ID NO: 6091955 - DNA, 20 bp, Homo sapiens
cctgtcgcccacccagctgg

SEQ ID NO: 6091956 - DNA, 13 bp, Homo sapiens
cctgtcgcccctc

SEQ ID NO: 6091957 - DNA, 21 bp, Homo sapiens
cctgtcggagccctgtctcct

SEQ ID NO: 6091958 - DNA, 20 bp, Homo sapiens
cctgtcggccacaccccaga

SEQ ID NO: 6091959 - DNA, 22 bp, Homo sapiens
cctgtcggccacaccccagact

SEQ ID NO: 6091960 - DNA, 13 bp, Homo sapiens
cctgtcggcctgg

SEQ ID NO: 6091961 - DNA, 15 bp, Homo sapiens
cctgtcgggcccgca

SEQ ID NO: 6091962 - DNA, 16 bp, Homo sapiens
cctgtcggtctccagt

SEQ ID NO: 6091963 - DNA, 18 bp, Homo sapiens
cctgtcggtggctgcctt

SEQ ID NO: 6091964 - DNA, 23 bp, Homo sapiens
cctgtctaaagccttaactaaga

SEQ ID NO: 6091965 - DNA, 21 bp, Homo sapiens
cctgtctaacctacgacccca

SEQ ID NO: 6091966 - DNA, 19 bp, Homo sapiens
cctgtctaacttggggaag

SEQ ID NO: 6091967 - DNA, 18 bp, Homo sapiens
cctgtctactcatccaga

SEQ ID NO: 6091968 - DNA, 17 bp, Homo sapiens
cctgtctagagagggag

SEQ ID NO: 6091969 - DNA, 19 bp, Homo sapiens
cctgtctaggtctcctcag

SEQ ID NO: 6091970 - DNA, 20 bp, Homo sapiens
cctgtctaggtctcctcagg

SEQ ID NO: 6091971 - DNA, 21 bp, Homo sapiens
cctgtctaggtctcctcaggg

SEQ ID NO: 6091972 - DNA, 21 bp, Homo sapiens
cctgtctagtctctcctgtaa

SEQ ID NO: 6091973 - DNA, 22 bp, Homo sapiens
cctgtctagtctctcctgtaag

SEQ ID NO: 6091974 - DNA, 20 bp, Homo sapiens
cctgtctataagagaattat

SEQ ID NO: 6091975 - DNA, 22 bp, Homo sapiens
cctgtctcaatagctccaagct

SEQ ID NO: 6091976 - DNA, 15 bp, Homo sapiens
cctgtctcagcctcc

SEQ ID NO: 6091977 - DNA, 18 bp, Homo sapiens
cctgtctcagcctcctga

SEQ ID NO: 6091978 - DNA, 15 bp, Homo sapiens
cctgtctcagctgtt

SEQ ID NO: 6091979 - DNA, 16 bp, Homo sapiens
cctgtctcatagcctc

SEQ ID NO: 6091980 - DNA, 21 bp, Homo sapiens
cctgtctcatcttctgaagag

SEQ ID NO: 6091981 - DNA, 16 bp, Homo sapiens
cctgtctccaagaatg

SEQ ID NO: 6091982 - DNA, 16 bp, Homo sapiens
cctgtctccactgtgc

SEQ ID NO: 6091983 - DNA, 23 bp, Homo sapiens
cctgtctccactgtgcctttgca

SEQ ID NO: 6091984 - DNA, 14 bp, Homo sapiens
cctgtctccagctg

SEQ ID NO: 6091985 - DNA, 16 bp, Homo sapiens
cctgtctccagctgcc

SEQ ID NO: 6091986 - DNA, 13 bp, Homo sapiens
cctgtctccaggg

SEQ ID NO: 6091987 - DNA, 17 bp, Homo sapiens
cctgtctccatgataac

SEQ ID NO: 6091988 - DNA, 20 bp, Homo sapiens
cctgtctcccaccctttctg

SEQ ID NO: 6091989 - DNA, 12 bp, Homo sapiens
cctgtctcccag

SEQ ID NO: 6091990 - DNA, 21 bp, Homo sapiens
cctgtctcccggctcccctcc

SEQ ID NO: 6091991 - DNA, 17 bp, Homo sapiens
cctgtctcctctgtcag

SEQ ID NO: 6091992 - DNA, 14 bp, Homo sapiens
cctgtctcgccaga

SEQ ID NO: 6091993 - DNA, 14 bp, Homo sapiens
cctgtctcggggct

SEQ ID NO: 6091994 - DNA, 16 bp, Homo sapiens
cctgtctctaaaaaga

SEQ ID NO: 6091995 - DNA, 23 bp, Homo sapiens
cctgtctctaaaaagaagccaca

SEQ ID NO: 6091996 - DNA, 18 bp, Homo sapiens
cctgtctctattagctgg

SEQ ID NO: 6091997 - DNA, 21 bp, Homo sapiens
cctgtctctcagggccaggcc

SEQ ID NO: 6091998 - DNA, 14 bp, Homo sapiens
cctgtctctcccta

SEQ ID NO: 6091999 - DNA, 21 bp, Homo sapiens
cctgtctctccctaccctctt

SEQ ID NO: 6092000 - DNA, 15 bp, Homo sapiens
cctgtctctccttgt

SEQ ID NO: 6092001 - DNA, 14 bp, Homo sapiens
cctgtctctgcaca

SEQ ID NO: 6092002 - DNA, 14 bp, Homo sapiens
cctgtctctggcta

SEQ ID NO: 6092003 - DNA, 22 bp, Homo sapiens
cctgtctctggctactccctgg

SEQ ID NO: 6092004 - DNA, 13 bp, Homo sapiens
cctgtctcttcca

SEQ ID NO: 6092005 - DNA, 18 bp, Homo sapiens
cctgtctcttgggaagca

SEQ ID NO: 6092006 - DNA, 20 bp, Homo sapiens
cctgtctgaaggacacttcc

SEQ ID NO: 6092007 - DNA, 15 bp, Homo sapiens
cctgtctgcaggcca

SEQ ID NO: 6092008 - DNA, 14 bp, Homo sapiens
cctgtctgccagcc

SEQ ID NO: 6092009 - DNA, 15 bp, Homo sapiens
cctgtctgccagcca

SEQ ID NO: 6092010 - DNA, 19 bp, Homo sapiens
cctgtctgccagccagcag

SEQ ID NO: 6092011 - DNA, 20 bp, Homo sapiens
cctgtctgccccagcccaga

SEQ ID NO: 6092012 - DNA, 18 bp, Homo sapiens
cctgtctgctaggcgctg

SEQ ID NO: 6092013 - DNA, 15 bp, Homo sapiens
cctgtctgctccagc

SEQ ID NO: 6092014 - DNA, 13 bp, Homo sapiens
cctgtctgctgcc

SEQ ID NO: 6092015 - DNA, 15 bp, Homo sapiens
cctgtctgctgccag

SEQ ID NO: 6092016 - DNA, 15 bp, Homo sapiens
cctgtctgctgggct

SEQ ID NO: 6092017 - DNA, 22 bp, Homo sapiens
cctgtctgcttgcatctgcaca

SEQ ID NO: 6092018 - DNA, 23 bp, Homo sapiens
cctgtctggaagacgtggctctg

SEQ ID NO: 6092019 - DNA, 23 bp, Homo sapiens
cctgtctgtagagggccctggtg

SEQ ID NO: 6092020 - DNA, 13 bp, Homo sapiens
cctgtctgtccaa

SEQ ID NO: 6092021 - DNA, 15 bp, Homo sapiens
cctgtctgtccaacc

SEQ ID NO: 6092022 - DNA, 21 bp, Homo sapiens
cctgtctgtccaacccctccc

SEQ ID NO: 6092023 - DNA, 16 bp, Homo sapiens
cctgtctgtccctttt

SEQ ID NO: 6092024 - DNA, 20 bp, Homo sapiens
cctgtctgtctgtctctctt

SEQ ID NO: 6092025 - DNA, 11 bp, Homo sapiens
cctgtctgtga

SEQ ID NO: 6092026 - DNA, 19 bp, Homo sapiens
cctgtctgtgaagagcaag

SEQ ID NO: 6092027 - DNA, 13 bp, Homo sapiens
cctgtctgtgacc

SEQ ID NO: 6092028 - DNA, 22 bp, Homo sapiens
cctgtctgtgacctgcatctaa

SEQ ID NO: 6092029 - DNA, 14 bp, Homo sapiens
cctgtctgtgcaga

SEQ ID NO: 6092030 - DNA, 21 bp, Homo sapiens
cctgtctgtgtcccagccacg

SEQ ID NO: 6092031 - DNA, 24 bp, Homo sapiens
cctgtctgtgtcccagccacgcag

SEQ ID NO: 6092032 - DNA, 17 bp, Homo sapiens
cctgtctgttcccagcc

SEQ ID NO: 6092033 - DNA, 19 bp, Homo sapiens
cctgtctgttcccagcccc

SEQ ID NO: 6092034 - DNA, 14 bp, Homo sapiens
cctgtctgtttgct

SEQ ID NO: 6092035 - DNA, 22 bp, Homo sapiens
cctgtcttatcctccaccgtct

SEQ ID NO: 6092036 - DNA, 16 bp, Homo sapiens
cctgtcttcacctgcc

SEQ ID NO: 6092037 - DNA, 19 bp, Homo sapiens
cctgtcttcacctgccacc

SEQ ID NO: 6092038 - DNA, 22 bp, Homo sapiens
cctgtcttcacctgccaccaca

SEQ ID NO: 6092039 - DNA, 16 bp, Homo sapiens
cctgtcttcagatcct

SEQ ID NO: 6092040 - DNA, 20 bp, Homo sapiens
cctgtcttcagatcctgctg

SEQ ID NO: 6092041 - DNA, 23 bp, Homo sapiens
cctgtcttcagatcctgctgccg

SEQ ID NO: 6092042 - DNA, 12 bp, Homo sapiens
cctgtcttcctc

SEQ ID NO: 6092043 - DNA, 14 bp, Homo sapiens
cctgtcttcctctg

SEQ ID NO: 6092044 - DNA, 15 bp, Homo sapiens
cctgtcttcctctgc

SEQ ID NO: 6092045 - DNA, 16 bp, Homo sapiens
cctgtcttcctctgca

SEQ ID NO: 6092046 - DNA, 19 bp, Homo sapiens
cctgtcttcctctgcaagt

SEQ ID NO: 6092047 - DNA, 15 bp, Homo sapiens
cctgtcttcctgcat

SEQ ID NO: 6092048 - DNA, 22 bp, Homo sapiens
cctgtcttcctgcattcaccca

SEQ ID NO: 6092049 - DNA, 17 bp, Homo sapiens
cctgtcttctctcccac

SEQ ID NO: 6092050 - DNA, 13 bp, Homo sapiens
cctgtcttctgct

SEQ ID NO: 6092051 - DNA, 14 bp, Homo sapiens
cctgtcttctgggc

SEQ ID NO: 6092052 - DNA, 21 bp, Homo sapiens
cctgtcttctgggcacagtgg

SEQ ID NO: 6092053 - DNA, 14 bp, Homo sapiens
cctgtcttctttct

SEQ ID NO: 6092054 - DNA, 15 bp, Homo sapiens
cctgtcttctttctc

SEQ ID NO: 6092055 - DNA, 19 bp, Homo sapiens
cctgtcttgcctttttcat

SEQ ID NO: 6092056 - DNA, 13 bp, Homo sapiens
cctgtcttgctcc

SEQ ID NO: 6092057 - DNA, 21 bp, Homo sapiens
cctgtcttgctcctggggaga

SEQ ID NO: 6092058 - DNA, 17 bp, Homo sapiens
cctgtcttggggccact

SEQ ID NO: 6092059 - DNA, 23 bp, Homo sapiens
cctgtcttgtcaggtggaccctg

SEQ ID NO: 6092060 - DNA, 14 bp, Homo sapiens
cctgtctttgctgt

SEQ ID NO: 6092061 - DNA, 23 bp, Homo sapiens
cctgtctttgctgtttatatata

SEQ ID NO: 6092062 - DNA, 21 bp, Homo sapiens
cctgtctttgttgtctccctc

SEQ ID NO: 6092063 - DNA, 19 bp, Homo sapiens
cctgtgaaatagttcaaag

SEQ ID NO: 6092064 - DNA, 16 bp, Homo sapiens
cctgtgaactgaactc

SEQ ID NO: 6092065 - DNA, 16 bp, Homo sapiens
cctgtgaactgccagg

SEQ ID NO: 6092066 - DNA, 17 bp, Homo sapiens
cctgtgaatcaatcctg

SEQ ID NO: 6092067 - DNA, 17 bp, Homo sapiens
cctgtgaatgccactgc

SEQ ID NO: 6092068 - DNA, 21 bp, Homo sapiens
cctgtgaatgccactgccttc

SEQ ID NO: 6092069 - DNA, 14 bp, Homo sapiens
cctgtgacaaaatt

SEQ ID NO: 6092070 - DNA, 18 bp, Homo sapiens
cctgtgacatggtgcctg

SEQ ID NO: 6092071 - DNA, 22 bp, Homo sapiens
cctgtgacatggtgcctgagag

SEQ ID NO: 6092072 - DNA, 18 bp, Homo sapiens
cctgtgaccacaacatga

SEQ ID NO: 6092073 - DNA, 19 bp, Homo sapiens
cctgtgaccacaacatgag

SEQ ID NO: 6092074 - DNA, 17 bp, Homo sapiens
cctgtgaccagcactgt

SEQ ID NO: 6092075 - DNA, 15 bp, Homo sapiens
cctgtgaccctctca

SEQ ID NO: 6092076 - DNA, 18 bp, Homo sapiens
cctgtgaccctctcactt

SEQ ID NO: 6092077 - DNA, 20 bp, Homo sapiens
cctgtgaccctctcactttg

SEQ ID NO: 6092078 - DNA, 19 bp, Homo sapiens
cctgtgaccctctttgctg

SEQ ID NO: 6092079 - DNA, 16 bp, Homo sapiens
cctgtgaccggggtcc

SEQ ID NO: 6092080 - DNA, 18 bp, Homo sapiens
cctgtgaccggggtcctg

SEQ ID NO: 6092081 - DNA, 19 bp, Homo sapiens
cctgtgaccggggtcctga

SEQ ID NO: 6092082 - DNA, 23 bp, Homo sapiens
cctgtgaccggggtcctgaggct

SEQ ID NO: 6092083 - DNA, 16 bp, Homo sapiens
cctgtgacctggtctg

SEQ ID NO: 6092084 - DNA, 21 bp, Homo sapiens
cctgtgacctggtctggtcag

SEQ ID NO: 6092085 - DNA, 15 bp, Homo sapiens
cctgtgagaaaggaa

SEQ ID NO: 6092086 - DNA, 18 bp, Homo sapiens
cctgtgagaaaggaaaaa

SEQ ID NO: 6092087 - DNA, 14 bp, Homo sapiens
cctgtgagatgtgt

SEQ ID NO: 6092088 - DNA, 18 bp, Homo sapiens
cctgtgagcacaaagaag

SEQ ID NO: 6092089 - DNA, 21 bp, Homo sapiens
cctgtgagcacaaagaagaaa

SEQ ID NO: 6092090 - DNA, 13 bp, Homo sapiens
cctgtgagcatcc

SEQ ID NO: 6092091 - DNA, 13 bp, Homo sapiens
cctgtgagccagt

SEQ ID NO: 6092092 - DNA, 15 bp, Homo sapiens
cctgtgagcccagct

SEQ ID NO: 6092093 - DNA, 20 bp, Homo sapiens
cctgtgagctccccaatcca

SEQ ID NO: 6092094 - DNA, 23 bp, Homo sapiens
cctgtgaggatagagacttgcag

SEQ ID NO: 6092095 - DNA, 17 bp, Homo sapiens
cctgtgaggcaggggcg

SEQ ID NO: 6092096 - DNA, 20 bp, Homo sapiens
cctgtgaggggcccctggcc

SEQ ID NO: 6092097 - DNA, 19 bp, Homo sapiens
cctgtgaggtgcagagtgc

SEQ ID NO: 6092098 - DNA, 17 bp, Homo sapiens
cctgtgaggtttcccaa

SEQ ID NO: 6092099 - DNA, 19 bp, Homo sapiens
cctgtgaggtttcccaatg

SEQ ID NO: 6092100 - DNA, 17 bp, Homo sapiens
cctgtgatacatttctg

SEQ ID NO: 6092101 - DNA, 16 bp, Homo sapiens
cctgtgatatgtctgc

SEQ ID NO: 6092102 - DNA, 20 bp, Homo sapiens
cctgtgatccacccaaccct

SEQ ID NO: 6092103 - DNA, 15 bp, Homo sapiens
cctgtgatcgtgtgt

SEQ ID NO: 6092104 - DNA, 16 bp, Homo sapiens
cctgtgatcgtgtgtt

SEQ ID NO: 6092105 - DNA, 21 bp, Homo sapiens
cctgtgatctgtgtacaattt

SEQ ID NO: 6092106 - DNA, 22 bp, Homo sapiens
cctgtgatcttatttttctaaa

SEQ ID NO: 6092107 - DNA, 14 bp, Homo sapiens
cctgtgatgcctga

SEQ ID NO: 6092108 - DNA, 21 bp, Homo sapiens
cctgtgatggggccctgcctc

SEQ ID NO: 6092109 - DNA, 12 bp, Homo sapiens
cctgtgatgtca

SEQ ID NO: 6092110 - DNA, 22 bp, Homo sapiens
cctgtgatgtcagcggtgcagc

SEQ ID NO: 6092111 - DNA, 18 bp, Homo sapiens
cctgtgatgttttatcct

SEQ ID NO: 6092112 - DNA, 17 bp, Homo sapiens
cctgtgatttctgtgcc

SEQ ID NO: 6092113 - DNA, 19 bp, Homo sapiens
cctgtgatttctgtgccat

SEQ ID NO: 6092114 - DNA, 19 bp, Homo sapiens
cctgtgcaaaataaaatga

SEQ ID NO: 6092115 - DNA, 22 bp, Homo sapiens
cctgtgcaattcagtctgctct

SEQ ID NO: 6092116 - DNA, 12 bp, Homo sapiens
cctgtgcacaca

SEQ ID NO: 6092117 - DNA, 14 bp, Homo sapiens
cctgtgcacacaca

SEQ ID NO: 6092118 - DNA, 22 bp, Homo sapiens
cctgtgcacacacacacacatg

SEQ ID NO: 6092119 - DNA, 13 bp, Homo sapiens
cctgtgcacagcc

SEQ ID NO: 6092120 - DNA, 14 bp, Homo sapiens
cctgtgcactgggc

SEQ ID NO: 6092121 - DNA, 12 bp, Homo sapiens
cctgtgcagaag

SEQ ID NO: 6092122 - DNA, 13 bp, Homo sapiens
cctgtgcagaagg

SEQ ID NO: 6092123 - DNA, 17 bp, Homo sapiens
cctgtgcagaaggtctg

SEQ ID NO: 6092124 - DNA, 19 bp, Homo sapiens
cctgtgcagaccttactca

SEQ ID NO: 6092125 - DNA, 15 bp, Homo sapiens
cctgtgcagatgctg

SEQ ID NO: 6092126 - DNA, 18 bp, Homo sapiens
cctgtgcagcagcccagc

SEQ ID NO: 6092127 - DNA, 23 bp, Homo sapiens
cctgtgcagcagcccagcttcct

SEQ ID NO: 6092128 - DNA, 21 bp, Homo sapiens
cctgtgcagccgctgagcgag

SEQ ID NO: 6092129 - DNA, 19 bp, Homo sapiens
cctgtgcagggccctctgg

SEQ ID NO: 6092130 - DNA, 19 bp, Homo sapiens
cctgtgcagtagagagcct

SEQ ID NO: 6092131 - DNA, 20 bp, Homo sapiens
cctgtgcagtagagagcctt

SEQ ID NO: 6092132 - DNA, 21 bp, Homo sapiens
cctgtgccacccaccagggcg

SEQ ID NO: 6092133 - DNA, 15 bp, Homo sapiens
cctgtgccacctgca

SEQ ID NO: 6092134 - DNA, 14 bp, Homo sapiens
cctgtgccagccca

SEQ ID NO: 6092135 - DNA, 13 bp, Homo sapiens
cctgtgccagctc

SEQ ID NO: 6092136 - DNA, 15 bp, Homo sapiens
cctgtgccagctcag

SEQ ID NO: 6092137 - DNA, 15 bp, Homo sapiens
cctgtgccaggctga

SEQ ID NO: 6092138 - DNA, 14 bp, Homo sapiens
cctgtgccaggtga

SEQ ID NO: 6092139 - DNA, 13 bp, Homo sapiens
cctgtgccatgcc

SEQ ID NO: 6092140 - DNA, 14 bp, Homo sapiens
cctgtgccatgccc

SEQ ID NO: 6092141 - DNA, 19 bp, Homo sapiens
cctgtgccatgcccaaggc

SEQ ID NO: 6092142 - DNA, 23 bp, Homo sapiens
cctgtgcccacatcccaggcttc

SEQ ID NO: 6092143 - DNA, 15 bp, Homo sapiens
cctgtgcccacccag

SEQ ID NO: 6092144 - DNA, 17 bp, Homo sapiens
cctgtgcccacgtgtgc

SEQ ID NO: 6092145 - DNA, 24 bp, Homo sapiens
cctgtgcccacgtgtgcagactgt

SEQ ID NO: 6092146 - DNA, 12 bp, Homo sapiens
cctgtgcccact

SEQ ID NO: 6092147 - DNA, 16 bp, Homo sapiens
cctgtgcccactccct

SEQ ID NO: 6092148 - DNA, 19 bp, Homo sapiens
cctgtgcccactccctatc

SEQ ID NO: 6092149 - DNA, 21 bp, Homo sapiens
cctgtgcccactccctatctc

SEQ ID NO: 6092150 - DNA, 17 bp, Homo sapiens
cctgtgcccatcatctc

SEQ ID NO: 6092151 - DNA, 20 bp, Homo sapiens
cctgtgcccatcatctctgc

SEQ ID NO: 6092152 - DNA, 15 bp, Homo sapiens
cctgtgccccagctg

SEQ ID NO: 6092153 - DNA, 20 bp, Homo sapiens
cctgtgccccagctgccagg

SEQ ID NO: 6092154 - DNA, 21 bp, Homo sapiens
cctgtgccccagctgccaggc

SEQ ID NO: 6092155 - DNA, 13 bp, Homo sapiens
cctgtgccccagt

SEQ ID NO: 6092156 - DNA, 20 bp, Homo sapiens
cctgtgcccccagcctcagc

SEQ ID NO: 6092157 - DNA, 21 bp, Homo sapiens
cctgtgccccgaccccacctg

SEQ ID NO: 6092158 - DNA, 12 bp, Homo sapiens
ccggagaggaag

SEQ ID NO: 6092159 - DNA, 14 bp, Homo sapiens
ccggagaggaccgg

SEQ ID NO: 6092160 - DNA, 15 bp, Homo sapiens
ccggagaggtggccg

SEQ ID NO: 6092161 - DNA, 15 bp, Homo sapiens
ccggagatgcatctg

SEQ ID NO: 6092162 - DNA, 17 bp, Homo sapiens
ccggagattggacggcc

SEQ ID NO: 6092163 - DNA, 19 bp, Homo sapiens
ccggagattggacggcctg

SEQ ID NO: 6092164 - DNA, 18 bp, Homo sapiens
ccggagcaaactctgctg

SEQ ID NO: 6092165 - DNA, 13 bp, Homo sapiens
ccggagcaagcag

SEQ ID NO: 6092166 - DNA, 14 bp, Homo sapiens
ccggagcacagccc

SEQ ID NO: 6092167 - DNA, 16 bp, Homo sapiens
ccggagcacagccctg

SEQ ID NO: 6092168 - DNA, 20 bp, Homo sapiens
ccggagcacagccctgggag

SEQ ID NO: 6092169 - DNA, 19 bp, Homo sapiens
ccggagcaggggtctgagc

SEQ ID NO: 6092170 - DNA, 17 bp, Homo sapiens
ccggagcagttggcctg

SEQ ID NO: 6092171 - DNA, 13 bp, Homo sapiens
ccggagcccagat

SEQ ID NO: 6092172 - DNA, 22 bp, Homo sapiens
ccggagccccaagactctgctc

SEQ ID NO: 6092173 - DNA, 13 bp, Homo sapiens
ccggagcctcatg

SEQ ID NO: 6092174 - DNA, 19 bp, Homo sapiens
ccggagcctcatgttctct

SEQ ID NO: 6092175 - DNA, 17 bp, Homo sapiens
ccggagcctgtgcagcc

SEQ ID NO: 6092176 - DNA, 19 bp, Homo sapiens
ccggagcgaccctggctct

SEQ ID NO: 6092177 - DNA, 20 bp, Homo sapiens
ccggagcgccctgcagggcc

SEQ ID NO: 6092178 - DNA, 22 bp, Homo sapiens
ccggagcgccctgcagggccgg

SEQ ID NO: 6092179 - DNA, 22 bp, Homo sapiens
ccggagctaacactggccccta

SEQ ID NO: 6092180 - DNA, 24 bp, Homo sapiens
ccggagctaagtcacccagagcac

SEQ ID NO: 6092181 - DNA, 18 bp, Homo sapiens
ccggagctgcccctctct

SEQ ID NO: 6092182 - DNA, 15 bp, Homo sapiens
ccggagctttcaaag

SEQ ID NO: 6092183 - DNA, 16 bp, Homo sapiens
ccggaggactgagccc

SEQ ID NO: 6092184 - DNA, 17 bp, Homo sapiens
ccggaggagcagcctcg

SEQ ID NO: 6092185 - DNA, 13 bp, Homo sapiens
ccggaggccagct

SEQ ID NO: 6092186 - DNA, 19 bp, Homo sapiens
ccggaggccagctatctgc

SEQ ID NO: 6092187 - DNA, 23 bp, Homo sapiens
ccggaggccagctatctgcctga

SEQ ID NO: 6092188 - DNA, 16 bp, Homo sapiens
ccggaggccgggccct

SEQ ID NO: 6092189 - DNA, 22 bp, Homo sapiens
ccggaggccttggggtgggggc

SEQ ID NO: 6092190 - DNA, 19 bp, Homo sapiens
ccggaggcgcccacctgcc

SEQ ID NO: 6092191 - DNA, 22 bp, Homo sapiens
ccggagggaaccctgactacag

SEQ ID NO: 6092192 - DNA, 17 bp, Homo sapiens
ccggagggaagggacgg

SEQ ID NO: 6092193 - DNA, 13 bp, Homo sapiens
ccggagggcagga

SEQ ID NO: 6092194 - DNA, 16 bp, Homo sapiens
ccggaggggcctggca

SEQ ID NO: 6092195 - DNA, 17 bp, Homo sapiens
ccggaggggcctggcag

SEQ ID NO: 6092196 - DNA, 21 bp, Homo sapiens
ccggaggggcctggcagccgt

SEQ ID NO: 6092197 - DNA, 18 bp, Homo sapiens
ccggagggtgtttatgta

SEQ ID NO: 6092198 - DNA, 19 bp, Homo sapiens
ccggaggtgtcaccttcct

SEQ ID NO: 6092199 - DNA, 21 bp, Homo sapiens
ccggagtaatcaggcagcctt

SEQ ID NO: 6092200 - DNA, 17 bp, Homo sapiens
ccggagtccactcccag

SEQ ID NO: 6092201 - DNA, 21 bp, Homo sapiens
ccggatattttttttttaatt

SEQ ID NO: 6092202 - DNA, 19 bp, Homo sapiens
ccggatcagagcaggacct

SEQ ID NO: 6092203 - DNA, 15 bp, Homo sapiens
ccggatcctgggtgg

SEQ ID NO: 6092204 - DNA, 14 bp, Homo sapiens
ccggatcctgttgc

SEQ ID NO: 6092205 - DNA, 12 bp, Homo sapiens
ccggatctccag

SEQ ID NO: 6092206 - DNA, 14 bp, Homo sapiens
ccggatctccaggc

SEQ ID NO: 6092207 - DNA, 17 bp, Homo sapiens
ccggatctccaggccca

SEQ ID NO: 6092208 - DNA, 19 bp, Homo sapiens
ccggatctccaggcccagc

SEQ ID NO: 6092209 - DNA, 19 bp, Homo sapiens
ccggatgacacaaatacca

SEQ ID NO: 6092210 - DNA, 14 bp, Homo sapiens
ccggatgcagaggc

SEQ ID NO: 6092211 - DNA, 22 bp, Homo sapiens
ccggatgcagaggcctgcaggg

SEQ ID NO: 6092212 - DNA, 18 bp, Homo sapiens
ccggatgccagccccgtg

SEQ ID NO: 6092213 - DNA, 16 bp, Homo sapiens
ccggatgcccacccct

SEQ ID NO: 6092214 - DNA, 19 bp, Homo sapiens
ccggatggaatcacagcca

SEQ ID NO: 6092215 - DNA, 14 bp, Homo sapiens
ccggatgtgctttt

SEQ ID NO: 6092216 - DNA, 15 bp, Homo sapiens
ccggatgtgcttttc

SEQ ID NO: 6092217 - DNA, 20 bp, Homo sapiens
ccggattccggccctggctg

SEQ ID NO: 6092218 - DNA, 14 bp, Homo sapiens
ccggattggccctg

SEQ ID NO: 6092219 - DNA, 19 bp, Homo sapiens
ccggattggccctgcccct

SEQ ID NO: 6092220 - DNA, 11 bp, Homo sapiens
ccggatttcta

SEQ ID NO: 6092221 - DNA, 17 bp, Homo sapiens
ccggatttctaacagtc

SEQ ID NO: 6092222 - DNA, 17 bp, Homo sapiens
ccggcaaccccagttct

SEQ ID NO: 6092223 - DNA, 14 bp, Homo sapiens
ccggcaacctgtaa

SEQ ID NO: 6092224 - DNA, 17 bp, Homo sapiens
ccggcaacctgtaactg

SEQ ID NO: 6092225 - DNA, 20 bp, Homo sapiens
ccggcaagcgcttctgctga

SEQ ID NO: 6092226 - DNA, 17 bp, Homo sapiens
ccggcaataaaagccca

SEQ ID NO: 6092227 - DNA, 23 bp, Homo sapiens
ccggcaataaaagcccaggagcc

SEQ ID NO: 6092228 - DNA, 15 bp, Homo sapiens
ccggcacactgccaa

SEQ ID NO: 6092229 - DNA, 16 bp, Homo sapiens
ccggcacactgccaaa

SEQ ID NO: 6092230 - DNA, 17 bp, Homo sapiens
ccggcacagctgggata

SEQ ID NO: 6092231 - DNA, 16 bp, Homo sapiens
ccggcaccccctgcag

SEQ ID NO: 6092232 - DNA, 17 bp, Homo sapiens
ccggcaccccctgcagc

SEQ ID NO: 6092233 - DNA, 13 bp, Homo sapiens
ccggcactgggtt

SEQ ID NO: 6092234 - DNA, 13 bp, Homo sapiens
ccggcagagctct

SEQ ID NO: 6092235 - DNA, 16 bp, Homo sapiens
ccggcagccagatggc

SEQ ID NO: 6092236 - DNA, 20 bp, Homo sapiens
ccggcagccagatggccccg

SEQ ID NO: 6092237 - DNA, 19 bp, Homo sapiens
ccggcagccccagcctgct

SEQ ID NO: 6092238 - DNA, 12 bp, Homo sapiens
ccggcagccccc

SEQ ID NO: 6092239 - DNA, 20 bp, Homo sapiens
ccggcagcgaggctgggctg

SEQ ID NO: 6092240 - DNA, 11 bp, Homo sapiens
ccggcaggccc

SEQ ID NO: 6092241 - DNA, 13 bp, Homo sapiens
ccggcaggccctg

SEQ ID NO: 6092242 - DNA, 14 bp, Homo sapiens
ccggcaggccctgc

SEQ ID NO: 6092243 - DNA, 17 bp, Homo sapiens
ccggcaggccctgcagt

SEQ ID NO: 6092244 - DNA, 16 bp, Homo sapiens
ccggcaggcctgagaa

SEQ ID NO: 6092245 - DNA, 11 bp, Homo sapiens
ccggcagggcg

SEQ ID NO: 6092246 - DNA, 16 bp, Homo sapiens
ccggcagggcgggcag

SEQ ID NO: 6092247 - DNA, 17 bp, Homo sapiens
ccggcagtgctggttct

SEQ ID NO: 6092248 - DNA, 20 bp, Homo sapiens
ccggcagtgctggttctcca

SEQ ID NO: 6092249 - DNA, 17 bp, Homo sapiens
ccggcagttctgggtgc

SEQ ID NO: 6092250 - DNA, 22 bp, Homo sapiens
ccggcagttctgggtgctccct

SEQ ID NO: 6092251 - DNA, 19 bp, Homo sapiens
ccggcatcatttcccctcc

SEQ ID NO: 6092252 - DNA, 11 bp, Homo sapiens
ccggcatcctg

SEQ ID NO: 6092253 - DNA, 14 bp, Homo sapiens
ccggcatcctgaaa

SEQ ID NO: 6092254 - DNA, 17 bp, Homo sapiens
ccggcatctcccctagc

SEQ ID NO: 6092255 - DNA, 23 bp, Homo sapiens
ccggcatctcccctagctcacca

SEQ ID NO: 6092256 - DNA, 22 bp, Homo sapiens
ccggcatgagactcagtgcaga

SEQ ID NO: 6092257 - DNA, 23 bp, Homo sapiens
ccggcatgagactcagtgcagat

SEQ ID NO: 6092258 - DNA, 14 bp, Homo sapiens
ccggcatgaggccc

SEQ ID NO: 6092259 - DNA, 14 bp, Homo sapiens
ccggcatgccgagt

SEQ ID NO: 6092260 - DNA, 13 bp, Homo sapiens
ccggcatgctggc

SEQ ID NO: 6092261 - DNA, 13 bp, Homo sapiens
ccggcatggacaa

SEQ ID NO: 6092262 - DNA, 17 bp, Homo sapiens
ccggcatggacaatgga

SEQ ID NO: 6092263 - DNA, 14 bp, Homo sapiens
ccggcatgggaaag

SEQ ID NO: 6092264 - DNA, 16 bp, Homo sapiens
ccggccaaggacactg

SEQ ID NO: 6092265 - DNA, 20 bp, Homo sapiens
ccggccaaggacccaggcgc

SEQ ID NO: 6092266 - DNA, 14 bp, Homo sapiens
ccggccacacccag

SEQ ID NO: 6092267 - DNA, 21 bp, Homo sapiens
ccggccacacccctctgctgc

SEQ ID NO: 6092268 - DNA, 14 bp, Homo sapiens
ccggccacagctgc

SEQ ID NO: 6092269 - DNA, 14 bp, Homo sapiens
ccggccacctctgc

SEQ ID NO: 6092270 - DNA, 17 bp, Homo sapiens
ccggccacctgcggtgc

SEQ ID NO: 6092271 - DNA, 21 bp, Homo sapiens
ccggccacgtctgtgctctgt

SEQ ID NO: 6092272 - DNA, 15 bp, Homo sapiens
ccggccagccatgtc

SEQ ID NO: 6092273 - DNA, 13 bp, Homo sapiens
ccggccagcgggc

SEQ ID NO: 6092274 - DNA, 15 bp, Homo sapiens
ccggccagcgggcac

SEQ ID NO: 6092275 - DNA, 11 bp, Homo sapiens
ccggccagctc

SEQ ID NO: 6092276 - DNA, 16 bp, Homo sapiens
ccggccagctccccct

SEQ ID NO: 6092277 - DNA, 15 bp, Homo sapiens
ccggccagctctgga

SEQ ID NO: 6092278 - DNA, 19 bp, Homo sapiens
ccggccagctgggatctga

SEQ ID NO: 6092279 - DNA, 18 bp, Homo sapiens
ccggccagggcctggtgt

SEQ ID NO: 6092280 - DNA, 18 bp, Homo sapiens
ccggccaggtgcctcctg

SEQ ID NO: 6092281 - DNA, 15 bp, Homo sapiens
ccggccaggtgggcg

SEQ ID NO: 6092282 - DNA, 15 bp, Homo sapiens
ccggccatactgcct

SEQ ID NO: 6092283 - DNA, 16 bp, Homo sapiens
ccggccatactgcctt

SEQ ID NO: 6092284 - DNA, 19 bp, Homo sapiens
ccggcccaacctcgccctc

SEQ ID NO: 6092285 - DNA, 14 bp, Homo sapiens
ccggcccacgcaga

SEQ ID NO: 6092286 - DNA, 20 bp, Homo sapiens
ccggcccacgcagagccccg

SEQ ID NO: 6092287 - DNA, 16 bp, Homo sapiens
ccggcccagagacccc

SEQ ID NO: 6092288 - DNA, 19 bp, Homo sapiens
ccggcccagagaccccttc

SEQ ID NO: 6092289 - DNA, 16 bp, Homo sapiens
ccggcccagtgccact

SEQ ID NO: 6092290 - DNA, 14 bp, Homo sapiens
ccggcccagtgccc

SEQ ID NO: 6092291 - DNA, 17 bp, Homo sapiens
ccggcccatatccctgg

SEQ ID NO: 6092292 - DNA, 17 bp, Homo sapiens
ccggccccacctccctg

SEQ ID NO: 6092293 - DNA, 13 bp, Homo sapiens
ccggccccaggct

SEQ ID NO: 6092294 - DNA, 18 bp, Homo sapiens
ccggccccagtacacagg

SEQ ID NO: 6092295 - DNA, 18 bp, Homo sapiens
ccggccccatcagaggct

SEQ ID NO: 6092296 - DNA, 15 bp, Homo sapiens
ccggcccccagcagg

SEQ ID NO: 6092297 - DNA, 14 bp, Homo sapiens
ccggcccccaggac

SEQ ID NO: 6092298 - DNA, 13 bp, Homo sapiens
ccggcccccctct

SEQ ID NO: 6092299 - DNA, 19 bp, Homo sapiens
ccggcccccgccctctgcc

SEQ ID NO: 6092300 - DNA, 23 bp, Homo sapiens
ccggccccctccccccagactct

SEQ ID NO: 6092301 - DNA, 14 bp, Homo sapiens
ccggccccctgccc

SEQ ID NO: 6092302 - DNA, 15 bp, Homo sapiens
ccggccccctggtct

SEQ ID NO: 6092303 - DNA, 20 bp, Homo sapiens
ccggccccctggtctctggt

SEQ ID NO: 6092304 - DNA, 20 bp, Homo sapiens
ccggcccccttcaccccttc

SEQ ID NO: 6092305 - DNA, 16 bp, Homo sapiens
ccggcccccttcctgg

SEQ ID NO: 6092306 - DNA, 17 bp, Homo sapiens
ccggcccccttcctggc

SEQ ID NO: 6092307 - DNA, 20 bp, Homo sapiens
ccggccccgcgcgtgccccc

SEQ ID NO: 6092308 - DNA, 11 bp, Homo sapiens
ccggcccctgc

SEQ ID NO: 6092309 - DNA, 13 bp, Homo sapiens
ccggcccctgctg

SEQ ID NO: 6092310 - DNA, 15 bp, Homo sapiens
ccggcccctgctggt

SEQ ID NO: 6092311 - DNA, 15 bp, Homo sapiens
ccggcccgccacctt

SEQ ID NO: 6092312 - DNA, 17 bp, Homo sapiens
ccggcccgcgccacagg

SEQ ID NO: 6092313 - DNA, 16 bp, Homo sapiens
ccggcccggctgagcc

SEQ ID NO: 6092314 - DNA, 20 bp, Homo sapiens
ccggcccggctgagccctgc

SEQ ID NO: 6092315 - DNA, 13 bp, Homo sapiens
ccggccctccaga

SEQ ID NO: 6092316 - DNA, 21 bp, Homo sapiens
ccggccctcctaccctgcgcc

SEQ ID NO: 6092317 - DNA, 22 bp, Homo sapiens
ccggccctgccccacacaggcc

SEQ ID NO: 6092318 - DNA, 14 bp, Homo sapiens
ccggccctgccccc

SEQ ID NO: 6092319 - DNA, 14 bp, Homo sapiens
ccggccctgcccct

SEQ ID NO: 6092320 - DNA, 16 bp, Homo sapiens
ccggccctgcccctcc

SEQ ID NO: 6092321 - DNA, 17 bp, Homo sapiens
ccggccctgcccctccc

SEQ ID NO: 6092322 - DNA, 22 bp, Homo sapiens
ccggccctgcccctccctagat

SEQ ID NO: 6092323 - DNA, 13 bp, Homo sapiens
ccggccctggctg

SEQ ID NO: 6092324 - DNA, 12 bp, Homo sapiens
ccggccctgggg

SEQ ID NO: 6092325 - DNA, 14 bp, Homo sapiens
ccggccctgtgtgc

SEQ ID NO: 6092326 - DNA, 17 bp, Homo sapiens
ccggccctgtgtgcagg

SEQ ID NO: 6092327 - DNA, 16 bp, Homo sapiens
ccggccgccgccagga

SEQ ID NO: 6092328 - DNA, 23 bp, Homo sapiens
ccggccgccttctcccctctccc

SEQ ID NO: 6092329 - DNA, 21 bp, Homo sapiens
ccggccgcgcaccgccatgca

SEQ ID NO: 6092330 - DNA, 14 bp, Homo sapiens
ccggccgcgccgcc

SEQ ID NO: 6092331 - DNA, 18 bp, Homo sapiens
ccggccgcggctccccct

SEQ ID NO: 6092332 - DNA, 15 bp, Homo sapiens
ccggccggacctctg

SEQ ID NO: 6092333 - DNA, 17 bp, Homo sapiens
ccggccggacctctgag

SEQ ID NO: 6092334 - DNA, 19 bp, Homo sapiens
ccggccggccctggcttgg

SEQ ID NO: 6092335 - DNA, 15 bp, Homo sapiens
ccggccggcctggca

SEQ ID NO: 6092336 - DNA, 15 bp, Homo sapiens
ccggccgtggaagga

SEQ ID NO: 6092337 - DNA, 18 bp, Homo sapiens
ccggcctaggcacctccc

SEQ ID NO: 6092338 - DNA, 13 bp, Homo sapiens
ccggcctcagggc

SEQ ID NO: 6092339 - DNA, 17 bp, Homo sapiens
ccggcctcagggcgctc

SEQ ID NO: 6092340 - DNA, 16 bp, Homo sapiens
cctgtgccccgcctcc

SEQ ID NO: 6092341 - DNA, 20 bp, Homo sapiens
cctgtgccccgcctcccggg

SEQ ID NO: 6092342 - DNA, 15 bp, Homo sapiens
cctgtgcccctcaga

SEQ ID NO: 6092343 - DNA, 21 bp, Homo sapiens
cctgtgcccgcatgtgtgcct

SEQ ID NO: 6092344 - DNA, 14 bp, Homo sapiens
cctgtgcccgctgc

SEQ ID NO: 6092345 - DNA, 16 bp, Homo sapiens
cctgtgcccgctgcgc

SEQ ID NO: 6092346 - DNA, 21 bp, Homo sapiens
cctgtgccctagatgcacgtg

SEQ ID NO: 6092347 - DNA, 18 bp, Homo sapiens
cctgtgccctcaccacca

SEQ ID NO: 6092348 - DNA, 20 bp, Homo sapiens
cctgtgccctcaccccaatc

SEQ ID NO: 6092349 - DNA, 22 bp, Homo sapiens
cctgtgccctcaccccaatccc

SEQ ID NO: 6092350 - DNA, 14 bp, Homo sapiens
cctgtgccctctca

SEQ ID NO: 6092351 - DNA, 15 bp, Homo sapiens
cctgtgccctctcac

SEQ ID NO: 6092352 - DNA, 21 bp, Homo sapiens
cctgtgccctctggattctct

SEQ ID NO: 6092353 - DNA, 15 bp, Homo sapiens
cctgtgcccttattc

SEQ ID NO: 6092354 - DNA, 15 bp, Homo sapiens
cctgtgcccttgctg

SEQ ID NO: 6092355 - DNA, 18 bp, Homo sapiens
cctgtgcccttgctgggt

SEQ ID NO: 6092356 - DNA, 19 bp, Homo sapiens
cctgtgcccttgctgggtc

SEQ ID NO: 6092357 - DNA, 17 bp, Homo sapiens
cctgtgccgcactctgg

SEQ ID NO: 6092358 - DNA, 15 bp, Homo sapiens
cctgtgcctccctct

SEQ ID NO: 6092359 - DNA, 19 bp, Homo sapiens
cctgtgcctccctctcctc

SEQ ID NO: 6092360 - DNA, 18 bp, Homo sapiens
cctgtgcctcccttttct

SEQ ID NO: 6092361 - DNA, 12 bp, Homo sapiens
cctgtgcctcct

SEQ ID NO: 6092362 - DNA, 15 bp, Homo sapiens
cctgtgcctcctcac

SEQ ID NO: 6092363 - DNA, 16 bp, Homo sapiens
cctgtgcctctgtcct

SEQ ID NO: 6092364 - DNA, 17 bp, Homo sapiens
cctgtgcctgctgggca

SEQ ID NO: 6092365 - DNA, 20 bp, Homo sapiens
cctgtgcctgctgggcactg

SEQ ID NO: 6092366 - DNA, 13 bp, Homo sapiens
cctgtgcctggcc

SEQ ID NO: 6092367 - DNA, 15 bp, Homo sapiens
cctgtgcctgggccc

SEQ ID NO: 6092368 - DNA, 14 bp, Homo sapiens
cctgtgcctgtcag

SEQ ID NO: 6092369 - DNA, 17 bp, Homo sapiens
cctgtgcctgtgtttca

SEQ ID NO: 6092370 - DNA, 21 bp, Homo sapiens
cctgtgcctttcctatcacct

SEQ ID NO: 6092371 - DNA, 15 bp, Homo sapiens
cctgtgcgtcccagc

SEQ ID NO: 6092372 - DNA, 14 bp, Homo sapiens
cctgtgctacagag

SEQ ID NO: 6092373 - DNA, 19 bp, Homo sapiens
cctgtgctactttgccttt

SEQ ID NO: 6092374 - DNA, 21 bp, Homo sapiens
cctgtgctagaagctccatgg

SEQ ID NO: 6092375 - DNA, 20 bp, Homo sapiens
cctgtgctatgctggacatt

SEQ ID NO: 6092376 - DNA, 18 bp, Homo sapiens
cctgtgctatttgtacaa

SEQ ID NO: 6092377 - DNA, 21 bp, Homo sapiens
cctgtgctatttgtacaaata

SEQ ID NO: 6092378 - DNA, 18 bp, Homo sapiens
cctgtgctcaccctctct

SEQ ID NO: 6092379 - DNA, 16 bp, Homo sapiens
cctgtgctcagccctg

SEQ ID NO: 6092380 - DNA, 22 bp, Homo sapiens
cctgtgctcccctgccacactg

SEQ ID NO: 6092381 - DNA, 20 bp, Homo sapiens
cctgtgctccgtgcctccac

SEQ ID NO: 6092382 - DNA, 22 bp, Homo sapiens
cctgtgctccgtgcctccacca

SEQ ID NO: 6092383 - DNA, 19 bp, Homo sapiens
cctgtgctcctgcccagga

SEQ ID NO: 6092384 - DNA, 20 bp, Homo sapiens
cctgtgctcctgcccaggag

SEQ ID NO: 6092385 - DNA, 22 bp, Homo sapiens
cctgtgctcctgcccaggagca

SEQ ID NO: 6092386 - DNA, 17 bp, Homo sapiens
cctgtgctgaacataac

SEQ ID NO: 6092387 - DNA, 18 bp, Homo sapiens
cctgtgctgacggaagcc

SEQ ID NO: 6092388 - DNA, 23 bp, Homo sapiens
cctgtgctgcccgtcttcagcct

SEQ ID NO: 6092389 - DNA, 19 bp, Homo sapiens
cctgtgctggaccagctgg

SEQ ID NO: 6092390 - DNA, 22 bp, Homo sapiens
cctgtgctggaccagctggcct

SEQ ID NO: 6092391 - DNA, 21 bp, Homo sapiens
cctgtgctgggccagtggctg

SEQ ID NO: 6092392 - DNA, 17 bp, Homo sapiens
cctgtgctggtgtcctg

SEQ ID NO: 6092393 - DNA, 21 bp, Homo sapiens
cctgtgctggtgtcctgacca

SEQ ID NO: 6092394 - DNA, 24 bp, Homo sapiens
cctgtgctggtgtcctgaccaccc

SEQ ID NO: 6092395 - DNA, 15 bp, Homo sapiens
cctgtgctgtgagtg

SEQ ID NO: 6092396 - DNA, 14 bp, Homo sapiens
cctgtgctgtggca

SEQ ID NO: 6092397 - DNA, 16 bp, Homo sapiens
cctgtgctgtggcata

SEQ ID NO: 6092398 - DNA, 24 bp, Homo sapiens
cctgtgcttgcttagagtgcccag

SEQ ID NO: 6092399 - DNA, 13 bp, Homo sapiens
cctgtgcttggag

SEQ ID NO: 6092400 - DNA, 20 bp, Homo sapiens
cctgtgcttggaggcctcag

SEQ ID NO: 6092401 - DNA, 13 bp, Homo sapiens
cctgtgctttcat

SEQ ID NO: 6092402 - DNA, 12 bp, Homo sapiens
cctgtgctttga

SEQ ID NO: 6092403 - DNA, 23 bp, Homo sapiens
cctgtggaaatatgcaacctgtg

SEQ ID NO: 6092404 - DNA, 22 bp, Homo sapiens
cctgtggaacccagcagttctg

SEQ ID NO: 6092405 - DNA, 22 bp, Homo sapiens
cctgtggaagcatggctgtctg

SEQ ID NO: 6092406 - DNA, 24 bp, Homo sapiens
cctgtggaagcatggctgtctgca

SEQ ID NO: 6092407 - DNA, 14 bp, Homo sapiens
cctgtggacaggat

SEQ ID NO: 6092408 - DNA, 18 bp, Homo sapiens
cctgtggagacagccctg

SEQ ID NO: 6092409 - DNA, 20 bp, Homo sapiens
cctgtggagacagccctgcc

SEQ ID NO: 6092410 - DNA, 21 bp, Homo sapiens
cctgtggagacagccctgcct

SEQ ID NO: 6092411 - DNA, 17 bp, Homo sapiens
cctgtggagctcagccc

SEQ ID NO: 6092412 - DNA, 18 bp, Homo sapiens
cctgtggagctcagcccc

SEQ ID NO: 6092413 - DNA, 18 bp, Homo sapiens
cctgtggaggtgacctgt

SEQ ID NO: 6092414 - DNA, 16 bp, Homo sapiens
cctgtggagtccagct

SEQ ID NO: 6092415 - DNA, 17 bp, Homo sapiens
cctgtggagtccagctc

SEQ ID NO: 6092416 - DNA, 19 bp, Homo sapiens
cctgtggagtccagctcta

SEQ ID NO: 6092417 - DNA, 20 bp, Homo sapiens
cctgtggatgagccctcaga

SEQ ID NO: 6092418 - DNA, 21 bp, Homo sapiens
cctgtggatgatcaatccttt

SEQ ID NO: 6092419 - DNA, 16 bp, Homo sapiens
cctgtggcacagccct

SEQ ID NO: 6092420 - DNA, 22 bp, Homo sapiens
cctgtggcacagccctgagtgt

SEQ ID NO: 6092421 - DNA, 24 bp, Homo sapiens
cctgtggcacagccctgagtgtcc

SEQ ID NO: 6092422 - DNA, 23 bp, Homo sapiens
cctgtggcagaaaagaggagacc

SEQ ID NO: 6092423 - DNA, 17 bp, Homo sapiens
cctgtggcagctgcccc

SEQ ID NO: 6092424 - DNA, 19 bp, Homo sapiens
cctgtggcagctgcccctg

SEQ ID NO: 6092425 - DNA, 15 bp, Homo sapiens
cctgtggcaggaggc

SEQ ID NO: 6092426 - DNA, 14 bp, Homo sapiens
cctgtggcaggcag

SEQ ID NO: 6092427 - DNA, 22 bp, Homo sapiens
cctgtggcaggcagcgccaagc

SEQ ID NO: 6092428 - DNA, 22 bp, Homo sapiens
cctgtggcagtaaagagaaact

SEQ ID NO: 6092429 - DNA, 19 bp, Homo sapiens
cctgtggcccacgggccgg

SEQ ID NO: 6092430 - DNA, 23 bp, Homo sapiens
cctgtggcccacgggccggccag

SEQ ID NO: 6092431 - DNA, 20 bp, Homo sapiens
cctgtggccccaccctgggc

SEQ ID NO: 6092432 - DNA, 22 bp, Homo sapiens
cctgtggccccaccctgggccc

SEQ ID NO: 6092433 - DNA, 23 bp, Homo sapiens
cctgtggccccgaggctgggaca

SEQ ID NO: 6092434 - DNA, 19 bp, Homo sapiens
cctgtggcccctcccctgc

SEQ ID NO: 6092435 - DNA, 18 bp, Homo sapiens
cctgtggccctgtcctgc

SEQ ID NO: 6092436 - DNA, 21 bp, Homo sapiens
cctgtggccctgtcctgccat

SEQ ID NO: 6092437 - DNA, 15 bp, Homo sapiens
cctgtggcctcagca

SEQ ID NO: 6092438 - DNA, 15 bp, Homo sapiens
cctgtggcctctcag

SEQ ID NO: 6092439 - DNA, 16 bp, Homo sapiens
cctgtggcctgccagt

SEQ ID NO: 6092440 - DNA, 19 bp, Homo sapiens
cctgtggcctgctcatcac

SEQ ID NO: 6092441 - DNA, 22 bp, Homo sapiens
cctgtggcgccgtctccagggg

SEQ ID NO: 6092442 - DNA, 19 bp, Homo sapiens
cctgtggcgctgcagcagg

SEQ ID NO: 6092443 - DNA, 16 bp, Homo sapiens
cctgtggcggtgcagt

SEQ ID NO: 6092444 - DNA, 17 bp, Homo sapiens
cctgtggcggtgcagtg

SEQ ID NO: 6092445 - DNA, 20 bp, Homo sapiens
cctgtggcggtgcctgggtg

SEQ ID NO: 6092446 - DNA, 14 bp, Homo sapiens
cctgtggctccagg

SEQ ID NO: 6092447 - DNA, 15 bp, Homo sapiens
cctgtggctccagga

SEQ ID NO: 6092448 - DNA, 12 bp, Homo sapiens
cctgtggctccc

SEQ ID NO: 6092449 - DNA, 14 bp, Homo sapiens
cctgtggctccctc

SEQ ID NO: 6092450 - DNA, 16 bp, Homo sapiens
cctgtggctccctctc

SEQ ID NO: 6092451 - DNA, 17 bp, Homo sapiens
cctgtggctccctctct

SEQ ID NO: 6092452 - DNA, 21 bp, Homo sapiens
cctgtggctcccttggtgccc

SEQ ID NO: 6092453 - DNA, 11 bp, Homo sapiens
cctgtggctct

SEQ ID NO: 6092454 - DNA, 12 bp, Homo sapiens
cctgtggctgcg

SEQ ID NO: 6092455 - DNA, 13 bp, Homo sapiens
cctgtggctgtgg

SEQ ID NO: 6092456 - DNA, 21 bp, Homo sapiens
cctgtggcttggagtggccaa

SEQ ID NO: 6092457 - DNA, 19 bp, Homo sapiens
cctgtgggaccccaggccc

SEQ ID NO: 6092458 - DNA, 18 bp, Homo sapiens
cctgtgggaccgcctggc

SEQ ID NO: 6092459 - DNA, 14 bp, Homo sapiens
cctgtgggagaagg

SEQ ID NO: 6092460 - DNA, 13 bp, Homo sapiens
cctgtgggagcct

SEQ ID NO: 6092461 - DNA, 14 bp, Homo sapiens
cctgtgggagcctc

SEQ ID NO: 6092462 - DNA, 16 bp, Homo sapiens
cctgtgggagcctcgc

SEQ ID NO: 6092463 - DNA, 17 bp, Homo sapiens
cctgtgggagcctcgca

SEQ ID NO: 6092464 - DNA, 15 bp, Homo sapiens
cctgtgggagcctgc

SEQ ID NO: 6092465 - DNA, 13 bp, Homo sapiens
cctgtgggagggg

SEQ ID NO: 6092466 - DNA, 16 bp, Homo sapiens
cctgtgggagggggag

SEQ ID NO: 6092467 - DNA, 15 bp, Homo sapiens
cctgtgggagtccac

SEQ ID NO: 6092468 - DNA, 16 bp, Homo sapiens
cctgtgggagtccact

SEQ ID NO: 6092469 - DNA, 17 bp, Homo sapiens
cctgtgggagtccactt

SEQ ID NO: 6092470 - DNA, 13 bp, Homo sapiens
cctgtgggccagc

SEQ ID NO: 6092471 - DNA, 14 bp, Homo sapiens
cctgtgggccagga

SEQ ID NO: 6092472 - DNA, 20 bp, Homo sapiens
cctgtgggccaggagctcag

SEQ ID NO: 6092473 - DNA, 21 bp, Homo sapiens
cctgtgggccaggagctcagc

SEQ ID NO: 6092474 - DNA, 14 bp, Homo sapiens
cctgtgggcgcata

SEQ ID NO: 6092475 - DNA, 15 bp, Homo sapiens
cctgtgggctcacac

SEQ ID NO: 6092476 - DNA, 19 bp, Homo sapiens
cctgtgggctcacaccggc

SEQ ID NO: 6092477 - DNA, 12 bp, Homo sapiens
cctgtgggcttc

SEQ ID NO: 6092478 - DNA, 18 bp, Homo sapiens
cctgtggggatctcaggg

SEQ ID NO: 6092479 - DNA, 20 bp, Homo sapiens
cctgtggggatttctcccag

SEQ ID NO: 6092480 - DNA, 18 bp, Homo sapiens
cctgtggggcaggagtgc

SEQ ID NO: 6092481 - DNA, 19 bp, Homo sapiens
cctgtggggcaggagtgcc

SEQ ID NO: 6092482 - DNA, 21 bp, Homo sapiens
cctgtggggcaggagtgccag

SEQ ID NO: 6092483 - DNA, 14 bp, Homo sapiens
cctgtggggcctgg

SEQ ID NO: 6092484 - DNA, 22 bp, Homo sapiens
cctgtggggcctggggagccca

SEQ ID NO: 6092485 - DNA, 16 bp, Homo sapiens
cctgtgggggcggctg

SEQ ID NO: 6092486 - DNA, 21 bp, Homo sapiens
cctgtgggggtggccatccct

SEQ ID NO: 6092487 - DNA, 21 bp, Homo sapiens
cctgtggggtcaacccttctg

SEQ ID NO: 6092488 - DNA, 15 bp, Homo sapiens
cctgtgggtccccac

SEQ ID NO: 6092489 - DNA, 18 bp, Homo sapiens
cctgtgggtccccactca

SEQ ID NO: 6092490 - DNA, 16 bp, Homo sapiens
cctgtgggtctctgaa

SEQ ID NO: 6092491 - DNA, 19 bp, Homo sapiens
cctgtgggtctctgaaggg

SEQ ID NO: 6092492 - DNA, 15 bp, Homo sapiens
cctgtgggtggggct

SEQ ID NO: 6092493 - DNA, 19 bp, Homo sapiens
cctgtgggtggggcttctc

SEQ ID NO: 6092494 - DNA, 18 bp, Homo sapiens
cctgtgggtgtctccctc

SEQ ID NO: 6092495 - DNA, 22 bp, Homo sapiens
cctgtgggtgttctttcctgcc

SEQ ID NO: 6092496 - DNA, 20 bp, Homo sapiens
cctgtgggtttgggtgcctc

SEQ ID NO: 6092497 - DNA, 20 bp, Homo sapiens
cctgtggtaactttgcaggc

SEQ ID NO: 6092498 - DNA, 21 bp, Homo sapiens
cctgtggtaccctggcagaga

SEQ ID NO: 6092499 - DNA, 18 bp, Homo sapiens
cctgtggtagtcctccca

SEQ ID NO: 6092500 - DNA, 14 bp, Homo sapiens
cctgtggtcatgtg

SEQ ID NO: 6092501 - DNA, 19 bp, Homo sapiens
cctgtggtcatgtgagtct

SEQ ID NO: 6092502 - DNA, 16 bp, Homo sapiens
cctgtggtctggggag

SEQ ID NO: 6092503 - DNA, 15 bp, Homo sapiens
cctgtggtctgtgtg

SEQ ID NO: 6092504 - DNA, 14 bp, Homo sapiens
cctgtggtgaagtg

SEQ ID NO: 6092505 - DNA, 15 bp, Homo sapiens
cctgtggtgaagtgt

SEQ ID NO: 6092506 - DNA, 22 bp, Homo sapiens
cctgtggtgaagtgtggctggt

SEQ ID NO: 6092507 - DNA, 12 bp, Homo sapiens
cctgtggtgcaa

SEQ ID NO: 6092508 - DNA, 22 bp, Homo sapiens
cctgtggtgctgggagatgctc

SEQ ID NO: 6092509 - DNA, 22 bp, Homo sapiens
cctgtggtggcctggtgcacag

SEQ ID NO: 6092510 - DNA, 14 bp, Homo sapiens
cctgtggtggctcc

SEQ ID NO: 6092511 - DNA, 22 bp, Homo sapiens
cctgtggttacagtgcagacag

SEQ ID NO: 6092512 - DNA, 19 bp, Homo sapiens
cctgtggttctgagatggc

SEQ ID NO: 6092513 - DNA, 20 bp, Homo sapiens
cctgtggtttgctccagaat

SEQ ID NO: 6092514 - DNA, 15 bp, Homo sapiens
cctgtgtaacatctg

SEQ ID NO: 6092515 - DNA, 19 bp, Homo sapiens
cctgtgtaacatctgccat

SEQ ID NO: 6092516 - DNA, 12 bp, Homo sapiens
cctgtgtacctc

SEQ ID NO: 6092517 - DNA, 15 bp, Homo sapiens
ccggcctccactccc

SEQ ID NO: 6092518 - DNA, 16 bp, Homo sapiens
ccggcctccaggctgg

SEQ ID NO: 6092519 - DNA, 17 bp, Homo sapiens
ccggcctccaggctggg

SEQ ID NO: 6092520 - DNA, 18 bp, Homo sapiens
ccggcctccaggctgggg

SEQ ID NO: 6092521 - DNA, 19 bp, Homo sapiens
ccggcctccaggctggggc

SEQ ID NO: 6092522 - DNA, 21 bp, Homo sapiens
ccggcctcctagcctctccgc

SEQ ID NO: 6092523 - DNA, 15 bp, Homo sapiens
ccggcctcctcctca

SEQ ID NO: 6092524 - DNA, 22 bp, Homo sapiens
ccggcctcctcggagagcagca

SEQ ID NO: 6092525 - DNA, 18 bp, Homo sapiens
ccggcctctccagcctca

SEQ ID NO: 6092526 - DNA, 14 bp, Homo sapiens
ccggcctctccctg

SEQ ID NO: 6092527 - DNA, 18 bp, Homo sapiens
ccggcctctccctgcctg

SEQ ID NO: 6092528 - DNA, 12 bp, Homo sapiens
ccggcctctctg

SEQ ID NO: 6092529 - DNA, 17 bp, Homo sapiens
ccggcctctctgcccca

SEQ ID NO: 6092530 - DNA, 13 bp, Homo sapiens
ccggcctctctgg

SEQ ID NO: 6092531 - DNA, 20 bp, Homo sapiens
ccggcctctctggcctccca

SEQ ID NO: 6092532 - DNA, 22 bp, Homo sapiens
ccggcctctctggcctcccacc

SEQ ID NO: 6092533 - DNA, 17 bp, Homo sapiens
ccggcctctgctgcccc

SEQ ID NO: 6092534 - DNA, 18 bp, Homo sapiens
ccggcctctgctgccccc

SEQ ID NO: 6092535 - DNA, 21 bp, Homo sapiens
ccggcctctgctgcccccttc

SEQ ID NO: 6092536 - DNA, 14 bp, Homo sapiens
ccggcctcttccac

SEQ ID NO: 6092537 - DNA, 13 bp, Homo sapiens
ccggcctgcagcc

SEQ ID NO: 6092538 - DNA, 14 bp, Homo sapiens
ccggcctgccagga

SEQ ID NO: 6092539 - DNA, 15 bp, Homo sapiens
ccggcctgccaggag

SEQ ID NO: 6092540 - DNA, 20 bp, Homo sapiens
ccggcctgctcccagcagcc

SEQ ID NO: 6092541 - DNA, 21 bp, Homo sapiens
ccggcctggatgccagctgtg

SEQ ID NO: 6092542 - DNA, 22 bp, Homo sapiens
ccggcctggatgccagctgtgt

SEQ ID NO: 6092543 - DNA, 12 bp, Homo sapiens
ccggcctggcac

SEQ ID NO: 6092544 - DNA, 11 bp, Homo sapiens
ccggcctggcc

SEQ ID NO: 6092545 - DNA, 15 bp, Homo sapiens
ccggcctggccccct

SEQ ID NO: 6092546 - DNA, 19 bp, Homo sapiens
ccggcctggccccctcgcg

SEQ ID NO: 6092547 - DNA, 13 bp, Homo sapiens
ccggcctggcctt

SEQ ID NO: 6092548 - DNA, 22 bp, Homo sapiens
ccggcctgggaaaccctctcca

SEQ ID NO: 6092549 - DNA, 18 bp, Homo sapiens
ccggcctggggccgggct

SEQ ID NO: 6092550 - DNA, 21 bp, Homo sapiens
ccggcgagggggccgggggga

SEQ ID NO: 6092551 - DNA, 23 bp, Homo sapiens
ccggcgagggggccggggggagg

SEQ ID NO: 6092552 - DNA, 13 bp, Homo sapiens
ccggcgcctgccc

SEQ ID NO: 6092553 - DNA, 14 bp, Homo sapiens
ccggcgcctgccct

SEQ ID NO: 6092554 - DNA, 16 bp, Homo sapiens
ccggcgcctgccctgc

SEQ ID NO: 6092555 - DNA, 19 bp, Homo sapiens
ccggcgcctgccctgccca

SEQ ID NO: 6092556 - DNA, 22 bp, Homo sapiens
ccggcgcctgccctgcccaagt

SEQ ID NO: 6092557 - DNA, 19 bp, Homo sapiens
ccggcgctgattcctcgtg

SEQ ID NO: 6092558 - DNA, 21 bp, Homo sapiens
ccggcgctgattcctcgtgtc

SEQ ID NO: 6092559 - DNA, 21 bp, Homo sapiens
ccggcggccctgctgaagctg

SEQ ID NO: 6092560 - DNA, 17 bp, Homo sapiens
ccggcggctactctgga

SEQ ID NO: 6092561 - DNA, 18 bp, Homo sapiens
ccggcggctctgagcagg

SEQ ID NO: 6092562 - DNA, 20 bp, Homo sapiens
ccggcggctctgagcagggg

SEQ ID NO: 6092563 - DNA, 19 bp, Homo sapiens
ccggcgggatgttgaactg

SEQ ID NO: 6092564 - DNA, 20 bp, Homo sapiens
ccggcggggaccttggtctg

SEQ ID NO: 6092565 - DNA, 18 bp, Homo sapiens
ccggcgggtgacagctcc

SEQ ID NO: 6092566 - DNA, 14 bp, Homo sapiens
ccggcgggtgctct

SEQ ID NO: 6092567 - DNA, 22 bp, Homo sapiens
ccggcgggtgctctgaggcctc

SEQ ID NO: 6092568 - DNA, 13 bp, Homo sapiens
ccggcgtcagcct

SEQ ID NO: 6092569 - DNA, 16 bp, Homo sapiens
ccggcgtcagcctcca

SEQ ID NO: 6092570 - DNA, 20 bp, Homo sapiens
ccggcgtcttgcccagcagc

SEQ ID NO: 6092571 - DNA, 16 bp, Homo sapiens
ccggcgtggtggaaga

SEQ ID NO: 6092572 - DNA, 16 bp, Homo sapiens
ccggctaagcaggcgc

SEQ ID NO: 6092573 - DNA, 15 bp, Homo sapiens
ccggctaatttttgt

SEQ ID NO: 6092574 - DNA, 19 bp, Homo sapiens
ccggctaatttttgtattt

SEQ ID NO: 6092575 - DNA, 22 bp, Homo sapiens
ccggctaattttttttgtattt

SEQ ID NO: 6092576 - DNA, 14 bp, Homo sapiens
ccggctacatcagc

SEQ ID NO: 6092577 - DNA, 12 bp, Homo sapiens
ccggctccagag

SEQ ID NO: 6092578 - DNA, 15 bp, Homo sapiens
ccggctccagtttcc

SEQ ID NO: 6092579 - DNA, 12 bp, Homo sapiens
ccggctcccacc

SEQ ID NO: 6092580 - DNA, 23 bp, Homo sapiens
ccggctcccaccggtgccaaacc

SEQ ID NO: 6092581 - DNA, 13 bp, Homo sapiens
ccggctccccctg

SEQ ID NO: 6092582 - DNA, 17 bp, Homo sapiens
ccggctccccctgccag

SEQ ID NO: 6092583 - DNA, 20 bp, Homo sapiens
ccggctccccctgccagcaa

SEQ ID NO: 6092584 - DNA, 13 bp, Homo sapiens
ccggctccctcct

SEQ ID NO: 6092585 - DNA, 14 bp, Homo sapiens
ccggctcctggtca

SEQ ID NO: 6092586 - DNA, 23 bp, Homo sapiens
ccggctcgagcagtcctgcctca

SEQ ID NO: 6092587 - DNA, 15 bp, Homo sapiens
ccggctcggcccagc

SEQ ID NO: 6092588 - DNA, 16 bp, Homo sapiens
ccggctcggcccagca

SEQ ID NO: 6092589 - DNA, 17 bp, Homo sapiens
ccggctcggcccagcac

SEQ ID NO: 6092590 - DNA, 17 bp, Homo sapiens
ccggctctacgggggcc

SEQ ID NO: 6092591 - DNA, 12 bp, Homo sapiens
ccggctctgcct

SEQ ID NO: 6092592 - DNA, 17 bp, Homo sapiens
ccggctctggctctccc

SEQ ID NO: 6092593 - DNA, 13 bp, Homo sapiens
ccggctctgggcc

SEQ ID NO: 6092594 - DNA, 15 bp, Homo sapiens
ccggctctgggcctg

SEQ ID NO: 6092595 - DNA, 22 bp, Homo sapiens
ccggctctggtggccactgagc

SEQ ID NO: 6092596 - DNA, 22 bp, Homo sapiens
ccggctcttatagaagcttcag

SEQ ID NO: 6092597 - DNA, 15 bp, Homo sapiens
ccggctgacacctcc

SEQ ID NO: 6092598 - DNA, 15 bp, Homo sapiens
ccggctgagcccccc

SEQ ID NO: 6092599 - DNA, 23 bp, Homo sapiens
ccggctgagctgtgccagctgct

SEQ ID NO: 6092600 - DNA, 15 bp, Homo sapiens
ccggctgagtggcag

SEQ ID NO: 6092601 - DNA, 18 bp, Homo sapiens
ccggctgcatacccgggc

SEQ ID NO: 6092602 - DNA, 18 bp, Homo sapiens
ccggctgcccccatcacc

SEQ ID NO: 6092603 - DNA, 13 bp, Homo sapiens
ccggctgcctgcc

SEQ ID NO: 6092604 - DNA, 21 bp, Homo sapiens
ccggctgctgtgtgtgagcag

SEQ ID NO: 6092605 - DNA, 19 bp, Homo sapiens
ccggctggaccacgtctcc

SEQ ID NO: 6092606 - DNA, 15 bp, Homo sapiens
ccggctggacctggg

SEQ ID NO: 6092607 - DNA, 13 bp, Homo sapiens
ccggctggacttt

SEQ ID NO: 6092608 - DNA, 15 bp, Homo sapiens
ccggctggccggtcc

SEQ ID NO: 6092609 - DNA, 21 bp, Homo sapiens
ccggctggccggtccaccccg

SEQ ID NO: 6092610 - DNA, 21 bp, Homo sapiens
ccggctggcctggaggctcag

SEQ ID NO: 6092611 - DNA, 19 bp, Homo sapiens
ccggctgggcccgagggtc

SEQ ID NO: 6092612 - DNA, 15 bp, Homo sapiens
ccggctgtgattgct

SEQ ID NO: 6092613 - DNA, 19 bp, Homo sapiens
ccggctgtgattgctgcca

SEQ ID NO: 6092614 - DNA, 17 bp, Homo sapiens
ccggctgtgctcagaga

SEQ ID NO: 6092615 - DNA, 17 bp, Homo sapiens
ccggctgtgctgggaga

SEQ ID NO: 6092616 - DNA, 23 bp, Homo sapiens
ccggctgtggagcaaaaggcagc

SEQ ID NO: 6092617 - DNA, 15 bp, Homo sapiens
ccggctgtttcctga

SEQ ID NO: 6092618 - DNA, 14 bp, Homo sapiens
ccggctttcagggc

SEQ ID NO: 6092619 - DNA, 12 bp, Homo sapiens
ccggctttcctc

SEQ ID NO: 6092620 - DNA, 16 bp, Homo sapiens
ccggctttcctccgga

SEQ ID NO: 6092621 - DNA, 17 bp, Homo sapiens
ccggctttgcagggaga

SEQ ID NO: 6092622 - DNA, 16 bp, Homo sapiens
ccggctttgtggcact

SEQ ID NO: 6092623 - DNA, 22 bp, Homo sapiens
ccgggaaagaagagccggagcc

SEQ ID NO: 6092624 - DNA, 19 bp, Homo sapiens
ccgggaacctccccagcct

SEQ ID NO: 6092625 - DNA, 17 bp, Homo sapiens
ccgggaacgcttgctct

SEQ ID NO: 6092626 - DNA, 15 bp, Homo sapiens
ccgggaactcctgcc

SEQ ID NO: 6092627 - DNA, 17 bp, Homo sapiens
ccgggaagagccacctg

SEQ ID NO: 6092628 - DNA, 22 bp, Homo sapiens
ccgggaagcatcctccccacca

SEQ ID NO: 6092629 - DNA, 15 bp, Homo sapiens
ccgggaagccaccct

SEQ ID NO: 6092630 - DNA, 11 bp, Homo sapiens
ccgggaaggaa

SEQ ID NO: 6092631 - DNA, 18 bp, Homo sapiens
ccgggaaggaaggctctc

SEQ ID NO: 6092632 - DNA, 14 bp, Homo sapiens
ccgggaataacatg

SEQ ID NO: 6092633 - DNA, 19 bp, Homo sapiens
ccgggaatgaatggggagg

SEQ ID NO: 6092634 - DNA, 19 bp, Homo sapiens
ccgggacaccgtggggaag

SEQ ID NO: 6092635 - DNA, 16 bp, Homo sapiens
ccgggacagacctgga

SEQ ID NO: 6092636 - DNA, 23 bp, Homo sapiens
ccgggaccacagctgctggccag

SEQ ID NO: 6092637 - DNA, 21 bp, Homo sapiens
ccgggaccaccctgagccggc

SEQ ID NO: 6092638 - DNA, 13 bp, Homo sapiens
ccgggacccccag

SEQ ID NO: 6092639 - DNA, 18 bp, Homo sapiens
ccgggaccccgagcctgg

SEQ ID NO: 6092640 - DNA, 21 bp, Homo sapiens
ccgggaccctgctcacaggca

SEQ ID NO: 6092641 - DNA, 16 bp, Homo sapiens
ccgggacgcttccaga

SEQ ID NO: 6092642 - DNA, 17 bp, Homo sapiens
ccgggacgcttccagac

SEQ ID NO: 6092643 - DNA, 18 bp, Homo sapiens
ccgggacgcttccagacc

SEQ ID NO: 6092644 - DNA, 19 bp, Homo sapiens
ccgggacgcttccagacca

SEQ ID NO: 6092645 - DNA, 21 bp, Homo sapiens
ccgggacgcttccagaccacc

SEQ ID NO: 6092646 - DNA, 22 bp, Homo sapiens
ccgggacgcttccagaccacct

SEQ ID NO: 6092647 - DNA, 23 bp, Homo sapiens
ccgggacgcttccagaccacctg

SEQ ID NO: 6092648 - DNA, 19 bp, Homo sapiens
ccgggacgtggcacctcct

SEQ ID NO: 6092649 - DNA, 13 bp, Homo sapiens
ccgggactcactg

SEQ ID NO: 6092650 - DNA, 19 bp, Homo sapiens
ccgggactcactggcagcc

SEQ ID NO: 6092651 - DNA, 12 bp, Homo sapiens
ccgggactccag

SEQ ID NO: 6092652 - DNA, 19 bp, Homo sapiens
ccgggactctccccctttc

SEQ ID NO: 6092653 - DNA, 12 bp, Homo sapiens
ccgggactctgc

SEQ ID NO: 6092654 - DNA, 23 bp, Homo sapiens
ccgggactgaccttcggcagtgg

SEQ ID NO: 6092655 - DNA, 16 bp, Homo sapiens
ccgggagaagccacct

SEQ ID NO: 6092656 - DNA, 20 bp, Homo sapiens
ccgggagactgccagtggag

SEQ ID NO: 6092657 - DNA, 12 bp, Homo sapiens
ccgggagaggag

SEQ ID NO: 6092658 - DNA, 12 bp, Homo sapiens
ccgggagagggg

SEQ ID NO: 6092659 - DNA, 20 bp, Homo sapiens
ccgggagatccgccctgggc

SEQ ID NO: 6092660 - DNA, 16 bp, Homo sapiens
ccgggagcctgatcac

SEQ ID NO: 6092661 - DNA, 15 bp, Homo sapiens
ccgggagctcaggaa

SEQ ID NO: 6092662 - DNA, 15 bp, Homo sapiens
ccgggagctgctgcc

SEQ ID NO: 6092663 - DNA, 11 bp, Homo sapiens
ccgggagctgg

SEQ ID NO: 6092664 - DNA, 18 bp, Homo sapiens
ccgggagctgggccctgc

SEQ ID NO: 6092665 - DNA, 21 bp, Homo sapiens
ccgggagctttgggtgaccag

SEQ ID NO: 6092666 - DNA, 22 bp, Homo sapiens
ccgggagctttgggtgaccagc

SEQ ID NO: 6092667 - DNA, 22 bp, Homo sapiens
ccgggaggaaaaggcccctgca

SEQ ID NO: 6092668 - DNA, 23 bp, Homo sapiens
ccgggaggaaaaggcccctgcaa

SEQ ID NO: 6092669 - DNA, 15 bp, Homo sapiens
ccgggaggcagccac

SEQ ID NO: 6092670 - DNA, 22 bp, Homo sapiens
ccgggagggacagtctggaggt

SEQ ID NO: 6092671 - DNA, 15 bp, Homo sapiens
ccgggaggggcccgc

SEQ ID NO: 6092672 - DNA, 22 bp, Homo sapiens
ccgggaggggcccgcttgcctc

SEQ ID NO: 6092673 - DNA, 22 bp, Homo sapiens
ccgggaggtggaggttgcagtg

SEQ ID NO: 6092674 - DNA, 19 bp, Homo sapiens
ccgggatatatattctctc

SEQ ID NO: 6092675 - DNA, 23 bp, Homo sapiens
ccgggatattatagaaaattatt

SEQ ID NO: 6092676 - DNA, 15 bp, Homo sapiens
ccgggatcctgcccc

SEQ ID NO: 6092677 - DNA, 15 bp, Homo sapiens
ccgggcaaagggtct

SEQ ID NO: 6092678 - DNA, 19 bp, Homo sapiens
ccgggcaaatgccagggcc

SEQ ID NO: 6092679 - DNA, 16 bp, Homo sapiens
ccgggcaccaccccca

SEQ ID NO: 6092680 - DNA, 16 bp, Homo sapiens
ccgggcaccaggggcc

SEQ ID NO: 6092681 - DNA, 23 bp, Homo sapiens
ccgggcacggtcacacggccacc

SEQ ID NO: 6092682 - DNA, 15 bp, Homo sapiens
ccgggcactcagaag

SEQ ID NO: 6092683 - DNA, 16 bp, Homo sapiens
ccgggcactcccggga

SEQ ID NO: 6092684 - DNA, 14 bp, Homo sapiens
ccgggcactggcac

SEQ ID NO: 6092685 - DNA, 19 bp, Homo sapiens
ccgggcactgtcatgccca

SEQ ID NO: 6092686 - DNA, 11 bp, Homo sapiens
ccgggcagaaa

SEQ ID NO: 6092687 - DNA, 13 bp, Homo sapiens
ccgggcagagacc

SEQ ID NO: 6092688 - DNA, 13 bp, Homo sapiens
ccgggcagagcac

SEQ ID NO: 6092689 - DNA, 12 bp, Homo sapiens
ccgggcagcaga

SEQ ID NO: 6092690 - DNA, 14 bp, Homo sapiens
ccgggcagcagaga

SEQ ID NO: 6092691 - DNA, 16 bp, Homo sapiens
ccgggcagcagagaga

SEQ ID NO: 6092692 - DNA, 20 bp, Homo sapiens
ccgggcagggctcccacaga

SEQ ID NO: 6092693 - DNA, 19 bp, Homo sapiens
ccgggcaggggagccaggg

SEQ ID NO: 6092694 - DNA, 22 bp, Homo sapiens
ccgggcaggggagccagggtag

SEQ ID NO: 6092695 - DNA, 16 bp, Homo sapiens
ccgggcaggtcctgcc

SEQ ID NO: 6092696 - DNA, 14 bp, Homo sapiens
cctgtgtactgtgt

SEQ ID NO: 6092697 - DNA, 14 bp, Homo sapiens
cctgtgtagccagt

SEQ ID NO: 6092698 - DNA, 15 bp, Homo sapiens
cctgtgtagctgtga

SEQ ID NO: 6092699 - DNA, 21 bp, Homo sapiens
cctgtgtagctgtgacctgct

SEQ ID NO: 6092700 - DNA, 14 bp, Homo sapiens
cctgtgtatggaaa

SEQ ID NO: 6092701 - DNA, 20 bp, Homo sapiens
cctgtgtatggaaaaaccat

SEQ ID NO: 6092702 - DNA, 20 bp, Homo sapiens
cctgtgtatggtgacctctc

SEQ ID NO: 6092703 - DNA, 22 bp, Homo sapiens
cctgtgtatggtgacctctccg

SEQ ID NO: 6092704 - DNA, 15 bp, Homo sapiens
cctgtgtcaatccag

SEQ ID NO: 6092705 - DNA, 21 bp, Homo sapiens
cctgtgtcaatccagatggtg

SEQ ID NO: 6092706 - DNA, 21 bp, Homo sapiens
cctgtgtcagaaaccctggtc

SEQ ID NO: 6092707 - DNA, 14 bp, Homo sapiens
cctgtgtcagagcc

SEQ ID NO: 6092708 - DNA, 15 bp, Homo sapiens
cctgtgtcagagcct

SEQ ID NO: 6092709 - DNA, 22 bp, Homo sapiens
cctgtgtcagtttatgttttgg

SEQ ID NO: 6092710 - DNA, 16 bp, Homo sapiens
cctgtgtccactgaga

SEQ ID NO: 6092711 - DNA, 13 bp, Homo sapiens
cctgtgtccatct

SEQ ID NO: 6092712 - DNA, 19 bp, Homo sapiens
cctgtgtccatctgaccgt

SEQ ID NO: 6092713 - DNA, 21 bp, Homo sapiens
cctgtgtccatgtgatctcat

SEQ ID NO: 6092714 - DNA, 13 bp, Homo sapiens
cctgtgtcccatg

SEQ ID NO: 6092715 - DNA, 13 bp, Homo sapiens
cctgtgtcctgaa

SEQ ID NO: 6092716 - DNA, 20 bp, Homo sapiens
cctgtgtctgcgaagtccta

SEQ ID NO: 6092717 - DNA, 14 bp, Homo sapiens
cctgtgtctgtcac

SEQ ID NO: 6092718 - DNA, 19 bp, Homo sapiens
cctgtgtcttgcaatggca

SEQ ID NO: 6092719 - DNA, 22 bp, Homo sapiens
cctgtgtcttgcaatggcagcc

SEQ ID NO: 6092720 - DNA, 18 bp, Homo sapiens
cctgtgtctttttcgcca

SEQ ID NO: 6092721 - DNA, 19 bp, Homo sapiens
cctgtgtgacatcacaggg

SEQ ID NO: 6092722 - DNA, 14 bp, Homo sapiens
cctgtgtgactcca

SEQ ID NO: 6092723 - DNA, 23 bp, Homo sapiens
cctgtgtgactggcaagaggcct

SEQ ID NO: 6092724 - DNA, 13 bp, Homo sapiens
cctgtgtgcagtg

SEQ ID NO: 6092725 - DNA, 15 bp, Homo sapiens
cctgtgtgcagtgga

SEQ ID NO: 6092726 - DNA, 14 bp, Homo sapiens
cctgtgtgcccagc

SEQ ID NO: 6092727 - DNA, 20 bp, Homo sapiens
cctgtgtgcccagcacctgg

SEQ ID NO: 6092728 - DNA, 21 bp, Homo sapiens
cctgtgtgcccagcacctgga

SEQ ID NO: 6092729 - DNA, 17 bp, Homo sapiens
cctgtgtgcgagtctga

SEQ ID NO: 6092730 - DNA, 15 bp, Homo sapiens
cctgtgtggacagga

SEQ ID NO: 6092731 - DNA, 17 bp, Homo sapiens
cctgtgtggacaggact

SEQ ID NO: 6092732 - DNA, 15 bp, Homo sapiens
cctgtgtggagaggg

SEQ ID NO: 6092733 - DNA, 15 bp, Homo sapiens
cctgtgtggccactt

SEQ ID NO: 6092734 - DNA, 15 bp, Homo sapiens
cctgtgtggccctgg

SEQ ID NO: 6092735 - DNA, 16 bp, Homo sapiens
cctgtgtggccctgga

SEQ ID NO: 6092736 - DNA, 18 bp, Homo sapiens
cctgtgtggccctggaca

SEQ ID NO: 6092737 - DNA, 20 bp, Homo sapiens
cctgtgtggccctggacaca

SEQ ID NO: 6092738 - DNA, 23 bp, Homo sapiens
cctgtgtggccctggacacagcc

SEQ ID NO: 6092739 - DNA, 14 bp, Homo sapiens
cctgtgtgggaggg

SEQ ID NO: 6092740 - DNA, 15 bp, Homo sapiens
cctgtgtgggagggc

SEQ ID NO: 6092741 - DNA, 18 bp, Homo sapiens
cctgtgtggggaggcagc

SEQ ID NO: 6092742 - DNA, 21 bp, Homo sapiens
cctgtgtggggaggcagctcc

SEQ ID NO: 6092743 - DNA, 19 bp, Homo sapiens
cctgtgtggtactctgaaa

SEQ ID NO: 6092744 - DNA, 20 bp, Homo sapiens
cctgtgtggtttagtgtaaa

SEQ ID NO: 6092745 - DNA, 18 bp, Homo sapiens
cctgtgtgtactctgtcc

SEQ ID NO: 6092746 - DNA, 19 bp, Homo sapiens
cctgtgtgtactctgtcca

SEQ ID NO: 6092747 - DNA, 20 bp, Homo sapiens
cctgtgtgtccaaaactgcc

SEQ ID NO: 6092748 - DNA, 16 bp, Homo sapiens
cctgtgtgtgggtggg

SEQ ID NO: 6092749 - DNA, 14 bp, Homo sapiens
cctgtgtgtgtgta

SEQ ID NO: 6092750 - DNA, 19 bp, Homo sapiens
cctgtgtgtgtgtgtgctg

SEQ ID NO: 6092751 - DNA, 18 bp, Homo sapiens
cctgtgtgtgtgtgtgta

SEQ ID NO: 6092752 - DNA, 21 bp, Homo sapiens
cctgtgtgttcttttgataca

SEQ ID NO: 6092753 - DNA, 20 bp, Homo sapiens
cctgtgtgttgccaggcagg

SEQ ID NO: 6092754 - DNA, 21 bp, Homo sapiens
cctgtgtgtttgacatgtgaa

SEQ ID NO: 6092755 - DNA, 13 bp, Homo sapiens
cctgtgttaattt

SEQ ID NO: 6092756 - DNA, 14 bp, Homo sapiens
cctgtgttaattta

SEQ ID NO: 6092757 - DNA, 20 bp, Homo sapiens
cctgtgttagtgtctgtcca

SEQ ID NO: 6092758 - DNA, 13 bp, Homo sapiens
cctgtgttctggg

SEQ ID NO: 6092759 - DNA, 15 bp, Homo sapiens
cctgtgttctgggct

SEQ ID NO: 6092760 - DNA, 16 bp, Homo sapiens
cctgtgttctgggctg

SEQ ID NO: 6092761 - DNA, 17 bp, Homo sapiens
cctgtgttctgggctgg

SEQ ID NO: 6092762 - DNA, 19 bp, Homo sapiens
cctgtgttctgggctgggg

SEQ ID NO: 6092763 - DNA, 18 bp, Homo sapiens
cctgtgttgtcccatctg

SEQ ID NO: 6092764 - DNA, 20 bp, Homo sapiens
cctgtgttgtctctagagca

SEQ ID NO: 6092765 - DNA, 23 bp, Homo sapiens
cctgtgtttcatgttctgtgtca

SEQ ID NO: 6092766 - DNA, 18 bp, Homo sapiens
cctgtgtttgtcctgggt

SEQ ID NO: 6092767 - DNA, 18 bp, Homo sapiens
cctgtgtttttttctaaa

SEQ ID NO: 6092768 - DNA, 21 bp, Homo sapiens
cctgttaaaagatgaaaatat

SEQ ID NO: 6092769 - DNA, 14 bp, Homo sapiens
cctgttaaacagta

SEQ ID NO: 6092770 - DNA, 16 bp, Homo sapiens
cctgttaaattttctc

SEQ ID NO: 6092771 - DNA, 21 bp, Homo sapiens
cctgttaacactgtaatatct

SEQ ID NO: 6092772 - DNA, 14 bp, Homo sapiens
cctgttaaccctcc

SEQ ID NO: 6092773 - DNA, 19 bp, Homo sapiens
cctgttaacgtcatctcag

SEQ ID NO: 6092774 - DNA, 20 bp, Homo sapiens
cctgttaagagataattctt

SEQ ID NO: 6092775 - DNA, 22 bp, Homo sapiens
cctgttaatttataatgtattt

SEQ ID NO: 6092776 - DNA, 14 bp, Homo sapiens
cctgttacaatatt

SEQ ID NO: 6092777 - DNA, 13 bp, Homo sapiens
cctgttacactgg

SEQ ID NO: 6092778 - DNA, 21 bp, Homo sapiens
cctgttacctaattagagcag

SEQ ID NO: 6092779 - DNA, 17 bp, Homo sapiens
cctgttacctactttga

SEQ ID NO: 6092780 - DNA, 16 bp, Homo sapiens
cctgttactctgtccc

SEQ ID NO: 6092781 - DNA, 17 bp, Homo sapiens
cctgttacttaaatagc

SEQ ID NO: 6092782 - DNA, 23 bp, Homo sapiens
cctgttacttgaaataccagtga

SEQ ID NO: 6092783 - DNA, 16 bp, Homo sapiens
cctgttagcagacagg

SEQ ID NO: 6092784 - DNA, 13 bp, Homo sapiens
cctgttagccagg

SEQ ID NO: 6092785 - DNA, 18 bp, Homo sapiens
cctgttagctcctcactg

SEQ ID NO: 6092786 - DNA, 23 bp, Homo sapiens
cctgttagctcctcactgtggta

SEQ ID NO: 6092787 - DNA, 18 bp, Homo sapiens
cctgttagctgttatttc

SEQ ID NO: 6092788 - DNA, 20 bp, Homo sapiens
cctgttaggccaactgcctc

SEQ ID NO: 6092789 - DNA, 21 bp, Homo sapiens
cctgttaggccaactgcctcc

SEQ ID NO: 6092790 - DNA, 18 bp, Homo sapiens
cctgttaggggaaaatag

SEQ ID NO: 6092791 - DNA, 20 bp, Homo sapiens
cctgttaggggaaaatagta

SEQ ID NO: 6092792 - DNA, 19 bp, Homo sapiens
cctgttaggtctcatgccc

SEQ ID NO: 6092793 - DNA, 21 bp, Homo sapiens
cctgttatgccaaacagttgt

SEQ ID NO: 6092794 - DNA, 20 bp, Homo sapiens
cctgttatggaaaatgtcaa

SEQ ID NO: 6092795 - DNA, 15 bp, Homo sapiens
cctgttattttatgt

SEQ ID NO: 6092796 - DNA, 13 bp, Homo sapiens
cctgttattttca

SEQ ID NO: 6092797 - DNA, 14 bp, Homo sapiens
cctgttatttttct

SEQ ID NO: 6092798 - DNA, 18 bp, Homo sapiens
cctgttatttttctgccc

SEQ ID NO: 6092799 - DNA, 21 bp, Homo sapiens
cctgttatttttctgccctgg

SEQ ID NO: 6092800 - DNA, 13 bp, Homo sapiens
cctgttcaaagta

SEQ ID NO: 6092801 - DNA, 23 bp, Homo sapiens
cctgttcagaaaggggctcttct

SEQ ID NO: 6092802 - DNA, 13 bp, Homo sapiens
cctgttcagctcc

SEQ ID NO: 6092803 - DNA, 19 bp, Homo sapiens
cctgttcagctccagctca

SEQ ID NO: 6092804 - DNA, 19 bp, Homo sapiens
cctgttcagtgtcccgggc

SEQ ID NO: 6092805 - DNA, 11 bp, Homo sapiens
cctgttcagtt

SEQ ID NO: 6092806 - DNA, 15 bp, Homo sapiens
cctgttcatgtgcct

SEQ ID NO: 6092807 - DNA, 16 bp, Homo sapiens
cctgttcatgtgcctc

SEQ ID NO: 6092808 - DNA, 17 bp, Homo sapiens
cctgttcccaagcaaag

SEQ ID NO: 6092809 - DNA, 16 bp, Homo sapiens
cctgttccccagagaa

SEQ ID NO: 6092810 - DNA, 23 bp, Homo sapiens
cctgttccccagagaaaggggag

SEQ ID NO: 6092811 - DNA, 17 bp, Homo sapiens
cctgttcccccgctggc

SEQ ID NO: 6092812 - DNA, 22 bp, Homo sapiens
cctgttcccctcactggatgaa

SEQ ID NO: 6092813 - DNA, 16 bp, Homo sapiens
cctgttcccctctccc

SEQ ID NO: 6092814 - DNA, 13 bp, Homo sapiens
cctgttccctacc

SEQ ID NO: 6092815 - DNA, 16 bp, Homo sapiens
cctgttccctagagag

SEQ ID NO: 6092816 - DNA, 22 bp, Homo sapiens
cctgttccctagagagaataaa

SEQ ID NO: 6092817 - DNA, 12 bp, Homo sapiens
cctgttccctcc

SEQ ID NO: 6092818 - DNA, 13 bp, Homo sapiens
cctgttccctcct

SEQ ID NO: 6092819 - DNA, 19 bp, Homo sapiens
cctgttccctcctggtcct

SEQ ID NO: 6092820 - DNA, 16 bp, Homo sapiens
cctgttccctgaggac

SEQ ID NO: 6092821 - DNA, 19 bp, Homo sapiens
cctgttccctgaggacctg

SEQ ID NO: 6092822 - DNA, 15 bp, Homo sapiens
cctgttcccttcctg

SEQ ID NO: 6092823 - DNA, 12 bp, Homo sapiens
cctgttccgcct

SEQ ID NO: 6092824 - DNA, 14 bp, Homo sapiens
cctgttcctgctgc

SEQ ID NO: 6092825 - DNA, 13 bp, Homo sapiens
cctgttccttcct

SEQ ID NO: 6092826 - DNA, 22 bp, Homo sapiens
cctgttccttcctgcagacctg

SEQ ID NO: 6092827 - DNA, 22 bp, Homo sapiens
cctgttcctttgagtgtcttct

SEQ ID NO: 6092828 - DNA, 12 bp, Homo sapiens
cctgttctcaga

SEQ ID NO: 6092829 - DNA, 23 bp, Homo sapiens
cctgttctcagagctccacagaa

SEQ ID NO: 6092830 - DNA, 14 bp, Homo sapiens
cctgttctcagcat

SEQ ID NO: 6092831 - DNA, 16 bp, Homo sapiens
cctgttctcagctccg

SEQ ID NO: 6092832 - DNA, 13 bp, Homo sapiens
cctgttctccaga

SEQ ID NO: 6092833 - DNA, 14 bp, Homo sapiens
cctgttctcccttt

SEQ ID NO: 6092834 - DNA, 21 bp, Homo sapiens
cctgttctccctttctctctc

SEQ ID NO: 6092835 - DNA, 24 bp, Homo sapiens
cctgttctccctttctctctcctc

SEQ ID NO: 6092836 - DNA, 16 bp, Homo sapiens
cctgttctcctgtccc

SEQ ID NO: 6092837 - DNA, 15 bp, Homo sapiens
cctgttctcttgtat

SEQ ID NO: 6092838 - DNA, 18 bp, Homo sapiens
cctgttctcttgtatagc

SEQ ID NO: 6092839 - DNA, 13 bp, Homo sapiens
cctgttctgaaat

SEQ ID NO: 6092840 - DNA, 16 bp, Homo sapiens
cctgttctgcgctgtg

SEQ ID NO: 6092841 - DNA, 16 bp, Homo sapiens
cctgttctgctttcct

SEQ ID NO: 6092842 - DNA, 13 bp, Homo sapiens
cctgttctgtgtc

SEQ ID NO: 6092843 - DNA, 24 bp, Homo sapiens
cctgttcttcctccagctgcacca

SEQ ID NO: 6092844 - DNA, 20 bp, Homo sapiens
cctgttcttccttcctagaa

SEQ ID NO: 6092845 - DNA, 14 bp, Homo sapiens
cctgttcttgaggt

SEQ ID NO: 6092846 - DNA, 23 bp, Homo sapiens
cctgttgaattttgttctctggg

SEQ ID NO: 6092847 - DNA, 19 bp, Homo sapiens
cctgttgacacaggtcttt

SEQ ID NO: 6092848 - DNA, 22 bp, Homo sapiens
cctgttgacacaggtctttcct

SEQ ID NO: 6092849 - DNA, 16 bp, Homo sapiens
cctgttgacctaccct

SEQ ID NO: 6092850 - DNA, 13 bp, Homo sapiens
cctgttgacctgc

SEQ ID NO: 6092851 - DNA, 14 bp, Homo sapiens
cctgttgacctgcc

SEQ ID NO: 6092852 - DNA, 21 bp, Homo sapiens
cctgttgaggtgggtgggcct

SEQ ID NO: 6092853 - DNA, 23 bp, Homo sapiens
cctgttgaggtgggtgggcctga

SEQ ID NO: 6092854 - DNA, 19 bp, Homo sapiens
cctgttgagtatttgctgt

SEQ ID NO: 6092855 - DNA, 24 bp, Homo sapiens
cctgttgagtatttgctgtttgtc

SEQ ID NO: 6092856 - DNA, 13 bp, Homo sapiens
cctgttgatggga

SEQ ID NO: 6092857 - DNA, 23 bp, Homo sapiens
cctgttgattaatttctgccatt

SEQ ID NO: 6092858 - DNA, 14 bp, Homo sapiens
cctgttgcacccag

SEQ ID NO: 6092859 - DNA, 15 bp, Homo sapiens
cctgttgcacccagc

SEQ ID NO: 6092860 - DNA, 18 bp, Homo sapiens
cctgttgcacccagccct

SEQ ID NO: 6092861 - DNA, 20 bp, Homo sapiens
cctgttgcacccagccctgg

SEQ ID NO: 6092862 - DNA, 14 bp, Homo sapiens
cctgttgcacctca

SEQ ID NO: 6092863 - DNA, 12 bp, Homo sapiens
cctgttgcactg

SEQ ID NO: 6092864 - DNA, 18 bp, Homo sapiens
cctgttgcaggcaaatgt

SEQ ID NO: 6092865 - DNA, 14 bp, Homo sapiens
cctgttgctgtctt

SEQ ID NO: 6092866 - DNA, 17 bp, Homo sapiens
cctgttgcttacaattt

SEQ ID NO: 6092867 - DNA, 19 bp, Homo sapiens
cctgttgctttcttcctgc

SEQ ID NO: 6092868 - DNA, 18 bp, Homo sapiens
cctgttggcaggcccact

SEQ ID NO: 6092869 - DNA, 14 bp, Homo sapiens
cctgttggcctgtg

SEQ ID NO: 6092870 - DNA, 17 bp, Homo sapiens
cctgttggcctgtgggc

SEQ ID NO: 6092871 - DNA, 13 bp, Homo sapiens
cctgttggctgct

SEQ ID NO: 6092872 - DNA, 14 bp, Homo sapiens
cctgttggctgctg

SEQ ID NO: 6092873 - DNA, 17 bp, Homo sapiens
cctgttgggcagagctg

SEQ ID NO: 6092874 - DNA, 17 bp, Homo sapiens
cctgttgggggcttcag

SEQ ID NO: 6092875 - DNA, 21 bp, Homo sapiens
ccgggcaggtcctgcccatgt

SEQ ID NO: 6092876 - DNA, 17 bp, Homo sapiens
ccgggcatgtctgcctg

SEQ ID NO: 6092877 - DNA, 20 bp, Homo sapiens
ccgggcatgtctgcctggag

SEQ ID NO: 6092878 - DNA, 17 bp, Homo sapiens
ccgggccacgcaggggc

SEQ ID NO: 6092879 - DNA, 18 bp, Homo sapiens
ccgggccacgcaggggct

SEQ ID NO: 6092880 - DNA, 21 bp, Homo sapiens
ccgggccactccttcctgccc

SEQ ID NO: 6092881 - DNA, 13 bp, Homo sapiens
ccgggccagggct

SEQ ID NO: 6092882 - DNA, 10 bp, Homo sapiens
ccgggcccag

SEQ ID NO: 6092883 - DNA, 20 bp, Homo sapiens
ccgggcccagaggagctggg

SEQ ID NO: 6092884 - DNA, 14 bp, Homo sapiens
ccgggcccaggcag

SEQ ID NO: 6092885 - DNA, 18 bp, Homo sapiens
ccgggccccatggtcaca

SEQ ID NO: 6092886 - DNA, 15 bp, Homo sapiens
ccgggcccccaccgc

SEQ ID NO: 6092887 - DNA, 16 bp, Homo sapiens
ccgggcccccaccgcc

SEQ ID NO: 6092888 - DNA, 12 bp, Homo sapiens
ccgggcccccct

SEQ ID NO: 6092889 - DNA, 16 bp, Homo sapiens
ccgggcccctggcacg

SEQ ID NO: 6092890 - DNA, 16 bp, Homo sapiens
ccgggccctcagccct

SEQ ID NO: 6092891 - DNA, 17 bp, Homo sapiens
ccgggccctctgtagct

SEQ ID NO: 6092892 - DNA, 18 bp, Homo sapiens
ccgggccctctgtagctc

SEQ ID NO: 6092893 - DNA, 22 bp, Homo sapiens
ccgggccgaccctgcggcctcc

SEQ ID NO: 6092894 - DNA, 18 bp, Homo sapiens
ccgggccggacgcaggtg

SEQ ID NO: 6092895 - DNA, 17 bp, Homo sapiens
ccgggcctcagggtcct

SEQ ID NO: 6092896 - DNA, 12 bp, Homo sapiens
ccgggcctccca

SEQ ID NO: 6092897 - DNA, 12 bp, Homo sapiens
ccgggcctcggc

SEQ ID NO: 6092898 - DNA, 18 bp, Homo sapiens
ccgggcctcggcctggct

SEQ ID NO: 6092899 - DNA, 19 bp, Homo sapiens
ccgggcctcggcctggctt

SEQ ID NO: 6092900 - DNA, 12 bp, Homo sapiens
ccgggcctgcac

SEQ ID NO: 6092901 - DNA, 13 bp, Homo sapiens
ccgggcctggggc

SEQ ID NO: 6092902 - DNA, 13 bp, Homo sapiens
ccgggcgcatgcc

SEQ ID NO: 6092903 - DNA, 21 bp, Homo sapiens
ccgggcgcatgcctcccaggc

SEQ ID NO: 6092904 - DNA, 17 bp, Homo sapiens
ccgggcgccaggacagc

SEQ ID NO: 6092905 - DNA, 20 bp, Homo sapiens
ccgggcgccaggacagcagc

SEQ ID NO: 6092906 - DNA, 21 bp, Homo sapiens
ccgggcgcggtggcgggcacc

SEQ ID NO: 6092907 - DNA, 22 bp, Homo sapiens
ccgggcgggcgtgggaggaggg

SEQ ID NO: 6092908 - DNA, 21 bp, Homo sapiens
ccgggctcagggaccacagca

SEQ ID NO: 6092909 - DNA, 19 bp, Homo sapiens
ccgggctccatgcctctgg

SEQ ID NO: 6092910 - DNA, 15 bp, Homo sapiens
ccgggctcccacacc

SEQ ID NO: 6092911 - DNA, 16 bp, Homo sapiens
ccgggctctcctgccc

SEQ ID NO: 6092912 - DNA, 23 bp, Homo sapiens
ccgggctctcctgccctgccctc

SEQ ID NO: 6092913 - DNA, 13 bp, Homo sapiens
ccgggctctctgc

SEQ ID NO: 6092914 - DNA, 11 bp, Homo sapiens
ccgggctctgc

SEQ ID NO: 6092915 - DNA, 12 bp, Homo sapiens
ccgggctctgca

SEQ ID NO: 6092916 - DNA, 14 bp, Homo sapiens
ccgggctctgcctc

SEQ ID NO: 6092917 - DNA, 18 bp, Homo sapiens
ccgggctctgcctcccat

SEQ ID NO: 6092918 - DNA, 17 bp, Homo sapiens
ccgggctctggccaccc

SEQ ID NO: 6092919 - DNA, 16 bp, Homo sapiens
ccgggctgagggcctg

SEQ ID NO: 6092920 - DNA, 21 bp, Homo sapiens
ccgggctgagggcctgctgga

SEQ ID NO: 6092921 - DNA, 11 bp, Homo sapiens
ccgggctgccc

SEQ ID NO: 6092922 - DNA, 24 bp, Homo sapiens
ccgggctgcccttcgctgccagga

SEQ ID NO: 6092923 - DNA, 17 bp, Homo sapiens
ccgggctgcctgggctg

SEQ ID NO: 6092924 - DNA, 21 bp, Homo sapiens
ccgggctgcctgggctgttgg

SEQ ID NO: 6092925 - DNA, 23 bp, Homo sapiens
ccgggctggagaaagagctgcct

SEQ ID NO: 6092926 - DNA, 12 bp, Homo sapiens
ccgggctggccc

SEQ ID NO: 6092927 - DNA, 19 bp, Homo sapiens
ccgggctggccctgtgcag

SEQ ID NO: 6092928 - DNA, 12 bp, Homo sapiens
ccgggctggcct

SEQ ID NO: 6092929 - DNA, 23 bp, Homo sapiens
ccgggctggcctgacacaatggt

SEQ ID NO: 6092930 - DNA, 22 bp, Homo sapiens
ccgggctggctgcttgcagcca

SEQ ID NO: 6092931 - DNA, 23 bp, Homo sapiens
ccgggctggctgcttgcagccag

SEQ ID NO: 6092932 - DNA, 19 bp, Homo sapiens
ccgggctggcttctccctg

SEQ ID NO: 6092933 - DNA, 13 bp, Homo sapiens
ccgggctgggagc

SEQ ID NO: 6092934 - DNA, 20 bp, Homo sapiens
ccgggcttcccttctcccca

SEQ ID NO: 6092935 - DNA, 22 bp, Homo sapiens
ccgggcttcccttctccccagc

SEQ ID NO: 6092936 - DNA, 17 bp, Homo sapiens
ccgggcttgggccctgc

SEQ ID NO: 6092937 - DNA, 21 bp, Homo sapiens
ccgggcttgggccctgcacag

SEQ ID NO: 6092938 - DNA, 12 bp, Homo sapiens
ccggggaacaaa

SEQ ID NO: 6092939 - DNA, 15 bp, Homo sapiens
ccggggaactggcca

SEQ ID NO: 6092940 - DNA, 16 bp, Homo sapiens
ccggggaagctgccag

SEQ ID NO: 6092941 - DNA, 18 bp, Homo sapiens
ccggggaagctgccagcc

SEQ ID NO: 6092942 - DNA, 15 bp, Homo sapiens
ccggggacagaggcc

SEQ ID NO: 6092943 - DNA, 17 bp, Homo sapiens
ccggggaccgggacccg

SEQ ID NO: 6092944 - DNA, 13 bp, Homo sapiens
ccggggagctgag

SEQ ID NO: 6092945 - DNA, 12 bp, Homo sapiens
ccggggagctgc

SEQ ID NO: 6092946 - DNA, 13 bp, Homo sapiens
ccggggaggagcc

SEQ ID NO: 6092947 - DNA, 16 bp, Homo sapiens
ccggggaggagccttg

SEQ ID NO: 6092948 - DNA, 23 bp, Homo sapiens
ccggggaggcaggggtcctgcag

SEQ ID NO: 6092949 - DNA, 13 bp, Homo sapiens
ccggggagggggc

SEQ ID NO: 6092950 - DNA, 15 bp, Homo sapiens
ccggggatggatctt

SEQ ID NO: 6092951 - DNA, 17 bp, Homo sapiens
ccggggcaagagggaag

SEQ ID NO: 6092952 - DNA, 19 bp, Homo sapiens
ccggggcagcagcagccct

SEQ ID NO: 6092953 - DNA, 19 bp, Homo sapiens
ccggggcagctgccagaga

SEQ ID NO: 6092954 - DNA, 15 bp, Homo sapiens
ccggggcagctggca

SEQ ID NO: 6092955 - DNA, 16 bp, Homo sapiens
ccggggcagggcagcc

SEQ ID NO: 6092956 - DNA, 15 bp, Homo sapiens
ccggggccagcactt

SEQ ID NO: 6092957 - DNA, 12 bp, Homo sapiens
ccggggccatgg

SEQ ID NO: 6092958 - DNA, 15 bp, Homo sapiens
ccggggcccaggact

SEQ ID NO: 6092959 - DNA, 12 bp, Homo sapiens
ccggggccccct

SEQ ID NO: 6092960 - DNA, 13 bp, Homo sapiens
ccggggcccctca

SEQ ID NO: 6092961 - DNA, 14 bp, Homo sapiens
ccggggcctggaca

SEQ ID NO: 6092962 - DNA, 14 bp, Homo sapiens
ccggggccttcctt

SEQ ID NO: 6092963 - DNA, 17 bp, Homo sapiens
ccggggctgctggcctg

SEQ ID NO: 6092964 - DNA, 19 bp, Homo sapiens
ccggggctggcggctactc

SEQ ID NO: 6092965 - DNA, 13 bp, Homo sapiens
ccggggctgggtt

SEQ ID NO: 6092966 - DNA, 13 bp, Homo sapiens
ccgggggacagag

SEQ ID NO: 6092967 - DNA, 21 bp, Homo sapiens
ccgggggacgcctgccctgcc

SEQ ID NO: 6092968 - DNA, 12 bp, Homo sapiens
ccgggggagagg

SEQ ID NO: 6092969 - DNA, 17 bp, Homo sapiens
ccgggggaggggccctc

SEQ ID NO: 6092970 - DNA, 15 bp, Homo sapiens
ccgggggaggggcgc

SEQ ID NO: 6092971 - DNA, 16 bp, Homo sapiens
ccgggggccccacctc

SEQ ID NO: 6092972 - DNA, 13 bp, Homo sapiens
ccgggggctgctg

SEQ ID NO: 6092973 - DNA, 15 bp, Homo sapiens
ccgggggctgctggg

SEQ ID NO: 6092974 - DNA, 17 bp, Homo sapiens
ccgggggctgctgggcg

SEQ ID NO: 6092975 - DNA, 18 bp, Homo sapiens
ccgggggctgctgggcgt

SEQ ID NO: 6092976 - DNA, 19 bp, Homo sapiens
ccggggggaaagaaaagga

SEQ ID NO: 6092977 - DNA, 20 bp, Homo sapiens
ccggggggaggggacagagc

SEQ ID NO: 6092978 - DNA, 22 bp, Homo sapiens
ccggggggggtaggagaggaga

SEQ ID NO: 6092979 - DNA, 12 bp, Homo sapiens
ccgggggtgggg

SEQ ID NO: 6092980 - DNA, 16 bp, Homo sapiens
ccggggtccaggcatg

SEQ ID NO: 6092981 - DNA, 15 bp, Homo sapiens
ccggggtccaggccc

SEQ ID NO: 6092982 - DNA, 12 bp, Homo sapiens
ccggggtcctgg

SEQ ID NO: 6092983 - DNA, 22 bp, Homo sapiens
ccggggtcctgggaggctgcag

SEQ ID NO: 6092984 - DNA, 12 bp, Homo sapiens
ccggggtcctgt

SEQ ID NO: 6092985 - DNA, 23 bp, Homo sapiens
ccggggtcctgtggcaggcagcg

SEQ ID NO: 6092986 - DNA, 18 bp, Homo sapiens
ccggggtctcctggacct

SEQ ID NO: 6092987 - DNA, 22 bp, Homo sapiens
ccggggtctgtgctgtgcctgc

SEQ ID NO: 6092988 - DNA, 23 bp, Homo sapiens
ccggggtctgtgctgtgcctgct

SEQ ID NO: 6092989 - DNA, 22 bp, Homo sapiens
ccggggtgagggggggctccct

SEQ ID NO: 6092990 - DNA, 20 bp, Homo sapiens
ccggggtgcccacaggccgc

SEQ ID NO: 6092991 - DNA, 20 bp, Homo sapiens
ccggggtgcccgtgtggcct

SEQ ID NO: 6092992 - DNA, 23 bp, Homo sapiens
ccggggtgcccgtgtggcctggg

SEQ ID NO: 6092993 - DNA, 13 bp, Homo sapiens
ccggggtggagtc

SEQ ID NO: 6092994 - DNA, 18 bp, Homo sapiens
ccggggtggggtgcctga

SEQ ID NO: 6092995 - DNA, 18 bp, Homo sapiens
ccggggtggggtggctgc

SEQ ID NO: 6092996 - DNA, 22 bp, Homo sapiens
ccggggtgggtgggtgggcagg

SEQ ID NO: 6092997 - DNA, 18 bp, Homo sapiens
ccggggtgtaacttcctg

SEQ ID NO: 6092998 - DNA, 19 bp, Homo sapiens
ccggggtgtaacttcctgc

SEQ ID NO: 6092999 - DNA, 19 bp, Homo sapiens
ccggggttcaagccatggc

SEQ ID NO: 6093000 - DNA, 19 bp, Homo sapiens
ccggggttccccacacagg

SEQ ID NO: 6093001 - DNA, 18 bp, Homo sapiens
ccgggtacctcagtttct

SEQ ID NO: 6093002 - DNA, 24 bp, Homo sapiens
ccgggtcacacaaaggcatgctgg

SEQ ID NO: 6093003 - DNA, 16 bp, Homo sapiens
ccgggtcaccctgtga

SEQ ID NO: 6093004 - DNA, 15 bp, Homo sapiens
ccgggtcactgctgt

SEQ ID NO: 6093005 - DNA, 16 bp, Homo sapiens
ccgggtcactgctgta

SEQ ID NO: 6093006 - DNA, 12 bp, Homo sapiens
ccgggtccagga

SEQ ID NO: 6093007 - DNA, 15 bp, Homo sapiens
ccgggtccccagctc

SEQ ID NO: 6093008 - DNA, 17 bp, Homo sapiens
ccgggtccccagctccc

SEQ ID NO: 6093009 - DNA, 20 bp, Homo sapiens
ccgggtccccagctccccag

SEQ ID NO: 6093010 - DNA, 13 bp, Homo sapiens
ccgggtccggcct

SEQ ID NO: 6093011 - DNA, 23 bp, Homo sapiens
ccgggtccggcctctccctgcct

SEQ ID NO: 6093012 - DNA, 13 bp, Homo sapiens
ccgggtcctccta

SEQ ID NO: 6093013 - DNA, 21 bp, Homo sapiens
ccgggtgaaaatgccagtctg

SEQ ID NO: 6093014 - DNA, 14 bp, Homo sapiens
ccgggtgccattcc

SEQ ID NO: 6093015 - DNA, 16 bp, Homo sapiens
ccgggtgcctgtgacc

SEQ ID NO: 6093016 - DNA, 13 bp, Homo sapiens
ccgggtggcagcg

SEQ ID NO: 6093017 - DNA, 13 bp, Homo sapiens
ccgggtgggcctg

SEQ ID NO: 6093018 - DNA, 14 bp, Homo sapiens
ccgggtgggcctgg

SEQ ID NO: 6093019 - DNA, 18 bp, Homo sapiens
ccgggtgggcctggcctg

SEQ ID NO: 6093020 - DNA, 20 bp, Homo sapiens
ccgggtgggcctggcctgag

SEQ ID NO: 6093021 - DNA, 20 bp, Homo sapiens
ccgggtggggggagggcacc

SEQ ID NO: 6093022 - DNA, 23 bp, Homo sapiens
ccgggtgtccccaacagcgccca

SEQ ID NO: 6093023 - DNA, 16 bp, Homo sapiens
ccgggtgtggcacgca

SEQ ID NO: 6093024 - DNA, 22 bp, Homo sapiens
ccgggtgtggcctcagccctca

SEQ ID NO: 6093025 - DNA, 23 bp, Homo sapiens
ccgggttcaagagattctgcctc

SEQ ID NO: 6093026 - DNA, 13 bp, Homo sapiens
ccgggttcagcct

SEQ ID NO: 6093027 - DNA, 16 bp, Homo sapiens
ccgggttcagcctggc

SEQ ID NO: 6093028 - DNA, 12 bp, Homo sapiens
ccgggttccagc

SEQ ID NO: 6093029 - DNA, 15 bp, Homo sapiens
ccgggttccagcacc

SEQ ID NO: 6093030 - DNA, 23 bp, Homo sapiens
ccgggttcgcaccattctcctgc

SEQ ID NO: 6093031 - DNA, 20 bp, Homo sapiens
ccgggttctagtctcctttg

SEQ ID NO: 6093032 - DNA, 18 bp, Homo sapiens
ccgggttggaggcctcac

SEQ ID NO: 6093033 - DNA, 19 bp, Homo sapiens
ccgggtttggcgggccaag

SEQ ID NO: 6093034 - DNA, 20 bp, Homo sapiens
ccgggtttggcgggccaagg

SEQ ID NO: 6093035 - DNA, 21 bp, Homo sapiens
ccgggtttggcgggccaagga

SEQ ID NO: 6093036 - DNA, 22 bp, Homo sapiens
ccggtaaacacgcctgcaaacg

SEQ ID NO: 6093037 - DNA, 15 bp, Homo sapiens
ccggtaactgtcctg

SEQ ID NO: 6093038 - DNA, 19 bp, Homo sapiens
ccggtagaggctccccagg

SEQ ID NO: 6093039 - DNA, 23 bp, Homo sapiens
ccggtcaccgagacggctggacc

SEQ ID NO: 6093040 - DNA, 19 bp, Homo sapiens
ccggtcacctagcaagctg

SEQ ID NO: 6093041 - DNA, 15 bp, Homo sapiens
ccggtcacgttcttg

SEQ ID NO: 6093042 - DNA, 23 bp, Homo sapiens
ccggtcagaggagcgcaggcagc

SEQ ID NO: 6093043 - DNA, 13 bp, Homo sapiens
ccggtcagccaag

SEQ ID NO: 6093044 - DNA, 13 bp, Homo sapiens
ccggtcagtgcct

SEQ ID NO: 6093045 - DNA, 20 bp, Homo sapiens
ccggtcagtgccttttggaa

SEQ ID NO: 6093046 - DNA, 16 bp, Homo sapiens
ccggtccacaggtcca

SEQ ID NO: 6093047 - DNA, 23 bp, Homo sapiens
ccggtcccacccctccctctgtc

SEQ ID NO: 6093048 - DNA, 12 bp, Homo sapiens
ccggtcccagcc

SEQ ID NO: 6093049 - DNA, 16 bp, Homo sapiens
ccggtcccagcctggg

SEQ ID NO: 6093050 - DNA, 17 bp, Homo sapiens
ccggtcccagcctgggc

SEQ ID NO: 6093051 - DNA, 13 bp, Homo sapiens
ccggtcccaggcc

SEQ ID NO: 6093052 - DNA, 14 bp, Homo sapiens
ccggtcccaggccg

SEQ ID NO: 6093053 - DNA, 15 bp, Homo sapiens
ccggtcccaggccgc

SEQ ID NO: 6093054 - DNA, 12 bp, Homo sapiens
ccggtcccccag

SEQ ID NO: 6093055 - DNA, 13 bp, Homo sapiens
cctgttggttcca

SEQ ID NO: 6093056 - DNA, 19 bp, Homo sapiens
cctgttgtcagatctattg

SEQ ID NO: 6093057 - DNA, 17 bp, Homo sapiens
cctgttgtctgaaacat

SEQ ID NO: 6093058 - DNA, 15 bp, Homo sapiens
cctgttgtgccacag

SEQ ID NO: 6093059 - DNA, 20 bp, Homo sapiens
cctgttgtgtaataacagaa

SEQ ID NO: 6093060 - DNA, 13 bp, Homo sapiens
cctgttgtgtgcc

SEQ ID NO: 6093061 - DNA, 14 bp, Homo sapiens
cctgtttaaatatt

SEQ ID NO: 6093062 - DNA, 12 bp, Homo sapiens
cctgtttaagag

SEQ ID NO: 6093063 - DNA, 15 bp, Homo sapiens
cctgtttaatattta

SEQ ID NO: 6093064 - DNA, 21 bp, Homo sapiens
cctgtttaatgttatgaggac

SEQ ID NO: 6093065 - DNA, 18 bp, Homo sapiens
cctgtttacggtacttgg

SEQ ID NO: 6093066 - DNA, 13 bp, Homo sapiens
cctgtttactgat

SEQ ID NO: 6093067 - DNA, 17 bp, Homo sapiens
cctgtttattccaaatg

SEQ ID NO: 6093068 - DNA, 19 bp, Homo sapiens
cctgtttattcccatcttt

SEQ ID NO: 6093069 - DNA, 20 bp, Homo sapiens
cctgtttcccgtaaggctgt

SEQ ID NO: 6093070 - DNA, 11 bp, Homo sapiens
cctgtttctaa

SEQ ID NO: 6093071 - DNA, 15 bp, Homo sapiens
cctgtttctacctat

SEQ ID NO: 6093072 - DNA, 16 bp, Homo sapiens
cctgtttctcctccat

SEQ ID NO: 6093073 - DNA, 13 bp, Homo sapiens
cctgtttctctgc

SEQ ID NO: 6093074 - DNA, 18 bp, Homo sapiens
cctgtttctgcagccctt

SEQ ID NO: 6093075 - DNA, 14 bp, Homo sapiens
cctgtttctggcac

SEQ ID NO: 6093076 - DNA, 23 bp, Homo sapiens
cctgtttgaagcctgcccttgtc

SEQ ID NO: 6093077 - DNA, 17 bp, Homo sapiens
cctgtttgaaggggaga

SEQ ID NO: 6093078 - DNA, 21 bp, Homo sapiens
cctgtttggaaatggggagct

SEQ ID NO: 6093079 - DNA, 22 bp, Homo sapiens
cctgtttggaaatggggagctg

SEQ ID NO: 6093080 - DNA, 23 bp, Homo sapiens
cctgtttggaaatggggagctgg

SEQ ID NO: 6093081 - DNA, 13 bp, Homo sapiens
cctgtttggattt

SEQ ID NO: 6093082 - DNA, 16 bp, Homo sapiens
cctgtttggattttta

SEQ ID NO: 6093083 - DNA, 22 bp, Homo sapiens
cctgtttgggaatgaggcactt

SEQ ID NO: 6093084 - DNA, 18 bp, Homo sapiens
cctgtttgggaggctgga

SEQ ID NO: 6093085 - DNA, 21 bp, Homo sapiens
cctgtttgggcccctctccca

SEQ ID NO: 6093086 - DNA, 14 bp, Homo sapiens
cctgtttggggagg

SEQ ID NO: 6093087 - DNA, 23 bp, Homo sapiens
cctgtttggtagtctcttcacag

SEQ ID NO: 6093088 - DNA, 17 bp, Homo sapiens
cctgtttggtgaggacc

SEQ ID NO: 6093089 - DNA, 16 bp, Homo sapiens
cctgtttggtggggtg

SEQ ID NO: 6093090 - DNA, 15 bp, Homo sapiens
cctgtttgtattttt

SEQ ID NO: 6093091 - DNA, 18 bp, Homo sapiens
cctgttttagtttctgaa

SEQ ID NO: 6093092 - DNA, 20 bp, Homo sapiens
cctgttttagtttctgaact

SEQ ID NO: 6093093 - DNA, 23 bp, Homo sapiens
cctgttttattgagttctgaagg

SEQ ID NO: 6093094 - DNA, 19 bp, Homo sapiens
cctgttttcacaccttaca

SEQ ID NO: 6093095 - DNA, 18 bp, Homo sapiens
cctgttttcatggacagc

SEQ ID NO: 6093096 - DNA, 21 bp, Homo sapiens
cctgttttcatggacagctga

SEQ ID NO: 6093097 - DNA, 14 bp, Homo sapiens
cctgttttctccct

SEQ ID NO: 6093098 - DNA, 19 bp, Homo sapiens
cctgttttctgaaacacac

SEQ ID NO: 6093099 - DNA, 16 bp, Homo sapiens
cctgttttctgctgtt

SEQ ID NO: 6093100 - DNA, 14 bp, Homo sapiens
cctgttttgctttt

SEQ ID NO: 6093101 - DNA, 16 bp, Homo sapiens
cctgttttgtacatag

SEQ ID NO: 6093102 - DNA, 17 bp, Homo sapiens
cctgttttgttggaagg

SEQ ID NO: 6093103 - DNA, 14 bp, Homo sapiens
cctgtttttattat

SEQ ID NO: 6093104 - DNA, 13 bp, Homo sapiens
cctgtttttcaca

SEQ ID NO: 6093105 - DNA, 15 bp, Homo sapiens
cctgtttttcctttt

SEQ ID NO: 6093106 - DNA, 17 bp, Homo sapiens
cctgttttttttctttt

SEQ ID NO: 6093107 - DNA, 18 bp, Homo sapiens
ccttaaaaaaaaaaatga

SEQ ID NO: 6093108 - DNA, 20 bp, Homo sapiens
ccttaaaaaatatgctctcc

SEQ ID NO: 6093109 - DNA, 23 bp, Homo sapiens
ccttaaaaactggcccgtggaga

SEQ ID NO: 6093110 - DNA, 14 bp, Homo sapiens
ccttaaaaatgcac

SEQ ID NO: 6093111 - DNA, 14 bp, Homo sapiens
ccttaaaacagctg

SEQ ID NO: 6093112 - DNA, 15 bp, Homo sapiens
ccttaaaaccaaaga

SEQ ID NO: 6093113 - DNA, 16 bp, Homo sapiens
ccttaaaaccaaagag

SEQ ID NO: 6093114 - DNA, 23 bp, Homo sapiens
ccttaaaactttaatcccacttg

SEQ ID NO: 6093115 - DNA, 15 bp, Homo sapiens
ccttaaaagtaataa

SEQ ID NO: 6093116 - DNA, 17 bp, Homo sapiens
ccttaaaagtaataaag

SEQ ID NO: 6093117 - DNA, 18 bp, Homo sapiens
ccttaaaagtaataaaga

SEQ ID NO: 6093118 - DNA, 21 bp, Homo sapiens
ccttaaaattaagttgaaaaa

SEQ ID NO: 6093119 - DNA, 19 bp, Homo sapiens
ccttaaaattacttggctt

SEQ ID NO: 6093120 - DNA, 20 bp, Homo sapiens
ccttaaaattacttggcttt

SEQ ID NO: 6093121 - DNA, 15 bp, Homo sapiens
ccttaaaatttgaaa

SEQ ID NO: 6093122 - DNA, 17 bp, Homo sapiens
ccttaaaatttgaaaca

SEQ ID NO: 6093123 - DNA, 23 bp, Homo sapiens
ccttaaacagggcatctccagga

SEQ ID NO: 6093124 - DNA, 20 bp, Homo sapiens
ccttaaacagttgcacagca

SEQ ID NO: 6093125 - DNA, 19 bp, Homo sapiens
ccttaaacctgaagatgtc

SEQ ID NO: 6093126 - DNA, 18 bp, Homo sapiens
ccttaaactctggacact

SEQ ID NO: 6093127 - DNA, 21 bp, Homo sapiens
ccttaaagaaaattgcatgaa

SEQ ID NO: 6093128 - DNA, 17 bp, Homo sapiens
ccttaaagagtgtggca

SEQ ID NO: 6093129 - DNA, 12 bp, Homo sapiens
ccttaaaggaag

SEQ ID NO: 6093130 - DNA, 22 bp, Homo sapiens
ccttaaaggcaccatctaatag

SEQ ID NO: 6093131 - DNA, 14 bp, Homo sapiens
ccttaaaggggaga

SEQ ID NO: 6093132 - DNA, 14 bp, Homo sapiens
ccttaaatgaaaaa

SEQ ID NO: 6093133 - DNA, 17 bp, Homo sapiens
ccttaaatgaactactg

SEQ ID NO: 6093134 - DNA, 23 bp, Homo sapiens
ccttaaatgaactactgctattt

SEQ ID NO: 6093135 - DNA, 13 bp, Homo sapiens
ccttaaattaaac

SEQ ID NO: 6093136 - DNA, 18 bp, Homo sapiens
ccttaaattaaacaattt

SEQ ID NO: 6093137 - DNA, 18 bp, Homo sapiens
ccttaaatttctgccctg

SEQ ID NO: 6093138 - DNA, 13 bp, Homo sapiens
ccttaaatttttg

SEQ ID NO: 6093139 - DNA, 16 bp, Homo sapiens
ccttaacacactggcc

SEQ ID NO: 6093140 - DNA, 22 bp, Homo sapiens
ccttaacacctgatctggccca

SEQ ID NO: 6093141 - DNA, 23 bp, Homo sapiens
ccttaacatccctcctgctttta

SEQ ID NO: 6093142 - DNA, 20 bp, Homo sapiens
ccttaacccacctctcctgc

SEQ ID NO: 6093143 - DNA, 23 bp, Homo sapiens
ccttaaccctaaaattttaaggc

SEQ ID NO: 6093144 - DNA, 21 bp, Homo sapiens
ccttaacctctctaagccaca

SEQ ID NO: 6093145 - DNA, 15 bp, Homo sapiens
ccttaacctgggacc

SEQ ID NO: 6093146 - DNA, 14 bp, Homo sapiens
ccttaactaagact

SEQ ID NO: 6093147 - DNA, 15 bp, Homo sapiens
ccttaactaagactc

SEQ ID NO: 6093148 - DNA, 18 bp, Homo sapiens
ccttaactaagactcccg

SEQ ID NO: 6093149 - DNA, 14 bp, Homo sapiens
ccttaactccaaga

SEQ ID NO: 6093150 - DNA, 22 bp, Homo sapiens
ccttaactctaaccctgtggaa

SEQ ID NO: 6093151 - DNA, 12 bp, Homo sapiens
ccttaactgaca

SEQ ID NO: 6093152 - DNA, 13 bp, Homo sapiens
ccttaactgacat

SEQ ID NO: 6093153 - DNA, 17 bp, Homo sapiens
ccttaactggagaccag

SEQ ID NO: 6093154 - DNA, 17 bp, Homo sapiens
ccttaactggagcccca

SEQ ID NO: 6093155 - DNA, 14 bp, Homo sapiens
ccttaagaaagcta

SEQ ID NO: 6093156 - DNA, 15 bp, Homo sapiens
ccttaagacactgtg

SEQ ID NO: 6093157 - DNA, 12 bp, Homo sapiens
ccttaagcaaat

SEQ ID NO: 6093158 - DNA, 13 bp, Homo sapiens
ccttaagcaaatt

SEQ ID NO: 6093159 - DNA, 16 bp, Homo sapiens
ccttaagcaaattttg

SEQ ID NO: 6093160 - DNA, 15 bp, Homo sapiens
ccttaagcagaacaa

SEQ ID NO: 6093161 - DNA, 22 bp, Homo sapiens
ccttaagccaaactcaggccca

SEQ ID NO: 6093162 - DNA, 19 bp, Homo sapiens
ccttaagccataggcccag

SEQ ID NO: 6093163 - DNA, 22 bp, Homo sapiens
ccttaagccataggcccaggat

SEQ ID NO: 6093164 - DNA, 16 bp, Homo sapiens
ccttaagccctggccc

SEQ ID NO: 6093165 - DNA, 14 bp, Homo sapiens
ccttaagctgcagg

SEQ ID NO: 6093166 - DNA, 20 bp, Homo sapiens
ccttaaggacaaaaatgaac

SEQ ID NO: 6093167 - DNA, 19 bp, Homo sapiens
ccttaagggttgaaggcag

SEQ ID NO: 6093168 - DNA, 14 bp, Homo sapiens
ccttaagtaagcaa

SEQ ID NO: 6093169 - DNA, 12 bp, Homo sapiens
ccttaagtcaga

SEQ ID NO: 6093170 - DNA, 19 bp, Homo sapiens
ccttaagtctttttgaagt

SEQ ID NO: 6093171 - DNA, 21 bp, Homo sapiens
ccttaagtctttttgaagtgt

SEQ ID NO: 6093172 - DNA, 14 bp, Homo sapiens
ccttaagtggctgt

SEQ ID NO: 6093173 - DNA, 23 bp, Homo sapiens
ccttaataaatatagttgtcttt

SEQ ID NO: 6093174 - DNA, 15 bp, Homo sapiens
ccttaatatttcttc

SEQ ID NO: 6093175 - DNA, 14 bp, Homo sapiens
ccttaatcttgctt

SEQ ID NO: 6093176 - DNA, 22 bp, Homo sapiens
ccttaatgtatggctcatttgc

SEQ ID NO: 6093177 - DNA, 22 bp, Homo sapiens
ccttaattaattctcagattcc

SEQ ID NO: 6093178 - DNA, 16 bp, Homo sapiens
ccttaattacttaaaa

SEQ ID NO: 6093179 - DNA, 14 bp, Homo sapiens
ccttaatttaactt

SEQ ID NO: 6093180 - DNA, 16 bp, Homo sapiens
ccttaatttaattgct

SEQ ID NO: 6093181 - DNA, 22 bp, Homo sapiens
ccttaatttaattgctttgaag

SEQ ID NO: 6093182 - DNA, 17 bp, Homo sapiens
ccttaatttagaaactg

SEQ ID NO: 6093183 - DNA, 19 bp, Homo sapiens
ccttaatttagaaactgaa

SEQ ID NO: 6093184 - DNA, 19 bp, Homo sapiens
ccttaatttcctttttgac

SEQ ID NO: 6093185 - DNA, 19 bp, Homo sapiens
ccttaatttttgaaaagct

SEQ ID NO: 6093186 - DNA, 19 bp, Homo sapiens
ccttaatttttttttcata

SEQ ID NO: 6093187 - DNA, 14 bp, Homo sapiens
ccttacaaagccag

SEQ ID NO: 6093188 - DNA, 15 bp, Homo sapiens
ccttacaaagccagc

SEQ ID NO: 6093189 - DNA, 12 bp, Homo sapiens
ccttacaaaggg

SEQ ID NO: 6093190 - DNA, 17 bp, Homo sapiens
ccttacaaatgattgct

SEQ ID NO: 6093191 - DNA, 22 bp, Homo sapiens
ccttacaagttagaaaacataa

SEQ ID NO: 6093192 - DNA, 17 bp, Homo sapiens
ccttacacaccattttg

SEQ ID NO: 6093193 - DNA, 18 bp, Homo sapiens
ccttacacaccattttgt

SEQ ID NO: 6093194 - DNA, 22 bp, Homo sapiens
ccttacacactcaggcctgtgc

SEQ ID NO: 6093195 - DNA, 22 bp, Homo sapiens
ccttacacctcgttagggaaga

SEQ ID NO: 6093196 - DNA, 12 bp, Homo sapiens
ccttacactccc

SEQ ID NO: 6093197 - DNA, 13 bp, Homo sapiens
ccttacactcccc

SEQ ID NO: 6093198 - DNA, 15 bp, Homo sapiens
ccttacacttactgt

SEQ ID NO: 6093199 - DNA, 16 bp, Homo sapiens
ccttacacttactgtt

SEQ ID NO: 6093200 - DNA, 14 bp, Homo sapiens
ccttacagcctctg

SEQ ID NO: 6093201 - DNA, 17 bp, Homo sapiens
ccttacagtaggagccc

SEQ ID NO: 6093202 - DNA, 13 bp, Homo sapiens
ccttacagttatc

SEQ ID NO: 6093203 - DNA, 17 bp, Homo sapiens
ccttacagttatcctgc

SEQ ID NO: 6093204 - DNA, 22 bp, Homo sapiens
ccttacagttatcctgcaaggg

SEQ ID NO: 6093205 - DNA, 21 bp, Homo sapiens
ccttacattaaaaagccttac

SEQ ID NO: 6093206 - DNA, 15 bp, Homo sapiens
ccttacattcctaga

SEQ ID NO: 6093207 - DNA, 15 bp, Homo sapiens
ccttacatttcctgg

SEQ ID NO: 6093208 - DNA, 13 bp, Homo sapiens
ccttacatttgtg

SEQ ID NO: 6093209 - DNA, 19 bp, Homo sapiens
ccttacatttgtgagattc

SEQ ID NO: 6093210 - DNA, 21 bp, Homo sapiens
ccttaccaacagcttttccca

SEQ ID NO: 6093211 - DNA, 15 bp, Homo sapiens
ccttaccaactttct

SEQ ID NO: 6093212 - DNA, 17 bp, Homo sapiens
ccttaccactgctctga

SEQ ID NO: 6093213 - DNA, 13 bp, Homo sapiens
ccttaccactgtg

SEQ ID NO: 6093214 - DNA, 23 bp, Homo sapiens
ccttaccactgtggaagtccctc

SEQ ID NO: 6093215 - DNA, 21 bp, Homo sapiens
ccttaccagagacgcccagcc

SEQ ID NO: 6093216 - DNA, 17 bp, Homo sapiens
ccttaccagcagagcac

SEQ ID NO: 6093217 - DNA, 19 bp, Homo sapiens
ccttaccataccactttga

SEQ ID NO: 6093218 - DNA, 15 bp, Homo sapiens
ccttaccatgtgcct

SEQ ID NO: 6093219 - DNA, 21 bp, Homo sapiens
ccttaccatgtgcctgatcca

SEQ ID NO: 6093220 - DNA, 14 bp, Homo sapiens
ccttacccatctgc

SEQ ID NO: 6093221 - DNA, 19 bp, Homo sapiens
ccttaccccagttttttga

SEQ ID NO: 6093222 - DNA, 13 bp, Homo sapiens
ccttacccctgcc

SEQ ID NO: 6093223 - DNA, 15 bp, Homo sapiens
ccttaccccttagcc

SEQ ID NO: 6093224 - DNA, 19 bp, Homo sapiens
ccttaccctactggctgta

SEQ ID NO: 6093225 - DNA, 15 bp, Homo sapiens
ccttaccctcatgtt

SEQ ID NO: 6093226 - DNA, 19 bp, Homo sapiens
ccttaccctcatgttctta

SEQ ID NO: 6093227 - DNA, 16 bp, Homo sapiens
ccttaccctcctctgc

SEQ ID NO: 6093228 - DNA, 18 bp, Homo sapiens
ccttaccctcctctgctg

SEQ ID NO: 6093229 - DNA, 19 bp, Homo sapiens
ccttaccctcctctgctgg

SEQ ID NO: 6093230 - DNA, 20 bp, Homo sapiens
ccttaccctcctctgctggg

SEQ ID NO: 6093231 - DNA, 17 bp, Homo sapiens
ccttaccctccttggga

SEQ ID NO: 6093232 - DNA, 13 bp, Homo sapiens
ccttaccctggga

SEQ ID NO: 6093233 - DNA, 14 bp, Homo sapiens
ccttacccttagaa

SEQ ID NO: 6093234 - DNA, 16 bp, Homo sapiens
ccggtcccccagagca

SEQ ID NO: 6093235 - DNA, 21 bp, Homo sapiens
ccggtcccccagagcatctgc

SEQ ID NO: 6093236 - DNA, 12 bp, Homo sapiens
ccggtcccctgc

SEQ ID NO: 6093237 - DNA, 18 bp, Homo sapiens
ccggtcccttgagacctc

SEQ ID NO: 6093238 - DNA, 18 bp, Homo sapiens
ccggtccgcccgcttccc

SEQ ID NO: 6093239 - DNA, 22 bp, Homo sapiens
ccggtcctggccccagccccca

SEQ ID NO: 6093240 - DNA, 22 bp, Homo sapiens
ccggtcgccctttgctgcatgg

SEQ ID NO: 6093241 - DNA, 23 bp, Homo sapiens
ccggtcgccctttgctgcatggc

SEQ ID NO: 6093242 - DNA, 19 bp, Homo sapiens
ccggtcgggcagccagcag

SEQ ID NO: 6093243 - DNA, 15 bp, Homo sapiens
ccggtgacacatcca

SEQ ID NO: 6093244 - DNA, 18 bp, Homo sapiens
ccggtgacctctagccct

SEQ ID NO: 6093245 - DNA, 17 bp, Homo sapiens
ccggtgaggggaggggc

SEQ ID NO: 6093246 - DNA, 19 bp, Homo sapiens
ccggtgaggggaggggcct

SEQ ID NO: 6093247 - DNA, 14 bp, Homo sapiens
ccggtgcacaggcc

SEQ ID NO: 6093248 - DNA, 23 bp, Homo sapiens
ccggtgcacaggcctctgcctgc

SEQ ID NO: 6093249 - DNA, 11 bp, Homo sapiens
ccggtgcagaa

SEQ ID NO: 6093250 - DNA, 13 bp, Homo sapiens
ccggtgcagggcc

SEQ ID NO: 6093251 - DNA, 18 bp, Homo sapiens
ccggtgcagggcctggca

SEQ ID NO: 6093252 - DNA, 19 bp, Homo sapiens
ccggtgcagggcctggcat

SEQ ID NO: 6093253 - DNA, 18 bp, Homo sapiens
ccggtgccaaacccagcc

SEQ ID NO: 6093254 - DNA, 22 bp, Homo sapiens
ccggtgccaaacccagcccctg

SEQ ID NO: 6093255 - DNA, 17 bp, Homo sapiens
ccggtgccagctgccct

SEQ ID NO: 6093256 - DNA, 21 bp, Homo sapiens
ccggtgccagctgcccttgca

SEQ ID NO: 6093257 - DNA, 17 bp, Homo sapiens
ccggtgccatcttccat

SEQ ID NO: 6093258 - DNA, 17 bp, Homo sapiens
ccggtgccttccaccct

SEQ ID NO: 6093259 - DNA, 16 bp, Homo sapiens
ccggtgctccctctgt

SEQ ID NO: 6093260 - DNA, 13 bp, Homo sapiens
ccggtgctgcagg

SEQ ID NO: 6093261 - DNA, 15 bp, Homo sapiens
ccggtgctgcaggag

SEQ ID NO: 6093262 - DNA, 14 bp, Homo sapiens
ccggtgctgggggc

SEQ ID NO: 6093263 - DNA, 19 bp, Homo sapiens
ccggtgctgggggcacagc

SEQ ID NO: 6093264 - DNA, 23 bp, Homo sapiens
ccggtgcttccaacaaggacagc

SEQ ID NO: 6093265 - DNA, 24 bp, Homo sapiens
ccggtgcttccaacaaggacagcc

SEQ ID NO: 6093266 - DNA, 18 bp, Homo sapiens
ccggtgcttctggaaact

SEQ ID NO: 6093267 - DNA, 14 bp, Homo sapiens
ccggtggcagtgga

SEQ ID NO: 6093268 - DNA, 21 bp, Homo sapiens
ccggtggcggcagggccaggc

SEQ ID NO: 6093269 - DNA, 14 bp, Homo sapiens
ccggtggcttctgg

SEQ ID NO: 6093270 - DNA, 22 bp, Homo sapiens
ccggtgggacccccgtggggca

SEQ ID NO: 6093271 - DNA, 17 bp, Homo sapiens
ccggtggggccagcgct

SEQ ID NO: 6093272 - DNA, 21 bp, Homo sapiens
ccggtgggggggcagagccct

SEQ ID NO: 6093273 - DNA, 13 bp, Homo sapiens
ccggtggtgcccg

SEQ ID NO: 6093274 - DNA, 13 bp, Homo sapiens
ccggtgtccctgg

SEQ ID NO: 6093275 - DNA, 15 bp, Homo sapiens
ccggtgtccctggat

SEQ ID NO: 6093276 - DNA, 15 bp, Homo sapiens
ccggtgtgagcccac

SEQ ID NO: 6093277 - DNA, 21 bp, Homo sapiens
ccggtgtgaggaggggcggga

SEQ ID NO: 6093278 - DNA, 23 bp, Homo sapiens
ccggtgtggccctgcaagggcgt

SEQ ID NO: 6093279 - DNA, 12 bp, Homo sapiens
ccggtgtgtcag

SEQ ID NO: 6093280 - DNA, 19 bp, Homo sapiens
ccggttattcgcccacccg

SEQ ID NO: 6093281 - DNA, 22 bp, Homo sapiens
ccggttccacgtggggtggaat

SEQ ID NO: 6093282 - DNA, 14 bp, Homo sapiens
ccggttcccacaag

SEQ ID NO: 6093283 - DNA, 21 bp, Homo sapiens
ccggttccccgcaacccacag

SEQ ID NO: 6093284 - DNA, 16 bp, Homo sapiens
ccggttccctccccag

SEQ ID NO: 6093285 - DNA, 17 bp, Homo sapiens
ccggttccctccccagc

SEQ ID NO: 6093286 - DNA, 17 bp, Homo sapiens
ccggttcctgtccctgc

SEQ ID NO: 6093287 - DNA, 19 bp, Homo sapiens
ccggttgcagtcactgtga

SEQ ID NO: 6093288 - DNA, 15 bp, Homo sapiens
ccggttgctggtcag

SEQ ID NO: 6093289 - DNA, 14 bp, Homo sapiens
ccggttgcttctgg

SEQ ID NO: 6093290 - DNA, 14 bp, Homo sapiens
ccggtttgggagag

SEQ ID NO: 6093291 - DNA, 16 bp, Homo sapiens
ccggttttcctcagct

SEQ ID NO: 6093292 - DNA, 17 bp, Homo sapiens
ccggttttcctcagctc

SEQ ID NO: 6093293 - DNA, 12 bp, Homo sapiens
ccgtaaaaactg

SEQ ID NO: 6093294 - DNA, 20 bp, Homo sapiens
ccgtaaaaactgaagttctg

SEQ ID NO: 6093295 - DNA, 21 bp, Homo sapiens
ccgtaatggggactctccagg

SEQ ID NO: 6093296 - DNA, 22 bp, Homo sapiens
ccgtaattctttctgtctccct

SEQ ID NO: 6093297 - DNA, 22 bp, Homo sapiens
ccgtaattgctttgtgcctttg

SEQ ID NO: 6093298 - DNA, 23 bp, Homo sapiens
ccgtaattgctttgtgcctttgg

SEQ ID NO: 6093299 - DNA, 17 bp, Homo sapiens
ccgtacaaactcagatc

SEQ ID NO: 6093300 - DNA, 19 bp, Homo sapiens
ccgtaccatcggtcagcag

SEQ ID NO: 6093301 - DNA, 15 bp, Homo sapiens
ccgtactatggctcc

SEQ ID NO: 6093302 - DNA, 13 bp, Homo sapiens
ccgtactccctgc

SEQ ID NO: 6093303 - DNA, 17 bp, Homo sapiens
ccgtactccctgcaccg

SEQ ID NO: 6093304 - DNA, 17 bp, Homo sapiens
ccgtactcggcttcctg

SEQ ID NO: 6093305 - DNA, 17 bp, Homo sapiens
ccgtactgtctgtgtcc

SEQ ID NO: 6093306 - DNA, 20 bp, Homo sapiens
ccgtagaaatccccctttct

SEQ ID NO: 6093307 - DNA, 16 bp, Homo sapiens
ccgtagactaggaagt

SEQ ID NO: 6093308 - DNA, 19 bp, Homo sapiens
ccgtagactcacggctgca

SEQ ID NO: 6093309 - DNA, 14 bp, Homo sapiens
ccgtagagaatgtg

SEQ ID NO: 6093310 - DNA, 13 bp, Homo sapiens
ccgtagccactct

SEQ ID NO: 6093311 - DNA, 20 bp, Homo sapiens
ccgtagccactctctgccca

SEQ ID NO: 6093312 - DNA, 22 bp, Homo sapiens
ccgtagccactctctgcccact

SEQ ID NO: 6093313 - DNA, 17 bp, Homo sapiens
ccgtagctctgctgctg

SEQ ID NO: 6093314 - DNA, 14 bp, Homo sapiens
ccgtaggcagcctc

SEQ ID NO: 6093315 - DNA, 15 bp, Homo sapiens
ccgtagggagtacct

SEQ ID NO: 6093316 - DNA, 19 bp, Homo sapiens
ccgtagggtggcactggga

SEQ ID NO: 6093317 - DNA, 19 bp, Homo sapiens
ccgtagtcctttttgtaac

SEQ ID NO: 6093318 - DNA, 11 bp, Homo sapiens
ccgtagtctcc

SEQ ID NO: 6093319 - DNA, 13 bp, Homo sapiens
ccgtagtctcctg

SEQ ID NO: 6093320 - DNA, 19 bp, Homo sapiens
ccgtagtctcctgggtgtg

SEQ ID NO: 6093321 - DNA, 15 bp, Homo sapiens
ccgtagttccctgaa

SEQ ID NO: 6093322 - DNA, 16 bp, Homo sapiens
ccgtagttccctgaaa

SEQ ID NO: 6093323 - DNA, 15 bp, Homo sapiens
ccgtatacttaaaat

SEQ ID NO: 6093324 - DNA, 16 bp, Homo sapiens
ccgtatcacagtgttt

SEQ ID NO: 6093325 - DNA, 22 bp, Homo sapiens
ccgtatctccggctcccagcct

SEQ ID NO: 6093326 - DNA, 15 bp, Homo sapiens
ccgtattagccagga

SEQ ID NO: 6093327 - DNA, 13 bp, Homo sapiens
ccgtattcctctc

SEQ ID NO: 6093328 - DNA, 23 bp, Homo sapiens
ccgtatttatttttttattcttc

SEQ ID NO: 6093329 - DNA, 22 bp, Homo sapiens
ccgtcaaaacagattgtttgca

SEQ ID NO: 6093330 - DNA, 22 bp, Homo sapiens
ccgtcaaggaaagggcagtgga

SEQ ID NO: 6093331 - DNA, 13 bp, Homo sapiens
ccgtcacatccca

SEQ ID NO: 6093332 - DNA, 15 bp, Homo sapiens
ccgtcaccaccaccc

SEQ ID NO: 6093333 - DNA, 17 bp, Homo sapiens
ccgtcaccaccacccct

SEQ ID NO: 6093334 - DNA, 19 bp, Homo sapiens
ccgtcaccacgactggcca

SEQ ID NO: 6093335 - DNA, 20 bp, Homo sapiens
ccgtcaccacgactggccag

SEQ ID NO: 6093336 - DNA, 12 bp, Homo sapiens
ccgtcaccctgg

SEQ ID NO: 6093337 - DNA, 23 bp, Homo sapiens
ccgtcacccttggtagagtttat

SEQ ID NO: 6093338 - DNA, 17 bp, Homo sapiens
ccgtcagccaaatgtaa

SEQ ID NO: 6093339 - DNA, 18 bp, Homo sapiens
ccgtcagctgcttctgct

SEQ ID NO: 6093340 - DNA, 19 bp, Homo sapiens
ccgtcagcttctcccaagc

SEQ ID NO: 6093341 - DNA, 17 bp, Homo sapiens
ccgtcaggccacagccc

SEQ ID NO: 6093342 - DNA, 20 bp, Homo sapiens
ccgtcaggccacagcccctg

SEQ ID NO: 6093343 - DNA, 21 bp, Homo sapiens
ccgtcaggccacagcccctgg

SEQ ID NO: 6093344 - DNA, 13 bp, Homo sapiens
ccgtcagggagag

SEQ ID NO: 6093345 - DNA, 22 bp, Homo sapiens
ccgtcaggtactcctgccaggg

SEQ ID NO: 6093346 - DNA, 14 bp, Homo sapiens
ccgtcatgctccca

SEQ ID NO: 6093347 - DNA, 19 bp, Homo sapiens
ccgtcattgctgctgctac

SEQ ID NO: 6093348 - DNA, 13 bp, Homo sapiens
ccgtccacccagg

SEQ ID NO: 6093349 - DNA, 21 bp, Homo sapiens
ccgtccacccaggctgcactg

SEQ ID NO: 6093350 - DNA, 24 bp, Homo sapiens
ccgtccacccaggctgcactgcag

SEQ ID NO: 6093351 - DNA, 15 bp, Homo sapiens
ccgtccacccttcca

SEQ ID NO: 6093352 - DNA, 16 bp, Homo sapiens
ccgtccaggagcctgg

SEQ ID NO: 6093353 - DNA, 17 bp, Homo sapiens
ccgtccaggccccaccg

SEQ ID NO: 6093354 - DNA, 21 bp, Homo sapiens
ccgtccaggggagatggggag

SEQ ID NO: 6093355 - DNA, 18 bp, Homo sapiens
ccgtccatatcagaactg

SEQ ID NO: 6093356 - DNA, 14 bp, Homo sapiens
ccgtccatccccct

SEQ ID NO: 6093357 - DNA, 20 bp, Homo sapiens
ccgtccatccgactgcccct

SEQ ID NO: 6093358 - DNA, 15 bp, Homo sapiens
ccgtccatggcacca

SEQ ID NO: 6093359 - DNA, 23 bp, Homo sapiens
ccgtccatggcaccagccccctg

SEQ ID NO: 6093360 - DNA, 15 bp, Homo sapiens
ccgtccattcttcag

SEQ ID NO: 6093361 - DNA, 19 bp, Homo sapiens
ccgtccattcttcagtgtc

SEQ ID NO: 6093362 - DNA, 12 bp, Homo sapiens
ccgtcccagagg

SEQ ID NO: 6093363 - DNA, 13 bp, Homo sapiens
ccgtcccagaggc

SEQ ID NO: 6093364 - DNA, 18 bp, Homo sapiens
ccgtcccatatcctgcct

SEQ ID NO: 6093365 - DNA, 13 bp, Homo sapiens
ccgtccccagggt

SEQ ID NO: 6093366 - DNA, 14 bp, Homo sapiens
ccgtccccccatcc

SEQ ID NO: 6093367 - DNA, 19 bp, Homo sapiens
ccgtccccccccaggccct

SEQ ID NO: 6093368 - DNA, 14 bp, Homo sapiens
ccgtccccctctgg

SEQ ID NO: 6093369 - DNA, 13 bp, Homo sapiens
ccgtcccctaacc

SEQ ID NO: 6093370 - DNA, 16 bp, Homo sapiens
ccgtcccctccttccc

SEQ ID NO: 6093371 - DNA, 16 bp, Homo sapiens
ccgtcccctctcccct

SEQ ID NO: 6093372 - DNA, 17 bp, Homo sapiens
ccgtcccctctcccctt

SEQ ID NO: 6093373 - DNA, 19 bp, Homo sapiens
ccgtcccctgcagcctggg

SEQ ID NO: 6093374 - DNA, 23 bp, Homo sapiens
ccgtcccctgcagcctgggtctg

SEQ ID NO: 6093375 - DNA, 17 bp, Homo sapiens
ccgtcccctgggccacc

SEQ ID NO: 6093376 - DNA, 22 bp, Homo sapiens
ccgtccctgacttcccagctgg

SEQ ID NO: 6093377 - DNA, 13 bp, Homo sapiens
ccgtccctgtccc

SEQ ID NO: 6093378 - DNA, 15 bp, Homo sapiens
ccgtccctttccctg

SEQ ID NO: 6093379 - DNA, 17 bp, Homo sapiens
ccgtccgcccgcccacc

SEQ ID NO: 6093380 - DNA, 14 bp, Homo sapiens
ccgtccgccctgct

SEQ ID NO: 6093381 - DNA, 11 bp, Homo sapiens
ccgtcctcacc

SEQ ID NO: 6093382 - DNA, 13 bp, Homo sapiens
ccgtcctccctca

SEQ ID NO: 6093383 - DNA, 19 bp, Homo sapiens
ccgtcctccctcagcctcc

SEQ ID NO: 6093384 - DNA, 13 bp, Homo sapiens
ccgtcctctcccc

SEQ ID NO: 6093385 - DNA, 17 bp, Homo sapiens
ccgtcctctccccagcc

SEQ ID NO: 6093386 - DNA, 15 bp, Homo sapiens
ccgtcctctcggctg

SEQ ID NO: 6093387 - DNA, 14 bp, Homo sapiens
ccgtcctgcctgtg

SEQ ID NO: 6093388 - DNA, 21 bp, Homo sapiens
ccgtcctgctgtccctgtcag

SEQ ID NO: 6093389 - DNA, 16 bp, Homo sapiens
ccgtcctggcagggca

SEQ ID NO: 6093390 - DNA, 18 bp, Homo sapiens
ccgtcctggcagggcagg

SEQ ID NO: 6093391 - DNA, 18 bp, Homo sapiens
ccgtcctgggcgtgaccc

SEQ ID NO: 6093392 - DNA, 24 bp, Homo sapiens
ccgtcctggggtggttggaggcct

SEQ ID NO: 6093393 - DNA, 12 bp, Homo sapiens
ccgtcgaccagg

SEQ ID NO: 6093394 - DNA, 16 bp, Homo sapiens
ccgtcgcgctggacag

SEQ ID NO: 6093395 - DNA, 13 bp, Homo sapiens
ccgtcggagctgc

SEQ ID NO: 6093396 - DNA, 17 bp, Homo sapiens
ccgtcggagctgcctgc

SEQ ID NO: 6093397 - DNA, 20 bp, Homo sapiens
ccgtcggagctgcctgcagc

SEQ ID NO: 6093398 - DNA, 22 bp, Homo sapiens
ccgtcgggcccctgcctgcctt

SEQ ID NO: 6093399 - DNA, 14 bp, Homo sapiens
ccgtctacctgagg

SEQ ID NO: 6093400 - DNA, 20 bp, Homo sapiens
ccgtctccaggggctgcttc

SEQ ID NO: 6093401 - DNA, 16 bp, Homo sapiens
ccgtctccgaagaaaa

SEQ ID NO: 6093402 - DNA, 14 bp, Homo sapiens
ccgtctcctccctc

SEQ ID NO: 6093403 - DNA, 16 bp, Homo sapiens
ccgtctcctctccagc

SEQ ID NO: 6093404 - DNA, 13 bp, Homo sapiens
ccgtctcggccct

SEQ ID NO: 6093405 - DNA, 14 bp, Homo sapiens
ccgtctcggccctg

SEQ ID NO: 6093406 - DNA, 17 bp, Homo sapiens
ccgtctctctgcccact

SEQ ID NO: 6093407 - DNA, 16 bp, Homo sapiens
ccgtctctcttggacc

SEQ ID NO: 6093408 - DNA, 18 bp, Homo sapiens
ccgtctctcttggaccca

SEQ ID NO: 6093409 - DNA, 13 bp, Homo sapiens
ccgtctctgccct

SEQ ID NO: 6093410 - DNA, 20 bp, Homo sapiens
ccgtctctgccctgggctcc

SEQ ID NO: 6093411 - DNA, 22 bp, Homo sapiens
ccgtctctgccctgggctcctc

SEQ ID NO: 6093412 - DNA, 15 bp, Homo sapiens
ccgtctctgctctgc

SEQ ID NO: 6093413 - DNA, 18 bp, Homo sapiens
ccgtctctggttcctccc

SEQ ID NO: 6093414 - DNA, 17 bp, Homo sapiens
ccttaccgagagccaaa

SEQ ID NO: 6093415 - DNA, 16 bp, Homo sapiens
ccttacctatttcctc

SEQ ID NO: 6093416 - DNA, 14 bp, Homo sapiens
ccttacctcccctg

SEQ ID NO: 6093417 - DNA, 13 bp, Homo sapiens
ccttacctcctgc

SEQ ID NO: 6093418 - DNA, 14 bp, Homo sapiens
ccttacctcctgcc

SEQ ID NO: 6093419 - DNA, 14 bp, Homo sapiens
ccttacctcgggga

SEQ ID NO: 6093420 - DNA, 16 bp, Homo sapiens
ccttacctcggggaga

SEQ ID NO: 6093421 - DNA, 12 bp, Homo sapiens
ccttacctctgg

SEQ ID NO: 6093422 - DNA, 15 bp, Homo sapiens
ccttacctctggaac

SEQ ID NO: 6093423 - DNA, 14 bp, Homo sapiens
ccttacctcttccg

SEQ ID NO: 6093424 - DNA, 19 bp, Homo sapiens
ccttacctgccaggaagcc

SEQ ID NO: 6093425 - DNA, 18 bp, Homo sapiens
ccttacgatcaggcacag

SEQ ID NO: 6093426 - DNA, 21 bp, Homo sapiens
ccttacgatcaggcacaggtc

SEQ ID NO: 6093427 - DNA, 13 bp, Homo sapiens
ccttacgtgagaa

SEQ ID NO: 6093428 - DNA, 20 bp, Homo sapiens
ccttactacttcttggaaaa

SEQ ID NO: 6093429 - DNA, 21 bp, Homo sapiens
ccttactacttcttggaaaaa

SEQ ID NO: 6093430 - DNA, 19 bp, Homo sapiens
ccttactatgatctcagga

SEQ ID NO: 6093431 - DNA, 21 bp, Homo sapiens
ccttactcctgtgggagcctc

SEQ ID NO: 6093432 - DNA, 22 bp, Homo sapiens
ccttactcctgtgggagcctcg

SEQ ID NO: 6093433 - DNA, 14 bp, Homo sapiens
ccttactctgagcc

SEQ ID NO: 6093434 - DNA, 17 bp, Homo sapiens
ccttactctgagcccag

SEQ ID NO: 6093435 - DNA, 19 bp, Homo sapiens
ccttactctgagcccaggc

SEQ ID NO: 6093436 - DNA, 20 bp, Homo sapiens
ccttactctgagcccaggcc

SEQ ID NO: 6093437 - DNA, 21 bp, Homo sapiens
ccttactctgagcccaggccg

SEQ ID NO: 6093438 - DNA, 15 bp, Homo sapiens
ccttactctgagctc

SEQ ID NO: 6093439 - DNA, 22 bp, Homo sapiens
ccttactgaaaaaaaaaaaaga

SEQ ID NO: 6093440 - DNA, 23 bp, Homo sapiens
ccttactgaaaaaaaaaaaagaa

SEQ ID NO: 6093441 - DNA, 19 bp, Homo sapiens
ccttactgagcgcaagcca

SEQ ID NO: 6093442 - DNA, 12 bp, Homo sapiens
ccttactgcaga

SEQ ID NO: 6093443 - DNA, 14 bp, Homo sapiens
ccttactggcactg

SEQ ID NO: 6093444 - DNA, 15 bp, Homo sapiens
ccttactggcactgt

SEQ ID NO: 6093445 - DNA, 15 bp, Homo sapiens
ccttactgtctctct

SEQ ID NO: 6093446 - DNA, 13 bp, Homo sapiens
ccttactgtttac

SEQ ID NO: 6093447 - DNA, 20 bp, Homo sapiens
ccttacttacagcataaggg

SEQ ID NO: 6093448 - DNA, 14 bp, Homo sapiens
ccttacttagcatg

SEQ ID NO: 6093449 - DNA, 13 bp, Homo sapiens
ccttacttccagc

SEQ ID NO: 6093450 - DNA, 15 bp, Homo sapiens
ccttacttccagcaa

SEQ ID NO: 6093451 - DNA, 20 bp, Homo sapiens
ccttacttccagcaagcaaa

SEQ ID NO: 6093452 - DNA, 16 bp, Homo sapiens
ccttacttgcactgtt

SEQ ID NO: 6093453 - DNA, 20 bp, Homo sapiens
ccttacttgcttctctagct

SEQ ID NO: 6093454 - DNA, 21 bp, Homo sapiens
ccttactttactgcctgaata

SEQ ID NO: 6093455 - DNA, 19 bp, Homo sapiens
ccttactttgtatgatatt

SEQ ID NO: 6093456 - DNA, 20 bp, Homo sapiens
ccttactttgtatgatattc

SEQ ID NO: 6093457 - DNA, 13 bp, Homo sapiens
ccttacttttaaa

SEQ ID NO: 6093458 - DNA, 17 bp, Homo sapiens
ccttacttttaaaataa

SEQ ID NO: 6093459 - DNA, 19 bp, Homo sapiens
ccttagaaaagactgacct

SEQ ID NO: 6093460 - DNA, 16 bp, Homo sapiens
ccttagaaaatgtgtc

SEQ ID NO: 6093461 - DNA, 21 bp, Homo sapiens
ccttagaaatgtaaactgcca

SEQ ID NO: 6093462 - DNA, 20 bp, Homo sapiens
ccttagaacattttaattca

SEQ ID NO: 6093463 - DNA, 18 bp, Homo sapiens
ccttagaacctttcttac

SEQ ID NO: 6093464 - DNA, 16 bp, Homo sapiens
ccttagaagagagcca

SEQ ID NO: 6093465 - DNA, 21 bp, Homo sapiens
ccttagaaggtattaagatta

SEQ ID NO: 6093466 - DNA, 13 bp, Homo sapiens
ccttagacaaatg

SEQ ID NO: 6093467 - DNA, 21 bp, Homo sapiens
ccttagacagaggccctcaag

SEQ ID NO: 6093468 - DNA, 16 bp, Homo sapiens
ccttagacagtccctg

SEQ ID NO: 6093469 - DNA, 17 bp, Homo sapiens
ccttagacagtccctgc

SEQ ID NO: 6093470 - DNA, 18 bp, Homo sapiens
ccttagaccaccaagcct

SEQ ID NO: 6093471 - DNA, 16 bp, Homo sapiens
ccttagaccttccata

SEQ ID NO: 6093472 - DNA, 14 bp, Homo sapiens
ccttagagaagcta

SEQ ID NO: 6093473 - DNA, 21 bp, Homo sapiens
ccttagagactagacaaataa

SEQ ID NO: 6093474 - DNA, 23 bp, Homo sapiens
ccttagagattgccccagagccc

SEQ ID NO: 6093475 - DNA, 16 bp, Homo sapiens
ccttagagccaggcac

SEQ ID NO: 6093476 - DNA, 13 bp, Homo sapiens
ccttagagctctt

SEQ ID NO: 6093477 - DNA, 16 bp, Homo sapiens
ccttagagctcttgtg

SEQ ID NO: 6093478 - DNA, 13 bp, Homo sapiens
ccttagaggacct

SEQ ID NO: 6093479 - DNA, 16 bp, Homo sapiens
ccttagagtgctgtga

SEQ ID NO: 6093480 - DNA, 18 bp, Homo sapiens
ccttagatgtgtctcctg

SEQ ID NO: 6093481 - DNA, 18 bp, Homo sapiens
ccttagattagctctgga

SEQ ID NO: 6093482 - DNA, 17 bp, Homo sapiens
ccttagcaacagccgag

SEQ ID NO: 6093483 - DNA, 15 bp, Homo sapiens
ccttagcacagagag

SEQ ID NO: 6093484 - DNA, 18 bp, Homo sapiens
ccttagcactatggacat

SEQ ID NO: 6093485 - DNA, 16 bp, Homo sapiens
ccttagcacttctttc

SEQ ID NO: 6093486 - DNA, 21 bp, Homo sapiens
ccttagcacttctttcctctc

SEQ ID NO: 6093487 - DNA, 13 bp, Homo sapiens
ccttagcagccca

SEQ ID NO: 6093488 - DNA, 15 bp, Homo sapiens
ccttagcagcccagc

SEQ ID NO: 6093489 - DNA, 22 bp, Homo sapiens
ccttagcagctcaggcgcagcc

SEQ ID NO: 6093490 - DNA, 19 bp, Homo sapiens
ccttagcagggaaacagct

SEQ ID NO: 6093491 - DNA, 20 bp, Homo sapiens
ccttagcagggaaacagcta

SEQ ID NO: 6093492 - DNA, 19 bp, Homo sapiens
ccttagcatgtttgctgaa

SEQ ID NO: 6093493 - DNA, 18 bp, Homo sapiens
ccttagccagttgtatat

SEQ ID NO: 6093494 - DNA, 16 bp, Homo sapiens
ccttagccatgatctg

SEQ ID NO: 6093495 - DNA, 15 bp, Homo sapiens
ccttagcccccaccc

SEQ ID NO: 6093496 - DNA, 18 bp, Homo sapiens
ccttagcccccacccact

SEQ ID NO: 6093497 - DNA, 21 bp, Homo sapiens
ccttagcccccacccacttcc

SEQ ID NO: 6093498 - DNA, 22 bp, Homo sapiens
ccttagcccggatgcccacccc

SEQ ID NO: 6093499 - DNA, 20 bp, Homo sapiens
ccttagccctgtctgctagg

SEQ ID NO: 6093500 - DNA, 21 bp, Homo sapiens
ccttagcctaaaatccacacc

SEQ ID NO: 6093501 - DNA, 14 bp, Homo sapiens
ccttagcctctccc

SEQ ID NO: 6093502 - DNA, 16 bp, Homo sapiens
ccttagcctctcccac

SEQ ID NO: 6093503 - DNA, 16 bp, Homo sapiens
ccttagcctcttggaa

SEQ ID NO: 6093504 - DNA, 13 bp, Homo sapiens
ccttagcctggac

SEQ ID NO: 6093505 - DNA, 15 bp, Homo sapiens
ccttagcctggacct

SEQ ID NO: 6093506 - DNA, 17 bp, Homo sapiens
ccttagccttgctgtag

SEQ ID NO: 6093507 - DNA, 19 bp, Homo sapiens
ccttagccttgctgtagag

SEQ ID NO: 6093508 - DNA, 23 bp, Homo sapiens
ccttagccttgctgtagagactt

SEQ ID NO: 6093509 - DNA, 17 bp, Homo sapiens
ccttagctatttatccc

SEQ ID NO: 6093510 - DNA, 18 bp, Homo sapiens
ccttagctatttatccct

SEQ ID NO: 6093511 - DNA, 16 bp, Homo sapiens
ccttagctcccagcta

SEQ ID NO: 6093512 - DNA, 20 bp, Homo sapiens
ccttagctcttagtctcttt

SEQ ID NO: 6093513 - DNA, 23 bp, Homo sapiens
ccttagctgccagtgctggtcac

SEQ ID NO: 6093514 - DNA, 19 bp, Homo sapiens
ccttagcttagacctcagc

SEQ ID NO: 6093515 - DNA, 20 bp, Homo sapiens
ccttagcttagacctcagcc

SEQ ID NO: 6093516 - DNA, 23 bp, Homo sapiens
ccttagcttattgatcccacatt

SEQ ID NO: 6093517 - DNA, 12 bp, Homo sapiens
ccttagcttcag

SEQ ID NO: 6093518 - DNA, 14 bp, Homo sapiens
ccttagcttcagga

SEQ ID NO: 6093519 - DNA, 17 bp, Homo sapiens
ccttagcttcaggaacc

SEQ ID NO: 6093520 - DNA, 14 bp, Homo sapiens
ccttagcttctggc

SEQ ID NO: 6093521 - DNA, 22 bp, Homo sapiens
ccttagcttggtatgagacaga

SEQ ID NO: 6093522 - DNA, 18 bp, Homo sapiens
ccttagcttttagcctgg

SEQ ID NO: 6093523 - DNA, 20 bp, Homo sapiens
ccttagcttttagcctggct

SEQ ID NO: 6093524 - DNA, 17 bp, Homo sapiens
ccttaggaatactgttt

SEQ ID NO: 6093525 - DNA, 20 bp, Homo sapiens
ccttaggagacgctgcactt

SEQ ID NO: 6093526 - DNA, 15 bp, Homo sapiens
ccttaggagatgtca

SEQ ID NO: 6093527 - DNA, 15 bp, Homo sapiens
ccttaggaggccccc

SEQ ID NO: 6093528 - DNA, 13 bp, Homo sapiens
ccttaggcaggga

SEQ ID NO: 6093529 - DNA, 16 bp, Homo sapiens
ccttaggcagggaagt

SEQ ID NO: 6093530 - DNA, 22 bp, Homo sapiens
ccttaggccacatgggagcagt

SEQ ID NO: 6093531 - DNA, 14 bp, Homo sapiens
ccttaggcctctga

SEQ ID NO: 6093532 - DNA, 18 bp, Homo sapiens
ccttagggaagctggcct

SEQ ID NO: 6093533 - DNA, 21 bp, Homo sapiens
ccttagggaagctggcctgag

SEQ ID NO: 6093534 - DNA, 20 bp, Homo sapiens
ccttagggaagttgtctcct

SEQ ID NO: 6093535 - DNA, 23 bp, Homo sapiens
ccttagggagggactgggatgag

SEQ ID NO: 6093536 - DNA, 20 bp, Homo sapiens
ccttaggggagctgaaataa

SEQ ID NO: 6093537 - DNA, 20 bp, Homo sapiens
ccttaggggtaattggtaat

SEQ ID NO: 6093538 - DNA, 16 bp, Homo sapiens
ccttagggttttctct

SEQ ID NO: 6093539 - DNA, 20 bp, Homo sapiens
ccttaggtttttttccttct

SEQ ID NO: 6093540 - DNA, 22 bp, Homo sapiens
ccttagtacatgctctgtccag

SEQ ID NO: 6093541 - DNA, 17 bp, Homo sapiens
ccttagtataatattaa

SEQ ID NO: 6093542 - DNA, 17 bp, Homo sapiens
ccttagtcaataaactt

SEQ ID NO: 6093543 - DNA, 17 bp, Homo sapiens
ccttagtccccctggtc

SEQ ID NO: 6093544 - DNA, 23 bp, Homo sapiens
ccttagtccgcaagttcagggaa

SEQ ID NO: 6093545 - DNA, 20 bp, Homo sapiens
ccttagtctcagtttgtgtg

SEQ ID NO: 6093546 - DNA, 13 bp, Homo sapiens
ccttagtcttctc

SEQ ID NO: 6093547 - DNA, 14 bp, Homo sapiens
ccttagtcttctca

SEQ ID NO: 6093548 - DNA, 14 bp, Homo sapiens
ccttagtctttcct

SEQ ID NO: 6093549 - DNA, 20 bp, Homo sapiens
ccttagtgcagttatttgct

SEQ ID NO: 6093550 - DNA, 14 bp, Homo sapiens
ccttagtgccagga

SEQ ID NO: 6093551 - DNA, 20 bp, Homo sapiens
ccttagtggcttttttcctc

SEQ ID NO: 6093552 - DNA, 19 bp, Homo sapiens
ccttagtgggccagggctg

SEQ ID NO: 6093553 - DNA, 12 bp, Homo sapiens
ccttagtgtttc

SEQ ID NO: 6093554 - DNA, 15 bp, Homo sapiens
ccttagtttttacct

SEQ ID NO: 6093555 - DNA, 12 bp, Homo sapiens
ccttataaaatc

SEQ ID NO: 6093556 - DNA, 21 bp, Homo sapiens
ccttatacatcacttcctgtt

SEQ ID NO: 6093557 - DNA, 20 bp, Homo sapiens
ccttatatatgcacttaatt

SEQ ID NO: 6093558 - DNA, 15 bp, Homo sapiens
ccttatatttacaat

SEQ ID NO: 6093559 - DNA, 16 bp, Homo sapiens
ccttatatttctgtgt

SEQ ID NO: 6093560 - DNA, 13 bp, Homo sapiens
ccttatcaaagga

SEQ ID NO: 6093561 - DNA, 12 bp, Homo sapiens
ccttatcaagtg

SEQ ID NO: 6093562 - DNA, 13 bp, Homo sapiens
ccttatcaagtgt

SEQ ID NO: 6093563 - DNA, 19 bp, Homo sapiens
ccttatcacagaaataaaa

SEQ ID NO: 6093564 - DNA, 20 bp, Homo sapiens
ccttatcacagaaataaaat

SEQ ID NO: 6093565 - DNA, 20 bp, Homo sapiens
ccttatcaccagctgcctct

SEQ ID NO: 6093566 - DNA, 14 bp, Homo sapiens
ccttatcaggcaaa

SEQ ID NO: 6093567 - DNA, 17 bp, Homo sapiens
ccttatcattcattctt

SEQ ID NO: 6093568 - DNA, 13 bp, Homo sapiens
ccttatccaggac

SEQ ID NO: 6093569 - DNA, 17 bp, Homo sapiens
ccttatccaggactctg

SEQ ID NO: 6093570 - DNA, 14 bp, Homo sapiens
ccttatccctctct

SEQ ID NO: 6093571 - DNA, 14 bp, Homo sapiens
ccttatcctagcct

SEQ ID NO: 6093572 - DNA, 13 bp, Homo sapiens
ccttatcctctga

SEQ ID NO: 6093573 - DNA, 16 bp, Homo sapiens
ccttatcctctgatct

SEQ ID NO: 6093574 - DNA, 14 bp, Homo sapiens
ccttatccttcctc

SEQ ID NO: 6093575 - DNA, 16 bp, Homo sapiens
ccttatcgaaactcat

SEQ ID NO: 6093576 - DNA, 13 bp, Homo sapiens
ccttatctgtttt

SEQ ID NO: 6093577 - DNA, 12 bp, Homo sapiens
ccttatcttgaa

SEQ ID NO: 6093578 - DNA, 20 bp, Homo sapiens
ccttatgagactcttaaata

SEQ ID NO: 6093579 - DNA, 20 bp, Homo sapiens
ccttatgagcgtcactgccc

SEQ ID NO: 6093580 - DNA, 18 bp, Homo sapiens
ccttatgagctcagcctc

SEQ ID NO: 6093581 - DNA, 14 bp, Homo sapiens
ccttatggaacact

SEQ ID NO: 6093582 - DNA, 19 bp, Homo sapiens
ccttatggatgatttaagt

SEQ ID NO: 6093583 - DNA, 15 bp, Homo sapiens
ccttatgggctgaag

SEQ ID NO: 6093584 - DNA, 17 bp, Homo sapiens
ccttattaaggccccag

SEQ ID NO: 6093585 - DNA, 18 bp, Homo sapiens
ccttattaaggccccaga

SEQ ID NO: 6093586 - DNA, 16 bp, Homo sapiens
ccttattagagtgtct

SEQ ID NO: 6093587 - DNA, 14 bp, Homo sapiens
ccttattcagggaa

SEQ ID NO: 6093588 - DNA, 22 bp, Homo sapiens
ccttattcccccaaactttttg

SEQ ID NO: 6093589 - DNA, 14 bp, Homo sapiens
ccttattcttctca

SEQ ID NO: 6093590 - DNA, 19 bp, Homo sapiens
ccttattgagcgtgattct

SEQ ID NO: 6093591 - DNA, 20 bp, Homo sapiens
ccttattgatctttgcccat

SEQ ID NO: 6093592 - DNA, 20 bp, Homo sapiens
ccttattgcctcccaggcaa

SEQ ID NO: 6093593 - DNA, 14 bp, Homo sapiens
ccgtctctttctca

SEQ ID NO: 6093594 - DNA, 17 bp, Homo sapiens
ccgtctgactccagagt

SEQ ID NO: 6093595 - DNA, 20 bp, Homo sapiens
ccgtctgattgttcctcccc

SEQ ID NO: 6093596 - DNA, 18 bp, Homo sapiens
ccgtctgctcctccctcc

SEQ ID NO: 6093597 - DNA, 17 bp, Homo sapiens
ccgtctggacctgggga

SEQ ID NO: 6093598 - DNA, 18 bp, Homo sapiens
ccgtctggacctggggag

SEQ ID NO: 6093599 - DNA, 22 bp, Homo sapiens
ccgtctggcgagcccttagcct

SEQ ID NO: 6093600 - DNA, 17 bp, Homo sapiens
ccgtctggggttcagcc

SEQ ID NO: 6093601 - DNA, 11 bp, Homo sapiens
ccgtctgtcct

SEQ ID NO: 6093602 - DNA, 18 bp, Homo sapiens
ccgtcttcacactgcgca

SEQ ID NO: 6093603 - DNA, 13 bp, Homo sapiens
ccgtcttcctcca

SEQ ID NO: 6093604 - DNA, 11 bp, Homo sapiens
ccgtcttcctt

SEQ ID NO: 6093605 - DNA, 22 bp, Homo sapiens
ccgtcttggggctcgccccacc

SEQ ID NO: 6093606 - DNA, 23 bp, Homo sapiens
ccgtcttgtaaaaaggggaggag

SEQ ID NO: 6093607 - DNA, 16 bp, Homo sapiens
ccgtcttttcctgttt

SEQ ID NO: 6093608 - DNA, 17 bp, Homo sapiens
ccgtgaaaacggagctg

SEQ ID NO: 6093609 - DNA, 16 bp, Homo sapiens
ccgtgaactctggtgc

SEQ ID NO: 6093610 - DNA, 16 bp, Homo sapiens
ccgtgaactgtgcata

SEQ ID NO: 6093611 - DNA, 17 bp, Homo sapiens
ccgtgaagatactttgt

SEQ ID NO: 6093612 - DNA, 23 bp, Homo sapiens
ccgtgaagcagtgcctcgaggca

SEQ ID NO: 6093613 - DNA, 13 bp, Homo sapiens
ccgtgaattgctt

SEQ ID NO: 6093614 - DNA, 14 bp, Homo sapiens
ccgtgaattgcttt

SEQ ID NO: 6093615 - DNA, 18 bp, Homo sapiens
ccgtgacagtggctgaca

SEQ ID NO: 6093616 - DNA, 20 bp, Homo sapiens
ccgtgacctattcaccctcc

SEQ ID NO: 6093617 - DNA, 21 bp, Homo sapiens
ccgtgacctattcaccctcca

SEQ ID NO: 6093618 - DNA, 14 bp, Homo sapiens
ccgtgacgtctggg

SEQ ID NO: 6093619 - DNA, 14 bp, Homo sapiens
ccgtgagacacaag

SEQ ID NO: 6093620 - DNA, 21 bp, Homo sapiens
ccgtgagcaccaccagggctc

SEQ ID NO: 6093621 - DNA, 20 bp, Homo sapiens
ccgtgagcaggaaggcctgg

SEQ ID NO: 6093622 - DNA, 13 bp, Homo sapiens
ccgtgagcaggct

SEQ ID NO: 6093623 - DNA, 21 bp, Homo sapiens
ccgtgagcagtgtgtctcctg

SEQ ID NO: 6093624 - DNA, 13 bp, Homo sapiens
ccgtgagcatgca

SEQ ID NO: 6093625 - DNA, 13 bp, Homo sapiens
ccgtgagccaaga

SEQ ID NO: 6093626 - DNA, 12 bp, Homo sapiens
ccgtgagccctt

SEQ ID NO: 6093627 - DNA, 20 bp, Homo sapiens
ccgtgagcgcctgtgcacac

SEQ ID NO: 6093628 - DNA, 16 bp, Homo sapiens
ccgtgaggagggggag

SEQ ID NO: 6093629 - DNA, 14 bp, Homo sapiens
ccgtgaggccaaga

SEQ ID NO: 6093630 - DNA, 13 bp, Homo sapiens
ccgtgaggccaga

SEQ ID NO: 6093631 - DNA, 17 bp, Homo sapiens
ccgtgaggctgctgcca

SEQ ID NO: 6093632 - DNA, 19 bp, Homo sapiens
ccgtgaggctgctgccatc

SEQ ID NO: 6093633 - DNA, 16 bp, Homo sapiens
ccgtgagttctcaggg

SEQ ID NO: 6093634 - DNA, 18 bp, Homo sapiens
ccgtgagttctcagggct

SEQ ID NO: 6093635 - DNA, 20 bp, Homo sapiens
ccgtgagttctcagggctcc

SEQ ID NO: 6093636 - DNA, 18 bp, Homo sapiens
ccgtgatggagaggacag

SEQ ID NO: 6093637 - DNA, 23 bp, Homo sapiens
ccgtgatgtagggtaaggtgcct

SEQ ID NO: 6093638 - DNA, 21 bp, Homo sapiens
ccgtgcaacggaagccaggcc

SEQ ID NO: 6093639 - DNA, 13 bp, Homo sapiens
ccgtgcacggggc

SEQ ID NO: 6093640 - DNA, 19 bp, Homo sapiens
ccgtgcagactggagggga

SEQ ID NO: 6093641 - DNA, 15 bp, Homo sapiens
ccgtgcagagctgca

SEQ ID NO: 6093642 - DNA, 14 bp, Homo sapiens
ccgtgcagctggga

SEQ ID NO: 6093643 - DNA, 20 bp, Homo sapiens
ccgtgcatcccccctgctca

SEQ ID NO: 6093644 - DNA, 21 bp, Homo sapiens
ccgtgcatcccccctgctcag

SEQ ID NO: 6093645 - DNA, 19 bp, Homo sapiens
ccgtgcatggctcctgtct

SEQ ID NO: 6093646 - DNA, 22 bp, Homo sapiens
ccgtgcattagcacagatttta

SEQ ID NO: 6093647 - DNA, 22 bp, Homo sapiens
ccgtgccaaccccacccagctc

SEQ ID NO: 6093648 - DNA, 21 bp, Homo sapiens
ccgtgccaagtccaggtcctg

SEQ ID NO: 6093649 - DNA, 22 bp, Homo sapiens
ccgtgccacccccagccctggc

SEQ ID NO: 6093650 - DNA, 21 bp, Homo sapiens
ccgtgccacgcgctctgcatg

SEQ ID NO: 6093651 - DNA, 22 bp, Homo sapiens
ccgtgccacgcgctctgcatgc

SEQ ID NO: 6093652 - DNA, 11 bp, Homo sapiens
ccgtgccaggc

SEQ ID NO: 6093653 - DNA, 17 bp, Homo sapiens
ccgtgccattgtactcc

SEQ ID NO: 6093654 - DNA, 12 bp, Homo sapiens
ccgtgcccaggg

SEQ ID NO: 6093655 - DNA, 20 bp, Homo sapiens
ccgtgcccaggggcccacag

SEQ ID NO: 6093656 - DNA, 19 bp, Homo sapiens
ccgtgccccacctccccac

SEQ ID NO: 6093657 - DNA, 21 bp, Homo sapiens
ccgtgcccccgcctgccaccg

SEQ ID NO: 6093658 - DNA, 15 bp, Homo sapiens
ccgtgcccctgggat

SEQ ID NO: 6093659 - DNA, 18 bp, Homo sapiens
ccgtgccccttccctggg

SEQ ID NO: 6093660 - DNA, 16 bp, Homo sapiens
ccgtgcccctttcctt

SEQ ID NO: 6093661 - DNA, 14 bp, Homo sapiens
ccgtgcccgcagga

SEQ ID NO: 6093662 - DNA, 16 bp, Homo sapiens
ccgtgcccgcaggaac

SEQ ID NO: 6093663 - DNA, 19 bp, Homo sapiens
ccgtgcccgcaggaactgg

SEQ ID NO: 6093664 - DNA, 16 bp, Homo sapiens
ccgtgcccgcccacct

SEQ ID NO: 6093665 - DNA, 17 bp, Homo sapiens
ccgtgcccgcccacctc

SEQ ID NO: 6093666 - DNA, 14 bp, Homo sapiens
ccgtgccgcctgca

SEQ ID NO: 6093667 - DNA, 23 bp, Homo sapiens
ccgtgccggcggcagccccactt

SEQ ID NO: 6093668 - DNA, 14 bp, Homo sapiens
ccgtgcctccacca

SEQ ID NO: 6093669 - DNA, 12 bp, Homo sapiens
ccgtgcctggct

SEQ ID NO: 6093670 - DNA, 20 bp, Homo sapiens
ccgtgcctggctgattcagc

SEQ ID NO: 6093671 - DNA, 12 bp, Homo sapiens
ccgtgcctggga

SEQ ID NO: 6093672 - DNA, 13 bp, Homo sapiens
ccgtgcctgggcc

SEQ ID NO: 6093673 - DNA, 18 bp, Homo sapiens
ccgtgcctgggcccctcc

SEQ ID NO: 6093674 - DNA, 12 bp, Homo sapiens
ccgtgcctggtg

SEQ ID NO: 6093675 - DNA, 14 bp, Homo sapiens
ccgtgcgagctgcc

SEQ ID NO: 6093676 - DNA, 18 bp, Homo sapiens
ccgtgcgggaaattcagt

SEQ ID NO: 6093677 - DNA, 16 bp, Homo sapiens
ccgtgctaaggacttg

SEQ ID NO: 6093678 - DNA, 15 bp, Homo sapiens
ccgtgctcctctgcc

SEQ ID NO: 6093679 - DNA, 18 bp, Homo sapiens
ccgtgctcctctgcccgc

SEQ ID NO: 6093680 - DNA, 16 bp, Homo sapiens
ccgtgctcgccccagc

SEQ ID NO: 6093681 - DNA, 14 bp, Homo sapiens
ccgtgctgacagct

SEQ ID NO: 6093682 - DNA, 16 bp, Homo sapiens
ccgtgctgacagctgc

SEQ ID NO: 6093683 - DNA, 17 bp, Homo sapiens
ccgtgctgacagctgct

SEQ ID NO: 6093684 - DNA, 20 bp, Homo sapiens
ccgtgctgacagctgctcct

SEQ ID NO: 6093685 - DNA, 12 bp, Homo sapiens
ccgtgctgggca

SEQ ID NO: 6093686 - DNA, 15 bp, Homo sapiens
ccgtgctgggcagcc

SEQ ID NO: 6093687 - DNA, 17 bp, Homo sapiens
ccgtgctgtcttctggt

SEQ ID NO: 6093688 - DNA, 18 bp, Homo sapiens
ccgtgctgtcttctggtc

SEQ ID NO: 6093689 - DNA, 23 bp, Homo sapiens
ccgtgctgtcttctggtctgtgt

SEQ ID NO: 6093690 - DNA, 20 bp, Homo sapiens
ccgtgcttgtttgctcacct

SEQ ID NO: 6093691 - DNA, 22 bp, Homo sapiens
ccgtgcttgtttgctcacctgg

SEQ ID NO: 6093692 - DNA, 16 bp, Homo sapiens
ccgtggacaccccaga

SEQ ID NO: 6093693 - DNA, 23 bp, Homo sapiens
ccgtggacaccccagacctgcga

SEQ ID NO: 6093694 - DNA, 15 bp, Homo sapiens
ccgtggaccttcctg

SEQ ID NO: 6093695 - DNA, 19 bp, Homo sapiens
ccgtggagaattggccaga

SEQ ID NO: 6093696 - DNA, 23 bp, Homo sapiens
ccgtggagatcgcttttctcaga

SEQ ID NO: 6093697 - DNA, 22 bp, Homo sapiens
ccgtggaggaggaaggcaagag

SEQ ID NO: 6093698 - DNA, 23 bp, Homo sapiens
ccgtggaggaggaaggcaagagg

SEQ ID NO: 6093699 - DNA, 11 bp, Homo sapiens
ccgtggagggt

SEQ ID NO: 6093700 - DNA, 18 bp, Homo sapiens
ccgtggatctccttccct

SEQ ID NO: 6093701 - DNA, 14 bp, Homo sapiens
ccgtggatgctctt

SEQ ID NO: 6093702 - DNA, 18 bp, Homo sapiens
ccgtggatggtctccacc

SEQ ID NO: 6093703 - DNA, 19 bp, Homo sapiens
ccgtggattgcacgtggcc

SEQ ID NO: 6093704 - DNA, 20 bp, Homo sapiens
ccgtggattgcacgtggcct

SEQ ID NO: 6093705 - DNA, 16 bp, Homo sapiens
ccgtggcaaccctcag

SEQ ID NO: 6093706 - DNA, 13 bp, Homo sapiens
ccgtggcacagct

SEQ ID NO: 6093707 - DNA, 15 bp, Homo sapiens
ccgtggcagcttgct

SEQ ID NO: 6093708 - DNA, 20 bp, Homo sapiens
ccgtggcagcttgctgggct

SEQ ID NO: 6093709 - DNA, 22 bp, Homo sapiens
ccgtggccccagcctggcccag

SEQ ID NO: 6093710 - DNA, 22 bp, Homo sapiens
ccgtggcccttcctggacagct

SEQ ID NO: 6093711 - DNA, 16 bp, Homo sapiens
ccgtggcctggcatct

SEQ ID NO: 6093712 - DNA, 20 bp, Homo sapiens
ccgtggcctggcatctgtgt

SEQ ID NO: 6093713 - DNA, 21 bp, Homo sapiens
ccgtggcctggcatctgtgtg

SEQ ID NO: 6093714 - DNA, 16 bp, Homo sapiens
ccgtggctctgggaga

SEQ ID NO: 6093715 - DNA, 21 bp, Homo sapiens
ccgtggcttggcatctgtgtg

SEQ ID NO: 6093716 - DNA, 23 bp, Homo sapiens
ccgtgggacccaggctcccagcc

SEQ ID NO: 6093717 - DNA, 22 bp, Homo sapiens
ccgtgggcaattgtctgaaaag

SEQ ID NO: 6093718 - DNA, 21 bp, Homo sapiens
ccgtgggcagaatgactttta

SEQ ID NO: 6093719 - DNA, 15 bp, Homo sapiens
ccgtgggcagctcct

SEQ ID NO: 6093720 - DNA, 15 bp, Homo sapiens
ccgtgggccatggca

SEQ ID NO: 6093721 - DNA, 21 bp, Homo sapiens
ccgtgggccgtatctgtcaca

SEQ ID NO: 6093722 - DNA, 13 bp, Homo sapiens
ccgtgggcctggg

SEQ ID NO: 6093723 - DNA, 19 bp, Homo sapiens
ccgtgggcggggccttgcg

SEQ ID NO: 6093724 - DNA, 14 bp, Homo sapiens
ccgtgggctccctg

SEQ ID NO: 6093725 - DNA, 14 bp, Homo sapiens
ccgtggggaagggg

SEQ ID NO: 6093726 - DNA, 15 bp, Homo sapiens
ccgtggggaggccat

SEQ ID NO: 6093727 - DNA, 23 bp, Homo sapiens
ccgtggggcagggagctgggccc

SEQ ID NO: 6093728 - DNA, 15 bp, Homo sapiens
ccgtggggctcccgg

SEQ ID NO: 6093729 - DNA, 16 bp, Homo sapiens
ccgtggggctccggag

SEQ ID NO: 6093730 - DNA, 15 bp, Homo sapiens
ccgtgggggcagggg

SEQ ID NO: 6093731 - DNA, 20 bp, Homo sapiens
ccgtgggggcaggggacctg

SEQ ID NO: 6093732 - DNA, 16 bp, Homo sapiens
ccgtgggtcatcccag

SEQ ID NO: 6093733 - DNA, 14 bp, Homo sapiens
ccgtgggttgctaa

SEQ ID NO: 6093734 - DNA, 15 bp, Homo sapiens
ccgtgggttgctaac

SEQ ID NO: 6093735 - DNA, 17 bp, Homo sapiens
ccgtgggttgctaactg

SEQ ID NO: 6093736 - DNA, 20 bp, Homo sapiens
ccgtgggttgctaactgaac

SEQ ID NO: 6093737 - DNA, 15 bp, Homo sapiens
ccgtggtagaggcct

SEQ ID NO: 6093738 - DNA, 17 bp, Homo sapiens
ccgtggtagaggcctgg

SEQ ID NO: 6093739 - DNA, 18 bp, Homo sapiens
ccgtggtatgtctgccat

SEQ ID NO: 6093740 - DNA, 24 bp, Homo sapiens
ccgtggtcagagggactgtcagct

SEQ ID NO: 6093741 - DNA, 21 bp, Homo sapiens
ccgtggtcagagtgccactgc

SEQ ID NO: 6093742 - DNA, 16 bp, Homo sapiens
ccgtggtccagctctt

SEQ ID NO: 6093743 - DNA, 16 bp, Homo sapiens
ccgtggtccctgagga

SEQ ID NO: 6093744 - DNA, 17 bp, Homo sapiens
ccgtggtctttgaataa

SEQ ID NO: 6093745 - DNA, 19 bp, Homo sapiens
ccgtggtctttgaataaag

SEQ ID NO: 6093746 - DNA, 22 bp, Homo sapiens
ccgtggtctttgaataaagtct

SEQ ID NO: 6093747 - DNA, 20 bp, Homo sapiens
ccgtggtgacatttcccaag

SEQ ID NO: 6093748 - DNA, 22 bp, Homo sapiens
ccgtggtgacatttcccaagtc

SEQ ID NO: 6093749 - DNA, 13 bp, Homo sapiens
ccgtggtgcctgc

SEQ ID NO: 6093750 - DNA, 18 bp, Homo sapiens
ccgtggtgtgaggccccc

SEQ ID NO: 6093751 - DNA, 22 bp, Homo sapiens
ccgtggtgtgaggcccccggag

SEQ ID NO: 6093752 - DNA, 20 bp, Homo sapiens
ccgtggtgttatttaaagaa

SEQ ID NO: 6093753 - DNA, 21 bp, Homo sapiens
ccgtgtaaaaagcctccttgt

SEQ ID NO: 6093754 - DNA, 16 bp, Homo sapiens
ccgtgtaaaccaaagc

SEQ ID NO: 6093755 - DNA, 19 bp, Homo sapiens
ccgtgtaaataatttatta

SEQ ID NO: 6093756 - DNA, 13 bp, Homo sapiens
ccgtgtaaatatg

SEQ ID NO: 6093757 - DNA, 11 bp, Homo sapiens
ccgtgtacaat

SEQ ID NO: 6093758 - DNA, 18 bp, Homo sapiens
ccgtgtaggaacctgcac

SEQ ID NO: 6093759 - DNA, 15 bp, Homo sapiens
ccgtgtagtttctgg

SEQ ID NO: 6093760 - DNA, 23 bp, Homo sapiens
ccgtgtcaagctgctctgagcca

SEQ ID NO: 6093761 - DNA, 16 bp, Homo sapiens
ccgtgtccagcacaga

SEQ ID NO: 6093762 - DNA, 23 bp, Homo sapiens
ccgtgtccagcacagaaggaatc

SEQ ID NO: 6093763 - DNA, 11 bp, Homo sapiens
ccgtgtcccaa

SEQ ID NO: 6093764 - DNA, 13 bp, Homo sapiens
ccgtgtcctcctc

SEQ ID NO: 6093765 - DNA, 17 bp, Homo sapiens
ccgtgtcctctccctgc

SEQ ID NO: 6093766 - DNA, 16 bp, Homo sapiens
ccgtgtcctgccttga

SEQ ID NO: 6093767 - DNA, 18 bp, Homo sapiens
ccgtgtcgggcaggtcag

SEQ ID NO: 6093768 - DNA, 22 bp, Homo sapiens
ccgtgtcgggcaggtcagcgcg

SEQ ID NO: 6093769 - DNA, 16 bp, Homo sapiens
ccgtgtctctgaggac

SEQ ID NO: 6093770 - DNA, 19 bp, Homo sapiens
ccgtgtctgtggccctctc

SEQ ID NO: 6093771 - DNA, 21 bp, Homo sapiens
ccttattgcctcccaggcaag

SEQ ID NO: 6093772 - DNA, 13 bp, Homo sapiens
ccttattgctgcc

SEQ ID NO: 6093773 - DNA, 16 bp, Homo sapiens
ccttattgctgccaaa

SEQ ID NO: 6093774 - DNA, 19 bp, Homo sapiens
ccttattgctgccaaaacc

SEQ ID NO: 6093775 - DNA, 21 bp, Homo sapiens
ccttattgctgccaaaaccac

SEQ ID NO: 6093776 - DNA, 17 bp, Homo sapiens
ccttattggatatttga

SEQ ID NO: 6093777 - DNA, 16 bp, Homo sapiens
ccttattgtacgttta

SEQ ID NO: 6093778 - DNA, 17 bp, Homo sapiens
ccttatttaaaagattt

SEQ ID NO: 6093779 - DNA, 16 bp, Homo sapiens
ccttatttatatatca

SEQ ID NO: 6093780 - DNA, 13 bp, Homo sapiens
ccttatttatcaa

SEQ ID NO: 6093781 - DNA, 16 bp, Homo sapiens
ccttatttatttttgt

SEQ ID NO: 6093782 - DNA, 12 bp, Homo sapiens
ccttatttctca

SEQ ID NO: 6093783 - DNA, 16 bp, Homo sapiens
ccttatttctctctcc

SEQ ID NO: 6093784 - DNA, 21 bp, Homo sapiens
ccttatttctctctcctggtg

SEQ ID NO: 6093785 - DNA, 14 bp, Homo sapiens
ccttatttgccttc

SEQ ID NO: 6093786 - DNA, 19 bp, Homo sapiens
ccttatttgccttctactc

SEQ ID NO: 6093787 - DNA, 19 bp, Homo sapiens
ccttatttgtctgtaaaaa

SEQ ID NO: 6093788 - DNA, 18 bp, Homo sapiens
ccttattttgataaaatg

SEQ ID NO: 6093789 - DNA, 17 bp, Homo sapiens
ccttatttttatttatt

SEQ ID NO: 6093790 - DNA, 15 bp, Homo sapiens
ccttatttttgaatt

SEQ ID NO: 6093791 - DNA, 17 bp, Homo sapiens
ccttatttttgaattct

SEQ ID NO: 6093792 - DNA, 21 bp, Homo sapiens
ccttcaaaatgttctatttaa

SEQ ID NO: 6093793 - DNA, 17 bp, Homo sapiens
ccttcaaagaaacttga

SEQ ID NO: 6093794 - DNA, 15 bp, Homo sapiens
ccttcaaagcaaatg

SEQ ID NO: 6093795 - DNA, 19 bp, Homo sapiens
ccttcaaagcaaatgtctt

SEQ ID NO: 6093796 - DNA, 15 bp, Homo sapiens
ccttcaaataaagaa

SEQ ID NO: 6093797 - DNA, 13 bp, Homo sapiens
ccttcaaatacat

SEQ ID NO: 6093798 - DNA, 19 bp, Homo sapiens
ccttcaaatacattctaaa

SEQ ID NO: 6093799 - DNA, 23 bp, Homo sapiens
ccttcaacaaggcttgctgcaga

SEQ ID NO: 6093800 - DNA, 22 bp, Homo sapiens
ccttcaacaattctaaaatgat

SEQ ID NO: 6093801 - DNA, 14 bp, Homo sapiens
ccttcaacacagct

SEQ ID NO: 6093802 - DNA, 17 bp, Homo sapiens
ccttcaacgtttcttca

SEQ ID NO: 6093803 - DNA, 19 bp, Homo sapiens
ccttcaacgtttcttcact

SEQ ID NO: 6093804 - DNA, 13 bp, Homo sapiens
ccttcaactgaaa

SEQ ID NO: 6093805 - DNA, 21 bp, Homo sapiens
ccttcaagacgaggggcaggg

SEQ ID NO: 6093806 - DNA, 14 bp, Homo sapiens
ccttcaagcaccct

SEQ ID NO: 6093807 - DNA, 21 bp, Homo sapiens
ccttcaagctctgagggaaag

SEQ ID NO: 6093808 - DNA, 21 bp, Homo sapiens
ccttcaaggactgtttcagtg

SEQ ID NO: 6093809 - DNA, 22 bp, Homo sapiens
ccttcaaggactgtttcagtgt

SEQ ID NO: 6093810 - DNA, 23 bp, Homo sapiens
ccttcaaggactgtttcagtgtg

SEQ ID NO: 6093811 - DNA, 13 bp, Homo sapiens
ccttcaaggcctc

SEQ ID NO: 6093812 - DNA, 15 bp, Homo sapiens
ccttcaagtgccaaa

SEQ ID NO: 6093813 - DNA, 21 bp, Homo sapiens
ccttcaatgaattaattcaga

SEQ ID NO: 6093814 - DNA, 15 bp, Homo sapiens
ccttcaatgttaaat

SEQ ID NO: 6093815 - DNA, 12 bp, Homo sapiens
ccttcaattatt

SEQ ID NO: 6093816 - DNA, 14 bp, Homo sapiens
ccttcaattcctgg

SEQ ID NO: 6093817 - DNA, 20 bp, Homo sapiens
ccttcaattcctgggcccca

SEQ ID NO: 6093818 - DNA, 12 bp, Homo sapiens
ccttcacaaagc

SEQ ID NO: 6093819 - DNA, 17 bp, Homo sapiens
ccttcacaaccagccac

SEQ ID NO: 6093820 - DNA, 20 bp, Homo sapiens
ccttcacaaccagccacaca

SEQ ID NO: 6093821 - DNA, 20 bp, Homo sapiens
ccttcacaccccaggccctt

SEQ ID NO: 6093822 - DNA, 17 bp, Homo sapiens
ccttcacagatgcctac

SEQ ID NO: 6093823 - DNA, 17 bp, Homo sapiens
ccttcacagatgggtgc

SEQ ID NO: 6093824 - DNA, 18 bp, Homo sapiens
ccttcacaggcagtgcat

SEQ ID NO: 6093825 - DNA, 15 bp, Homo sapiens
ccttcacagtcccag

SEQ ID NO: 6093826 - DNA, 16 bp, Homo sapiens
ccttcacagtcccagg

SEQ ID NO: 6093827 - DNA, 12 bp, Homo sapiens
ccttcacagtgt

SEQ ID NO: 6093828 - DNA, 21 bp, Homo sapiens
ccttcacattcccctggggac

SEQ ID NO: 6093829 - DNA, 22 bp, Homo sapiens
ccttcacatttactagctgtgc

SEQ ID NO: 6093830 - DNA, 13 bp, Homo sapiens
ccttcaccaagct

SEQ ID NO: 6093831 - DNA, 13 bp, Homo sapiens
ccttcaccacccc

SEQ ID NO: 6093832 - DNA, 15 bp, Homo sapiens
ccttcaccacctcat

SEQ ID NO: 6093833 - DNA, 17 bp, Homo sapiens
ccttcaccagagcccat

SEQ ID NO: 6093834 - DNA, 13 bp, Homo sapiens
ccttcacccagag

SEQ ID NO: 6093835 - DNA, 14 bp, Homo sapiens
ccttcacccagcac

SEQ ID NO: 6093836 - DNA, 14 bp, Homo sapiens
ccttcaccccttca

SEQ ID NO: 6093837 - DNA, 14 bp, Homo sapiens
ccttcaccgctccc

SEQ ID NO: 6093838 - DNA, 17 bp, Homo sapiens
ccttcaccgtggctacc

SEQ ID NO: 6093839 - DNA, 14 bp, Homo sapiens
ccttcacctcggag

SEQ ID NO: 6093840 - DNA, 19 bp, Homo sapiens
ccttcacctcggagggatg

SEQ ID NO: 6093841 - DNA, 14 bp, Homo sapiens
ccttcacctctgaa

SEQ ID NO: 6093842 - DNA, 19 bp, Homo sapiens
ccttcacgctggcttccag

SEQ ID NO: 6093843 - DNA, 16 bp, Homo sapiens
ccttcactccagacag

SEQ ID NO: 6093844 - DNA, 17 bp, Homo sapiens
ccttcactccagacaga

SEQ ID NO: 6093845 - DNA, 18 bp, Homo sapiens
ccttcactccctgtcata

SEQ ID NO: 6093846 - DNA, 23 bp, Homo sapiens
ccttcactccggtgtgcctgcag

SEQ ID NO: 6093847 - DNA, 13 bp, Homo sapiens
ccttcactctgac

SEQ ID NO: 6093848 - DNA, 19 bp, Homo sapiens
ccttcactgccatgatagc

SEQ ID NO: 6093849 - DNA, 18 bp, Homo sapiens
ccttcactgcctttgctc

SEQ ID NO: 6093850 - DNA, 14 bp, Homo sapiens
ccttcactggcgcc

SEQ ID NO: 6093851 - DNA, 15 bp, Homo sapiens
ccttcactggcgcct

SEQ ID NO: 6093852 - DNA, 19 bp, Homo sapiens
ccttcactggcgccttctc

SEQ ID NO: 6093853 - DNA, 14 bp, Homo sapiens
ccttcactgttccc

SEQ ID NO: 6093854 - DNA, 21 bp, Homo sapiens
ccttcactgttgcttaattgt

SEQ ID NO: 6093855 - DNA, 22 bp, Homo sapiens
ccttcacttctgaccacacttc

SEQ ID NO: 6093856 - DNA, 18 bp, Homo sapiens
ccttcactttctcctggt

SEQ ID NO: 6093857 - DNA, 23 bp, Homo sapiens
ccttcagaaaagacacttcaatg

SEQ ID NO: 6093858 - DNA, 18 bp, Homo sapiens
ccttcagaaccatccata

SEQ ID NO: 6093859 - DNA, 13 bp, Homo sapiens
ccttcagacacat

SEQ ID NO: 6093860 - DNA, 20 bp, Homo sapiens
ccttcagacaccctcaacct

SEQ ID NO: 6093861 - DNA, 15 bp, Homo sapiens
ccttcagaccccagt

SEQ ID NO: 6093862 - DNA, 19 bp, Homo sapiens
ccttcagagagcagtgctt

SEQ ID NO: 6093863 - DNA, 22 bp, Homo sapiens
ccttcagagagcagtgcttttg

SEQ ID NO: 6093864 - DNA, 19 bp, Homo sapiens
ccttcagagccagccggct

SEQ ID NO: 6093865 - DNA, 21 bp, Homo sapiens
ccttcagagtacgtcctgcct

SEQ ID NO: 6093866 - DNA, 22 bp, Homo sapiens
ccttcagagtacgtcctgcctg

SEQ ID NO: 6093867 - DNA, 16 bp, Homo sapiens
ccttcagatcctaccc

SEQ ID NO: 6093868 - DNA, 16 bp, Homo sapiens
ccttcagattccccat

SEQ ID NO: 6093869 - DNA, 17 bp, Homo sapiens
ccttcagcagctagagc

SEQ ID NO: 6093870 - DNA, 17 bp, Homo sapiens
ccttcagccacagggag

SEQ ID NO: 6093871 - DNA, 17 bp, Homo sapiens
ccttcagcccaccaccc

SEQ ID NO: 6093872 - DNA, 18 bp, Homo sapiens
ccttcagcccccagcccc

SEQ ID NO: 6093873 - DNA, 13 bp, Homo sapiens
ccttcagccttaa

SEQ ID NO: 6093874 - DNA, 16 bp, Homo sapiens
ccttcagctcctgagt

SEQ ID NO: 6093875 - DNA, 17 bp, Homo sapiens
ccttcagctcctgagta

SEQ ID NO: 6093876 - DNA, 16 bp, Homo sapiens
ccttcaggacccttct

SEQ ID NO: 6093877 - DNA, 12 bp, Homo sapiens
ccttcaggagcc

SEQ ID NO: 6093878 - DNA, 14 bp, Homo sapiens
ccttcaggagcctg

SEQ ID NO: 6093879 - DNA, 15 bp, Homo sapiens
ccttcaggcagctga

SEQ ID NO: 6093880 - DNA, 14 bp, Homo sapiens
ccttcaggccagct

SEQ ID NO: 6093881 - DNA, 16 bp, Homo sapiens
ccttcaggccagctgg

SEQ ID NO: 6093882 - DNA, 18 bp, Homo sapiens
ccttcagggagacaggca

SEQ ID NO: 6093883 - DNA, 19 bp, Homo sapiens
ccttcagggagacaggcag

SEQ ID NO: 6093884 - DNA, 20 bp, Homo sapiens
ccttcagggattccctgtcc

SEQ ID NO: 6093885 - DNA, 22 bp, Homo sapiens
ccttcagggattccctgtcccc

SEQ ID NO: 6093886 - DNA, 15 bp, Homo sapiens
ccttcagggccagaa

SEQ ID NO: 6093887 - DNA, 19 bp, Homo sapiens
ccttcagggccagaaggag

SEQ ID NO: 6093888 - DNA, 12 bp, Homo sapiens
ccttcagggtga

SEQ ID NO: 6093889 - DNA, 21 bp, Homo sapiens
ccttcaggtcccctggccctt

SEQ ID NO: 6093890 - DNA, 14 bp, Homo sapiens
ccttcaggttcctc

SEQ ID NO: 6093891 - DNA, 17 bp, Homo sapiens
ccttcaggttcctccta

SEQ ID NO: 6093892 - DNA, 23 bp, Homo sapiens
ccttcagtaccctctcagctcca

SEQ ID NO: 6093893 - DNA, 18 bp, Homo sapiens
ccttcagtatcaaggctg

SEQ ID NO: 6093894 - DNA, 16 bp, Homo sapiens
ccttcagtctgctcca

SEQ ID NO: 6093895 - DNA, 17 bp, Homo sapiens
ccttcagtctgctccac

SEQ ID NO: 6093896 - DNA, 20 bp, Homo sapiens
ccttcagtcttgaatttcta

SEQ ID NO: 6093897 - DNA, 15 bp, Homo sapiens
ccttcagtgagcccc

SEQ ID NO: 6093898 - DNA, 15 bp, Homo sapiens
ccttcagtgcccacc

SEQ ID NO: 6093899 - DNA, 12 bp, Homo sapiens
ccttcagtgcct

SEQ ID NO: 6093900 - DNA, 14 bp, Homo sapiens
ccttcagtgcctta

SEQ ID NO: 6093901 - DNA, 19 bp, Homo sapiens
ccttcagtgccttatggaa

SEQ ID NO: 6093902 - DNA, 18 bp, Homo sapiens
ccttcagttatgattttt

SEQ ID NO: 6093903 - DNA, 16 bp, Homo sapiens
ccttcagttctgcttg

SEQ ID NO: 6093904 - DNA, 12 bp, Homo sapiens
ccttcagtttga

SEQ ID NO: 6093905 - DNA, 22 bp, Homo sapiens
ccttcagtttgaaggctgcaca

SEQ ID NO: 6093906 - DNA, 19 bp, Homo sapiens
ccttcataaattatttcta

SEQ ID NO: 6093907 - DNA, 15 bp, Homo sapiens
ccttcataccgcctc

SEQ ID NO: 6093908 - DNA, 15 bp, Homo sapiens
ccttcatacttgaac

SEQ ID NO: 6093909 - DNA, 19 bp, Homo sapiens
ccttcatacttgaacgttt

SEQ ID NO: 6093910 - DNA, 22 bp, Homo sapiens
ccttcataggcggtcatgtgtg

SEQ ID NO: 6093911 - DNA, 20 bp, Homo sapiens
ccttcatcagaactcttcct

SEQ ID NO: 6093912 - DNA, 21 bp, Homo sapiens
ccttcatcagaactcttcctc

SEQ ID NO: 6093913 - DNA, 17 bp, Homo sapiens
ccttcatccgcctgtgg

SEQ ID NO: 6093914 - DNA, 20 bp, Homo sapiens
ccttcatcgaacaaactgat

SEQ ID NO: 6093915 - DNA, 17 bp, Homo sapiens
ccttcatctccagggag

SEQ ID NO: 6093916 - DNA, 22 bp, Homo sapiens
ccttcatcttcctgtgtcctga

SEQ ID NO: 6093917 - DNA, 13 bp, Homo sapiens
ccttcatctttta

SEQ ID NO: 6093918 - DNA, 21 bp, Homo sapiens
ccttcatgcatggaaattccc

SEQ ID NO: 6093919 - DNA, 17 bp, Homo sapiens
ccttcatgcttttctca

SEQ ID NO: 6093920 - DNA, 17 bp, Homo sapiens
ccttcattccgttagga

SEQ ID NO: 6093921 - DNA, 11 bp, Homo sapiens
ccttcatttaa

SEQ ID NO: 6093922 - DNA, 22 bp, Homo sapiens
ccttcatttaaactaaattact

SEQ ID NO: 6093923 - DNA, 18 bp, Homo sapiens
ccttcatttcaggaggga

SEQ ID NO: 6093924 - DNA, 17 bp, Homo sapiens
ccttcatttcatcctgt

SEQ ID NO: 6093925 - DNA, 13 bp, Homo sapiens
ccttcatttcctc

SEQ ID NO: 6093926 - DNA, 19 bp, Homo sapiens
ccttcatttctgatataga

SEQ ID NO: 6093927 - DNA, 15 bp, Homo sapiens
ccttcatttgcaatt

SEQ ID NO: 6093928 - DNA, 19 bp, Homo sapiens
ccttcatttggcattcccc

SEQ ID NO: 6093929 - DNA, 22 bp, Homo sapiens
ccttcatttggcattccccact

SEQ ID NO: 6093930 - DNA, 23 bp, Homo sapiens
ccttccaaaacctgcttccttca

SEQ ID NO: 6093931 - DNA, 20 bp, Homo sapiens
ccttccaaataataaagtct

SEQ ID NO: 6093932 - DNA, 19 bp, Homo sapiens
ccttccaacaggagctggg

SEQ ID NO: 6093933 - DNA, 13 bp, Homo sapiens
ccttccaacattt

SEQ ID NO: 6093934 - DNA, 19 bp, Homo sapiens
ccttccaactgctgcccca

SEQ ID NO: 6093935 - DNA, 17 bp, Homo sapiens
ccttccaacttcctgtg

SEQ ID NO: 6093936 - DNA, 17 bp, Homo sapiens
ccttccaagactgaaga

SEQ ID NO: 6093937 - DNA, 20 bp, Homo sapiens
ccttccaaggtcactcttgg

SEQ ID NO: 6093938 - DNA, 22 bp, Homo sapiens
ccttccaagtttgacttgtata

SEQ ID NO: 6093939 - DNA, 18 bp, Homo sapiens
ccttccaatgtctggaga

SEQ ID NO: 6093940 - DNA, 19 bp, Homo sapiens
ccttccaatgtctggagac

SEQ ID NO: 6093941 - DNA, 22 bp, Homo sapiens
ccttccacagttatcttagctg

SEQ ID NO: 6093942 - DNA, 16 bp, Homo sapiens
ccttccacatgtacat

SEQ ID NO: 6093943 - DNA, 15 bp, Homo sapiens
ccttccacccagggg

SEQ ID NO: 6093944 - DNA, 19 bp, Homo sapiens
ccttccaccctgccctggc

SEQ ID NO: 6093945 - DNA, 21 bp, Homo sapiens
ccttccaccctgccctggcct

SEQ ID NO: 6093946 - DNA, 23 bp, Homo sapiens
ccttccaccctgccctggcctac

SEQ ID NO: 6093947 - DNA, 15 bp, Homo sapiens
ccttccaccggcact

SEQ ID NO: 6093948 - DNA, 17 bp, Homo sapiens
ccttccaccggcactca

SEQ ID NO: 6093949 - DNA, 13 bp, Homo sapiens
ccttccacctcac

SEQ ID NO: 6093950 - DNA, 14 bp, Homo sapiens
ccgtgtgaatgtag

SEQ ID NO: 6093951 - DNA, 22 bp, Homo sapiens
ccgtgtgagaagtgaatgctgg

SEQ ID NO: 6093952 - DNA, 13 bp, Homo sapiens
ccgtgtgccctcg

SEQ ID NO: 6093953 - DNA, 16 bp, Homo sapiens
ccgtgtgccctcgggc

SEQ ID NO: 6093954 - DNA, 14 bp, Homo sapiens
ccgtgtgcctcctg

SEQ ID NO: 6093955 - DNA, 13 bp, Homo sapiens
ccgtgtgcctggg

SEQ ID NO: 6093956 - DNA, 13 bp, Homo sapiens
ccgtgtggcccct

SEQ ID NO: 6093957 - DNA, 15 bp, Homo sapiens
ccgtgtggcctgggt

SEQ ID NO: 6093958 - DNA, 20 bp, Homo sapiens
ccgtgtgggagaccggcctg

SEQ ID NO: 6093959 - DNA, 22 bp, Homo sapiens
ccgtgtggtaccttcagccctg

SEQ ID NO: 6093960 - DNA, 16 bp, Homo sapiens
ccgtgtgtatttctaa

SEQ ID NO: 6093961 - DNA, 14 bp, Homo sapiens
ccgtgtgtgcatgt

SEQ ID NO: 6093962 - DNA, 16 bp, Homo sapiens
ccgtgtgtgcatgtgc

SEQ ID NO: 6093963 - DNA, 18 bp, Homo sapiens
ccgtgtgtttagaagcct

SEQ ID NO: 6093964 - DNA, 14 bp, Homo sapiens
ccgtgttcctcggt

SEQ ID NO: 6093965 - DNA, 22 bp, Homo sapiens
ccgtgttgcatgaaggagcagc

SEQ ID NO: 6093966 - DNA, 13 bp, Homo sapiens
ccgtgttgcttca

SEQ ID NO: 6093967 - DNA, 23 bp, Homo sapiens
ccgtgtttctctaaggaattatt

SEQ ID NO: 6093968 - DNA, 14 bp, Homo sapiens
ccgttaaatgtcaa

SEQ ID NO: 6093969 - DNA, 23 bp, Homo sapiens
ccgttacatctgtgcagggctgg

SEQ ID NO: 6093970 - DNA, 14 bp, Homo sapiens
ccgttagctcctgt

SEQ ID NO: 6093971 - DNA, 18 bp, Homo sapiens
ccgttagctcctgtggcc

SEQ ID NO: 6093972 - DNA, 20 bp, Homo sapiens
ccgttaggaataacactgca

SEQ ID NO: 6093973 - DNA, 23 bp, Homo sapiens
ccgttagggaaatccaactccag

SEQ ID NO: 6093974 - DNA, 12 bp, Homo sapiens
ccgttattaaaa

SEQ ID NO: 6093975 - DNA, 14 bp, Homo sapiens
ccgttcacttcccc

SEQ ID NO: 6093976 - DNA, 20 bp, Homo sapiens
ccgttcagtgtcccaggcag

SEQ ID NO: 6093977 - DNA, 14 bp, Homo sapiens
ccgttcatctgagg

SEQ ID NO: 6093978 - DNA, 17 bp, Homo sapiens
ccgttcatctgaggagt

SEQ ID NO: 6093979 - DNA, 15 bp, Homo sapiens
ccgttcatgggggag

SEQ ID NO: 6093980 - DNA, 15 bp, Homo sapiens
ccgttccagctgaca

SEQ ID NO: 6093981 - DNA, 15 bp, Homo sapiens
ccgttccaggagcac

SEQ ID NO: 6093982 - DNA, 14 bp, Homo sapiens
ccgttcccagcgca

SEQ ID NO: 6093983 - DNA, 14 bp, Homo sapiens
ccgttcctccccct

SEQ ID NO: 6093984 - DNA, 21 bp, Homo sapiens
ccgttcctcctcagcctccct

SEQ ID NO: 6093985 - DNA, 22 bp, Homo sapiens
ccgttcctgacatcacagcagc

SEQ ID NO: 6093986 - DNA, 23 bp, Homo sapiens
ccgttcctgacatcacagcagcc

SEQ ID NO: 6093987 - DNA, 13 bp, Homo sapiens
ccgttcctgggac

SEQ ID NO: 6093988 - DNA, 15 bp, Homo sapiens
ccgttctgctggcct

SEQ ID NO: 6093989 - DNA, 16 bp, Homo sapiens
ccgttgaatctgggag

SEQ ID NO: 6093990 - DNA, 13 bp, Homo sapiens
ccgttgaccagat

SEQ ID NO: 6093991 - DNA, 16 bp, Homo sapiens
ccgttgacgtgaccaa

SEQ ID NO: 6093992 - DNA, 19 bp, Homo sapiens
ccgttgatgttggctggga

SEQ ID NO: 6093993 - DNA, 16 bp, Homo sapiens
ccgttgcaaacccaaa

SEQ ID NO: 6093994 - DNA, 12 bp, Homo sapiens
ccgttgcatttg

SEQ ID NO: 6093995 - DNA, 17 bp, Homo sapiens
ccgttgccgggcctgga

SEQ ID NO: 6093996 - DNA, 19 bp, Homo sapiens
ccgttgccgggcctggact

SEQ ID NO: 6093997 - DNA, 20 bp, Homo sapiens
ccgttgccgggcctggactg

SEQ ID NO: 6093998 - DNA, 17 bp, Homo sapiens
ccgttgcctctctgcca

SEQ ID NO: 6093999 - DNA, 23 bp, Homo sapiens
ccgttgcctctctgccagccgct

SEQ ID NO: 6094000 - DNA, 14 bp, Homo sapiens
ccgttgctgaaaat

SEQ ID NO: 6094001 - DNA, 14 bp, Homo sapiens
ccgttgctgactta

SEQ ID NO: 6094002 - DNA, 17 bp, Homo sapiens
ccgttgctgacttagaa

SEQ ID NO: 6094003 - DNA, 17 bp, Homo sapiens
ccgttgctgccatcgta

SEQ ID NO: 6094004 - DNA, 13 bp, Homo sapiens
ccgttgcttcccg

SEQ ID NO: 6094005 - DNA, 23 bp, Homo sapiens
ccgttggaaacataaccattaca

SEQ ID NO: 6094006 - DNA, 20 bp, Homo sapiens
ccgttgggccccagccttct

SEQ ID NO: 6094007 - DNA, 20 bp, Homo sapiens
ccgttggggattggggaaga

SEQ ID NO: 6094008 - DNA, 14 bp, Homo sapiens
ccgttgtctccctg

SEQ ID NO: 6094009 - DNA, 13 bp, Homo sapiens
ccgttgtgagctg

SEQ ID NO: 6094010 - DNA, 13 bp, Homo sapiens
ccgttgtgcctgg

SEQ ID NO: 6094011 - DNA, 14 bp, Homo sapiens
ccgttgtgcctggt

SEQ ID NO: 6094012 - DNA, 12 bp, Homo sapiens
ccgtttacagtg

SEQ ID NO: 6094013 - DNA, 17 bp, Homo sapiens
ccgtttacctagaagaa

SEQ ID NO: 6094014 - DNA, 21 bp, Homo sapiens
ccgtttagtcatatctatcta

SEQ ID NO: 6094015 - DNA, 19 bp, Homo sapiens
ccgtttatgggccttgctt

SEQ ID NO: 6094016 - DNA, 17 bp, Homo sapiens
ccgtttcagtggaccct

SEQ ID NO: 6094017 - DNA, 23 bp, Homo sapiens
ccgtttcatttagtcatgtgacc

SEQ ID NO: 6094018 - DNA, 14 bp, Homo sapiens
ccgtttccctccag

SEQ ID NO: 6094019 - DNA, 15 bp, Homo sapiens
ccgtttccttacaca

SEQ ID NO: 6094020 - DNA, 13 bp, Homo sapiens
ccgtttctccttt

SEQ ID NO: 6094021 - DNA, 13 bp, Homo sapiens
ccgtttcttccct

SEQ ID NO: 6094022 - DNA, 18 bp, Homo sapiens
ccgtttgaccaatttgca

SEQ ID NO: 6094023 - DNA, 22 bp, Homo sapiens
ccgtttgagaagaaaacatcta

SEQ ID NO: 6094024 - DNA, 21 bp, Homo sapiens
ccgtttgatttgtcactgctt

SEQ ID NO: 6094025 - DNA, 23 bp, Homo sapiens
ccgtttggtgtctgatgtgtgcc

SEQ ID NO: 6094026 - DNA, 20 bp, Homo sapiens
ccgttttcatcctggcctcc

SEQ ID NO: 6094027 - DNA, 21 bp, Homo sapiens
ccgttttcatcctggcctcct

SEQ ID NO: 6094028 - DNA, 17 bp, Homo sapiens
ccgttttccccatgaca

SEQ ID NO: 6094029 - DNA, 15 bp, Homo sapiens
ccgttttcctcatcc

SEQ ID NO: 6094030 - DNA, 19 bp, Homo sapiens
ccgttttgtcactttttct

SEQ ID NO: 6094031 - DNA, 23 bp, Homo sapiens
ccgtttttcaagaaaactggaaa

SEQ ID NO: 6094032 - DNA, 14 bp, Homo sapiens
cctaaaaaagatat

SEQ ID NO: 6094033 - DNA, 19 bp, Homo sapiens
cctaaaaagattgccaatt

SEQ ID NO: 6094034 - DNA, 11 bp, Homo sapiens
cctaaaaataa

SEQ ID NO: 6094035 - DNA, 14 bp, Homo sapiens
cctaaaaataaagc

SEQ ID NO: 6094036 - DNA, 20 bp, Homo sapiens
cctaaaaataagctttattt

SEQ ID NO: 6094037 - DNA, 20 bp, Homo sapiens
cctaaaaataggggccgttt

SEQ ID NO: 6094038 - DNA, 17 bp, Homo sapiens
cctaaaaattcccttcc

SEQ ID NO: 6094039 - DNA, 18 bp, Homo sapiens
cctaaaacaaaagctcat

SEQ ID NO: 6094040 - DNA, 12 bp, Homo sapiens
cctaaaacaaat

SEQ ID NO: 6094041 - DNA, 15 bp, Homo sapiens
cctaaaactggcctg

SEQ ID NO: 6094042 - DNA, 20 bp, Homo sapiens
cctaaaactggcctgacttg

SEQ ID NO: 6094043 - DNA, 12 bp, Homo sapiens
cctaaaactggg

SEQ ID NO: 6094044 - DNA, 18 bp, Homo sapiens
cctaaaagcacactcatc

SEQ ID NO: 6094045 - DNA, 17 bp, Homo sapiens
cctaaaaggcccagaga

SEQ ID NO: 6094046 - DNA, 14 bp, Homo sapiens
cctaaaagtaaaca

SEQ ID NO: 6094047 - DNA, 15 bp, Homo sapiens
cctaaaagtaaacat

SEQ ID NO: 6094048 - DNA, 17 bp, Homo sapiens
cctaaaagttgaaaagc

SEQ ID NO: 6094049 - DNA, 15 bp, Homo sapiens
cctaaaataaaaacc

SEQ ID NO: 6094050 - DNA, 17 bp, Homo sapiens
cctaaaataaaaaccag

SEQ ID NO: 6094051 - DNA, 23 bp, Homo sapiens
cctaaaataacagtatgtgggat

SEQ ID NO: 6094052 - DNA, 15 bp, Homo sapiens
cctaaaataagaata

SEQ ID NO: 6094053 - DNA, 18 bp, Homo sapiens
cctaaaataattggttct

SEQ ID NO: 6094054 - DNA, 21 bp, Homo sapiens
cctaaaatattacaaaataag

SEQ ID NO: 6094055 - DNA, 18 bp, Homo sapiens
cctaaaattactattctt

SEQ ID NO: 6094056 - DNA, 22 bp, Homo sapiens
cctaaaatttgccctcccatcc

SEQ ID NO: 6094057 - DNA, 23 bp, Homo sapiens
cctaaacaaaagcaaagatgcat

SEQ ID NO: 6094058 - DNA, 18 bp, Homo sapiens
cctaaacaacctggtgca

SEQ ID NO: 6094059 - DNA, 19 bp, Homo sapiens
cctaaacagctgctttatg

SEQ ID NO: 6094060 - DNA, 21 bp, Homo sapiens
cctaaaccaaaaactgaaagt

SEQ ID NO: 6094061 - DNA, 20 bp, Homo sapiens
cctaaacccccgctccagat

SEQ ID NO: 6094062 - DNA, 16 bp, Homo sapiens
cctaaaccctctgtga

SEQ ID NO: 6094063 - DNA, 17 bp, Homo sapiens
cctaaaccctctgtgaa

SEQ ID NO: 6094064 - DNA, 22 bp, Homo sapiens
cctaaaccgtcccctccttccc

SEQ ID NO: 6094065 - DNA, 13 bp, Homo sapiens
cctaaacctcagt

SEQ ID NO: 6094066 - DNA, 16 bp, Homo sapiens
cctaaacggggcagta

SEQ ID NO: 6094067 - DNA, 20 bp, Homo sapiens
cctaaacggggcagtactcc

SEQ ID NO: 6094068 - DNA, 14 bp, Homo sapiens
cctaaactatcttt

SEQ ID NO: 6094069 - DNA, 18 bp, Homo sapiens
cctaaactgcagcctctc

SEQ ID NO: 6094070 - DNA, 22 bp, Homo sapiens
cctaaacttacatttaaaagac

SEQ ID NO: 6094071 - DNA, 14 bp, Homo sapiens
cctaaactttagac

SEQ ID NO: 6094072 - DNA, 16 bp, Homo sapiens
cctaaagaaaaagata

SEQ ID NO: 6094073 - DNA, 15 bp, Homo sapiens
cctaaagaacaaagt

SEQ ID NO: 6094074 - DNA, 19 bp, Homo sapiens
cctaaagaccatttaatct

SEQ ID NO: 6094075 - DNA, 17 bp, Homo sapiens
cctaaagacgtctcttt

SEQ ID NO: 6094076 - DNA, 13 bp, Homo sapiens
cctaaagagcatc

SEQ ID NO: 6094077 - DNA, 18 bp, Homo sapiens
cctaaagagcatcctgat

SEQ ID NO: 6094078 - DNA, 18 bp, Homo sapiens
cctaaagagttattcaaa

SEQ ID NO: 6094079 - DNA, 20 bp, Homo sapiens
cctaaagatggcgcacccgg

SEQ ID NO: 6094080 - DNA, 15 bp, Homo sapiens
cctaaagattttgat

SEQ ID NO: 6094081 - DNA, 16 bp, Homo sapiens
cctaaagattttgatc

SEQ ID NO: 6094082 - DNA, 20 bp, Homo sapiens
cctaaagcaaatctgccacc

SEQ ID NO: 6094083 - DNA, 14 bp, Homo sapiens
cctaaagcagccag

SEQ ID NO: 6094084 - DNA, 15 bp, Homo sapiens
cctaaagcagccagc

SEQ ID NO: 6094085 - DNA, 11 bp, Homo sapiens
cctaaagccaa

SEQ ID NO: 6094086 - DNA, 16 bp, Homo sapiens
cctaaagccaggctca

SEQ ID NO: 6094087 - DNA, 21 bp, Homo sapiens
cctaaagccaggctcaggaga

SEQ ID NO: 6094088 - DNA, 23 bp, Homo sapiens
cctaaagccaggctcaggagaag

SEQ ID NO: 6094089 - DNA, 19 bp, Homo sapiens
cctaaagcctcaaaacaaa

SEQ ID NO: 6094090 - DNA, 18 bp, Homo sapiens
cctaaagctaaaaatatt

SEQ ID NO: 6094091 - DNA, 13 bp, Homo sapiens
cctaaagggacta

SEQ ID NO: 6094092 - DNA, 23 bp, Homo sapiens
cctaaagggagaaggaagggcag

SEQ ID NO: 6094093 - DNA, 18 bp, Homo sapiens
cctaaagtacagcctgga

SEQ ID NO: 6094094 - DNA, 20 bp, Homo sapiens
cctaaagtacagcctggacc

SEQ ID NO: 6094095 - DNA, 14 bp, Homo sapiens
cctaaagtctcagg

SEQ ID NO: 6094096 - DNA, 15 bp, Homo sapiens
cctaaagtgaagaag

SEQ ID NO: 6094097 - DNA, 20 bp, Homo sapiens
cctaaataaaaaaagacaaa

SEQ ID NO: 6094098 - DNA, 23 bp, Homo sapiens
cctaaataaacacatagattcac

SEQ ID NO: 6094099 - DNA, 19 bp, Homo sapiens
cctaaatagcagaaagaag

SEQ ID NO: 6094100 - DNA, 21 bp, Homo sapiens
cctaaataggtttttcttgct

SEQ ID NO: 6094101 - DNA, 13 bp, Homo sapiens
cctaaatccaaag

SEQ ID NO: 6094102 - DNA, 14 bp, Homo sapiens
cctaaatccaaaga

SEQ ID NO: 6094103 - DNA, 18 bp, Homo sapiens
cctaaatccatttggaaa

SEQ ID NO: 6094104 - DNA, 19 bp, Homo sapiens
cctaaatccatttggaaat

SEQ ID NO: 6094105 - DNA, 20 bp, Homo sapiens
cctaaatccatttggaaatc

SEQ ID NO: 6094106 - DNA, 17 bp, Homo sapiens
cctaaatccattttcta

SEQ ID NO: 6094107 - DNA, 14 bp, Homo sapiens
cctaaatctccagt

SEQ ID NO: 6094108 - DNA, 14 bp, Homo sapiens
cctaaatgacctca

SEQ ID NO: 6094109 - DNA, 18 bp, Homo sapiens
cctaaatgacctcagcaa

SEQ ID NO: 6094110 - DNA, 19 bp, Homo sapiens
cctaaatgacctcagcaaa

SEQ ID NO: 6094111 - DNA, 12 bp, Homo sapiens
cctaaatgatgg

SEQ ID NO: 6094112 - DNA, 16 bp, Homo sapiens
cctaaatgatggtgct

SEQ ID NO: 6094113 - DNA, 22 bp, Homo sapiens
cctaaattaacaaattcagtgg

SEQ ID NO: 6094114 - DNA, 18 bp, Homo sapiens
cctaaatttaatgctgcc

SEQ ID NO: 6094115 - DNA, 12 bp, Homo sapiens
cctaaatttcac

SEQ ID NO: 6094116 - DNA, 14 bp, Homo sapiens
cctaaatttcagta

SEQ ID NO: 6094117 - DNA, 18 bp, Homo sapiens
cctaaatttcattgtgtt

SEQ ID NO: 6094118 - DNA, 13 bp, Homo sapiens
cctaacaccagcg

SEQ ID NO: 6094119 - DNA, 22 bp, Homo sapiens
cctaacaccccctagcaaaact

SEQ ID NO: 6094120 - DNA, 12 bp, Homo sapiens
cctaacagtcag

SEQ ID NO: 6094121 - DNA, 15 bp, Homo sapiens
cctaacatagtgtct

SEQ ID NO: 6094122 - DNA, 19 bp, Homo sapiens
cctaacatagtgtctgctg

SEQ ID NO: 6094123 - DNA, 21 bp, Homo sapiens
cctaacatctgacctggcatc

SEQ ID NO: 6094124 - DNA, 14 bp, Homo sapiens
cctaaccaaatgct

SEQ ID NO: 6094125 - DNA, 20 bp, Homo sapiens
cctaaccaggcccagccagt

SEQ ID NO: 6094126 - DNA, 14 bp, Homo sapiens
cctaaccatgggct

SEQ ID NO: 6094127 - DNA, 20 bp, Homo sapiens
cctaaccatgggctcagggc

SEQ ID NO: 6094128 - DNA, 16 bp, Homo sapiens
cctaacccccagtcct

SEQ ID NO: 6094129 - DNA, 19 bp, Homo sapiens
cctaacccccagtcctcac

SEQ ID NO: 6094130 - DNA, 14 bp, Homo sapiens
ccttccacctcaca

SEQ ID NO: 6094131 - DNA, 17 bp, Homo sapiens
ccttccacctgctctgc

SEQ ID NO: 6094132 - DNA, 18 bp, Homo sapiens
ccttccacctgctctgct

SEQ ID NO: 6094133 - DNA, 20 bp, Homo sapiens
ccttccacgctgtctccaga

SEQ ID NO: 6094134 - DNA, 17 bp, Homo sapiens
ccttccacggactcaag

SEQ ID NO: 6094135 - DNA, 20 bp, Homo sapiens
ccttccacggatccatgtag

SEQ ID NO: 6094136 - DNA, 21 bp, Homo sapiens
ccttccacggatccatgtagc

SEQ ID NO: 6094137 - DNA, 22 bp, Homo sapiens
ccttccacgggggctgtggctc

SEQ ID NO: 6094138 - DNA, 23 bp, Homo sapiens
ccttccacgggggctgtggctct

SEQ ID NO: 6094139 - DNA, 15 bp, Homo sapiens
ccttccactgcctct

SEQ ID NO: 6094140 - DNA, 20 bp, Homo sapiens
ccttccactgcctctgcctt

SEQ ID NO: 6094141 - DNA, 21 bp, Homo sapiens
ccttccactgcctctgcctta

SEQ ID NO: 6094142 - DNA, 14 bp, Homo sapiens
ccttccagaaaaca

SEQ ID NO: 6094143 - DNA, 16 bp, Homo sapiens
ccttccagagcccaag

SEQ ID NO: 6094144 - DNA, 17 bp, Homo sapiens
ccttccagagcccaagg

SEQ ID NO: 6094145 - DNA, 14 bp, Homo sapiens
ccttccagcccaga

SEQ ID NO: 6094146 - DNA, 22 bp, Homo sapiens
ccttccagcccagacccccagt

SEQ ID NO: 6094147 - DNA, 13 bp, Homo sapiens
ccttccagcccat

SEQ ID NO: 6094148 - DNA, 18 bp, Homo sapiens
ccttccagcctgagatgt

SEQ ID NO: 6094149 - DNA, 13 bp, Homo sapiens
ccttccagcctgg

SEQ ID NO: 6094150 - DNA, 14 bp, Homo sapiens
ccttccagcctggg

SEQ ID NO: 6094151 - DNA, 16 bp, Homo sapiens
ccttccagcctgggac

SEQ ID NO: 6094152 - DNA, 12 bp, Homo sapiens
ccttccagcctt

SEQ ID NO: 6094153 - DNA, 13 bp, Homo sapiens
ccttccagctccc

SEQ ID NO: 6094154 - DNA, 15 bp, Homo sapiens
ccttccagctccctc

SEQ ID NO: 6094155 - DNA, 17 bp, Homo sapiens
ccttccagctccctccc

SEQ ID NO: 6094156 - DNA, 20 bp, Homo sapiens
ccttccagctccctcccctg

SEQ ID NO: 6094157 - DNA, 16 bp, Homo sapiens
ccttccagctcctgta

SEQ ID NO: 6094158 - DNA, 17 bp, Homo sapiens
ccttccagctcctgtaa

SEQ ID NO: 6094159 - DNA, 12 bp, Homo sapiens
ccttccagctgc

SEQ ID NO: 6094160 - DNA, 16 bp, Homo sapiens
ccttccagctgctgtc

SEQ ID NO: 6094161 - DNA, 20 bp, Homo sapiens
ccttccaggaatgctgggcc

SEQ ID NO: 6094162 - DNA, 16 bp, Homo sapiens
ccttccaggccccagg

SEQ ID NO: 6094163 - DNA, 18 bp, Homo sapiens
ccttccaggccccaggct

SEQ ID NO: 6094164 - DNA, 19 bp, Homo sapiens
ccttccaggccccaggctg

SEQ ID NO: 6094165 - DNA, 20 bp, Homo sapiens
ccttccaggccccaggctgg

SEQ ID NO: 6094166 - DNA, 21 bp, Homo sapiens
ccttccaggccccaggctgga

SEQ ID NO: 6094167 - DNA, 22 bp, Homo sapiens
ccttccaggcgtagggccaggg

SEQ ID NO: 6094168 - DNA, 12 bp, Homo sapiens
ccttccagggcc

SEQ ID NO: 6094169 - DNA, 19 bp, Homo sapiens
ccttccagggccctaggcc

SEQ ID NO: 6094170 - DNA, 13 bp, Homo sapiens
ccttccaggggtg

SEQ ID NO: 6094171 - DNA, 15 bp, Homo sapiens
ccttccaggggtggg

SEQ ID NO: 6094172 - DNA, 16 bp, Homo sapiens
ccttccaggggtggga

SEQ ID NO: 6094173 - DNA, 15 bp, Homo sapiens
ccttccaggtcagga

SEQ ID NO: 6094174 - DNA, 18 bp, Homo sapiens
ccttccagtggcttctcc

SEQ ID NO: 6094175 - DNA, 12 bp, Homo sapiens
ccttccagtggg

SEQ ID NO: 6094176 - DNA, 20 bp, Homo sapiens
ccttccagtgggttatcttt

SEQ ID NO: 6094177 - DNA, 20 bp, Homo sapiens
ccttccataaaaaaacaatt

SEQ ID NO: 6094178 - DNA, 14 bp, Homo sapiens
ccttccatacattt

SEQ ID NO: 6094179 - DNA, 17 bp, Homo sapiens
ccttccatatccctgcc

SEQ ID NO: 6094180 - DNA, 24 bp, Homo sapiens
ccttccatccatctttccatccat

SEQ ID NO: 6094181 - DNA, 14 bp, Homo sapiens
ccttccatcctgag

SEQ ID NO: 6094182 - DNA, 23 bp, Homo sapiens
ccttccatccttgactgaagcga

SEQ ID NO: 6094183 - DNA, 17 bp, Homo sapiens
ccttccatctcgccacc

SEQ ID NO: 6094184 - DNA, 16 bp, Homo sapiens
ccttccatctcttcct

SEQ ID NO: 6094185 - DNA, 15 bp, Homo sapiens
ccttccatcttcaca

SEQ ID NO: 6094186 - DNA, 13 bp, Homo sapiens
ccttccatcttgt

SEQ ID NO: 6094187 - DNA, 12 bp, Homo sapiens
ccttccatgccc

SEQ ID NO: 6094188 - DNA, 16 bp, Homo sapiens
ccttccatgccccagg

SEQ ID NO: 6094189 - DNA, 19 bp, Homo sapiens
ccttccatggtactgtagc

SEQ ID NO: 6094190 - DNA, 23 bp, Homo sapiens
ccttccatggtgtgatcgtctga

SEQ ID NO: 6094191 - DNA, 21 bp, Homo sapiens
ccttccatgtcaggccagcct

SEQ ID NO: 6094192 - DNA, 24 bp, Homo sapiens
ccttccatgtcaggccagcctgtc

SEQ ID NO: 6094193 - DNA, 18 bp, Homo sapiens
ccttccatgtcgcctctg

SEQ ID NO: 6094194 - DNA, 19 bp, Homo sapiens
ccttccatgtcgcctctgc

SEQ ID NO: 6094195 - DNA, 23 bp, Homo sapiens
ccttccatgtcgcctctgcattc

SEQ ID NO: 6094196 - DNA, 15 bp, Homo sapiens
ccttccatgtgcctt

SEQ ID NO: 6094197 - DNA, 22 bp, Homo sapiens
ccttccatgtgcctttctttgc

SEQ ID NO: 6094198 - DNA, 12 bp, Homo sapiens
ccttccattcca

SEQ ID NO: 6094199 - DNA, 15 bp, Homo sapiens
ccttccatttcttct

SEQ ID NO: 6094200 - DNA, 11 bp, Homo sapiens
ccttccatttt

SEQ ID NO: 6094201 - DNA, 19 bp, Homo sapiens
ccttccattttcccccact

SEQ ID NO: 6094202 - DNA, 22 bp, Homo sapiens
ccttccatttttgatttagtga

SEQ ID NO: 6094203 - DNA, 17 bp, Homo sapiens
ccttcccaacctcccct

SEQ ID NO: 6094204 - DNA, 20 bp, Homo sapiens
ccttcccaaggttactcagc

SEQ ID NO: 6094205 - DNA, 17 bp, Homo sapiens
ccttcccaatccagtgg

SEQ ID NO: 6094206 - DNA, 20 bp, Homo sapiens
ccttcccacatgcctgcgcc

SEQ ID NO: 6094207 - DNA, 17 bp, Homo sapiens
ccttcccacccctacac

SEQ ID NO: 6094208 - DNA, 15 bp, Homo sapiens
ccttcccacccctat

SEQ ID NO: 6094209 - DNA, 23 bp, Homo sapiens
ccttcccacctactgcactttcc

SEQ ID NO: 6094210 - DNA, 13 bp, Homo sapiens
ccttcccacggcc

SEQ ID NO: 6094211 - DNA, 18 bp, Homo sapiens
ccttcccacggccactgc

SEQ ID NO: 6094212 - DNA, 20 bp, Homo sapiens
ccttcccacggccactgcag

SEQ ID NO: 6094213 - DNA, 15 bp, Homo sapiens
ccttcccactgtcct

SEQ ID NO: 6094214 - DNA, 13 bp, Homo sapiens
ccttcccagacca

SEQ ID NO: 6094215 - DNA, 14 bp, Homo sapiens
ccttcccagaccag

SEQ ID NO: 6094216 - DNA, 18 bp, Homo sapiens
ccttcccagaccccgcag

SEQ ID NO: 6094217 - DNA, 24 bp, Homo sapiens
ccttcccagaccccgcagcacgcc

SEQ ID NO: 6094218 - DNA, 17 bp, Homo sapiens
ccttcccagaggggcct

SEQ ID NO: 6094219 - DNA, 24 bp, Homo sapiens
ccttcccagaggggcctgccacct

SEQ ID NO: 6094220 - DNA, 14 bp, Homo sapiens
ccttcccagccctc

SEQ ID NO: 6094221 - DNA, 12 bp, Homo sapiens
ccttcccagctc

SEQ ID NO: 6094222 - DNA, 14 bp, Homo sapiens
ccttcccagctctc

SEQ ID NO: 6094223 - DNA, 19 bp, Homo sapiens
ccttcccagctctccctct

SEQ ID NO: 6094224 - DNA, 21 bp, Homo sapiens
ccttcccagctctccctctgg

SEQ ID NO: 6094225 - DNA, 20 bp, Homo sapiens
ccttcccaggccagcgaggc

SEQ ID NO: 6094226 - DNA, 15 bp, Homo sapiens
ccttcccaggccctt

SEQ ID NO: 6094227 - DNA, 16 bp, Homo sapiens
ccttcccaggcccttt

SEQ ID NO: 6094228 - DNA, 11 bp, Homo sapiens
ccttcccaggg

SEQ ID NO: 6094229 - DNA, 14 bp, Homo sapiens
ccttcccagggacc

SEQ ID NO: 6094230 - DNA, 12 bp, Homo sapiens
ccttcccagggc

SEQ ID NO: 6094231 - DNA, 22 bp, Homo sapiens
ccttcccagggcacccaggcag

SEQ ID NO: 6094232 - DNA, 15 bp, Homo sapiens
ccttcccatctcttc

SEQ ID NO: 6094233 - DNA, 18 bp, Homo sapiens
ccttcccatgatgccgct

SEQ ID NO: 6094234 - DNA, 15 bp, Homo sapiens
ccttcccatgccctg

SEQ ID NO: 6094235 - DNA, 14 bp, Homo sapiens
ccttcccatttctt

SEQ ID NO: 6094236 - DNA, 14 bp, Homo sapiens
ccttccccacccca

SEQ ID NO: 6094237 - DNA, 12 bp, Homo sapiens
ccttccccactc

SEQ ID NO: 6094238 - DNA, 14 bp, Homo sapiens
ccttccccactccc

SEQ ID NO: 6094239 - DNA, 14 bp, Homo sapiens
ccttccccagaccc

SEQ ID NO: 6094240 - DNA, 13 bp, Homo sapiens
ccttccccagact

SEQ ID NO: 6094241 - DNA, 11 bp, Homo sapiens
ccttccccagc

SEQ ID NO: 6094242 - DNA, 12 bp, Homo sapiens
ccttccccagca

SEQ ID NO: 6094243 - DNA, 14 bp, Homo sapiens
ccttccccagccct

SEQ ID NO: 6094244 - DNA, 13 bp, Homo sapiens
ccttccccagcct

SEQ ID NO: 6094245 - DNA, 22 bp, Homo sapiens
ccttccccagctttgctgcctg

SEQ ID NO: 6094246 - DNA, 12 bp, Homo sapiens
ccttccccagga

SEQ ID NO: 6094247 - DNA, 13 bp, Homo sapiens
ccttccccaggat

SEQ ID NO: 6094248 - DNA, 21 bp, Homo sapiens
ccttccccaggatggactctt

SEQ ID NO: 6094249 - DNA, 12 bp, Homo sapiens
ccttccccaggc

SEQ ID NO: 6094250 - DNA, 14 bp, Homo sapiens
ccttccccaggccc

SEQ ID NO: 6094251 - DNA, 18 bp, Homo sapiens
ccttccccaggcccacca

SEQ ID NO: 6094252 - DNA, 14 bp, Homo sapiens
ccttccccatcctg

SEQ ID NO: 6094253 - DNA, 14 bp, Homo sapiens
ccttccccatctcc

SEQ ID NO: 6094254 - DNA, 13 bp, Homo sapiens
ccttccccatggg

SEQ ID NO: 6094255 - DNA, 16 bp, Homo sapiens
ccttccccatttcctc

SEQ ID NO: 6094256 - DNA, 13 bp, Homo sapiens
ccttcccccagca

SEQ ID NO: 6094257 - DNA, 14 bp, Homo sapiens
ccttcccccagccc

SEQ ID NO: 6094258 - DNA, 16 bp, Homo sapiens
ccttcccccagctttc

SEQ ID NO: 6094259 - DNA, 21 bp, Homo sapiens
ccttcccccatcccctttcct

SEQ ID NO: 6094260 - DNA, 17 bp, Homo sapiens
ccttccccccatctctg

SEQ ID NO: 6094261 - DNA, 20 bp, Homo sapiens
ccttccccctcccagggcca

SEQ ID NO: 6094262 - DNA, 22 bp, Homo sapiens
ccttccccctcccccagccact

SEQ ID NO: 6094263 - DNA, 13 bp, Homo sapiens
ccttcccccttcc

SEQ ID NO: 6094264 - DNA, 20 bp, Homo sapiens
ccttccccctttctctgcct

SEQ ID NO: 6094265 - DNA, 23 bp, Homo sapiens
ccttccccgagggatgatgccac

SEQ ID NO: 6094266 - DNA, 21 bp, Homo sapiens
ccttcccctaaaccccaagct

SEQ ID NO: 6094267 - DNA, 15 bp, Homo sapiens
ccttcccctacacct

SEQ ID NO: 6094268 - DNA, 15 bp, Homo sapiens
ccttcccctcccagc

SEQ ID NO: 6094269 - DNA, 16 bp, Homo sapiens
ccttcccctcccagcc

SEQ ID NO: 6094270 - DNA, 14 bp, Homo sapiens
ccttcccctcccct

SEQ ID NO: 6094271 - DNA, 16 bp, Homo sapiens
ccttcccctgcgccct

SEQ ID NO: 6094272 - DNA, 13 bp, Homo sapiens
ccttcccctggca

SEQ ID NO: 6094273 - DNA, 23 bp, Homo sapiens
ccttcccctgggaactctcctgg

SEQ ID NO: 6094274 - DNA, 12 bp, Homo sapiens
ccttcccctgtc

SEQ ID NO: 6094275 - DNA, 14 bp, Homo sapiens
ccttcccctgtctt

SEQ ID NO: 6094276 - DNA, 19 bp, Homo sapiens
ccttcccctgtcttcacct

SEQ ID NO: 6094277 - DNA, 17 bp, Homo sapiens
ccttccccttccccgtc

SEQ ID NO: 6094278 - DNA, 20 bp, Homo sapiens
ccttccccttgcccagggct

SEQ ID NO: 6094279 - DNA, 22 bp, Homo sapiens
ccttccccttgcccagggctca

SEQ ID NO: 6094280 - DNA, 15 bp, Homo sapiens
ccttccccttgtccc

SEQ ID NO: 6094281 - DNA, 18 bp, Homo sapiens
ccttcccctttactcagc

SEQ ID NO: 6094282 - DNA, 20 bp, Homo sapiens
ccttcccctttactcagccc

SEQ ID NO: 6094283 - DNA, 22 bp, Homo sapiens
ccttcccctttactcagcccag

SEQ ID NO: 6094284 - DNA, 24 bp, Homo sapiens
ccttcccctttactcagcccagct

SEQ ID NO: 6094285 - DNA, 20 bp, Homo sapiens
ccttccccttttgcctggct

SEQ ID NO: 6094286 - DNA, 23 bp, Homo sapiens
ccttcccgacccagccagctgca

SEQ ID NO: 6094287 - DNA, 15 bp, Homo sapiens
ccttcccgcagcacc

SEQ ID NO: 6094288 - DNA, 13 bp, Homo sapiens
ccttcccgccctc

SEQ ID NO: 6094289 - DNA, 16 bp, Homo sapiens
ccttcccgcctcggct

SEQ ID NO: 6094290 - DNA, 15 bp, Homo sapiens
ccttcccgccttcag

SEQ ID NO: 6094291 - DNA, 15 bp, Homo sapiens
ccttcccgccttcca

SEQ ID NO: 6094292 - DNA, 20 bp, Homo sapiens
ccttcccggttgtgagagcc

SEQ ID NO: 6094293 - DNA, 16 bp, Homo sapiens
ccttccctaaagtgat

SEQ ID NO: 6094294 - DNA, 17 bp, Homo sapiens
ccttccctaaagtgatg

SEQ ID NO: 6094295 - DNA, 12 bp, Homo sapiens
ccttccctccaa

SEQ ID NO: 6094296 - DNA, 19 bp, Homo sapiens
ccttccctccacctgcttg

SEQ ID NO: 6094297 - DNA, 18 bp, Homo sapiens
ccttccctccccacagtc

SEQ ID NO: 6094298 - DNA, 14 bp, Homo sapiens
ccttccctccctga

SEQ ID NO: 6094299 - DNA, 12 bp, Homo sapiens
ccttccctcctc

SEQ ID NO: 6094300 - DNA, 15 bp, Homo sapiens
ccttccctcctttgt

SEQ ID NO: 6094301 - DNA, 13 bp, Homo sapiens
ccttccctcgact

SEQ ID NO: 6094302 - DNA, 16 bp, Homo sapiens
ccttccctctctccct

SEQ ID NO: 6094303 - DNA, 18 bp, Homo sapiens
ccttccctctctccctgc

SEQ ID NO: 6094304 - DNA, 13 bp, Homo sapiens
ccttccctctctg

SEQ ID NO: 6094305 - DNA, 18 bp, Homo sapiens
ccttccctctctggagaa

SEQ ID NO: 6094306 - DNA, 15 bp, Homo sapiens
ccttccctcttccct

SEQ ID NO: 6094307 - DNA, 14 bp, Homo sapiens
ccttccctctttcc

SEQ ID NO: 6094308 - DNA, 15 bp, Homo sapiens
ccttccctctttcta

SEQ ID NO: 6094309 - DNA, 13 bp, Homo sapiens
ccttccctgcact

SEQ ID NO: 6094310 - DNA, 21 bp, Homo sapiens
ccttccctgcctccagctgtc

SEQ ID NO: 6094311 - DNA, 13 bp, Homo sapiens
ccttccctgctgt

SEQ ID NO: 6094312 - DNA, 16 bp, Homo sapiens
cctaaccccttccaga

SEQ ID NO: 6094313 - DNA, 15 bp, Homo sapiens
cctaacccctttcct

SEQ ID NO: 6094314 - DNA, 15 bp, Homo sapiens
cctaaccctctgtca

SEQ ID NO: 6094315 - DNA, 20 bp, Homo sapiens
cctaaccctctgtcacccag

SEQ ID NO: 6094316 - DNA, 15 bp, Homo sapiens
cctaaccctgggctc

SEQ ID NO: 6094317 - DNA, 19 bp, Homo sapiens
cctaacctctaaccctcat

SEQ ID NO: 6094318 - DNA, 15 bp, Homo sapiens
cctaacctggcttat

SEQ ID NO: 6094319 - DNA, 17 bp, Homo sapiens
cctaacctgtgtctgcg

SEQ ID NO: 6094320 - DNA, 19 bp, Homo sapiens
cctaacgggggtgcggcag

SEQ ID NO: 6094321 - DNA, 15 bp, Homo sapiens
cctaactccaccgcc

SEQ ID NO: 6094322 - DNA, 19 bp, Homo sapiens
cctaactccctaggcctga

SEQ ID NO: 6094323 - DNA, 18 bp, Homo sapiens
cctaactctgcccaccct

SEQ ID NO: 6094324 - DNA, 14 bp, Homo sapiens
cctaactcttcttt

SEQ ID NO: 6094325 - DNA, 15 bp, Homo sapiens
cctaactcttctttc

SEQ ID NO: 6094326 - DNA, 13 bp, Homo sapiens
cctaactcttgct

SEQ ID NO: 6094327 - DNA, 15 bp, Homo sapiens
cctaactcttgctca

SEQ ID NO: 6094328 - DNA, 16 bp, Homo sapiens
cctaactcttgctcac

SEQ ID NO: 6094329 - DNA, 21 bp, Homo sapiens
cctaactcttgctcactccct

SEQ ID NO: 6094330 - DNA, 22 bp, Homo sapiens
cctaactcttgctcactcccta

SEQ ID NO: 6094331 - DNA, 11 bp, Homo sapiens
cctaactgtat

SEQ ID NO: 6094332 - DNA, 14 bp, Homo sapiens
cctaactgtatctt

SEQ ID NO: 6094333 - DNA, 16 bp, Homo sapiens
cctaactgtatcttga

SEQ ID NO: 6094334 - DNA, 16 bp, Homo sapiens
cctaacttacccagat

SEQ ID NO: 6094335 - DNA, 12 bp, Homo sapiens
cctaacttcctt

SEQ ID NO: 6094336 - DNA, 13 bp, Homo sapiens
cctaacttccttt

SEQ ID NO: 6094337 - DNA, 17 bp, Homo sapiens
cctaacttcgtattttt

SEQ ID NO: 6094338 - DNA, 13 bp, Homo sapiens
cctaacttctgta

SEQ ID NO: 6094339 - DNA, 11 bp, Homo sapiens
cctaagaaaaa

SEQ ID NO: 6094340 - DNA, 16 bp, Homo sapiens
cctaagaaaaaggaaa

SEQ ID NO: 6094341 - DNA, 23 bp, Homo sapiens
cctaagaaagacatcacatccct

SEQ ID NO: 6094342 - DNA, 20 bp, Homo sapiens
cctaagaaatatgtgagatt

SEQ ID NO: 6094343 - DNA, 21 bp, Homo sapiens
cctaagaagaaggccagagag

SEQ ID NO: 6094344 - DNA, 24 bp, Homo sapiens
cctaagaagaaggccagagaggga

SEQ ID NO: 6094345 - DNA, 17 bp, Homo sapiens
cctaagaagtccccagg

SEQ ID NO: 6094346 - DNA, 15 bp, Homo sapiens
cctaagaataaacat

SEQ ID NO: 6094347 - DNA, 17 bp, Homo sapiens
cctaagaatctttagag

SEQ ID NO: 6094348 - DNA, 13 bp, Homo sapiens
cctaagaattccc

SEQ ID NO: 6094349 - DNA, 14 bp, Homo sapiens
cctaagaattccca

SEQ ID NO: 6094350 - DNA, 18 bp, Homo sapiens
cctaagaattcccagata

SEQ ID NO: 6094351 - DNA, 20 bp, Homo sapiens
cctaagaatttcactgtctt

SEQ ID NO: 6094352 - DNA, 12 bp, Homo sapiens
cctaagaatttt

SEQ ID NO: 6094353 - DNA, 16 bp, Homo sapiens
cctaagaccctgaatc

SEQ ID NO: 6094354 - DNA, 20 bp, Homo sapiens
cctaagactaacaaaggcag

SEQ ID NO: 6094355 - DNA, 23 bp, Homo sapiens
cctaagactaacaaaggcagctg

SEQ ID NO: 6094356 - DNA, 15 bp, Homo sapiens
cctaagactgccttc

SEQ ID NO: 6094357 - DNA, 16 bp, Homo sapiens
cctaagactgccttca

SEQ ID NO: 6094358 - DNA, 21 bp, Homo sapiens
cctaagactgccttcagtagg

SEQ ID NO: 6094359 - DNA, 15 bp, Homo sapiens
cctaagactgtgaca

SEQ ID NO: 6094360 - DNA, 12 bp, Homo sapiens
cctaagagattc

SEQ ID NO: 6094361 - DNA, 13 bp, Homo sapiens
cctaagagattta

SEQ ID NO: 6094362 - DNA, 16 bp, Homo sapiens
cctaagagatttatct

SEQ ID NO: 6094363 - DNA, 19 bp, Homo sapiens
cctaagaggcgacttcctc

SEQ ID NO: 6094364 - DNA, 18 bp, Homo sapiens
cctaagagtggaggagga

SEQ ID NO: 6094365 - DNA, 19 bp, Homo sapiens
cctaagagtggaggaggag

SEQ ID NO: 6094366 - DNA, 20 bp, Homo sapiens
cctaagagtgtcactgagct

SEQ ID NO: 6094367 - DNA, 16 bp, Homo sapiens
cctaagagtgtttaat

SEQ ID NO: 6094368 - DNA, 22 bp, Homo sapiens
cctaagcaatcactgggcccag

SEQ ID NO: 6094369 - DNA, 14 bp, Homo sapiens
cctaagcacttcta

SEQ ID NO: 6094370 - DNA, 17 bp, Homo sapiens
cctaagcacttctagaa

SEQ ID NO: 6094371 - DNA, 14 bp, Homo sapiens
cctaagcagaaagt

SEQ ID NO: 6094372 - DNA, 22 bp, Homo sapiens
cctaagcagtgcttgtaaacca

SEQ ID NO: 6094373 - DNA, 21 bp, Homo sapiens
cctaagccaagggcctcttgc

SEQ ID NO: 6094374 - DNA, 21 bp, Homo sapiens
cctaagccactcccgccacac

SEQ ID NO: 6094375 - DNA, 14 bp, Homo sapiens
cctaagccagcctg

SEQ ID NO: 6094376 - DNA, 16 bp, Homo sapiens
cctaagccagcctggt

SEQ ID NO: 6094377 - DNA, 19 bp, Homo sapiens
cctaagccagcctggtcca

SEQ ID NO: 6094378 - DNA, 13 bp, Homo sapiens
cctaagcccccag

SEQ ID NO: 6094379 - DNA, 15 bp, Homo sapiens
cctaagcccccaggg

SEQ ID NO: 6094380 - DNA, 19 bp, Homo sapiens
cctaagcccccagggcctc

SEQ ID NO: 6094381 - DNA, 22 bp, Homo sapiens
cctaagcccccagggcctccag

SEQ ID NO: 6094382 - DNA, 12 bp, Homo sapiens
cctaagccctgc

SEQ ID NO: 6094383 - DNA, 15 bp, Homo sapiens
cctaagcctgtcccc

SEQ ID NO: 6094384 - DNA, 15 bp, Homo sapiens
cctaagcctgtggct

SEQ ID NO: 6094385 - DNA, 16 bp, Homo sapiens
cctaagctccaggtgc

SEQ ID NO: 6094386 - DNA, 18 bp, Homo sapiens
cctaagctggagtgcagt

SEQ ID NO: 6094387 - DNA, 22 bp, Homo sapiens
cctaaggaaaggaattggcatg

SEQ ID NO: 6094388 - DNA, 19 bp, Homo sapiens
cctaaggaagccagtcacc

SEQ ID NO: 6094389 - DNA, 15 bp, Homo sapiens
cctaaggaatatcca

SEQ ID NO: 6094390 - DNA, 15 bp, Homo sapiens
cctaaggacacacta

SEQ ID NO: 6094391 - DNA, 17 bp, Homo sapiens
cctaaggacacactaat

SEQ ID NO: 6094392 - DNA, 21 bp, Homo sapiens
cctaaggacgaaaaacacagt

SEQ ID NO: 6094393 - DNA, 11 bp, Homo sapiens
cctaaggactt

SEQ ID NO: 6094394 - DNA, 17 bp, Homo sapiens
cctaaggacttctttaa

SEQ ID NO: 6094395 - DNA, 15 bp, Homo sapiens
cctaaggcagacagg

SEQ ID NO: 6094396 - DNA, 21 bp, Homo sapiens
cctaaggcatctatctgtgct

SEQ ID NO: 6094397 - DNA, 20 bp, Homo sapiens
cctaaggcatgttgggatag

SEQ ID NO: 6094398 - DNA, 16 bp, Homo sapiens
cctaaggccactgttt

SEQ ID NO: 6094399 - DNA, 21 bp, Homo sapiens
cctaaggccactgttttaaaa

SEQ ID NO: 6094400 - DNA, 16 bp, Homo sapiens
cctaaggccagccatt

SEQ ID NO: 6094401 - DNA, 14 bp, Homo sapiens
cctaaggcccagct

SEQ ID NO: 6094402 - DNA, 12 bp, Homo sapiens
cctaaggcccat

SEQ ID NO: 6094403 - DNA, 14 bp, Homo sapiens
cctaaggctcccca

SEQ ID NO: 6094404 - DNA, 18 bp, Homo sapiens
cctaaggctccccacccc

SEQ ID NO: 6094405 - DNA, 14 bp, Homo sapiens
cctaagggcagccc

SEQ ID NO: 6094406 - DNA, 17 bp, Homo sapiens
cctaagggcagccctcc

SEQ ID NO: 6094407 - DNA, 20 bp, Homo sapiens
cctaagggcagccctccatg

SEQ ID NO: 6094408 - DNA, 14 bp, Homo sapiens
cctaagggctaagg

SEQ ID NO: 6094409 - DNA, 20 bp, Homo sapiens
cctaaggtccaacaagaatg

SEQ ID NO: 6094410 - DNA, 21 bp, Homo sapiens
cctaagtaagtttcttcctgc

SEQ ID NO: 6094411 - DNA, 14 bp, Homo sapiens
cctaagtactgtaa

SEQ ID NO: 6094412 - DNA, 21 bp, Homo sapiens
cctaagtagaccaaatcttgt

SEQ ID NO: 6094413 - DNA, 16 bp, Homo sapiens
cctaagtccctgcccc

SEQ ID NO: 6094414 - DNA, 15 bp, Homo sapiens
cctaagtcccttcct

SEQ ID NO: 6094415 - DNA, 16 bp, Homo sapiens
cctaagtcccttccta

SEQ ID NO: 6094416 - DNA, 23 bp, Homo sapiens
cctaagtcccttcctattctcct

SEQ ID NO: 6094417 - DNA, 15 bp, Homo sapiens
cctaagtctctgtga

SEQ ID NO: 6094418 - DNA, 21 bp, Homo sapiens
cctaagtgacacaaattgaag

SEQ ID NO: 6094419 - DNA, 12 bp, Homo sapiens
cctaagtgccca

SEQ ID NO: 6094420 - DNA, 14 bp, Homo sapiens
cctaagtgcccaaa

SEQ ID NO: 6094421 - DNA, 14 bp, Homo sapiens
cctaagtgcctctt

SEQ ID NO: 6094422 - DNA, 20 bp, Homo sapiens
cctaagtgggaagtgaagcc

SEQ ID NO: 6094423 - DNA, 22 bp, Homo sapiens
cctaagtgggaagtgaagcccc

SEQ ID NO: 6094424 - DNA, 23 bp, Homo sapiens
cctaagtgggaagtgaagcccct

SEQ ID NO: 6094425 - DNA, 17 bp, Homo sapiens
cctaagtgtcaccccgc

SEQ ID NO: 6094426 - DNA, 14 bp, Homo sapiens
cctaataaaaaggt

SEQ ID NO: 6094427 - DNA, 15 bp, Homo sapiens
cctaataaaaaggtg

SEQ ID NO: 6094428 - DNA, 19 bp, Homo sapiens
cctaataaaactgatgtga

SEQ ID NO: 6094429 - DNA, 22 bp, Homo sapiens
cctaataaaactgatgtgaaac

SEQ ID NO: 6094430 - DNA, 13 bp, Homo sapiens
cctaataattgta

SEQ ID NO: 6094431 - DNA, 16 bp, Homo sapiens
cctaatacattaaagc

SEQ ID NO: 6094432 - DNA, 20 bp, Homo sapiens
cctaatacattaaagcagtc

SEQ ID NO: 6094433 - DNA, 15 bp, Homo sapiens
cctaatagaaagaaa

SEQ ID NO: 6094434 - DNA, 17 bp, Homo sapiens
cctaatagcttttcctg

SEQ ID NO: 6094435 - DNA, 17 bp, Homo sapiens
cctaatatcattttatt

SEQ ID NO: 6094436 - DNA, 23 bp, Homo sapiens
cctaatatcattttattcacata

SEQ ID NO: 6094437 - DNA, 20 bp, Homo sapiens
cctaatattcaatgaacttc

SEQ ID NO: 6094438 - DNA, 21 bp, Homo sapiens
cctaatattcatgctgcctgc

SEQ ID NO: 6094439 - DNA, 13 bp, Homo sapiens
cctaatattgaaa

SEQ ID NO: 6094440 - DNA, 19 bp, Homo sapiens
cctaatcaaattctgtctg

SEQ ID NO: 6094441 - DNA, 20 bp, Homo sapiens
cctaatcacctttccaaggc

SEQ ID NO: 6094442 - DNA, 16 bp, Homo sapiens
cctaatcactctgagt

SEQ ID NO: 6094443 - DNA, 15 bp, Homo sapiens
cctaatccacctggt

SEQ ID NO: 6094444 - DNA, 23 bp, Homo sapiens
cctaatccacctggtggccctgc

SEQ ID NO: 6094445 - DNA, 15 bp, Homo sapiens
cctaatccaggcaga

SEQ ID NO: 6094446 - DNA, 20 bp, Homo sapiens
cctaatccaggcagatccag

SEQ ID NO: 6094447 - DNA, 16 bp, Homo sapiens
cctaatccccttctcc

SEQ ID NO: 6094448 - DNA, 21 bp, Homo sapiens
cctaatccctgggcattgctt

SEQ ID NO: 6094449 - DNA, 21 bp, Homo sapiens
cctaatcccttcctctcccat

SEQ ID NO: 6094450 - DNA, 18 bp, Homo sapiens
cctaatctcatacctctg

SEQ ID NO: 6094451 - DNA, 22 bp, Homo sapiens
cctaatgaaagtgatgacatat

SEQ ID NO: 6094452 - DNA, 13 bp, Homo sapiens
cctaatgaaggcc

SEQ ID NO: 6094453 - DNA, 22 bp, Homo sapiens
cctaatgagatatatctttata

SEQ ID NO: 6094454 - DNA, 13 bp, Homo sapiens
cctaatgagggtg

SEQ ID NO: 6094455 - DNA, 15 bp, Homo sapiens
cctaatgagggtgtg

SEQ ID NO: 6094456 - DNA, 19 bp, Homo sapiens
cctaatgatgacttgagcc

SEQ ID NO: 6094457 - DNA, 14 bp, Homo sapiens
cctaatgcagaatt

SEQ ID NO: 6094458 - DNA, 21 bp, Homo sapiens
cctaatgcataagctttttaa

SEQ ID NO: 6094459 - DNA, 18 bp, Homo sapiens
cctaatgccctatgtgta

SEQ ID NO: 6094460 - DNA, 20 bp, Homo sapiens
cctaatgccctatgtgtata

SEQ ID NO: 6094461 - DNA, 16 bp, Homo sapiens
cctaatgctccttgtt

SEQ ID NO: 6094462 - DNA, 12 bp, Homo sapiens
cctaatggcttt

SEQ ID NO: 6094463 - DNA, 15 bp, Homo sapiens
cctaatggtgatgca

SEQ ID NO: 6094464 - DNA, 18 bp, Homo sapiens
cctaatgtctcactgttc

SEQ ID NO: 6094465 - DNA, 13 bp, Homo sapiens
cctaatgtgtttc

SEQ ID NO: 6094466 - DNA, 14 bp, Homo sapiens
cctaatgttttgct

SEQ ID NO: 6094467 - DNA, 16 bp, Homo sapiens
cctaattaccagtctt

SEQ ID NO: 6094468 - DNA, 23 bp, Homo sapiens
cctaattagagcagatgacccct

SEQ ID NO: 6094469 - DNA, 22 bp, Homo sapiens
cctaattattgtaatgtaataa

SEQ ID NO: 6094470 - DNA, 12 bp, Homo sapiens
cctaattcagcc

SEQ ID NO: 6094471 - DNA, 13 bp, Homo sapiens
cctaattccacag

SEQ ID NO: 6094472 - DNA, 15 bp, Homo sapiens
cctaattccacagct

SEQ ID NO: 6094473 - DNA, 17 bp, Homo sapiens
cctaattccacagctgc

SEQ ID NO: 6094474 - DNA, 21 bp, Homo sapiens
cctaattcctggcatgacact

SEQ ID NO: 6094475 - DNA, 16 bp, Homo sapiens
cctaattctatgatta

SEQ ID NO: 6094476 - DNA, 22 bp, Homo sapiens
cctaattcttattttataattt

SEQ ID NO: 6094477 - DNA, 14 bp, Homo sapiens
cctaattgaaattt

SEQ ID NO: 6094478 - DNA, 18 bp, Homo sapiens
cctaattgtcacatcaag

SEQ ID NO: 6094479 - DNA, 15 bp, Homo sapiens
cctaattgtgcccct

SEQ ID NO: 6094480 - DNA, 13 bp, Homo sapiens
cctaattgtggat

SEQ ID NO: 6094481 - DNA, 20 bp, Homo sapiens
cctaatttattggattccct

SEQ ID NO: 6094482 - DNA, 14 bp, Homo sapiens
cctaatttcatttt

SEQ ID NO: 6094483 - DNA, 20 bp, Homo sapiens
cctaatttctcctcccttcc

SEQ ID NO: 6094484 - DNA, 15 bp, Homo sapiens
cctaatttgcccttc

SEQ ID NO: 6094485 - DNA, 17 bp, Homo sapiens
cctaatttgcccttcag

SEQ ID NO: 6094486 - DNA, 23 bp, Homo sapiens
cctaatttgtttcttctgtcttt

SEQ ID NO: 6094487 - DNA, 18 bp, Homo sapiens
cctaattttaaataattt

SEQ ID NO: 6094488 - DNA, 21 bp, Homo sapiens
cctacaaaagcttgtgtatct

SEQ ID NO: 6094489 - DNA, 14 bp, Homo sapiens
cctacaaagaaaaa

SEQ ID NO: 6094490 - DNA, 14 bp, Homo sapiens
cctacaaagctctg

SEQ ID NO: 6094491 - DNA, 15 bp, Homo sapiens
cctacaaagctctga

SEQ ID NO: 6094492 - DNA, 13 bp, Homo sapiens
ccttccctgcttt

SEQ ID NO: 6094493 - DNA, 14 bp, Homo sapiens
ccttccctgctttg

SEQ ID NO: 6094494 - DNA, 13 bp, Homo sapiens
ccttccctggccc

SEQ ID NO: 6094495 - DNA, 14 bp, Homo sapiens
ccttccctggcccc

SEQ ID NO: 6094496 - DNA, 23 bp, Homo sapiens
ccttccctggctacttcccttcc

SEQ ID NO: 6094497 - DNA, 19 bp, Homo sapiens
ccttccctgggctgtgcta

SEQ ID NO: 6094498 - DNA, 13 bp, Homo sapiens
ccttccctgggga

SEQ ID NO: 6094499 - DNA, 14 bp, Homo sapiens
ccttccctggggag

SEQ ID NO: 6094500 - DNA, 18 bp, Homo sapiens
ccttccctggggagccct

SEQ ID NO: 6094501 - DNA, 12 bp, Homo sapiens
ccttccctgggt

SEQ ID NO: 6094502 - DNA, 13 bp, Homo sapiens
ccttccctggtcc

SEQ ID NO: 6094503 - DNA, 20 bp, Homo sapiens
ccttccctgtgcctcctccc

SEQ ID NO: 6094504 - DNA, 17 bp, Homo sapiens
ccttccctgttctccct

SEQ ID NO: 6094505 - DNA, 22 bp, Homo sapiens
ccttccctgttttccccccaag

SEQ ID NO: 6094506 - DNA, 13 bp, Homo sapiens
ccttcccttctct

SEQ ID NO: 6094507 - DNA, 14 bp, Homo sapiens
ccttcccttctctt

SEQ ID NO: 6094508 - DNA, 13 bp, Homo sapiens
ccttcccttgcca

SEQ ID NO: 6094509 - DNA, 14 bp, Homo sapiens
ccttcccttgccac

SEQ ID NO: 6094510 - DNA, 18 bp, Homo sapiens
ccttcccttgccactttg

SEQ ID NO: 6094511 - DNA, 20 bp, Homo sapiens
ccttcccttgccactttgca

SEQ ID NO: 6094512 - DNA, 23 bp, Homo sapiens
ccttccctttctaagcaaccaca

SEQ ID NO: 6094513 - DNA, 22 bp, Homo sapiens
ccttcccttttctgttctagtt

SEQ ID NO: 6094514 - DNA, 16 bp, Homo sapiens
ccttccgaccctctgg

SEQ ID NO: 6094515 - DNA, 18 bp, Homo sapiens
ccttccgatgacagtgct

SEQ ID NO: 6094516 - DNA, 13 bp, Homo sapiens
ccttccgccactg

SEQ ID NO: 6094517 - DNA, 16 bp, Homo sapiens
ccttccgccccttccc

SEQ ID NO: 6094518 - DNA, 15 bp, Homo sapiens
ccttccgctccttta

SEQ ID NO: 6094519 - DNA, 17 bp, Homo sapiens
ccttccgctcctttacc

SEQ ID NO: 6094520 - DNA, 21 bp, Homo sapiens
ccttccgctcctttacctacc

SEQ ID NO: 6094521 - DNA, 17 bp, Homo sapiens
ccttccgctctgaggca

SEQ ID NO: 6094522 - DNA, 22 bp, Homo sapiens
ccttccgctgcgggcccagctg

SEQ ID NO: 6094523 - DNA, 22 bp, Homo sapiens
ccttccgggtctcgcagcctga

SEQ ID NO: 6094524 - DNA, 19 bp, Homo sapiens
ccttccgtaacccaactct

SEQ ID NO: 6094525 - DNA, 16 bp, Homo sapiens
ccttccgtccatcccc

SEQ ID NO: 6094526 - DNA, 19 bp, Homo sapiens
ccttccgtccatccccctt

SEQ ID NO: 6094527 - DNA, 21 bp, Homo sapiens
ccttccgtccatcccccttct

SEQ ID NO: 6094528 - DNA, 16 bp, Homo sapiens
ccttccgttccccgct

SEQ ID NO: 6094529 - DNA, 18 bp, Homo sapiens
ccttcctaaatatccaaa

SEQ ID NO: 6094530 - DNA, 23 bp, Homo sapiens
ccttcctaaattttcctgtcctc

SEQ ID NO: 6094531 - DNA, 17 bp, Homo sapiens
ccttcctaagcctgtgg

SEQ ID NO: 6094532 - DNA, 18 bp, Homo sapiens
ccttcctaattccacagc

SEQ ID NO: 6094533 - DNA, 14 bp, Homo sapiens
ccttcctaccaccc

SEQ ID NO: 6094534 - DNA, 17 bp, Homo sapiens
ccttcctactcctcata

SEQ ID NO: 6094535 - DNA, 21 bp, Homo sapiens
ccttcctagaagcccctgtcg

SEQ ID NO: 6094536 - DNA, 21 bp, Homo sapiens
ccttcctagttcatcccttct

SEQ ID NO: 6094537 - DNA, 21 bp, Homo sapiens
ccttcctataacttgatgcat

SEQ ID NO: 6094538 - DNA, 14 bp, Homo sapiens
ccttcctcactgcc

SEQ ID NO: 6094539 - DNA, 16 bp, Homo sapiens
ccttcctcagcctggg

SEQ ID NO: 6094540 - DNA, 17 bp, Homo sapiens
ccttcctcagcctgggg

SEQ ID NO: 6094541 - DNA, 23 bp, Homo sapiens
ccttcctcagctcagctgggcca

SEQ ID NO: 6094542 - DNA, 18 bp, Homo sapiens
ccttcctcagctgcctcc

SEQ ID NO: 6094543 - DNA, 17 bp, Homo sapiens
ccttcctcatccacccc

SEQ ID NO: 6094544 - DNA, 20 bp, Homo sapiens
ccttcctcatccaccccatc

SEQ ID NO: 6094545 - DNA, 22 bp, Homo sapiens
ccttcctcatctgtgcctgtct

SEQ ID NO: 6094546 - DNA, 19 bp, Homo sapiens
ccttcctccccaacctgca

SEQ ID NO: 6094547 - DNA, 15 bp, Homo sapiens
ccttcctccccacac

SEQ ID NO: 6094548 - DNA, 18 bp, Homo sapiens
ccttcctccccacactcc

SEQ ID NO: 6094549 - DNA, 16 bp, Homo sapiens
ccttcctcccggggcc

SEQ ID NO: 6094550 - DNA, 14 bp, Homo sapiens
ccttcctccctgtc

SEQ ID NO: 6094551 - DNA, 23 bp, Homo sapiens
ccttcctccgctcccctttccca

SEQ ID NO: 6094552 - DNA, 10 bp, Homo sapiens
ccttcctcct

SEQ ID NO: 6094553 - DNA, 21 bp, Homo sapiens
ccttcctcctaccacccagcc

SEQ ID NO: 6094554 - DNA, 13 bp, Homo sapiens
ccttcctcctcca

SEQ ID NO: 6094555 - DNA, 17 bp, Homo sapiens
ccttcctcctccacagt

SEQ ID NO: 6094556 - DNA, 20 bp, Homo sapiens
ccttcctcctccacagtgct

SEQ ID NO: 6094557 - DNA, 13 bp, Homo sapiens
ccttcctcctctc

SEQ ID NO: 6094558 - DNA, 20 bp, Homo sapiens
ccttcctcctctcctggaaa

SEQ ID NO: 6094559 - DNA, 13 bp, Homo sapiens
ccttcctcctgaa

SEQ ID NO: 6094560 - DNA, 12 bp, Homo sapiens
ccttcctcctta

SEQ ID NO: 6094561 - DNA, 18 bp, Homo sapiens
ccttcctcgcacagggca

SEQ ID NO: 6094562 - DNA, 19 bp, Homo sapiens
ccttcctcgcagagaggcc

SEQ ID NO: 6094563 - DNA, 18 bp, Homo sapiens
ccttcctcggtggctctg

SEQ ID NO: 6094564 - DNA, 22 bp, Homo sapiens
ccttcctcggtggctctggggt

SEQ ID NO: 6094565 - DNA, 17 bp, Homo sapiens
ccttcctctcaagctag

SEQ ID NO: 6094566 - DNA, 17 bp, Homo sapiens
ccttcctctcactcctg

SEQ ID NO: 6094567 - DNA, 20 bp, Homo sapiens
ccttcctctcactcctgcct

SEQ ID NO: 6094568 - DNA, 21 bp, Homo sapiens
ccttcctctcactcctgcctc

SEQ ID NO: 6094569 - DNA, 22 bp, Homo sapiens
ccttcctctccaccctcccaga

SEQ ID NO: 6094570 - DNA, 15 bp, Homo sapiens
ccttcctctccactg

SEQ ID NO: 6094571 - DNA, 16 bp, Homo sapiens
ccttcctctccactgc

SEQ ID NO: 6094572 - DNA, 16 bp, Homo sapiens
ccttcctctgagcctt

SEQ ID NO: 6094573 - DNA, 15 bp, Homo sapiens
ccttcctctgaggac

SEQ ID NO: 6094574 - DNA, 12 bp, Homo sapiens
ccttcctctgca

SEQ ID NO: 6094575 - DNA, 22 bp, Homo sapiens
ccttcctctgcctttgttcact

SEQ ID NO: 6094576 - DNA, 13 bp, Homo sapiens
ccttcctctgctc

SEQ ID NO: 6094577 - DNA, 15 bp, Homo sapiens
ccttcctctgtgcca

SEQ ID NO: 6094578 - DNA, 16 bp, Homo sapiens
ccttcctctgtgccac

SEQ ID NO: 6094579 - DNA, 19 bp, Homo sapiens
ccttcctctgtgccacgct

SEQ ID NO: 6094580 - DNA, 20 bp, Homo sapiens
ccttcctcttcggccctcag

SEQ ID NO: 6094581 - DNA, 18 bp, Homo sapiens
ccttcctgaccctccgct

SEQ ID NO: 6094582 - DNA, 13 bp, Homo sapiens
ccttcctgacctc

SEQ ID NO: 6094583 - DNA, 12 bp, Homo sapiens
ccttcctgactg

SEQ ID NO: 6094584 - DNA, 19 bp, Homo sapiens
ccttcctgaggagccggga

SEQ ID NO: 6094585 - DNA, 13 bp, Homo sapiens
ccttcctgcaccc

SEQ ID NO: 6094586 - DNA, 14 bp, Homo sapiens
ccttcctgcacccg

SEQ ID NO: 6094587 - DNA, 12 bp, Homo sapiens
ccttcctgcaga

SEQ ID NO: 6094588 - DNA, 13 bp, Homo sapiens
ccttcctgcagac

SEQ ID NO: 6094589 - DNA, 17 bp, Homo sapiens
ccttcctgcagacctgg

SEQ ID NO: 6094590 - DNA, 20 bp, Homo sapiens
ccttcctgcagacctggctg

SEQ ID NO: 6094591 - DNA, 15 bp, Homo sapiens
ccttcctgcatttct

SEQ ID NO: 6094592 - DNA, 17 bp, Homo sapiens
ccttcctgccaccagtc

SEQ ID NO: 6094593 - DNA, 17 bp, Homo sapiens
ccttcctgccacctgct

SEQ ID NO: 6094594 - DNA, 12 bp, Homo sapiens
ccttcctgccca

SEQ ID NO: 6094595 - DNA, 23 bp, Homo sapiens
ccttcctgccccaactccttcca

SEQ ID NO: 6094596 - DNA, 16 bp, Homo sapiens
ccttcctgccctgtac

SEQ ID NO: 6094597 - DNA, 20 bp, Homo sapiens
ccttcctgccctgtacctct

SEQ ID NO: 6094598 - DNA, 16 bp, Homo sapiens
ccttcctgccctgtgg

SEQ ID NO: 6094599 - DNA, 21 bp, Homo sapiens
ccttcctgccctgtggcccac

SEQ ID NO: 6094600 - DNA, 22 bp, Homo sapiens
ccttcctgcctactgcccctgc

SEQ ID NO: 6094601 - DNA, 11 bp, Homo sapiens
ccttcctgctg

SEQ ID NO: 6094602 - DNA, 15 bp, Homo sapiens
ccttcctggaaacag

SEQ ID NO: 6094603 - DNA, 16 bp, Homo sapiens
ccttcctggacacact

SEQ ID NO: 6094604 - DNA, 18 bp, Homo sapiens
ccttcctggacacactct

SEQ ID NO: 6094605 - DNA, 18 bp, Homo sapiens
ccttcctggacagctgtg

SEQ ID NO: 6094606 - DNA, 20 bp, Homo sapiens
ccttcctggacagctgtgcc

SEQ ID NO: 6094607 - DNA, 21 bp, Homo sapiens
ccttcctggacagctgtgcct

SEQ ID NO: 6094608 - DNA, 21 bp, Homo sapiens
ccttcctggagcccagaggag

SEQ ID NO: 6094609 - DNA, 18 bp, Homo sapiens
ccttcctggaggctgcct

SEQ ID NO: 6094610 - DNA, 11 bp, Homo sapiens
ccttcctggcc

SEQ ID NO: 6094611 - DNA, 17 bp, Homo sapiens
ccttcctggcccaggcc

SEQ ID NO: 6094612 - DNA, 19 bp, Homo sapiens
ccttcctggcccaggcctt

SEQ ID NO: 6094613 - DNA, 22 bp, Homo sapiens
ccttcctggcccaggccttgct

SEQ ID NO: 6094614 - DNA, 12 bp, Homo sapiens
ccttcctggcct

SEQ ID NO: 6094615 - DNA, 13 bp, Homo sapiens
ccttcctggcctc

SEQ ID NO: 6094616 - DNA, 16 bp, Homo sapiens
ccttcctggcctgaga

SEQ ID NO: 6094617 - DNA, 16 bp, Homo sapiens
ccttcctggctaggac

SEQ ID NO: 6094618 - DNA, 12 bp, Homo sapiens
ccttcctgggac

SEQ ID NO: 6094619 - DNA, 23 bp, Homo sapiens
ccttcctgggaccccctcgccag

SEQ ID NO: 6094620 - DNA, 14 bp, Homo sapiens
ccttcctgggagga

SEQ ID NO: 6094621 - DNA, 17 bp, Homo sapiens
ccttcctgggaggacag

SEQ ID NO: 6094622 - DNA, 22 bp, Homo sapiens
ccttcctgggaggacaggcagg

SEQ ID NO: 6094623 - DNA, 18 bp, Homo sapiens
ccttcctgggcagcccag

SEQ ID NO: 6094624 - DNA, 22 bp, Homo sapiens
ccttcctgggcagcccagagag

SEQ ID NO: 6094625 - DNA, 22 bp, Homo sapiens
ccttcctggttttgtacactgc

SEQ ID NO: 6094626 - DNA, 18 bp, Homo sapiens
ccttcctgtccccaaaat

SEQ ID NO: 6094627 - DNA, 18 bp, Homo sapiens
ccttcctgtccccagggg

SEQ ID NO: 6094628 - DNA, 13 bp, Homo sapiens
ccttcctgtccct

SEQ ID NO: 6094629 - DNA, 16 bp, Homo sapiens
ccttcctgtccgccct

SEQ ID NO: 6094630 - DNA, 17 bp, Homo sapiens
ccttcctgtcctgcctc

SEQ ID NO: 6094631 - DNA, 21 bp, Homo sapiens
ccttcctgtcctgcctcctca

SEQ ID NO: 6094632 - DNA, 22 bp, Homo sapiens
ccttcctgtcctgcctcctcat

SEQ ID NO: 6094633 - DNA, 24 bp, Homo sapiens
ccttcctgtcctgcctcctcatca

SEQ ID NO: 6094634 - DNA, 15 bp, Homo sapiens
ccttcctgtcctgct

SEQ ID NO: 6094635 - DNA, 16 bp, Homo sapiens
ccttcctgtcctgctc

SEQ ID NO: 6094636 - DNA, 15 bp, Homo sapiens
ccttcctgtctggcc

SEQ ID NO: 6094637 - DNA, 12 bp, Homo sapiens
ccttcctgtctt

SEQ ID NO: 6094638 - DNA, 17 bp, Homo sapiens
ccttcctgtcttcctgc

SEQ ID NO: 6094639 - DNA, 19 bp, Homo sapiens
ccttcctgtcttcctgcat

SEQ ID NO: 6094640 - DNA, 16 bp, Homo sapiens
ccttcctgtggcctca

SEQ ID NO: 6094641 - DNA, 23 bp, Homo sapiens
ccttcctgtgggtgttctttcct

SEQ ID NO: 6094642 - DNA, 17 bp, Homo sapiens
ccttcctgttccctcct

SEQ ID NO: 6094643 - DNA, 18 bp, Homo sapiens
ccttcctgttccctcctg

SEQ ID NO: 6094644 - DNA, 20 bp, Homo sapiens
ccttcctgttccctcctggt

SEQ ID NO: 6094645 - DNA, 21 bp, Homo sapiens
ccttcctgttccctcctggtc

SEQ ID NO: 6094646 - DNA, 20 bp, Homo sapiens
ccttcctgttctgtgtctgc

SEQ ID NO: 6094647 - DNA, 21 bp, Homo sapiens
ccttcctgttctgtgtctgct

SEQ ID NO: 6094648 - DNA, 22 bp, Homo sapiens
ccttcctgttctgtgtctgctg

SEQ ID NO: 6094649 - DNA, 13 bp, Homo sapiens
ccttcctgtttca

SEQ ID NO: 6094650 - DNA, 19 bp, Homo sapiens
ccttcctgtttttcacatt

SEQ ID NO: 6094651 - DNA, 13 bp, Homo sapiens
ccttccttcccac

SEQ ID NO: 6094652 - DNA, 16 bp, Homo sapiens
ccttccttcccgccag

SEQ ID NO: 6094653 - DNA, 12 bp, Homo sapiens
ccttccttccct

SEQ ID NO: 6094654 - DNA, 11 bp, Homo sapiens
ccttccttctg

SEQ ID NO: 6094655 - DNA, 19 bp, Homo sapiens
ccttccttctgctcccacc

SEQ ID NO: 6094656 - DNA, 16 bp, Homo sapiens
ccttccttgactgtct

SEQ ID NO: 6094657 - DNA, 18 bp, Homo sapiens
ccttccttgcgaccacca

SEQ ID NO: 6094658 - DNA, 20 bp, Homo sapiens
ccttccttgctgtcctaggc

SEQ ID NO: 6094659 - DNA, 13 bp, Homo sapiens
ccttccttgggga

SEQ ID NO: 6094660 - DNA, 16 bp, Homo sapiens
ccttcctttccctggg

SEQ ID NO: 6094661 - DNA, 19 bp, Homo sapiens
ccttcctttcctctgcagc

SEQ ID NO: 6094662 - DNA, 16 bp, Homo sapiens
ccttcctttctcccct

SEQ ID NO: 6094663 - DNA, 15 bp, Homo sapiens
ccttcctttggtgcc

SEQ ID NO: 6094664 - DNA, 21 bp, Homo sapiens
ccttcctttggtgcctcactg

SEQ ID NO: 6094665 - DNA, 14 bp, Homo sapiens
ccttcctttgtctt

SEQ ID NO: 6094666 - DNA, 18 bp, Homo sapiens
ccttcctttgtcttacat

SEQ ID NO: 6094667 - DNA, 13 bp, Homo sapiens
ccttccttttccc

SEQ ID NO: 6094668 - DNA, 17 bp, Homo sapiens
ccttccttttgaggagc

SEQ ID NO: 6094669 - DNA, 20 bp, Homo sapiens
ccttccttttgaggagctgg

SEQ ID NO: 6094670 - DNA, 12 bp, Homo sapiens
ccttcctttttt

SEQ ID NO: 6094671 - DNA, 15 bp, Homo sapiens
ccttcgaaaggcctt

SEQ ID NO: 6094672 - DNA, 15 bp, Homo sapiens
cctacaaatcagtaa

SEQ ID NO: 6094673 - DNA, 19 bp, Homo sapiens
cctacaaccccagcctcct

SEQ ID NO: 6094674 - DNA, 15 bp, Homo sapiens
cctacaagacacagt

SEQ ID NO: 6094675 - DNA, 18 bp, Homo sapiens
cctacaagagcagcctgt

SEQ ID NO: 6094676 - DNA, 13 bp, Homo sapiens
cctacaagatgcc

SEQ ID NO: 6094677 - DNA, 22 bp, Homo sapiens
cctacaagatttagaaaaaagt

SEQ ID NO: 6094678 - DNA, 13 bp, Homo sapiens
cctacaaggccta

SEQ ID NO: 6094679 - DNA, 23 bp, Homo sapiens
cctacaatatcattttcctggga

SEQ ID NO: 6094680 - DNA, 14 bp, Homo sapiens
cctacaatatttta

SEQ ID NO: 6094681 - DNA, 17 bp, Homo sapiens
cctacacacacactccc

SEQ ID NO: 6094682 - DNA, 18 bp, Homo sapiens
cctacacacacagcctat

SEQ ID NO: 6094683 - DNA, 15 bp, Homo sapiens
cctacacaggacagg

SEQ ID NO: 6094684 - DNA, 23 bp, Homo sapiens
cctacacaggacaggggttcctt

SEQ ID NO: 6094685 - DNA, 14 bp, Homo sapiens
cctacacaggagtc

SEQ ID NO: 6094686 - DNA, 14 bp, Homo sapiens
cctacacagggcct

SEQ ID NO: 6094687 - DNA, 15 bp, Homo sapiens
cctacacagggcctg

SEQ ID NO: 6094688 - DNA, 21 bp, Homo sapiens
cctacaccattatcttggaaa

SEQ ID NO: 6094689 - DNA, 19 bp, Homo sapiens
cctacacccagaccccagg

SEQ ID NO: 6094690 - DNA, 14 bp, Homo sapiens
cctacacctccctc

SEQ ID NO: 6094691 - DNA, 15 bp, Homo sapiens
cctacactgatgcaa

SEQ ID NO: 6094692 - DNA, 20 bp, Homo sapiens
cctacagaaaacccagctag

SEQ ID NO: 6094693 - DNA, 20 bp, Homo sapiens
cctacagaaatactgctctg

SEQ ID NO: 6094694 - DNA, 21 bp, Homo sapiens
cctacagaaatactgctctga

SEQ ID NO: 6094695 - DNA, 15 bp, Homo sapiens
cctacagaaattgaa

SEQ ID NO: 6094696 - DNA, 20 bp, Homo sapiens
cctacagaacttcagaaaga

SEQ ID NO: 6094697 - DNA, 21 bp, Homo sapiens
cctacagaatactagccagag

SEQ ID NO: 6094698 - DNA, 14 bp, Homo sapiens
cctacagacatgga

SEQ ID NO: 6094699 - DNA, 17 bp, Homo sapiens
cctacagacctggctct

SEQ ID NO: 6094700 - DNA, 21 bp, Homo sapiens
cctacagactccatctcttct

SEQ ID NO: 6094701 - DNA, 17 bp, Homo sapiens
cctacagaggtctctgc

SEQ ID NO: 6094702 - DNA, 23 bp, Homo sapiens
cctacagaggtctctgccggctc

SEQ ID NO: 6094703 - DNA, 21 bp, Homo sapiens
cctacagataatttattttgt

SEQ ID NO: 6094704 - DNA, 18 bp, Homo sapiens
cctacagcactactgggt

SEQ ID NO: 6094705 - DNA, 18 bp, Homo sapiens
cctacagcatattcttca

SEQ ID NO: 6094706 - DNA, 14 bp, Homo sapiens
cctacagccacatc

SEQ ID NO: 6094707 - DNA, 15 bp, Homo sapiens
cctacagccacatcc

SEQ ID NO: 6094708 - DNA, 14 bp, Homo sapiens
cctacagccccttt

SEQ ID NO: 6094709 - DNA, 19 bp, Homo sapiens
cctacagcctagggcagac

SEQ ID NO: 6094710 - DNA, 13 bp, Homo sapiens
cctacagcctcag

SEQ ID NO: 6094711 - DNA, 16 bp, Homo sapiens
cctacagcctgcacac

SEQ ID NO: 6094712 - DNA, 20 bp, Homo sapiens
cctacagctttgatccctga

SEQ ID NO: 6094713 - DNA, 21 bp, Homo sapiens
cctacagctttgatccctgac

SEQ ID NO: 6094714 - DNA, 21 bp, Homo sapiens
cctacaggctgacgttccggg

SEQ ID NO: 6094715 - DNA, 16 bp, Homo sapiens
cctacagggaactggg

SEQ ID NO: 6094716 - DNA, 20 bp, Homo sapiens
cctacagggaactgggaaga

SEQ ID NO: 6094717 - DNA, 16 bp, Homo sapiens
cctacagggggtctgg

SEQ ID NO: 6094718 - DNA, 13 bp, Homo sapiens
cctacagtatata

SEQ ID NO: 6094719 - DNA, 17 bp, Homo sapiens
cctacagtatataagct

SEQ ID NO: 6094720 - DNA, 18 bp, Homo sapiens
cctacagtatataagctt

SEQ ID NO: 6094721 - DNA, 11 bp, Homo sapiens
cctacagtgaa

SEQ ID NO: 6094722 - DNA, 10 bp, Homo sapiens
cctacagtgt

SEQ ID NO: 6094723 - DNA, 21 bp, Homo sapiens
cctacagttgaaaaacagctg

SEQ ID NO: 6094724 - DNA, 22 bp, Homo sapiens
cctacagttttaactgtggata

SEQ ID NO: 6094725 - DNA, 23 bp, Homo sapiens
cctacatatttgtatgtttttct

SEQ ID NO: 6094726 - DNA, 19 bp, Homo sapiens
cctacatccccaggtctct

SEQ ID NO: 6094727 - DNA, 20 bp, Homo sapiens
cctacatccccaggtctctc

SEQ ID NO: 6094728 - DNA, 22 bp, Homo sapiens
cctacatcctaaggttcttgct

SEQ ID NO: 6094729 - DNA, 22 bp, Homo sapiens
cctacatcggaatccaagctaa

SEQ ID NO: 6094730 - DNA, 12 bp, Homo sapiens
cctacatctgaa

SEQ ID NO: 6094731 - DNA, 23 bp, Homo sapiens
cctacatctgaaatctacaacat

SEQ ID NO: 6094732 - DNA, 20 bp, Homo sapiens
cctacatcttcagctcccat

SEQ ID NO: 6094733 - DNA, 19 bp, Homo sapiens
cctacatcttcttcccagt

SEQ ID NO: 6094734 - DNA, 17 bp, Homo sapiens
cctacatgccccctccc

SEQ ID NO: 6094735 - DNA, 17 bp, Homo sapiens
cctacatgctttgtgaa

SEQ ID NO: 6094736 - DNA, 15 bp, Homo sapiens
cctacattccaccct

SEQ ID NO: 6094737 - DNA, 18 bp, Homo sapiens
cctacattccctggcctg

SEQ ID NO: 6094738 - DNA, 17 bp, Homo sapiens
cctacattctttattct

SEQ ID NO: 6094739 - DNA, 16 bp, Homo sapiens
cctaccaaaaattgcc

SEQ ID NO: 6094740 - DNA, 11 bp, Homo sapiens
cctaccaaagt

SEQ ID NO: 6094741 - DNA, 14 bp, Homo sapiens
cctaccaacctctg

SEQ ID NO: 6094742 - DNA, 15 bp, Homo sapiens
cctaccaatgcatgc

SEQ ID NO: 6094743 - DNA, 17 bp, Homo sapiens
cctaccacagctgcctc

SEQ ID NO: 6094744 - DNA, 18 bp, Homo sapiens
cctaccacagctgcctcc

SEQ ID NO: 6094745 - DNA, 13 bp, Homo sapiens
cctaccacagtgt

SEQ ID NO: 6094746 - DNA, 14 bp, Homo sapiens
cctaccacagtgtc

SEQ ID NO: 6094747 - DNA, 15 bp, Homo sapiens
cctaccacccagccc

SEQ ID NO: 6094748 - DNA, 15 bp, Homo sapiens
cctaccaccttccct

SEQ ID NO: 6094749 - DNA, 14 bp, Homo sapiens
cctaccactctaat

SEQ ID NO: 6094750 - DNA, 14 bp, Homo sapiens
cctaccactgagcc

SEQ ID NO: 6094751 - DNA, 18 bp, Homo sapiens
cctaccactgagcccttg

SEQ ID NO: 6094752 - DNA, 23 bp, Homo sapiens
cctaccactgagcccttgcacag

SEQ ID NO: 6094753 - DNA, 13 bp, Homo sapiens
cctaccactgtct

SEQ ID NO: 6094754 - DNA, 22 bp, Homo sapiens
cctaccactgtggccccaagag

SEQ ID NO: 6094755 - DNA, 23 bp, Homo sapiens
cctaccactgtggccccaagagg

SEQ ID NO: 6094756 - DNA, 16 bp, Homo sapiens
cctaccagcgcccgct

SEQ ID NO: 6094757 - DNA, 17 bp, Homo sapiens
cctaccagcgcccgctg

SEQ ID NO: 6094758 - DNA, 19 bp, Homo sapiens
cctaccagcgcccgctggg

SEQ ID NO: 6094759 - DNA, 22 bp, Homo sapiens
cctaccagcgcccgctgggctg

SEQ ID NO: 6094760 - DNA, 13 bp, Homo sapiens
cctaccaggactc

SEQ ID NO: 6094761 - DNA, 19 bp, Homo sapiens
cctaccagtcgccctctgt

SEQ ID NO: 6094762 - DNA, 22 bp, Homo sapiens
cctaccagtcgccctctgtgcc

SEQ ID NO: 6094763 - DNA, 16 bp, Homo sapiens
cctaccatcagctctg

SEQ ID NO: 6094764 - DNA, 22 bp, Homo sapiens
cctaccatcagggacaggatga

SEQ ID NO: 6094765 - DNA, 21 bp, Homo sapiens
cctacccaatgtctcccacac

SEQ ID NO: 6094766 - DNA, 17 bp, Homo sapiens
cctacccacacctctgc

SEQ ID NO: 6094767 - DNA, 13 bp, Homo sapiens
cctacccactctt

SEQ ID NO: 6094768 - DNA, 20 bp, Homo sapiens
cctacccagcgtggcccagg

SEQ ID NO: 6094769 - DNA, 21 bp, Homo sapiens
cctacccagcgtggcccaggc

SEQ ID NO: 6094770 - DNA, 21 bp, Homo sapiens
cctacccagtccccattttct

SEQ ID NO: 6094771 - DNA, 13 bp, Homo sapiens
cctacccatatcc

SEQ ID NO: 6094772 - DNA, 14 bp, Homo sapiens
cctacccatccccg

SEQ ID NO: 6094773 - DNA, 11 bp, Homo sapiens
cctaccccaca

SEQ ID NO: 6094774 - DNA, 13 bp, Homo sapiens
cctaccccacacc

SEQ ID NO: 6094775 - DNA, 18 bp, Homo sapiens
cctaccccacaccaggcc

SEQ ID NO: 6094776 - DNA, 11 bp, Homo sapiens
cctaccccacc

SEQ ID NO: 6094777 - DNA, 15 bp, Homo sapiens
cctaccccagttcct

SEQ ID NO: 6094778 - DNA, 13 bp, Homo sapiens
cctaccccctcat

SEQ ID NO: 6094779 - DNA, 16 bp, Homo sapiens
cctacccctcccagct

SEQ ID NO: 6094780 - DNA, 21 bp, Homo sapiens
cctacccctcccagctgacag

SEQ ID NO: 6094781 - DNA, 17 bp, Homo sapiens
cctacccctcctgcgct

SEQ ID NO: 6094782 - DNA, 16 bp, Homo sapiens
cctacccctcttccag

SEQ ID NO: 6094783 - DNA, 16 bp, Homo sapiens
cctacccctgccctgc

SEQ ID NO: 6094784 - DNA, 15 bp, Homo sapiens
cctacccctggctgt

SEQ ID NO: 6094785 - DNA, 14 bp, Homo sapiens
cctaccccttcctg

SEQ ID NO: 6094786 - DNA, 15 bp, Homo sapiens
cctaccccttcctgt

SEQ ID NO: 6094787 - DNA, 18 bp, Homo sapiens
cctaccccttcctgtcct

SEQ ID NO: 6094788 - DNA, 20 bp, Homo sapiens
cctaccccttcctgtcctgc

SEQ ID NO: 6094789 - DNA, 16 bp, Homo sapiens
cctacccctttctcca

SEQ ID NO: 6094790 - DNA, 19 bp, Homo sapiens
cctacccctttctccagcc

SEQ ID NO: 6094791 - DNA, 13 bp, Homo sapiens
cctacccgcccgc

SEQ ID NO: 6094792 - DNA, 16 bp, Homo sapiens
cctaccctcaaagtag

SEQ ID NO: 6094793 - DNA, 11 bp, Homo sapiens
cctaccctcct

SEQ ID NO: 6094794 - DNA, 14 bp, Homo sapiens
cctaccctcctgct

SEQ ID NO: 6094795 - DNA, 15 bp, Homo sapiens
cctaccctcctgctg

SEQ ID NO: 6094796 - DNA, 17 bp, Homo sapiens
cctaccctcctgctgag

SEQ ID NO: 6094797 - DNA, 22 bp, Homo sapiens
cctaccctcctgctgagctgcc

SEQ ID NO: 6094798 - DNA, 19 bp, Homo sapiens
cctaccctcgggcccacct

SEQ ID NO: 6094799 - DNA, 15 bp, Homo sapiens
cctaccctcttctca

SEQ ID NO: 6094800 - DNA, 16 bp, Homo sapiens
cctaccctcttctcag

SEQ ID NO: 6094801 - DNA, 23 bp, Homo sapiens
cctaccctgcctcccttgacttt

SEQ ID NO: 6094802 - DNA, 13 bp, Homo sapiens
cctaccctggacc

SEQ ID NO: 6094803 - DNA, 18 bp, Homo sapiens
cctaccctggaccgagtg

SEQ ID NO: 6094804 - DNA, 14 bp, Homo sapiens
cctaccctggactt

SEQ ID NO: 6094805 - DNA, 16 bp, Homo sapiens
cctacccttcctgcca

SEQ ID NO: 6094806 - DNA, 22 bp, Homo sapiens
cctacccttgtaccccatccct

SEQ ID NO: 6094807 - DNA, 20 bp, Homo sapiens
cctaccgaaaccttgccttt

SEQ ID NO: 6094808 - DNA, 16 bp, Homo sapiens
cctaccgagtctcttc

SEQ ID NO: 6094809 - DNA, 13 bp, Homo sapiens
cctaccgcatggc

SEQ ID NO: 6094810 - DNA, 16 bp, Homo sapiens
cctaccgcatggcagc

SEQ ID NO: 6094811 - DNA, 20 bp, Homo sapiens
cctaccgcatggcagctggg

SEQ ID NO: 6094812 - DNA, 22 bp, Homo sapiens
cctaccgctggccctgccgttt

SEQ ID NO: 6094813 - DNA, 17 bp, Homo sapiens
cctaccgtactccctgc

SEQ ID NO: 6094814 - DNA, 19 bp, Homo sapiens
cctacctaacccagaaaat

SEQ ID NO: 6094815 - DNA, 22 bp, Homo sapiens
cctacctcaacctgtaaattat

SEQ ID NO: 6094816 - DNA, 19 bp, Homo sapiens
cctacctcaagttcttgga

SEQ ID NO: 6094817 - DNA, 22 bp, Homo sapiens
cctacctcaagttcttggacca

SEQ ID NO: 6094818 - DNA, 23 bp, Homo sapiens
cctacctcaggttgctggttgct

SEQ ID NO: 6094819 - DNA, 15 bp, Homo sapiens
cctacctccactctc

SEQ ID NO: 6094820 - DNA, 17 bp, Homo sapiens
cctacctccctccctct

SEQ ID NO: 6094821 - DNA, 14 bp, Homo sapiens
cctacctctccaca

SEQ ID NO: 6094822 - DNA, 13 bp, Homo sapiens
cctacctctgtct

SEQ ID NO: 6094823 - DNA, 14 bp, Homo sapiens
cctacctctgtctg

SEQ ID NO: 6094824 - DNA, 14 bp, Homo sapiens
cctacctctgtgcc

SEQ ID NO: 6094825 - DNA, 15 bp, Homo sapiens
cctacctctgtgcca

SEQ ID NO: 6094826 - DNA, 18 bp, Homo sapiens
cctacctgaaggcagggc

SEQ ID NO: 6094827 - DNA, 20 bp, Homo sapiens
cctacctgaaggcagggctc

SEQ ID NO: 6094828 - DNA, 13 bp, Homo sapiens
cctacctgcccca

SEQ ID NO: 6094829 - DNA, 12 bp, Homo sapiens
cctacctgcctg

SEQ ID NO: 6094830 - DNA, 14 bp, Homo sapiens
cctacctgctcccc

SEQ ID NO: 6094831 - DNA, 12 bp, Homo sapiens
cctacctgctct

SEQ ID NO: 6094832 - DNA, 16 bp, Homo sapiens
cctacctgctctccaa

SEQ ID NO: 6094833 - DNA, 12 bp, Homo sapiens
cctacctgctgc

SEQ ID NO: 6094834 - DNA, 12 bp, Homo sapiens
cctacctgcttc

SEQ ID NO: 6094835 - DNA, 15 bp, Homo sapiens
cctacctggccgcaa

SEQ ID NO: 6094836 - DNA, 12 bp, Homo sapiens
cctacctgggga

SEQ ID NO: 6094837 - DNA, 22 bp, Homo sapiens
cctacctggggaaagcctgaag

SEQ ID NO: 6094838 - DNA, 21 bp, Homo sapiens
cctacctgggggcagaactcc

SEQ ID NO: 6094839 - DNA, 23 bp, Homo sapiens
cctacctggtcaacccgctgctt

SEQ ID NO: 6094840 - DNA, 16 bp, Homo sapiens
cctacctgtctgctgc

SEQ ID NO: 6094841 - DNA, 22 bp, Homo sapiens
cctacctgttcagtgtcccggg

SEQ ID NO: 6094842 - DNA, 23 bp, Homo sapiens
cctacctgttcagtgtcccgggc

SEQ ID NO: 6094843 - DNA, 19 bp, Homo sapiens
cctaccttcatttcaggag

SEQ ID NO: 6094844 - DNA, 17 bp, Homo sapiens
cctaccttcttcaggct

SEQ ID NO: 6094845 - DNA, 16 bp, Homo sapiens
cctaccttttgtctct

SEQ ID NO: 6094846 - DNA, 19 bp, Homo sapiens
cctacgaaatatgaagagc

SEQ ID NO: 6094847 - DNA, 15 bp, Homo sapiens
cctacgaggagtgtt

SEQ ID NO: 6094848 - DNA, 22 bp, Homo sapiens
cctacgcagatgctgtcactgg

SEQ ID NO: 6094849 - DNA, 18 bp, Homo sapiens
cctacgctcatctctgga

SEQ ID NO: 6094850 - DNA, 21 bp, Homo sapiens
cctacgctcatctctggaagg

SEQ ID NO: 6094851 - DNA, 13 bp, Homo sapiens
cctacgctgaaga

SEQ ID NO: 6094852 - DNA, 16 bp, Homo sapiens
ccttcgacagcatttt

SEQ ID NO: 6094853 - DNA, 17 bp, Homo sapiens
ccttcgaggttgcccct

SEQ ID NO: 6094854 - DNA, 20 bp, Homo sapiens
ccttcgaggttgccccttcc

SEQ ID NO: 6094855 - DNA, 15 bp, Homo sapiens
ccttcgatacaccgg

SEQ ID NO: 6094856 - DNA, 22 bp, Homo sapiens
ccttcgatacaccgggcctgga

SEQ ID NO: 6094857 - DNA, 23 bp, Homo sapiens
ccttcgatacaccgggcctggag

SEQ ID NO: 6094858 - DNA, 13 bp, Homo sapiens
ccttcgcctttgc

SEQ ID NO: 6094859 - DNA, 20 bp, Homo sapiens
ccttcgcggtggaaggcccg

SEQ ID NO: 6094860 - DNA, 16 bp, Homo sapiens
ccttcgctccatgttt

SEQ ID NO: 6094861 - DNA, 18 bp, Homo sapiens
ccttcgctcctgtgtctt

SEQ ID NO: 6094862 - DNA, 16 bp, Homo sapiens
ccttcgcttcttgcct

SEQ ID NO: 6094863 - DNA, 17 bp, Homo sapiens
ccttcgcttcttgcctc

SEQ ID NO: 6094864 - DNA, 19 bp, Homo sapiens
ccttcgcttcttgcctctg

SEQ ID NO: 6094865 - DNA, 20 bp, Homo sapiens
ccttcggacaactcagtccc

SEQ ID NO: 6094866 - DNA, 23 bp, Homo sapiens
ccttcggagcgttctctgtccta

SEQ ID NO: 6094867 - DNA, 14 bp, Homo sapiens
ccttcggcagtggc

SEQ ID NO: 6094868 - DNA, 18 bp, Homo sapiens
ccttcggcctctcttgga

SEQ ID NO: 6094869 - DNA, 13 bp, Homo sapiens
ccttcggctccgg

SEQ ID NO: 6094870 - DNA, 19 bp, Homo sapiens
ccttcgggagcagggctgt

SEQ ID NO: 6094871 - DNA, 18 bp, Homo sapiens
ccttcggggcctgtctga

SEQ ID NO: 6094872 - DNA, 21 bp, Homo sapiens
ccttcggggcgatgctccctc

SEQ ID NO: 6094873 - DNA, 17 bp, Homo sapiens
ccttcggtacccaccac

SEQ ID NO: 6094874 - DNA, 20 bp, Homo sapiens
ccttcggtggaagagctcaa

SEQ ID NO: 6094875 - DNA, 19 bp, Homo sapiens
ccttcgtccccagttgccg

SEQ ID NO: 6094876 - DNA, 16 bp, Homo sapiens
ccttcgtctttcccat

SEQ ID NO: 6094877 - DNA, 17 bp, Homo sapiens
ccttcgtctttcccatg

SEQ ID NO: 6094878 - DNA, 17 bp, Homo sapiens
ccttcgtgaacatcccc

SEQ ID NO: 6094879 - DNA, 22 bp, Homo sapiens
ccttcgtgaacatcccctccca

SEQ ID NO: 6094880 - DNA, 13 bp, Homo sapiens
ccttcgtgccccc

SEQ ID NO: 6094881 - DNA, 14 bp, Homo sapiens
ccttcgtgcctgag

SEQ ID NO: 6094882 - DNA, 20 bp, Homo sapiens
ccttcgtgcctgagaccagg

SEQ ID NO: 6094883 - DNA, 21 bp, Homo sapiens
ccttcgtggttatagccctgc

SEQ ID NO: 6094884 - DNA, 14 bp, Homo sapiens
ccttcgtgtgctgc

SEQ ID NO: 6094885 - DNA, 16 bp, Homo sapiens
ccttcgtgtggctcct

SEQ ID NO: 6094886 - DNA, 20 bp, Homo sapiens
ccttcgtttactatgcctgt

SEQ ID NO: 6094887 - DNA, 14 bp, Homo sapiens
ccttcgtttatatt

SEQ ID NO: 6094888 - DNA, 21 bp, Homo sapiens
ccttctaaattcccaaatcct

SEQ ID NO: 6094889 - DNA, 15 bp, Homo sapiens
ccttctacaaggact

SEQ ID NO: 6094890 - DNA, 18 bp, Homo sapiens
ccttctacaaggactcca

SEQ ID NO: 6094891 - DNA, 19 bp, Homo sapiens
ccttctaccctgggtcctc

SEQ ID NO: 6094892 - DNA, 23 bp, Homo sapiens
ccttctaccctgggtcctcgggc

SEQ ID NO: 6094893 - DNA, 14 bp, Homo sapiens
ccttctacctgcag

SEQ ID NO: 6094894 - DNA, 19 bp, Homo sapiens
ccttctacctgcaggactc

SEQ ID NO: 6094895 - DNA, 13 bp, Homo sapiens
ccttctacctgcc

SEQ ID NO: 6094896 - DNA, 20 bp, Homo sapiens
ccttctacctgccactcaca

SEQ ID NO: 6094897 - DNA, 15 bp, Homo sapiens
ccttctactcccctt

SEQ ID NO: 6094898 - DNA, 14 bp, Homo sapiens
ccttctagaacctg

SEQ ID NO: 6094899 - DNA, 19 bp, Homo sapiens
ccttctagaacctgggctg

SEQ ID NO: 6094900 - DNA, 14 bp, Homo sapiens
ccttctaggaagct

SEQ ID NO: 6094901 - DNA, 19 bp, Homo sapiens
ccttctaggtgtggtccca

SEQ ID NO: 6094902 - DNA, 19 bp, Homo sapiens
ccttctagtgagcctgggc

SEQ ID NO: 6094903 - DNA, 21 bp, Homo sapiens
ccttctagtgagcctgggcca

SEQ ID NO: 6094904 - DNA, 22 bp, Homo sapiens
ccttctagtgagcctgggccag

SEQ ID NO: 6094905 - DNA, 23 bp, Homo sapiens
ccttctagtgagcctgggccagg

SEQ ID NO: 6094906 - DNA, 17 bp, Homo sapiens
ccttctagttgccccca

SEQ ID NO: 6094907 - DNA, 16 bp, Homo sapiens
ccttctagtttcccac

SEQ ID NO: 6094908 - DNA, 17 bp, Homo sapiens
ccttctagtttcccaca

SEQ ID NO: 6094909 - DNA, 23 bp, Homo sapiens
ccttctatacatgtttgcagtgt

SEQ ID NO: 6094910 - DNA, 21 bp, Homo sapiens
ccttctatagcatcacttaaa

SEQ ID NO: 6094911 - DNA, 18 bp, Homo sapiens
ccttctatgttcataaaa

SEQ ID NO: 6094912 - DNA, 15 bp, Homo sapiens
ccttctattggtctc

SEQ ID NO: 6094913 - DNA, 22 bp, Homo sapiens
ccttctatttggggcttgatga

SEQ ID NO: 6094914 - DNA, 13 bp, Homo sapiens
ccttctattttcc

SEQ ID NO: 6094915 - DNA, 22 bp, Homo sapiens
ccttctcacacacaactgtcca

SEQ ID NO: 6094916 - DNA, 14 bp, Homo sapiens
ccttctcacagcac

SEQ ID NO: 6094917 - DNA, 14 bp, Homo sapiens
ccttctcaccagct

SEQ ID NO: 6094918 - DNA, 15 bp, Homo sapiens
ccttctcaccagctg

SEQ ID NO: 6094919 - DNA, 17 bp, Homo sapiens
ccttctcaccagctgca

SEQ ID NO: 6094920 - DNA, 14 bp, Homo sapiens
ccttctcaccccag

SEQ ID NO: 6094921 - DNA, 14 bp, Homo sapiens
ccttctcagaatct

SEQ ID NO: 6094922 - DNA, 15 bp, Homo sapiens
ccttctcaggctggc

SEQ ID NO: 6094923 - DNA, 13 bp, Homo sapiens
ccttctcatcact

SEQ ID NO: 6094924 - DNA, 17 bp, Homo sapiens
ccttctcatcactcccc

SEQ ID NO: 6094925 - DNA, 13 bp, Homo sapiens
ccttctcattacc

SEQ ID NO: 6094926 - DNA, 17 bp, Homo sapiens
ccttctcattacccacc

SEQ ID NO: 6094927 - DNA, 18 bp, Homo sapiens
ccttctcattacccaccc

SEQ ID NO: 6094928 - DNA, 17 bp, Homo sapiens
ccttctcattgctgccc

SEQ ID NO: 6094929 - DNA, 14 bp, Homo sapiens
ccttctccaaaggc

SEQ ID NO: 6094930 - DNA, 19 bp, Homo sapiens
ccttctccaaaggctctgt

SEQ ID NO: 6094931 - DNA, 12 bp, Homo sapiens
ccttctccacag

SEQ ID NO: 6094932 - DNA, 14 bp, Homo sapiens
ccttctccatctct

SEQ ID NO: 6094933 - DNA, 15 bp, Homo sapiens
ccttctccatctttg

SEQ ID NO: 6094934 - DNA, 14 bp, Homo sapiens
ccttctccatggag

SEQ ID NO: 6094935 - DNA, 22 bp, Homo sapiens
ccttctccatggccctgccatg

SEQ ID NO: 6094936 - DNA, 17 bp, Homo sapiens
ccttctcccactctcct

SEQ ID NO: 6094937 - DNA, 12 bp, Homo sapiens
ccttctccccaa

SEQ ID NO: 6094938 - DNA, 15 bp, Homo sapiens
ccttctccccagcca

SEQ ID NO: 6094939 - DNA, 16 bp, Homo sapiens
ccttctccccagccag

SEQ ID NO: 6094940 - DNA, 22 bp, Homo sapiens
ccttctcccccccggggctggg

SEQ ID NO: 6094941 - DNA, 23 bp, Homo sapiens
ccttctcccccccggggctgggt

SEQ ID NO: 6094942 - DNA, 16 bp, Homo sapiens
ccttctcccccttgtc

SEQ ID NO: 6094943 - DNA, 12 bp, Homo sapiens
ccttctcccctc

SEQ ID NO: 6094944 - DNA, 18 bp, Homo sapiens
ccttctcccctccagacc

SEQ ID NO: 6094945 - DNA, 21 bp, Homo sapiens
ccttctcccctccagacccct

SEQ ID NO: 6094946 - DNA, 18 bp, Homo sapiens
ccttctcccctctcccag

SEQ ID NO: 6094947 - DNA, 19 bp, Homo sapiens
ccttctcccctcttctgag

SEQ ID NO: 6094948 - DNA, 22 bp, Homo sapiens
ccttctcccctgcactgtaaaa

SEQ ID NO: 6094949 - DNA, 16 bp, Homo sapiens
ccttctccccttcctg

SEQ ID NO: 6094950 - DNA, 16 bp, Homo sapiens
ccttctcccggccctc

SEQ ID NO: 6094951 - DNA, 16 bp, Homo sapiens
ccttctccctcatttc

SEQ ID NO: 6094952 - DNA, 12 bp, Homo sapiens
ccttctccctgg

SEQ ID NO: 6094953 - DNA, 15 bp, Homo sapiens
ccttctccctgggaa

SEQ ID NO: 6094954 - DNA, 16 bp, Homo sapiens
ccttctcccttcttgg

SEQ ID NO: 6094955 - DNA, 16 bp, Homo sapiens
ccttctcctagctctg

SEQ ID NO: 6094956 - DNA, 16 bp, Homo sapiens
ccttctcctcttgtaa

SEQ ID NO: 6094957 - DNA, 15 bp, Homo sapiens
ccttctccttcacct

SEQ ID NO: 6094958 - DNA, 18 bp, Homo sapiens
ccttctccttccccagga

SEQ ID NO: 6094959 - DNA, 19 bp, Homo sapiens
ccttctccttccccaggat

SEQ ID NO: 6094960 - DNA, 17 bp, Homo sapiens
ccttctcctttccttcc

SEQ ID NO: 6094961 - DNA, 18 bp, Homo sapiens
ccttctcctttccttccc

SEQ ID NO: 6094962 - DNA, 15 bp, Homo sapiens
ccttctcgcattttc

SEQ ID NO: 6094963 - DNA, 18 bp, Homo sapiens
ccttctcgtcttcctctc

SEQ ID NO: 6094964 - DNA, 19 bp, Homo sapiens
ccttctcgtgtttgcttaa

SEQ ID NO: 6094965 - DNA, 20 bp, Homo sapiens
ccttctctacactcttgtaa

SEQ ID NO: 6094966 - DNA, 19 bp, Homo sapiens
ccttctctactcatgccag

SEQ ID NO: 6094967 - DNA, 15 bp, Homo sapiens
ccttctctcaatccc

SEQ ID NO: 6094968 - DNA, 16 bp, Homo sapiens
ccttctctcacctcct

SEQ ID NO: 6094969 - DNA, 17 bp, Homo sapiens
ccttctctcacctccta

SEQ ID NO: 6094970 - DNA, 16 bp, Homo sapiens
ccttctctcactgtgt

SEQ ID NO: 6094971 - DNA, 13 bp, Homo sapiens
ccttctctcagct

SEQ ID NO: 6094972 - DNA, 16 bp, Homo sapiens
ccttctctcagctccc

SEQ ID NO: 6094973 - DNA, 14 bp, Homo sapiens
ccttctctcatctc

SEQ ID NO: 6094974 - DNA, 15 bp, Homo sapiens
ccttctctcatctct

SEQ ID NO: 6094975 - DNA, 21 bp, Homo sapiens
ccttctctcatctcttagctc

SEQ ID NO: 6094976 - DNA, 12 bp, Homo sapiens
ccttctctccag

SEQ ID NO: 6094977 - DNA, 17 bp, Homo sapiens
ccttctctccagcccct

SEQ ID NO: 6094978 - DNA, 23 bp, Homo sapiens
ccttctctccagcccctggatgc

SEQ ID NO: 6094979 - DNA, 15 bp, Homo sapiens
ccttctctctttcta

SEQ ID NO: 6094980 - DNA, 21 bp, Homo sapiens
ccttctctcttttcttctcag

SEQ ID NO: 6094981 - DNA, 15 bp, Homo sapiens
ccttctctgaacaca

SEQ ID NO: 6094982 - DNA, 13 bp, Homo sapiens
ccttctctgccca

SEQ ID NO: 6094983 - DNA, 16 bp, Homo sapiens
ccttctctggtctcct

SEQ ID NO: 6094984 - DNA, 15 bp, Homo sapiens
ccttctctgtagctg

SEQ ID NO: 6094985 - DNA, 17 bp, Homo sapiens
ccttctctgtctcatgt

SEQ ID NO: 6094986 - DNA, 17 bp, Homo sapiens
ccttctctgttcatttc

SEQ ID NO: 6094987 - DNA, 19 bp, Homo sapiens
ccttctcttccaggcagcc

SEQ ID NO: 6094988 - DNA, 12 bp, Homo sapiens
ccttctcttctc

SEQ ID NO: 6094989 - DNA, 17 bp, Homo sapiens
ccttctcttctcttctt

SEQ ID NO: 6094990 - DNA, 18 bp, Homo sapiens
ccttctcttctcttcttt

SEQ ID NO: 6094991 - DNA, 20 bp, Homo sapiens
ccttctcttgaggcctgtgc

SEQ ID NO: 6094992 - DNA, 14 bp, Homo sapiens
ccttctctttaaat

SEQ ID NO: 6094993 - DNA, 17 bp, Homo sapiens
ccttctctttcaatgtg

SEQ ID NO: 6094994 - DNA, 14 bp, Homo sapiens
ccttctctttgggg

SEQ ID NO: 6094995 - DNA, 23 bp, Homo sapiens
ccttctgaacatgagtgtcaact

SEQ ID NO: 6094996 - DNA, 13 bp, Homo sapiens
ccttctgaactcc

SEQ ID NO: 6094997 - DNA, 20 bp, Homo sapiens
ccttctgaagtctgagccca

SEQ ID NO: 6094998 - DNA, 23 bp, Homo sapiens
ccttctgaagtgtgtccatcctg

SEQ ID NO: 6094999 - DNA, 13 bp, Homo sapiens
ccttctgaatgaa

SEQ ID NO: 6095000 - DNA, 17 bp, Homo sapiens
ccttctgacccatgctg

SEQ ID NO: 6095001 - DNA, 21 bp, Homo sapiens
ccttctgacccatgctgccct

SEQ ID NO: 6095002 - DNA, 22 bp, Homo sapiens
ccttctgacccatgctgccctg

SEQ ID NO: 6095003 - DNA, 23 bp, Homo sapiens
ccttctgacccatgctgccctgt

SEQ ID NO: 6095004 - DNA, 14 bp, Homo sapiens
ccttctgacctggg

SEQ ID NO: 6095005 - DNA, 18 bp, Homo sapiens
ccttctgacgcagcctga

SEQ ID NO: 6095006 - DNA, 20 bp, Homo sapiens
ccttctgacgcagcctgaga

SEQ ID NO: 6095007 - DNA, 22 bp, Homo sapiens
ccttctgactgtttatttaagg

SEQ ID NO: 6095008 - DNA, 23 bp, Homo sapiens
ccttctgactgtttatttaagga

SEQ ID NO: 6095009 - DNA, 20 bp, Homo sapiens
ccttctgagccttctactta

SEQ ID NO: 6095010 - DNA, 14 bp, Homo sapiens
ccttctgagctcca

SEQ ID NO: 6095011 - DNA, 15 bp, Homo sapiens
ccttctgagctcctg

SEQ ID NO: 6095012 - DNA, 21 bp, Homo sapiens
ccttctgaggacattccaaga

SEQ ID NO: 6095013 - DNA, 14 bp, Homo sapiens
ccttctgaggatgc

SEQ ID NO: 6095014 - DNA, 15 bp, Homo sapiens
ccttctgatccacag

SEQ ID NO: 6095015 - DNA, 12 bp, Homo sapiens
ccttctgcaccc

SEQ ID NO: 6095016 - DNA, 14 bp, Homo sapiens
ccttctgcacccag

SEQ ID NO: 6095017 - DNA, 19 bp, Homo sapiens
ccttctgcagtcagactga

SEQ ID NO: 6095018 - DNA, 20 bp, Homo sapiens
ccttctgccaacgcctcctg

SEQ ID NO: 6095019 - DNA, 11 bp, Homo sapiens
ccttctgccct

SEQ ID NO: 6095020 - DNA, 18 bp, Homo sapiens
ccttctgccctcctgcca

SEQ ID NO: 6095021 - DNA, 12 bp, Homo sapiens
ccttctgctgaa

SEQ ID NO: 6095022 - DNA, 22 bp, Homo sapiens
ccttctgcttctccctggctga

SEQ ID NO: 6095023 - DNA, 14 bp, Homo sapiens
ccttctgcttgtcc

SEQ ID NO: 6095024 - DNA, 12 bp, Homo sapiens
ccttctgctttc

SEQ ID NO: 6095025 - DNA, 14 bp, Homo sapiens
ccttctgctttcta

SEQ ID NO: 6095026 - DNA, 16 bp, Homo sapiens
ccttctggatccatgg

SEQ ID NO: 6095027 - DNA, 18 bp, Homo sapiens
ccttctggattcttggcc

SEQ ID NO: 6095028 - DNA, 19 bp, Homo sapiens
ccttctggattcttggccc

SEQ ID NO: 6095029 - DNA, 17 bp, Homo sapiens
ccttctggccggtgctg

SEQ ID NO: 6095030 - DNA, 20 bp, Homo sapiens
ccttctggcctcccacagac

SEQ ID NO: 6095031 - DNA, 12 bp, Homo sapiens
ccttctggctcc

SEQ ID NO: 6095032 - DNA, 13 bp, Homo sapiens
cctacggaccagg

SEQ ID NO: 6095033 - DNA, 17 bp, Homo sapiens
cctacggagtcagccag

SEQ ID NO: 6095034 - DNA, 19 bp, Homo sapiens
cctacgggcgctgcagcct

SEQ ID NO: 6095035 - DNA, 20 bp, Homo sapiens
cctacgggcgctgcagcctc

SEQ ID NO: 6095036 - DNA, 21 bp, Homo sapiens
cctacgtcaaacatgaagtgt

SEQ ID NO: 6095037 - DNA, 13 bp, Homo sapiens
cctacgtccaagg

SEQ ID NO: 6095038 - DNA, 16 bp, Homo sapiens
cctacgtccaaggtgg

SEQ ID NO: 6095039 - DNA, 22 bp, Homo sapiens
cctacgttctctttaaaagctg

SEQ ID NO: 6095040 - DNA, 16 bp, Homo sapiens
cctactaataaaccag

SEQ ID NO: 6095041 - DNA, 21 bp, Homo sapiens
cctactacactttgctagtga

SEQ ID NO: 6095042 - DNA, 21 bp, Homo sapiens
cctactacccattgttccctt

SEQ ID NO: 6095043 - DNA, 24 bp, Homo sapiens
cctactacccattgttcccttcct

SEQ ID NO: 6095044 - DNA, 16 bp, Homo sapiens
cctactactcaattgt

SEQ ID NO: 6095045 - DNA, 17 bp, Homo sapiens
cctactagggacctggg

SEQ ID NO: 6095046 - DNA, 20 bp, Homo sapiens
cctactagggacctggggaa

SEQ ID NO: 6095047 - DNA, 21 bp, Homo sapiens
cctactagttttccttgaaaa

SEQ ID NO: 6095048 - DNA, 23 bp, Homo sapiens
cctactagttttccttgaaaaaa

SEQ ID NO: 6095049 - DNA, 23 bp, Homo sapiens
cctactcaagcgggtggctctgg

SEQ ID NO: 6095050 - DNA, 23 bp, Homo sapiens
cctactcacacaggcatttcctg

SEQ ID NO: 6095051 - DNA, 18 bp, Homo sapiens
cctactcacacttcagct

SEQ ID NO: 6095052 - DNA, 16 bp, Homo sapiens
cctactccaaaatgtt

SEQ ID NO: 6095053 - DNA, 18 bp, Homo sapiens
cctactccactgccctgg

SEQ ID NO: 6095054 - DNA, 17 bp, Homo sapiens
cctactcccctgatccc

SEQ ID NO: 6095055 - DNA, 14 bp, Homo sapiens
cctactcccctggg

SEQ ID NO: 6095056 - DNA, 15 bp, Homo sapiens
cctactcccctgggc

SEQ ID NO: 6095057 - DNA, 12 bp, Homo sapiens
cctactccctct

SEQ ID NO: 6095058 - DNA, 20 bp, Homo sapiens
cctactccctgcagatgcca

SEQ ID NO: 6095059 - DNA, 20 bp, Homo sapiens
cctactcctccccctcctcc

SEQ ID NO: 6095060 - DNA, 23 bp, Homo sapiens
cctactcctccccctcctccatg

SEQ ID NO: 6095061 - DNA, 11 bp, Homo sapiens
cctactcctga

SEQ ID NO: 6095062 - DNA, 13 bp, Homo sapiens
cctactcctgact

SEQ ID NO: 6095063 - DNA, 20 bp, Homo sapiens
cctactcctgactcctacct

SEQ ID NO: 6095064 - DNA, 19 bp, Homo sapiens
cctactcctgtcttctgct

SEQ ID NO: 6095065 - DNA, 17 bp, Homo sapiens
cctactctcttatgcat

SEQ ID NO: 6095066 - DNA, 20 bp, Homo sapiens
cctactcttctctctgctct

SEQ ID NO: 6095067 - DNA, 21 bp, Homo sapiens
cctactcttctctctgctctg

SEQ ID NO: 6095068 - DNA, 18 bp, Homo sapiens
cctactgagtagctttca

SEQ ID NO: 6095069 - DNA, 15 bp, Homo sapiens
cctactgcccctgcc

SEQ ID NO: 6095070 - DNA, 18 bp, Homo sapiens
cctactgcccctgccctg

SEQ ID NO: 6095071 - DNA, 12 bp, Homo sapiens
cctactgctgtg

SEQ ID NO: 6095072 - DNA, 15 bp, Homo sapiens
cctactggagtcccg

SEQ ID NO: 6095073 - DNA, 23 bp, Homo sapiens
cctactggatgcttacagtgact

SEQ ID NO: 6095074 - DNA, 22 bp, Homo sapiens
cctactgggagactgggacacc

SEQ ID NO: 6095075 - DNA, 15 bp, Homo sapiens
cctactggggaaact

SEQ ID NO: 6095076 - DNA, 12 bp, Homo sapiens
cctactgtccct

SEQ ID NO: 6095077 - DNA, 14 bp, Homo sapiens
cctactgtcctgga

SEQ ID NO: 6095078 - DNA, 19 bp, Homo sapiens
cctactgtctaagcagttt

SEQ ID NO: 6095079 - DNA, 16 bp, Homo sapiens
cctactgtctccttcc

SEQ ID NO: 6095080 - DNA, 17 bp, Homo sapiens
cctactgtctccttccc

SEQ ID NO: 6095081 - DNA, 22 bp, Homo sapiens
cctactgtggggagagatggca

SEQ ID NO: 6095082 - DNA, 15 bp, Homo sapiens
cctactgttactcta

SEQ ID NO: 6095083 - DNA, 15 bp, Homo sapiens
cctactgttctaaag

SEQ ID NO: 6095084 - DNA, 16 bp, Homo sapiens
cctactgttctaaagc

SEQ ID NO: 6095085 - DNA, 19 bp, Homo sapiens
cctactgttctaaagctct

SEQ ID NO: 6095086 - DNA, 16 bp, Homo sapiens
cctacttaaacaaaaa

SEQ ID NO: 6095087 - DNA, 22 bp, Homo sapiens
cctacttacccaggtgggtccc

SEQ ID NO: 6095088 - DNA, 18 bp, Homo sapiens
cctacttagatatttcat

SEQ ID NO: 6095089 - DNA, 19 bp, Homo sapiens
cctacttagatatttcatg

SEQ ID NO: 6095090 - DNA, 17 bp, Homo sapiens
cctacttagggaagaaa

SEQ ID NO: 6095091 - DNA, 18 bp, Homo sapiens
cctacttcattttcagag

SEQ ID NO: 6095092 - DNA, 21 bp, Homo sapiens
cctacttcattttcagagtga

SEQ ID NO: 6095093 - DNA, 18 bp, Homo sapiens
cctacttccaagaaaaat

SEQ ID NO: 6095094 - DNA, 21 bp, Homo sapiens
cctacttccccttcctaattc

SEQ ID NO: 6095095 - DNA, 16 bp, Homo sapiens
cctacttcctcctcct

SEQ ID NO: 6095096 - DNA, 17 bp, Homo sapiens
cctacttcctcctcctc

SEQ ID NO: 6095097 - DNA, 13 bp, Homo sapiens
cctacttcctgtg

SEQ ID NO: 6095098 - DNA, 20 bp, Homo sapiens
cctacttctgactttacttg

SEQ ID NO: 6095099 - DNA, 21 bp, Homo sapiens
cctacttgataatattagtga

SEQ ID NO: 6095100 - DNA, 20 bp, Homo sapiens
cctacttgtaaacttgaaag

SEQ ID NO: 6095101 - DNA, 18 bp, Homo sapiens
cctacttgtgactgaagg

SEQ ID NO: 6095102 - DNA, 13 bp, Homo sapiens
cctactttctatt

SEQ ID NO: 6095103 - DNA, 17 bp, Homo sapiens
cctactttctattttta

SEQ ID NO: 6095104 - DNA, 14 bp, Homo sapiens
cctactttctctct

SEQ ID NO: 6095105 - DNA, 17 bp, Homo sapiens
cctactttgcttccgcc

SEQ ID NO: 6095106 - DNA, 19 bp, Homo sapiens
cctactttgcttccgccac

SEQ ID NO: 6095107 - DNA, 17 bp, Homo sapiens
cctacttttaaagaatt

SEQ ID NO: 6095108 - DNA, 21 bp, Homo sapiens
cctagaaaattgtttttaatt

SEQ ID NO: 6095109 - DNA, 16 bp, Homo sapiens
cctagaaacaacactg

SEQ ID NO: 6095110 - DNA, 18 bp, Homo sapiens
cctagaaacaacactgta

SEQ ID NO: 6095111 - DNA, 23 bp, Homo sapiens
cctagaaacccaagctcctcctc

SEQ ID NO: 6095112 - DNA, 23 bp, Homo sapiens
cctagaaagggcaaggggtgagg

SEQ ID NO: 6095113 - DNA, 15 bp, Homo sapiens
cctagaaatacatgg

SEQ ID NO: 6095114 - DNA, 20 bp, Homo sapiens
cctagaacaagccagagccg

SEQ ID NO: 6095115 - DNA, 22 bp, Homo sapiens
cctagaacaagccagagccgca

SEQ ID NO: 6095116 - DNA, 21 bp, Homo sapiens
cctagaacactaactcaccag

SEQ ID NO: 6095117 - DNA, 20 bp, Homo sapiens
cctagaacatccctgggcaa

SEQ ID NO: 6095118 - DNA, 19 bp, Homo sapiens
cctagaaccaagcttcaga

SEQ ID NO: 6095119 - DNA, 20 bp, Homo sapiens
cctagaaccaagcttcagag

SEQ ID NO: 6095120 - DNA, 15 bp, Homo sapiens
cctagaactgtgcct

SEQ ID NO: 6095121 - DNA, 14 bp, Homo sapiens
cctagaacttcaaa

SEQ ID NO: 6095122 - DNA, 13 bp, Homo sapiens
cctagaagaaaac

SEQ ID NO: 6095123 - DNA, 12 bp, Homo sapiens
cctagaagaagc

SEQ ID NO: 6095124 - DNA, 22 bp, Homo sapiens
cctagaagagcacagagccctg

SEQ ID NO: 6095125 - DNA, 22 bp, Homo sapiens
cctagaaggtggggacctgggg

SEQ ID NO: 6095126 - DNA, 23 bp, Homo sapiens
cctagaagtaagaagaggagcct

SEQ ID NO: 6095127 - DNA, 22 bp, Homo sapiens
cctagaagtctccctgcacagc

SEQ ID NO: 6095128 - DNA, 13 bp, Homo sapiens
cctagaagtcttc

SEQ ID NO: 6095129 - DNA, 20 bp, Homo sapiens
cctagaatggaagcctccac

SEQ ID NO: 6095130 - DNA, 17 bp, Homo sapiens
cctagacaacctttctg

SEQ ID NO: 6095131 - DNA, 21 bp, Homo sapiens
cctagacatggacgcaccggc

SEQ ID NO: 6095132 - DNA, 16 bp, Homo sapiens
cctagacatggcctct

SEQ ID NO: 6095133 - DNA, 16 bp, Homo sapiens
cctagaccctccccaa

SEQ ID NO: 6095134 - DNA, 16 bp, Homo sapiens
cctagacctccccctc

SEQ ID NO: 6095135 - DNA, 20 bp, Homo sapiens
cctagaccttgcctcccctc

SEQ ID NO: 6095136 - DNA, 21 bp, Homo sapiens
cctagactaattaaaatctgg

SEQ ID NO: 6095137 - DNA, 23 bp, Homo sapiens
cctagactcggggtgcttccttg

SEQ ID NO: 6095138 - DNA, 17 bp, Homo sapiens
cctagactctccctgta

SEQ ID NO: 6095139 - DNA, 21 bp, Homo sapiens
cctagactctgtaacatcact

SEQ ID NO: 6095140 - DNA, 22 bp, Homo sapiens
cctagactctgtaaccacctct

SEQ ID NO: 6095141 - DNA, 16 bp, Homo sapiens
cctagactgctcctgg

SEQ ID NO: 6095142 - DNA, 12 bp, Homo sapiens
cctagactgtgt

SEQ ID NO: 6095143 - DNA, 14 bp, Homo sapiens
cctagactgttact

SEQ ID NO: 6095144 - DNA, 20 bp, Homo sapiens
cctagacttcccaacagcct

SEQ ID NO: 6095145 - DNA, 20 bp, Homo sapiens
cctagagaacgcagccctag

SEQ ID NO: 6095146 - DNA, 24 bp, Homo sapiens
cctagagaagacaggctggaagat

SEQ ID NO: 6095147 - DNA, 23 bp, Homo sapiens
cctagagaagctaaaacctgagc

SEQ ID NO: 6095148 - DNA, 16 bp, Homo sapiens
cctagagacagaagca

SEQ ID NO: 6095149 - DNA, 19 bp, Homo sapiens
cctagagacagtgatgcct

SEQ ID NO: 6095150 - DNA, 14 bp, Homo sapiens
cctagagagaataa

SEQ ID NO: 6095151 - DNA, 15 bp, Homo sapiens
cctagagagaataaa

SEQ ID NO: 6095152 - DNA, 17 bp, Homo sapiens
cctagagagaataaatt

SEQ ID NO: 6095153 - DNA, 16 bp, Homo sapiens
cctagagccagaccaa

SEQ ID NO: 6095154 - DNA, 17 bp, Homo sapiens
cctagagccctctcctc

SEQ ID NO: 6095155 - DNA, 14 bp, Homo sapiens
cctagagctcctgt

SEQ ID NO: 6095156 - DNA, 16 bp, Homo sapiens
cctagagctcctgtcc

SEQ ID NO: 6095157 - DNA, 19 bp, Homo sapiens
cctagagctcctgtcccta

SEQ ID NO: 6095158 - DNA, 21 bp, Homo sapiens
cctagagctcctgtccctacc

SEQ ID NO: 6095159 - DNA, 21 bp, Homo sapiens
cctagaggacactaggagact

SEQ ID NO: 6095160 - DNA, 23 bp, Homo sapiens
cctagaggacactaggagactgg

SEQ ID NO: 6095161 - DNA, 13 bp, Homo sapiens
cctagaggaggaa

SEQ ID NO: 6095162 - DNA, 20 bp, Homo sapiens
cctagaggattgtccacctt

SEQ ID NO: 6095163 - DNA, 22 bp, Homo sapiens
cctagaggattgtccaccttct

SEQ ID NO: 6095164 - DNA, 21 bp, Homo sapiens
cctagaggcaaacatttctta

SEQ ID NO: 6095165 - DNA, 13 bp, Homo sapiens
cctagaggcccca

SEQ ID NO: 6095166 - DNA, 20 bp, Homo sapiens
cctagaggcgagccaggcaa

SEQ ID NO: 6095167 - DNA, 23 bp, Homo sapiens
cctagaggggacaagccaggccc

SEQ ID NO: 6095168 - DNA, 23 bp, Homo sapiens
cctagaggtactttccacttgat

SEQ ID NO: 6095169 - DNA, 17 bp, Homo sapiens
cctagataaaaagatgg

SEQ ID NO: 6095170 - DNA, 20 bp, Homo sapiens
cctagatccacacacagagg

SEQ ID NO: 6095171 - DNA, 13 bp, Homo sapiens
cctagatccagaa

SEQ ID NO: 6095172 - DNA, 18 bp, Homo sapiens
cctagatctgcaggctgc

SEQ ID NO: 6095173 - DNA, 22 bp, Homo sapiens
cctagatctgcaggctgcacct

SEQ ID NO: 6095174 - DNA, 17 bp, Homo sapiens
cctagatgaagaaagag

SEQ ID NO: 6095175 - DNA, 23 bp, Homo sapiens
cctagatgcacgtggggcccact

SEQ ID NO: 6095176 - DNA, 18 bp, Homo sapiens
cctagatggttccctttg

SEQ ID NO: 6095177 - DNA, 20 bp, Homo sapiens
cctagatgtataactaggag

SEQ ID NO: 6095178 - DNA, 21 bp, Homo sapiens
cctagatgtataactaggagc

SEQ ID NO: 6095179 - DNA, 18 bp, Homo sapiens
cctagatgtgttctaagc

SEQ ID NO: 6095180 - DNA, 12 bp, Homo sapiens
cctagattacat

SEQ ID NO: 6095181 - DNA, 20 bp, Homo sapiens
cctagattacatctgcctta

SEQ ID NO: 6095182 - DNA, 20 bp, Homo sapiens
cctagattaggtagactttg

SEQ ID NO: 6095183 - DNA, 14 bp, Homo sapiens
cctagattattgaa

SEQ ID NO: 6095184 - DNA, 16 bp, Homo sapiens
cctagatttaatataa

SEQ ID NO: 6095185 - DNA, 20 bp, Homo sapiens
cctagcaaccaactttacct

SEQ ID NO: 6095186 - DNA, 15 bp, Homo sapiens
cctagcaagctggcc

SEQ ID NO: 6095187 - DNA, 16 bp, Homo sapiens
cctagcaagctggcct

SEQ ID NO: 6095188 - DNA, 22 bp, Homo sapiens
cctagcaagtaagaatggccaa

SEQ ID NO: 6095189 - DNA, 20 bp, Homo sapiens
cctagcactgccccacatgc

SEQ ID NO: 6095190 - DNA, 22 bp, Homo sapiens
cctagcactgccccacatgcat

SEQ ID NO: 6095191 - DNA, 18 bp, Homo sapiens
cctagcagatatgtatta

SEQ ID NO: 6095192 - DNA, 12 bp, Homo sapiens
cctagcagcacc

SEQ ID NO: 6095193 - DNA, 20 bp, Homo sapiens
cctagcagcaccgttctgtg

SEQ ID NO: 6095194 - DNA, 23 bp, Homo sapiens
cctagcagcaccgttctgtgcac

SEQ ID NO: 6095195 - DNA, 20 bp, Homo sapiens
cctagcagcccaccctgctg

SEQ ID NO: 6095196 - DNA, 23 bp, Homo sapiens
cctagcagcccaccctgctgctg

SEQ ID NO: 6095197 - DNA, 13 bp, Homo sapiens
cctagcagcctca

SEQ ID NO: 6095198 - DNA, 17 bp, Homo sapiens
cctagcaggatctgccc

SEQ ID NO: 6095199 - DNA, 17 bp, Homo sapiens
cctagcaggcacaggac

SEQ ID NO: 6095200 - DNA, 16 bp, Homo sapiens
cctagcaggctgttcc

SEQ ID NO: 6095201 - DNA, 13 bp, Homo sapiens
cctagcagtgaac

SEQ ID NO: 6095202 - DNA, 16 bp, Homo sapiens
cctagcagtgaactat

SEQ ID NO: 6095203 - DNA, 21 bp, Homo sapiens
cctagcatacgtacacatttt

SEQ ID NO: 6095204 - DNA, 16 bp, Homo sapiens
cctagcatggggtcag

SEQ ID NO: 6095205 - DNA, 22 bp, Homo sapiens
cctagcattgcacttggcctca

SEQ ID NO: 6095206 - DNA, 14 bp, Homo sapiens
cctagccaccagtg

SEQ ID NO: 6095207 - DNA, 13 bp, Homo sapiens
ccttctggctcca

SEQ ID NO: 6095208 - DNA, 11 bp, Homo sapiens
ccttctggctg

SEQ ID NO: 6095209 - DNA, 18 bp, Homo sapiens
ccttctggctgctgcagt

SEQ ID NO: 6095210 - DNA, 14 bp, Homo sapiens
ccttctgggaaaca

SEQ ID NO: 6095211 - DNA, 12 bp, Homo sapiens
ccttctgggcat

SEQ ID NO: 6095212 - DNA, 22 bp, Homo sapiens
ccttctgtagcctgaagagttt

SEQ ID NO: 6095213 - DNA, 16 bp, Homo sapiens
ccttctgtagttttat

SEQ ID NO: 6095214 - DNA, 12 bp, Homo sapiens
ccttctgtccaa

SEQ ID NO: 6095215 - DNA, 20 bp, Homo sapiens
ccttctgtccaccagaccca

SEQ ID NO: 6095216 - DNA, 16 bp, Homo sapiens
ccttctgtccccagcc

SEQ ID NO: 6095217 - DNA, 19 bp, Homo sapiens
ccttctgtccccagccctg

SEQ ID NO: 6095218 - DNA, 20 bp, Homo sapiens
ccttctgtcctactctgtgt

SEQ ID NO: 6095219 - DNA, 21 bp, Homo sapiens
ccttctgtcctactctgtgtc

SEQ ID NO: 6095220 - DNA, 21 bp, Homo sapiens
ccttctgtcctggtgtcactt

SEQ ID NO: 6095221 - DNA, 22 bp, Homo sapiens
ccttctgtcctggtgtcactta

SEQ ID NO: 6095222 - DNA, 18 bp, Homo sapiens
ccttctgtcgtccccaga

SEQ ID NO: 6095223 - DNA, 19 bp, Homo sapiens
ccttctgtcgtccccagac

SEQ ID NO: 6095224 - DNA, 12 bp, Homo sapiens
ccttctgtgaag

SEQ ID NO: 6095225 - DNA, 16 bp, Homo sapiens
ccttctgtgaagaagc

SEQ ID NO: 6095226 - DNA, 17 bp, Homo sapiens
ccttctgtgaagaagcc

SEQ ID NO: 6095227 - DNA, 21 bp, Homo sapiens
ccttctgtgcatctggcctgg

SEQ ID NO: 6095228 - DNA, 20 bp, Homo sapiens
ccttctgtgcccagctcagt

SEQ ID NO: 6095229 - DNA, 21 bp, Homo sapiens
ccttctgtgcccagctcagtc

SEQ ID NO: 6095230 - DNA, 23 bp, Homo sapiens
ccttctgtgctcatgtttggaaa

SEQ ID NO: 6095231 - DNA, 14 bp, Homo sapiens
ccttctgtggctca

SEQ ID NO: 6095232 - DNA, 21 bp, Homo sapiens
ccttctgtggggctgggcacc

SEQ ID NO: 6095233 - DNA, 12 bp, Homo sapiens
ccttctgtgtca

SEQ ID NO: 6095234 - DNA, 18 bp, Homo sapiens
ccttctgtgtttctggag

SEQ ID NO: 6095235 - DNA, 21 bp, Homo sapiens
ccttctgttaagaaaggatat

SEQ ID NO: 6095236 - DNA, 13 bp, Homo sapiens
ccttctgttgctg

SEQ ID NO: 6095237 - DNA, 20 bp, Homo sapiens
ccttctgttttgagttttgt

SEQ ID NO: 6095238 - DNA, 17 bp, Homo sapiens
ccttcttaactctgcag

SEQ ID NO: 6095239 - DNA, 22 bp, Homo sapiens
ccttcttaagatacaaatggtg

SEQ ID NO: 6095240 - DNA, 20 bp, Homo sapiens
ccttcttatatctgaagatt

SEQ ID NO: 6095241 - DNA, 18 bp, Homo sapiens
ccttcttattctcactcc

SEQ ID NO: 6095242 - DNA, 19 bp, Homo sapiens
ccttcttcacccagctaat

SEQ ID NO: 6095243 - DNA, 15 bp, Homo sapiens
ccttcttcatgttca

SEQ ID NO: 6095244 - DNA, 13 bp, Homo sapiens
ccttcttccaagg

SEQ ID NO: 6095245 - DNA, 15 bp, Homo sapiens
ccttcttccacagca

SEQ ID NO: 6095246 - DNA, 18 bp, Homo sapiens
ccttcttccatcccagga

SEQ ID NO: 6095247 - DNA, 23 bp, Homo sapiens
ccttcttcccaatagcaaggctg

SEQ ID NO: 6095248 - DNA, 22 bp, Homo sapiens
ccttcttccccaaggcactgag

SEQ ID NO: 6095249 - DNA, 17 bp, Homo sapiens
ccttcttcccccagggt

SEQ ID NO: 6095250 - DNA, 15 bp, Homo sapiens
ccttcttcccgcccc

SEQ ID NO: 6095251 - DNA, 18 bp, Homo sapiens
ccttcttccctgttttaa

SEQ ID NO: 6095252 - DNA, 11 bp, Homo sapiens
ccttcttcctc

SEQ ID NO: 6095253 - DNA, 22 bp, Homo sapiens
ccttcttcctcaagtcttgaca

SEQ ID NO: 6095254 - DNA, 14 bp, Homo sapiens
ccttcttcctcccc

SEQ ID NO: 6095255 - DNA, 13 bp, Homo sapiens
ccttcttcgctgc

SEQ ID NO: 6095256 - DNA, 22 bp, Homo sapiens
ccttcttcggggaactcctgga

SEQ ID NO: 6095257 - DNA, 21 bp, Homo sapiens
ccttcttctttttgctgttgt

SEQ ID NO: 6095258 - DNA, 13 bp, Homo sapiens
ccttcttgccctg

SEQ ID NO: 6095259 - DNA, 15 bp, Homo sapiens
ccttcttgccctgag

SEQ ID NO: 6095260 - DNA, 16 bp, Homo sapiens
ccttcttgcctgctgg

SEQ ID NO: 6095261 - DNA, 14 bp, Homo sapiens
ccttcttgctcagt

SEQ ID NO: 6095262 - DNA, 18 bp, Homo sapiens
ccttcttgctcagtccct

SEQ ID NO: 6095263 - DNA, 12 bp, Homo sapiens
ccttcttgctgc

SEQ ID NO: 6095264 - DNA, 16 bp, Homo sapiens
ccttcttgctgcccac

SEQ ID NO: 6095265 - DNA, 20 bp, Homo sapiens
ccttcttggcttcctggcgc

SEQ ID NO: 6095266 - DNA, 18 bp, Homo sapiens
ccttcttgggactgctgt

SEQ ID NO: 6095267 - DNA, 13 bp, Homo sapiens
ccttcttgggccc

SEQ ID NO: 6095268 - DNA, 18 bp, Homo sapiens
ccttcttgggccccagac

SEQ ID NO: 6095269 - DNA, 19 bp, Homo sapiens
ccttcttgggccccagacc

SEQ ID NO: 6095270 - DNA, 23 bp, Homo sapiens
ccttcttgggtagggcagacatg

SEQ ID NO: 6095271 - DNA, 18 bp, Homo sapiens
ccttcttgggtctgccct

SEQ ID NO: 6095272 - DNA, 18 bp, Homo sapiens
ccttcttggtttcagcca

SEQ ID NO: 6095273 - DNA, 12 bp, Homo sapiens
ccttcttgtagt

SEQ ID NO: 6095274 - DNA, 16 bp, Homo sapiens
ccttcttgtctctctg

SEQ ID NO: 6095275 - DNA, 16 bp, Homo sapiens
ccttcttgtgtcctgg

SEQ ID NO: 6095276 - DNA, 23 bp, Homo sapiens
ccttctttaaatcaaaagctgct

SEQ ID NO: 6095277 - DNA, 18 bp, Homo sapiens
ccttctttattgcccctt

SEQ ID NO: 6095278 - DNA, 13 bp, Homo sapiens
ccttctttcctct

SEQ ID NO: 6095279 - DNA, 17 bp, Homo sapiens
ccttctttcctcttccc

SEQ ID NO: 6095280 - DNA, 14 bp, Homo sapiens
ccttctttccttcc

SEQ ID NO: 6095281 - DNA, 18 bp, Homo sapiens
ccttctttccttcctttt

SEQ ID NO: 6095282 - DNA, 10 bp, Homo sapiens
ccttctttct

SEQ ID NO: 6095283 - DNA, 13 bp, Homo sapiens
ccttctttgaaga

SEQ ID NO: 6095284 - DNA, 18 bp, Homo sapiens
ccttctttgataatgtta

SEQ ID NO: 6095285 - DNA, 20 bp, Homo sapiens
ccttctttgataatgttaaa

SEQ ID NO: 6095286 - DNA, 13 bp, Homo sapiens
ccttctttgtata

SEQ ID NO: 6095287 - DNA, 14 bp, Homo sapiens
ccttcttttatgag

SEQ ID NO: 6095288 - DNA, 24 bp, Homo sapiens
ccttcttttatgagcagaaggaaa

SEQ ID NO: 6095289 - DNA, 13 bp, Homo sapiens
ccttcttttcctg

SEQ ID NO: 6095290 - DNA, 12 bp, Homo sapiens
ccttcttttgta

SEQ ID NO: 6095291 - DNA, 17 bp, Homo sapiens
ccttgaaaaaaaacagt

SEQ ID NO: 6095292 - DNA, 14 bp, Homo sapiens
ccttgaaaaacaaa

SEQ ID NO: 6095293 - DNA, 14 bp, Homo sapiens
ccttgaaaaatgac

SEQ ID NO: 6095294 - DNA, 21 bp, Homo sapiens
ccttgaaaacaagcctccact

SEQ ID NO: 6095295 - DNA, 15 bp, Homo sapiens
ccttgaaaacactgt

SEQ ID NO: 6095296 - DNA, 19 bp, Homo sapiens
ccttgaaaacactgttctc

SEQ ID NO: 6095297 - DNA, 21 bp, Homo sapiens
ccttgaaaacactgttctctg

SEQ ID NO: 6095298 - DNA, 15 bp, Homo sapiens
ccttgaaaataaaaa

SEQ ID NO: 6095299 - DNA, 16 bp, Homo sapiens
ccttgaaacagttcca

SEQ ID NO: 6095300 - DNA, 18 bp, Homo sapiens
ccttgaaaccagctcagg

SEQ ID NO: 6095301 - DNA, 21 bp, Homo sapiens
ccttgaaatacctgtttcttt

SEQ ID NO: 6095302 - DNA, 20 bp, Homo sapiens
ccttgaaatttacacagtga

SEQ ID NO: 6095303 - DNA, 17 bp, Homo sapiens
ccttgaaatttctcagc

SEQ ID NO: 6095304 - DNA, 23 bp, Homo sapiens
ccttgaacaacccaatctggctg

SEQ ID NO: 6095305 - DNA, 19 bp, Homo sapiens
ccttgaaccacttccctca

SEQ ID NO: 6095306 - DNA, 21 bp, Homo sapiens
ccttgaacccccctccgcccc

SEQ ID NO: 6095307 - DNA, 20 bp, Homo sapiens
ccttgaaccccctccctgtc

SEQ ID NO: 6095308 - DNA, 15 bp, Homo sapiens
ccttgaacctcatta

SEQ ID NO: 6095309 - DNA, 16 bp, Homo sapiens
ccttgaacctcattaa

SEQ ID NO: 6095310 - DNA, 18 bp, Homo sapiens
ccttgaacctgtcacctg

SEQ ID NO: 6095311 - DNA, 16 bp, Homo sapiens
ccttgaacctgtgagt

SEQ ID NO: 6095312 - DNA, 15 bp, Homo sapiens
ccttgaactgaggcc

SEQ ID NO: 6095313 - DNA, 14 bp, Homo sapiens
ccttgaactgggta

SEQ ID NO: 6095314 - DNA, 15 bp, Homo sapiens
ccttgaagaaaatga

SEQ ID NO: 6095315 - DNA, 18 bp, Homo sapiens
ccttgaagaaaatgactt

SEQ ID NO: 6095316 - DNA, 19 bp, Homo sapiens
ccttgaagaaaatgacttt

SEQ ID NO: 6095317 - DNA, 18 bp, Homo sapiens
ccttgaagaactgcaggc

SEQ ID NO: 6095318 - DNA, 16 bp, Homo sapiens
ccttgaagactccctg

SEQ ID NO: 6095319 - DNA, 22 bp, Homo sapiens
ccttgaagactccctgatccca

SEQ ID NO: 6095320 - DNA, 16 bp, Homo sapiens
ccttgaagatgtagct

SEQ ID NO: 6095321 - DNA, 16 bp, Homo sapiens
ccttgaagcaaatgtg

SEQ ID NO: 6095322 - DNA, 14 bp, Homo sapiens
ccttgaagcaataa

SEQ ID NO: 6095323 - DNA, 15 bp, Homo sapiens
ccttgaagcaataac

SEQ ID NO: 6095324 - DNA, 23 bp, Homo sapiens
ccttgaagcaataactccaagca

SEQ ID NO: 6095325 - DNA, 14 bp, Homo sapiens
ccttgaagccactg

SEQ ID NO: 6095326 - DNA, 22 bp, Homo sapiens
ccttgaagccactgaagctggg

SEQ ID NO: 6095327 - DNA, 11 bp, Homo sapiens
ccttgaagccg

SEQ ID NO: 6095328 - DNA, 14 bp, Homo sapiens
ccttgaagcctcct

SEQ ID NO: 6095329 - DNA, 14 bp, Homo sapiens
ccttgaagcttgta

SEQ ID NO: 6095330 - DNA, 16 bp, Homo sapiens
ccttgaagcttgtatc

SEQ ID NO: 6095331 - DNA, 14 bp, Homo sapiens
ccttgaaggaagag

SEQ ID NO: 6095332 - DNA, 21 bp, Homo sapiens
ccttgaagggtaaagaagttt

SEQ ID NO: 6095333 - DNA, 14 bp, Homo sapiens
ccttgaaggtatat

SEQ ID NO: 6095334 - DNA, 12 bp, Homo sapiens
ccttgaaggtct

SEQ ID NO: 6095335 - DNA, 19 bp, Homo sapiens
ccttgaagttctgaaattt

SEQ ID NO: 6095336 - DNA, 21 bp, Homo sapiens
ccttgaagttctgaaatttaa

SEQ ID NO: 6095337 - DNA, 13 bp, Homo sapiens
ccttgaataataa

SEQ ID NO: 6095338 - DNA, 21 bp, Homo sapiens
ccttgaatatcccctcccagt

SEQ ID NO: 6095339 - DNA, 17 bp, Homo sapiens
ccttgaatgatgccatg

SEQ ID NO: 6095340 - DNA, 14 bp, Homo sapiens
ccttgaatgctgcc

SEQ ID NO: 6095341 - DNA, 15 bp, Homo sapiens
ccttgaatgctgcca

SEQ ID NO: 6095342 - DNA, 16 bp, Homo sapiens
ccttgaatgctgccag

SEQ ID NO: 6095343 - DNA, 22 bp, Homo sapiens
ccttgaatgctgccagtgtgga

SEQ ID NO: 6095344 - DNA, 12 bp, Homo sapiens
ccttgaatgtgg

SEQ ID NO: 6095345 - DNA, 15 bp, Homo sapiens
ccttgaattcttttc

SEQ ID NO: 6095346 - DNA, 13 bp, Homo sapiens
ccttgaattgtct

SEQ ID NO: 6095347 - DNA, 21 bp, Homo sapiens
ccttgacaaagtcaagccaca

SEQ ID NO: 6095348 - DNA, 14 bp, Homo sapiens
ccttgacacactgt

SEQ ID NO: 6095349 - DNA, 13 bp, Homo sapiens
ccttgacagagca

SEQ ID NO: 6095350 - DNA, 14 bp, Homo sapiens
ccttgacagagcag

SEQ ID NO: 6095351 - DNA, 22 bp, Homo sapiens
ccttgacagagcagctaactcc

SEQ ID NO: 6095352 - DNA, 13 bp, Homo sapiens
ccttgacagggca

SEQ ID NO: 6095353 - DNA, 20 bp, Homo sapiens
ccttgacataccaagtggtt

SEQ ID NO: 6095354 - DNA, 14 bp, Homo sapiens
ccttgacatcagtt

SEQ ID NO: 6095355 - DNA, 15 bp, Homo sapiens
ccttgacatcagttc

SEQ ID NO: 6095356 - DNA, 12 bp, Homo sapiens
ccttgaccagca

SEQ ID NO: 6095357 - DNA, 21 bp, Homo sapiens
ccttgaccagcagatcccagc

SEQ ID NO: 6095358 - DNA, 14 bp, Homo sapiens
ccttgacctttcca

SEQ ID NO: 6095359 - DNA, 21 bp, Homo sapiens
ccttgacctttgtacagccca

SEQ ID NO: 6095360 - DNA, 20 bp, Homo sapiens
ccttgacgcgagaggctctg

SEQ ID NO: 6095361 - DNA, 20 bp, Homo sapiens
ccttgacgtcaagtctcctt

SEQ ID NO: 6095362 - DNA, 23 bp, Homo sapiens
ccttgactgtctagccactccct

SEQ ID NO: 6095363 - DNA, 16 bp, Homo sapiens
ccttgactgttgatgt

SEQ ID NO: 6095364 - DNA, 16 bp, Homo sapiens
ccttgacttgccatga

SEQ ID NO: 6095365 - DNA, 14 bp, Homo sapiens
ccttgagaaacctt

SEQ ID NO: 6095366 - DNA, 14 bp, Homo sapiens
ccttgagacagctt

SEQ ID NO: 6095367 - DNA, 16 bp, Homo sapiens
ccttgagaccacaggg

SEQ ID NO: 6095368 - DNA, 14 bp, Homo sapiens
ccttgagaccctct

SEQ ID NO: 6095369 - DNA, 14 bp, Homo sapiens
ccttgagacctcag

SEQ ID NO: 6095370 - DNA, 16 bp, Homo sapiens
ccttgagacctcagcc

SEQ ID NO: 6095371 - DNA, 17 bp, Homo sapiens
ccttgagacctcagcca

SEQ ID NO: 6095372 - DNA, 19 bp, Homo sapiens
ccttgagacctcagccatg

SEQ ID NO: 6095373 - DNA, 16 bp, Homo sapiens
ccttgagagaccaggc

SEQ ID NO: 6095374 - DNA, 18 bp, Homo sapiens
ccttgagagttccgggga

SEQ ID NO: 6095375 - DNA, 22 bp, Homo sapiens
ccttgagagttccggggagaaa

SEQ ID NO: 6095376 - DNA, 22 bp, Homo sapiens
ccttgagatgcttcactttcct

SEQ ID NO: 6095377 - DNA, 13 bp, Homo sapiens
ccttgagcactca

SEQ ID NO: 6095378 - DNA, 14 bp, Homo sapiens
ccttgagcatctgg

SEQ ID NO: 6095379 - DNA, 18 bp, Homo sapiens
ccttgagccctccccagg

SEQ ID NO: 6095380 - DNA, 14 bp, Homo sapiens
ccttgagccctggc

SEQ ID NO: 6095381 - DNA, 15 bp, Homo sapiens
ccttgagccctggct

SEQ ID NO: 6095382 - DNA, 21 bp, Homo sapiens
ccttgagccgtgacctccagg

SEQ ID NO: 6095383 - DNA, 14 bp, Homo sapiens
ccttgagctgagat

SEQ ID NO: 6095384 - DNA, 19 bp, Homo sapiens
ccttgagctgcctgctctg

SEQ ID NO: 6095385 - DNA, 16 bp, Homo sapiens
ccttgagctgttgtga

SEQ ID NO: 6095386 - DNA, 19 bp, Homo sapiens
ccttgaggacctccacctg

SEQ ID NO: 6095387 - DNA, 20 bp, Homo sapiens
ccttgaggacctccacctgg

SEQ ID NO: 6095388 - DNA, 19 bp, Homo sapiens
cctagccaccagtgtcctc

SEQ ID NO: 6095389 - DNA, 16 bp, Homo sapiens
cctagccacccaccac

SEQ ID NO: 6095390 - DNA, 12 bp, Homo sapiens
cctagccacctc

SEQ ID NO: 6095391 - DNA, 23 bp, Homo sapiens
cctagccacctcccaccccactc

SEQ ID NO: 6095392 - DNA, 19 bp, Homo sapiens
cctagccaggtctcctggg

SEQ ID NO: 6095393 - DNA, 20 bp, Homo sapiens
cctagccaggtctcctggga

SEQ ID NO: 6095394 - DNA, 13 bp, Homo sapiens
cctagcccaccct

SEQ ID NO: 6095395 - DNA, 20 bp, Homo sapiens
cctagcccaccctgctgcct

SEQ ID NO: 6095396 - DNA, 13 bp, Homo sapiens
cctagcccacttg

SEQ ID NO: 6095397 - DNA, 17 bp, Homo sapiens
cctagcccagcgctctg

SEQ ID NO: 6095398 - DNA, 23 bp, Homo sapiens
cctagcccagcgctctgcctcac

SEQ ID NO: 6095399 - DNA, 12 bp, Homo sapiens
cctagccccacc

SEQ ID NO: 6095400 - DNA, 14 bp, Homo sapiens
cctagccccaccca

SEQ ID NO: 6095401 - DNA, 18 bp, Homo sapiens
cctagccccacccagagg

SEQ ID NO: 6095402 - DNA, 19 bp, Homo sapiens
cctagccccacccagaggt

SEQ ID NO: 6095403 - DNA, 18 bp, Homo sapiens
cctagcccctcacttcca

SEQ ID NO: 6095404 - DNA, 18 bp, Homo sapiens
cctagcccctctctcaca

SEQ ID NO: 6095405 - DNA, 21 bp, Homo sapiens
cctagccccttagcccccacc

SEQ ID NO: 6095406 - DNA, 12 bp, Homo sapiens
cctagccctccc

SEQ ID NO: 6095407 - DNA, 16 bp, Homo sapiens
cctagccctctccctc

SEQ ID NO: 6095408 - DNA, 12 bp, Homo sapiens
cctagccctggt

SEQ ID NO: 6095409 - DNA, 13 bp, Homo sapiens
cctagcccttcca

SEQ ID NO: 6095410 - DNA, 21 bp, Homo sapiens
cctagcccttccagcctggga

SEQ ID NO: 6095411 - DNA, 14 bp, Homo sapiens
cctagcccttccct

SEQ ID NO: 6095412 - DNA, 18 bp, Homo sapiens
cctagcccttccctgagt

SEQ ID NO: 6095413 - DNA, 23 bp, Homo sapiens
cctagcccttctaccccacctga

SEQ ID NO: 6095414 - DNA, 15 bp, Homo sapiens
cctagccgacctcag

SEQ ID NO: 6095415 - DNA, 22 bp, Homo sapiens
cctagccggttcctgtccctgc

SEQ ID NO: 6095416 - DNA, 14 bp, Homo sapiens
cctagcctccacca

SEQ ID NO: 6095417 - DNA, 21 bp, Homo sapiens
cctagcctctccgcccacgcg

SEQ ID NO: 6095418 - DNA, 16 bp, Homo sapiens
cctagcctgctctgcc

SEQ ID NO: 6095419 - DNA, 18 bp, Homo sapiens
cctagcctgctctgccac

SEQ ID NO: 6095420 - DNA, 12 bp, Homo sapiens
cctagcctggat

SEQ ID NO: 6095421 - DNA, 18 bp, Homo sapiens
cctagcctggatggcccc

SEQ ID NO: 6095422 - DNA, 10 bp, Homo sapiens
cctagccttg

SEQ ID NO: 6095423 - DNA, 19 bp, Homo sapiens
cctagcgatctctcctggc

SEQ ID NO: 6095424 - DNA, 18 bp, Homo sapiens
cctagcgctctcttccag

SEQ ID NO: 6095425 - DNA, 15 bp, Homo sapiens
cctagcggagcccag

SEQ ID NO: 6095426 - DNA, 16 bp, Homo sapiens
cctagcggagcccagc

SEQ ID NO: 6095427 - DNA, 20 bp, Homo sapiens
cctagcggagcccagcctgg

SEQ ID NO: 6095428 - DNA, 17 bp, Homo sapiens
cctagcgggatggggct

SEQ ID NO: 6095429 - DNA, 19 bp, Homo sapiens
cctagctacttggcaggct

SEQ ID NO: 6095430 - DNA, 21 bp, Homo sapiens
cctagctacttggcaggctga

SEQ ID NO: 6095431 - DNA, 17 bp, Homo sapiens
cctagctaggagcaggc

SEQ ID NO: 6095432 - DNA, 19 bp, Homo sapiens
cctagctaggagcaggctt

SEQ ID NO: 6095433 - DNA, 14 bp, Homo sapiens
cctagctcaccagg

SEQ ID NO: 6095434 - DNA, 19 bp, Homo sapiens
cctagctcaccaggcctgg

SEQ ID NO: 6095435 - DNA, 20 bp, Homo sapiens
cctagctcaccaggcctggc

SEQ ID NO: 6095436 - DNA, 22 bp, Homo sapiens
cctagctccaccctcaccagga

SEQ ID NO: 6095437 - DNA, 19 bp, Homo sapiens
cctagctcctcctcctggg

SEQ ID NO: 6095438 - DNA, 17 bp, Homo sapiens
cctagctctcccagtga

SEQ ID NO: 6095439 - DNA, 21 bp, Homo sapiens
cctagctctggaggtgctgct

SEQ ID NO: 6095440 - DNA, 13 bp, Homo sapiens
cctagctcttaca

SEQ ID NO: 6095441 - DNA, 22 bp, Homo sapiens
cctagctcttgggcctgacctc

SEQ ID NO: 6095442 - DNA, 23 bp, Homo sapiens
cctagctcttgggcctgacctcc

SEQ ID NO: 6095443 - DNA, 14 bp, Homo sapiens
cctagctgaatgtt

SEQ ID NO: 6095444 - DNA, 20 bp, Homo sapiens
cctagctgaatgtttttcta

SEQ ID NO: 6095445 - DNA, 13 bp, Homo sapiens
cctagctgacccc

SEQ ID NO: 6095446 - DNA, 14 bp, Homo sapiens
cctagctgacgcca

SEQ ID NO: 6095447 - DNA, 19 bp, Homo sapiens
cctagctgcacagggcagc

SEQ ID NO: 6095448 - DNA, 14 bp, Homo sapiens
cctagctgctacaa

SEQ ID NO: 6095449 - DNA, 15 bp, Homo sapiens
cctagctgctgtcac

SEQ ID NO: 6095450 - DNA, 12 bp, Homo sapiens
cctagctggaga

SEQ ID NO: 6095451 - DNA, 16 bp, Homo sapiens
cctagctggagaggag

SEQ ID NO: 6095452 - DNA, 13 bp, Homo sapiens
cctagctggctct

SEQ ID NO: 6095453 - DNA, 14 bp, Homo sapiens
cctagctggctctg

SEQ ID NO: 6095454 - DNA, 15 bp, Homo sapiens
cctagctggctctgt

SEQ ID NO: 6095455 - DNA, 22 bp, Homo sapiens
cctagctgtcctttttcctctc

SEQ ID NO: 6095456 - DNA, 16 bp, Homo sapiens
cctagctgtgccccct

SEQ ID NO: 6095457 - DNA, 20 bp, Homo sapiens
cctagctgtgccccctctgg

SEQ ID NO: 6095458 - DNA, 13 bp, Homo sapiens
cctagctgtgtca

SEQ ID NO: 6095459 - DNA, 22 bp, Homo sapiens
cctagctgtgtgaatacctgct

SEQ ID NO: 6095460 - DNA, 13 bp, Homo sapiens
cctagctgtgtgc

SEQ ID NO: 6095461 - DNA, 17 bp, Homo sapiens
cctagctgtgttattcc

SEQ ID NO: 6095462 - DNA, 17 bp, Homo sapiens
cctagcttatctccctg

SEQ ID NO: 6095463 - DNA, 17 bp, Homo sapiens
cctagctttagaccctg

SEQ ID NO: 6095464 - DNA, 18 bp, Homo sapiens
cctagctttagaccctgg

SEQ ID NO: 6095465 - DNA, 20 bp, Homo sapiens
cctagctttagaccctgggt

SEQ ID NO: 6095466 - DNA, 20 bp, Homo sapiens
cctagctttatatatggaca

SEQ ID NO: 6095467 - DNA, 16 bp, Homo sapiens
cctagcttttaaaaaa

SEQ ID NO: 6095468 - DNA, 19 bp, Homo sapiens
cctagctttttcctggaaa

SEQ ID NO: 6095469 - DNA, 22 bp, Homo sapiens
cctaggaagcctcagattcctt

SEQ ID NO: 6095470 - DNA, 16 bp, Homo sapiens
cctaggaattcccagc

SEQ ID NO: 6095471 - DNA, 17 bp, Homo sapiens
cctaggaattcccagcc

SEQ ID NO: 6095472 - DNA, 18 bp, Homo sapiens
cctaggaccactcagccc

SEQ ID NO: 6095473 - DNA, 13 bp, Homo sapiens
cctaggacctcag

SEQ ID NO: 6095474 - DNA, 15 bp, Homo sapiens
cctaggacctcaggc

SEQ ID NO: 6095475 - DNA, 19 bp, Homo sapiens
cctaggacgccaacttctc

SEQ ID NO: 6095476 - DNA, 20 bp, Homo sapiens
cctaggacgccaacttctcc

SEQ ID NO: 6095477 - DNA, 22 bp, Homo sapiens
cctaggacgccaacttctccca

SEQ ID NO: 6095478 - DNA, 19 bp, Homo sapiens
cctaggactcaggcctgcc

SEQ ID NO: 6095479 - DNA, 13 bp, Homo sapiens
cctaggagagcca

SEQ ID NO: 6095480 - DNA, 15 bp, Homo sapiens
cctaggagagccaac

SEQ ID NO: 6095481 - DNA, 19 bp, Homo sapiens
cctaggagatatctgaggg

SEQ ID NO: 6095482 - DNA, 22 bp, Homo sapiens
cctaggagatatctgagggagg

SEQ ID NO: 6095483 - DNA, 14 bp, Homo sapiens
cctaggagctggct

SEQ ID NO: 6095484 - DNA, 16 bp, Homo sapiens
cctaggagctggctgg

SEQ ID NO: 6095485 - DNA, 14 bp, Homo sapiens
cctaggagctgggg

SEQ ID NO: 6095486 - DNA, 13 bp, Homo sapiens
cctaggagggtgt

SEQ ID NO: 6095487 - DNA, 16 bp, Homo sapiens
cctaggagtatatttc

SEQ ID NO: 6095488 - DNA, 20 bp, Homo sapiens
cctaggagtgccccattctt

SEQ ID NO: 6095489 - DNA, 16 bp, Homo sapiens
cctaggatgctgcagc

SEQ ID NO: 6095490 - DNA, 21 bp, Homo sapiens
cctaggatgctgcagcagagt

SEQ ID NO: 6095491 - DNA, 18 bp, Homo sapiens
cctaggattcacacccca

SEQ ID NO: 6095492 - DNA, 20 bp, Homo sapiens
cctaggattccccctgccct

SEQ ID NO: 6095493 - DNA, 14 bp, Homo sapiens
cctaggattctaaa

SEQ ID NO: 6095494 - DNA, 11 bp, Homo sapiens
cctaggatttc

SEQ ID NO: 6095495 - DNA, 15 bp, Homo sapiens
cctaggatttcagcc

SEQ ID NO: 6095496 - DNA, 23 bp, Homo sapiens
cctaggcacctccccgctctccc

SEQ ID NO: 6095497 - DNA, 13 bp, Homo sapiens
cctaggcaggaca

SEQ ID NO: 6095498 - DNA, 22 bp, Homo sapiens
cctaggcatactctccaggatt

SEQ ID NO: 6095499 - DNA, 21 bp, Homo sapiens
cctaggcatctgctgtaataa

SEQ ID NO: 6095500 - DNA, 16 bp, Homo sapiens
cctaggcattctggac

SEQ ID NO: 6095501 - DNA, 19 bp, Homo sapiens
cctaggcattgcaggacct

SEQ ID NO: 6095502 - DNA, 22 bp, Homo sapiens
cctaggccaaatgcacaagctc

SEQ ID NO: 6095503 - DNA, 23 bp, Homo sapiens
cctaggccaaatgcacaagctca

SEQ ID NO: 6095504 - DNA, 16 bp, Homo sapiens
cctaggccactcctcc

SEQ ID NO: 6095505 - DNA, 19 bp, Homo sapiens
cctaggccactcctccaaa

SEQ ID NO: 6095506 - DNA, 14 bp, Homo sapiens
cctaggccagctcc

SEQ ID NO: 6095507 - DNA, 15 bp, Homo sapiens
cctaggccagctcct

SEQ ID NO: 6095508 - DNA, 11 bp, Homo sapiens
cctaggccagg

SEQ ID NO: 6095509 - DNA, 16 bp, Homo sapiens
cctaggcccaggcctg

SEQ ID NO: 6095510 - DNA, 14 bp, Homo sapiens
cctaggccccagag

SEQ ID NO: 6095511 - DNA, 22 bp, Homo sapiens
cctaggcccctcctagacccag

SEQ ID NO: 6095512 - DNA, 23 bp, Homo sapiens
cctaggcccctcctagacccagg

SEQ ID NO: 6095513 - DNA, 14 bp, Homo sapiens
cctaggcctcagcc

SEQ ID NO: 6095514 - DNA, 19 bp, Homo sapiens
cctaggcctcagccagaga

SEQ ID NO: 6095515 - DNA, 23 bp, Homo sapiens
cctaggcctgggcagtggatggc

SEQ ID NO: 6095516 - DNA, 13 bp, Homo sapiens
cctaggctcctct

SEQ ID NO: 6095517 - DNA, 14 bp, Homo sapiens
cctaggctcctctt

SEQ ID NO: 6095518 - DNA, 22 bp, Homo sapiens
cctaggctgaggttagagagat

SEQ ID NO: 6095519 - DNA, 11 bp, Homo sapiens
cctaggctgca

SEQ ID NO: 6095520 - DNA, 18 bp, Homo sapiens
cctaggctggaagccatg

SEQ ID NO: 6095521 - DNA, 14 bp, Homo sapiens
cctaggctggaagg

SEQ ID NO: 6095522 - DNA, 19 bp, Homo sapiens
cctaggctggaaggaggaa

SEQ ID NO: 6095523 - DNA, 20 bp, Homo sapiens
cctaggcttggctcctttca

SEQ ID NO: 6095524 - DNA, 15 bp, Homo sapiens
cctagggaatgaact

SEQ ID NO: 6095525 - DNA, 11 bp, Homo sapiens
cctagggagcc

SEQ ID NO: 6095526 - DNA, 14 bp, Homo sapiens
cctagggctcagag

SEQ ID NO: 6095527 - DNA, 16 bp, Homo sapiens
cctagggctcagaggg

SEQ ID NO: 6095528 - DNA, 18 bp, Homo sapiens
cctagggctcagaggggc

SEQ ID NO: 6095529 - DNA, 17 bp, Homo sapiens
cctagggctctccaagc

SEQ ID NO: 6095530 - DNA, 19 bp, Homo sapiens
cctaggggaacagaccagt

SEQ ID NO: 6095531 - DNA, 13 bp, Homo sapiens
cctaggggaatga

SEQ ID NO: 6095532 - DNA, 17 bp, Homo sapiens
cctaggggacacttccc

SEQ ID NO: 6095533 - DNA, 17 bp, Homo sapiens
cctaggggccagggctt

SEQ ID NO: 6095534 - DNA, 17 bp, Homo sapiens
cctaggggcttggtcct

SEQ ID NO: 6095535 - DNA, 14 bp, Homo sapiens
cctagggggacggg

SEQ ID NO: 6095536 - DNA, 20 bp, Homo sapiens
cctagggggtgtcagaagct

SEQ ID NO: 6095537 - DNA, 23 bp, Homo sapiens
cctagggggtgtcagaagctggg

SEQ ID NO: 6095538 - DNA, 14 bp, Homo sapiens
cctaggggtggcgc

SEQ ID NO: 6095539 - DNA, 17 bp, Homo sapiens
cctaggggtttctgttg

SEQ ID NO: 6095540 - DNA, 21 bp, Homo sapiens
cctagggtcttgggggtcagg

SEQ ID NO: 6095541 - DNA, 16 bp, Homo sapiens
cctaggtagccccctc

SEQ ID NO: 6095542 - DNA, 22 bp, Homo sapiens
cctaggtataattcacattgta

SEQ ID NO: 6095543 - DNA, 15 bp, Homo sapiens
cctaggtcatgaagg

SEQ ID NO: 6095544 - DNA, 14 bp, Homo sapiens
cctaggtcccttcc

SEQ ID NO: 6095545 - DNA, 16 bp, Homo sapiens
cctaggtcccttcccg

SEQ ID NO: 6095546 - DNA, 15 bp, Homo sapiens
cctaggtctccaccc

SEQ ID NO: 6095547 - DNA, 17 bp, Homo sapiens
cctaggtctccacccct

SEQ ID NO: 6095548 - DNA, 18 bp, Homo sapiens
cctaggtctccacccctc

SEQ ID NO: 6095549 - DNA, 13 bp, Homo sapiens
cctaggtgacaga

SEQ ID NO: 6095550 - DNA, 15 bp, Homo sapiens
cctaggtgcagctcc

SEQ ID NO: 6095551 - DNA, 21 bp, Homo sapiens
cctaggtgcagctcctcagcg

SEQ ID NO: 6095552 - DNA, 17 bp, Homo sapiens
cctaggtgcccagggcc

SEQ ID NO: 6095553 - DNA, 18 bp, Homo sapiens
cctaggtgcccagggcca

SEQ ID NO: 6095554 - DNA, 13 bp, Homo sapiens
cctaggtgggagc

SEQ ID NO: 6095555 - DNA, 15 bp, Homo sapiens
cctaggtgggagcca

SEQ ID NO: 6095556 - DNA, 20 bp, Homo sapiens
cctaggtgggagccaccact

SEQ ID NO: 6095557 - DNA, 19 bp, Homo sapiens
cctaggtgggtcaactcca

SEQ ID NO: 6095558 - DNA, 20 bp, Homo sapiens
cctaggtgttgtcagcaggc

SEQ ID NO: 6095559 - DNA, 22 bp, Homo sapiens
cctaggttaacaaccctgttga

SEQ ID NO: 6095560 - DNA, 19 bp, Homo sapiens
cctaggttatgggtacggc

SEQ ID NO: 6095561 - DNA, 16 bp, Homo sapiens
cctaggttcccggtcc

SEQ ID NO: 6095562 - DNA, 22 bp, Homo sapiens
cctaggttccctgttcttcctc

SEQ ID NO: 6095563 - DNA, 21 bp, Homo sapiens
cctaggttggtttcccctgca

SEQ ID NO: 6095564 - DNA, 14 bp, Homo sapiens
cctaggttttgaga

SEQ ID NO: 6095565 - DNA, 21 bp, Homo sapiens
cctaggttttgagatttagag

SEQ ID NO: 6095566 - DNA, 20 bp, Homo sapiens
cctaggttttggagagtttg

SEQ ID NO: 6095567 - DNA, 13 bp, Homo sapiens
ccttgaggagaag

SEQ ID NO: 6095568 - DNA, 16 bp, Homo sapiens
ccttgaggagtcttgt

SEQ ID NO: 6095569 - DNA, 19 bp, Homo sapiens
ccttgaggatggagagcag

SEQ ID NO: 6095570 - DNA, 23 bp, Homo sapiens
ccttgaggatggagagcagccag

SEQ ID NO: 6095571 - DNA, 13 bp, Homo sapiens
ccttgagggctgc

SEQ ID NO: 6095572 - DNA, 18 bp, Homo sapiens
ccttgaggggccccagcg

SEQ ID NO: 6095573 - DNA, 20 bp, Homo sapiens
ccttgagggtgggccagcat

SEQ ID NO: 6095574 - DNA, 14 bp, Homo sapiens
ccttgaggtctcag

SEQ ID NO: 6095575 - DNA, 17 bp, Homo sapiens
ccttgaggtctcagccc

SEQ ID NO: 6095576 - DNA, 13 bp, Homo sapiens
ccttgaggtcttt

SEQ ID NO: 6095577 - DNA, 15 bp, Homo sapiens
ccttgagtaaaaagg

SEQ ID NO: 6095578 - DNA, 17 bp, Homo sapiens
ccttgagtagaaaagtc

SEQ ID NO: 6095579 - DNA, 16 bp, Homo sapiens
ccttgagtaggccctg

SEQ ID NO: 6095580 - DNA, 19 bp, Homo sapiens
ccttgagtagtttttatct

SEQ ID NO: 6095581 - DNA, 13 bp, Homo sapiens
ccttgagtctctg

SEQ ID NO: 6095582 - DNA, 14 bp, Homo sapiens
ccttgagtggggtt

SEQ ID NO: 6095583 - DNA, 21 bp, Homo sapiens
ccttgagttgagtattacaca

SEQ ID NO: 6095584 - DNA, 20 bp, Homo sapiens
ccttgagttgattcagctct

SEQ ID NO: 6095585 - DNA, 17 bp, Homo sapiens
ccttgagtttcatatat

SEQ ID NO: 6095586 - DNA, 19 bp, Homo sapiens
ccttgataatacttgacct

SEQ ID NO: 6095587 - DNA, 13 bp, Homo sapiens
ccttgatcatgtc

SEQ ID NO: 6095588 - DNA, 14 bp, Homo sapiens
ccttgatcccaatc

SEQ ID NO: 6095589 - DNA, 18 bp, Homo sapiens
ccttgatcgacttcttgg

SEQ ID NO: 6095590 - DNA, 22 bp, Homo sapiens
ccttgatgaaataacacagcag

SEQ ID NO: 6095591 - DNA, 18 bp, Homo sapiens
ccttgatgaagcccgtgt

SEQ ID NO: 6095592 - DNA, 22 bp, Homo sapiens
ccttgatgaagcccgtgtcctg

SEQ ID NO: 6095593 - DNA, 17 bp, Homo sapiens
ccttgatgaagcctgtg

SEQ ID NO: 6095594 - DNA, 13 bp, Homo sapiens
ccttgatgactgc

SEQ ID NO: 6095595 - DNA, 13 bp, Homo sapiens
ccttgatgccaga

SEQ ID NO: 6095596 - DNA, 14 bp, Homo sapiens
ccttgatgccagag

SEQ ID NO: 6095597 - DNA, 19 bp, Homo sapiens
ccttgatgccagagggcca

SEQ ID NO: 6095598 - DNA, 20 bp, Homo sapiens
ccttgatgccagagggccag

SEQ ID NO: 6095599 - DNA, 23 bp, Homo sapiens
ccttgatgccagagggccagcag

SEQ ID NO: 6095600 - DNA, 21 bp, Homo sapiens
ccttgatggagaaggaaaagg

SEQ ID NO: 6095601 - DNA, 21 bp, Homo sapiens
ccttgatggggaatccgtgtg

SEQ ID NO: 6095602 - DNA, 21 bp, Homo sapiens
ccttgatggggtccagagagc

SEQ ID NO: 6095603 - DNA, 23 bp, Homo sapiens
ccttgatggggtccagagagcct

SEQ ID NO: 6095604 - DNA, 14 bp, Homo sapiens
ccttgatgtcttga

SEQ ID NO: 6095605 - DNA, 22 bp, Homo sapiens
ccttgatgtcttgagagcgctg

SEQ ID NO: 6095606 - DNA, 15 bp, Homo sapiens
ccttgattacttcca

SEQ ID NO: 6095607 - DNA, 19 bp, Homo sapiens
ccttgattataccactgca

SEQ ID NO: 6095608 - DNA, 14 bp, Homo sapiens
ccttgattcattct

SEQ ID NO: 6095609 - DNA, 19 bp, Homo sapiens
ccttgattgattagataaa

SEQ ID NO: 6095610 - DNA, 14 bp, Homo sapiens
ccttgattgggact

SEQ ID NO: 6095611 - DNA, 23 bp, Homo sapiens
ccttgattgttcgggtgtgcaat

SEQ ID NO: 6095612 - DNA, 20 bp, Homo sapiens
ccttgattttaattcaggtg

SEQ ID NO: 6095613 - DNA, 20 bp, Homo sapiens
ccttgattttagccttctct

SEQ ID NO: 6095614 - DNA, 13 bp, Homo sapiens
ccttgattttctt

SEQ ID NO: 6095615 - DNA, 20 bp, Homo sapiens
ccttgattttcttctttgtg

SEQ ID NO: 6095616 - DNA, 17 bp, Homo sapiens
ccttgcaaccaggcagc

SEQ ID NO: 6095617 - DNA, 14 bp, Homo sapiens
ccttgcaacccaag

SEQ ID NO: 6095618 - DNA, 20 bp, Homo sapiens
ccttgcaacccaaggtgagg

SEQ ID NO: 6095619 - DNA, 17 bp, Homo sapiens
ccttgcaacttcatgtc

SEQ ID NO: 6095620 - DNA, 15 bp, Homo sapiens
ccttgcaagaatcag

SEQ ID NO: 6095621 - DNA, 11 bp, Homo sapiens
ccttgcaagcc

SEQ ID NO: 6095622 - DNA, 13 bp, Homo sapiens
ccttgcaagccat

SEQ ID NO: 6095623 - DNA, 15 bp, Homo sapiens
ccttgcaagccataa

SEQ ID NO: 6095624 - DNA, 21 bp, Homo sapiens
ccttgcaatggatcagccaag

SEQ ID NO: 6095625 - DNA, 16 bp, Homo sapiens
ccttgcacacccactg

SEQ ID NO: 6095626 - DNA, 19 bp, Homo sapiens
ccttgcacacccactgccc

SEQ ID NO: 6095627 - DNA, 18 bp, Homo sapiens
ccttgcacactcagaagc

SEQ ID NO: 6095628 - DNA, 18 bp, Homo sapiens
ccttgcacagctggagaa

SEQ ID NO: 6095629 - DNA, 19 bp, Homo sapiens
ccttgcacaggccacttgc

SEQ ID NO: 6095630 - DNA, 14 bp, Homo sapiens
ccttgcacatagta

SEQ ID NO: 6095631 - DNA, 14 bp, Homo sapiens
ccttgcacccgcaa

SEQ ID NO: 6095632 - DNA, 16 bp, Homo sapiens
ccttgcacctgagcct

SEQ ID NO: 6095633 - DNA, 23 bp, Homo sapiens
ccttgcacctgagcctgttccca

SEQ ID NO: 6095634 - DNA, 16 bp, Homo sapiens
ccttgcacctgcatcc

SEQ ID NO: 6095635 - DNA, 20 bp, Homo sapiens
ccttgcactattggactttg

SEQ ID NO: 6095636 - DNA, 17 bp, Homo sapiens
ccttgcactcctcacac

SEQ ID NO: 6095637 - DNA, 18 bp, Homo sapiens
ccttgcagaaggcaaggc

SEQ ID NO: 6095638 - DNA, 10 bp, Homo sapiens
ccttgcagca

SEQ ID NO: 6095639 - DNA, 15 bp, Homo sapiens
ccttgcagcggctcc

SEQ ID NO: 6095640 - DNA, 19 bp, Homo sapiens
ccttgcagcggctcctgca

SEQ ID NO: 6095641 - DNA, 17 bp, Homo sapiens
ccttgcagttcagcacc

SEQ ID NO: 6095642 - DNA, 23 bp, Homo sapiens
ccttgcagtttaagatgacactt

SEQ ID NO: 6095643 - DNA, 14 bp, Homo sapiens
ccttgccaaagcac

SEQ ID NO: 6095644 - DNA, 16 bp, Homo sapiens
ccttgccaagctttct

SEQ ID NO: 6095645 - DNA, 18 bp, Homo sapiens
ccttgccaagctttcttc

SEQ ID NO: 6095646 - DNA, 21 bp, Homo sapiens
ccttgccaatggtgtagctgt

SEQ ID NO: 6095647 - DNA, 21 bp, Homo sapiens
ccttgccacccattcttcccg

SEQ ID NO: 6095648 - DNA, 22 bp, Homo sapiens
ccttgccacccattcttcccgt

SEQ ID NO: 6095649 - DNA, 13 bp, Homo sapiens
ccttgccacccca

SEQ ID NO: 6095650 - DNA, 24 bp, Homo sapiens
ccttgccaccccaccctccctgga

SEQ ID NO: 6095651 - DNA, 22 bp, Homo sapiens
ccttgccaccccccgccggcag

SEQ ID NO: 6095652 - DNA, 19 bp, Homo sapiens
ccttgccactttgcacgac

SEQ ID NO: 6095653 - DNA, 12 bp, Homo sapiens
ccttgccagaga

SEQ ID NO: 6095654 - DNA, 13 bp, Homo sapiens
ccttgccagagat

SEQ ID NO: 6095655 - DNA, 13 bp, Homo sapiens
ccttgccagctgc

SEQ ID NO: 6095656 - DNA, 14 bp, Homo sapiens
ccttgccagctgct

SEQ ID NO: 6095657 - DNA, 23 bp, Homo sapiens
ccttgccagctgctgagccgcag

SEQ ID NO: 6095658 - DNA, 24 bp, Homo sapiens
ccttgccagctgctgagccgcaga

SEQ ID NO: 6095659 - DNA, 15 bp, Homo sapiens
ccttgccagggaggt

SEQ ID NO: 6095660 - DNA, 16 bp, Homo sapiens
ccttgccagttttccg

SEQ ID NO: 6095661 - DNA, 23 bp, Homo sapiens
ccttgccatcctaaaagccaccc

SEQ ID NO: 6095662 - DNA, 19 bp, Homo sapiens
ccttgcccaactcccagcc

SEQ ID NO: 6095663 - DNA, 21 bp, Homo sapiens
ccttgcccaactcccagccac

SEQ ID NO: 6095664 - DNA, 13 bp, Homo sapiens
ccttgcccacagg

SEQ ID NO: 6095665 - DNA, 17 bp, Homo sapiens
ccttgcccactcctgct

SEQ ID NO: 6095666 - DNA, 19 bp, Homo sapiens
ccttgcccactcctgctct

SEQ ID NO: 6095667 - DNA, 18 bp, Homo sapiens
ccttgcccacttctcctt

SEQ ID NO: 6095668 - DNA, 11 bp, Homo sapiens
ccttgcccaga

SEQ ID NO: 6095669 - DNA, 12 bp, Homo sapiens
ccttgcccagag

SEQ ID NO: 6095670 - DNA, 13 bp, Homo sapiens
ccttgcccagaga

SEQ ID NO: 6095671 - DNA, 14 bp, Homo sapiens
ccttgcccagagat

SEQ ID NO: 6095672 - DNA, 14 bp, Homo sapiens
ccttgcccagcctg

SEQ ID NO: 6095673 - DNA, 16 bp, Homo sapiens
ccttgcccagcctgga

SEQ ID NO: 6095674 - DNA, 13 bp, Homo sapiens
ccttgcccaggcc

SEQ ID NO: 6095675 - DNA, 14 bp, Homo sapiens
ccttgcccaggcct

SEQ ID NO: 6095676 - DNA, 14 bp, Homo sapiens
ccttgcccatcagc

SEQ ID NO: 6095677 - DNA, 20 bp, Homo sapiens
ccttgccccaacccttcttc

SEQ ID NO: 6095678 - DNA, 16 bp, Homo sapiens
ccttgccccacctccc

SEQ ID NO: 6095679 - DNA, 15 bp, Homo sapiens
ccttgccccactcct

SEQ ID NO: 6095680 - DNA, 15 bp, Homo sapiens
ccttgccccaggcca

SEQ ID NO: 6095681 - DNA, 17 bp, Homo sapiens
ccttgccccaggccagg

SEQ ID NO: 6095682 - DNA, 21 bp, Homo sapiens
ccttgccccaggccaggtagc

SEQ ID NO: 6095683 - DNA, 13 bp, Homo sapiens
ccttgccccagtc

SEQ ID NO: 6095684 - DNA, 17 bp, Homo sapiens
ccttgccccagtcctgg

SEQ ID NO: 6095685 - DNA, 17 bp, Homo sapiens
ccttgcccccatccctc

SEQ ID NO: 6095686 - DNA, 17 bp, Homo sapiens
ccttgcccccctggcct

SEQ ID NO: 6095687 - DNA, 16 bp, Homo sapiens
ccttgcccctgctctg

SEQ ID NO: 6095688 - DNA, 22 bp, Homo sapiens
ccttgcccgccagccagtggcc

SEQ ID NO: 6095689 - DNA, 20 bp, Homo sapiens
ccttgcccgccagcctcagt

SEQ ID NO: 6095690 - DNA, 17 bp, Homo sapiens
ccttgccctcaagcaat

SEQ ID NO: 6095691 - DNA, 22 bp, Homo sapiens
ccttgccctccctttctctctc

SEQ ID NO: 6095692 - DNA, 17 bp, Homo sapiens
ccttgccctccgcctgg

SEQ ID NO: 6095693 - DNA, 19 bp, Homo sapiens
ccttgccctccgcctggga

SEQ ID NO: 6095694 - DNA, 18 bp, Homo sapiens
ccttgccctcctgggccc

SEQ ID NO: 6095695 - DNA, 20 bp, Homo sapiens
ccttgccctcctgggccctg

SEQ ID NO: 6095696 - DNA, 21 bp, Homo sapiens
ccttgccctcctgggccctgg

SEQ ID NO: 6095697 - DNA, 23 bp, Homo sapiens
ccttgccctcctgggccctgggc

SEQ ID NO: 6095698 - DNA, 14 bp, Homo sapiens
ccttgccctgacct

SEQ ID NO: 6095699 - DNA, 19 bp, Homo sapiens
ccttgccctgacctcccag

SEQ ID NO: 6095700 - DNA, 14 bp, Homo sapiens
ccttgccctgggct

SEQ ID NO: 6095701 - DNA, 14 bp, Homo sapiens
ccttgcccttcctg

SEQ ID NO: 6095702 - DNA, 17 bp, Homo sapiens
ccttgccgctgggagag

SEQ ID NO: 6095703 - DNA, 23 bp, Homo sapiens
ccttgccgctgggagagccaagg

SEQ ID NO: 6095704 - DNA, 20 bp, Homo sapiens
ccttgccggggcctggactg

SEQ ID NO: 6095705 - DNA, 23 bp, Homo sapiens
ccttgcctaaatttaatgctgcc

SEQ ID NO: 6095706 - DNA, 15 bp, Homo sapiens
ccttgcctcaatgcc

SEQ ID NO: 6095707 - DNA, 12 bp, Homo sapiens
ccttgcctcccc

SEQ ID NO: 6095708 - DNA, 20 bp, Homo sapiens
ccttgcctgaactccagagg

SEQ ID NO: 6095709 - DNA, 12 bp, Homo sapiens
ccttgcctgcct

SEQ ID NO: 6095710 - DNA, 15 bp, Homo sapiens
ccttgcctgcctcct

SEQ ID NO: 6095711 - DNA, 17 bp, Homo sapiens
ccttgcctgcctcctag

SEQ ID NO: 6095712 - DNA, 18 bp, Homo sapiens
ccttgcctgcctcctagg

SEQ ID NO: 6095713 - DNA, 19 bp, Homo sapiens
ccttgcctgcctcctaggc

SEQ ID NO: 6095714 - DNA, 11 bp, Homo sapiens
ccttgcctggt

SEQ ID NO: 6095715 - DNA, 17 bp, Homo sapiens
ccttgcctgtctaaagc

SEQ ID NO: 6095716 - DNA, 20 bp, Homo sapiens
ccttgccttaataaatatgt

SEQ ID NO: 6095717 - DNA, 18 bp, Homo sapiens
ccttgccttatgggctga

SEQ ID NO: 6095718 - DNA, 15 bp, Homo sapiens
ccttgccttcccctg

SEQ ID NO: 6095719 - DNA, 17 bp, Homo sapiens
ccttgccttgcttctcc

SEQ ID NO: 6095720 - DNA, 18 bp, Homo sapiens
ccttgcctttcgaggcct

SEQ ID NO: 6095721 - DNA, 20 bp, Homo sapiens
ccttgcctttgtggccttcc

SEQ ID NO: 6095722 - DNA, 17 bp, Homo sapiens
ccttgcgctgtcccagg

SEQ ID NO: 6095723 - DNA, 17 bp, Homo sapiens
ccttgcggctcctcagg

SEQ ID NO: 6095724 - DNA, 23 bp, Homo sapiens
ccttgctaccacggcctcctttc

SEQ ID NO: 6095725 - DNA, 20 bp, Homo sapiens
ccttgctacttgaaggtaca

SEQ ID NO: 6095726 - DNA, 16 bp, Homo sapiens
ccttgctagccctggg

SEQ ID NO: 6095727 - DNA, 19 bp, Homo sapiens
ccttgctagctagccagcc

SEQ ID NO: 6095728 - DNA, 23 bp, Homo sapiens
ccttgctcaaccatggctgaagg

SEQ ID NO: 6095729 - DNA, 16 bp, Homo sapiens
ccttgctcactcactc

SEQ ID NO: 6095730 - DNA, 19 bp, Homo sapiens
ccttgctcatgagctcctg

SEQ ID NO: 6095731 - DNA, 14 bp, Homo sapiens
ccttgctccagcct

SEQ ID NO: 6095732 - DNA, 20 bp, Homo sapiens
ccttgctccagcctgacaac

SEQ ID NO: 6095733 - DNA, 22 bp, Homo sapiens
ccttgctcccaatggtgcttgg

SEQ ID NO: 6095734 - DNA, 16 bp, Homo sapiens
ccttgctcctagcaga

SEQ ID NO: 6095735 - DNA, 18 bp, Homo sapiens
ccttgctcctagcagaca

SEQ ID NO: 6095736 - DNA, 13 bp, Homo sapiens
ccttgctcctgga

SEQ ID NO: 6095737 - DNA, 14 bp, Homo sapiens
ccttgctcctggaa

SEQ ID NO: 6095738 - DNA, 18 bp, Homo sapiens
ccttgctcgctgtaaaat

SEQ ID NO: 6095739 - DNA, 16 bp, Homo sapiens
ccttgctctacctggc

SEQ ID NO: 6095740 - DNA, 19 bp, Homo sapiens
ccttgctctacctggccgg

SEQ ID NO: 6095741 - DNA, 17 bp, Homo sapiens
ccttgctctccctcttc

SEQ ID NO: 6095742 - DNA, 13 bp, Homo sapiens
ccttgctctcctc

SEQ ID NO: 6095743 - DNA, 18 bp, Homo sapiens
ccttgctctcctcatctc

SEQ ID NO: 6095744 - DNA, 15 bp, Homo sapiens
ccttgctctcttcaa

SEQ ID NO: 6095745 - DNA, 15 bp, Homo sapiens
ccttgctctgagcac

SEQ ID NO: 6095746 - DNA, 22 bp, Homo sapiens
cctaggtttttcctactgtcct

SEQ ID NO: 6095747 - DNA, 16 bp, Homo sapiens
cctagtaaatgttaac

SEQ ID NO: 6095748 - DNA, 22 bp, Homo sapiens
cctagtaaccaaggccctgtct

SEQ ID NO: 6095749 - DNA, 19 bp, Homo sapiens
cctagtaagtcaggacagc

SEQ ID NO: 6095750 - DNA, 15 bp, Homo sapiens
cctagtaagtgcctt

SEQ ID NO: 6095751 - DNA, 14 bp, Homo sapiens
cctagtacaatctt

SEQ ID NO: 6095752 - DNA, 16 bp, Homo sapiens
cctagtacaatcttgg

SEQ ID NO: 6095753 - DNA, 21 bp, Homo sapiens
cctagtactctctgctctagc

SEQ ID NO: 6095754 - DNA, 22 bp, Homo sapiens
cctagtactctctgctctagcc

SEQ ID NO: 6095755 - DNA, 13 bp, Homo sapiens
cctagtactgccc

SEQ ID NO: 6095756 - DNA, 23 bp, Homo sapiens
cctagtagctggcgcccatccta

SEQ ID NO: 6095757 - DNA, 14 bp, Homo sapiens
cctagtagctggga

SEQ ID NO: 6095758 - DNA, 20 bp, Homo sapiens
cctagtagctgggatgacag

SEQ ID NO: 6095759 - DNA, 18 bp, Homo sapiens
cctagtaggagctgagct

SEQ ID NO: 6095760 - DNA, 14 bp, Homo sapiens
cctagtagtcattt

SEQ ID NO: 6095761 - DNA, 17 bp, Homo sapiens
cctagtatgaaagctgg

SEQ ID NO: 6095762 - DNA, 20 bp, Homo sapiens
cctagtatgaaagctggggg

SEQ ID NO: 6095763 - DNA, 20 bp, Homo sapiens
cctagtattcctaacctgtc

SEQ ID NO: 6095764 - DNA, 22 bp, Homo sapiens
cctagtcaaaactatttttgta

SEQ ID NO: 6095765 - DNA, 23 bp, Homo sapiens
cctagtcaaaactatttttgtaa

SEQ ID NO: 6095766 - DNA, 17 bp, Homo sapiens
cctagtcagatggatgt

SEQ ID NO: 6095767 - DNA, 20 bp, Homo sapiens
cctagtcagggcacagctgc

SEQ ID NO: 6095768 - DNA, 18 bp, Homo sapiens
cctagtcccctttcctct

SEQ ID NO: 6095769 - DNA, 13 bp, Homo sapiens
cctagtcccttcc

SEQ ID NO: 6095770 - DNA, 19 bp, Homo sapiens
cctagtcccttccacaccc

SEQ ID NO: 6095771 - DNA, 21 bp, Homo sapiens
cctagtcccttcccctccctg

SEQ ID NO: 6095772 - DNA, 21 bp, Homo sapiens
cctagtcgggcagggcccctg

SEQ ID NO: 6095773 - DNA, 14 bp, Homo sapiens
cctagtctctatca

SEQ ID NO: 6095774 - DNA, 21 bp, Homo sapiens
cctagtctctatcattaaagt

SEQ ID NO: 6095775 - DNA, 21 bp, Homo sapiens
cctagtgaaggcttctctctg

SEQ ID NO: 6095776 - DNA, 15 bp, Homo sapiens
cctagtgacaggttt

SEQ ID NO: 6095777 - DNA, 18 bp, Homo sapiens
cctagtgacccggaggcc

SEQ ID NO: 6095778 - DNA, 20 bp, Homo sapiens
cctagtgacccggaggccac

SEQ ID NO: 6095779 - DNA, 12 bp, Homo sapiens
cctagtgcccca

SEQ ID NO: 6095780 - DNA, 14 bp, Homo sapiens
cctagtgccccaga

SEQ ID NO: 6095781 - DNA, 17 bp, Homo sapiens
cctagtgccccagactg

SEQ ID NO: 6095782 - DNA, 22 bp, Homo sapiens
cctagtgccccagactgagctc

SEQ ID NO: 6095783 - DNA, 20 bp, Homo sapiens
cctagtgctattctgtgttg

SEQ ID NO: 6095784 - DNA, 22 bp, Homo sapiens
cctagtggagttttataaatta

SEQ ID NO: 6095785 - DNA, 20 bp, Homo sapiens
cctagtggatgactgttgat

SEQ ID NO: 6095786 - DNA, 15 bp, Homo sapiens
cctagtggctgtcca

SEQ ID NO: 6095787 - DNA, 16 bp, Homo sapiens
cctagtggctgtccag

SEQ ID NO: 6095788 - DNA, 20 bp, Homo sapiens
cctagtggcttcagcccctg

SEQ ID NO: 6095789 - DNA, 15 bp, Homo sapiens
cctagtggcttcctc

SEQ ID NO: 6095790 - DNA, 17 bp, Homo sapiens
cctagtggcttcctccg

SEQ ID NO: 6095791 - DNA, 19 bp, Homo sapiens
cctagtggcttcctccgtc

SEQ ID NO: 6095792 - DNA, 13 bp, Homo sapiens
cctagtggcttgt

SEQ ID NO: 6095793 - DNA, 21 bp, Homo sapiens
cctagtgggagcccagcacac

SEQ ID NO: 6095794 - DNA, 14 bp, Homo sapiens
cctagtgggagtta

SEQ ID NO: 6095795 - DNA, 12 bp, Homo sapiens
cctagtggggag

SEQ ID NO: 6095796 - DNA, 23 bp, Homo sapiens
cctagtggggaggggcctggcct

SEQ ID NO: 6095797 - DNA, 20 bp, Homo sapiens
cctagtggggtctccctctc

SEQ ID NO: 6095798 - DNA, 21 bp, Homo sapiens
cctagtggggtctccctctcc

SEQ ID NO: 6095799 - DNA, 23 bp, Homo sapiens
cctagtggggtctccctctcctg

SEQ ID NO: 6095800 - DNA, 24 bp, Homo sapiens
cctagtggggtctccctctcctgc

SEQ ID NO: 6095801 - DNA, 22 bp, Homo sapiens
cctagtggtgtcatttttgaat

SEQ ID NO: 6095802 - DNA, 20 bp, Homo sapiens
cctagtgtctattccctgga

SEQ ID NO: 6095803 - DNA, 19 bp, Homo sapiens
cctagttaaagaaaggaaa

SEQ ID NO: 6095804 - DNA, 14 bp, Homo sapiens
cctagttacccacc

SEQ ID NO: 6095805 - DNA, 16 bp, Homo sapiens
cctagttagcatccag

SEQ ID NO: 6095806 - DNA, 18 bp, Homo sapiens
cctagttagcatccaggc

SEQ ID NO: 6095807 - DNA, 21 bp, Homo sapiens
cctagttagcatccaggctgg

SEQ ID NO: 6095808 - DNA, 16 bp, Homo sapiens
cctagttcaggtccaa

SEQ ID NO: 6095809 - DNA, 23 bp, Homo sapiens
cctagttggtgagaaacctgtat

SEQ ID NO: 6095810 - DNA, 13 bp, Homo sapiens
cctagtttcctct

SEQ ID NO: 6095811 - DNA, 15 bp, Homo sapiens
cctagtttcctctcc

SEQ ID NO: 6095812 - DNA, 19 bp, Homo sapiens
cctagtttcttacacactg

SEQ ID NO: 6095813 - DNA, 17 bp, Homo sapiens
cctagtttgacctcaca

SEQ ID NO: 6095814 - DNA, 18 bp, Homo sapiens
cctagttttctcctccca

SEQ ID NO: 6095815 - DNA, 16 bp, Homo sapiens
cctagttttctttcct

SEQ ID NO: 6095816 - DNA, 12 bp, Homo sapiens
cctataaaacag

SEQ ID NO: 6095817 - DNA, 20 bp, Homo sapiens
cctataaaacaggtcaatac

SEQ ID NO: 6095818 - DNA, 11 bp, Homo sapiens
cctataaaatc

SEQ ID NO: 6095819 - DNA, 18 bp, Homo sapiens
cctataaaatcaaagaaa

SEQ ID NO: 6095820 - DNA, 15 bp, Homo sapiens
cctataaagggccca

SEQ ID NO: 6095821 - DNA, 19 bp, Homo sapiens
cctataaagtgcctcggac

SEQ ID NO: 6095822 - DNA, 11 bp, Homo sapiens
cctataaatgg

SEQ ID NO: 6095823 - DNA, 17 bp, Homo sapiens
cctataacccctgcctg

SEQ ID NO: 6095824 - DNA, 19 bp, Homo sapiens
cctataacccctgcctgga

SEQ ID NO: 6095825 - DNA, 17 bp, Homo sapiens
cctataacctgtaggaa

SEQ ID NO: 6095826 - DNA, 15 bp, Homo sapiens
cctataacttcttcc

SEQ ID NO: 6095827 - DNA, 16 bp, Homo sapiens
cctataacttcttcct

SEQ ID NO: 6095828 - DNA, 18 bp, Homo sapiens
cctataacttcttcctgc

SEQ ID NO: 6095829 - DNA, 19 bp, Homo sapiens
cctataacttcttcctgct

SEQ ID NO: 6095830 - DNA, 22 bp, Homo sapiens
cctataacttcttcctgctgga

SEQ ID NO: 6095831 - DNA, 18 bp, Homo sapiens
cctataacttgatgcatg

SEQ ID NO: 6095832 - DNA, 14 bp, Homo sapiens
cctataagaagcct

SEQ ID NO: 6095833 - DNA, 16 bp, Homo sapiens
cctataagaagcctta

SEQ ID NO: 6095834 - DNA, 22 bp, Homo sapiens
cctataaggagagttcaagcct

SEQ ID NO: 6095835 - DNA, 17 bp, Homo sapiens
cctataataaaatggca

SEQ ID NO: 6095836 - DNA, 22 bp, Homo sapiens
cctataataaaatggcaccttc

SEQ ID NO: 6095837 - DNA, 16 bp, Homo sapiens
cctataataaaggctg

SEQ ID NO: 6095838 - DNA, 18 bp, Homo sapiens
cctataatccttgataat

SEQ ID NO: 6095839 - DNA, 14 bp, Homo sapiens
cctataatgtgtgt

SEQ ID NO: 6095840 - DNA, 21 bp, Homo sapiens
cctataatgtgtgtatgtgta

SEQ ID NO: 6095841 - DNA, 21 bp, Homo sapiens
cctatacagaacagagggcca

SEQ ID NO: 6095842 - DNA, 17 bp, Homo sapiens
cctatacccagcagagg

SEQ ID NO: 6095843 - DNA, 23 bp, Homo sapiens
cctataccccttacttagcatgc

SEQ ID NO: 6095844 - DNA, 16 bp, Homo sapiens
cctataccgagaccca

SEQ ID NO: 6095845 - DNA, 23 bp, Homo sapiens
cctataccgagacccaccatcct

SEQ ID NO: 6095846 - DNA, 22 bp, Homo sapiens
cctatacgcagcgtgctttaaa

SEQ ID NO: 6095847 - DNA, 20 bp, Homo sapiens
cctatacgtttctgtggagt

SEQ ID NO: 6095848 - DNA, 23 bp, Homo sapiens
cctatagaaatagaacactgcct

SEQ ID NO: 6095849 - DNA, 14 bp, Homo sapiens
cctatagagaaacc

SEQ ID NO: 6095850 - DNA, 13 bp, Homo sapiens
cctatagagaggg

SEQ ID NO: 6095851 - DNA, 16 bp, Homo sapiens
cctatagctacatgtt

SEQ ID NO: 6095852 - DNA, 20 bp, Homo sapiens
cctatagctacatgttcttt

SEQ ID NO: 6095853 - DNA, 20 bp, Homo sapiens
cctataggaaagtctgtcag

SEQ ID NO: 6095854 - DNA, 19 bp, Homo sapiens
cctataggaacagcccagc

SEQ ID NO: 6095855 - DNA, 17 bp, Homo sapiens
cctatagtcccactact

SEQ ID NO: 6095856 - DNA, 14 bp, Homo sapiens
cctatagtcccagc

SEQ ID NO: 6095857 - DNA, 18 bp, Homo sapiens
cctatataataaagctac

SEQ ID NO: 6095858 - DNA, 13 bp, Homo sapiens
cctatatatttct

SEQ ID NO: 6095859 - DNA, 17 bp, Homo sapiens
cctatatcagtcgtttt

SEQ ID NO: 6095860 - DNA, 17 bp, Homo sapiens
cctatatcctccttctc

SEQ ID NO: 6095861 - DNA, 16 bp, Homo sapiens
cctatatcctgtgact

SEQ ID NO: 6095862 - DNA, 14 bp, Homo sapiens
cctatatctgagag

SEQ ID NO: 6095863 - DNA, 16 bp, Homo sapiens
cctatatctggagtga

SEQ ID NO: 6095864 - DNA, 15 bp, Homo sapiens
cctatatctgtttgt

SEQ ID NO: 6095865 - DNA, 20 bp, Homo sapiens
cctatatctgtttgtatatt

SEQ ID NO: 6095866 - DNA, 15 bp, Homo sapiens
cctatatcttacaaa

SEQ ID NO: 6095867 - DNA, 22 bp, Homo sapiens
cctatatcttacaaaatacaca

SEQ ID NO: 6095868 - DNA, 15 bp, Homo sapiens
cctatatgagaagaa

SEQ ID NO: 6095869 - DNA, 18 bp, Homo sapiens
cctatatgatttatagtt

SEQ ID NO: 6095870 - DNA, 14 bp, Homo sapiens
cctatatgtagtat

SEQ ID NO: 6095871 - DNA, 13 bp, Homo sapiens
cctatatttacag

SEQ ID NO: 6095872 - DNA, 24 bp, Homo sapiens
cctatatttacagtgaaaatgtaa

SEQ ID NO: 6095873 - DNA, 14 bp, Homo sapiens
cctatatttcctct

SEQ ID NO: 6095874 - DNA, 16 bp, Homo sapiens
cctatatttcctcttc

SEQ ID NO: 6095875 - DNA, 14 bp, Homo sapiens
cctatattttcctg

SEQ ID NO: 6095876 - DNA, 15 bp, Homo sapiens
cctatcaaaacatat

SEQ ID NO: 6095877 - DNA, 18 bp, Homo sapiens
cctatcaaaacatatcaa

SEQ ID NO: 6095878 - DNA, 15 bp, Homo sapiens
cctatcacctcccct

SEQ ID NO: 6095879 - DNA, 18 bp, Homo sapiens
cctatcacctcccctcct

SEQ ID NO: 6095880 - DNA, 17 bp, Homo sapiens
cctatcacttacatttt

SEQ ID NO: 6095881 - DNA, 14 bp, Homo sapiens
cctatcagagaagc

SEQ ID NO: 6095882 - DNA, 20 bp, Homo sapiens
cctatcagagttgctgcaaa

SEQ ID NO: 6095883 - DNA, 16 bp, Homo sapiens
cctatcaggtgcccct

SEQ ID NO: 6095884 - DNA, 19 bp, Homo sapiens
cctatcaggtgcccctctt

SEQ ID NO: 6095885 - DNA, 12 bp, Homo sapiens
cctatcagtgtg

SEQ ID NO: 6095886 - DNA, 16 bp, Homo sapiens
cctatcagtgtgcccc

SEQ ID NO: 6095887 - DNA, 13 bp, Homo sapiens
cctatcatttatt

SEQ ID NO: 6095888 - DNA, 18 bp, Homo sapiens
cctatccaccaccccacc

SEQ ID NO: 6095889 - DNA, 13 bp, Homo sapiens
cctatccacccag

SEQ ID NO: 6095890 - DNA, 17 bp, Homo sapiens
cctatccacccagccca

SEQ ID NO: 6095891 - DNA, 14 bp, Homo sapiens
cctatcccaaacct

SEQ ID NO: 6095892 - DNA, 15 bp, Homo sapiens
cctatcccattctgc

SEQ ID NO: 6095893 - DNA, 16 bp, Homo sapiens
cctatccccaggccag

SEQ ID NO: 6095894 - DNA, 18 bp, Homo sapiens
cctatccccaggccaggt

SEQ ID NO: 6095895 - DNA, 19 bp, Homo sapiens
cctatccccaggccaggtc

SEQ ID NO: 6095896 - DNA, 14 bp, Homo sapiens
cctatccctctcct

SEQ ID NO: 6095897 - DNA, 17 bp, Homo sapiens
cctatccgctgccagcc

SEQ ID NO: 6095898 - DNA, 15 bp, Homo sapiens
cctatcctccccttt

SEQ ID NO: 6095899 - DNA, 12 bp, Homo sapiens
cctatcctctgt

SEQ ID NO: 6095900 - DNA, 16 bp, Homo sapiens
cctatcctgcaccctc

SEQ ID NO: 6095901 - DNA, 17 bp, Homo sapiens
cctatcctgcaccctct

SEQ ID NO: 6095902 - DNA, 18 bp, Homo sapiens
cctatcctgcaccctctg

SEQ ID NO: 6095903 - DNA, 16 bp, Homo sapiens
cctatcctgttcttcc

SEQ ID NO: 6095904 - DNA, 16 bp, Homo sapiens
cctatctagcatttat

SEQ ID NO: 6095905 - DNA, 16 bp, Homo sapiens
cctatctatcttccaa

SEQ ID NO: 6095906 - DNA, 21 bp, Homo sapiens
cctatctatcttccaaatgca

SEQ ID NO: 6095907 - DNA, 17 bp, Homo sapiens
cctatctatgaacaaca

SEQ ID NO: 6095908 - DNA, 20 bp, Homo sapiens
cctatctattaaagtgactt

SEQ ID NO: 6095909 - DNA, 13 bp, Homo sapiens
cctatctcaggga

SEQ ID NO: 6095910 - DNA, 14 bp, Homo sapiens
cctatctcccacaa

SEQ ID NO: 6095911 - DNA, 16 bp, Homo sapiens
cctatctcccccaacc

SEQ ID NO: 6095912 - DNA, 21 bp, Homo sapiens
cctatctcccccaacccacct

SEQ ID NO: 6095913 - DNA, 14 bp, Homo sapiens
cctatctccttccc

SEQ ID NO: 6095914 - DNA, 16 bp, Homo sapiens
cctatctccttcccac

SEQ ID NO: 6095915 - DNA, 17 bp, Homo sapiens
cctatctcgtgggagag

SEQ ID NO: 6095916 - DNA, 18 bp, Homo sapiens
cctatctcttcctgtcta

SEQ ID NO: 6095917 - DNA, 12 bp, Homo sapiens
cctatctgactt

SEQ ID NO: 6095918 - DNA, 15 bp, Homo sapiens
cctatctgcctggag

SEQ ID NO: 6095919 - DNA, 16 bp, Homo sapiens
cctatctgcctggagg

SEQ ID NO: 6095920 - DNA, 12 bp, Homo sapiens
cctatctgggct

SEQ ID NO: 6095921 - DNA, 18 bp, Homo sapiens
cctatctgggcttcctgg

SEQ ID NO: 6095922 - DNA, 16 bp, Homo sapiens
cctatctggggagctc

SEQ ID NO: 6095923 - DNA, 19 bp, Homo sapiens
cctatctggggagctcctg

SEQ ID NO: 6095924 - DNA, 21 bp, Homo sapiens
cctatctggggagctcctggc

SEQ ID NO: 6095925 - DNA, 19 bp, Homo sapiens
ccttgctcttctttctgag

SEQ ID NO: 6095926 - DNA, 19 bp, Homo sapiens
ccttgctgacaataaagat

SEQ ID NO: 6095927 - DNA, 13 bp, Homo sapiens
ccttgctgactct

SEQ ID NO: 6095928 - DNA, 21 bp, Homo sapiens
ccttgctgagtggcgcaaggc

SEQ ID NO: 6095929 - DNA, 22 bp, Homo sapiens
ccttgctgagtggcgcaaggcc

SEQ ID NO: 6095930 - DNA, 16 bp, Homo sapiens
ccttgctgatggcttg

SEQ ID NO: 6095931 - DNA, 17 bp, Homo sapiens
ccttgctgatggcttga

SEQ ID NO: 6095932 - DNA, 18 bp, Homo sapiens
ccttgctgcacctgaggc

SEQ ID NO: 6095933 - DNA, 15 bp, Homo sapiens
ccttgctgcagcttc

SEQ ID NO: 6095934 - DNA, 15 bp, Homo sapiens
ccttgctgccaagtc

SEQ ID NO: 6095935 - DNA, 24 bp, Homo sapiens
ccttgctgccaagtcctgcctttg

SEQ ID NO: 6095936 - DNA, 11 bp, Homo sapiens
ccttgctgccc

SEQ ID NO: 6095937 - DNA, 23 bp, Homo sapiens
ccttgctgcccgcgggagacagc

SEQ ID NO: 6095938 - DNA, 12 bp, Homo sapiens
ccttgctgctgc

SEQ ID NO: 6095939 - DNA, 14 bp, Homo sapiens
ccttgctgctgccc

SEQ ID NO: 6095940 - DNA, 13 bp, Homo sapiens
ccttgctgctggc

SEQ ID NO: 6095941 - DNA, 16 bp, Homo sapiens
ccttgctgctggctcc

SEQ ID NO: 6095942 - DNA, 22 bp, Homo sapiens
ccttgctgctggctcccatctc

SEQ ID NO: 6095943 - DNA, 22 bp, Homo sapiens
ccttgctggacggggactgggg

SEQ ID NO: 6095944 - DNA, 20 bp, Homo sapiens
ccttgctggatgctgctgta

SEQ ID NO: 6095945 - DNA, 12 bp, Homo sapiens
ccttgctgggcc

SEQ ID NO: 6095946 - DNA, 17 bp, Homo sapiens
ccttgctgggcctgggg

SEQ ID NO: 6095947 - DNA, 20 bp, Homo sapiens
ccttgctgggcctgggggtt

SEQ ID NO: 6095948 - DNA, 17 bp, Homo sapiens
ccttgctggggtccagg

SEQ ID NO: 6095949 - DNA, 21 bp, Homo sapiens
ccttgctggggtccagggctg

SEQ ID NO: 6095950 - DNA, 14 bp, Homo sapiens
ccttgctgtagaga

SEQ ID NO: 6095951 - DNA, 18 bp, Homo sapiens
ccttgctgtagagacttc

SEQ ID NO: 6095952 - DNA, 19 bp, Homo sapiens
ccttgctgtagagacttcc

SEQ ID NO: 6095953 - DNA, 20 bp, Homo sapiens
ccttgctgtagagacttccg

SEQ ID NO: 6095954 - DNA, 16 bp, Homo sapiens
ccttgctgtcctaggc

SEQ ID NO: 6095955 - DNA, 14 bp, Homo sapiens
ccttgctgtcctga

SEQ ID NO: 6095956 - DNA, 23 bp, Homo sapiens
ccttgctgttcttgaagctgggc

SEQ ID NO: 6095957 - DNA, 18 bp, Homo sapiens
ccttgctgttttttggag

SEQ ID NO: 6095958 - DNA, 16 bp, Homo sapiens
ccttgcttacctctca

SEQ ID NO: 6095959 - DNA, 16 bp, Homo sapiens
ccttgcttagcctgtg

SEQ ID NO: 6095960 - DNA, 14 bp, Homo sapiens
ccttgcttcacttt

SEQ ID NO: 6095961 - DNA, 15 bp, Homo sapiens
ccttgcttccttctc

SEQ ID NO: 6095962 - DNA, 17 bp, Homo sapiens
ccttgcttccttctcat

SEQ ID NO: 6095963 - DNA, 22 bp, Homo sapiens
ccttgcttccttctcatcttgc

SEQ ID NO: 6095964 - DNA, 17 bp, Homo sapiens
ccttgcttctaagggat

SEQ ID NO: 6095965 - DNA, 22 bp, Homo sapiens
ccttgcttctaagggatccaga

SEQ ID NO: 6095966 - DNA, 11 bp, Homo sapiens
ccttgcttctc

SEQ ID NO: 6095967 - DNA, 12 bp, Homo sapiens
ccttgcttctct

SEQ ID NO: 6095968 - DNA, 20 bp, Homo sapiens
ccttgcttctcttctttcca

SEQ ID NO: 6095969 - DNA, 12 bp, Homo sapiens
ccttgcttctgt

SEQ ID NO: 6095970 - DNA, 16 bp, Homo sapiens
ccttgcttgcctgcag

SEQ ID NO: 6095971 - DNA, 18 bp, Homo sapiens
ccttgcttgtatgatcgt

SEQ ID NO: 6095972 - DNA, 22 bp, Homo sapiens
ccttgctttacaaaccaaccat

SEQ ID NO: 6095973 - DNA, 18 bp, Homo sapiens
ccttgctttcctgggcct

SEQ ID NO: 6095974 - DNA, 15 bp, Homo sapiens
ccttgctttcggagc

SEQ ID NO: 6095975 - DNA, 20 bp, Homo sapiens
ccttgctttcggagctcctg

SEQ ID NO: 6095976 - DNA, 23 bp, Homo sapiens
ccttgctttgagactcctcagca

SEQ ID NO: 6095977 - DNA, 22 bp, Homo sapiens
ccttgctttgggctttgcaggc

SEQ ID NO: 6095978 - DNA, 20 bp, Homo sapiens
ccttgctttgtctggcctca

SEQ ID NO: 6095979 - DNA, 15 bp, Homo sapiens
ccttgcttttatagt

SEQ ID NO: 6095980 - DNA, 13 bp, Homo sapiens
ccttgcttttgct

SEQ ID NO: 6095981 - DNA, 20 bp, Homo sapiens
ccttggaaacagttggcact

SEQ ID NO: 6095982 - DNA, 11 bp, Homo sapiens
ccttggaaacc

SEQ ID NO: 6095983 - DNA, 17 bp, Homo sapiens
ccttggaaacctgccct

SEQ ID NO: 6095984 - DNA, 20 bp, Homo sapiens
ccttggaaacctgccctgcc

SEQ ID NO: 6095985 - DNA, 18 bp, Homo sapiens
ccttggaaatagaaagaa

SEQ ID NO: 6095986 - DNA, 22 bp, Homo sapiens
ccttggaaatagaaagaagcca

SEQ ID NO: 6095987 - DNA, 23 bp, Homo sapiens
ccttggaaatagaaagaagccat

SEQ ID NO: 6095988 - DNA, 11 bp, Homo sapiens
ccttggaaatg

SEQ ID NO: 6095989 - DNA, 17 bp, Homo sapiens
ccttggaaatgtctgct

SEQ ID NO: 6095990 - DNA, 18 bp, Homo sapiens
ccttggaaatgtctgctg

SEQ ID NO: 6095991 - DNA, 17 bp, Homo sapiens
ccttggaaccagcccca

SEQ ID NO: 6095992 - DNA, 16 bp, Homo sapiens
ccttggaatatggcca

SEQ ID NO: 6095993 - DNA, 18 bp, Homo sapiens
ccttggacaacttttctc

SEQ ID NO: 6095994 - DNA, 16 bp, Homo sapiens
ccttggacaccatccc

SEQ ID NO: 6095995 - DNA, 16 bp, Homo sapiens
ccttggacacgctcag

SEQ ID NO: 6095996 - DNA, 20 bp, Homo sapiens
ccttggacattttatgtctt

SEQ ID NO: 6095997 - DNA, 14 bp, Homo sapiens
ccttggacctccag

SEQ ID NO: 6095998 - DNA, 20 bp, Homo sapiens
ccttggacggggacacggcc

SEQ ID NO: 6095999 - DNA, 21 bp, Homo sapiens
ccttggacggggacacggcct

SEQ ID NO: 6096000 - DNA, 16 bp, Homo sapiens
ccttggactccatcgc

SEQ ID NO: 6096001 - DNA, 23 bp, Homo sapiens
ccttggagaactcggtttggtag

SEQ ID NO: 6096002 - DNA, 17 bp, Homo sapiens
ccttggagagacacagc

SEQ ID NO: 6096003 - DNA, 17 bp, Homo sapiens
ccttggagagcagctgg

SEQ ID NO: 6096004 - DNA, 23 bp, Homo sapiens
ccttggagattagcccttccttg

SEQ ID NO: 6096005 - DNA, 13 bp, Homo sapiens
ccttggagcagaa

SEQ ID NO: 6096006 - DNA, 22 bp, Homo sapiens
ccttggagcagaaagccagggt

SEQ ID NO: 6096007 - DNA, 12 bp, Homo sapiens
ccttggagcatt

SEQ ID NO: 6096008 - DNA, 14 bp, Homo sapiens
ccttggagcattta

SEQ ID NO: 6096009 - DNA, 13 bp, Homo sapiens
ccttggagccccg

SEQ ID NO: 6096010 - DNA, 16 bp, Homo sapiens
ccttggaggacagtgg

SEQ ID NO: 6096011 - DNA, 15 bp, Homo sapiens
ccttggaggagagag

SEQ ID NO: 6096012 - DNA, 17 bp, Homo sapiens
ccttggaggagagagac

SEQ ID NO: 6096013 - DNA, 18 bp, Homo sapiens
ccttggaggagagagacc

SEQ ID NO: 6096014 - DNA, 12 bp, Homo sapiens
ccttggaggcca

SEQ ID NO: 6096015 - DNA, 16 bp, Homo sapiens
ccttggaggccttccc

SEQ ID NO: 6096016 - DNA, 18 bp, Homo sapiens
ccttggaggctgtcttct

SEQ ID NO: 6096017 - DNA, 14 bp, Homo sapiens
ccttggagggagag

SEQ ID NO: 6096018 - DNA, 22 bp, Homo sapiens
ccttggagggagaggtggcagg

SEQ ID NO: 6096019 - DNA, 11 bp, Homo sapiens
ccttggagtga

SEQ ID NO: 6096020 - DNA, 22 bp, Homo sapiens
ccttggagtgctgcagctttgg

SEQ ID NO: 6096021 - DNA, 18 bp, Homo sapiens
ccttggataatgctgttg

SEQ ID NO: 6096022 - DNA, 20 bp, Homo sapiens
ccttggatcaagcagaaaac

SEQ ID NO: 6096023 - DNA, 16 bp, Homo sapiens
ccttggatcagaggtc

SEQ ID NO: 6096024 - DNA, 22 bp, Homo sapiens
ccttggatcgctaagctggctc

SEQ ID NO: 6096025 - DNA, 15 bp, Homo sapiens
ccttggatggcacca

SEQ ID NO: 6096026 - DNA, 16 bp, Homo sapiens
ccttggattcctgcac

SEQ ID NO: 6096027 - DNA, 15 bp, Homo sapiens
ccttggattgtcccc

SEQ ID NO: 6096028 - DNA, 23 bp, Homo sapiens
ccttggatttctgaatggctgca

SEQ ID NO: 6096029 - DNA, 20 bp, Homo sapiens
ccttggatttgcatttttgt

SEQ ID NO: 6096030 - DNA, 11 bp, Homo sapiens
ccttggcacca

SEQ ID NO: 6096031 - DNA, 14 bp, Homo sapiens
ccttggcaccacca

SEQ ID NO: 6096032 - DNA, 15 bp, Homo sapiens
ccttggcaccaccag

SEQ ID NO: 6096033 - DNA, 22 bp, Homo sapiens
ccttggcacccccatgctgcct

SEQ ID NO: 6096034 - DNA, 22 bp, Homo sapiens
ccttggcacgaggggggccagg

SEQ ID NO: 6096035 - DNA, 18 bp, Homo sapiens
ccttggcaggctgctgga

SEQ ID NO: 6096036 - DNA, 22 bp, Homo sapiens
ccttggcagtgtcccagggccc

SEQ ID NO: 6096037 - DNA, 19 bp, Homo sapiens
ccttggcatcacagggcag

SEQ ID NO: 6096038 - DNA, 17 bp, Homo sapiens
ccttggcatgggcgcag

SEQ ID NO: 6096039 - DNA, 22 bp, Homo sapiens
ccttggcatgggcgcaggccca

SEQ ID NO: 6096040 - DNA, 17 bp, Homo sapiens
ccttggccaagagaagg

SEQ ID NO: 6096041 - DNA, 16 bp, Homo sapiens
ccttggccacggcctg

SEQ ID NO: 6096042 - DNA, 16 bp, Homo sapiens
ccttggcccacctgag

SEQ ID NO: 6096043 - DNA, 13 bp, Homo sapiens
ccttggcccagag

SEQ ID NO: 6096044 - DNA, 13 bp, Homo sapiens
ccttggcccagca

SEQ ID NO: 6096045 - DNA, 15 bp, Homo sapiens
ccttggcccaggagc

SEQ ID NO: 6096046 - DNA, 15 bp, Homo sapiens
ccttggcccctcaca

SEQ ID NO: 6096047 - DNA, 23 bp, Homo sapiens
ccttggcccctcacatcctctcc

SEQ ID NO: 6096048 - DNA, 22 bp, Homo sapiens
ccttggcccctccctcccggct

SEQ ID NO: 6096049 - DNA, 13 bp, Homo sapiens
ccttggcccctcg

SEQ ID NO: 6096050 - DNA, 14 bp, Homo sapiens
ccttggcccctctc

SEQ ID NO: 6096051 - DNA, 15 bp, Homo sapiens
ccttggcccctctct

SEQ ID NO: 6096052 - DNA, 18 bp, Homo sapiens
ccttggcccctctctgtt

SEQ ID NO: 6096053 - DNA, 15 bp, Homo sapiens
ccttggccctacagc

SEQ ID NO: 6096054 - DNA, 17 bp, Homo sapiens
ccttggccctacagccc

SEQ ID NO: 6096055 - DNA, 15 bp, Homo sapiens
ccttggccgcaccta

SEQ ID NO: 6096056 - DNA, 16 bp, Homo sapiens
ccttggccggctgtgc

SEQ ID NO: 6096057 - DNA, 20 bp, Homo sapiens
ccttggccggctgtgctcag

SEQ ID NO: 6096058 - DNA, 21 bp, Homo sapiens
ccttggccggctgtgctcaga

SEQ ID NO: 6096059 - DNA, 12 bp, Homo sapiens
ccttggcctccc

SEQ ID NO: 6096060 - DNA, 17 bp, Homo sapiens
ccttggcctcccaaagt

SEQ ID NO: 6096061 - DNA, 19 bp, Homo sapiens
ccttggcctcggcgggctt

SEQ ID NO: 6096062 - DNA, 12 bp, Homo sapiens
ccttggcctgga

SEQ ID NO: 6096063 - DNA, 13 bp, Homo sapiens
ccttggcctggag

SEQ ID NO: 6096064 - DNA, 21 bp, Homo sapiens
ccttggcctggagcacaaaga

SEQ ID NO: 6096065 - DNA, 23 bp, Homo sapiens
ccttggcctgtctcatccccagg

SEQ ID NO: 6096066 - DNA, 13 bp, Homo sapiens
ccttggccttctc

SEQ ID NO: 6096067 - DNA, 23 bp, Homo sapiens
ccttggccttctcccctcttctg

SEQ ID NO: 6096068 - DNA, 13 bp, Homo sapiens
ccttggccttgca

SEQ ID NO: 6096069 - DNA, 17 bp, Homo sapiens
ccttggccttgcagctg

SEQ ID NO: 6096070 - DNA, 20 bp, Homo sapiens
ccttggcgctctcagctttc

SEQ ID NO: 6096071 - DNA, 20 bp, Homo sapiens
ccttggcgggcagcccagcc

SEQ ID NO: 6096072 - DNA, 22 bp, Homo sapiens
ccttggcgggcagcccagcctc

SEQ ID NO: 6096073 - DNA, 18 bp, Homo sapiens
ccttggcgtgtgtccctg

SEQ ID NO: 6096074 - DNA, 22 bp, Homo sapiens
ccttggctcccgggggccccac

SEQ ID NO: 6096075 - DNA, 20 bp, Homo sapiens
ccttggctgacatgaagctg

SEQ ID NO: 6096076 - DNA, 13 bp, Homo sapiens
ccttggctgcagc

SEQ ID NO: 6096077 - DNA, 17 bp, Homo sapiens
ccttggctgcagccatc

SEQ ID NO: 6096078 - DNA, 18 bp, Homo sapiens
ccttggctgcagccatcc

SEQ ID NO: 6096079 - DNA, 19 bp, Homo sapiens
ccttggctgcaggcaacac

SEQ ID NO: 6096080 - DNA, 21 bp, Homo sapiens
ccttggctgtgaggcccctgg

SEQ ID NO: 6096081 - DNA, 18 bp, Homo sapiens
ccttggcttacctgacct

SEQ ID NO: 6096082 - DNA, 11 bp, Homo sapiens
ccttggcttct

SEQ ID NO: 6096083 - DNA, 19 bp, Homo sapiens
ccttggcttgcctggtggg

SEQ ID NO: 6096084 - DNA, 15 bp, Homo sapiens
ccttggcttgtgtta

SEQ ID NO: 6096085 - DNA, 13 bp, Homo sapiens
ccttggcttgtta

SEQ ID NO: 6096086 - DNA, 19 bp, Homo sapiens
ccttggctttcagagccag

SEQ ID NO: 6096087 - DNA, 22 bp, Homo sapiens
ccttggctttcagagccagcct

SEQ ID NO: 6096088 - DNA, 22 bp, Homo sapiens
ccttggctttgaggccgaagct

SEQ ID NO: 6096089 - DNA, 22 bp, Homo sapiens
ccttggcttttgcttggcagag

SEQ ID NO: 6096090 - DNA, 15 bp, Homo sapiens
ccttgggaaggacac

SEQ ID NO: 6096091 - DNA, 16 bp, Homo sapiens
ccttgggaaggacaca

SEQ ID NO: 6096092 - DNA, 15 bp, Homo sapiens
ccttgggagaactaa

SEQ ID NO: 6096093 - DNA, 19 bp, Homo sapiens
ccttgggagccactgccac

SEQ ID NO: 6096094 - DNA, 20 bp, Homo sapiens
ccttgggaggaagcagaata

SEQ ID NO: 6096095 - DNA, 21 bp, Homo sapiens
ccttgggaggaagcagaataa

SEQ ID NO: 6096096 - DNA, 23 bp, Homo sapiens
ccttgggaggaagcagaataaag

SEQ ID NO: 6096097 - DNA, 19 bp, Homo sapiens
ccttgggaggccccactgg

SEQ ID NO: 6096098 - DNA, 20 bp, Homo sapiens
ccttgggaggccccactggg

SEQ ID NO: 6096099 - DNA, 22 bp, Homo sapiens
ccttgggatagcaaactccagg

SEQ ID NO: 6096100 - DNA, 19 bp, Homo sapiens
ccttgggatgggcacaggc

SEQ ID NO: 6096101 - DNA, 15 bp, Homo sapiens
ccttgggcacatctg

SEQ ID NO: 6096102 - DNA, 11 bp, Homo sapiens
ccttgggcagt

SEQ ID NO: 6096103 - DNA, 22 bp, Homo sapiens
cctatctgtttacagtgttccg

SEQ ID NO: 6096104 - DNA, 19 bp, Homo sapiens
cctatcttttatttcattc

SEQ ID NO: 6096105 - DNA, 20 bp, Homo sapiens
cctatgaaactggtttataa

SEQ ID NO: 6096106 - DNA, 14 bp, Homo sapiens
cctatgaaagcaac

SEQ ID NO: 6096107 - DNA, 20 bp, Homo sapiens
cctatgaagtttattttcta

SEQ ID NO: 6096108 - DNA, 16 bp, Homo sapiens
cctatgaatgctttgc

SEQ ID NO: 6096109 - DNA, 13 bp, Homo sapiens
cctatgacacagt

SEQ ID NO: 6096110 - DNA, 20 bp, Homo sapiens
cctatgacattactgtattt

SEQ ID NO: 6096111 - DNA, 17 bp, Homo sapiens
cctatgaccctgtgcct

SEQ ID NO: 6096112 - DNA, 17 bp, Homo sapiens
cctatgagatggccatg

SEQ ID NO: 6096113 - DNA, 20 bp, Homo sapiens
cctatgagatggccatgctc

SEQ ID NO: 6096114 - DNA, 22 bp, Homo sapiens
cctatgagggtgagctggtccc

SEQ ID NO: 6096115 - DNA, 15 bp, Homo sapiens
cctatgatcccagca

SEQ ID NO: 6096116 - DNA, 14 bp, Homo sapiens
cctatgatgtatac

SEQ ID NO: 6096117 - DNA, 19 bp, Homo sapiens
cctatgcactgaagagctc

SEQ ID NO: 6096118 - DNA, 19 bp, Homo sapiens
cctatgcagacatctctgg

SEQ ID NO: 6096119 - DNA, 16 bp, Homo sapiens
cctatgccacctgcag

SEQ ID NO: 6096120 - DNA, 18 bp, Homo sapiens
cctatgccacctgcagcg

SEQ ID NO: 6096121 - DNA, 19 bp, Homo sapiens
cctatgccacctgcagcgt

SEQ ID NO: 6096122 - DNA, 15 bp, Homo sapiens
cctatgcccaggtac

SEQ ID NO: 6096123 - DNA, 21 bp, Homo sapiens
cctatgcccaggtaccaccct

SEQ ID NO: 6096124 - DNA, 20 bp, Homo sapiens
cctatgccctgcccttcctc

SEQ ID NO: 6096125 - DNA, 13 bp, Homo sapiens
cctatgcctgtgg

SEQ ID NO: 6096126 - DNA, 15 bp, Homo sapiens
cctatgcctgtggtg

SEQ ID NO: 6096127 - DNA, 16 bp, Homo sapiens
cctatgccttcaaata

SEQ ID NO: 6096128 - DNA, 21 bp, Homo sapiens
cctatgctattgacaataaaa

SEQ ID NO: 6096129 - DNA, 22 bp, Homo sapiens
cctatgctattgacaataaaat

SEQ ID NO: 6096130 - DNA, 19 bp, Homo sapiens
cctatgctggtagatgctg

SEQ ID NO: 6096131 - DNA, 13 bp, Homo sapiens
cctatggaaaaaa

SEQ ID NO: 6096132 - DNA, 13 bp, Homo sapiens
cctatggaaacat

SEQ ID NO: 6096133 - DNA, 14 bp, Homo sapiens
cctatggaatttat

SEQ ID NO: 6096134 - DNA, 16 bp, Homo sapiens
cctatggaatttataa

SEQ ID NO: 6096135 - DNA, 15 bp, Homo sapiens
cctatggagagccct

SEQ ID NO: 6096136 - DNA, 22 bp, Homo sapiens
cctatggagagccctgggaccg

SEQ ID NO: 6096137 - DNA, 11 bp, Homo sapiens
cctatggatgt

SEQ ID NO: 6096138 - DNA, 14 bp, Homo sapiens
cctatggcccagcc

SEQ ID NO: 6096139 - DNA, 18 bp, Homo sapiens
cctatggcccagccactg

SEQ ID NO: 6096140 - DNA, 18 bp, Homo sapiens
cctatggctggccactgc

SEQ ID NO: 6096141 - DNA, 18 bp, Homo sapiens
cctatgggagtcaagtgt

SEQ ID NO: 6096142 - DNA, 17 bp, Homo sapiens
cctatggggatggtcca

SEQ ID NO: 6096143 - DNA, 17 bp, Homo sapiens
cctatgtacagagcttt

SEQ ID NO: 6096144 - DNA, 23 bp, Homo sapiens
cctatgtactctacgccaaagtg

SEQ ID NO: 6096145 - DNA, 15 bp, Homo sapiens
cctatgtacttgaaa

SEQ ID NO: 6096146 - DNA, 17 bp, Homo sapiens
cctatgtatatcttcta

SEQ ID NO: 6096147 - DNA, 22 bp, Homo sapiens
cctatgtcctaaggacacacta

SEQ ID NO: 6096148 - DNA, 17 bp, Homo sapiens
cctatgtgagtttcaga

SEQ ID NO: 6096149 - DNA, 18 bp, Homo sapiens
cctatgtgagtttcagaa

SEQ ID NO: 6096150 - DNA, 14 bp, Homo sapiens
cctatgtggcagct

SEQ ID NO: 6096151 - DNA, 15 bp, Homo sapiens
cctatgtggcagctg

SEQ ID NO: 6096152 - DNA, 12 bp, Homo sapiens
cctatgttattt

SEQ ID NO: 6096153 - DNA, 20 bp, Homo sapiens
cctatgttgatccatccagc

SEQ ID NO: 6096154 - DNA, 18 bp, Homo sapiens
cctatgttgcccaggctg

SEQ ID NO: 6096155 - DNA, 22 bp, Homo sapiens
cctatgttgggggggaccctgc

SEQ ID NO: 6096156 - DNA, 19 bp, Homo sapiens
cctatgttgtaattttact

SEQ ID NO: 6096157 - DNA, 21 bp, Homo sapiens
cctatgttgtaattttacttt

SEQ ID NO: 6096158 - DNA, 16 bp, Homo sapiens
cctattaacctagaga

SEQ ID NO: 6096159 - DNA, 20 bp, Homo sapiens
cctattaatgtctcacttta

SEQ ID NO: 6096160 - DNA, 17 bp, Homo sapiens
cctattagagaagagat

SEQ ID NO: 6096161 - DNA, 15 bp, Homo sapiens
cctattaggtggaaa

SEQ ID NO: 6096162 - DNA, 22 bp, Homo sapiens
cctattaggtggaaattttata

SEQ ID NO: 6096163 - DNA, 16 bp, Homo sapiens
cctattagtgttatat

SEQ ID NO: 6096164 - DNA, 12 bp, Homo sapiens
cctattatccca

SEQ ID NO: 6096165 - DNA, 17 bp, Homo sapiens
cctattatcccagctgc

SEQ ID NO: 6096166 - DNA, 15 bp, Homo sapiens
cctattcaccctcca

SEQ ID NO: 6096167 - DNA, 21 bp, Homo sapiens
cctattcagttcccagaatca

SEQ ID NO: 6096168 - DNA, 21 bp, Homo sapiens
cctattccaggaattcctctt

SEQ ID NO: 6096169 - DNA, 15 bp, Homo sapiens
cctattcctcctggg

SEQ ID NO: 6096170 - DNA, 18 bp, Homo sapiens
cctattcctgaactataa

SEQ ID NO: 6096171 - DNA, 12 bp, Homo sapiens
cctattccttca

SEQ ID NO: 6096172 - DNA, 13 bp, Homo sapiens
cctattccttggt

SEQ ID NO: 6096173 - DNA, 18 bp, Homo sapiens
cctattcgtagccatctc

SEQ ID NO: 6096174 - DNA, 11 bp, Homo sapiens
cctattctcac

SEQ ID NO: 6096175 - DNA, 13 bp, Homo sapiens
cctattctcacca

SEQ ID NO: 6096176 - DNA, 19 bp, Homo sapiens
cctattctcaccaggaagg

SEQ ID NO: 6096177 - DNA, 15 bp, Homo sapiens
cctattctcctgcca

SEQ ID NO: 6096178 - DNA, 14 bp, Homo sapiens
cctattctgttgcc

SEQ ID NO: 6096179 - DNA, 15 bp, Homo sapiens
cctattctttcgaaa

SEQ ID NO: 6096180 - DNA, 18 bp, Homo sapiens
cctattctttgccacctt

SEQ ID NO: 6096181 - DNA, 22 bp, Homo sapiens
cctattgcaaaggttccaactg

SEQ ID NO: 6096182 - DNA, 20 bp, Homo sapiens
cctattgccaggaatgtttc

SEQ ID NO: 6096183 - DNA, 16 bp, Homo sapiens
cctattgctagagctc

SEQ ID NO: 6096184 - DNA, 23 bp, Homo sapiens
cctattgctgtaaataaaaatag

SEQ ID NO: 6096185 - DNA, 14 bp, Homo sapiens
cctattgcttgggt

SEQ ID NO: 6096186 - DNA, 17 bp, Homo sapiens
cctattgcttgggtctc

SEQ ID NO: 6096187 - DNA, 21 bp, Homo sapiens
cctattggtgttatgtttatg

SEQ ID NO: 6096188 - DNA, 16 bp, Homo sapiens
cctattgtaaatacaa

SEQ ID NO: 6096189 - DNA, 18 bp, Homo sapiens
cctattgttgaataaatg

SEQ ID NO: 6096190 - DNA, 23 bp, Homo sapiens
cctattgttgaataaatgtatct

SEQ ID NO: 6096191 - DNA, 12 bp, Homo sapiens
cctatttaagcc

SEQ ID NO: 6096192 - DNA, 12 bp, Homo sapiens
cctatttaatac

SEQ ID NO: 6096193 - DNA, 15 bp, Homo sapiens
cctatttaatacagc

SEQ ID NO: 6096194 - DNA, 12 bp, Homo sapiens
cctatttattgg

SEQ ID NO: 6096195 - DNA, 14 bp, Homo sapiens
cctatttattgggg

SEQ ID NO: 6096196 - DNA, 22 bp, Homo sapiens
cctatttcaaaaatttggaatt

SEQ ID NO: 6096197 - DNA, 11 bp, Homo sapiens
cctatttcaga

SEQ ID NO: 6096198 - DNA, 19 bp, Homo sapiens
cctatttcagtgttacctg

SEQ ID NO: 6096199 - DNA, 23 bp, Homo sapiens
cctatttcagtgttacctgtgtg

SEQ ID NO: 6096200 - DNA, 16 bp, Homo sapiens
cctatttccagaaata

SEQ ID NO: 6096201 - DNA, 15 bp, Homo sapiens
cctatttctatgtca

SEQ ID NO: 6096202 - DNA, 17 bp, Homo sapiens
cctatttctatgtcatt

SEQ ID NO: 6096203 - DNA, 19 bp, Homo sapiens
cctatttctatgtcatttt

SEQ ID NO: 6096204 - DNA, 22 bp, Homo sapiens
cctatttctatgtcatttttaa

SEQ ID NO: 6096205 - DNA, 16 bp, Homo sapiens
cctatttctgatgatg

SEQ ID NO: 6096206 - DNA, 17 bp, Homo sapiens
cctatttctgatgatgt

SEQ ID NO: 6096207 - DNA, 13 bp, Homo sapiens
cctatttgactgc

SEQ ID NO: 6096208 - DNA, 23 bp, Homo sapiens
cctatttgactgcttcacggact

SEQ ID NO: 6096209 - DNA, 15 bp, Homo sapiens
cctattttaataaac

SEQ ID NO: 6096210 - DNA, 13 bp, Homo sapiens
cctattttcattg

SEQ ID NO: 6096211 - DNA, 17 bp, Homo sapiens
cctattttcatttgtac

SEQ ID NO: 6096212 - DNA, 11 bp, Homo sapiens
cctattttgaa

SEQ ID NO: 6096213 - DNA, 19 bp, Homo sapiens
cctattttgaaaaattcct

SEQ ID NO: 6096214 - DNA, 16 bp, Homo sapiens
cctattttggagtggt

SEQ ID NO: 6096215 - DNA, 23 bp, Homo sapiens
cctattttgtaatttttttgaaa

SEQ ID NO: 6096216 - DNA, 14 bp, Homo sapiens
cctatttttcagaa

SEQ ID NO: 6096217 - DNA, 13 bp, Homo sapiens
cctatttttcctt

SEQ ID NO: 6096218 - DNA, 15 bp, Homo sapiens
cctatttttccttta

SEQ ID NO: 6096219 - DNA, 13 bp, Homo sapiens
cctatttttgtag

SEQ ID NO: 6096220 - DNA, 14 bp, Homo sapiens
cctattttttgaca

SEQ ID NO: 6096221 - DNA, 17 bp, Homo sapiens
cctattttttgacactt

SEQ ID NO: 6096222 - DNA, 22 bp, Homo sapiens
cctattttttgacacttccatt

SEQ ID NO: 6096223 - DNA, 23 bp, Homo sapiens
cctatttttttagattgagaaat

SEQ ID NO: 6096224 - DNA, 18 bp, Homo sapiens
cctcaaaaacgccctcaa

SEQ ID NO: 6096225 - DNA, 21 bp, Homo sapiens
cctcaaaaacgccctcaagaa

SEQ ID NO: 6096226 - DNA, 20 bp, Homo sapiens
cctcaaaaagatttccccat

SEQ ID NO: 6096227 - DNA, 12 bp, Homo sapiens
cctcaaaagaaa

SEQ ID NO: 6096228 - DNA, 13 bp, Homo sapiens
cctcaaaagaaaa

SEQ ID NO: 6096229 - DNA, 16 bp, Homo sapiens
cctcaaaagcaccctt

SEQ ID NO: 6096230 - DNA, 19 bp, Homo sapiens
cctcaaacaggatggaaca

SEQ ID NO: 6096231 - DNA, 22 bp, Homo sapiens
cctcaaacagtaggttggcagt

SEQ ID NO: 6096232 - DNA, 16 bp, Homo sapiens
cctcaaacatggaaga

SEQ ID NO: 6096233 - DNA, 13 bp, Homo sapiens
cctcaaacctcct

SEQ ID NO: 6096234 - DNA, 20 bp, Homo sapiens
cctcaaacgacagaggagct

SEQ ID NO: 6096235 - DNA, 17 bp, Homo sapiens
cctcaaactcattgcag

SEQ ID NO: 6096236 - DNA, 19 bp, Homo sapiens
cctcaaactcattgcagca

SEQ ID NO: 6096237 - DNA, 14 bp, Homo sapiens
cctcaaactgcaca

SEQ ID NO: 6096238 - DNA, 16 bp, Homo sapiens
cctcaaagaaagtgta

SEQ ID NO: 6096239 - DNA, 15 bp, Homo sapiens
cctcaaagaggcctt

SEQ ID NO: 6096240 - DNA, 14 bp, Homo sapiens
cctcaaagcaaccc

SEQ ID NO: 6096241 - DNA, 17 bp, Homo sapiens
cctcaaagcaacccgct

SEQ ID NO: 6096242 - DNA, 21 bp, Homo sapiens
cctcaaagcaacccgctggag

SEQ ID NO: 6096243 - DNA, 22 bp, Homo sapiens
cctcaaagcaacccgctggagc

SEQ ID NO: 6096244 - DNA, 24 bp, Homo sapiens
cctcaaagcaacccgctggagccc

SEQ ID NO: 6096245 - DNA, 24 bp, Homo sapiens
cctcaaagcttggattaaatacat

SEQ ID NO: 6096246 - DNA, 13 bp, Homo sapiens
cctcaaagctttt

SEQ ID NO: 6096247 - DNA, 16 bp, Homo sapiens
cctcaaaggcccgctc

SEQ ID NO: 6096248 - DNA, 14 bp, Homo sapiens
cctcaaagggcagt

SEQ ID NO: 6096249 - DNA, 20 bp, Homo sapiens
cctcaaatacatgcacagtc

SEQ ID NO: 6096250 - DNA, 23 bp, Homo sapiens
cctcaaatcaaaaacaggcaggt

SEQ ID NO: 6096251 - DNA, 20 bp, Homo sapiens
cctcaaatcagtcttccttg

SEQ ID NO: 6096252 - DNA, 15 bp, Homo sapiens
cctcaaatcgtccag

SEQ ID NO: 6096253 - DNA, 16 bp, Homo sapiens
cctcaaatgaattctt

SEQ ID NO: 6096254 - DNA, 19 bp, Homo sapiens
cctcaaatgacccaaagac

SEQ ID NO: 6096255 - DNA, 16 bp, Homo sapiens
cctcaaattttttgac

SEQ ID NO: 6096256 - DNA, 18 bp, Homo sapiens
cctcaacaagggagagac

SEQ ID NO: 6096257 - DNA, 14 bp, Homo sapiens
cctcaacaccctgc

SEQ ID NO: 6096258 - DNA, 15 bp, Homo sapiens
cctcaacaccctgct

SEQ ID NO: 6096259 - DNA, 14 bp, Homo sapiens
cctcaacagcagga

SEQ ID NO: 6096260 - DNA, 20 bp, Homo sapiens
cctcaacagcaggaggcaca

SEQ ID NO: 6096261 - DNA, 21 bp, Homo sapiens
cctcaacagcaggaggcacag

SEQ ID NO: 6096262 - DNA, 19 bp, Homo sapiens
cctcaacagccaagtgtga

SEQ ID NO: 6096263 - DNA, 13 bp, Homo sapiens
cctcaacaggccc

SEQ ID NO: 6096264 - DNA, 17 bp, Homo sapiens
cctcaacaggcccaggg

SEQ ID NO: 6096265 - DNA, 21 bp, Homo sapiens
cctcaacaggcccagggaggg

SEQ ID NO: 6096266 - DNA, 16 bp, Homo sapiens
cctcaacccacatggg

SEQ ID NO: 6096267 - DNA, 22 bp, Homo sapiens
cctcaaccctccctcagcccct

SEQ ID NO: 6096268 - DNA, 23 bp, Homo sapiens
cctcaaccctccctcagcccctc

SEQ ID NO: 6096269 - DNA, 14 bp, Homo sapiens
cctcaaccctccgt

SEQ ID NO: 6096270 - DNA, 14 bp, Homo sapiens
cctcaacctcatcc

SEQ ID NO: 6096271 - DNA, 12 bp, Homo sapiens
cctcaacctccc

SEQ ID NO: 6096272 - DNA, 14 bp, Homo sapiens
cctcaacctcccaa

SEQ ID NO: 6096273 - DNA, 12 bp, Homo sapiens
cctcaacctcct

SEQ ID NO: 6096274 - DNA, 16 bp, Homo sapiens
cctcaacctcctgggt

SEQ ID NO: 6096275 - DNA, 17 bp, Homo sapiens
cctcaacctcctgggtt

SEQ ID NO: 6096276 - DNA, 18 bp, Homo sapiens
cctcaacctcctgggttc

SEQ ID NO: 6096277 - DNA, 12 bp, Homo sapiens
cctcaacctctt

SEQ ID NO: 6096278 - DNA, 20 bp, Homo sapiens
cctcaacctcttctggctca

SEQ ID NO: 6096279 - DNA, 14 bp, Homo sapiens
cctcaacctgtaaa

SEQ ID NO: 6096280 - DNA, 16 bp, Homo sapiens
cctcaactaaccctta

SEQ ID NO: 6096281 - DNA, 15 bp, Homo sapiens
cctcaactattctgt

SEQ ID NO: 6096282 - DNA, 16 bp, Homo sapiens
cctcaactcctcccat

SEQ ID NO: 6096283 - DNA, 19 bp, Homo sapiens
ccttgggcatccacccagt

SEQ ID NO: 6096284 - DNA, 22 bp, Homo sapiens
ccttgggccagaagtaccagac

SEQ ID NO: 6096285 - DNA, 16 bp, Homo sapiens
ccttgggccataatta

SEQ ID NO: 6096286 - DNA, 17 bp, Homo sapiens
ccttgggccctctggtt

SEQ ID NO: 6096287 - DNA, 15 bp, Homo sapiens
ccttgggccctggaa

SEQ ID NO: 6096288 - DNA, 12 bp, Homo sapiens
ccttgggccctt

SEQ ID NO: 6096289 - DNA, 14 bp, Homo sapiens
ccttgggccctttg

SEQ ID NO: 6096290 - DNA, 21 bp, Homo sapiens
ccttgggcctcccactcccat

SEQ ID NO: 6096291 - DNA, 22 bp, Homo sapiens
ccttgggcctccccccagcccc

SEQ ID NO: 6096292 - DNA, 19 bp, Homo sapiens
ccttgggcctggccagtct

SEQ ID NO: 6096293 - DNA, 17 bp, Homo sapiens
ccttgggccttgctgct

SEQ ID NO: 6096294 - DNA, 15 bp, Homo sapiens
ccttgggcctttcag

SEQ ID NO: 6096295 - DNA, 17 bp, Homo sapiens
ccttgggcggctgagag

SEQ ID NO: 6096296 - DNA, 21 bp, Homo sapiens
ccttgggctccgtgtgggaga

SEQ ID NO: 6096297 - DNA, 17 bp, Homo sapiens
ccttgggctcctggctg

SEQ ID NO: 6096298 - DNA, 18 bp, Homo sapiens
ccttgggctcctggctgc

SEQ ID NO: 6096299 - DNA, 22 bp, Homo sapiens
ccttgggctcctggctgccagg

SEQ ID NO: 6096300 - DNA, 18 bp, Homo sapiens
ccttgggctgctcctcat

SEQ ID NO: 6096301 - DNA, 16 bp, Homo sapiens
ccttggggaaatgtgg

SEQ ID NO: 6096302 - DNA, 22 bp, Homo sapiens
ccttggggaatttcctctattg

SEQ ID NO: 6096303 - DNA, 19 bp, Homo sapiens
ccttggggacaaccttggc

SEQ ID NO: 6096304 - DNA, 19 bp, Homo sapiens
ccttggggaggacaaaact

SEQ ID NO: 6096305 - DNA, 22 bp, Homo sapiens
ccttggggaggacaaaacttct

SEQ ID NO: 6096306 - DNA, 22 bp, Homo sapiens
ccttggggaggggtcagctctg

SEQ ID NO: 6096307 - DNA, 16 bp, Homo sapiens
ccttggggcagggcct

SEQ ID NO: 6096308 - DNA, 22 bp, Homo sapiens
ccttggggcagggcctgggcct

SEQ ID NO: 6096309 - DNA, 23 bp, Homo sapiens
ccttggggcagggcctgggcctc

SEQ ID NO: 6096310 - DNA, 15 bp, Homo sapiens
ccttggggccagact

SEQ ID NO: 6096311 - DNA, 15 bp, Homo sapiens
ccttggggcctggct

SEQ ID NO: 6096312 - DNA, 16 bp, Homo sapiens
ccttggggcctggctt

SEQ ID NO: 6096313 - DNA, 14 bp, Homo sapiens
ccttggggggccaa

SEQ ID NO: 6096314 - DNA, 17 bp, Homo sapiens
ccttgggggggctgcct

SEQ ID NO: 6096315 - DNA, 19 bp, Homo sapiens
ccttgggggggctgccttt

SEQ ID NO: 6096316 - DNA, 22 bp, Homo sapiens
ccttggggggtgggggctgtcc

SEQ ID NO: 6096317 - DNA, 21 bp, Homo sapiens
ccttgggggtctgctctgtgc

SEQ ID NO: 6096318 - DNA, 23 bp, Homo sapiens
ccttgggggttcagggaactgct

SEQ ID NO: 6096319 - DNA, 21 bp, Homo sapiens
ccttggggtaagccagagcct

SEQ ID NO: 6096320 - DNA, 13 bp, Homo sapiens
ccttggggtggcg

SEQ ID NO: 6096321 - DNA, 21 bp, Homo sapiens
ccttgggtatttgcaatattc

SEQ ID NO: 6096322 - DNA, 15 bp, Homo sapiens
ccttgggtggcccct

SEQ ID NO: 6096323 - DNA, 18 bp, Homo sapiens
ccttggtagcagcctggg

SEQ ID NO: 6096324 - DNA, 16 bp, Homo sapiens
ccttggtatgtgccag

SEQ ID NO: 6096325 - DNA, 17 bp, Homo sapiens
ccttggtatgtgccagg

SEQ ID NO: 6096326 - DNA, 18 bp, Homo sapiens
ccttggtatttgtttaat

SEQ ID NO: 6096327 - DNA, 18 bp, Homo sapiens
ccttggtcccagacagct

SEQ ID NO: 6096328 - DNA, 21 bp, Homo sapiens
ccttggtcccagacagctgga

SEQ ID NO: 6096329 - DNA, 15 bp, Homo sapiens
ccttggtccctctca

SEQ ID NO: 6096330 - DNA, 15 bp, Homo sapiens
ccttggtcctgcctc

SEQ ID NO: 6096331 - DNA, 16 bp, Homo sapiens
ccttggtcctgcctct

SEQ ID NO: 6096332 - DNA, 22 bp, Homo sapiens
ccttggtcctgcctctttgagt

SEQ ID NO: 6096333 - DNA, 21 bp, Homo sapiens
ccttggtgccaccaaaagtgc

SEQ ID NO: 6096334 - DNA, 14 bp, Homo sapiens
ccttggtgccctcg

SEQ ID NO: 6096335 - DNA, 17 bp, Homo sapiens
ccttggtgcctcttgta

SEQ ID NO: 6096336 - DNA, 12 bp, Homo sapiens
ccttggtgctct

SEQ ID NO: 6096337 - DNA, 20 bp, Homo sapiens
ccttggtgctcttgcttttt

SEQ ID NO: 6096338 - DNA, 13 bp, Homo sapiens
ccttggtgctgtg

SEQ ID NO: 6096339 - DNA, 17 bp, Homo sapiens
ccttggtggagcagcca

SEQ ID NO: 6096340 - DNA, 18 bp, Homo sapiens
ccttggtggagcagccag

SEQ ID NO: 6096341 - DNA, 23 bp, Homo sapiens
ccttggtggagcagccagagctg

SEQ ID NO: 6096342 - DNA, 24 bp, Homo sapiens
ccttggtggagcagccagagctgt

SEQ ID NO: 6096343 - DNA, 21 bp, Homo sapiens
ccttggtggcaaccccagacc

SEQ ID NO: 6096344 - DNA, 17 bp, Homo sapiens
ccttggtggcaagagcc

SEQ ID NO: 6096345 - DNA, 16 bp, Homo sapiens
ccttggtgtccacctg

SEQ ID NO: 6096346 - DNA, 19 bp, Homo sapiens
ccttggtgtcgggcatgac

SEQ ID NO: 6096347 - DNA, 20 bp, Homo sapiens
ccttggtgtcgggcatgaca

SEQ ID NO: 6096348 - DNA, 21 bp, Homo sapiens
ccttggtgtcgggcatgacac

SEQ ID NO: 6096349 - DNA, 22 bp, Homo sapiens
ccttggtgtcgggcatgacacg

SEQ ID NO: 6096350 - DNA, 19 bp, Homo sapiens
ccttggtgtttcccttcct

SEQ ID NO: 6096351 - DNA, 20 bp, Homo sapiens
ccttggtgtttcccttcctc

SEQ ID NO: 6096352 - DNA, 22 bp, Homo sapiens
ccttggtgtttctttttccacc

SEQ ID NO: 6096353 - DNA, 17 bp, Homo sapiens
ccttggttcatcagtgt

SEQ ID NO: 6096354 - DNA, 17 bp, Homo sapiens
ccttggttcctccagca

SEQ ID NO: 6096355 - DNA, 15 bp, Homo sapiens
ccttggttcctcccc

SEQ ID NO: 6096356 - DNA, 12 bp, Homo sapiens
ccttggttcctg

SEQ ID NO: 6096357 - DNA, 17 bp, Homo sapiens
ccttggttcctggggca

SEQ ID NO: 6096358 - DNA, 22 bp, Homo sapiens
ccttggttctgcactgttgcca

SEQ ID NO: 6096359 - DNA, 16 bp, Homo sapiens
ccttggttctggccac

SEQ ID NO: 6096360 - DNA, 13 bp, Homo sapiens
ccttggttggaag

SEQ ID NO: 6096361 - DNA, 21 bp, Homo sapiens
ccttggttgggtcaaggacag

SEQ ID NO: 6096362 - DNA, 16 bp, Homo sapiens
ccttggtttctccctc

SEQ ID NO: 6096363 - DNA, 15 bp, Homo sapiens
ccttggtttgctagt

SEQ ID NO: 6096364 - DNA, 22 bp, Homo sapiens
ccttggttttgcctctttaaat

SEQ ID NO: 6096365 - DNA, 23 bp, Homo sapiens
ccttggtttttactgctctgaga

SEQ ID NO: 6096366 - DNA, 18 bp, Homo sapiens
ccttgtaaaaaaagcaaa

SEQ ID NO: 6096367 - DNA, 21 bp, Homo sapiens
ccttgtaaagacagagtgaat

SEQ ID NO: 6096368 - DNA, 16 bp, Homo sapiens
ccttgtaaatgggaaa

SEQ ID NO: 6096369 - DNA, 23 bp, Homo sapiens
ccttgtaaattccccttcccaac

SEQ ID NO: 6096370 - DNA, 17 bp, Homo sapiens
ccttgtaaccagtgcag

SEQ ID NO: 6096371 - DNA, 19 bp, Homo sapiens
ccttgtaaccagtgcagaa

SEQ ID NO: 6096372 - DNA, 19 bp, Homo sapiens
ccttgtaattctaaatgaa

SEQ ID NO: 6096373 - DNA, 20 bp, Homo sapiens
ccttgtacagtctgctcctc

SEQ ID NO: 6096374 - DNA, 22 bp, Homo sapiens
ccttgtacagtgtctgtgccat

SEQ ID NO: 6096375 - DNA, 12 bp, Homo sapiens
ccttgtactctt

SEQ ID NO: 6096376 - DNA, 13 bp, Homo sapiens
ccttgtactctta

SEQ ID NO: 6096377 - DNA, 16 bp, Homo sapiens
ccttgtactcttagga

SEQ ID NO: 6096378 - DNA, 16 bp, Homo sapiens
ccttgtactttacaat

SEQ ID NO: 6096379 - DNA, 21 bp, Homo sapiens
ccttgtagaaaaatccctcca

SEQ ID NO: 6096380 - DNA, 15 bp, Homo sapiens
ccttgtagctcctcc

SEQ ID NO: 6096381 - DNA, 22 bp, Homo sapiens
ccttgtatgaataaaaggctgg

SEQ ID NO: 6096382 - DNA, 13 bp, Homo sapiens
ccttgtatttaaa

SEQ ID NO: 6096383 - DNA, 21 bp, Homo sapiens
ccttgtatttaaatattaaat

SEQ ID NO: 6096384 - DNA, 19 bp, Homo sapiens
ccttgtattttgttaaagc

SEQ ID NO: 6096385 - DNA, 14 bp, Homo sapiens
ccttgtcaccagca

SEQ ID NO: 6096386 - DNA, 14 bp, Homo sapiens
ccttgtcactgaag

SEQ ID NO: 6096387 - DNA, 17 bp, Homo sapiens
ccttgtcactgaagatt

SEQ ID NO: 6096388 - DNA, 18 bp, Homo sapiens
ccttgtcaggacccaggc

SEQ ID NO: 6096389 - DNA, 20 bp, Homo sapiens
ccttgtcaggacccaggccg

SEQ ID NO: 6096390 - DNA, 21 bp, Homo sapiens
ccttgtcagggtctccttcct

SEQ ID NO: 6096391 - DNA, 22 bp, Homo sapiens
ccttgtcagggtctccttcctt

SEQ ID NO: 6096392 - DNA, 18 bp, Homo sapiens
ccttgtcagtgtgtcagt

SEQ ID NO: 6096393 - DNA, 20 bp, Homo sapiens
ccttgtcagtgtgtcagttt

SEQ ID NO: 6096394 - DNA, 15 bp, Homo sapiens
ccttgtcatcctccc

SEQ ID NO: 6096395 - DNA, 17 bp, Homo sapiens
ccttgtcatctctctgc

SEQ ID NO: 6096396 - DNA, 14 bp, Homo sapiens
ccttgtcattgcct

SEQ ID NO: 6096397 - DNA, 15 bp, Homo sapiens
ccttgtccaggaact

SEQ ID NO: 6096398 - DNA, 15 bp, Homo sapiens
ccttgtcccagccag

SEQ ID NO: 6096399 - DNA, 13 bp, Homo sapiens
ccttgtccccaca

SEQ ID NO: 6096400 - DNA, 14 bp, Homo sapiens
ccttgtccccacac

SEQ ID NO: 6096401 - DNA, 15 bp, Homo sapiens
ccttgtccccacact

SEQ ID NO: 6096402 - DNA, 21 bp, Homo sapiens
ccttgtccccacactcctaca

SEQ ID NO: 6096403 - DNA, 14 bp, Homo sapiens
ccttgtcccctgcc

SEQ ID NO: 6096404 - DNA, 14 bp, Homo sapiens
ccttgtccctgggg

SEQ ID NO: 6096405 - DNA, 20 bp, Homo sapiens
ccttgtcctctcagagcctc

SEQ ID NO: 6096406 - DNA, 22 bp, Homo sapiens
ccttgtcctgaagcccagcgac

SEQ ID NO: 6096407 - DNA, 13 bp, Homo sapiens
ccttgtcctgcca

SEQ ID NO: 6096408 - DNA, 15 bp, Homo sapiens
ccttgtcctgccagc

SEQ ID NO: 6096409 - DNA, 20 bp, Homo sapiens
ccttgtcctgccagctgcct

SEQ ID NO: 6096410 - DNA, 16 bp, Homo sapiens
ccttgtcctgggtctg

SEQ ID NO: 6096411 - DNA, 23 bp, Homo sapiens
ccttgtcgcgcgtctcccatcct

SEQ ID NO: 6096412 - DNA, 15 bp, Homo sapiens
ccttgtcgctgaacc

SEQ ID NO: 6096413 - DNA, 20 bp, Homo sapiens
ccttgtctagtttcccacat

SEQ ID NO: 6096414 - DNA, 19 bp, Homo sapiens
ccttgtctcctactcctga

SEQ ID NO: 6096415 - DNA, 18 bp, Homo sapiens
ccttgtctcttcctctgc

SEQ ID NO: 6096416 - DNA, 19 bp, Homo sapiens
ccttgtctgaatgtattta

SEQ ID NO: 6096417 - DNA, 20 bp, Homo sapiens
ccttgtctgctgctcccagc

SEQ ID NO: 6096418 - DNA, 18 bp, Homo sapiens
ccttgtctgggtctacca

SEQ ID NO: 6096419 - DNA, 21 bp, Homo sapiens
ccttgtctgggtgcagctggg

SEQ ID NO: 6096420 - DNA, 12 bp, Homo sapiens
ccttgtcttccc

SEQ ID NO: 6096421 - DNA, 18 bp, Homo sapiens
ccttgtcttcccccctct

SEQ ID NO: 6096422 - DNA, 22 bp, Homo sapiens
ccttgtcttcccccctctcctc

SEQ ID NO: 6096423 - DNA, 20 bp, Homo sapiens
ccttgtgaatcaagggtcag

SEQ ID NO: 6096424 - DNA, 21 bp, Homo sapiens
ccttgtgactcagtgtatttt

SEQ ID NO: 6096425 - DNA, 21 bp, Homo sapiens
ccttgtgacttacaatttgca

SEQ ID NO: 6096426 - DNA, 14 bp, Homo sapiens
ccttgtgagctgct

SEQ ID NO: 6096427 - DNA, 22 bp, Homo sapiens
ccttgtgatgtcatacagagaa

SEQ ID NO: 6096428 - DNA, 23 bp, Homo sapiens
ccttgtgatgtggcaataaattt

SEQ ID NO: 6096429 - DNA, 16 bp, Homo sapiens
ccttgtgccctgcccc

SEQ ID NO: 6096430 - DNA, 14 bp, Homo sapiens
ccttgtggactggc

SEQ ID NO: 6096431 - DNA, 12 bp, Homo sapiens
ccttgtggcaga

SEQ ID NO: 6096432 - DNA, 16 bp, Homo sapiens
ccttgtgggaataaac

SEQ ID NO: 6096433 - DNA, 21 bp, Homo sapiens
ccttgtgggcaaaggcagggc

SEQ ID NO: 6096434 - DNA, 23 bp, Homo sapiens
ccttgtgggcaaaggcagggcca

SEQ ID NO: 6096435 - DNA, 21 bp, Homo sapiens
ccttgtggtctcgatgctgct

SEQ ID NO: 6096436 - DNA, 18 bp, Homo sapiens
ccttgtgtactttcttcc

SEQ ID NO: 6096437 - DNA, 18 bp, Homo sapiens
ccttgtgtatatttgtat

SEQ ID NO: 6096438 - DNA, 14 bp, Homo sapiens
ccttgtgtatcctg

SEQ ID NO: 6096439 - DNA, 23 bp, Homo sapiens
ccttgtgtatgtgactccatatc

SEQ ID NO: 6096440 - DNA, 20 bp, Homo sapiens
ccttgtgtcaagacatttct

SEQ ID NO: 6096441 - DNA, 15 bp, Homo sapiens
ccttgtgtcagagct

SEQ ID NO: 6096442 - DNA, 15 bp, Homo sapiens
ccttgtgtgatttta

SEQ ID NO: 6096443 - DNA, 18 bp, Homo sapiens
ccttgtgtgcatttctgt

SEQ ID NO: 6096444 - DNA, 16 bp, Homo sapiens
ccttgtgtgtaccaca

SEQ ID NO: 6096445 - DNA, 23 bp, Homo sapiens
ccttgtgtgtaccacaccctgcc

SEQ ID NO: 6096446 - DNA, 15 bp, Homo sapiens
ccttgtgtgtcaggc

SEQ ID NO: 6096447 - DNA, 17 bp, Homo sapiens
ccttgtgtgtcaggccc

SEQ ID NO: 6096448 - DNA, 14 bp, Homo sapiens
ccttgtgtgtgccc

SEQ ID NO: 6096449 - DNA, 15 bp, Homo sapiens
ccttgtgtgtgccct

SEQ ID NO: 6096450 - DNA, 18 bp, Homo sapiens
ccttgtgtgtgccctggg

SEQ ID NO: 6096451 - DNA, 22 bp, Homo sapiens
ccttgtgtgtgccctgggccag

SEQ ID NO: 6096452 - DNA, 13 bp, Homo sapiens
ccttgtgttcctt

SEQ ID NO: 6096453 - DNA, 15 bp, Homo sapiens
ccttgtgttccttct

SEQ ID NO: 6096454 - DNA, 21 bp, Homo sapiens
ccttgtgttccttctgtgaag

SEQ ID NO: 6096455 - DNA, 23 bp, Homo sapiens
ccttgtgttgcactgaacaggtt

SEQ ID NO: 6096456 - DNA, 23 bp, Homo sapiens
ccttgttaagtatcagctacaat

SEQ ID NO: 6096457 - DNA, 16 bp, Homo sapiens
ccttgttacccatgaa

SEQ ID NO: 6096458 - DNA, 15 bp, Homo sapiens
ccttgttacttctga

SEQ ID NO: 6096459 - DNA, 15 bp, Homo sapiens
cctcaactctcctcc

SEQ ID NO: 6096460 - DNA, 19 bp, Homo sapiens
cctcaactctcctccagag

SEQ ID NO: 6096461 - DNA, 21 bp, Homo sapiens
cctcaactctcctccagagtc

SEQ ID NO: 6096462 - DNA, 16 bp, Homo sapiens
cctcaactctgctgag

SEQ ID NO: 6096463 - DNA, 21 bp, Homo sapiens
cctcaactgagaagccaagcc

SEQ ID NO: 6096464 - DNA, 14 bp, Homo sapiens
cctcaactgcctac

SEQ ID NO: 6096465 - DNA, 13 bp, Homo sapiens
cctcaagaacatg

SEQ ID NO: 6096466 - DNA, 17 bp, Homo sapiens
cctcaagagcacacaga

SEQ ID NO: 6096467 - DNA, 17 bp, Homo sapiens
cctcaagatgaaggcaa

SEQ ID NO: 6096468 - DNA, 21 bp, Homo sapiens
cctcaagcaataattgtttcc

SEQ ID NO: 6096469 - DNA, 13 bp, Homo sapiens
cctcaagcaatcc

SEQ ID NO: 6096470 - DNA, 22 bp, Homo sapiens
cctcaagcaatccacctgcctt

SEQ ID NO: 6096471 - DNA, 18 bp, Homo sapiens
cctcaagccaatcccctc

SEQ ID NO: 6096472 - DNA, 13 bp, Homo sapiens
cctcaagccagga

SEQ ID NO: 6096473 - DNA, 23 bp, Homo sapiens
cctcaagccaggagaccctgtct

SEQ ID NO: 6096474 - DNA, 12 bp, Homo sapiens
cctcaagccatc

SEQ ID NO: 6096475 - DNA, 19 bp, Homo sapiens
cctcaagccccagcagccc

SEQ ID NO: 6096476 - DNA, 18 bp, Homo sapiens
cctcaagccccttctctc

SEQ ID NO: 6096477 - DNA, 13 bp, Homo sapiens
cctcaagccctga

SEQ ID NO: 6096478 - DNA, 15 bp, Homo sapiens
cctcaagccctgagg

SEQ ID NO: 6096479 - DNA, 12 bp, Homo sapiens
cctcaagcctgt

SEQ ID NO: 6096480 - DNA, 13 bp, Homo sapiens
cctcaagcctgtg

SEQ ID NO: 6096481 - DNA, 14 bp, Homo sapiens
cctcaagcctgtgg

SEQ ID NO: 6096482 - DNA, 16 bp, Homo sapiens
cctcaagcctgtgggc

SEQ ID NO: 6096483 - DNA, 21 bp, Homo sapiens
cctcaagcctgtgggcagcat

SEQ ID NO: 6096484 - DNA, 17 bp, Homo sapiens
cctcaagcttctcagac

SEQ ID NO: 6096485 - DNA, 15 bp, Homo sapiens
cctcaagctttcctg

SEQ ID NO: 6096486 - DNA, 20 bp, Homo sapiens
cctcaagctttcctgctgtc

SEQ ID NO: 6096487 - DNA, 15 bp, Homo sapiens
cctcaaggaagagcc

SEQ ID NO: 6096488 - DNA, 20 bp, Homo sapiens
cctcaaggaagagccagccg

SEQ ID NO: 6096489 - DNA, 14 bp, Homo sapiens
cctcaaggaagcta

SEQ ID NO: 6096490 - DNA, 21 bp, Homo sapiens
cctcaaggacaaagtctccag

SEQ ID NO: 6096491 - DNA, 22 bp, Homo sapiens
cctcaaggacaaagtctccagc

SEQ ID NO: 6096492 - DNA, 19 bp, Homo sapiens
cctcaaggacttgaaagca

SEQ ID NO: 6096493 - DNA, 22 bp, Homo sapiens
cctcaaggacttgaaagcatcc

SEQ ID NO: 6096494 - DNA, 23 bp, Homo sapiens
cctcaaggacttgaaagcatcca

SEQ ID NO: 6096495 - DNA, 21 bp, Homo sapiens
cctcaaggccctcggagctgg

SEQ ID NO: 6096496 - DNA, 18 bp, Homo sapiens
cctcaaggcctcccacag

SEQ ID NO: 6096497 - DNA, 18 bp, Homo sapiens
cctcaaggggcagggagg

SEQ ID NO: 6096498 - DNA, 23 bp, Homo sapiens
cctcaagggtagggtctgcgtgt

SEQ ID NO: 6096499 - DNA, 18 bp, Homo sapiens
cctcaaggtgcggggaga

SEQ ID NO: 6096500 - DNA, 16 bp, Homo sapiens
cctcaagtaaactccc

SEQ ID NO: 6096501 - DNA, 20 bp, Homo sapiens
cctcaagtcactcccaagcc

SEQ ID NO: 6096502 - DNA, 15 bp, Homo sapiens
cctcaagtcttgaca

SEQ ID NO: 6096503 - DNA, 21 bp, Homo sapiens
cctcaagtctttctctttccc

SEQ ID NO: 6096504 - DNA, 20 bp, Homo sapiens
cctcaagtgattctcctgcc

SEQ ID NO: 6096505 - DNA, 18 bp, Homo sapiens
cctcaagtgcaaggacca

SEQ ID NO: 6096506 - DNA, 13 bp, Homo sapiens
cctcaagttcaat

SEQ ID NO: 6096507 - DNA, 16 bp, Homo sapiens
cctcaagttccagtgc

SEQ ID NO: 6096508 - DNA, 18 bp, Homo sapiens
cctcaataaacatttcat

SEQ ID NO: 6096509 - DNA, 13 bp, Homo sapiens
cctcaataaagct

SEQ ID NO: 6096510 - DNA, 16 bp, Homo sapiens
cctcaatcagtattca

SEQ ID NO: 6096511 - DNA, 16 bp, Homo sapiens
cctcaatctaaggcct

SEQ ID NO: 6096512 - DNA, 23 bp, Homo sapiens
cctcaatgcagtcagtgtttctt

SEQ ID NO: 6096513 - DNA, 15 bp, Homo sapiens
cctcaatgccctgcc

SEQ ID NO: 6096514 - DNA, 16 bp, Homo sapiens
cctcaatgccctgcca

SEQ ID NO: 6096515 - DNA, 19 bp, Homo sapiens
cctcaatgccctgccatta

SEQ ID NO: 6096516 - DNA, 16 bp, Homo sapiens
cctcaatgctgggccc

SEQ ID NO: 6096517 - DNA, 17 bp, Homo sapiens
cctcaatggacttcaaa

SEQ ID NO: 6096518 - DNA, 16 bp, Homo sapiens
cctcaatggaggtttg

SEQ ID NO: 6096519 - DNA, 20 bp, Homo sapiens
cctcaatgtgaatcagaccc

SEQ ID NO: 6096520 - DNA, 13 bp, Homo sapiens
cctcaatgtttga

SEQ ID NO: 6096521 - DNA, 13 bp, Homo sapiens
cctcaattctcca

SEQ ID NO: 6096522 - DNA, 18 bp, Homo sapiens
cctcaattgacattcctt

SEQ ID NO: 6096523 - DNA, 12 bp, Homo sapiens
cctcaatttcaa

SEQ ID NO: 6096524 - DNA, 16 bp, Homo sapiens
cctcaatttctgaaca

SEQ ID NO: 6096525 - DNA, 16 bp, Homo sapiens
cctcaattttcactgt

SEQ ID NO: 6096526 - DNA, 17 bp, Homo sapiens
cctcaattttcactgtg

SEQ ID NO: 6096527 - DNA, 19 bp, Homo sapiens
cctcaatttttgtctcaga

SEQ ID NO: 6096528 - DNA, 18 bp, Homo sapiens
cctcacaaatgctgtggt

SEQ ID NO: 6096529 - DNA, 14 bp, Homo sapiens
cctcacaacccctg

SEQ ID NO: 6096530 - DNA, 14 bp, Homo sapiens
cctcacaactcctt

SEQ ID NO: 6096531 - DNA, 21 bp, Homo sapiens
cctcacaactccttccatcct

SEQ ID NO: 6096532 - DNA, 15 bp, Homo sapiens
cctcacaagcctctt

SEQ ID NO: 6096533 - DNA, 21 bp, Homo sapiens
cctcacaagcgctcccagcct

SEQ ID NO: 6096534 - DNA, 16 bp, Homo sapiens
cctcacacacacagct

SEQ ID NO: 6096535 - DNA, 20 bp, Homo sapiens
cctcacacacacagctgggc

SEQ ID NO: 6096536 - DNA, 21 bp, Homo sapiens
cctcacacacacagctgggca

SEQ ID NO: 6096537 - DNA, 13 bp, Homo sapiens
cctcacacaccct

SEQ ID NO: 6096538 - DNA, 18 bp, Homo sapiens
cctcacacacctctgccc

SEQ ID NO: 6096539 - DNA, 22 bp, Homo sapiens
cctcacacacggaggccagaca

SEQ ID NO: 6096540 - DNA, 16 bp, Homo sapiens
cctcacacccacctgc

SEQ ID NO: 6096541 - DNA, 20 bp, Homo sapiens
cctcacacccacctgctgct

SEQ ID NO: 6096542 - DNA, 18 bp, Homo sapiens
cctcacaccctggacggg

SEQ ID NO: 6096543 - DNA, 14 bp, Homo sapiens
cctcacactcaccc

SEQ ID NO: 6096544 - DNA, 13 bp, Homo sapiens
cctcacactgcaa

SEQ ID NO: 6096545 - DNA, 18 bp, Homo sapiens
cctcacactgctgtcctc

SEQ ID NO: 6096546 - DNA, 12 bp, Homo sapiens
cctcacactggg

SEQ ID NO: 6096547 - DNA, 13 bp, Homo sapiens
cctcacactggga

SEQ ID NO: 6096548 - DNA, 13 bp, Homo sapiens
cctcacagactct

SEQ ID NO: 6096549 - DNA, 17 bp, Homo sapiens
cctcacagactcttcca

SEQ ID NO: 6096550 - DNA, 24 bp, Homo sapiens
cctcacagactcttccaccagagc

SEQ ID NO: 6096551 - DNA, 14 bp, Homo sapiens
cctcacagatgctg

SEQ ID NO: 6096552 - DNA, 15 bp, Homo sapiens
cctcacagatgctgg

SEQ ID NO: 6096553 - DNA, 19 bp, Homo sapiens
cctcacagatgctggcctc

SEQ ID NO: 6096554 - DNA, 20 bp, Homo sapiens
cctcacagatgctggcctct

SEQ ID NO: 6096555 - DNA, 18 bp, Homo sapiens
cctcacagcagtcacagg

SEQ ID NO: 6096556 - DNA, 19 bp, Homo sapiens
cctcacagcagtcacaggc

SEQ ID NO: 6096557 - DNA, 13 bp, Homo sapiens
cctcacagcctag

SEQ ID NO: 6096558 - DNA, 18 bp, Homo sapiens
cctcacagcctaggacca

SEQ ID NO: 6096559 - DNA, 12 bp, Homo sapiens
cctcacagcctc

SEQ ID NO: 6096560 - DNA, 19 bp, Homo sapiens
cctcacagcctctccctta

SEQ ID NO: 6096561 - DNA, 21 bp, Homo sapiens
cctcacagcctctgacccctc

SEQ ID NO: 6096562 - DNA, 11 bp, Homo sapiens
cctcacagcta

SEQ ID NO: 6096563 - DNA, 17 bp, Homo sapiens
cctcacagctggccgtc

SEQ ID NO: 6096564 - DNA, 15 bp, Homo sapiens
cctcacaggagcaga

SEQ ID NO: 6096565 - DNA, 18 bp, Homo sapiens
cctcacaggagcagacag

SEQ ID NO: 6096566 - DNA, 19 bp, Homo sapiens
cctcacaggagcagacaga

SEQ ID NO: 6096567 - DNA, 17 bp, Homo sapiens
cctcacagtccttacca

SEQ ID NO: 6096568 - DNA, 23 bp, Homo sapiens
cctcacagtccttaccagcagag

SEQ ID NO: 6096569 - DNA, 18 bp, Homo sapiens
cctcacagtgacccttcc

SEQ ID NO: 6096570 - DNA, 19 bp, Homo sapiens
cctcacagtgacccttccc

SEQ ID NO: 6096571 - DNA, 14 bp, Homo sapiens
cctcacatcctcct

SEQ ID NO: 6096572 - DNA, 14 bp, Homo sapiens
cctcacatcctctc

SEQ ID NO: 6096573 - DNA, 16 bp, Homo sapiens
cctcacatcctctcca

SEQ ID NO: 6096574 - DNA, 17 bp, Homo sapiens
cctcacatcctctccag

SEQ ID NO: 6096575 - DNA, 16 bp, Homo sapiens
cctcacatgcccgctg

SEQ ID NO: 6096576 - DNA, 22 bp, Homo sapiens
cctcacatggcgtcctgccctt

SEQ ID NO: 6096577 - DNA, 17 bp, Homo sapiens
cctcaccaaggaccttg

SEQ ID NO: 6096578 - DNA, 14 bp, Homo sapiens
cctcaccaataact

SEQ ID NO: 6096579 - DNA, 17 bp, Homo sapiens
cctcaccaataacttca

SEQ ID NO: 6096580 - DNA, 23 bp, Homo sapiens
cctcaccaataacttcagagaag

SEQ ID NO: 6096581 - DNA, 21 bp, Homo sapiens
cctcaccacacccaggtctct

SEQ ID NO: 6096582 - DNA, 15 bp, Homo sapiens
cctcaccacagcctt

SEQ ID NO: 6096583 - DNA, 14 bp, Homo sapiens
cctcaccaccccca

SEQ ID NO: 6096584 - DNA, 16 bp, Homo sapiens
cctcaccacccccact

SEQ ID NO: 6096585 - DNA, 13 bp, Homo sapiens
cctcaccacctct

SEQ ID NO: 6096586 - DNA, 17 bp, Homo sapiens
cctcaccagagaccagg

SEQ ID NO: 6096587 - DNA, 19 bp, Homo sapiens
cctcaccaggggcaggcac

SEQ ID NO: 6096588 - DNA, 15 bp, Homo sapiens
cctcaccatccagtg

SEQ ID NO: 6096589 - DNA, 16 bp, Homo sapiens
cctcaccatccagtgg

SEQ ID NO: 6096590 - DNA, 17 bp, Homo sapiens
cctcaccatccagtggg

SEQ ID NO: 6096591 - DNA, 16 bp, Homo sapiens
cctcaccatgatgggg

SEQ ID NO: 6096592 - DNA, 14 bp, Homo sapiens
cctcacccacaccc

SEQ ID NO: 6096593 - DNA, 15 bp, Homo sapiens
cctcacccaccatgg

SEQ ID NO: 6096594 - DNA, 23 bp, Homo sapiens
cctcacccaccatggaccagccc

SEQ ID NO: 6096595 - DNA, 16 bp, Homo sapiens
cctcacccacccctgc

SEQ ID NO: 6096596 - DNA, 15 bp, Homo sapiens
cctcacccaccctgt

SEQ ID NO: 6096597 - DNA, 16 bp, Homo sapiens
cctcacccacctctgg

SEQ ID NO: 6096598 - DNA, 18 bp, Homo sapiens
cctcacccactctggtgg

SEQ ID NO: 6096599 - DNA, 13 bp, Homo sapiens
cctcacccagaag

SEQ ID NO: 6096600 - DNA, 23 bp, Homo sapiens
cctcacccagatcaggaaccagg

SEQ ID NO: 6096601 - DNA, 20 bp, Homo sapiens
cctcaccccaatccctgcca

SEQ ID NO: 6096602 - DNA, 21 bp, Homo sapiens
cctcaccccaatccctgccac

SEQ ID NO: 6096603 - DNA, 22 bp, Homo sapiens
cctcaccccaatccctgccact

SEQ ID NO: 6096604 - DNA, 14 bp, Homo sapiens
cctcaccccagtgc

SEQ ID NO: 6096605 - DNA, 19 bp, Homo sapiens
cctcacccccacccctgta

SEQ ID NO: 6096606 - DNA, 22 bp, Homo sapiens
cctcacccccacccctgtaccc

SEQ ID NO: 6096607 - DNA, 22 bp, Homo sapiens
cctcacccccgacggtgtggct

SEQ ID NO: 6096608 - DNA, 21 bp, Homo sapiens
cctcaccccctcccaccccca

SEQ ID NO: 6096609 - DNA, 15 bp, Homo sapiens
cctcaccccctcggg

SEQ ID NO: 6096610 - DNA, 18 bp, Homo sapiens
cctcaccccgaggccctg

SEQ ID NO: 6096611 - DNA, 19 bp, Homo sapiens
cctcaccccgaggccctgc

SEQ ID NO: 6096612 - DNA, 16 bp, Homo sapiens
cctcacccctcccctg

SEQ ID NO: 6096613 - DNA, 17 bp, Homo sapiens
cctcacccctcccctgg

SEQ ID NO: 6096614 - DNA, 16 bp, Homo sapiens
cctcacccctgcaggc

SEQ ID NO: 6096615 - DNA, 22 bp, Homo sapiens
cctcacccctgcccctgtggga

SEQ ID NO: 6096616 - DNA, 15 bp, Homo sapiens
cctcacccctggttc

SEQ ID NO: 6096617 - DNA, 21 bp, Homo sapiens
cctcacccctggttctcatct

SEQ ID NO: 6096618 - DNA, 20 bp, Homo sapiens
cctcacccctgtcctcactg

SEQ ID NO: 6096619 - DNA, 21 bp, Homo sapiens
cctcacccctgtcctcactgc

SEQ ID NO: 6096620 - DNA, 16 bp, Homo sapiens
cctcaccccttccttt

SEQ ID NO: 6096621 - DNA, 22 bp, Homo sapiens
cctcacccgctgcccagccctc

SEQ ID NO: 6096622 - DNA, 15 bp, Homo sapiens
cctcacccggcctct

SEQ ID NO: 6096623 - DNA, 13 bp, Homo sapiens
cctcaccctctgt

SEQ ID NO: 6096624 - DNA, 11 bp, Homo sapiens
cctcaccctgc

SEQ ID NO: 6096625 - DNA, 21 bp, Homo sapiens
cctcaccctgcttggggcctg

SEQ ID NO: 6096626 - DNA, 13 bp, Homo sapiens
cctcaccctgtgg

SEQ ID NO: 6096627 - DNA, 16 bp, Homo sapiens
cctcaccctgtgggac

SEQ ID NO: 6096628 - DNA, 13 bp, Homo sapiens
cctcacccttccc

SEQ ID NO: 6096629 - DNA, 21 bp, Homo sapiens
cctcacccttcccggcccccg

SEQ ID NO: 6096630 - DNA, 13 bp, Homo sapiens
cctcacccttgcg

SEQ ID NO: 6096631 - DNA, 13 bp, Homo sapiens
cctcaccgcggct

SEQ ID NO: 6096632 - DNA, 19 bp, Homo sapiens
cctcaccgcggctggatgg

SEQ ID NO: 6096633 - DNA, 23 bp, Homo sapiens
cctcaccgcggctggatgggggc

SEQ ID NO: 6096634 - DNA, 18 bp, Homo sapiens
cctcaccggcatgctggc

SEQ ID NO: 6096635 - DNA, 21 bp, Homo sapiens
cctcaccggcatgctggcctg

SEQ ID NO: 6096636 - DNA, 22 bp, Homo sapiens
cctcacctaataggctgggaga

SEQ ID NO: 6096637 - DNA, 13 bp, Homo sapiens
cctcacctcagga

SEQ ID NO: 6096638 - DNA, 18 bp, Homo sapiens
ccttgttacttctgaggt

SEQ ID NO: 6096639 - DNA, 19 bp, Homo sapiens
ccttgttacttctgaggta

SEQ ID NO: 6096640 - DNA, 18 bp, Homo sapiens
ccttgttagaatgcaagc

SEQ ID NO: 6096641 - DNA, 13 bp, Homo sapiens
ccttgttcatgga

SEQ ID NO: 6096642 - DNA, 13 bp, Homo sapiens
ccttgttctattt

SEQ ID NO: 6096643 - DNA, 11 bp, Homo sapiens
ccttgttctgt

SEQ ID NO: 6096644 - DNA, 13 bp, Homo sapiens
ccttgttgcactg

SEQ ID NO: 6096645 - DNA, 15 bp, Homo sapiens
ccttgttgcactgcc

SEQ ID NO: 6096646 - DNA, 18 bp, Homo sapiens
ccttgttgcactgccccc

SEQ ID NO: 6096647 - DNA, 13 bp, Homo sapiens
ccttgttgcatga

SEQ ID NO: 6096648 - DNA, 18 bp, Homo sapiens
ccttgttggagcctgcag

SEQ ID NO: 6096649 - DNA, 19 bp, Homo sapiens
ccttgttggagcctgcagg

SEQ ID NO: 6096650 - DNA, 16 bp, Homo sapiens
ccttgttggtcagagg

SEQ ID NO: 6096651 - DNA, 14 bp, Homo sapiens
ccttgttggtggag

SEQ ID NO: 6096652 - DNA, 22 bp, Homo sapiens
ccttgtttatcagatacatcac

SEQ ID NO: 6096653 - DNA, 22 bp, Homo sapiens
ccttgtttcaaacacaaatgca

SEQ ID NO: 6096654 - DNA, 22 bp, Homo sapiens
ccttgtttcaatctttgctgta

SEQ ID NO: 6096655 - DNA, 15 bp, Homo sapiens
ccttgtttctgatga

SEQ ID NO: 6096656 - DNA, 19 bp, Homo sapiens
ccttgtttctgttgttccc

SEQ ID NO: 6096657 - DNA, 21 bp, Homo sapiens
ccttgtttgagtttttcctcc

SEQ ID NO: 6096658 - DNA, 19 bp, Homo sapiens
ccttgttttgaaactagaa

SEQ ID NO: 6096659 - DNA, 20 bp, Homo sapiens
ccttgtttttaatctcctgt

SEQ ID NO: 6096660 - DNA, 16 bp, Homo sapiens
ccttgtttttgatgtg

SEQ ID NO: 6096661 - DNA, 13 bp, Homo sapiens
cctttaaaaaagc

SEQ ID NO: 6096662 - DNA, 12 bp, Homo sapiens
cctttaaaaata

SEQ ID NO: 6096663 - DNA, 16 bp, Homo sapiens
cctttaaaaatgtata

SEQ ID NO: 6096664 - DNA, 23 bp, Homo sapiens
cctttaaaatatatgtctatata

SEQ ID NO: 6096665 - DNA, 20 bp, Homo sapiens
cctttaaaatttttttagaa

SEQ ID NO: 6096666 - DNA, 16 bp, Homo sapiens
cctttaaaggttttta

SEQ ID NO: 6096667 - DNA, 18 bp, Homo sapiens
cctttaaagtaaaggcct

SEQ ID NO: 6096668 - DNA, 18 bp, Homo sapiens
cctttaaagtatgaatct

SEQ ID NO: 6096669 - DNA, 22 bp, Homo sapiens
cctttaaagtatgaatctatgc

SEQ ID NO: 6096670 - DNA, 23 bp, Homo sapiens
cctttaaagtgagtactgttaag

SEQ ID NO: 6096671 - DNA, 17 bp, Homo sapiens
cctttaaattctccaac

SEQ ID NO: 6096672 - DNA, 22 bp, Homo sapiens
cctttaaatttaggtaaataaa

SEQ ID NO: 6096673 - DNA, 16 bp, Homo sapiens
cctttaacaacatgtt

SEQ ID NO: 6096674 - DNA, 24 bp, Homo sapiens
cctttaactgagggctgatcttta

SEQ ID NO: 6096675 - DNA, 22 bp, Homo sapiens
cctttaactgtatccttaacca

SEQ ID NO: 6096676 - DNA, 19 bp, Homo sapiens
cctttaacttttttttctc

SEQ ID NO: 6096677 - DNA, 20 bp, Homo sapiens
cctttaacttttttttctct

SEQ ID NO: 6096678 - DNA, 15 bp, Homo sapiens
cctttaagaacctta

SEQ ID NO: 6096679 - DNA, 21 bp, Homo sapiens
cctttaagaaccttaatgaca

SEQ ID NO: 6096680 - DNA, 14 bp, Homo sapiens
cctttaagagaaat

SEQ ID NO: 6096681 - DNA, 23 bp, Homo sapiens
cctttaagccaaagaaacaagct

SEQ ID NO: 6096682 - DNA, 18 bp, Homo sapiens
cctttaaggtactgaagc

SEQ ID NO: 6096683 - DNA, 15 bp, Homo sapiens
cctttaagtcctctc

SEQ ID NO: 6096684 - DNA, 17 bp, Homo sapiens
cctttaataatgttata

SEQ ID NO: 6096685 - DNA, 20 bp, Homo sapiens
cctttaatattttgtaatat

SEQ ID NO: 6096686 - DNA, 21 bp, Homo sapiens
cctttaatattttgtaatatt

SEQ ID NO: 6096687 - DNA, 19 bp, Homo sapiens
cctttaatcaggtcctgct

SEQ ID NO: 6096688 - DNA, 20 bp, Homo sapiens
cctttaatcaggtcctgctc

SEQ ID NO: 6096689 - DNA, 15 bp, Homo sapiens
cctttacaatgtgaa

SEQ ID NO: 6096690 - DNA, 21 bp, Homo sapiens
cctttacacattcggctccct

SEQ ID NO: 6096691 - DNA, 19 bp, Homo sapiens
cctttacactcaggctttc

SEQ ID NO: 6096692 - DNA, 17 bp, Homo sapiens
cctttacattcaacttt

SEQ ID NO: 6096693 - DNA, 13 bp, Homo sapiens
cctttaccactgt

SEQ ID NO: 6096694 - DNA, 18 bp, Homo sapiens
cctttaccctcatctgtc

SEQ ID NO: 6096695 - DNA, 21 bp, Homo sapiens
cctttaccctctttgctgcag

SEQ ID NO: 6096696 - DNA, 20 bp, Homo sapiens
cctttaccgaggacagcctg

SEQ ID NO: 6096697 - DNA, 17 bp, Homo sapiens
cctttacctaccacctt

SEQ ID NO: 6096698 - DNA, 17 bp, Homo sapiens
cctttaccttttctata

SEQ ID NO: 6096699 - DNA, 18 bp, Homo sapiens
cctttaccttttctataa

SEQ ID NO: 6096700 - DNA, 14 bp, Homo sapiens
cctttacggacacc

SEQ ID NO: 6096701 - DNA, 13 bp, Homo sapiens
cctttactcagcc

SEQ ID NO: 6096702 - DNA, 19 bp, Homo sapiens
cctttactcagcccagctg

SEQ ID NO: 6096703 - DNA, 21 bp, Homo sapiens
cctttactcagcccagctggc

SEQ ID NO: 6096704 - DNA, 18 bp, Homo sapiens
cctttactcatagcactt

SEQ ID NO: 6096705 - DNA, 14 bp, Homo sapiens
cctttactcctggc

SEQ ID NO: 6096706 - DNA, 13 bp, Homo sapiens
cctttactgcagc

SEQ ID NO: 6096707 - DNA, 14 bp, Homo sapiens
cctttactgtgctt

SEQ ID NO: 6096708 - DNA, 16 bp, Homo sapiens
cctttactttctctct

SEQ ID NO: 6096709 - DNA, 16 bp, Homo sapiens
cctttagaaaatataa

SEQ ID NO: 6096710 - DNA, 21 bp, Homo sapiens
cctttagaaactgagtcctgt

SEQ ID NO: 6096711 - DNA, 22 bp, Homo sapiens
cctttagaaactgagtcctgtt

SEQ ID NO: 6096712 - DNA, 15 bp, Homo sapiens
cctttagaatattaa

SEQ ID NO: 6096713 - DNA, 19 bp, Homo sapiens
cctttagatagcagcctgg

SEQ ID NO: 6096714 - DNA, 21 bp, Homo sapiens
cctttagatagcagcctggct

SEQ ID NO: 6096715 - DNA, 15 bp, Homo sapiens
cctttagcctggacc

SEQ ID NO: 6096716 - DNA, 14 bp, Homo sapiens
cctttagctgtgtt

SEQ ID NO: 6096717 - DNA, 15 bp, Homo sapiens
cctttagcttaagag

SEQ ID NO: 6096718 - DNA, 15 bp, Homo sapiens
cctttaggatctcag

SEQ ID NO: 6096719 - DNA, 15 bp, Homo sapiens
cctttaggcagcctg

SEQ ID NO: 6096720 - DNA, 12 bp, Homo sapiens
cctttaggcagg

SEQ ID NO: 6096721 - DNA, 13 bp, Homo sapiens
cctttaggcagga

SEQ ID NO: 6096722 - DNA, 16 bp, Homo sapiens
cctttaggcaggaagt

SEQ ID NO: 6096723 - DNA, 14 bp, Homo sapiens
cctttagggcagct

SEQ ID NO: 6096724 - DNA, 22 bp, Homo sapiens
cctttagggcttatggccaggg

SEQ ID NO: 6096725 - DNA, 13 bp, Homo sapiens
cctttaggttctt

SEQ ID NO: 6096726 - DNA, 23 bp, Homo sapiens
cctttagtccacggacccccaga

SEQ ID NO: 6096727 - DNA, 10 bp, Homo sapiens
cctttataat

SEQ ID NO: 6096728 - DNA, 17 bp, Homo sapiens
cctttatactgtgaagt

SEQ ID NO: 6096729 - DNA, 19 bp, Homo sapiens
cctttatatttagtgaact

SEQ ID NO: 6096730 - DNA, 21 bp, Homo sapiens
cctttatcaagagactcctga

SEQ ID NO: 6096731 - DNA, 18 bp, Homo sapiens
cctttatcatgtgtttct

SEQ ID NO: 6096732 - DNA, 16 bp, Homo sapiens
cctttatcccctcctt

SEQ ID NO: 6096733 - DNA, 14 bp, Homo sapiens
cctttatccctgct

SEQ ID NO: 6096734 - DNA, 15 bp, Homo sapiens
cctttatccctgctt

SEQ ID NO: 6096735 - DNA, 20 bp, Homo sapiens
cctttatccctgcttatctg

SEQ ID NO: 6096736 - DNA, 21 bp, Homo sapiens
cctttatccctgcttatctga

SEQ ID NO: 6096737 - DNA, 21 bp, Homo sapiens
cctttatgagtcagtctctct

SEQ ID NO: 6096738 - DNA, 23 bp, Homo sapiens
cctttatgtgaatttttaagctg

SEQ ID NO: 6096739 - DNA, 12 bp, Homo sapiens
cctttatgtgat

SEQ ID NO: 6096740 - DNA, 16 bp, Homo sapiens
cctttattaatgaact

SEQ ID NO: 6096741 - DNA, 17 bp, Homo sapiens
cctttattaatgaactg

SEQ ID NO: 6096742 - DNA, 23 bp, Homo sapiens
cctttattaatgaactgtgacag

SEQ ID NO: 6096743 - DNA, 14 bp, Homo sapiens
cctttattctcact

SEQ ID NO: 6096744 - DNA, 14 bp, Homo sapiens
cctttattctggca

SEQ ID NO: 6096745 - DNA, 17 bp, Homo sapiens
cctttattgctcctgta

SEQ ID NO: 6096746 - DNA, 18 bp, Homo sapiens
cctttatttaggaaacac

SEQ ID NO: 6096747 - DNA, 18 bp, Homo sapiens
cctttatttattaaactt

SEQ ID NO: 6096748 - DNA, 22 bp, Homo sapiens
cctttatttattaaacttcagc

SEQ ID NO: 6096749 - DNA, 16 bp, Homo sapiens
cctttatttctcttct

SEQ ID NO: 6096750 - DNA, 16 bp, Homo sapiens
cctttatttctgtatc

SEQ ID NO: 6096751 - DNA, 13 bp, Homo sapiens
cctttattttaga

SEQ ID NO: 6096752 - DNA, 13 bp, Homo sapiens
cctttattttatt

SEQ ID NO: 6096753 - DNA, 15 bp, Homo sapiens
cctttattttattga

SEQ ID NO: 6096754 - DNA, 23 bp, Homo sapiens
cctttattttattttttttcaaa

SEQ ID NO: 6096755 - DNA, 21 bp, Homo sapiens
cctttatttttctatctggtt

SEQ ID NO: 6096756 - DNA, 20 bp, Homo sapiens
cctttcaaagtgcacacaca

SEQ ID NO: 6096757 - DNA, 14 bp, Homo sapiens
cctttcaaatttag

SEQ ID NO: 6096758 - DNA, 15 bp, Homo sapiens
cctttcaaatttaga

SEQ ID NO: 6096759 - DNA, 14 bp, Homo sapiens
cctttcaataaagt

SEQ ID NO: 6096760 - DNA, 17 bp, Homo sapiens
cctttcaataggaaaaa

SEQ ID NO: 6096761 - DNA, 21 bp, Homo sapiens
cctttcaataggaaaaactga

SEQ ID NO: 6096762 - DNA, 21 bp, Homo sapiens
cctttcaattccaccagggcc

SEQ ID NO: 6096763 - DNA, 14 bp, Homo sapiens
cctttcacaggcag

SEQ ID NO: 6096764 - DNA, 17 bp, Homo sapiens
cctttcaccccagggcc

SEQ ID NO: 6096765 - DNA, 19 bp, Homo sapiens
cctttcaccccagggcctg

SEQ ID NO: 6096766 - DNA, 17 bp, Homo sapiens
cctttcaccctcatgaa

SEQ ID NO: 6096767 - DNA, 22 bp, Homo sapiens
cctttcacctttgtgtattttt

SEQ ID NO: 6096768 - DNA, 19 bp, Homo sapiens
cctttcactcctttcctcc

SEQ ID NO: 6096769 - DNA, 17 bp, Homo sapiens
cctttcacttctttccc

SEQ ID NO: 6096770 - DNA, 20 bp, Homo sapiens
cctttcacttttagttggca

SEQ ID NO: 6096771 - DNA, 14 bp, Homo sapiens
cctttcagatgtct

SEQ ID NO: 6096772 - DNA, 19 bp, Homo sapiens
cctttcagatgtcttctgc

SEQ ID NO: 6096773 - DNA, 22 bp, Homo sapiens
cctttcagccacatgccccagg

SEQ ID NO: 6096774 - DNA, 15 bp, Homo sapiens
cctttcagcccacgt

SEQ ID NO: 6096775 - DNA, 22 bp, Homo sapiens
cctttcagcccacgtcacgtgt

SEQ ID NO: 6096776 - DNA, 13 bp, Homo sapiens
cctttcagccctg

SEQ ID NO: 6096777 - DNA, 17 bp, Homo sapiens
cctttcaggatctattt

SEQ ID NO: 6096778 - DNA, 19 bp, Homo sapiens
cctttcaggatctattttt

SEQ ID NO: 6096779 - DNA, 15 bp, Homo sapiens
cctttcagtcccaaa

SEQ ID NO: 6096780 - DNA, 22 bp, Homo sapiens
cctttcagtgcagtttcttttc

SEQ ID NO: 6096781 - DNA, 18 bp, Homo sapiens
cctttcataatttttaaa

SEQ ID NO: 6096782 - DNA, 19 bp, Homo sapiens
cctttcatagagaggcctg

SEQ ID NO: 6096783 - DNA, 23 bp, Homo sapiens
cctttcatatgaggggacccagc

SEQ ID NO: 6096784 - DNA, 15 bp, Homo sapiens
cctttcatcctcagc

SEQ ID NO: 6096785 - DNA, 18 bp, Homo sapiens
cctttcatcggtgcctgg

SEQ ID NO: 6096786 - DNA, 19 bp, Homo sapiens
cctttcatcggtgcctggt

SEQ ID NO: 6096787 - DNA, 18 bp, Homo sapiens
cctttcattaccctacag

SEQ ID NO: 6096788 - DNA, 18 bp, Homo sapiens
cctttcatttactgtggc

SEQ ID NO: 6096789 - DNA, 19 bp, Homo sapiens
cctttcatttactgtggct

SEQ ID NO: 6096790 - DNA, 13 bp, Homo sapiens
cctttccaaagag

SEQ ID NO: 6096791 - DNA, 17 bp, Homo sapiens
cctttccaacctcactt

SEQ ID NO: 6096792 - DNA, 15 bp, Homo sapiens
cctttccaattccaa

SEQ ID NO: 6096793 - DNA, 17 bp, Homo sapiens
cctttccaattccaaaa

SEQ ID NO: 6096794 - DNA, 23 bp, Homo sapiens
cctttccaccacagccagcacct

SEQ ID NO: 6096795 - DNA, 13 bp, Homo sapiens
cctttccacccag

SEQ ID NO: 6096796 - DNA, 19 bp, Homo sapiens
cctttccacccagaccctc

SEQ ID NO: 6096797 - DNA, 21 bp, Homo sapiens
cctttccagagaactgcagac

SEQ ID NO: 6096798 - DNA, 22 bp, Homo sapiens
cctttccagagaactgcagacc

SEQ ID NO: 6096799 - DNA, 18 bp, Homo sapiens
cctttccagagcaaccag

SEQ ID NO: 6096800 - DNA, 13 bp, Homo sapiens
cctttccagcctc

SEQ ID NO: 6096801 - DNA, 13 bp, Homo sapiens
cctttccaggaat

SEQ ID NO: 6096802 - DNA, 16 bp, Homo sapiens
cctttccagtgctgct

SEQ ID NO: 6096803 - DNA, 20 bp, Homo sapiens
cctttccagtggcctggctc

SEQ ID NO: 6096804 - DNA, 18 bp, Homo sapiens
cctttccatccatggcca

SEQ ID NO: 6096805 - DNA, 22 bp, Homo sapiens
cctttccatctgtccacatccc

SEQ ID NO: 6096806 - DNA, 22 bp, Homo sapiens
cctttcccaacacttcagactg

SEQ ID NO: 6096807 - DNA, 13 bp, Homo sapiens
cctttcccacagt

SEQ ID NO: 6096808 - DNA, 14 bp, Homo sapiens
cctttcccaccctc

SEQ ID NO: 6096809 - DNA, 11 bp, Homo sapiens
cctttcccact

SEQ ID NO: 6096810 - DNA, 22 bp, Homo sapiens
cctttcccatcaccccttcccc

SEQ ID NO: 6096811 - DNA, 20 bp, Homo sapiens
cctttcccatgatccagaac

SEQ ID NO: 6096812 - DNA, 21 bp, Homo sapiens
cctttcccatgatccagaact

SEQ ID NO: 6096813 - DNA, 14 bp, Homo sapiens
cctttcccatgctg

SEQ ID NO: 6096814 - DNA, 17 bp, Homo sapiens
cctttcccatgctgaat

SEQ ID NO: 6096815 - DNA, 21 bp, Homo sapiens
cctttccccactcagctgtgg

SEQ ID NO: 6096816 - DNA, 16 bp, Homo sapiens
cctcacctcatgccca

SEQ ID NO: 6096817 - DNA, 23 bp, Homo sapiens
cctcacctcatgcccaccccctg

SEQ ID NO: 6096818 - DNA, 11 bp, Homo sapiens
cctcacctcca

SEQ ID NO: 6096819 - DNA, 12 bp, Homo sapiens
cctcacctccat

SEQ ID NO: 6096820 - DNA, 18 bp, Homo sapiens
cctcacctcccagggcta

SEQ ID NO: 6096821 - DNA, 19 bp, Homo sapiens
cctcacctcccagggctac

SEQ ID NO: 6096822 - DNA, 13 bp, Homo sapiens
cctcacctctacc

SEQ ID NO: 6096823 - DNA, 19 bp, Homo sapiens
cctcacctctccaggtgct

SEQ ID NO: 6096824 - DNA, 20 bp, Homo sapiens
cctcacctctcccccaaggc

SEQ ID NO: 6096825 - DNA, 14 bp, Homo sapiens
cctcacctctgagg

SEQ ID NO: 6096826 - DNA, 13 bp, Homo sapiens
cctcacctctgat

SEQ ID NO: 6096827 - DNA, 18 bp, Homo sapiens
cctcacctctggactggc

SEQ ID NO: 6096828 - DNA, 21 bp, Homo sapiens
cctcacctgagacctccactc

SEQ ID NO: 6096829 - DNA, 16 bp, Homo sapiens
cctcacctgagagcca

SEQ ID NO: 6096830 - DNA, 20 bp, Homo sapiens
cctcacctgcatcctctccc

SEQ ID NO: 6096831 - DNA, 13 bp, Homo sapiens
cctcacctgcccc

SEQ ID NO: 6096832 - DNA, 18 bp, Homo sapiens
cctcacctgcccctctgt

SEQ ID NO: 6096833 - DNA, 13 bp, Homo sapiens
cctcacctgcctg

SEQ ID NO: 6096834 - DNA, 16 bp, Homo sapiens
cctcacctggcttccc

SEQ ID NO: 6096835 - DNA, 18 bp, Homo sapiens
cctcacctggcttcccag

SEQ ID NO: 6096836 - DNA, 23 bp, Homo sapiens
cctcacctggcttcccaggaccc

SEQ ID NO: 6096837 - DNA, 12 bp, Homo sapiens
cctcacctgggc

SEQ ID NO: 6096838 - DNA, 19 bp, Homo sapiens
cctcacctggtacctggac

SEQ ID NO: 6096839 - DNA, 19 bp, Homo sapiens
cctcacctgtcgcacccac

SEQ ID NO: 6096840 - DNA, 12 bp, Homo sapiens
cctcaccttcca

SEQ ID NO: 6096841 - DNA, 12 bp, Homo sapiens
cctcaccttcct

SEQ ID NO: 6096842 - DNA, 13 bp, Homo sapiens
cctcaccttcctg

SEQ ID NO: 6096843 - DNA, 18 bp, Homo sapiens
cctcaccttccttgaaat

SEQ ID NO: 6096844 - DNA, 22 bp, Homo sapiens
cctcaccttgcaacacacagac

SEQ ID NO: 6096845 - DNA, 18 bp, Homo sapiens
cctcaccttgggctgggg

SEQ ID NO: 6096846 - DNA, 20 bp, Homo sapiens
cctcaccttgggctggggga

SEQ ID NO: 6096847 - DNA, 20 bp, Homo sapiens
cctcaccttggggccttgat

SEQ ID NO: 6096848 - DNA, 21 bp, Homo sapiens
cctcacctttcccacagtctc

SEQ ID NO: 6096849 - DNA, 16 bp, Homo sapiens
cctcacgactggtcac

SEQ ID NO: 6096850 - DNA, 23 bp, Homo sapiens
cctcacgcaactcacacctcctt

SEQ ID NO: 6096851 - DNA, 14 bp, Homo sapiens
cctcacgcacctcc

SEQ ID NO: 6096852 - DNA, 17 bp, Homo sapiens
cctcacgcaggctgagt

SEQ ID NO: 6096853 - DNA, 14 bp, Homo sapiens
cctcacgcccagcc

SEQ ID NO: 6096854 - DNA, 23 bp, Homo sapiens
cctcacgcccagcctcctcccac

SEQ ID NO: 6096855 - DNA, 13 bp, Homo sapiens
cctcacgccccct

SEQ ID NO: 6096856 - DNA, 19 bp, Homo sapiens
cctcacgccccctgtgact

SEQ ID NO: 6096857 - DNA, 14 bp, Homo sapiens
cctcacgctctgga

SEQ ID NO: 6096858 - DNA, 15 bp, Homo sapiens
cctcacgctctggac

SEQ ID NO: 6096859 - DNA, 17 bp, Homo sapiens
cctcacggggttggctg

SEQ ID NO: 6096860 - DNA, 21 bp, Homo sapiens
cctcacggggttggctgttcc

SEQ ID NO: 6096861 - DNA, 19 bp, Homo sapiens
cctcacgtgaccagccccg

SEQ ID NO: 6096862 - DNA, 13 bp, Homo sapiens
cctcacgtgcagg

SEQ ID NO: 6096863 - DNA, 16 bp, Homo sapiens
cctcacgtgcaggaca

SEQ ID NO: 6096864 - DNA, 17 bp, Homo sapiens
cctcacgtgcaggacag

SEQ ID NO: 6096865 - DNA, 19 bp, Homo sapiens
cctcactagccatgcttta

SEQ ID NO: 6096866 - DNA, 22 bp, Homo sapiens
cctcactatcccggctgccctt

SEQ ID NO: 6096867 - DNA, 23 bp, Homo sapiens
cctcactatgacactgagcaaga

SEQ ID NO: 6096868 - DNA, 20 bp, Homo sapiens
cctcactatggtatgctggc

SEQ ID NO: 6096869 - DNA, 23 bp, Homo sapiens
cctcactatggtatgctggccag

SEQ ID NO: 6096870 - DNA, 21 bp, Homo sapiens
cctcactcaagaccaggctgc

SEQ ID NO: 6096871 - DNA, 15 bp, Homo sapiens
cctcactcaagcctg

SEQ ID NO: 6096872 - DNA, 21 bp, Homo sapiens
cctcactcaggaaccctggag

SEQ ID NO: 6096873 - DNA, 17 bp, Homo sapiens
cctcactccacactggc

SEQ ID NO: 6096874 - DNA, 22 bp, Homo sapiens
cctcactccactcccctcatcc

SEQ ID NO: 6096875 - DNA, 19 bp, Homo sapiens
cctcactccccagggagct

SEQ ID NO: 6096876 - DNA, 18 bp, Homo sapiens
cctcactccctaggccca

SEQ ID NO: 6096877 - DNA, 23 bp, Homo sapiens
cctcactccctaggcccaagtct

SEQ ID NO: 6096878 - DNA, 18 bp, Homo sapiens
cctcactccctctgcaga

SEQ ID NO: 6096879 - DNA, 22 bp, Homo sapiens
cctcactcccttctacctgcca

SEQ ID NO: 6096880 - DNA, 12 bp, Homo sapiens
cctcactcctgt

SEQ ID NO: 6096881 - DNA, 13 bp, Homo sapiens
cctcactcctgtt

SEQ ID NO: 6096882 - DNA, 14 bp, Homo sapiens
cctcactctcagga

SEQ ID NO: 6096883 - DNA, 20 bp, Homo sapiens
cctcactctgctaccttgcc

SEQ ID NO: 6096884 - DNA, 14 bp, Homo sapiens
cctcactctgtcag

SEQ ID NO: 6096885 - DNA, 19 bp, Homo sapiens
cctcactctgtcagccagc

SEQ ID NO: 6096886 - DNA, 22 bp, Homo sapiens
cctcactctgtcagccagccgc

SEQ ID NO: 6096887 - DNA, 15 bp, Homo sapiens
cctcactcttcctca

SEQ ID NO: 6096888 - DNA, 20 bp, Homo sapiens
cctcactcttcctcatcctg

SEQ ID NO: 6096889 - DNA, 12 bp, Homo sapiens
cctcactcttga

SEQ ID NO: 6096890 - DNA, 13 bp, Homo sapiens
cctcactcttgaa

SEQ ID NO: 6096891 - DNA, 14 bp, Homo sapiens
cctcactcttgaag

SEQ ID NO: 6096892 - DNA, 15 bp, Homo sapiens
cctcactcttgccaa

SEQ ID NO: 6096893 - DNA, 16 bp, Homo sapiens
cctcactcttgccaac

SEQ ID NO: 6096894 - DNA, 23 bp, Homo sapiens
cctcactctttatagtgcacaaa

SEQ ID NO: 6096895 - DNA, 20 bp, Homo sapiens
cctcactgaaaacatctgga

SEQ ID NO: 6096896 - DNA, 13 bp, Homo sapiens
cctcactgaagga

SEQ ID NO: 6096897 - DNA, 22 bp, Homo sapiens
cctcactgaaggacctgagctg

SEQ ID NO: 6096898 - DNA, 17 bp, Homo sapiens
cctcactgaatgcctca

SEQ ID NO: 6096899 - DNA, 15 bp, Homo sapiens
cctcactgagcctca

SEQ ID NO: 6096900 - DNA, 23 bp, Homo sapiens
cctcactgcatctttctcttccc

SEQ ID NO: 6096901 - DNA, 20 bp, Homo sapiens
cctcactgccccaccagcca

SEQ ID NO: 6096902 - DNA, 16 bp, Homo sapiens
cctcactgcccgcaca

SEQ ID NO: 6096903 - DNA, 21 bp, Homo sapiens
cctcactgcccgcacaccctc

SEQ ID NO: 6096904 - DNA, 22 bp, Homo sapiens
cctcactgcccgcacaccctca

SEQ ID NO: 6096905 - DNA, 14 bp, Homo sapiens
cctcactgccctcc

SEQ ID NO: 6096906 - DNA, 18 bp, Homo sapiens
cctcactgcctcatggca

SEQ ID NO: 6096907 - DNA, 14 bp, Homo sapiens
cctcactgccttcc

SEQ ID NO: 6096908 - DNA, 19 bp, Homo sapiens
cctcactgccttccaggag

SEQ ID NO: 6096909 - DNA, 20 bp, Homo sapiens
cctcactgctggggagtccc

SEQ ID NO: 6096910 - DNA, 12 bp, Homo sapiens
cctcactggcca

SEQ ID NO: 6096911 - DNA, 15 bp, Homo sapiens
cctcactggccatcc

SEQ ID NO: 6096912 - DNA, 16 bp, Homo sapiens
cctcactggcctgcca

SEQ ID NO: 6096913 - DNA, 13 bp, Homo sapiens
cctcactggctct

SEQ ID NO: 6096914 - DNA, 18 bp, Homo sapiens
cctcactggctctcctgg

SEQ ID NO: 6096915 - DNA, 22 bp, Homo sapiens
cctcactggctggactggaggc

SEQ ID NO: 6096916 - DNA, 17 bp, Homo sapiens
cctcactggctggggca

SEQ ID NO: 6096917 - DNA, 18 bp, Homo sapiens
cctcactgggctcactgc

SEQ ID NO: 6096918 - DNA, 13 bp, Homo sapiens
cctcactgggggc

SEQ ID NO: 6096919 - DNA, 14 bp, Homo sapiens
cctcactgggggct

SEQ ID NO: 6096920 - DNA, 13 bp, Homo sapiens
cctcactgggtgg

SEQ ID NO: 6096921 - DNA, 21 bp, Homo sapiens
cctcactgggtgtggcctggc

SEQ ID NO: 6096922 - DNA, 15 bp, Homo sapiens
cctcactggtgcatt

SEQ ID NO: 6096923 - DNA, 18 bp, Homo sapiens
cctcactggtgcatttaa

SEQ ID NO: 6096924 - DNA, 19 bp, Homo sapiens
cctcactgtagcaggttct

SEQ ID NO: 6096925 - DNA, 13 bp, Homo sapiens
cctcactgtcctg

SEQ ID NO: 6096926 - DNA, 16 bp, Homo sapiens
cctcactgtcctgtga

SEQ ID NO: 6096927 - DNA, 16 bp, Homo sapiens
cctcactgttgaattt

SEQ ID NO: 6096928 - DNA, 21 bp, Homo sapiens
cctcacttcccgtagctgcca

SEQ ID NO: 6096929 - DNA, 22 bp, Homo sapiens
cctcacttcccgtagctgccag

SEQ ID NO: 6096930 - DNA, 14 bp, Homo sapiens
cctcacttccctgg

SEQ ID NO: 6096931 - DNA, 15 bp, Homo sapiens
cctcacttccctggg

SEQ ID NO: 6096932 - DNA, 16 bp, Homo sapiens
cctcacttccctggga

SEQ ID NO: 6096933 - DNA, 11 bp, Homo sapiens
cctcacttcct

SEQ ID NO: 6096934 - DNA, 14 bp, Homo sapiens
cctcacttctgtct

SEQ ID NO: 6096935 - DNA, 15 bp, Homo sapiens
cctcacttctgtctc

SEQ ID NO: 6096936 - DNA, 18 bp, Homo sapiens
cctcacttctgtctcctg

SEQ ID NO: 6096937 - DNA, 16 bp, Homo sapiens
cctcacttgaggagga

SEQ ID NO: 6096938 - DNA, 18 bp, Homo sapiens
cctcacttgattcatctc

SEQ ID NO: 6096939 - DNA, 20 bp, Homo sapiens
cctcacttgattcatctctg

SEQ ID NO: 6096940 - DNA, 23 bp, Homo sapiens
cctcacttgattcatctctggtt

SEQ ID NO: 6096941 - DNA, 18 bp, Homo sapiens
cctcacttggctgtctga

SEQ ID NO: 6096942 - DNA, 21 bp, Homo sapiens
cctcacttggctgtctgacca

SEQ ID NO: 6096943 - DNA, 22 bp, Homo sapiens
cctcacttggctgtctgaccag

SEQ ID NO: 6096944 - DNA, 21 bp, Homo sapiens
cctcacttggtctgccaggcc

SEQ ID NO: 6096945 - DNA, 22 bp, Homo sapiens
cctcacttggtctgccaggccc

SEQ ID NO: 6096946 - DNA, 14 bp, Homo sapiens
cctcactttcttct

SEQ ID NO: 6096947 - DNA, 19 bp, Homo sapiens
cctcagaaaacttattaac

SEQ ID NO: 6096948 - DNA, 16 bp, Homo sapiens
cctcagaaaggatttt

SEQ ID NO: 6096949 - DNA, 15 bp, Homo sapiens
cctcagaaagtcacc

SEQ ID NO: 6096950 - DNA, 19 bp, Homo sapiens
cctcagaaagtgcagcatg

SEQ ID NO: 6096951 - DNA, 21 bp, Homo sapiens
cctcagaaagtgcagcatgga

SEQ ID NO: 6096952 - DNA, 21 bp, Homo sapiens
cctcagaacaaagtgagacag

SEQ ID NO: 6096953 - DNA, 23 bp, Homo sapiens
cctcagaacaaagtgagacagtc

SEQ ID NO: 6096954 - DNA, 15 bp, Homo sapiens
cctcagaacaccctg

SEQ ID NO: 6096955 - DNA, 22 bp, Homo sapiens
cctcagaacccacagtgagagg

SEQ ID NO: 6096956 - DNA, 19 bp, Homo sapiens
cctcagaagaaaacaaagt

SEQ ID NO: 6096957 - DNA, 20 bp, Homo sapiens
cctcagaagaaaacttttgt

SEQ ID NO: 6096958 - DNA, 23 bp, Homo sapiens
cctcagaagcctcgactgagctt

SEQ ID NO: 6096959 - DNA, 14 bp, Homo sapiens
cctcagaagccttc

SEQ ID NO: 6096960 - DNA, 18 bp, Homo sapiens
cctcagaagccttcttgc

SEQ ID NO: 6096961 - DNA, 19 bp, Homo sapiens
cctcagaagccttcttgct

SEQ ID NO: 6096962 - DNA, 14 bp, Homo sapiens
cctcagaaggcccc

SEQ ID NO: 6096963 - DNA, 16 bp, Homo sapiens
cctcagaaggccccag

SEQ ID NO: 6096964 - DNA, 14 bp, Homo sapiens
cctcagaatagtga

SEQ ID NO: 6096965 - DNA, 20 bp, Homo sapiens
cctcagaatattaagcacat

SEQ ID NO: 6096966 - DNA, 15 bp, Homo sapiens
cctcagacagactta

SEQ ID NO: 6096967 - DNA, 17 bp, Homo sapiens
cctcagacatctccagt

SEQ ID NO: 6096968 - DNA, 18 bp, Homo sapiens
cctcagaccaactctctc

SEQ ID NO: 6096969 - DNA, 13 bp, Homo sapiens
cctcagacccagc

SEQ ID NO: 6096970 - DNA, 19 bp, Homo sapiens
cctcagacccagcggtcca

SEQ ID NO: 6096971 - DNA, 14 bp, Homo sapiens
cctcagacccagga

SEQ ID NO: 6096972 - DNA, 21 bp, Homo sapiens
cctcagacccaggagtccagc

SEQ ID NO: 6096973 - DNA, 21 bp, Homo sapiens
cctcagaccccaggtcagcat

SEQ ID NO: 6096974 - DNA, 13 bp, Homo sapiens
cctcagactcaga

SEQ ID NO: 6096975 - DNA, 19 bp, Homo sapiens
cctcagactcagaggtcca

SEQ ID NO: 6096976 - DNA, 23 bp, Homo sapiens
cctcagactcagaggtccaggcc

SEQ ID NO: 6096977 - DNA, 22 bp, Homo sapiens
cctcagactcatacagaaggtg

SEQ ID NO: 6096978 - DNA, 15 bp, Homo sapiens
cctcagactcattgt

SEQ ID NO: 6096979 - DNA, 15 bp, Homo sapiens
cctcagactctaaga

SEQ ID NO: 6096980 - DNA, 14 bp, Homo sapiens
cctcagactgctca

SEQ ID NO: 6096981 - DNA, 19 bp, Homo sapiens
cctcagacttaccaggaag

SEQ ID NO: 6096982 - DNA, 21 bp, Homo sapiens
cctcagagaatgatcaccctg

SEQ ID NO: 6096983 - DNA, 18 bp, Homo sapiens
cctcagagacaccaaact

SEQ ID NO: 6096984 - DNA, 13 bp, Homo sapiens
cctcagagacagc

SEQ ID NO: 6096985 - DNA, 16 bp, Homo sapiens
cctcagagacagcgcg

SEQ ID NO: 6096986 - DNA, 16 bp, Homo sapiens
cctcagagaccagggc

SEQ ID NO: 6096987 - DNA, 17 bp, Homo sapiens
cctcagagaccagggct

SEQ ID NO: 6096988 - DNA, 12 bp, Homo sapiens
cctcagagaggc

SEQ ID NO: 6096989 - DNA, 15 bp, Homo sapiens
cctcagagatgatca

SEQ ID NO: 6096990 - DNA, 16 bp, Homo sapiens
cctcagagatgatcag

SEQ ID NO: 6096991 - DNA, 22 bp, Homo sapiens
cctcagagcatttaaggaaact

SEQ ID NO: 6096992 - DNA, 11 bp, Homo sapiens
cctcagagcct

SEQ ID NO: 6096993 - DNA, 14 bp, Homo sapiens
cctcagagcctgac

SEQ ID NO: 6096994 - DNA, 16 bp, Homo sapiens
cctcagagcctgacct

SEQ ID NO: 6096995 - DNA, 22 bp, Homo sapiens
cctttccccagcatcactcccc

SEQ ID NO: 6096996 - DNA, 16 bp, Homo sapiens
cctttccccagcctct

SEQ ID NO: 6096997 - DNA, 11 bp, Homo sapiens
cctttccccat

SEQ ID NO: 6096998 - DNA, 20 bp, Homo sapiens
cctttccccattcagtgaca

SEQ ID NO: 6096999 - DNA, 23 bp, Homo sapiens
cctttccccattcattcctgatg

SEQ ID NO: 6097000 - DNA, 13 bp, Homo sapiens
cctttcccctaga

SEQ ID NO: 6097001 - DNA, 18 bp, Homo sapiens
cctttcccctagatccag

SEQ ID NO: 6097002 - DNA, 16 bp, Homo sapiens
cctttccccttccttt

SEQ ID NO: 6097003 - DNA, 18 bp, Homo sapiens
cctttcccgggctgtcca

SEQ ID NO: 6097004 - DNA, 22 bp, Homo sapiens
cctttcccgggctgtccactag

SEQ ID NO: 6097005 - DNA, 12 bp, Homo sapiens
cctttccctaag

SEQ ID NO: 6097006 - DNA, 12 bp, Homo sapiens
cctttccctcca

SEQ ID NO: 6097007 - DNA, 20 bp, Homo sapiens
cctttccctccactccttcc

SEQ ID NO: 6097008 - DNA, 22 bp, Homo sapiens
cctttccctccgaacgctgctc

SEQ ID NO: 6097009 - DNA, 14 bp, Homo sapiens
cctttccctcgcta

SEQ ID NO: 6097010 - DNA, 11 bp, Homo sapiens
cctttccctct

SEQ ID NO: 6097011 - DNA, 13 bp, Homo sapiens
cctttccctctcc

SEQ ID NO: 6097012 - DNA, 15 bp, Homo sapiens
cctttccctctccca

SEQ ID NO: 6097013 - DNA, 17 bp, Homo sapiens
cctttccctgcatccct

SEQ ID NO: 6097014 - DNA, 14 bp, Homo sapiens
cctttccctggagc

SEQ ID NO: 6097015 - DNA, 19 bp, Homo sapiens
cctttcccttgtagctcct

SEQ ID NO: 6097016 - DNA, 14 bp, Homo sapiens
cctttccgctgtcg

SEQ ID NO: 6097017 - DNA, 18 bp, Homo sapiens
cctttcctatctttacat

SEQ ID NO: 6097018 - DNA, 15 bp, Homo sapiens
cctttcctatttccc

SEQ ID NO: 6097019 - DNA, 19 bp, Homo sapiens
cctttcctccccatacaca

SEQ ID NO: 6097020 - DNA, 14 bp, Homo sapiens
cctttcctccccca

SEQ ID NO: 6097021 - DNA, 18 bp, Homo sapiens
cctttcctcccccagcgt

SEQ ID NO: 6097022 - DNA, 23 bp, Homo sapiens
cctttcctccctccctcgatccc

SEQ ID NO: 6097023 - DNA, 15 bp, Homo sapiens
cctttcctccgcctg

SEQ ID NO: 6097024 - DNA, 17 bp, Homo sapiens
cctttcctccgcctgtc

SEQ ID NO: 6097025 - DNA, 20 bp, Homo sapiens
cctttcctcggtctcccttc

SEQ ID NO: 6097026 - DNA, 15 bp, Homo sapiens
cctttcctctccctc

SEQ ID NO: 6097027 - DNA, 22 bp, Homo sapiens
cctttcctctccctcaggggca

SEQ ID NO: 6097028 - DNA, 16 bp, Homo sapiens
cctttcctctcctctc

SEQ ID NO: 6097029 - DNA, 19 bp, Homo sapiens
cctttcctctcctctctgg

SEQ ID NO: 6097030 - DNA, 17 bp, Homo sapiens
cctttcctctctcctgt

SEQ ID NO: 6097031 - DNA, 19 bp, Homo sapiens
cctttcctctgcagcactt

SEQ ID NO: 6097032 - DNA, 21 bp, Homo sapiens
cctttcctctgcagcacttta

SEQ ID NO: 6097033 - DNA, 12 bp, Homo sapiens
cctttcctgatg

SEQ ID NO: 6097034 - DNA, 18 bp, Homo sapiens
cctttcctgatgcccctg

SEQ ID NO: 6097035 - DNA, 21 bp, Homo sapiens
cctttcctgccgtccctcctg

SEQ ID NO: 6097036 - DNA, 22 bp, Homo sapiens
cctttcctgccgtccctcctgt

SEQ ID NO: 6097037 - DNA, 11 bp, Homo sapiens
cctttcctgga

SEQ ID NO: 6097038 - DNA, 19 bp, Homo sapiens
cctttcctggcagtctcag

SEQ ID NO: 6097039 - DNA, 12 bp, Homo sapiens
cctttcctggtt

SEQ ID NO: 6097040 - DNA, 15 bp, Homo sapiens
cctttcctggtttcc

SEQ ID NO: 6097041 - DNA, 15 bp, Homo sapiens
cctttcctgtcccac

SEQ ID NO: 6097042 - DNA, 20 bp, Homo sapiens
cctttcctgtgccaacctga

SEQ ID NO: 6097043 - DNA, 14 bp, Homo sapiens
cctttcctgtgtga

SEQ ID NO: 6097044 - DNA, 11 bp, Homo sapiens
cctttcctgtt

SEQ ID NO: 6097045 - DNA, 18 bp, Homo sapiens
cctttcctgttcagcatt

SEQ ID NO: 6097046 - DNA, 14 bp, Homo sapiens
cctttccttcagtc

SEQ ID NO: 6097047 - DNA, 23 bp, Homo sapiens
cctttccttcccaggccctttgg

SEQ ID NO: 6097048 - DNA, 11 bp, Homo sapiens
cctttcctttc

SEQ ID NO: 6097049 - DNA, 12 bp, Homo sapiens
cctttcctttcc

SEQ ID NO: 6097050 - DNA, 16 bp, Homo sapiens
cctttcgaaagcaatg

SEQ ID NO: 6097051 - DNA, 15 bp, Homo sapiens
cctttcgaggcctga

SEQ ID NO: 6097052 - DNA, 16 bp, Homo sapiens
cctttcgaggcctgaa

SEQ ID NO: 6097053 - DNA, 18 bp, Homo sapiens
cctttcgaggcctgaagc

SEQ ID NO: 6097054 - DNA, 17 bp, Homo sapiens
cctttcggatccaggga

SEQ ID NO: 6097055 - DNA, 21 bp, Homo sapiens
cctttcggcagaggaaccccc

SEQ ID NO: 6097056 - DNA, 21 bp, Homo sapiens
cctttcgttctgctgaccaaa

SEQ ID NO: 6097057 - DNA, 15 bp, Homo sapiens
cctttctaaacaaga

SEQ ID NO: 6097058 - DNA, 19 bp, Homo sapiens
cctttctaagcaggaaggt

SEQ ID NO: 6097059 - DNA, 20 bp, Homo sapiens
cctttctaaggatagccttt

SEQ ID NO: 6097060 - DNA, 21 bp, Homo sapiens
cctttctaaggctcagcccca

SEQ ID NO: 6097061 - DNA, 22 bp, Homo sapiens
cctttctaaggctcagccccac

SEQ ID NO: 6097062 - DNA, 13 bp, Homo sapiens
cctttctaataaa

SEQ ID NO: 6097063 - DNA, 15 bp, Homo sapiens
cctttctagccttag

SEQ ID NO: 6097064 - DNA, 15 bp, Homo sapiens
cctttctagttgaaa

SEQ ID NO: 6097065 - DNA, 16 bp, Homo sapiens
cctttctataatttta

SEQ ID NO: 6097066 - DNA, 15 bp, Homo sapiens
cctttctcaactgtc

SEQ ID NO: 6097067 - DNA, 10 bp, Homo sapiens
cctttctcac

SEQ ID NO: 6097068 - DNA, 14 bp, Homo sapiens
cctttctccacacc

SEQ ID NO: 6097069 - DNA, 14 bp, Homo sapiens
cctttctccacagg

SEQ ID NO: 6097070 - DNA, 13 bp, Homo sapiens
cctttctccagcc

SEQ ID NO: 6097071 - DNA, 16 bp, Homo sapiens
cctttctccagccagc

SEQ ID NO: 6097072 - DNA, 17 bp, Homo sapiens
cctttctccagccagca

SEQ ID NO: 6097073 - DNA, 22 bp, Homo sapiens
cctttctccagccagcaatgat

SEQ ID NO: 6097074 - DNA, 14 bp, Homo sapiens
cctttctccagccc

SEQ ID NO: 6097075 - DNA, 13 bp, Homo sapiens
cctttctccaggc

SEQ ID NO: 6097076 - DNA, 20 bp, Homo sapiens
cctttctccaggccctcaga

SEQ ID NO: 6097077 - DNA, 17 bp, Homo sapiens
cctttctcccaggccag

SEQ ID NO: 6097078 - DNA, 15 bp, Homo sapiens
cctttctcccctgcc

SEQ ID NO: 6097079 - DNA, 17 bp, Homo sapiens
cctttctccctgcagcc

SEQ ID NO: 6097080 - DNA, 20 bp, Homo sapiens
cctttctccctgcagccttt

SEQ ID NO: 6097081 - DNA, 17 bp, Homo sapiens
cctttctcctccccacc

SEQ ID NO: 6097082 - DNA, 14 bp, Homo sapiens
cctttctcctttgt

SEQ ID NO: 6097083 - DNA, 21 bp, Homo sapiens
cctttctcggggtcaggttct

SEQ ID NO: 6097084 - DNA, 15 bp, Homo sapiens
cctttctctctcctc

SEQ ID NO: 6097085 - DNA, 15 bp, Homo sapiens
cctttctctctctaa

SEQ ID NO: 6097086 - DNA, 17 bp, Homo sapiens
cctttctctgagagaga

SEQ ID NO: 6097087 - DNA, 12 bp, Homo sapiens
cctttctctgcc

SEQ ID NO: 6097088 - DNA, 19 bp, Homo sapiens
cctttctctggctccagaa

SEQ ID NO: 6097089 - DNA, 14 bp, Homo sapiens
cctttctctgtata

SEQ ID NO: 6097090 - DNA, 14 bp, Homo sapiens
cctttctcttgctg

SEQ ID NO: 6097091 - DNA, 12 bp, Homo sapiens
cctttctctttc

SEQ ID NO: 6097092 - DNA, 16 bp, Homo sapiens
cctttctctttcgtta

SEQ ID NO: 6097093 - DNA, 14 bp, Homo sapiens
cctttctctttctc

SEQ ID NO: 6097094 - DNA, 17 bp, Homo sapiens
cctttctctttctctct

SEQ ID NO: 6097095 - DNA, 18 bp, Homo sapiens
cctttctctttctctctt

SEQ ID NO: 6097096 - DNA, 22 bp, Homo sapiens
cctttctcttttcccctttcct

SEQ ID NO: 6097097 - DNA, 13 bp, Homo sapiens
cctttctgactgt

SEQ ID NO: 6097098 - DNA, 23 bp, Homo sapiens
cctttctgagtgacatgggtgtg

SEQ ID NO: 6097099 - DNA, 21 bp, Homo sapiens
cctttctgccagggatggcag

SEQ ID NO: 6097100 - DNA, 11 bp, Homo sapiens
cctttctgccc

SEQ ID NO: 6097101 - DNA, 18 bp, Homo sapiens
cctttctgcccacttccc

SEQ ID NO: 6097102 - DNA, 14 bp, Homo sapiens
cctttctgcccagc

SEQ ID NO: 6097103 - DNA, 20 bp, Homo sapiens
cctttctgcccagcctgctc

SEQ ID NO: 6097104 - DNA, 12 bp, Homo sapiens
cctttctgcccc

SEQ ID NO: 6097105 - DNA, 14 bp, Homo sapiens
cctttctgcccccc

SEQ ID NO: 6097106 - DNA, 22 bp, Homo sapiens
cctttctgccccccagggctag

SEQ ID NO: 6097107 - DNA, 15 bp, Homo sapiens
cctttctgccgaccc

SEQ ID NO: 6097108 - DNA, 17 bp, Homo sapiens
cctttctgccgacccct

SEQ ID NO: 6097109 - DNA, 14 bp, Homo sapiens
cctttctgccttgg

SEQ ID NO: 6097110 - DNA, 15 bp, Homo sapiens
cctttctgccttggc

SEQ ID NO: 6097111 - DNA, 16 bp, Homo sapiens
cctttctgccttggcc

SEQ ID NO: 6097112 - DNA, 21 bp, Homo sapiens
cctttctgccttggcctcggc

SEQ ID NO: 6097113 - DNA, 22 bp, Homo sapiens
cctttctggcacgaaatggctg

SEQ ID NO: 6097114 - DNA, 14 bp, Homo sapiens
cctttctggcctgt

SEQ ID NO: 6097115 - DNA, 12 bp, Homo sapiens
cctttctgggct

SEQ ID NO: 6097116 - DNA, 15 bp, Homo sapiens
cctttctgggctttc

SEQ ID NO: 6097117 - DNA, 16 bp, Homo sapiens
cctttctgggctttct

SEQ ID NO: 6097118 - DNA, 22 bp, Homo sapiens
cctttctgggctttctcctgga

SEQ ID NO: 6097119 - DNA, 22 bp, Homo sapiens
cctttctgtatcaagcccctgt

SEQ ID NO: 6097120 - DNA, 14 bp, Homo sapiens
cctttctgtgccct

SEQ ID NO: 6097121 - DNA, 17 bp, Homo sapiens
cctttctgtggtgaggg

SEQ ID NO: 6097122 - DNA, 11 bp, Homo sapiens
cctttctgtgt

SEQ ID NO: 6097123 - DNA, 12 bp, Homo sapiens
cctttctgtgtt

SEQ ID NO: 6097124 - DNA, 17 bp, Homo sapiens
cctttcttatcttgacc

SEQ ID NO: 6097125 - DNA, 21 bp, Homo sapiens
cctttcttatttgcaataaaa

SEQ ID NO: 6097126 - DNA, 15 bp, Homo sapiens
cctttcttccccacc

SEQ ID NO: 6097127 - DNA, 17 bp, Homo sapiens
cctttcttccccaccct

SEQ ID NO: 6097128 - DNA, 18 bp, Homo sapiens
cctttcttccccaccctg

SEQ ID NO: 6097129 - DNA, 11 bp, Homo sapiens
cctttcttccg

SEQ ID NO: 6097130 - DNA, 16 bp, Homo sapiens
cctttcttccttcctt

SEQ ID NO: 6097131 - DNA, 11 bp, Homo sapiens
cctttcttctg

SEQ ID NO: 6097132 - DNA, 16 bp, Homo sapiens
cctttcttctgtgtta

SEQ ID NO: 6097133 - DNA, 15 bp, Homo sapiens
cctttcttggccagt

SEQ ID NO: 6097134 - DNA, 18 bp, Homo sapiens
cctttcttggttcataaa

SEQ ID NO: 6097135 - DNA, 23 bp, Homo sapiens
cctttcttgtagccatggctggg

SEQ ID NO: 6097136 - DNA, 17 bp, Homo sapiens
cctttcttgtgccctgg

SEQ ID NO: 6097137 - DNA, 12 bp, Homo sapiens
cctttctttgcc

SEQ ID NO: 6097138 - DNA, 13 bp, Homo sapiens
cctttctttgcct

SEQ ID NO: 6097139 - DNA, 17 bp, Homo sapiens
cctttctttgcctctgc

SEQ ID NO: 6097140 - DNA, 19 bp, Homo sapiens
cctttcttttgaaatgcca

SEQ ID NO: 6097141 - DNA, 16 bp, Homo sapiens
cctttctttttcttct

SEQ ID NO: 6097142 - DNA, 20 bp, Homo sapiens
cctttcttttttttcttggt

SEQ ID NO: 6097143 - DNA, 17 bp, Homo sapiens
cctttgaaacctgctct

SEQ ID NO: 6097144 - DNA, 17 bp, Homo sapiens
cctttgaacgtgcttct

SEQ ID NO: 6097145 - DNA, 22 bp, Homo sapiens
cctttgaacttgattgcctatg

SEQ ID NO: 6097146 - DNA, 14 bp, Homo sapiens
cctttgaagaattg

SEQ ID NO: 6097147 - DNA, 20 bp, Homo sapiens
cctttgaagcctcagctacc

SEQ ID NO: 6097148 - DNA, 17 bp, Homo sapiens
cctttgaagtgcctctg

SEQ ID NO: 6097149 - DNA, 22 bp, Homo sapiens
cctttgaagtgcctctgattct

SEQ ID NO: 6097150 - DNA, 14 bp, Homo sapiens
cctttgaatatttt

SEQ ID NO: 6097151 - DNA, 21 bp, Homo sapiens
cctttgaatattttttgaagg

SEQ ID NO: 6097152 - DNA, 14 bp, Homo sapiens
cctttgaatcctct

SEQ ID NO: 6097153 - DNA, 17 bp, Homo sapiens
cctttgaatgtaaccaa

SEQ ID NO: 6097154 - DNA, 18 bp, Homo sapiens
cctttgaatgttaatttt

SEQ ID NO: 6097155 - DNA, 18 bp, Homo sapiens
cctttgaattacagcagt

SEQ ID NO: 6097156 - DNA, 15 bp, Homo sapiens
cctttgacctgcctc

SEQ ID NO: 6097157 - DNA, 16 bp, Homo sapiens
cctttgacctgttcag

SEQ ID NO: 6097158 - DNA, 13 bp, Homo sapiens
cctttgacttcag

SEQ ID NO: 6097159 - DNA, 14 bp, Homo sapiens
cctttgacttcagc

SEQ ID NO: 6097160 - DNA, 15 bp, Homo sapiens
cctttgacttcagct

SEQ ID NO: 6097161 - DNA, 18 bp, Homo sapiens
cctttgagaatgtgattc

SEQ ID NO: 6097162 - DNA, 17 bp, Homo sapiens
cctttgagacagtttct

SEQ ID NO: 6097163 - DNA, 19 bp, Homo sapiens
cctttgagacagtttctta

SEQ ID NO: 6097164 - DNA, 22 bp, Homo sapiens
cctttgagatctggggaggcag

SEQ ID NO: 6097165 - DNA, 15 bp, Homo sapiens
cctttgagcttctcc

SEQ ID NO: 6097166 - DNA, 13 bp, Homo sapiens
cctttgaggcccc

SEQ ID NO: 6097167 - DNA, 22 bp, Homo sapiens
cctttgaggtctaaacaaataa

SEQ ID NO: 6097168 - DNA, 19 bp, Homo sapiens
cctttgagtgcagtcctga

SEQ ID NO: 6097169 - DNA, 16 bp, Homo sapiens
cctttgagtgtgggac

SEQ ID NO: 6097170 - DNA, 17 bp, Homo sapiens
cctttgataaaataaat

SEQ ID NO: 6097171 - DNA, 14 bp, Homo sapiens
cctttgataaatgt

SEQ ID NO: 6097172 - DNA, 19 bp, Homo sapiens
cctttgatagaagataatg

SEQ ID NO: 6097173 - DNA, 18 bp, Homo sapiens
cctttgatcccagaaagt

SEQ ID NO: 6097174 - DNA, 20 bp, Homo sapiens
cctttgatgaattcttcctc

SEQ ID NO: 6097175 - DNA, 21 bp, Homo sapiens
cctttgattaaagactccagt

SEQ ID NO: 6097176 - DNA, 15 bp, Homo sapiens
cctttgattccattt

SEQ ID NO: 6097177 - DNA, 23 bp, Homo sapiens
cctcagagcgccaggaagccaga

SEQ ID NO: 6097178 - DNA, 12 bp, Homo sapiens
cctcagagcttc

SEQ ID NO: 6097179 - DNA, 11 bp, Homo sapiens
cctcagaggca

SEQ ID NO: 6097180 - DNA, 13 bp, Homo sapiens
cctcagaggcagc

SEQ ID NO: 6097181 - DNA, 16 bp, Homo sapiens
cctcagaggcagcttc

SEQ ID NO: 6097182 - DNA, 21 bp, Homo sapiens
cctcagaggccccttgctgct

SEQ ID NO: 6097183 - DNA, 17 bp, Homo sapiens
cctcagaggctgagccc

SEQ ID NO: 6097184 - DNA, 20 bp, Homo sapiens
cctcagaggctgagccctgt

SEQ ID NO: 6097185 - DNA, 13 bp, Homo sapiens
cctcagagtccag

SEQ ID NO: 6097186 - DNA, 18 bp, Homo sapiens
cctcagagtccaggcccc

SEQ ID NO: 6097187 - DNA, 22 bp, Homo sapiens
cctcagatagacctgtgacctg

SEQ ID NO: 6097188 - DNA, 15 bp, Homo sapiens
cctcagatctctctc

SEQ ID NO: 6097189 - DNA, 22 bp, Homo sapiens
cctcagatgatggggtcagcag

SEQ ID NO: 6097190 - DNA, 14 bp, Homo sapiens
cctcagatggcaca

SEQ ID NO: 6097191 - DNA, 14 bp, Homo sapiens
cctcagatggcagc

SEQ ID NO: 6097192 - DNA, 23 bp, Homo sapiens
cctcagatggcagcttttaaaag

SEQ ID NO: 6097193 - DNA, 19 bp, Homo sapiens
cctcagatgggaattgcac

SEQ ID NO: 6097194 - DNA, 16 bp, Homo sapiens
cctcagatgtcccttg

SEQ ID NO: 6097195 - DNA, 20 bp, Homo sapiens
cctcagattacacttctcca

SEQ ID NO: 6097196 - DNA, 13 bp, Homo sapiens
cctcagattcttc

SEQ ID NO: 6097197 - DNA, 13 bp, Homo sapiens
cctcagatttcca

SEQ ID NO: 6097198 - DNA, 22 bp, Homo sapiens
cctcagcaacctgtaagactga

SEQ ID NO: 6097199 - DNA, 20 bp, Homo sapiens
cctcagcaatataggaggca

SEQ ID NO: 6097200 - DNA, 13 bp, Homo sapiens
cctcagcacccca

SEQ ID NO: 6097201 - DNA, 17 bp, Homo sapiens
cctcagcacccctccag

SEQ ID NO: 6097202 - DNA, 17 bp, Homo sapiens
cctcagcaccccttcca

SEQ ID NO: 6097203 - DNA, 18 bp, Homo sapiens
cctcagcaccccttccat

SEQ ID NO: 6097204 - DNA, 20 bp, Homo sapiens
cctcagcaccccttccatgt

SEQ ID NO: 6097205 - DNA, 22 bp, Homo sapiens
cctcagcaccccttccatgtgg

SEQ ID NO: 6097206 - DNA, 22 bp, Homo sapiens
cctcagcagctctggctctgcc

SEQ ID NO: 6097207 - DNA, 14 bp, Homo sapiens
cctcagcagggcat

SEQ ID NO: 6097208 - DNA, 14 bp, Homo sapiens
cctcagcatcctgg

SEQ ID NO: 6097209 - DNA, 20 bp, Homo sapiens
cctcagcatttccttccagc

SEQ ID NO: 6097210 - DNA, 22 bp, Homo sapiens
cctcagcatttccttccagccc

SEQ ID NO: 6097211 - DNA, 15 bp, Homo sapiens
cctcagccaaacaca

SEQ ID NO: 6097212 - DNA, 21 bp, Homo sapiens
cctcagccaaacacagagcgg

SEQ ID NO: 6097213 - DNA, 16 bp, Homo sapiens
cctcagccacacccag

SEQ ID NO: 6097214 - DNA, 15 bp, Homo sapiens
cctcagccacgcctc

SEQ ID NO: 6097215 - DNA, 17 bp, Homo sapiens
cctcagccacgcctctc

SEQ ID NO: 6097216 - DNA, 13 bp, Homo sapiens
cctcagccactcc

SEQ ID NO: 6097217 - DNA, 19 bp, Homo sapiens
cctcagccactcccagggg

SEQ ID NO: 6097218 - DNA, 16 bp, Homo sapiens
cctcagccagagaagc

SEQ ID NO: 6097219 - DNA, 17 bp, Homo sapiens
cctcagccagagaagct

SEQ ID NO: 6097220 - DNA, 20 bp, Homo sapiens
cctcagccagccctggaggc

SEQ ID NO: 6097221 - DNA, 13 bp, Homo sapiens
cctcagccagcct

SEQ ID NO: 6097222 - DNA, 17 bp, Homo sapiens
cctcagccagctgccca

SEQ ID NO: 6097223 - DNA, 23 bp, Homo sapiens
cctcagccatgggaacctcatat

SEQ ID NO: 6097224 - DNA, 23 bp, Homo sapiens
cctcagccattcactgcccccag

SEQ ID NO: 6097225 - DNA, 17 bp, Homo sapiens
cctcagcccaacttctt

SEQ ID NO: 6097226 - DNA, 14 bp, Homo sapiens
cctcagcccacctg

SEQ ID NO: 6097227 - DNA, 14 bp, Homo sapiens
cctcagccccactg

SEQ ID NO: 6097228 - DNA, 19 bp, Homo sapiens
cctcagccccactgacacc

SEQ ID NO: 6097229 - DNA, 16 bp, Homo sapiens
cctcagccccagccca

SEQ ID NO: 6097230 - DNA, 17 bp, Homo sapiens
cctcagccccagcccag

SEQ ID NO: 6097231 - DNA, 13 bp, Homo sapiens
cctcagccccagg

SEQ ID NO: 6097232 - DNA, 21 bp, Homo sapiens
cctcagccccaggagaaggga

SEQ ID NO: 6097233 - DNA, 14 bp, Homo sapiens
cctcagccccaggg

SEQ ID NO: 6097234 - DNA, 22 bp, Homo sapiens
cctcagccccagggccctgctc

SEQ ID NO: 6097235 - DNA, 23 bp, Homo sapiens
cctcagccccagggccctgctca

SEQ ID NO: 6097236 - DNA, 13 bp, Homo sapiens
cctcagcccccag

SEQ ID NO: 6097237 - DNA, 17 bp, Homo sapiens
cctcagcccccaggcca

SEQ ID NO: 6097238 - DNA, 23 bp, Homo sapiens
cctcagcccctcttgccccccac

SEQ ID NO: 6097239 - DNA, 13 bp, Homo sapiens
cctcagccctcag

SEQ ID NO: 6097240 - DNA, 14 bp, Homo sapiens
cctcagccctcaga

SEQ ID NO: 6097241 - DNA, 15 bp, Homo sapiens
cctcagccctgaccc

SEQ ID NO: 6097242 - DNA, 21 bp, Homo sapiens
cctcagccctgaccctgtgga

SEQ ID NO: 6097243 - DNA, 22 bp, Homo sapiens
cctcagccctgctccctgcctc

SEQ ID NO: 6097244 - DNA, 19 bp, Homo sapiens
cctcagccctggccctgcc

SEQ ID NO: 6097245 - DNA, 21 bp, Homo sapiens
cctcagccctggccctgccca

SEQ ID NO: 6097246 - DNA, 23 bp, Homo sapiens
cctcagccgactgcacagcggcc

SEQ ID NO: 6097247 - DNA, 19 bp, Homo sapiens
cctcagccgagaaattggg

SEQ ID NO: 6097248 - DNA, 16 bp, Homo sapiens
cctcagccgtcagcca

SEQ ID NO: 6097249 - DNA, 15 bp, Homo sapiens
cctcagcctcagagg

SEQ ID NO: 6097250 - DNA, 15 bp, Homo sapiens
cctcagcctccaatg

SEQ ID NO: 6097251 - DNA, 20 bp, Homo sapiens
cctcagcctccaatgcattg

SEQ ID NO: 6097252 - DNA, 13 bp, Homo sapiens
cctcagcctccca

SEQ ID NO: 6097253 - DNA, 19 bp, Homo sapiens
cctcagcctcccaaaatgg

SEQ ID NO: 6097254 - DNA, 21 bp, Homo sapiens
cctcagcctcccaaagtgctg

SEQ ID NO: 6097255 - DNA, 14 bp, Homo sapiens
cctcagcctcccag

SEQ ID NO: 6097256 - DNA, 15 bp, Homo sapiens
cctcagcctcccaga

SEQ ID NO: 6097257 - DNA, 16 bp, Homo sapiens
cctcagcctcccagag

SEQ ID NO: 6097258 - DNA, 16 bp, Homo sapiens
cctcagcctccctttg

SEQ ID NO: 6097259 - DNA, 22 bp, Homo sapiens
cctcagcctccctttgccagcc

SEQ ID NO: 6097260 - DNA, 13 bp, Homo sapiens
cctcagcctcctg

SEQ ID NO: 6097261 - DNA, 16 bp, Homo sapiens
cctcagcctcctgagt

SEQ ID NO: 6097262 - DNA, 18 bp, Homo sapiens
cctcagcctcctgagtag

SEQ ID NO: 6097263 - DNA, 15 bp, Homo sapiens
cctcagcctcctggg

SEQ ID NO: 6097264 - DNA, 19 bp, Homo sapiens
cctcagcctcctgggtagc

SEQ ID NO: 6097265 - DNA, 11 bp, Homo sapiens
cctcagcctct

SEQ ID NO: 6097266 - DNA, 15 bp, Homo sapiens
cctcagcctctgcaa

SEQ ID NO: 6097267 - DNA, 20 bp, Homo sapiens
cctcagcctctgcaactgca

SEQ ID NO: 6097268 - DNA, 14 bp, Homo sapiens
cctcagcctctgcc

SEQ ID NO: 6097269 - DNA, 15 bp, Homo sapiens
cctcagcctctgcca

SEQ ID NO: 6097270 - DNA, 20 bp, Homo sapiens
cctcagcctgatcaggcttc

SEQ ID NO: 6097271 - DNA, 14 bp, Homo sapiens
cctcagcctgccca

SEQ ID NO: 6097272 - DNA, 18 bp, Homo sapiens
cctcagcctgcccacctc

SEQ ID NO: 6097273 - DNA, 19 bp, Homo sapiens
cctcagcctgcccacctct

SEQ ID NO: 6097274 - DNA, 19 bp, Homo sapiens
cctcagcctgcctgaagag

SEQ ID NO: 6097275 - DNA, 22 bp, Homo sapiens
cctcagcctgcctgaagagagg

SEQ ID NO: 6097276 - DNA, 11 bp, Homo sapiens
cctcagcctgg

SEQ ID NO: 6097277 - DNA, 17 bp, Homo sapiens
cctcagcctggagaggc

SEQ ID NO: 6097278 - DNA, 18 bp, Homo sapiens
cctcagcctggagaggcc

SEQ ID NO: 6097279 - DNA, 15 bp, Homo sapiens
cctcagcctggccag

SEQ ID NO: 6097280 - DNA, 14 bp, Homo sapiens
cctcagcctgggcg

SEQ ID NO: 6097281 - DNA, 17 bp, Homo sapiens
cctcagcctgggcgctg

SEQ ID NO: 6097282 - DNA, 12 bp, Homo sapiens
cctcagcctgtg

SEQ ID NO: 6097283 - DNA, 12 bp, Homo sapiens
cctcagccttaa

SEQ ID NO: 6097284 - DNA, 15 bp, Homo sapiens
cctcagccttctgag

SEQ ID NO: 6097285 - DNA, 20 bp, Homo sapiens
cctcagccttgccagagatc

SEQ ID NO: 6097286 - DNA, 23 bp, Homo sapiens
cctcagccttggataatgctgtt

SEQ ID NO: 6097287 - DNA, 14 bp, Homo sapiens
cctcagccttggga

SEQ ID NO: 6097288 - DNA, 16 bp, Homo sapiens
cctcagcgagaggcag

SEQ ID NO: 6097289 - DNA, 13 bp, Homo sapiens
cctcagcgcaggc

SEQ ID NO: 6097290 - DNA, 20 bp, Homo sapiens
cctcagcgcaggctgcagag

SEQ ID NO: 6097291 - DNA, 22 bp, Homo sapiens
cctcagcgcaggctgcagagcc

SEQ ID NO: 6097292 - DNA, 23 bp, Homo sapiens
cctcagcgcaggctgcagagccc

SEQ ID NO: 6097293 - DNA, 14 bp, Homo sapiens
cctcagcgcggccc

SEQ ID NO: 6097294 - DNA, 20 bp, Homo sapiens
cctcagcgctccctgtcgcc

SEQ ID NO: 6097295 - DNA, 17 bp, Homo sapiens
cctcagcgctgcccaca

SEQ ID NO: 6097296 - DNA, 22 bp, Homo sapiens
cctcagcgggggccttgaagac

SEQ ID NO: 6097297 - DNA, 13 bp, Homo sapiens
cctcagctaccca

SEQ ID NO: 6097298 - DNA, 16 bp, Homo sapiens
cctcagctagctctgc

SEQ ID NO: 6097299 - DNA, 16 bp, Homo sapiens
cctcagctatcagtgt

SEQ ID NO: 6097300 - DNA, 11 bp, Homo sapiens
cctcagctcag

SEQ ID NO: 6097301 - DNA, 12 bp, Homo sapiens
cctcagctcagc

SEQ ID NO: 6097302 - DNA, 13 bp, Homo sapiens
cctcagctcagcc

SEQ ID NO: 6097303 - DNA, 19 bp, Homo sapiens
cctcagctcagctgggcca

SEQ ID NO: 6097304 - DNA, 20 bp, Homo sapiens
cctcagctcccacaagcctc

SEQ ID NO: 6097305 - DNA, 20 bp, Homo sapiens
cctcagctccctgaccccct

SEQ ID NO: 6097306 - DNA, 14 bp, Homo sapiens
cctcagctccctgc

SEQ ID NO: 6097307 - DNA, 13 bp, Homo sapiens
cctcagctcggct

SEQ ID NO: 6097308 - DNA, 14 bp, Homo sapiens
cctcagctctctgg

SEQ ID NO: 6097309 - DNA, 15 bp, Homo sapiens
cctcagctctctggg

SEQ ID NO: 6097310 - DNA, 16 bp, Homo sapiens
cctcagctctctggga

SEQ ID NO: 6097311 - DNA, 11 bp, Homo sapiens
cctcagctctg

SEQ ID NO: 6097312 - DNA, 17 bp, Homo sapiens
cctcagctctgggagag

SEQ ID NO: 6097313 - DNA, 20 bp, Homo sapiens
cctcagctctgggagaggat

SEQ ID NO: 6097314 - DNA, 23 bp, Homo sapiens
cctcagctcttggtgggcccagg

SEQ ID NO: 6097315 - DNA, 14 bp, Homo sapiens
cctcagctgaatgc

SEQ ID NO: 6097316 - DNA, 22 bp, Homo sapiens
cctcagctgacccggcctctct

SEQ ID NO: 6097317 - DNA, 11 bp, Homo sapiens
cctcagctgca

SEQ ID NO: 6097318 - DNA, 18 bp, Homo sapiens
cctcagctgcacattcct

SEQ ID NO: 6097319 - DNA, 19 bp, Homo sapiens
cctcagctgcacattcctg

SEQ ID NO: 6097320 - DNA, 12 bp, Homo sapiens
cctcagctgcca

SEQ ID NO: 6097321 - DNA, 14 bp, Homo sapiens
cctcagctgccaag

SEQ ID NO: 6097322 - DNA, 16 bp, Homo sapiens
cctcagctgcctcact

SEQ ID NO: 6097323 - DNA, 14 bp, Homo sapiens
cctcagctggtcct

SEQ ID NO: 6097324 - DNA, 20 bp, Homo sapiens
cctcagctggtcctgaccag

SEQ ID NO: 6097325 - DNA, 23 bp, Homo sapiens
cctcagctgtacaaatcctctgt

SEQ ID NO: 6097326 - DNA, 12 bp, Homo sapiens
cctcagctgtca

SEQ ID NO: 6097327 - DNA, 14 bp, Homo sapiens
cctcagctgtcacc

SEQ ID NO: 6097328 - DNA, 18 bp, Homo sapiens
cctcagctgtcacctgct

SEQ ID NO: 6097329 - DNA, 24 bp, Homo sapiens
cctcagctgtcacctgctcacagg

SEQ ID NO: 6097330 - DNA, 14 bp, Homo sapiens
cctcagctgtcggg

SEQ ID NO: 6097331 - DNA, 17 bp, Homo sapiens
cctcagcttcaaataaa

SEQ ID NO: 6097332 - DNA, 13 bp, Homo sapiens
cctcagcttcccc

SEQ ID NO: 6097333 - DNA, 15 bp, Homo sapiens
cctcagcttccccag

SEQ ID NO: 6097334 - DNA, 21 bp, Homo sapiens
cctcaggaaagaatagaaaga

SEQ ID NO: 6097335 - DNA, 20 bp, Homo sapiens
cctcaggaacccaccctctc

SEQ ID NO: 6097336 - DNA, 21 bp, Homo sapiens
cctcaggaacccaccctctcc

SEQ ID NO: 6097337 - DNA, 24 bp, Homo sapiens
cctcaggaacccaccctctccaca

SEQ ID NO: 6097338 - DNA, 18 bp, Homo sapiens
cctcaggacaatgtctga

SEQ ID NO: 6097339 - DNA, 13 bp, Homo sapiens
cctcaggaccagg

SEQ ID NO: 6097340 - DNA, 18 bp, Homo sapiens
cctcaggaccccagaggg

SEQ ID NO: 6097341 - DNA, 22 bp, Homo sapiens
cctcaggaccctccccacccac

SEQ ID NO: 6097342 - DNA, 18 bp, Homo sapiens
cctcaggaccctcgctgg

SEQ ID NO: 6097343 - DNA, 21 bp, Homo sapiens
cctcaggaccctcgctggccc

SEQ ID NO: 6097344 - DNA, 23 bp, Homo sapiens
cctcaggaccctcgctggccccc

SEQ ID NO: 6097345 - DNA, 18 bp, Homo sapiens
cctcaggactgcaacagg

SEQ ID NO: 6097346 - DNA, 13 bp, Homo sapiens
cctcaggactggg

SEQ ID NO: 6097347 - DNA, 19 bp, Homo sapiens
cctcaggaggcaggacctt

SEQ ID NO: 6097348 - DNA, 14 bp, Homo sapiens
cctcaggagggcag

SEQ ID NO: 6097349 - DNA, 15 bp, Homo sapiens
cctcaggagggcagg

SEQ ID NO: 6097350 - DNA, 16 bp, Homo sapiens
cctcaggagggcaggc

SEQ ID NO: 6097351 - DNA, 18 bp, Homo sapiens
cctcaggaggtcacctgc

SEQ ID NO: 6097352 - DNA, 22 bp, Homo sapiens
cctcaggcaatctgcccgcctg

SEQ ID NO: 6097353 - DNA, 15 bp, Homo sapiens
cctcaggcacacagc

SEQ ID NO: 6097354 - DNA, 17 bp, Homo sapiens
cctcaggcacacagcta

SEQ ID NO: 6097355 - DNA, 19 bp, Homo sapiens
cctcaggcacaccttgcag

SEQ ID NO: 6097356 - DNA, 22 bp, Homo sapiens
cctcaggcacccgtccccacac

SEQ ID NO: 6097357 - DNA, 21 bp, Homo sapiens
cctttgattgagttcatcatg

SEQ ID NO: 6097358 - DNA, 18 bp, Homo sapiens
cctttgcaaatcagtgtt

SEQ ID NO: 6097359 - DNA, 22 bp, Homo sapiens
cctttgcaattgctcttctcca

SEQ ID NO: 6097360 - DNA, 14 bp, Homo sapiens
cctttgcaccctgt

SEQ ID NO: 6097361 - DNA, 17 bp, Homo sapiens
cctttgcacctgagacc

SEQ ID NO: 6097362 - DNA, 14 bp, Homo sapiens
cctttgcactgagg

SEQ ID NO: 6097363 - DNA, 12 bp, Homo sapiens
cctttgcaggca

SEQ ID NO: 6097364 - DNA, 13 bp, Homo sapiens
cctttgcagggca

SEQ ID NO: 6097365 - DNA, 15 bp, Homo sapiens
cctttgcagggcagc

SEQ ID NO: 6097366 - DNA, 22 bp, Homo sapiens
cctttgcagtgtgcagggtgga

SEQ ID NO: 6097367 - DNA, 18 bp, Homo sapiens
cctttgcagttggactct

SEQ ID NO: 6097368 - DNA, 23 bp, Homo sapiens
cctttgcagttggactctcaggg

SEQ ID NO: 6097369 - DNA, 16 bp, Homo sapiens
cctttgccagcagagc

SEQ ID NO: 6097370 - DNA, 18 bp, Homo sapiens
cctttgccagcagagcca

SEQ ID NO: 6097371 - DNA, 20 bp, Homo sapiens
cctttgccagcagagccagg

SEQ ID NO: 6097372 - DNA, 21 bp, Homo sapiens
cctttgccagcagagccaggg

SEQ ID NO: 6097373 - DNA, 22 bp, Homo sapiens
cctttgccagcagagccagggc

SEQ ID NO: 6097374 - DNA, 23 bp, Homo sapiens
cctttgccagcagagccagggca

SEQ ID NO: 6097375 - DNA, 24 bp, Homo sapiens
cctttgccagcagagccagggcag

SEQ ID NO: 6097376 - DNA, 21 bp, Homo sapiens
cctttgccccacctttattaa

SEQ ID NO: 6097377 - DNA, 19 bp, Homo sapiens
cctttgccccggcttgcct

SEQ ID NO: 6097378 - DNA, 11 bp, Homo sapiens
cctttgcccct

SEQ ID NO: 6097379 - DNA, 20 bp, Homo sapiens
cctttgcccttacctgtctc

SEQ ID NO: 6097380 - DNA, 11 bp, Homo sapiens
cctttgccgcg

SEQ ID NO: 6097381 - DNA, 12 bp, Homo sapiens
cctttgcctctg

SEQ ID NO: 6097382 - DNA, 13 bp, Homo sapiens
cctttgcctctgc

SEQ ID NO: 6097383 - DNA, 14 bp, Homo sapiens
cctttgcctctgct

SEQ ID NO: 6097384 - DNA, 17 bp, Homo sapiens
cctttgcctctgtcctc

SEQ ID NO: 6097385 - DNA, 21 bp, Homo sapiens
cctttgcctgtagagccagcc

SEQ ID NO: 6097386 - DNA, 21 bp, Homo sapiens
cctttgccttaaacctgaaga

SEQ ID NO: 6097387 - DNA, 14 bp, Homo sapiens
cctttgccttcccc

SEQ ID NO: 6097388 - DNA, 22 bp, Homo sapiens
cctttgcctttcttctgccctt

SEQ ID NO: 6097389 - DNA, 16 bp, Homo sapiens
cctttgcgctctgggt

SEQ ID NO: 6097390 - DNA, 20 bp, Homo sapiens
cctttgcgtggatcaagctt

SEQ ID NO: 6097391 - DNA, 19 bp, Homo sapiens
cctttgctccaccccactc

SEQ ID NO: 6097392 - DNA, 20 bp, Homo sapiens
cctttgctccaccccactca

SEQ ID NO: 6097393 - DNA, 15 bp, Homo sapiens
cctttgctcccggca

SEQ ID NO: 6097394 - DNA, 12 bp, Homo sapiens
cctttgctctgg

SEQ ID NO: 6097395 - DNA, 13 bp, Homo sapiens
cctttgctctttc

SEQ ID NO: 6097396 - DNA, 14 bp, Homo sapiens
cctttgctgccctt

SEQ ID NO: 6097397 - DNA, 16 bp, Homo sapiens
cctttgctgcccttgg

SEQ ID NO: 6097398 - DNA, 16 bp, Homo sapiens
cctttgctgccttctg

SEQ ID NO: 6097399 - DNA, 17 bp, Homo sapiens
cctttgctgccttctgt

SEQ ID NO: 6097400 - DNA, 18 bp, Homo sapiens
cctttgctgtcccatagt

SEQ ID NO: 6097401 - DNA, 12 bp, Homo sapiens
cctttgctgttc

SEQ ID NO: 6097402 - DNA, 19 bp, Homo sapiens
cctttgcttatgaatattt

SEQ ID NO: 6097403 - DNA, 12 bp, Homo sapiens
cctttggaaaaa

SEQ ID NO: 6097404 - DNA, 22 bp, Homo sapiens
cctttggaacaagacagccttc

SEQ ID NO: 6097405 - DNA, 22 bp, Homo sapiens
cctttggaacaattattttatt

SEQ ID NO: 6097406 - DNA, 16 bp, Homo sapiens
cctttggacctgcagt

SEQ ID NO: 6097407 - DNA, 15 bp, Homo sapiens
cctttggagatgctg

SEQ ID NO: 6097408 - DNA, 13 bp, Homo sapiens
cctttggagggga

SEQ ID NO: 6097409 - DNA, 16 bp, Homo sapiens
cctttggcatctagat

SEQ ID NO: 6097410 - DNA, 16 bp, Homo sapiens
cctttggcatgtttaa

SEQ ID NO: 6097411 - DNA, 12 bp, Homo sapiens
cctttggcctgg

SEQ ID NO: 6097412 - DNA, 14 bp, Homo sapiens
cctttggctctgga

SEQ ID NO: 6097413 - DNA, 15 bp, Homo sapiens
cctttggctctggag

SEQ ID NO: 6097414 - DNA, 21 bp, Homo sapiens
cctttggctggtagcagcagg

SEQ ID NO: 6097415 - DNA, 22 bp, Homo sapiens
cctttggcttctgatttttctc

SEQ ID NO: 6097416 - DNA, 23 bp, Homo sapiens
cctttggcttctgatttttctct

SEQ ID NO: 6097417 - DNA, 23 bp, Homo sapiens
cctttgggccaatttactggcca

SEQ ID NO: 6097418 - DNA, 17 bp, Homo sapiens
cctttgggcccagggac

SEQ ID NO: 6097419 - DNA, 17 bp, Homo sapiens
cctttgggccctgcatg

SEQ ID NO: 6097420 - DNA, 23 bp, Homo sapiens
cctttgggcctctgcttctctca

SEQ ID NO: 6097421 - DNA, 22 bp, Homo sapiens
cctttgggcttcagctgccagt

SEQ ID NO: 6097422 - DNA, 22 bp, Homo sapiens
cctttggggatagtctggaaag

SEQ ID NO: 6097423 - DNA, 15 bp, Homo sapiens
cctttggggcttctg

SEQ ID NO: 6097424 - DNA, 19 bp, Homo sapiens
cctttggggcttctgtgaa

SEQ ID NO: 6097425 - DNA, 11 bp, Homo sapiens
cctttgggggt

SEQ ID NO: 6097426 - DNA, 15 bp, Homo sapiens
cctttgggtactact

SEQ ID NO: 6097427 - DNA, 22 bp, Homo sapiens
cctttgggtactactgctgcaa

SEQ ID NO: 6097428 - DNA, 21 bp, Homo sapiens
cctttgggtgctgttttgcca

SEQ ID NO: 6097429 - DNA, 19 bp, Homo sapiens
cctttgggttccatcttgc

SEQ ID NO: 6097430 - DNA, 20 bp, Homo sapiens
cctttgggttccatcttgct

SEQ ID NO: 6097431 - DNA, 18 bp, Homo sapiens
cctttggtgaattccttc

SEQ ID NO: 6097432 - DNA, 13 bp, Homo sapiens
cctttggtgcctc

SEQ ID NO: 6097433 - DNA, 19 bp, Homo sapiens
cctttggttccccgcgaag

SEQ ID NO: 6097434 - DNA, 14 bp, Homo sapiens
cctttggttctggc

SEQ ID NO: 6097435 - DNA, 19 bp, Homo sapiens
cctttggtttggcctccat

SEQ ID NO: 6097436 - DNA, 18 bp, Homo sapiens
cctttgtaaaacagccta

SEQ ID NO: 6097437 - DNA, 23 bp, Homo sapiens
cctttgtaaattgtcagatgctg

SEQ ID NO: 6097438 - DNA, 18 bp, Homo sapiens
cctttgtaagaaaaccaa

SEQ ID NO: 6097439 - DNA, 17 bp, Homo sapiens
cctttgtaagacacaca

SEQ ID NO: 6097440 - DNA, 20 bp, Homo sapiens
cctttgtaagacacacagcc

SEQ ID NO: 6097441 - DNA, 16 bp, Homo sapiens
cctttgtaagacattt

SEQ ID NO: 6097442 - DNA, 22 bp, Homo sapiens
cctttgtaagacatttgtatat

SEQ ID NO: 6097443 - DNA, 17 bp, Homo sapiens
cctttgtacagcccaga

SEQ ID NO: 6097444 - DNA, 14 bp, Homo sapiens
cctttgtagctact

SEQ ID NO: 6097445 - DNA, 15 bp, Homo sapiens
cctttgtagctactt

SEQ ID NO: 6097446 - DNA, 18 bp, Homo sapiens
cctttgtatctttctttc

SEQ ID NO: 6097447 - DNA, 11 bp, Homo sapiens
cctttgtatta

SEQ ID NO: 6097448 - DNA, 18 bp, Homo sapiens
cctttgtattataaaagc

SEQ ID NO: 6097449 - DNA, 17 bp, Homo sapiens
cctttgtattataattg

SEQ ID NO: 6097450 - DNA, 20 bp, Homo sapiens
cctttgtattataattgttg

SEQ ID NO: 6097451 - DNA, 21 bp, Homo sapiens
cctttgtattataattgttga

SEQ ID NO: 6097452 - DNA, 22 bp, Homo sapiens
cctttgtattctgtcttcatcc

SEQ ID NO: 6097453 - DNA, 16 bp, Homo sapiens
cctttgtcaacttcag

SEQ ID NO: 6097454 - DNA, 17 bp, Homo sapiens
cctttgtcaacttcagt

SEQ ID NO: 6097455 - DNA, 12 bp, Homo sapiens
cctttgtcattt

SEQ ID NO: 6097456 - DNA, 16 bp, Homo sapiens
cctttgtccccaccgc

SEQ ID NO: 6097457 - DNA, 22 bp, Homo sapiens
cctttgtccccaccgcagacag

SEQ ID NO: 6097458 - DNA, 16 bp, Homo sapiens
cctttgtcctcctgct

SEQ ID NO: 6097459 - DNA, 18 bp, Homo sapiens
cctttgtcctttttcagg

SEQ ID NO: 6097460 - DNA, 18 bp, Homo sapiens
cctttgtctcacgattcc

SEQ ID NO: 6097461 - DNA, 21 bp, Homo sapiens
cctttgtctcacgattccagt

SEQ ID NO: 6097462 - DNA, 15 bp, Homo sapiens
cctttgtctggatgc

SEQ ID NO: 6097463 - DNA, 16 bp, Homo sapiens
cctttgtcttgtactt

SEQ ID NO: 6097464 - DNA, 17 bp, Homo sapiens
cctttgtcttgtacttc

SEQ ID NO: 6097465 - DNA, 15 bp, Homo sapiens
cctttgtctttcaaa

SEQ ID NO: 6097466 - DNA, 19 bp, Homo sapiens
cctttgtcttttttttcat

SEQ ID NO: 6097467 - DNA, 13 bp, Homo sapiens
cctttgtgaaaaa

SEQ ID NO: 6097468 - DNA, 15 bp, Homo sapiens
cctttgtgaggaagc

SEQ ID NO: 6097469 - DNA, 13 bp, Homo sapiens
cctttgtgagtca

SEQ ID NO: 6097470 - DNA, 21 bp, Homo sapiens
cctttgtgcagcttcgaggac

SEQ ID NO: 6097471 - DNA, 12 bp, Homo sapiens
cctttgtgctgc

SEQ ID NO: 6097472 - DNA, 20 bp, Homo sapiens
cctttgtgctttttgtcatg

SEQ ID NO: 6097473 - DNA, 21 bp, Homo sapiens
cctttgtgctttttgtcatgt

SEQ ID NO: 6097474 - DNA, 14 bp, Homo sapiens
cctttgtggccttc

SEQ ID NO: 6097475 - DNA, 22 bp, Homo sapiens
cctttgtggttttatggagacc

SEQ ID NO: 6097476 - DNA, 12 bp, Homo sapiens
cctttgtgtaat

SEQ ID NO: 6097477 - DNA, 19 bp, Homo sapiens
cctttgtgtggctcctggt

SEQ ID NO: 6097478 - DNA, 14 bp, Homo sapiens
cctttgtgtttata

SEQ ID NO: 6097479 - DNA, 18 bp, Homo sapiens
cctttgttccccactgga

SEQ ID NO: 6097480 - DNA, 12 bp, Homo sapiens
cctttgttccct

SEQ ID NO: 6097481 - DNA, 14 bp, Homo sapiens
cctttgttgaaaaa

SEQ ID NO: 6097482 - DNA, 17 bp, Homo sapiens
cctttgttgaactgtta

SEQ ID NO: 6097483 - DNA, 20 bp, Homo sapiens
cctttgttgaactgttagaa

SEQ ID NO: 6097484 - DNA, 15 bp, Homo sapiens
cctttgttgctgtct

SEQ ID NO: 6097485 - DNA, 23 bp, Homo sapiens
cctttgttgtctacattaaatca

SEQ ID NO: 6097486 - DNA, 16 bp, Homo sapiens
cctttgtttaataaag

SEQ ID NO: 6097487 - DNA, 15 bp, Homo sapiens
cctttgtttcggtgc

SEQ ID NO: 6097488 - DNA, 20 bp, Homo sapiens
cctttgtttttatgaagaaa

SEQ ID NO: 6097489 - DNA, 19 bp, Homo sapiens
cctttgtttttttttcctg

SEQ ID NO: 6097490 - DNA, 12 bp, Homo sapiens
ccttttaaaatg

SEQ ID NO: 6097491 - DNA, 16 bp, Homo sapiens
ccttttaaagtgtttc

SEQ ID NO: 6097492 - DNA, 15 bp, Homo sapiens
ccttttaaagttgga

SEQ ID NO: 6097493 - DNA, 22 bp, Homo sapiens
ccttttaaatcctgttgaaaag

SEQ ID NO: 6097494 - DNA, 14 bp, Homo sapiens
ccttttaaatggca

SEQ ID NO: 6097495 - DNA, 13 bp, Homo sapiens
ccttttaacattt

SEQ ID NO: 6097496 - DNA, 12 bp, Homo sapiens
ccttttaagaaa

SEQ ID NO: 6097497 - DNA, 14 bp, Homo sapiens
ccttttaagaaagc

SEQ ID NO: 6097498 - DNA, 24 bp, Homo sapiens
ccttttaaggtttcaacaaatttc

SEQ ID NO: 6097499 - DNA, 15 bp, Homo sapiens
ccttttaatataaaa

SEQ ID NO: 6097500 - DNA, 20 bp, Homo sapiens
ccttttaatctagagaaggc

SEQ ID NO: 6097501 - DNA, 16 bp, Homo sapiens
ccttttaattctacca

SEQ ID NO: 6097502 - DNA, 23 bp, Homo sapiens
ccttttaattttgtatgaggtcc

SEQ ID NO: 6097503 - DNA, 15 bp, Homo sapiens
ccttttacattctgt

SEQ ID NO: 6097504 - DNA, 16 bp, Homo sapiens
ccttttacattctgtg

SEQ ID NO: 6097505 - DNA, 14 bp, Homo sapiens
ccttttacattgtg

SEQ ID NO: 6097506 - DNA, 12 bp, Homo sapiens
ccttttactgtg

SEQ ID NO: 6097507 - DNA, 17 bp, Homo sapiens
ccttttacttttttata

SEQ ID NO: 6097508 - DNA, 20 bp, Homo sapiens
ccttttagcacatcactgag

SEQ ID NO: 6097509 - DNA, 16 bp, Homo sapiens
ccttttagtattagtt

SEQ ID NO: 6097510 - DNA, 11 bp, Homo sapiens
ccttttatagc

SEQ ID NO: 6097511 - DNA, 19 bp, Homo sapiens
ccttttatcccaaagttgt

SEQ ID NO: 6097512 - DNA, 19 bp, Homo sapiens
ccttttatctgcagaacat

SEQ ID NO: 6097513 - DNA, 16 bp, Homo sapiens
ccttttatgaatcaaa

SEQ ID NO: 6097514 - DNA, 17 bp, Homo sapiens
ccttttatgctcacctg

SEQ ID NO: 6097515 - DNA, 23 bp, Homo sapiens
ccttttattataagtcttacata

SEQ ID NO: 6097516 - DNA, 19 bp, Homo sapiens
ccttttatttttttctaat

SEQ ID NO: 6097517 - DNA, 22 bp, Homo sapiens
ccttttcaaatcaagaaaataa

SEQ ID NO: 6097518 - DNA, 20 bp, Homo sapiens
ccttttcaaatgcagcaatc

SEQ ID NO: 6097519 - DNA, 20 bp, Homo sapiens
ccttttcacccttctactct

SEQ ID NO: 6097520 - DNA, 19 bp, Homo sapiens
ccttttcactttattgcta

SEQ ID NO: 6097521 - DNA, 12 bp, Homo sapiens
ccttttcagccc

SEQ ID NO: 6097522 - DNA, 17 bp, Homo sapiens
ccttttcagcttctgct

SEQ ID NO: 6097523 - DNA, 12 bp, Homo sapiens
ccttttcaggaa

SEQ ID NO: 6097524 - DNA, 13 bp, Homo sapiens
ccttttcaggaga

SEQ ID NO: 6097525 - DNA, 14 bp, Homo sapiens
ccttttcaggagat

SEQ ID NO: 6097526 - DNA, 12 bp, Homo sapiens
ccttttcagggc

SEQ ID NO: 6097527 - DNA, 18 bp, Homo sapiens
ccttttcataggtctgaa

SEQ ID NO: 6097528 - DNA, 19 bp, Homo sapiens
ccttttcataggtctgaaa

SEQ ID NO: 6097529 - DNA, 18 bp, Homo sapiens
ccttttcatctccagtgt

SEQ ID NO: 6097530 - DNA, 16 bp, Homo sapiens
ccttttccacacgcat

SEQ ID NO: 6097531 - DNA, 21 bp, Homo sapiens
ccttttccataaagtgtaatt

SEQ ID NO: 6097532 - DNA, 18 bp, Homo sapiens
ccttttccatcatctctt

SEQ ID NO: 6097533 - DNA, 12 bp, Homo sapiens
ccttttcccaac

SEQ ID NO: 6097534 - DNA, 13 bp, Homo sapiens
ccttttccccagg

SEQ ID NO: 6097535 - DNA, 13 bp, Homo sapiens
ccttttcccccag

SEQ ID NO: 6097536 - DNA, 18 bp, Homo sapiens
ccttttcccctacagaat

SEQ ID NO: 6097537 - DNA, 16 bp, Homo sapiens
cctcaggcactagcct

SEQ ID NO: 6097538 - DNA, 18 bp, Homo sapiens
cctcaggcactagccttt

SEQ ID NO: 6097539 - DNA, 21 bp, Homo sapiens
cctcaggcagaggatgttctg

SEQ ID NO: 6097540 - DNA, 18 bp, Homo sapiens
cctcaggcaggtgggatg

SEQ ID NO: 6097541 - DNA, 17 bp, Homo sapiens
cctcaggcagtggccca

SEQ ID NO: 6097542 - DNA, 21 bp, Homo sapiens
cctcaggcagtggcccaggga

SEQ ID NO: 6097543 - DNA, 19 bp, Homo sapiens
cctcaggcagttactattt

SEQ ID NO: 6097544 - DNA, 22 bp, Homo sapiens
cctcaggcataggcctgggtgc

SEQ ID NO: 6097545 - DNA, 19 bp, Homo sapiens
cctcaggccaagggaccag

SEQ ID NO: 6097546 - DNA, 14 bp, Homo sapiens
cctcaggccagggc

SEQ ID NO: 6097547 - DNA, 12 bp, Homo sapiens
cctcaggccagt

SEQ ID NO: 6097548 - DNA, 13 bp, Homo sapiens
cctcaggccagtg

SEQ ID NO: 6097549 - DNA, 17 bp, Homo sapiens
cctcaggccagtgccag

SEQ ID NO: 6097550 - DNA, 20 bp, Homo sapiens
cctcaggccagtgccaggac

SEQ ID NO: 6097551 - DNA, 20 bp, Homo sapiens
cctcaggcccaggagtccag

SEQ ID NO: 6097552 - DNA, 19 bp, Homo sapiens
cctcaggcctctgtgccgc

SEQ ID NO: 6097553 - DNA, 11 bp, Homo sapiens
cctcaggcctg

SEQ ID NO: 6097554 - DNA, 16 bp, Homo sapiens
cctcaggcctggccct

SEQ ID NO: 6097555 - DNA, 21 bp, Homo sapiens
cctcaggcctgggggctgggc

SEQ ID NO: 6097556 - DNA, 23 bp, Homo sapiens
cctcaggcctgggggctgggcag

SEQ ID NO: 6097557 - DNA, 12 bp, Homo sapiens
cctcaggctccc

SEQ ID NO: 6097558 - DNA, 12 bp, Homo sapiens
cctcaggctcct

SEQ ID NO: 6097559 - DNA, 16 bp, Homo sapiens
cctcaggctcctaaag

SEQ ID NO: 6097560 - DNA, 15 bp, Homo sapiens
cctcaggctgctgga

SEQ ID NO: 6097561 - DNA, 17 bp, Homo sapiens
cctcaggctgctggagg

SEQ ID NO: 6097562 - DNA, 15 bp, Homo sapiens
cctcaggcttgaggg

SEQ ID NO: 6097563 - DNA, 19 bp, Homo sapiens
cctcaggcttgagggaggg

SEQ ID NO: 6097564 - DNA, 15 bp, Homo sapiens
cctcaggcttgggga

SEQ ID NO: 6097565 - DNA, 17 bp, Homo sapiens
cctcagggagcagggaa

SEQ ID NO: 6097566 - DNA, 22 bp, Homo sapiens
cctcagggagcagggaaggcct

SEQ ID NO: 6097567 - DNA, 23 bp, Homo sapiens
cctcagggagcagggaaggcctg

SEQ ID NO: 6097568 - DNA, 16 bp, Homo sapiens
cctcagggagcctccc

SEQ ID NO: 6097569 - DNA, 16 bp, Homo sapiens
cctcagggagcgatcc

SEQ ID NO: 6097570 - DNA, 23 bp, Homo sapiens
cctcagggatggccgttggccac

SEQ ID NO: 6097571 - DNA, 17 bp, Homo sapiens
cctcagggcaaagccag

SEQ ID NO: 6097572 - DNA, 22 bp, Homo sapiens
cctcagggcaaagccaggtccc

SEQ ID NO: 6097573 - DNA, 11 bp, Homo sapiens
cctcagggcac

SEQ ID NO: 6097574 - DNA, 22 bp, Homo sapiens
cctcagggcacgcaggaccagt

SEQ ID NO: 6097575 - DNA, 19 bp, Homo sapiens
cctcagggcagcctgcctg

SEQ ID NO: 6097576 - DNA, 13 bp, Homo sapiens
cctcagggccaag

SEQ ID NO: 6097577 - DNA, 15 bp, Homo sapiens
cctcagggccaagcc

SEQ ID NO: 6097578 - DNA, 14 bp, Homo sapiens
cctcagggccagga

SEQ ID NO: 6097579 - DNA, 15 bp, Homo sapiens
cctcagggccaggaa

SEQ ID NO: 6097580 - DNA, 20 bp, Homo sapiens
cctcagggccaggcccaggc

SEQ ID NO: 6097581 - DNA, 22 bp, Homo sapiens
cctcagggccaggcccaggcct

SEQ ID NO: 6097582 - DNA, 14 bp, Homo sapiens
cctcagggcccagc

SEQ ID NO: 6097583 - DNA, 14 bp, Homo sapiens
cctcagggcgctca

SEQ ID NO: 6097584 - DNA, 16 bp, Homo sapiens
cctcagggctcccagg

SEQ ID NO: 6097585 - DNA, 21 bp, Homo sapiens
cctcagggctctaccaagaca

SEQ ID NO: 6097586 - DNA, 17 bp, Homo sapiens
cctcagggctgtcccag

SEQ ID NO: 6097587 - DNA, 22 bp, Homo sapiens
cctcagggctgtcccagccccg

SEQ ID NO: 6097588 - DNA, 15 bp, Homo sapiens
cctcagggcttcctt

SEQ ID NO: 6097589 - DNA, 18 bp, Homo sapiens
cctcaggggaaaactgtt

SEQ ID NO: 6097590 - DNA, 21 bp, Homo sapiens
cctcaggggaaaactgttacc

SEQ ID NO: 6097591 - DNA, 17 bp, Homo sapiens
cctcaggggaagctgct

SEQ ID NO: 6097592 - DNA, 19 bp, Homo sapiens
cctcaggggaagctgctag

SEQ ID NO: 6097593 - DNA, 13 bp, Homo sapiens
cctcaggggagac

SEQ ID NO: 6097594 - DNA, 13 bp, Homo sapiens
cctcagggggcca

SEQ ID NO: 6097595 - DNA, 21 bp, Homo sapiens
cctcagggggtaggagagcac

SEQ ID NO: 6097596 - DNA, 16 bp, Homo sapiens
cctcaggggtctgagc

SEQ ID NO: 6097597 - DNA, 18 bp, Homo sapiens
cctcaggggtctgagctc

SEQ ID NO: 6097598 - DNA, 16 bp, Homo sapiens
cctcaggggtggagaa

SEQ ID NO: 6097599 - DNA, 20 bp, Homo sapiens
cctcagggtccctggtggca

SEQ ID NO: 6097600 - DNA, 17 bp, Homo sapiens
cctcagggtcctgccct

SEQ ID NO: 6097601 - DNA, 13 bp, Homo sapiens
cctcagggtgggg

SEQ ID NO: 6097602 - DNA, 19 bp, Homo sapiens
cctcagggtggggggtgac

SEQ ID NO: 6097603 - DNA, 23 bp, Homo sapiens
cctcaggtaatcgacctgcctcg

SEQ ID NO: 6097604 - DNA, 18 bp, Homo sapiens
cctcaggtacagcgggct

SEQ ID NO: 6097605 - DNA, 19 bp, Homo sapiens
cctcaggtacagcgggctg

SEQ ID NO: 6097606 - DNA, 22 bp, Homo sapiens
cctcaggtacagcgggctgtgc

SEQ ID NO: 6097607 - DNA, 22 bp, Homo sapiens
cctcaggtacggagaagaatag

SEQ ID NO: 6097608 - DNA, 20 bp, Homo sapiens
cctcaggtcagggtgaggat

SEQ ID NO: 6097609 - DNA, 19 bp, Homo sapiens
cctcaggtgatccacccac

SEQ ID NO: 6097610 - DNA, 22 bp, Homo sapiens
cctcaggtgatccacccacctc

SEQ ID NO: 6097611 - DNA, 12 bp, Homo sapiens
cctcaggtggcc

SEQ ID NO: 6097612 - DNA, 18 bp, Homo sapiens
cctcaggtgtgcctgttg

SEQ ID NO: 6097613 - DNA, 19 bp, Homo sapiens
cctcaggttctattttctt

SEQ ID NO: 6097614 - DNA, 16 bp, Homo sapiens
cctcaggttgctggtt

SEQ ID NO: 6097615 - DNA, 23 bp, Homo sapiens
cctcaggttgctggttgctgtgt

SEQ ID NO: 6097616 - DNA, 19 bp, Homo sapiens
cctcaggtttgcctgaggg

SEQ ID NO: 6097617 - DNA, 20 bp, Homo sapiens
cctcagtaaaagtcttctcc

SEQ ID NO: 6097618 - DNA, 23 bp, Homo sapiens
cctcagtagatactaaagcaaat

SEQ ID NO: 6097619 - DNA, 20 bp, Homo sapiens
cctcagtagcatctcagtgg

SEQ ID NO: 6097620 - DNA, 22 bp, Homo sapiens
cctcagtatgtgggggcttcat

SEQ ID NO: 6097621 - DNA, 23 bp, Homo sapiens
cctcagtatgtgggggcttcatc

SEQ ID NO: 6097622 - DNA, 18 bp, Homo sapiens
cctcagtatttatgtaat

SEQ ID NO: 6097623 - DNA, 17 bp, Homo sapiens
cctcagtcacccccact

SEQ ID NO: 6097624 - DNA, 23 bp, Homo sapiens
cctcagtcagttcccggagcaca

SEQ ID NO: 6097625 - DNA, 16 bp, Homo sapiens
cctcagtccatttata

SEQ ID NO: 6097626 - DNA, 13 bp, Homo sapiens
cctcagtccctcc

SEQ ID NO: 6097627 - DNA, 14 bp, Homo sapiens
cctcagtccctccc

SEQ ID NO: 6097628 - DNA, 20 bp, Homo sapiens
cctcagtccctccctcctgg

SEQ ID NO: 6097629 - DNA, 11 bp, Homo sapiens
cctcagtcctc

SEQ ID NO: 6097630 - DNA, 20 bp, Homo sapiens
cctcagtcctcccctcacag

SEQ ID NO: 6097631 - DNA, 21 bp, Homo sapiens
cctcagtcctcccctcacagc

SEQ ID NO: 6097632 - DNA, 24 bp, Homo sapiens
cctcagtcctcccctcacagcctc

SEQ ID NO: 6097633 - DNA, 13 bp, Homo sapiens
cctcagtcctgga

SEQ ID NO: 6097634 - DNA, 21 bp, Homo sapiens
cctcagtcggggcaggccagg

SEQ ID NO: 6097635 - DNA, 17 bp, Homo sapiens
cctcagtctacactcac

SEQ ID NO: 6097636 - DNA, 14 bp, Homo sapiens
cctcagtctacccc

SEQ ID NO: 6097637 - DNA, 21 bp, Homo sapiens
cctcagtctcacctgccggct

SEQ ID NO: 6097638 - DNA, 19 bp, Homo sapiens
cctcagtgaaggtggtggg

SEQ ID NO: 6097639 - DNA, 13 bp, Homo sapiens
cctcagtgaccca

SEQ ID NO: 6097640 - DNA, 17 bp, Homo sapiens
cctcagtgaccctggct

SEQ ID NO: 6097641 - DNA, 18 bp, Homo sapiens
cctcagtgaccctggctc

SEQ ID NO: 6097642 - DNA, 17 bp, Homo sapiens
cctcagtgcaaaatgtc

SEQ ID NO: 6097643 - DNA, 22 bp, Homo sapiens
cctcagtgcaaaatgtcttgtg

SEQ ID NO: 6097644 - DNA, 15 bp, Homo sapiens
cctcagtgcagcccc

SEQ ID NO: 6097645 - DNA, 16 bp, Homo sapiens
cctcagtgccacttga

SEQ ID NO: 6097646 - DNA, 19 bp, Homo sapiens
cctcagtgccacttgacat

SEQ ID NO: 6097647 - DNA, 20 bp, Homo sapiens
cctcagtgctcggcagtcat

SEQ ID NO: 6097648 - DNA, 23 bp, Homo sapiens
cctcagtggactttccaccccct

SEQ ID NO: 6097649 - DNA, 13 bp, Homo sapiens
cctcagtggcagc

SEQ ID NO: 6097650 - DNA, 16 bp, Homo sapiens
cctcagtggctctggg

SEQ ID NO: 6097651 - DNA, 14 bp, Homo sapiens
cctcagtggcttct

SEQ ID NO: 6097652 - DNA, 17 bp, Homo sapiens
cctcagtggcttctcca

SEQ ID NO: 6097653 - DNA, 20 bp, Homo sapiens
cctcagtggcttctccaggg

SEQ ID NO: 6097654 - DNA, 14 bp, Homo sapiens
cctcagtgggaaga

SEQ ID NO: 6097655 - DNA, 23 bp, Homo sapiens
cctcagtgggctccctggcccag

SEQ ID NO: 6097656 - DNA, 13 bp, Homo sapiens
cctcagtgtattt

SEQ ID NO: 6097657 - DNA, 11 bp, Homo sapiens
cctcagtgtca

SEQ ID NO: 6097658 - DNA, 23 bp, Homo sapiens
cctcagtgtcatttatgaaaaga

SEQ ID NO: 6097659 - DNA, 15 bp, Homo sapiens
cctcagtgtgaagcc

SEQ ID NO: 6097660 - DNA, 19 bp, Homo sapiens
cctcagttacacaggaacc

SEQ ID NO: 6097661 - DNA, 15 bp, Homo sapiens
cctcagttattttgt

SEQ ID NO: 6097662 - DNA, 22 bp, Homo sapiens
cctcagttcaacctggtggcac

SEQ ID NO: 6097663 - DNA, 19 bp, Homo sapiens
cctcagttcccagctcccc

SEQ ID NO: 6097664 - DNA, 15 bp, Homo sapiens
cctcagttcccttgg

SEQ ID NO: 6097665 - DNA, 21 bp, Homo sapiens
cctcagttcccttggcctcag

SEQ ID NO: 6097666 - DNA, 15 bp, Homo sapiens
cctcagttccttcat

SEQ ID NO: 6097667 - DNA, 19 bp, Homo sapiens
cctcagttcttgccacttt

SEQ ID NO: 6097668 - DNA, 20 bp, Homo sapiens
cctcagttgaaaatgcaact

SEQ ID NO: 6097669 - DNA, 16 bp, Homo sapiens
cctcagttggcctctg

SEQ ID NO: 6097670 - DNA, 17 bp, Homo sapiens
cctcagttggcctctgc

SEQ ID NO: 6097671 - DNA, 14 bp, Homo sapiens
cctcagttgtgcag

SEQ ID NO: 6097672 - DNA, 16 bp, Homo sapiens
cctcagttgtgcagct

SEQ ID NO: 6097673 - DNA, 20 bp, Homo sapiens
cctcagtttggtagtgcccc

SEQ ID NO: 6097674 - DNA, 19 bp, Homo sapiens
cctcagttttatcattttc

SEQ ID NO: 6097675 - DNA, 21 bp, Homo sapiens
cctcatacacataattttgtg

SEQ ID NO: 6097676 - DNA, 14 bp, Homo sapiens
cctcataccatctg

SEQ ID NO: 6097677 - DNA, 18 bp, Homo sapiens
cctcataccatctgctgc

SEQ ID NO: 6097678 - DNA, 20 bp, Homo sapiens
cctcatacgtttaaaataaa

SEQ ID NO: 6097679 - DNA, 22 bp, Homo sapiens
cctcatactcctgggctcaagc

SEQ ID NO: 6097680 - DNA, 23 bp, Homo sapiens
cctcatagccctcagacatttat

SEQ ID NO: 6097681 - DNA, 22 bp, Homo sapiens
cctcatagtaataagatggctg

SEQ ID NO: 6097682 - DNA, 20 bp, Homo sapiens
cctcatagtatggtggctgg

SEQ ID NO: 6097683 - DNA, 17 bp, Homo sapiens
cctcatatcccatcctt

SEQ ID NO: 6097684 - DNA, 18 bp, Homo sapiens
cctcatatcttcctcatc

SEQ ID NO: 6097685 - DNA, 20 bp, Homo sapiens
cctcatatcttcctcatcag

SEQ ID NO: 6097686 - DNA, 21 bp, Homo sapiens
cctcatcacagcaatatttaa

SEQ ID NO: 6097687 - DNA, 16 bp, Homo sapiens
cctcatcaccatcgtg

SEQ ID NO: 6097688 - DNA, 21 bp, Homo sapiens
cctcatcactggactgcatgg

SEQ ID NO: 6097689 - DNA, 12 bp, Homo sapiens
cctcatcagcct

SEQ ID NO: 6097690 - DNA, 15 bp, Homo sapiens
cctcatcagcctttt

SEQ ID NO: 6097691 - DNA, 13 bp, Homo sapiens
cctcatcatccac

SEQ ID NO: 6097692 - DNA, 15 bp, Homo sapiens
cctcatcatccaccc

SEQ ID NO: 6097693 - DNA, 15 bp, Homo sapiens
cctcatccagcctca

SEQ ID NO: 6097694 - DNA, 16 bp, Homo sapiens
cctcatccagcctcag

SEQ ID NO: 6097695 - DNA, 13 bp, Homo sapiens
cctcatccagggc

SEQ ID NO: 6097696 - DNA, 15 bp, Homo sapiens
cctcatccagggccc

SEQ ID NO: 6097697 - DNA, 23 bp, Homo sapiens
cctcatccagggctctgaccagt

SEQ ID NO: 6097698 - DNA, 14 bp, Homo sapiens
cctcatccatttct

SEQ ID NO: 6097699 - DNA, 15 bp, Homo sapiens
cctcatccatttctt

SEQ ID NO: 6097700 - DNA, 18 bp, Homo sapiens
cctcatcccctcgtcctg

SEQ ID NO: 6097701 - DNA, 14 bp, Homo sapiens
cctcatccgaggca

SEQ ID NO: 6097702 - DNA, 17 bp, Homo sapiens
cctcatcctcctcctca

SEQ ID NO: 6097703 - DNA, 13 bp, Homo sapiens
cctcatcctcctg

SEQ ID NO: 6097704 - DNA, 23 bp, Homo sapiens
cctcatcctcctggacccagcag

SEQ ID NO: 6097705 - DNA, 14 bp, Homo sapiens
cctcatcctgcttc

SEQ ID NO: 6097706 - DNA, 15 bp, Homo sapiens
cctcatcctgcttct

SEQ ID NO: 6097707 - DNA, 18 bp, Homo sapiens
cctcatcctgcttctctt

SEQ ID NO: 6097708 - DNA, 14 bp, Homo sapiens
cctcatcctttccc

SEQ ID NO: 6097709 - DNA, 21 bp, Homo sapiens
cctcatcgcgtcctcctaccg

SEQ ID NO: 6097710 - DNA, 12 bp, Homo sapiens
cctcatctcaga

SEQ ID NO: 6097711 - DNA, 13 bp, Homo sapiens
cctcatctcagac

SEQ ID NO: 6097712 - DNA, 21 bp, Homo sapiens
cctcatctcagaccctgctta

SEQ ID NO: 6097713 - DNA, 11 bp, Homo sapiens
cctcatctcca

SEQ ID NO: 6097714 - DNA, 12 bp, Homo sapiens
cctcatctccaa

SEQ ID NO: 6097715 - DNA, 14 bp, Homo sapiens
ccttttccctgctt

SEQ ID NO: 6097716 - DNA, 19 bp, Homo sapiens
ccttttccctgcttccagg

SEQ ID NO: 6097717 - DNA, 18 bp, Homo sapiens
ccttttcccttgctgtac

SEQ ID NO: 6097718 - DNA, 17 bp, Homo sapiens
ccttttcctatccttat

SEQ ID NO: 6097719 - DNA, 20 bp, Homo sapiens
ccttttcgcaggattcttcc

SEQ ID NO: 6097720 - DNA, 19 bp, Homo sapiens
ccttttcgcctttcctctc

SEQ ID NO: 6097721 - DNA, 11 bp, Homo sapiens
ccttttctaaa

SEQ ID NO: 6097722 - DNA, 16 bp, Homo sapiens
ccttttctatgttgct

SEQ ID NO: 6097723 - DNA, 12 bp, Homo sapiens
ccttttctattc

SEQ ID NO: 6097724 - DNA, 16 bp, Homo sapiens
ccttttctcattctgt

SEQ ID NO: 6097725 - DNA, 13 bp, Homo sapiens
ccttttctcccca

SEQ ID NO: 6097726 - DNA, 14 bp, Homo sapiens
ccttttctctgccc

SEQ ID NO: 6097727 - DNA, 15 bp, Homo sapiens
ccttttctctgccct

SEQ ID NO: 6097728 - DNA, 16 bp, Homo sapiens
ccttttctctgctctt

SEQ ID NO: 6097729 - DNA, 19 bp, Homo sapiens
ccttttctctgcttgccta

SEQ ID NO: 6097730 - DNA, 13 bp, Homo sapiens
ccttttctggctc

SEQ ID NO: 6097731 - DNA, 16 bp, Homo sapiens
ccttttctggctcctg

SEQ ID NO: 6097732 - DNA, 22 bp, Homo sapiens
ccttttctggggaaagacactg

SEQ ID NO: 6097733 - DNA, 20 bp, Homo sapiens
ccttttctggtccctcttct

SEQ ID NO: 6097734 - DNA, 21 bp, Homo sapiens
ccttttctggtccctcttctc

SEQ ID NO: 6097735 - DNA, 23 bp, Homo sapiens
ccttttctgtgccagacattgct

SEQ ID NO: 6097736 - DNA, 13 bp, Homo sapiens
ccttttctgttta

SEQ ID NO: 6097737 - DNA, 14 bp, Homo sapiens
ccttttcttggttc

SEQ ID NO: 6097738 - DNA, 14 bp, Homo sapiens
ccttttctttcctt

SEQ ID NO: 6097739 - DNA, 18 bp, Homo sapiens
ccttttcttttctaccct

SEQ ID NO: 6097740 - DNA, 14 bp, Homo sapiens
ccttttcttttgtt

SEQ ID NO: 6097741 - DNA, 15 bp, Homo sapiens
ccttttcttttgtta

SEQ ID NO: 6097742 - DNA, 16 bp, Homo sapiens
ccttttcttttgttac

SEQ ID NO: 6097743 - DNA, 23 bp, Homo sapiens
ccttttcttttgttactgttctt

SEQ ID NO: 6097744 - DNA, 21 bp, Homo sapiens
ccttttgaaattaacctctca

SEQ ID NO: 6097745 - DNA, 16 bp, Homo sapiens
ccttttgaacttgtca

SEQ ID NO: 6097746 - DNA, 17 bp, Homo sapiens
ccttttgaacttgtcac

SEQ ID NO: 6097747 - DNA, 22 bp, Homo sapiens
ccttttgaatacatttgtattt

SEQ ID NO: 6097748 - DNA, 13 bp, Homo sapiens
ccttttgacactg

SEQ ID NO: 6097749 - DNA, 15 bp, Homo sapiens
ccttttgacactgct

SEQ ID NO: 6097750 - DNA, 23 bp, Homo sapiens
ccttttgacagctggtccctgcc

SEQ ID NO: 6097751 - DNA, 16 bp, Homo sapiens
ccttttgactcttccg

SEQ ID NO: 6097752 - DNA, 15 bp, Homo sapiens
ccttttgagcctaga

SEQ ID NO: 6097753 - DNA, 16 bp, Homo sapiens
ccttttgaggagcccc

SEQ ID NO: 6097754 - DNA, 21 bp, Homo sapiens
ccttttgaggagccccagcta

SEQ ID NO: 6097755 - DNA, 20 bp, Homo sapiens
ccttttgataaaatgttcct

SEQ ID NO: 6097756 - DNA, 16 bp, Homo sapiens
ccttttgatggggaga

SEQ ID NO: 6097757 - DNA, 17 bp, Homo sapiens
ccttttgatggggagaa

SEQ ID NO: 6097758 - DNA, 10 bp, Homo sapiens
ccttttgcac

SEQ ID NO: 6097759 - DNA, 18 bp, Homo sapiens
ccttttgcacccctccca

SEQ ID NO: 6097760 - DNA, 17 bp, Homo sapiens
ccttttgcacctgctct

SEQ ID NO: 6097761 - DNA, 15 bp, Homo sapiens
ccttttgcaggaaaa

SEQ ID NO: 6097762 - DNA, 13 bp, Homo sapiens
ccttttgcattct

SEQ ID NO: 6097763 - DNA, 12 bp, Homo sapiens
ccttttgcattg

SEQ ID NO: 6097764 - DNA, 15 bp, Homo sapiens
ccttttgcatttctt

SEQ ID NO: 6097765 - DNA, 24 bp, Homo sapiens
ccttttgcccccgtggggctcccg

SEQ ID NO: 6097766 - DNA, 21 bp, Homo sapiens
ccttttgctctgtcctcccca

SEQ ID NO: 6097767 - DNA, 16 bp, Homo sapiens
ccttttgctgcgcacc

SEQ ID NO: 6097768 - DNA, 20 bp, Homo sapiens
ccttttgcttcatctggagt

SEQ ID NO: 6097769 - DNA, 11 bp, Homo sapiens
ccttttggaac

SEQ ID NO: 6097770 - DNA, 23 bp, Homo sapiens
ccttttggcccccgagctggggg

SEQ ID NO: 6097771 - DNA, 19 bp, Homo sapiens
ccttttggcctttgtaaga

SEQ ID NO: 6097772 - DNA, 15 bp, Homo sapiens
ccttttgggtttctg

SEQ ID NO: 6097773 - DNA, 21 bp, Homo sapiens
ccttttggtttcaccttccct

SEQ ID NO: 6097774 - DNA, 12 bp, Homo sapiens
ccttttgtaaag

SEQ ID NO: 6097775 - DNA, 17 bp, Homo sapiens
ccttttgtatcctccat

SEQ ID NO: 6097776 - DNA, 12 bp, Homo sapiens
ccttttgtattt

SEQ ID NO: 6097777 - DNA, 14 bp, Homo sapiens
ccttttgtcaattg

SEQ ID NO: 6097778 - DNA, 12 bp, Homo sapiens
ccttttgtctct

SEQ ID NO: 6097779 - DNA, 12 bp, Homo sapiens
ccttttgtcttc

SEQ ID NO: 6097780 - DNA, 20 bp, Homo sapiens
ccttttgtgggtttctctgt

SEQ ID NO: 6097781 - DNA, 20 bp, Homo sapiens
ccttttgtgtaattttaaag

SEQ ID NO: 6097782 - DNA, 15 bp, Homo sapiens
ccttttgtgtctatg

SEQ ID NO: 6097783 - DNA, 19 bp, Homo sapiens
ccttttgttaatgcattgt

SEQ ID NO: 6097784 - DNA, 19 bp, Homo sapiens
ccttttgttgagccaggcc

SEQ ID NO: 6097785 - DNA, 13 bp, Homo sapiens
ccttttgttttct

SEQ ID NO: 6097786 - DNA, 16 bp, Homo sapiens
ccttttgtttttccag

SEQ ID NO: 6097787 - DNA, 13 bp, Homo sapiens
cctttttaatcca

SEQ ID NO: 6097788 - DNA, 15 bp, Homo sapiens
cctttttaatccagg

SEQ ID NO: 6097789 - DNA, 14 bp, Homo sapiens
cctttttacacttt

SEQ ID NO: 6097790 - DNA, 17 bp, Homo sapiens
cctttttatattttata

SEQ ID NO: 6097791 - DNA, 16 bp, Homo sapiens
cctttttatgaggcaa

SEQ ID NO: 6097792 - DNA, 13 bp, Homo sapiens
cctttttattcat

SEQ ID NO: 6097793 - DNA, 18 bp, Homo sapiens
cctttttatttatatgta

SEQ ID NO: 6097794 - DNA, 22 bp, Homo sapiens
cctttttatttatatgtatgtg

SEQ ID NO: 6097795 - DNA, 13 bp, Homo sapiens
cctttttcattta

SEQ ID NO: 6097796 - DNA, 21 bp, Homo sapiens
cctttttcatttaactttata

SEQ ID NO: 6097797 - DNA, 14 bp, Homo sapiens
cctttttccatcat

SEQ ID NO: 6097798 - DNA, 16 bp, Homo sapiens
cctttttcctagcctg

SEQ ID NO: 6097799 - DNA, 19 bp, Homo sapiens
cctttttcctagcctgttt

SEQ ID NO: 6097800 - DNA, 17 bp, Homo sapiens
cctttttcctctccaca

SEQ ID NO: 6097801 - DNA, 12 bp, Homo sapiens
cctttttcctgc

SEQ ID NO: 6097802 - DNA, 14 bp, Homo sapiens
cctttttccttgtc

SEQ ID NO: 6097803 - DNA, 23 bp, Homo sapiens
cctttttctccacactccactga

SEQ ID NO: 6097804 - DNA, 18 bp, Homo sapiens
cctttttctgagatgctc

SEQ ID NO: 6097805 - DNA, 11 bp, Homo sapiens
cctttttctgc

SEQ ID NO: 6097806 - DNA, 15 bp, Homo sapiens
cctttttgacactga

SEQ ID NO: 6097807 - DNA, 13 bp, Homo sapiens
cctttttgagcca

SEQ ID NO: 6097808 - DNA, 17 bp, Homo sapiens
cctttttgcttatttta

SEQ ID NO: 6097809 - DNA, 20 bp, Homo sapiens
cctttttggactagccagaa

SEQ ID NO: 6097810 - DNA, 19 bp, Homo sapiens
cctttttggcctgtgatgt

SEQ ID NO: 6097811 - DNA, 16 bp, Homo sapiens
cctttttgttccccat

SEQ ID NO: 6097812 - DNA, 13 bp, Homo sapiens
ccttttttaaaaa

SEQ ID NO: 6097813 - DNA, 20 bp, Homo sapiens
ccttttttaaaagtaaatgt

SEQ ID NO: 6097814 - DNA, 13 bp, Homo sapiens
ccttttttaagat

SEQ ID NO: 6097815 - DNA, 19 bp, Homo sapiens
ccttttttaagatttttct

SEQ ID NO: 6097816 - DNA, 21 bp, Homo sapiens
ccttttttaagatttttctca

SEQ ID NO: 6097817 - DNA, 21 bp, Homo sapiens
ccttttttagagttgatacta

SEQ ID NO: 6097818 - DNA, 13 bp, Homo sapiens
ccttttttataac

SEQ ID NO: 6097819 - DNA, 21 bp, Homo sapiens
ccttttttatcatttctactg

SEQ ID NO: 6097820 - DNA, 12 bp, Homo sapiens
ccttttttcaaa

SEQ ID NO: 6097821 - DNA, 24 bp, Homo sapiens
ccttttttcaatatgcaagcagct

SEQ ID NO: 6097822 - DNA, 15 bp, Homo sapiens
ccttttttcacagcc

SEQ ID NO: 6097823 - DNA, 22 bp, Homo sapiens
ccttttttcacggaagttttca

SEQ ID NO: 6097824 - DNA, 14 bp, Homo sapiens
ccttttttcccagc

SEQ ID NO: 6097825 - DNA, 14 bp, Homo sapiens
ccttttttccccag

SEQ ID NO: 6097826 - DNA, 18 bp, Homo sapiens
ccttttttccccagactt

SEQ ID NO: 6097827 - DNA, 14 bp, Homo sapiens
ccttttttcctttc

SEQ ID NO: 6097828 - DNA, 16 bp, Homo sapiens
ccttttttcctttcca

SEQ ID NO: 6097829 - DNA, 20 bp, Homo sapiens
ccttttttcctttcttcctt

SEQ ID NO: 6097830 - DNA, 23 bp, Homo sapiens
ccttttttgataaagtttctcag

SEQ ID NO: 6097831 - DNA, 15 bp, Homo sapiens
ccttttttggctgct

SEQ ID NO: 6097832 - DNA, 20 bp, Homo sapiens
ccttttttggctgctgaagg

SEQ ID NO: 6097833 - DNA, 20 bp, Homo sapiens
ccttttttggctttagacac

SEQ ID NO: 6097834 - DNA, 17 bp, Homo sapiens
ccttttttgtcccccaa

SEQ ID NO: 6097835 - DNA, 23 bp, Homo sapiens
ccttttttgtcccccaacttgag

SEQ ID NO: 6097836 - DNA, 13 bp, Homo sapiens
ccttttttgtcta

SEQ ID NO: 6097837 - DNA, 22 bp, Homo sapiens
ccttttttgttttttcaaaata

SEQ ID NO: 6097838 - DNA, 15 bp, Homo sapiens
cctttttttaaattt

SEQ ID NO: 6097839 - DNA, 19 bp, Homo sapiens
cctttttttaaattttctc

SEQ ID NO: 6097840 - DNA, 20 bp, Homo sapiens
cctttttttaaattttctcc

SEQ ID NO: 6097841 - DNA, 13 bp, Homo sapiens
cctttttttctct

SEQ ID NO: 6097842 - DNA, 16 bp, Homo sapiens
cctttttttctctcct

SEQ ID NO: 6097843 - DNA, 21 bp, Homo sapiens
cgaaaaaaaaaaatgcactgt

SEQ ID NO: 6097844 - DNA, 17 bp, Homo sapiens
cgaaaaataaaaaggaa

SEQ ID NO: 6097845 - DNA, 17 bp, Homo sapiens
cgaaaacaaccgtcctg

SEQ ID NO: 6097846 - DNA, 19 bp, Homo sapiens
cgaaaacaaccgtcctgct

SEQ ID NO: 6097847 - DNA, 12 bp, Homo sapiens
cgaaaacattgt

SEQ ID NO: 6097848 - DNA, 13 bp, Homo sapiens
cgaaaaccaggcc

SEQ ID NO: 6097849 - DNA, 20 bp, Homo sapiens
cgaaaacgttgacccctttc

SEQ ID NO: 6097850 - DNA, 22 bp, Homo sapiens
cgaaaacgttgacccctttccc

SEQ ID NO: 6097851 - DNA, 15 bp, Homo sapiens
cgaaaagagtcttcc

SEQ ID NO: 6097852 - DNA, 22 bp, Homo sapiens
cgaaaatcatataatcttacaa

SEQ ID NO: 6097853 - DNA, 22 bp, Homo sapiens
cgaaaatgtattattgtaaagt

SEQ ID NO: 6097854 - DNA, 18 bp, Homo sapiens
cgaaacaacttgtgttct

SEQ ID NO: 6097855 - DNA, 17 bp, Homo sapiens
cgaaacacagaaacctt

SEQ ID NO: 6097856 - DNA, 17 bp, Homo sapiens
cgaaacacagaactcag

SEQ ID NO: 6097857 - DNA, 13 bp, Homo sapiens
cgaaacagcgctg

SEQ ID NO: 6097858 - DNA, 16 bp, Homo sapiens
cgaaaccaaagaagaa

SEQ ID NO: 6097859 - DNA, 19 bp, Homo sapiens
cgaaacccggtgcatctgg

SEQ ID NO: 6097860 - DNA, 24 bp, Homo sapiens
cgaaacccggtgcatctggcacgt

SEQ ID NO: 6097861 - DNA, 18 bp, Homo sapiens
cgaaacctgggattcagg

SEQ ID NO: 6097862 - DNA, 15 bp, Homo sapiens
cgaaactaagccagg

SEQ ID NO: 6097863 - DNA, 20 bp, Homo sapiens
cgaaactccatctcaaaaca

SEQ ID NO: 6097864 - DNA, 10 bp, Homo sapiens
cgaaactgcc

SEQ ID NO: 6097865 - DNA, 11 bp, Homo sapiens
cgaaactgcca

SEQ ID NO: 6097866 - DNA, 16 bp, Homo sapiens
cgaaactgccaagggt

SEQ ID NO: 6097867 - DNA, 13 bp, Homo sapiens
cgaaactggaagt

SEQ ID NO: 6097868 - DNA, 15 bp, Homo sapiens
cgaaactggaagtta

SEQ ID NO: 6097869 - DNA, 17 bp, Homo sapiens
cgaaacttgttattgtg

SEQ ID NO: 6097870 - DNA, 19 bp, Homo sapiens
cgaaacttgttattgtgaa

SEQ ID NO: 6097871 - DNA, 21 bp, Homo sapiens
cgaaacttgttattgtgaatg

SEQ ID NO: 6097872 - DNA, 16 bp, Homo sapiens
cgaaagaagacacaga

SEQ ID NO: 6097873 - DNA, 11 bp, Homo sapiens
cgaaagcacac

SEQ ID NO: 6097874 - DNA, 18 bp, Homo sapiens
cgaaagcatcactgcctt

SEQ ID NO: 6097875 - DNA, 22 bp, Homo sapiens
cgaaagcatcactgccttggcc

SEQ ID NO: 6097876 - DNA, 23 bp, Homo sapiens
cgaaagcatcactgccttggccc

SEQ ID NO: 6097877 - DNA, 13 bp, Homo sapiens
cgaaagctctaga

SEQ ID NO: 6097878 - DNA, 18 bp, Homo sapiens
cgaaagctctagaatctg

SEQ ID NO: 6097879 - DNA, 23 bp, Homo sapiens
cgaaaggaggccctgttccctgg

SEQ ID NO: 6097880 - DNA, 14 bp, Homo sapiens
cgaaaggatgagca

SEQ ID NO: 6097881 - DNA, 14 bp, Homo sapiens
cgaaaggccttcag

SEQ ID NO: 6097882 - DNA, 14 bp, Homo sapiens
cgaaaggcgagtcc

SEQ ID NO: 6097883 - DNA, 17 bp, Homo sapiens
cgaaagggacacaatgt

SEQ ID NO: 6097884 - DNA, 15 bp, Homo sapiens
cgaaaggtcacctca

SEQ ID NO: 6097885 - DNA, 23 bp, Homo sapiens
cgaaaggtcacctcactcagcac

SEQ ID NO: 6097886 - DNA, 17 bp, Homo sapiens
cgaaaggtgcagctgcg

SEQ ID NO: 6097887 - DNA, 18 bp, Homo sapiens
cgaaagtatttacttttt

SEQ ID NO: 6097888 - DNA, 11 bp, Homo sapiens
cgaaataacaa

SEQ ID NO: 6097889 - DNA, 19 bp, Homo sapiens
cgaaataattgttgttctg

SEQ ID NO: 6097890 - DNA, 21 bp, Homo sapiens
cgaaataattgttgttctgtt

SEQ ID NO: 6097891 - DNA, 20 bp, Homo sapiens
cgaaatcagcccccagcctt

SEQ ID NO: 6097892 - DNA, 16 bp, Homo sapiens
cgaaatccctgctcac

SEQ ID NO: 6097893 - DNA, 16 bp, Homo sapiens
cgaaatctaaatttct

SEQ ID NO: 6097894 - DNA, 12 bp, Homo sapiens
cgaaatggaaac

SEQ ID NO: 6097895 - DNA, 13 bp, Homo sapiens
cgaaatggctgaa

SEQ ID NO: 6097896 - DNA, 15 bp, Homo sapiens
cctcatctccagcct

SEQ ID NO: 6097897 - DNA, 19 bp, Homo sapiens
cctcatctccagcctcccc

SEQ ID NO: 6097898 - DNA, 21 bp, Homo sapiens
cctcatctccccatcattggt

SEQ ID NO: 6097899 - DNA, 20 bp, Homo sapiens
cctcatctctctgcccaacc

SEQ ID NO: 6097900 - DNA, 21 bp, Homo sapiens
cctcatctctgaaaattctgg

SEQ ID NO: 6097901 - DNA, 18 bp, Homo sapiens
cctcatctctgcctgaca

SEQ ID NO: 6097902 - DNA, 18 bp, Homo sapiens
cctcatctgagaggctct

SEQ ID NO: 6097903 - DNA, 19 bp, Homo sapiens
cctcatctgagaggctctc

SEQ ID NO: 6097904 - DNA, 13 bp, Homo sapiens
cctcatctgcagg

SEQ ID NO: 6097905 - DNA, 18 bp, Homo sapiens
cctcatctgcaggacaga

SEQ ID NO: 6097906 - DNA, 13 bp, Homo sapiens
cctcatctgcctg

SEQ ID NO: 6097907 - DNA, 17 bp, Homo sapiens
cctcatctgcctggaaa

SEQ ID NO: 6097908 - DNA, 22 bp, Homo sapiens
cctcatctgctcctagcccagc

SEQ ID NO: 6097909 - DNA, 17 bp, Homo sapiens
cctcatctgtgcctgtc

SEQ ID NO: 6097910 - DNA, 15 bp, Homo sapiens
cctcatctgtggagc

SEQ ID NO: 6097911 - DNA, 15 bp, Homo sapiens
cctcatcttccccag

SEQ ID NO: 6097912 - DNA, 16 bp, Homo sapiens
cctcatcttccccagc

SEQ ID NO: 6097913 - DNA, 15 bp, Homo sapiens
cctcatcttcttcac

SEQ ID NO: 6097914 - DNA, 15 bp, Homo sapiens
cctcatctttctcct

SEQ ID NO: 6097915 - DNA, 21 bp, Homo sapiens
cctcatgaaaacacacataca

SEQ ID NO: 6097916 - DNA, 18 bp, Homo sapiens
cctcatgaacactggctg

SEQ ID NO: 6097917 - DNA, 13 bp, Homo sapiens
cctcatgaataaa

SEQ ID NO: 6097918 - DNA, 13 bp, Homo sapiens
cctcatgaatgta

SEQ ID NO: 6097919 - DNA, 20 bp, Homo sapiens
cctcatgaatgtaaatttgt

SEQ ID NO: 6097920 - DNA, 15 bp, Homo sapiens
cctcatgacagccag

SEQ ID NO: 6097921 - DNA, 17 bp, Homo sapiens
cctcatgacagccagag

SEQ ID NO: 6097922 - DNA, 18 bp, Homo sapiens
cctcatgacagccagagc

SEQ ID NO: 6097923 - DNA, 20 bp, Homo sapiens
cctcatgaccctcctgtcca

SEQ ID NO: 6097924 - DNA, 11 bp, Homo sapiens
cctcatgagga

SEQ ID NO: 6097925 - DNA, 14 bp, Homo sapiens
cctcatgagtgtca

SEQ ID NO: 6097926 - DNA, 18 bp, Homo sapiens
cctcatgataatctgggc

SEQ ID NO: 6097927 - DNA, 18 bp, Homo sapiens
cctcatgcatctccacct

SEQ ID NO: 6097928 - DNA, 20 bp, Homo sapiens
cctcatgccaaccctgggct

SEQ ID NO: 6097929 - DNA, 22 bp, Homo sapiens
cctcatgcccaccccctgccct

SEQ ID NO: 6097930 - DNA, 14 bp, Homo sapiens
cctcatgcccagct

SEQ ID NO: 6097931 - DNA, 19 bp, Homo sapiens
cctcatgcccagctctctg

SEQ ID NO: 6097932 - DNA, 20 bp, Homo sapiens
cctcatgcccagctctctga

SEQ ID NO: 6097933 - DNA, 16 bp, Homo sapiens
cctcatgccccaggcc

SEQ ID NO: 6097934 - DNA, 18 bp, Homo sapiens
cctcatgccgctgtgtct

SEQ ID NO: 6097935 - DNA, 14 bp, Homo sapiens
cctcatgcctgctg

SEQ ID NO: 6097936 - DNA, 17 bp, Homo sapiens
cctcatgcctgctgaga

SEQ ID NO: 6097937 - DNA, 17 bp, Homo sapiens
cctcatgcctggccccc

SEQ ID NO: 6097938 - DNA, 14 bp, Homo sapiens
cctcatgctctcta

SEQ ID NO: 6097939 - DNA, 15 bp, Homo sapiens
cctcatgctgccaat

SEQ ID NO: 6097940 - DNA, 18 bp, Homo sapiens
cctcatgctggagggagg

SEQ ID NO: 6097941 - DNA, 15 bp, Homo sapiens
cctcatggcccccag

SEQ ID NO: 6097942 - DNA, 19 bp, Homo sapiens
cctcatggcccccaggggc

SEQ ID NO: 6097943 - DNA, 19 bp, Homo sapiens
cctcatggcgggactggag

SEQ ID NO: 6097944 - DNA, 17 bp, Homo sapiens
cctcatggctgttatct

SEQ ID NO: 6097945 - DNA, 19 bp, Homo sapiens
cctcatgggaagcatgtgg

SEQ ID NO: 6097946 - DNA, 24 bp, Homo sapiens
cctcatgggtcccttgaaggaaga

SEQ ID NO: 6097947 - DNA, 19 bp, Homo sapiens
cctcatggtgcatataaat

SEQ ID NO: 6097948 - DNA, 16 bp, Homo sapiens
cctcatgttctgtggg

SEQ ID NO: 6097949 - DNA, 13 bp, Homo sapiens
cctcatgttctta

SEQ ID NO: 6097950 - DNA, 14 bp, Homo sapiens
cctcatgttgctga

SEQ ID NO: 6097951 - DNA, 18 bp, Homo sapiens
cctcatgtttatgaaaat

SEQ ID NO: 6097952 - DNA, 15 bp, Homo sapiens
cctcattaatgacac

SEQ ID NO: 6097953 - DNA, 19 bp, Homo sapiens
cctcattacggctcctctc

SEQ ID NO: 6097954 - DNA, 16 bp, Homo sapiens
cctcattactgggcct

SEQ ID NO: 6097955 - DNA, 16 bp, Homo sapiens
cctcattactgtgagg

SEQ ID NO: 6097956 - DNA, 13 bp, Homo sapiens
cctcattataaaa

SEQ ID NO: 6097957 - DNA, 16 bp, Homo sapiens
cctcattatcaaacag

SEQ ID NO: 6097958 - DNA, 19 bp, Homo sapiens
cctcattcagagactgccc

SEQ ID NO: 6097959 - DNA, 16 bp, Homo sapiens
cctcattcaggaaaac

SEQ ID NO: 6097960 - DNA, 17 bp, Homo sapiens
cctcattcaggaaaact

SEQ ID NO: 6097961 - DNA, 22 bp, Homo sapiens
cctcattcaggaaaactgacag

SEQ ID NO: 6097962 - DNA, 13 bp, Homo sapiens
cctcattcctgaa

SEQ ID NO: 6097963 - DNA, 21 bp, Homo sapiens
cctcattctactaatgtgatg

SEQ ID NO: 6097964 - DNA, 14 bp, Homo sapiens
cctcattctgcatt

SEQ ID NO: 6097965 - DNA, 15 bp, Homo sapiens
cctcattctgcatta

SEQ ID NO: 6097966 - DNA, 15 bp, Homo sapiens
cctcattgcatttat

SEQ ID NO: 6097967 - DNA, 14 bp, Homo sapiens
cctcattgcctcct

SEQ ID NO: 6097968 - DNA, 17 bp, Homo sapiens
cctcattgctaccacag

SEQ ID NO: 6097969 - DNA, 19 bp, Homo sapiens
cctcattgctaccacagac

SEQ ID NO: 6097970 - DNA, 13 bp, Homo sapiens
cctcattggccag

SEQ ID NO: 6097971 - DNA, 21 bp, Homo sapiens
cctcattgtgccaagccttct

SEQ ID NO: 6097972 - DNA, 22 bp, Homo sapiens
cctcatttaatatttttcaaaa

SEQ ID NO: 6097973 - DNA, 18 bp, Homo sapiens
cctcatttatcactctga

SEQ ID NO: 6097974 - DNA, 19 bp, Homo sapiens
cctcatttatccctcaacc

SEQ ID NO: 6097975 - DNA, 20 bp, Homo sapiens
cctcatttatccctcaaccc

SEQ ID NO: 6097976 - DNA, 16 bp, Homo sapiens
cctcatttcattattt

SEQ ID NO: 6097977 - DNA, 22 bp, Homo sapiens
cctcatttcattatttttcaat

SEQ ID NO: 6097978 - DNA, 11 bp, Homo sapiens
cctcatttctc

SEQ ID NO: 6097979 - DNA, 17 bp, Homo sapiens
cctcatttctgccagcg

SEQ ID NO: 6097980 - DNA, 18 bp, Homo sapiens
cctcatttcttcctctgc

SEQ ID NO: 6097981 - DNA, 16 bp, Homo sapiens
cctcatttctttgtct

SEQ ID NO: 6097982 - DNA, 21 bp, Homo sapiens
cctcatttgcaaacctcagag

SEQ ID NO: 6097983 - DNA, 13 bp, Homo sapiens
cctcatttgcatc

SEQ ID NO: 6097984 - DNA, 22 bp, Homo sapiens
cctcattttactaaaatcgtat

SEQ ID NO: 6097985 - DNA, 10 bp, Homo sapiens
cctcattttg

SEQ ID NO: 6097986 - DNA, 15 bp, Homo sapiens
cctcatttttcatac

SEQ ID NO: 6097987 - DNA, 16 bp, Homo sapiens
cctcatttttcatact

SEQ ID NO: 6097988 - DNA, 15 bp, Homo sapiens
cctccaaaagcactt

SEQ ID NO: 6097989 - DNA, 19 bp, Homo sapiens
cctccaaacctccagcctc

SEQ ID NO: 6097990 - DNA, 15 bp, Homo sapiens
cctccaaactcctgc

SEQ ID NO: 6097991 - DNA, 16 bp, Homo sapiens
cctccaaactcctgcc

SEQ ID NO: 6097992 - DNA, 20 bp, Homo sapiens
cctccaaactcctgcctgtg

SEQ ID NO: 6097993 - DNA, 17 bp, Homo sapiens
cctccaaagcctgggca

SEQ ID NO: 6097994 - DNA, 20 bp, Homo sapiens
cctccaaagcctgggcagaa

SEQ ID NO: 6097995 - DNA, 14 bp, Homo sapiens
cctccaaaggaact

SEQ ID NO: 6097996 - DNA, 20 bp, Homo sapiens
cctccaaaggaactctagag

SEQ ID NO: 6097997 - DNA, 19 bp, Homo sapiens
cctccaaagggcagtgggt

SEQ ID NO: 6097998 - DNA, 19 bp, Homo sapiens
cctccaaagtcttgatagc

SEQ ID NO: 6097999 - DNA, 22 bp, Homo sapiens
cctccaaatggagaagctgcag

SEQ ID NO: 6098000 - DNA, 21 bp, Homo sapiens
cctccaaatgtcctttctcag

SEQ ID NO: 6098001 - DNA, 21 bp, Homo sapiens
cctccaaccaaataagacttc

SEQ ID NO: 6098002 - DNA, 12 bp, Homo sapiens
cctccaaccctg

SEQ ID NO: 6098003 - DNA, 18 bp, Homo sapiens
cctccaaccctgccgtca

SEQ ID NO: 6098004 - DNA, 18 bp, Homo sapiens
cctccaacgcccctgtgg

SEQ ID NO: 6098005 - DNA, 14 bp, Homo sapiens
cctccaactggatg

SEQ ID NO: 6098006 - DNA, 21 bp, Homo sapiens
cctccaagaagccctccttgc

SEQ ID NO: 6098007 - DNA, 20 bp, Homo sapiens
cctccaagaccttctccttc

SEQ ID NO: 6098008 - DNA, 22 bp, Homo sapiens
cctccaagaggctccctcctgt

SEQ ID NO: 6098009 - DNA, 18 bp, Homo sapiens
cctccaagcatttcatga

SEQ ID NO: 6098010 - DNA, 23 bp, Homo sapiens
cctccaagcctggcacccaccgt

SEQ ID NO: 6098011 - DNA, 17 bp, Homo sapiens
cctccaagcggccctgt

SEQ ID NO: 6098012 - DNA, 22 bp, Homo sapiens
cctccaagctccatctccactc

SEQ ID NO: 6098013 - DNA, 15 bp, Homo sapiens
cctccaaggactcta

SEQ ID NO: 6098014 - DNA, 14 bp, Homo sapiens
cctccaaggccagg

SEQ ID NO: 6098015 - DNA, 22 bp, Homo sapiens
cctccaaggggctttgtcctgg

SEQ ID NO: 6098016 - DNA, 15 bp, Homo sapiens
cctccaagggtttcg

SEQ ID NO: 6098017 - DNA, 22 bp, Homo sapiens
cctccaagggtttcgactggtc

SEQ ID NO: 6098018 - DNA, 19 bp, Homo sapiens
cctccaagtctgtacctca

SEQ ID NO: 6098019 - DNA, 22 bp, Homo sapiens
cctccaatcccaccaaccctca

SEQ ID NO: 6098020 - DNA, 14 bp, Homo sapiens
cctccaatcctccc

SEQ ID NO: 6098021 - DNA, 20 bp, Homo sapiens
cctccaatcctccccgctct

SEQ ID NO: 6098022 - DNA, 16 bp, Homo sapiens
cctccaatcctgcccc

SEQ ID NO: 6098023 - DNA, 20 bp, Homo sapiens
cctccaatgcattggcctct

SEQ ID NO: 6098024 - DNA, 12 bp, Homo sapiens
cctccaatgtcc

SEQ ID NO: 6098025 - DNA, 13 bp, Homo sapiens
cctccaatgtcta

SEQ ID NO: 6098026 - DNA, 17 bp, Homo sapiens
cctccaattctactagt

SEQ ID NO: 6098027 - DNA, 22 bp, Homo sapiens
cctccaattggtgcttcagccc

SEQ ID NO: 6098028 - DNA, 19 bp, Homo sapiens
cctccacaaagagaccagg

SEQ ID NO: 6098029 - DNA, 16 bp, Homo sapiens
cctccacacctgaact

SEQ ID NO: 6098030 - DNA, 14 bp, Homo sapiens
cctccacacctgcg

SEQ ID NO: 6098031 - DNA, 21 bp, Homo sapiens
cctccacactgaccaagtgct

SEQ ID NO: 6098032 - DNA, 12 bp, Homo sapiens
cctccacagaga

SEQ ID NO: 6098033 - DNA, 17 bp, Homo sapiens
cctccacagccgcagcc

SEQ ID NO: 6098034 - DNA, 21 bp, Homo sapiens
cctccacagcgagggcagctg

SEQ ID NO: 6098035 - DNA, 22 bp, Homo sapiens
cctccacagcgagggcagctgc

SEQ ID NO: 6098036 - DNA, 13 bp, Homo sapiens
cctccacagctgc

SEQ ID NO: 6098037 - DNA, 14 bp, Homo sapiens
cctccacagctgca

SEQ ID NO: 6098038 - DNA, 22 bp, Homo sapiens
cctccacaggagccgcagaggc

SEQ ID NO: 6098039 - DNA, 14 bp, Homo sapiens
cctccacagtgctg

SEQ ID NO: 6098040 - DNA, 18 bp, Homo sapiens
cctccacagtgctgcttc

SEQ ID NO: 6098041 - DNA, 15 bp, Homo sapiens
cctccacatcctcca

SEQ ID NO: 6098042 - DNA, 13 bp, Homo sapiens
cctccacatcctg

SEQ ID NO: 6098043 - DNA, 15 bp, Homo sapiens
cctccacatcctgtg

SEQ ID NO: 6098044 - DNA, 20 bp, Homo sapiens
cctccaccaccactggccac

SEQ ID NO: 6098045 - DNA, 15 bp, Homo sapiens
cctccaccagcctgc

SEQ ID NO: 6098046 - DNA, 10 bp, Homo sapiens
cctccaccca

SEQ ID NO: 6098047 - DNA, 14 bp, Homo sapiens
cctccacccacagt

SEQ ID NO: 6098048 - DNA, 13 bp, Homo sapiens
cctccacccacta

SEQ ID NO: 6098049 - DNA, 13 bp, Homo sapiens
cctccacccagcc

SEQ ID NO: 6098050 - DNA, 16 bp, Homo sapiens
cctccacccagcccct

SEQ ID NO: 6098051 - DNA, 13 bp, Homo sapiens
cctccaccccagg

SEQ ID NO: 6098052 - DNA, 14 bp, Homo sapiens
cctccaccccagga

SEQ ID NO: 6098053 - DNA, 16 bp, Homo sapiens
cctccaccccagtccc

SEQ ID NO: 6098054 - DNA, 20 bp, Homo sapiens
cctccacccccaagaaacct

SEQ ID NO: 6098055 - DNA, 16 bp, Homo sapiens
cctccacccccatgtg

SEQ ID NO: 6098056 - DNA, 18 bp, Homo sapiens
cctccaccccccactcag

SEQ ID NO: 6098057 - DNA, 16 bp, Homo sapiens
cctccacccccgccac

SEQ ID NO: 6098058 - DNA, 18 bp, Homo sapiens
cctccacccccgccacgg

SEQ ID NO: 6098059 - DNA, 14 bp, Homo sapiens
cctccacccgtcct

SEQ ID NO: 6098060 - DNA, 22 bp, Homo sapiens
cctccacccgtcctccctcagc

SEQ ID NO: 6098061 - DNA, 13 bp, Homo sapiens
cctccaccctctg

SEQ ID NO: 6098062 - DNA, 16 bp, Homo sapiens
cctccaccctctgagc

SEQ ID NO: 6098063 - DNA, 22 bp, Homo sapiens
cctccaccctctgagctttgca

SEQ ID NO: 6098064 - DNA, 12 bp, Homo sapiens
cctccaccctgc

SEQ ID NO: 6098065 - DNA, 14 bp, Homo sapiens
cctccaccctgcat

SEQ ID NO: 6098066 - DNA, 15 bp, Homo sapiens
cctccaccctgtccc

SEQ ID NO: 6098067 - DNA, 16 bp, Homo sapiens
cctccaccctgtcccc

SEQ ID NO: 6098068 - DNA, 17 bp, Homo sapiens
cctccaccgagccagct

SEQ ID NO: 6098069 - DNA, 21 bp, Homo sapiens
cctccaccgccatggcttcca

SEQ ID NO: 6098070 - DNA, 13 bp, Homo sapiens
cctccacctcaag

SEQ ID NO: 6098071 - DNA, 15 bp, Homo sapiens
cctccacctccctgc

SEQ ID NO: 6098072 - DNA, 17 bp, Homo sapiens
cctccacctccctgcaa

SEQ ID NO: 6098073 - DNA, 17 bp, Homo sapiens
cctccacctcctctctt

SEQ ID NO: 6098074 - DNA, 14 bp, Homo sapiens
cctccacctcctgg

SEQ ID NO: 6098075 - DNA, 15 bp, Homo sapiens
cctccacctcctggg

SEQ ID NO: 6098076 - DNA, 13 bp, Homo sapiens
cgaaatggtacca

SEQ ID NO: 6098077 - DNA, 22 bp, Homo sapiens
cgaaatgttattttttaattat

SEQ ID NO: 6098078 - DNA, 15 bp, Homo sapiens
cgaaatttcattttc

SEQ ID NO: 6098079 - DNA, 11 bp, Homo sapiens
cgaacaaaaca

SEQ ID NO: 6098080 - DNA, 11 bp, Homo sapiens
cgaacacacat

SEQ ID NO: 6098081 - DNA, 18 bp, Homo sapiens
cgaacaccctcgaagcgc

SEQ ID NO: 6098082 - DNA, 14 bp, Homo sapiens
cgaacagggacttg

SEQ ID NO: 6098083 - DNA, 15 bp, Homo sapiens
cgaacagggacttgt

SEQ ID NO: 6098084 - DNA, 16 bp, Homo sapiens
cgaacagttggggctg

SEQ ID NO: 6098085 - DNA, 21 bp, Homo sapiens
cgaacagttggggctgttcat

SEQ ID NO: 6098086 - DNA, 19 bp, Homo sapiens
cgaacatatcatttgtgaa

SEQ ID NO: 6098087 - DNA, 22 bp, Homo sapiens
cgaacatatcatttgtgaagaa

SEQ ID NO: 6098088 - DNA, 20 bp, Homo sapiens
cgaacatcttcatataaact

SEQ ID NO: 6098089 - DNA, 15 bp, Homo sapiens
cgaacatgaccaaaa

SEQ ID NO: 6098090 - DNA, 14 bp, Homo sapiens
cgaacatggcatgt

SEQ ID NO: 6098091 - DNA, 23 bp, Homo sapiens
cgaacatgtttttcttctccctc

SEQ ID NO: 6098092 - DNA, 15 bp, Homo sapiens
cgaacattaggaatt

SEQ ID NO: 6098093 - DNA, 16 bp, Homo sapiens
cgaaccaaggcagcct

SEQ ID NO: 6098094 - DNA, 14 bp, Homo sapiens
cgaaccacccaaaa

SEQ ID NO: 6098095 - DNA, 22 bp, Homo sapiens
cgaacccaatctgcacactcca

SEQ ID NO: 6098096 - DNA, 16 bp, Homo sapiens
cgaacccacctgctga

SEQ ID NO: 6098097 - DNA, 19 bp, Homo sapiens
cgaaccccccactccctgc

SEQ ID NO: 6098098 - DNA, 14 bp, Homo sapiens
cgaacccctcccct

SEQ ID NO: 6098099 - DNA, 21 bp, Homo sapiens
cgaacccctcccctcccccct

SEQ ID NO: 6098100 - DNA, 13 bp, Homo sapiens
cgaaccctgccag

SEQ ID NO: 6098101 - DNA, 14 bp, Homo sapiens
cgaaccctgccagg

SEQ ID NO: 6098102 - DNA, 15 bp, Homo sapiens
cgaacctcctctgtg

SEQ ID NO: 6098103 - DNA, 18 bp, Homo sapiens
cgaaccttggcctgggcc

SEQ ID NO: 6098104 - DNA, 16 bp, Homo sapiens
cgaacgacaatagctt

SEQ ID NO: 6098105 - DNA, 14 bp, Homo sapiens
cgaacgtatttctc

SEQ ID NO: 6098106 - DNA, 19 bp, Homo sapiens
cgaacgtatttctccagac

SEQ ID NO: 6098107 - DNA, 20 bp, Homo sapiens
cgaacgtatttctccagacc

SEQ ID NO: 6098108 - DNA, 14 bp, Homo sapiens
cgaactagaagaaa

SEQ ID NO: 6098109 - DNA, 15 bp, Homo sapiens
cgaactccaggctgg

SEQ ID NO: 6098110 - DNA, 19 bp, Homo sapiens
cgaactcctaacctcaagt

SEQ ID NO: 6098111 - DNA, 19 bp, Homo sapiens
cgaactcctgacatcaggt

SEQ ID NO: 6098112 - DNA, 16 bp, Homo sapiens
cgaactctcagaaata

SEQ ID NO: 6098113 - DNA, 14 bp, Homo sapiens
cgaactggctgcaa

SEQ ID NO: 6098114 - DNA, 13 bp, Homo sapiens
cgaactgtcctgg

SEQ ID NO: 6098115 - DNA, 12 bp, Homo sapiens
cgaactgtgcag

SEQ ID NO: 6098116 - DNA, 14 bp, Homo sapiens
cgaacttgctgggt

SEQ ID NO: 6098117 - DNA, 16 bp, Homo sapiens
cgaacttgctgggtgg

SEQ ID NO: 6098118 - DNA, 15 bp, Homo sapiens
cgaagaaagactcct

SEQ ID NO: 6098119 - DNA, 21 bp, Homo sapiens
cgaagaacaatgtcagaaact

SEQ ID NO: 6098120 - DNA, 17 bp, Homo sapiens
cgaagaactaataaatg

SEQ ID NO: 6098121 - DNA, 14 bp, Homo sapiens
cgaagaagagaaag

SEQ ID NO: 6098122 - DNA, 14 bp, Homo sapiens
cgaagaagcaacta

SEQ ID NO: 6098123 - DNA, 19 bp, Homo sapiens
cgaagaaggctaggagttc

SEQ ID NO: 6098124 - DNA, 18 bp, Homo sapiens
cgaagaagggtccttccc

SEQ ID NO: 6098125 - DNA, 20 bp, Homo sapiens
cgaagaatgaacccaagagc

SEQ ID NO: 6098126 - DNA, 13 bp, Homo sapiens
cgaagacacagac

SEQ ID NO: 6098127 - DNA, 21 bp, Homo sapiens
cgaagacccagcagatgttta

SEQ ID NO: 6098128 - DNA, 20 bp, Homo sapiens
cgaagaccctcttgcccatc

SEQ ID NO: 6098129 - DNA, 23 bp, Homo sapiens
cgaagaccctcttgcccatcctg

SEQ ID NO: 6098130 - DNA, 15 bp, Homo sapiens
cgaagagagttctgg

SEQ ID NO: 6098131 - DNA, 13 bp, Homo sapiens
cgaagagccctga

SEQ ID NO: 6098132 - DNA, 22 bp, Homo sapiens
cgaagagggaatggatggggag

SEQ ID NO: 6098133 - DNA, 20 bp, Homo sapiens
cgaagagtttaaagagaaaa

SEQ ID NO: 6098134 - DNA, 16 bp, Homo sapiens
cgaagatggtggccac

SEQ ID NO: 6098135 - DNA, 18 bp, Homo sapiens
cgaagatttcatccagaa

SEQ ID NO: 6098136 - DNA, 14 bp, Homo sapiens
cgaagcaagaagaa

SEQ ID NO: 6098137 - DNA, 20 bp, Homo sapiens
cgaagccacaggcctggcct

SEQ ID NO: 6098138 - DNA, 14 bp, Homo sapiens
cgaagccagtccag

SEQ ID NO: 6098139 - DNA, 20 bp, Homo sapiens
cgaagccatcacttctcccc

SEQ ID NO: 6098140 - DNA, 11 bp, Homo sapiens
cgaagccatgt

SEQ ID NO: 6098141 - DNA, 10 bp, Homo sapiens
cgaagcccag

SEQ ID NO: 6098142 - DNA, 18 bp, Homo sapiens
cgaagcccagagggtctg

SEQ ID NO: 6098143 - DNA, 14 bp, Homo sapiens
cgaagcccaggccc

SEQ ID NO: 6098144 - DNA, 14 bp, Homo sapiens
cgaagcccaggctg

SEQ ID NO: 6098145 - DNA, 15 bp, Homo sapiens
cgaagccccttggag

SEQ ID NO: 6098146 - DNA, 15 bp, Homo sapiens
cgaagcctgagcagg

SEQ ID NO: 6098147 - DNA, 16 bp, Homo sapiens
cgaagcctgagcaggc

SEQ ID NO: 6098148 - DNA, 18 bp, Homo sapiens
cgaagcctgagcaggcag

SEQ ID NO: 6098149 - DNA, 19 bp, Homo sapiens
cgaagccttctgcagcagg

SEQ ID NO: 6098150 - DNA, 20 bp, Homo sapiens
cgaagccttctgcagcagga

SEQ ID NO: 6098151 - DNA, 11 bp, Homo sapiens
cgaagcgcgcc

SEQ ID NO: 6098152 - DNA, 23 bp, Homo sapiens
cgaagcgcgccactcgcttcccc

SEQ ID NO: 6098153 - DNA, 18 bp, Homo sapiens
cgaagcggagagagccaa

SEQ ID NO: 6098154 - DNA, 19 bp, Homo sapiens
cgaagcggagagagccaag

SEQ ID NO: 6098155 - DNA, 21 bp, Homo sapiens
cgaagcggagagagccaagac

SEQ ID NO: 6098156 - DNA, 16 bp, Homo sapiens
cgaagcgttgtcctca

SEQ ID NO: 6098157 - DNA, 17 bp, Homo sapiens
cgaagcgttgtcctcag

SEQ ID NO: 6098158 - DNA, 16 bp, Homo sapiens
cgaagctcagcccacc

SEQ ID NO: 6098159 - DNA, 17 bp, Homo sapiens
cgaagctcagcccaccc

SEQ ID NO: 6098160 - DNA, 20 bp, Homo sapiens
cgaagctctggctgaaccct

SEQ ID NO: 6098161 - DNA, 14 bp, Homo sapiens
cgaagctgctgtga

SEQ ID NO: 6098162 - DNA, 18 bp, Homo sapiens
cgaaggaacctctcgcca

SEQ ID NO: 6098163 - DNA, 23 bp, Homo sapiens
cgaaggcagtgcaagagactctg

SEQ ID NO: 6098164 - DNA, 18 bp, Homo sapiens
cgaaggccccgcctgggt

SEQ ID NO: 6098165 - DNA, 12 bp, Homo sapiens
cgaagggagcat

SEQ ID NO: 6098166 - DNA, 15 bp, Homo sapiens
cgaagggcagccccg

SEQ ID NO: 6098167 - DNA, 14 bp, Homo sapiens
cgaagggcccccac

SEQ ID NO: 6098168 - DNA, 17 bp, Homo sapiens
cgaaggggaaaacccgc

SEQ ID NO: 6098169 - DNA, 16 bp, Homo sapiens
cgaaggggccccgggg

SEQ ID NO: 6098170 - DNA, 20 bp, Homo sapiens
cgaaggtcccacagccctga

SEQ ID NO: 6098171 - DNA, 22 bp, Homo sapiens
cgaaggtcccacagccctgaga

SEQ ID NO: 6098172 - DNA, 14 bp, Homo sapiens
cgaaggtgcctcag

SEQ ID NO: 6098173 - DNA, 15 bp, Homo sapiens
cgaaggtgcctcaga

SEQ ID NO: 6098174 - DNA, 18 bp, Homo sapiens
cgaagtcaagctcaacag

SEQ ID NO: 6098175 - DNA, 16 bp, Homo sapiens
cgaagtccagctttct

SEQ ID NO: 6098176 - DNA, 17 bp, Homo sapiens
cgaagtccagctttctg

SEQ ID NO: 6098177 - DNA, 20 bp, Homo sapiens
cgaagtcctatggaaacccg

SEQ ID NO: 6098178 - DNA, 18 bp, Homo sapiens
cgaagtctcatgggaagc

SEQ ID NO: 6098179 - DNA, 24 bp, Homo sapiens
cgaagtctctgattagttgacagt

SEQ ID NO: 6098180 - DNA, 16 bp, Homo sapiens
cgaagtctgctgctgt

SEQ ID NO: 6098181 - DNA, 14 bp, Homo sapiens
cgaagtcttccatc

SEQ ID NO: 6098182 - DNA, 20 bp, Homo sapiens
cgaagtctttgccttctctg

SEQ ID NO: 6098183 - DNA, 16 bp, Homo sapiens
cgaagtgcaatgatag

SEQ ID NO: 6098184 - DNA, 21 bp, Homo sapiens
cgaagtgtagggcaagggtgc

SEQ ID NO: 6098185 - DNA, 13 bp, Homo sapiens
cgaagtgttgcat

SEQ ID NO: 6098186 - DNA, 22 bp, Homo sapiens
cgaagtgtttatgtaatagttc

SEQ ID NO: 6098187 - DNA, 16 bp, Homo sapiens
cgaagttcaagatcaa

SEQ ID NO: 6098188 - DNA, 20 bp, Homo sapiens
cgaataaaggtcccatgctc

SEQ ID NO: 6098189 - DNA, 22 bp, Homo sapiens
cgaataaaggtcccatgctcca

SEQ ID NO: 6098190 - DNA, 22 bp, Homo sapiens
cgaataaggtaccaagatcaca

SEQ ID NO: 6098191 - DNA, 15 bp, Homo sapiens
cgaatactttgaatg

SEQ ID NO: 6098192 - DNA, 16 bp, Homo sapiens
cgaatagctgggacta

SEQ ID NO: 6098193 - DNA, 23 bp, Homo sapiens
cgaatagggaagtaaaaaaacaa

SEQ ID NO: 6098194 - DNA, 15 bp, Homo sapiens
cgaatatagttctgt

SEQ ID NO: 6098195 - DNA, 15 bp, Homo sapiens
cgaatatattactga

SEQ ID NO: 6098196 - DNA, 15 bp, Homo sapiens
cgaatatgaatgtca

SEQ ID NO: 6098197 - DNA, 17 bp, Homo sapiens
cgaatatgaatgtcaca

SEQ ID NO: 6098198 - DNA, 17 bp, Homo sapiens
cgaatattgagcaatat

SEQ ID NO: 6098199 - DNA, 17 bp, Homo sapiens
cgaatattgctgatggt

SEQ ID NO: 6098200 - DNA, 21 bp, Homo sapiens
cgaatcactcatttatttcca

SEQ ID NO: 6098201 - DNA, 18 bp, Homo sapiens
cgaatccaagctccctgc

SEQ ID NO: 6098202 - DNA, 15 bp, Homo sapiens
cgaatcccccaggga

SEQ ID NO: 6098203 - DNA, 14 bp, Homo sapiens
cgaatctacagaac

SEQ ID NO: 6098204 - DNA, 15 bp, Homo sapiens
cgaatctcatccctc

SEQ ID NO: 6098205 - DNA, 16 bp, Homo sapiens
cgaatctctgcccctc

SEQ ID NO: 6098206 - DNA, 22 bp, Homo sapiens
cgaatctctttttgctttcgaa

SEQ ID NO: 6098207 - DNA, 15 bp, Homo sapiens
cgaatgaaaagacaa

SEQ ID NO: 6098208 - DNA, 16 bp, Homo sapiens
cgaatgacactgttca

SEQ ID NO: 6098209 - DNA, 22 bp, Homo sapiens
cgaatgacggtaagtgttctca

SEQ ID NO: 6098210 - DNA, 17 bp, Homo sapiens
cgaatgcactcagggtc

SEQ ID NO: 6098211 - DNA, 16 bp, Homo sapiens
cgaatgcatattcaac

SEQ ID NO: 6098212 - DNA, 12 bp, Homo sapiens
cgaatggacttt

SEQ ID NO: 6098213 - DNA, 20 bp, Homo sapiens
cgaatggactttggaagcag

SEQ ID NO: 6098214 - DNA, 23 bp, Homo sapiens
cgaatggcttcgaggagataaac

SEQ ID NO: 6098215 - DNA, 14 bp, Homo sapiens
cgaatgggttttct

SEQ ID NO: 6098216 - DNA, 22 bp, Homo sapiens
cgaatggtagtctaaccaaatg

SEQ ID NO: 6098217 - DNA, 20 bp, Homo sapiens
cgaatggtctttgctccaga

SEQ ID NO: 6098218 - DNA, 19 bp, Homo sapiens
cgaatgtaattggaatctt

SEQ ID NO: 6098219 - DNA, 12 bp, Homo sapiens
cgaatgtcatac

SEQ ID NO: 6098220 - DNA, 23 bp, Homo sapiens
cgaatgtgtacaacttaagttgg

SEQ ID NO: 6098221 - DNA, 16 bp, Homo sapiens
cgaatgtgtctttaga

SEQ ID NO: 6098222 - DNA, 18 bp, Homo sapiens
cgaatgtgtgggcccaag

SEQ ID NO: 6098223 - DNA, 16 bp, Homo sapiens
cgaattaatagctttt

SEQ ID NO: 6098224 - DNA, 14 bp, Homo sapiens
cgaattcagaaaga

SEQ ID NO: 6098225 - DNA, 14 bp, Homo sapiens
cgaatttggtacac

SEQ ID NO: 6098226 - DNA, 16 bp, Homo sapiens
cgaatttggtacacat

SEQ ID NO: 6098227 - DNA, 21 bp, Homo sapiens
cgaatttggtacacatgtgtt

SEQ ID NO: 6098228 - DNA, 16 bp, Homo sapiens
cgacaaaatctcctgg

SEQ ID NO: 6098229 - DNA, 18 bp, Homo sapiens
cgacaaaggccacaggca

SEQ ID NO: 6098230 - DNA, 16 bp, Homo sapiens
cgacaacatttctgcc

SEQ ID NO: 6098231 - DNA, 15 bp, Homo sapiens
cgacaaccgatgctc

SEQ ID NO: 6098232 - DNA, 18 bp, Homo sapiens
cgacaaccgatgctccag

SEQ ID NO: 6098233 - DNA, 20 bp, Homo sapiens
cgacaagagtgagactccac

SEQ ID NO: 6098234 - DNA, 16 bp, Homo sapiens
cgacaagcacagtcag

SEQ ID NO: 6098235 - DNA, 12 bp, Homo sapiens
cgacaatgcaaa

SEQ ID NO: 6098236 - DNA, 22 bp, Homo sapiens
cgacaatgtcgagtatattatt

SEQ ID NO: 6098237 - DNA, 18 bp, Homo sapiens
cgacacacggggctcggg

SEQ ID NO: 6098238 - DNA, 19 bp, Homo sapiens
cgacacatttaccaaattg

SEQ ID NO: 6098239 - DNA, 17 bp, Homo sapiens
cgacaccactcctgcca

SEQ ID NO: 6098240 - DNA, 23 bp, Homo sapiens
cgacaccactcctgccagcccgg

SEQ ID NO: 6098241 - DNA, 23 bp, Homo sapiens
cgacaccactgggaaccaagggc

SEQ ID NO: 6098242 - DNA, 12 bp, Homo sapiens
cgacaccagaag

SEQ ID NO: 6098243 - DNA, 14 bp, Homo sapiens
cgacactcagggca

SEQ ID NO: 6098244 - DNA, 21 bp, Homo sapiens
cgacactgagctgtgacccag

SEQ ID NO: 6098245 - DNA, 21 bp, Homo sapiens
cgacactgcagccccacccag

SEQ ID NO: 6098246 - DNA, 21 bp, Homo sapiens
cgacactgctgcaccagagtg

SEQ ID NO: 6098247 - DNA, 22 bp, Homo sapiens
cgacagacatggacaaggagct

SEQ ID NO: 6098248 - DNA, 12 bp, Homo sapiens
cgacagagagat

SEQ ID NO: 6098249 - DNA, 11 bp, Homo sapiens
cgacagagcaa

SEQ ID NO: 6098250 - DNA, 14 bp, Homo sapiens
cgacagcattttaa

SEQ ID NO: 6098251 - DNA, 16 bp, Homo sapiens
cgacagcattttcctc

SEQ ID NO: 6098252 - DNA, 13 bp, Homo sapiens
cgacagcctggca

SEQ ID NO: 6098253 - DNA, 16 bp, Homo sapiens
cgacagcgcccctgct

SEQ ID NO: 6098254 - DNA, 19 bp, Homo sapiens
cgacagcgcccctgctgtc

SEQ ID NO: 6098255 - DNA, 15 bp, Homo sapiens
cgacagcggccttga

SEQ ID NO: 6098256 - DNA, 23 bp, Homo sapiens
cctccacctctcacgggccctgc

SEQ ID NO: 6098257 - DNA, 12 bp, Homo sapiens
cctccacctctg

SEQ ID NO: 6098258 - DNA, 22 bp, Homo sapiens
cctccacctctgtgcagggcac

SEQ ID NO: 6098259 - DNA, 16 bp, Homo sapiens
cctccacctgggagat

SEQ ID NO: 6098260 - DNA, 22 bp, Homo sapiens
cctccacctgggagatgctggg

SEQ ID NO: 6098261 - DNA, 14 bp, Homo sapiens
cctccacctgtgag

SEQ ID NO: 6098262 - DNA, 15 bp, Homo sapiens
cctccaccttccagg

SEQ ID NO: 6098263 - DNA, 21 bp, Homo sapiens
cctccaccttgagcactattc

SEQ ID NO: 6098264 - DNA, 17 bp, Homo sapiens
cctccaccttgctcttc

SEQ ID NO: 6098265 - DNA, 17 bp, Homo sapiens
cctccacgccactgcct

SEQ ID NO: 6098266 - DNA, 18 bp, Homo sapiens
cctccacgccactgcctc

SEQ ID NO: 6098267 - DNA, 17 bp, Homo sapiens
cctccacgcctcctggc

SEQ ID NO: 6098268 - DNA, 20 bp, Homo sapiens
cctccacggtccgcggcctg

SEQ ID NO: 6098269 - DNA, 23 bp, Homo sapiens
cctccacgtgtccgtccaccctt

SEQ ID NO: 6098270 - DNA, 17 bp, Homo sapiens
cctccacgttcacccct

SEQ ID NO: 6098271 - DNA, 17 bp, Homo sapiens
cctccacgttctgctca

SEQ ID NO: 6098272 - DNA, 16 bp, Homo sapiens
cctccactcactccag

SEQ ID NO: 6098273 - DNA, 21 bp, Homo sapiens
cctccactcactccagcccaa

SEQ ID NO: 6098274 - DNA, 15 bp, Homo sapiens
cctccactcagcact

SEQ ID NO: 6098275 - DNA, 13 bp, Homo sapiens
cctccactcccac

SEQ ID NO: 6098276 - DNA, 20 bp, Homo sapiens
cctccactcccccacctgac

SEQ ID NO: 6098277 - DNA, 12 bp, Homo sapiens
cctccactcctc

SEQ ID NO: 6098278 - DNA, 15 bp, Homo sapiens
cctccactccttcca

SEQ ID NO: 6098279 - DNA, 20 bp, Homo sapiens
cctccactctagttctagat

SEQ ID NO: 6098280 - DNA, 14 bp, Homo sapiens
cctccactctcccc

SEQ ID NO: 6098281 - DNA, 13 bp, Homo sapiens
cctccactctcct

SEQ ID NO: 6098282 - DNA, 21 bp, Homo sapiens
cctccactctgtatctatgca

SEQ ID NO: 6098283 - DNA, 15 bp, Homo sapiens
cctccactctttctt

SEQ ID NO: 6098284 - DNA, 12 bp, Homo sapiens
cctccactgtca

SEQ ID NO: 6098285 - DNA, 12 bp, Homo sapiens
cctccactgtgt

SEQ ID NO: 6098286 - DNA, 23 bp, Homo sapiens
cctccacttccccacacttccca

SEQ ID NO: 6098287 - DNA, 21 bp, Homo sapiens
cctccagaactcactggggcc

SEQ ID NO: 6098288 - DNA, 18 bp, Homo sapiens
cctccagaactcttcctc

SEQ ID NO: 6098289 - DNA, 12 bp, Homo sapiens
cctccagaagcc

SEQ ID NO: 6098290 - DNA, 18 bp, Homo sapiens
cctccagaagcctctggc

SEQ ID NO: 6098291 - DNA, 22 bp, Homo sapiens
cctccagaagcctctggctaga

SEQ ID NO: 6098292 - DNA, 15 bp, Homo sapiens
cctccagaagctgct

SEQ ID NO: 6098293 - DNA, 24 bp, Homo sapiens
cctccagacacccagaatgtagca

SEQ ID NO: 6098294 - DNA, 17 bp, Homo sapiens
cctccagacagatacag

SEQ ID NO: 6098295 - DNA, 22 bp, Homo sapiens
cctccagacagatacagcccca

SEQ ID NO: 6098296 - DNA, 10 bp, Homo sapiens
cctccagacc

SEQ ID NO: 6098297 - DNA, 17 bp, Homo sapiens
cctccagacccctaccc

SEQ ID NO: 6098298 - DNA, 10 bp, Homo sapiens
cctccagact

SEQ ID NO: 6098299 - DNA, 12 bp, Homo sapiens
cctccagactca

SEQ ID NO: 6098300 - DNA, 21 bp, Homo sapiens
cctccagactcgagagggctg

SEQ ID NO: 6098301 - DNA, 13 bp, Homo sapiens
cctccagactgcg

SEQ ID NO: 6098302 - DNA, 19 bp, Homo sapiens
cctccagagaaacccaggg

SEQ ID NO: 6098303 - DNA, 20 bp, Homo sapiens
cctccagagaaacccaggga

SEQ ID NO: 6098304 - DNA, 14 bp, Homo sapiens
cctccagagaaagc

SEQ ID NO: 6098305 - DNA, 15 bp, Homo sapiens
cctccagagaagccc

SEQ ID NO: 6098306 - DNA, 16 bp, Homo sapiens
cctccagagacaggaa

SEQ ID NO: 6098307 - DNA, 16 bp, Homo sapiens
cctccagagccagcct

SEQ ID NO: 6098308 - DNA, 18 bp, Homo sapiens
cctccagagccagcctgg

SEQ ID NO: 6098309 - DNA, 19 bp, Homo sapiens
cctccagagccagcctggg

SEQ ID NO: 6098310 - DNA, 13 bp, Homo sapiens
cctccagagcccc

SEQ ID NO: 6098311 - DNA, 15 bp, Homo sapiens
cctccagagccccac

SEQ ID NO: 6098312 - DNA, 18 bp, Homo sapiens
cctccagagccccacagc

SEQ ID NO: 6098313 - DNA, 19 bp, Homo sapiens
cctccagagccccacagcc

SEQ ID NO: 6098314 - DNA, 17 bp, Homo sapiens
cctccagagcctgggcg

SEQ ID NO: 6098315 - DNA, 22 bp, Homo sapiens
cctccagagctgcggtgtctcc

SEQ ID NO: 6098316 - DNA, 12 bp, Homo sapiens
cctccagaggag

SEQ ID NO: 6098317 - DNA, 16 bp, Homo sapiens
cctccagaggtcctcc

SEQ ID NO: 6098318 - DNA, 20 bp, Homo sapiens
cctccagattattttctata

SEQ ID NO: 6098319 - DNA, 17 bp, Homo sapiens
cctccagcacaaacaca

SEQ ID NO: 6098320 - DNA, 16 bp, Homo sapiens
cctccagcatcttttc

SEQ ID NO: 6098321 - DNA, 20 bp, Homo sapiens
cctccagccaaacgggagct

SEQ ID NO: 6098322 - DNA, 13 bp, Homo sapiens
cctccagccaaga

SEQ ID NO: 6098323 - DNA, 21 bp, Homo sapiens
cctccagcccacagtgctcag

SEQ ID NO: 6098324 - DNA, 14 bp, Homo sapiens
cctccagccccatg

SEQ ID NO: 6098325 - DNA, 12 bp, Homo sapiens
cctccagcccgg

SEQ ID NO: 6098326 - DNA, 22 bp, Homo sapiens
cctccagccctctcactgtgtc

SEQ ID NO: 6098327 - DNA, 18 bp, Homo sapiens
cctccagccctgcccacc

SEQ ID NO: 6098328 - DNA, 16 bp, Homo sapiens
cctccagccctgggca

SEQ ID NO: 6098329 - DNA, 13 bp, Homo sapiens
cctccagcccttc

SEQ ID NO: 6098330 - DNA, 23 bp, Homo sapiens
cctccagccgccggctgtgcagt

SEQ ID NO: 6098331 - DNA, 11 bp, Homo sapiens
cctccagcctc

SEQ ID NO: 6098332 - DNA, 18 bp, Homo sapiens
cctccagcctcccctccc

SEQ ID NO: 6098333 - DNA, 22 bp, Homo sapiens
cctccagcctcccctcccctgg

SEQ ID NO: 6098334 - DNA, 17 bp, Homo sapiens
cctccagcctccctgtc

SEQ ID NO: 6098335 - DNA, 23 bp, Homo sapiens
cctccagcctccctgtctccagc

SEQ ID NO: 6098336 - DNA, 12 bp, Homo sapiens
cctccagcctcg

SEQ ID NO: 6098337 - DNA, 13 bp, Homo sapiens
cctccagcctctc

SEQ ID NO: 6098338 - DNA, 21 bp, Homo sapiens
cctccagcctgcccaagccca

SEQ ID NO: 6098339 - DNA, 12 bp, Homo sapiens
cctccagcctgg

SEQ ID NO: 6098340 - DNA, 22 bp, Homo sapiens
cctccagcctttggccttggct

SEQ ID NO: 6098341 - DNA, 12 bp, Homo sapiens
cctccagctcct

SEQ ID NO: 6098342 - DNA, 13 bp, Homo sapiens
cctccagctcctg

SEQ ID NO: 6098343 - DNA, 14 bp, Homo sapiens
cctccagctgcacc

SEQ ID NO: 6098344 - DNA, 15 bp, Homo sapiens
cctccagctgcacca

SEQ ID NO: 6098345 - DNA, 20 bp, Homo sapiens
cctccagctgcaccagagca

SEQ ID NO: 6098346 - DNA, 19 bp, Homo sapiens
cctccagctgcgactttta

SEQ ID NO: 6098347 - DNA, 23 bp, Homo sapiens
cctccagctggaattgctgctct

SEQ ID NO: 6098348 - DNA, 14 bp, Homo sapiens
cctccagctgggat

SEQ ID NO: 6098349 - DNA, 17 bp, Homo sapiens
cctccagctgtcagcct

SEQ ID NO: 6098350 - DNA, 20 bp, Homo sapiens
cctccagcttcaggcaggcc

SEQ ID NO: 6098351 - DNA, 21 bp, Homo sapiens
cctccagcttgtggagcccca

SEQ ID NO: 6098352 - DNA, 15 bp, Homo sapiens
cctccagcttttgaa

SEQ ID NO: 6098353 - DNA, 20 bp, Homo sapiens
cctccaggaagaagcagggg

SEQ ID NO: 6098354 - DNA, 12 bp, Homo sapiens
cctccaggacca

SEQ ID NO: 6098355 - DNA, 13 bp, Homo sapiens
cctccaggaccag

SEQ ID NO: 6098356 - DNA, 15 bp, Homo sapiens
cctccaggaccttgc

SEQ ID NO: 6098357 - DNA, 20 bp, Homo sapiens
cctccaggaccttgcttcct

SEQ ID NO: 6098358 - DNA, 22 bp, Homo sapiens
cctccaggagaaggggcccaag

SEQ ID NO: 6098359 - DNA, 13 bp, Homo sapiens
cctccaggagcct

SEQ ID NO: 6098360 - DNA, 15 bp, Homo sapiens
cctccaggagcctac

SEQ ID NO: 6098361 - DNA, 11 bp, Homo sapiens
cctccaggagg

SEQ ID NO: 6098362 - DNA, 20 bp, Homo sapiens
cctccaggaggactgttcta

SEQ ID NO: 6098363 - DNA, 22 bp, Homo sapiens
cctccaggaggactgttctaac

SEQ ID NO: 6098364 - DNA, 21 bp, Homo sapiens
cctccaggagggaccaccctc

SEQ ID NO: 6098365 - DNA, 22 bp, Homo sapiens
cctccaggagggaccaccctcc

SEQ ID NO: 6098366 - DNA, 21 bp, Homo sapiens
cctccaggaggggcctgggca

SEQ ID NO: 6098367 - DNA, 22 bp, Homo sapiens
cctccaggaggggcctgggcag

SEQ ID NO: 6098368 - DNA, 16 bp, Homo sapiens
cctccaggcctgcctc

SEQ ID NO: 6098369 - DNA, 19 bp, Homo sapiens
cctccaggcctgcctccca

SEQ ID NO: 6098370 - DNA, 17 bp, Homo sapiens
cctccaggcctgttgct

SEQ ID NO: 6098371 - DNA, 16 bp, Homo sapiens
cctccaggctggggcc

SEQ ID NO: 6098372 - DNA, 18 bp, Homo sapiens
cctccagggaaggtggcc

SEQ ID NO: 6098373 - DNA, 21 bp, Homo sapiens
cctccagggaatccgcctgca

SEQ ID NO: 6098374 - DNA, 15 bp, Homo sapiens
cctccagggacagca

SEQ ID NO: 6098375 - DNA, 12 bp, Homo sapiens
cctccagggcat

SEQ ID NO: 6098376 - DNA, 15 bp, Homo sapiens
cctccagggcattgc

SEQ ID NO: 6098377 - DNA, 14 bp, Homo sapiens
cctccagggccacg

SEQ ID NO: 6098378 - DNA, 19 bp, Homo sapiens
cctccagggccacgtgcca

SEQ ID NO: 6098379 - DNA, 13 bp, Homo sapiens
cctccagggccag

SEQ ID NO: 6098380 - DNA, 22 bp, Homo sapiens
cctccagggctcaacactgtga

SEQ ID NO: 6098381 - DNA, 17 bp, Homo sapiens
cctccagggctggactg

SEQ ID NO: 6098382 - DNA, 23 bp, Homo sapiens
cctccagggctggactgaggcct

SEQ ID NO: 6098383 - DNA, 16 bp, Homo sapiens
cctccaggggctcctg

SEQ ID NO: 6098384 - DNA, 18 bp, Homo sapiens
cctccagggggcctgcag

SEQ ID NO: 6098385 - DNA, 21 bp, Homo sapiens
cctccagggggcctgcaggcc

SEQ ID NO: 6098386 - DNA, 22 bp, Homo sapiens
cctccagggggcctgcaggccc

SEQ ID NO: 6098387 - DNA, 23 bp, Homo sapiens
cctccagggggcctgcaggcccc

SEQ ID NO: 6098388 - DNA, 22 bp, Homo sapiens
cctccagggtctaaagagaaca

SEQ ID NO: 6098389 - DNA, 17 bp, Homo sapiens
cctccagggtgtgtgct

SEQ ID NO: 6098390 - DNA, 23 bp, Homo sapiens
cctccaggtcggagtgcctggag

SEQ ID NO: 6098391 - DNA, 12 bp, Homo sapiens
cctccaggtgca

SEQ ID NO: 6098392 - DNA, 19 bp, Homo sapiens
cctccaggtgcacaagctc

SEQ ID NO: 6098393 - DNA, 15 bp, Homo sapiens
cctccaggtgcagag

SEQ ID NO: 6098394 - DNA, 18 bp, Homo sapiens
cctccaggtgcagaggta

SEQ ID NO: 6098395 - DNA, 14 bp, Homo sapiens
cctccaggtgtgca

SEQ ID NO: 6098396 - DNA, 18 bp, Homo sapiens
cctccaggtgttgttgag

SEQ ID NO: 6098397 - DNA, 14 bp, Homo sapiens
cctccaggttcctc

SEQ ID NO: 6098398 - DNA, 12 bp, Homo sapiens
cctccaggtttt

SEQ ID NO: 6098399 - DNA, 16 bp, Homo sapiens
cctccaggtttttcaa

SEQ ID NO: 6098400 - DNA, 17 bp, Homo sapiens
cctccaggtttttcaat

SEQ ID NO: 6098401 - DNA, 20 bp, Homo sapiens
cctccagtaccttctgccag

SEQ ID NO: 6098402 - DNA, 17 bp, Homo sapiens
cctccagtaccttgctt

SEQ ID NO: 6098403 - DNA, 22 bp, Homo sapiens
cctccagtacgtcccgctgctg

SEQ ID NO: 6098404 - DNA, 16 bp, Homo sapiens
cctccagtcacactcc

SEQ ID NO: 6098405 - DNA, 14 bp, Homo sapiens
cctccagtccccct

SEQ ID NO: 6098406 - DNA, 18 bp, Homo sapiens
cctccagtcctgctggcc

SEQ ID NO: 6098407 - DNA, 23 bp, Homo sapiens
cctccagtcctgctggcctgctc

SEQ ID NO: 6098408 - DNA, 18 bp, Homo sapiens
cctccagtcgttatttct

SEQ ID NO: 6098409 - DNA, 16 bp, Homo sapiens
cctccagtctgctctc

SEQ ID NO: 6098410 - DNA, 17 bp, Homo sapiens
cctccagtctgctctca

SEQ ID NO: 6098411 - DNA, 20 bp, Homo sapiens
cctccagtctgctctcagct

SEQ ID NO: 6098412 - DNA, 21 bp, Homo sapiens
cctccagtctgctctcagctt

SEQ ID NO: 6098413 - DNA, 15 bp, Homo sapiens
cctccagtctgttct

SEQ ID NO: 6098414 - DNA, 19 bp, Homo sapiens
cctccagtctgttctcaca

SEQ ID NO: 6098415 - DNA, 20 bp, Homo sapiens
cctccagtctgttctcacat

SEQ ID NO: 6098416 - DNA, 18 bp, Homo sapiens
cctccagtgagtacctgc

SEQ ID NO: 6098417 - DNA, 24 bp, Homo sapiens
cctccagtgagtacctgcaaaaat

SEQ ID NO: 6098418 - DNA, 12 bp, Homo sapiens
cctccagtgctg

SEQ ID NO: 6098419 - DNA, 16 bp, Homo sapiens
cctccagtgctggatt

SEQ ID NO: 6098420 - DNA, 21 bp, Homo sapiens
cctccagtgctggctgctggc

SEQ ID NO: 6098421 - DNA, 21 bp, Homo sapiens
cctccagtgcttggctgcccc

SEQ ID NO: 6098422 - DNA, 20 bp, Homo sapiens
cctccagtgggctgatgctg

SEQ ID NO: 6098423 - DNA, 16 bp, Homo sapiens
cctccagtgtgggctt

SEQ ID NO: 6098424 - DNA, 17 bp, Homo sapiens
cctccagttttgcctga

SEQ ID NO: 6098425 - DNA, 20 bp, Homo sapiens
cctccataagtttaacttta

SEQ ID NO: 6098426 - DNA, 15 bp, Homo sapiens
cctccatagcgacac

SEQ ID NO: 6098427 - DNA, 22 bp, Homo sapiens
cctccatcacctgaaacactgg

SEQ ID NO: 6098428 - DNA, 18 bp, Homo sapiens
cctccatccacacacagc

SEQ ID NO: 6098429 - DNA, 22 bp, Homo sapiens
cctccatccacacacagcagct

SEQ ID NO: 6098430 - DNA, 16 bp, Homo sapiens
cctccatccatccttc

SEQ ID NO: 6098431 - DNA, 17 bp, Homo sapiens
cctccatccatccttcc

SEQ ID NO: 6098432 - DNA, 20 bp, Homo sapiens
cctccatccatctgtccgtc

SEQ ID NO: 6098433 - DNA, 19 bp, Homo sapiens
cctccatccatgtgttcca

SEQ ID NO: 6098434 - DNA, 16 bp, Homo sapiens
cgacagctgggctgga

SEQ ID NO: 6098435 - DNA, 21 bp, Homo sapiens
cgacaggcgagagaggagcca

SEQ ID NO: 6098436 - DNA, 16 bp, Homo sapiens
cgacagggcctggagc

SEQ ID NO: 6098437 - DNA, 13 bp, Homo sapiens
cgacagtcccagt

SEQ ID NO: 6098438 - DNA, 16 bp, Homo sapiens
cgacagtgagactctg

SEQ ID NO: 6098439 - DNA, 15 bp, Homo sapiens
cgacagtggctctcc

SEQ ID NO: 6098440 - DNA, 16 bp, Homo sapiens
cgacagtggctctcca

SEQ ID NO: 6098441 - DNA, 15 bp, Homo sapiens
cgacagttctgaact

SEQ ID NO: 6098442 - DNA, 13 bp, Homo sapiens
cgacataccccac

SEQ ID NO: 6098443 - DNA, 14 bp, Homo sapiens
cgacatactcattt

SEQ ID NO: 6098444 - DNA, 22 bp, Homo sapiens
cgacatagcccatccctgcctg

SEQ ID NO: 6098445 - DNA, 18 bp, Homo sapiens
cgacatagtatggaagta

SEQ ID NO: 6098446 - DNA, 23 bp, Homo sapiens
cgacatcagcccggtgtgaggag

SEQ ID NO: 6098447 - DNA, 23 bp, Homo sapiens
cgacatccgtcattgctgctgct

SEQ ID NO: 6098448 - DNA, 17 bp, Homo sapiens
cgacatcctagccccac

SEQ ID NO: 6098449 - DNA, 20 bp, Homo sapiens
cgacatcctagccccaccca

SEQ ID NO: 6098450 - DNA, 13 bp, Homo sapiens
cgacatgctgcca

SEQ ID NO: 6098451 - DNA, 16 bp, Homo sapiens
cgacatgctgccagga

SEQ ID NO: 6098452 - DNA, 13 bp, Homo sapiens
cgacattgtctcc

SEQ ID NO: 6098453 - DNA, 14 bp, Homo sapiens
cgacattgtctccc

SEQ ID NO: 6098454 - DNA, 16 bp, Homo sapiens
cgaccaactccagact

SEQ ID NO: 6098455 - DNA, 14 bp, Homo sapiens
cgaccaactgccct

SEQ ID NO: 6098456 - DNA, 15 bp, Homo sapiens
cgaccaactgcccta

SEQ ID NO: 6098457 - DNA, 11 bp, Homo sapiens
cgaccaaggat

SEQ ID NO: 6098458 - DNA, 18 bp, Homo sapiens
cgaccaatccccagccta

SEQ ID NO: 6098459 - DNA, 23 bp, Homo sapiens
cgaccacccccgatgggatggct

SEQ ID NO: 6098460 - DNA, 11 bp, Homo sapiens
cgaccacccct

SEQ ID NO: 6098461 - DNA, 15 bp, Homo sapiens
cgaccacccctgcct

SEQ ID NO: 6098462 - DNA, 21 bp, Homo sapiens
cgaccacccctgcctccaccc

SEQ ID NO: 6098463 - DNA, 16 bp, Homo sapiens
cgaccacccctgtgcg

SEQ ID NO: 6098464 - DNA, 15 bp, Homo sapiens
cgaccagagccccac

SEQ ID NO: 6098465 - DNA, 16 bp, Homo sapiens
cgaccagaggagcctt

SEQ ID NO: 6098466 - DNA, 14 bp, Homo sapiens
cgaccagaggtggg

SEQ ID NO: 6098467 - DNA, 16 bp, Homo sapiens
cgaccagcaggctcct

SEQ ID NO: 6098468 - DNA, 21 bp, Homo sapiens
cgaccagcaggctcctcagcc

SEQ ID NO: 6098469 - DNA, 18 bp, Homo sapiens
cgaccaggctggacaccc

SEQ ID NO: 6098470 - DNA, 23 bp, Homo sapiens
cgaccaggctggacaccctctgc

SEQ ID NO: 6098471 - DNA, 19 bp, Homo sapiens
cgaccatcgtccagccctc

SEQ ID NO: 6098472 - DNA, 15 bp, Homo sapiens
cgaccatgtgtagat

SEQ ID NO: 6098473 - DNA, 13 bp, Homo sapiens
cgacccacgcaga

SEQ ID NO: 6098474 - DNA, 20 bp, Homo sapiens
cgacccagaatggagcctgc

SEQ ID NO: 6098475 - DNA, 18 bp, Homo sapiens
cgacccagccagctgcag

SEQ ID NO: 6098476 - DNA, 22 bp, Homo sapiens
cgaccccaaaggaacactgaca

SEQ ID NO: 6098477 - DNA, 12 bp, Homo sapiens
cgaccccagact

SEQ ID NO: 6098478 - DNA, 16 bp, Homo sapiens
cgaccccagagtgact

SEQ ID NO: 6098479 - DNA, 15 bp, Homo sapiens
cgaccccatctgccc

SEQ ID NO: 6098480 - DNA, 17 bp, Homo sapiens
cgaccccatctgcccag

SEQ ID NO: 6098481 - DNA, 19 bp, Homo sapiens
cgaccccatctgcccagga

SEQ ID NO: 6098482 - DNA, 13 bp, Homo sapiens
cgacccccaaggg

SEQ ID NO: 6098483 - DNA, 20 bp, Homo sapiens
cgacccccaagggacccgca

SEQ ID NO: 6098484 - DNA, 17 bp, Homo sapiens
cgacccccgcagaggca

SEQ ID NO: 6098485 - DNA, 23 bp, Homo sapiens
cgaccccctctccctgcatggca

SEQ ID NO: 6098486 - DNA, 22 bp, Homo sapiens
cgacccctcctgcccctctctc

SEQ ID NO: 6098487 - DNA, 17 bp, Homo sapiens
cgacccctgcctcgagg

SEQ ID NO: 6098488 - DNA, 12 bp, Homo sapiens
cgacccctgtcc

SEQ ID NO: 6098489 - DNA, 15 bp, Homo sapiens
cgacccgaggcccag

SEQ ID NO: 6098490 - DNA, 16 bp, Homo sapiens
cgacccgaggcccaga

SEQ ID NO: 6098491 - DNA, 17 bp, Homo sapiens
cgacccggggcgggctg

SEQ ID NO: 6098492 - DNA, 21 bp, Homo sapiens
cgaccctcatggcccccaggg

SEQ ID NO: 6098493 - DNA, 14 bp, Homo sapiens
cgaccctccccggc

SEQ ID NO: 6098494 - DNA, 17 bp, Homo sapiens
cgaccctcctggccttc

SEQ ID NO: 6098495 - DNA, 21 bp, Homo sapiens
cgaccctctgggaacctccca

SEQ ID NO: 6098496 - DNA, 23 bp, Homo sapiens
cgaccctctgggaacctcccaga

SEQ ID NO: 6098497 - DNA, 19 bp, Homo sapiens
cgaccctggctctgccagc

SEQ ID NO: 6098498 - DNA, 12 bp, Homo sapiens
cgaccctggggc

SEQ ID NO: 6098499 - DNA, 13 bp, Homo sapiens
cgaccctggggcg

SEQ ID NO: 6098500 - DNA, 19 bp, Homo sapiens
cgaccctgggggcacagga

SEQ ID NO: 6098501 - DNA, 23 bp, Homo sapiens
cgaccctgggggcacaggaggca

SEQ ID NO: 6098502 - DNA, 12 bp, Homo sapiens
cgaccctgtccc

SEQ ID NO: 6098503 - DNA, 19 bp, Homo sapiens
cgacccttgccgtctacct

SEQ ID NO: 6098504 - DNA, 18 bp, Homo sapiens
cgacccttttgagcctag

SEQ ID NO: 6098505 - DNA, 15 bp, Homo sapiens
cgaccgaggctggag

SEQ ID NO: 6098506 - DNA, 15 bp, Homo sapiens
cgaccgcctgcttca

SEQ ID NO: 6098507 - DNA, 20 bp, Homo sapiens
cgacctaaacagctgcttta

SEQ ID NO: 6098508 - DNA, 18 bp, Homo sapiens
cgacctaccaccccactg

SEQ ID NO: 6098509 - DNA, 22 bp, Homo sapiens
cgacctacgttcctggccccct

SEQ ID NO: 6098510 - DNA, 14 bp, Homo sapiens
cgacctcagccttc

SEQ ID NO: 6098511 - DNA, 15 bp, Homo sapiens
cgacctccctggctt

SEQ ID NO: 6098512 - DNA, 20 bp, Homo sapiens
cgacctccctggcttgagtg

SEQ ID NO: 6098513 - DNA, 14 bp, Homo sapiens
cgacctcgtcctcc

SEQ ID NO: 6098514 - DNA, 19 bp, Homo sapiens
cgacctcgtcctccccctg

SEQ ID NO: 6098515 - DNA, 22 bp, Homo sapiens
cgacctcgtcctccccctgcca

SEQ ID NO: 6098516 - DNA, 14 bp, Homo sapiens
cgacctctctgcct

SEQ ID NO: 6098517 - DNA, 16 bp, Homo sapiens
cgacctctctgcctct

SEQ ID NO: 6098518 - DNA, 16 bp, Homo sapiens
cgacctcttagaaaat

SEQ ID NO: 6098519 - DNA, 23 bp, Homo sapiens
cgacctgatttacagtttcaaaa

SEQ ID NO: 6098520 - DNA, 11 bp, Homo sapiens
cgacctggctg

SEQ ID NO: 6098521 - DNA, 13 bp, Homo sapiens
cgacctggctgag

SEQ ID NO: 6098522 - DNA, 16 bp, Homo sapiens
cgacctggctgcccct

SEQ ID NO: 6098523 - DNA, 23 bp, Homo sapiens
cgacctggctgcccctcaccttg

SEQ ID NO: 6098524 - DNA, 15 bp, Homo sapiens
cgaccttcaccaagc

SEQ ID NO: 6098525 - DNA, 11 bp, Homo sapiens
cgaccttggcc

SEQ ID NO: 6098526 - DNA, 22 bp, Homo sapiens
cgacgacaaatcttttggcaga

SEQ ID NO: 6098527 - DNA, 16 bp, Homo sapiens
cgacgcgggcttctgg

SEQ ID NO: 6098528 - DNA, 18 bp, Homo sapiens
cgacgctctctctcggaa

SEQ ID NO: 6098529 - DNA, 13 bp, Homo sapiens
cgacgctgcagag

SEQ ID NO: 6098530 - DNA, 16 bp, Homo sapiens
cgacggacccctttca

SEQ ID NO: 6098531 - DNA, 13 bp, Homo sapiens
cgacggagccact

SEQ ID NO: 6098532 - DNA, 17 bp, Homo sapiens
cgacggcctccaggagg

SEQ ID NO: 6098533 - DNA, 14 bp, Homo sapiens
cgacggctgtgacg

SEQ ID NO: 6098534 - DNA, 19 bp, Homo sapiens
cgacgtttgcggcagtgtt

SEQ ID NO: 6098535 - DNA, 16 bp, Homo sapiens
cgactactgctcctgt

SEQ ID NO: 6098536 - DNA, 16 bp, Homo sapiens
cgactagacacacaaa

SEQ ID NO: 6098537 - DNA, 13 bp, Homo sapiens
cgactagcaggca

SEQ ID NO: 6098538 - DNA, 21 bp, Homo sapiens
cgactcacaccactagcctca

SEQ ID NO: 6098539 - DNA, 13 bp, Homo sapiens
cgactcagcacca

SEQ ID NO: 6098540 - DNA, 11 bp, Homo sapiens
cgactcaggat

SEQ ID NO: 6098541 - DNA, 12 bp, Homo sapiens
cgactccagcca

SEQ ID NO: 6098542 - DNA, 13 bp, Homo sapiens
cgactcccagctc

SEQ ID NO: 6098543 - DNA, 21 bp, Homo sapiens
cgactccctgagtctggacct

SEQ ID NO: 6098544 - DNA, 19 bp, Homo sapiens
cgactctaagctgtgtgca

SEQ ID NO: 6098545 - DNA, 20 bp, Homo sapiens
cgactctaagctgtgtgcag

SEQ ID NO: 6098546 - DNA, 20 bp, Homo sapiens
cgactctatagactctagga

SEQ ID NO: 6098547 - DNA, 14 bp, Homo sapiens
cgactctcctgcct

SEQ ID NO: 6098548 - DNA, 17 bp, Homo sapiens
cgactctcctgcctcag

SEQ ID NO: 6098549 - DNA, 12 bp, Homo sapiens
cgactctgcact

SEQ ID NO: 6098550 - DNA, 22 bp, Homo sapiens
cgactctgtgctggccagcgag

SEQ ID NO: 6098551 - DNA, 14 bp, Homo sapiens
cgactcttcctgca

SEQ ID NO: 6098552 - DNA, 19 bp, Homo sapiens
cgactctttctgagtgcct

SEQ ID NO: 6098553 - DNA, 22 bp, Homo sapiens
cgactctttctgagtgccttct

SEQ ID NO: 6098554 - DNA, 18 bp, Homo sapiens
cgactgaaaatattgttt

SEQ ID NO: 6098555 - DNA, 16 bp, Homo sapiens
cgactgaccctgagga

SEQ ID NO: 6098556 - DNA, 18 bp, Homo sapiens
cgactgaccctgaggagg

SEQ ID NO: 6098557 - DNA, 14 bp, Homo sapiens
cgactgcaacagga

SEQ ID NO: 6098558 - DNA, 11 bp, Homo sapiens
cgactgcccag

SEQ ID NO: 6098559 - DNA, 14 bp, Homo sapiens
cgactgcccagcca

SEQ ID NO: 6098560 - DNA, 17 bp, Homo sapiens
cgactgcccggcagggt

SEQ ID NO: 6098561 - DNA, 17 bp, Homo sapiens
cgactggatgctcgcca

SEQ ID NO: 6098562 - DNA, 15 bp, Homo sapiens
cgactggccagggcc

SEQ ID NO: 6098563 - DNA, 16 bp, Homo sapiens
cgactgggctgctggg

SEQ ID NO: 6098564 - DNA, 20 bp, Homo sapiens
cgactgggctgctggggcag

SEQ ID NO: 6098565 - DNA, 13 bp, Homo sapiens
cgactggtccagc

SEQ ID NO: 6098566 - DNA, 15 bp, Homo sapiens
cgactggtccagctc

SEQ ID NO: 6098567 - DNA, 19 bp, Homo sapiens
cgactgtgacctgtgggga

SEQ ID NO: 6098568 - DNA, 18 bp, Homo sapiens
cgacttcaatttcccacc

SEQ ID NO: 6098569 - DNA, 13 bp, Homo sapiens
cgacttcctctcc

SEQ ID NO: 6098570 - DNA, 22 bp, Homo sapiens
cgacttcctctccagccttctc

SEQ ID NO: 6098571 - DNA, 15 bp, Homo sapiens
cgacttcctgactct

SEQ ID NO: 6098572 - DNA, 22 bp, Homo sapiens
cgacttcttcggaggtggcagc

SEQ ID NO: 6098573 - DNA, 20 bp, Homo sapiens
cgacttgaccctttcctccc

SEQ ID NO: 6098574 - DNA, 17 bp, Homo sapiens
cgacttgcatacctgct

SEQ ID NO: 6098575 - DNA, 16 bp, Homo sapiens
cgacttgcatttttgc

SEQ ID NO: 6098576 - DNA, 18 bp, Homo sapiens
cgacttgtgcacaggcag

SEQ ID NO: 6098577 - DNA, 13 bp, Homo sapiens
cgactttctgcct

SEQ ID NO: 6098578 - DNA, 20 bp, Homo sapiens
cgactttctttaacatatca

SEQ ID NO: 6098579 - DNA, 18 bp, Homo sapiens
cgactttgagctggaaag

SEQ ID NO: 6098580 - DNA, 23 bp, Homo sapiens
cgactttgtaccccccaacccct

SEQ ID NO: 6098581 - DNA, 22 bp, Homo sapiens
cgacttttttgagacatgggat

SEQ ID NO: 6098582 - DNA, 19 bp, Homo sapiens
cgagaaagaggcaccagga

SEQ ID NO: 6098583 - DNA, 20 bp, Homo sapiens
cgagaaataaagtttgctta

SEQ ID NO: 6098584 - DNA, 14 bp, Homo sapiens
cgagaaccctgagc

SEQ ID NO: 6098585 - DNA, 22 bp, Homo sapiens
cgagaaccctgagcagggtcca

SEQ ID NO: 6098586 - DNA, 15 bp, Homo sapiens
cgagaagcaagaaag

SEQ ID NO: 6098587 - DNA, 16 bp, Homo sapiens
cgagaagctgctctgg

SEQ ID NO: 6098588 - DNA, 24 bp, Homo sapiens
cgagaagggtggatgacagggcag

SEQ ID NO: 6098589 - DNA, 13 bp, Homo sapiens
cgagaagtgccct

SEQ ID NO: 6098590 - DNA, 20 bp, Homo sapiens
cgagaatgaacatatttgat

SEQ ID NO: 6098591 - DNA, 13 bp, Homo sapiens
cgagacaccctaa

SEQ ID NO: 6098592 - DNA, 14 bp, Homo sapiens
cgagacacttgcct

SEQ ID NO: 6098593 - DNA, 14 bp, Homo sapiens
cgagacagtccagt

SEQ ID NO: 6098594 - DNA, 14 bp, Homo sapiens
cgagaccagcctcg

SEQ ID NO: 6098595 - DNA, 13 bp, Homo sapiens
cgagaccagcctg

SEQ ID NO: 6098596 - DNA, 16 bp, Homo sapiens
cgagaccagcctggcc

SEQ ID NO: 6098597 - DNA, 15 bp, Homo sapiens
cgagaccatcctggc

SEQ ID NO: 6098598 - DNA, 16 bp, Homo sapiens
cgagaccatcctggcc

SEQ ID NO: 6098599 - DNA, 17 bp, Homo sapiens
cgagaccatcctggcca

SEQ ID NO: 6098600 - DNA, 19 bp, Homo sapiens
cgagaccatcctggcccct

SEQ ID NO: 6098601 - DNA, 21 bp, Homo sapiens
cgagaccatcctggcccctcc

SEQ ID NO: 6098602 - DNA, 19 bp, Homo sapiens
cgagacccaaggctcactg

SEQ ID NO: 6098603 - DNA, 24 bp, Homo sapiens
cgagacccaccatccttccatcct

SEQ ID NO: 6098604 - DNA, 20 bp, Homo sapiens
cgagacccaggagacaaaca

SEQ ID NO: 6098605 - DNA, 21 bp, Homo sapiens
cgagaccccatcttccagcca

SEQ ID NO: 6098606 - DNA, 17 bp, Homo sapiens
cgagacccccatccagc

SEQ ID NO: 6098607 - DNA, 18 bp, Homo sapiens
cgagacccccatccagcc

SEQ ID NO: 6098608 - DNA, 20 bp, Homo sapiens
cgagaccccggcttcctttc

SEQ ID NO: 6098609 - DNA, 22 bp, Homo sapiens
cgagaccgggccctgggttcct

SEQ ID NO: 6098610 - DNA, 21 bp, Homo sapiens
cgagacgcacacagctgagca

SEQ ID NO: 6098611 - DNA, 18 bp, Homo sapiens
cgagactgagaggcagaa

SEQ ID NO: 6098612 - DNA, 23 bp, Homo sapiens
cgagagaccctacagacagtatg

SEQ ID NO: 6098613 - DNA, 21 bp, Homo sapiens
cgagagacttgtggcctggga

SEQ ID NO: 6098614 - DNA, 20 bp, Homo sapiens
cctccatccccatcggccct

SEQ ID NO: 6098615 - DNA, 14 bp, Homo sapiens
cctccatcccgaca

SEQ ID NO: 6098616 - DNA, 13 bp, Homo sapiens
cctccatccctgc

SEQ ID NO: 6098617 - DNA, 14 bp, Homo sapiens
cctccatccctgct

SEQ ID NO: 6098618 - DNA, 15 bp, Homo sapiens
cctccatccctgctc

SEQ ID NO: 6098619 - DNA, 16 bp, Homo sapiens
cctccatcccttcccc

SEQ ID NO: 6098620 - DNA, 21 bp, Homo sapiens
cctccatcctatccactgggc

SEQ ID NO: 6098621 - DNA, 14 bp, Homo sapiens
cctccatcctcatc

SEQ ID NO: 6098622 - DNA, 12 bp, Homo sapiens
cctccatcctga

SEQ ID NO: 6098623 - DNA, 19 bp, Homo sapiens
cctccatctccaagaatgc

SEQ ID NO: 6098624 - DNA, 21 bp, Homo sapiens
cctccatctccaagaatgctg

SEQ ID NO: 6098625 - DNA, 15 bp, Homo sapiens
cctccatctggggat

SEQ ID NO: 6098626 - DNA, 21 bp, Homo sapiens
cctccatctgtacttggtcca

SEQ ID NO: 6098627 - DNA, 16 bp, Homo sapiens
cctccatctttctaca

SEQ ID NO: 6098628 - DNA, 18 bp, Homo sapiens
cctccatctttttcttgg

SEQ ID NO: 6098629 - DNA, 21 bp, Homo sapiens
cctccatgatgcaagccagct

SEQ ID NO: 6098630 - DNA, 17 bp, Homo sapiens
cctccatgattccaagg

SEQ ID NO: 6098631 - DNA, 22 bp, Homo sapiens
cctccatgattccaagggccca

SEQ ID NO: 6098632 - DNA, 11 bp, Homo sapiens
cctccatgccc

SEQ ID NO: 6098633 - DNA, 16 bp, Homo sapiens
cctccatgcctgacca

SEQ ID NO: 6098634 - DNA, 15 bp, Homo sapiens
cctccatgctgcctc

SEQ ID NO: 6098635 - DNA, 16 bp, Homo sapiens
cctccatgctgcctcc

SEQ ID NO: 6098636 - DNA, 18 bp, Homo sapiens
cctccatgctgtccctgt

SEQ ID NO: 6098637 - DNA, 22 bp, Homo sapiens
cctccatgctgtccctgtgggc

SEQ ID NO: 6098638 - DNA, 23 bp, Homo sapiens
cctccatgctgtccctgtgggct

SEQ ID NO: 6098639 - DNA, 19 bp, Homo sapiens
cctccatggcagcagccag

SEQ ID NO: 6098640 - DNA, 11 bp, Homo sapiens
cctccatggga

SEQ ID NO: 6098641 - DNA, 16 bp, Homo sapiens
cctccatggtcctgtc

SEQ ID NO: 6098642 - DNA, 17 bp, Homo sapiens
cctccatggtcctgtct

SEQ ID NO: 6098643 - DNA, 23 bp, Homo sapiens
cctccatggtcctgtctgtcctt

SEQ ID NO: 6098644 - DNA, 18 bp, Homo sapiens
cctccatggtgcctctgg

SEQ ID NO: 6098645 - DNA, 15 bp, Homo sapiens
cctccatggtgctgc

SEQ ID NO: 6098646 - DNA, 18 bp, Homo sapiens
cctccatggtggaagggg

SEQ ID NO: 6098647 - DNA, 21 bp, Homo sapiens
cctccatgtaccttgtgtact

SEQ ID NO: 6098648 - DNA, 14 bp, Homo sapiens
cctccatgtcatcc

SEQ ID NO: 6098649 - DNA, 15 bp, Homo sapiens
cctccatgtgagaat

SEQ ID NO: 6098650 - DNA, 14 bp, Homo sapiens
cctccatgtggccc

SEQ ID NO: 6098651 - DNA, 22 bp, Homo sapiens
cctccatgtggccccaggtgcc

SEQ ID NO: 6098652 - DNA, 16 bp, Homo sapiens
cctccattcatccttc

SEQ ID NO: 6098653 - DNA, 17 bp, Homo sapiens
cctccattcatccttcc

SEQ ID NO: 6098654 - DNA, 11 bp, Homo sapiens
cctccattccc

SEQ ID NO: 6098655 - DNA, 15 bp, Homo sapiens
cctccattcccaccc

SEQ ID NO: 6098656 - DNA, 18 bp, Homo sapiens
cctccattcccacccctc

SEQ ID NO: 6098657 - DNA, 13 bp, Homo sapiens
cctccattcctgc

SEQ ID NO: 6098658 - DNA, 15 bp, Homo sapiens
cctccattcctgctc

SEQ ID NO: 6098659 - DNA, 15 bp, Homo sapiens
cctccattctgacca

SEQ ID NO: 6098660 - DNA, 21 bp, Homo sapiens
cctccattggctcccaagtca

SEQ ID NO: 6098661 - DNA, 18 bp, Homo sapiens
cctccattgggcacagtc

SEQ ID NO: 6098662 - DNA, 20 bp, Homo sapiens
cctccattgggcacagtcca

SEQ ID NO: 6098663 - DNA, 20 bp, Homo sapiens
cctccatttcaactccagaa

SEQ ID NO: 6098664 - DNA, 14 bp, Homo sapiens
cctccatttctgtc

SEQ ID NO: 6098665 - DNA, 20 bp, Homo sapiens
cctcccaaagtgctgagatt

SEQ ID NO: 6098666 - DNA, 17 bp, Homo sapiens
cctcccaaagtgctggg

SEQ ID NO: 6098667 - DNA, 23 bp, Homo sapiens
cctcccaaagtgctgggattaca

SEQ ID NO: 6098668 - DNA, 23 bp, Homo sapiens
cctcccaaatatgcccctcccca

SEQ ID NO: 6098669 - DNA, 15 bp, Homo sapiens
cctcccaacagcgct

SEQ ID NO: 6098670 - DNA, 18 bp, Homo sapiens
cctcccaaccaaccagca

SEQ ID NO: 6098671 - DNA, 14 bp, Homo sapiens
cctcccaacccagc

SEQ ID NO: 6098672 - DNA, 21 bp, Homo sapiens
cctcccaacctcaatgccctg

SEQ ID NO: 6098673 - DNA, 15 bp, Homo sapiens
cctcccaactcaccc

SEQ ID NO: 6098674 - DNA, 17 bp, Homo sapiens
cctcccaactcacccca

SEQ ID NO: 6098675 - DNA, 16 bp, Homo sapiens
cctcccaactctggcc

SEQ ID NO: 6098676 - DNA, 15 bp, Homo sapiens
cctcccaagcagctg

SEQ ID NO: 6098677 - DNA, 20 bp, Homo sapiens
cctcccaagcagctgaaggg

SEQ ID NO: 6098678 - DNA, 18 bp, Homo sapiens
cctcccaagcgttcctgg

SEQ ID NO: 6098679 - DNA, 19 bp, Homo sapiens
cctcccaagcgttcctggc

SEQ ID NO: 6098680 - DNA, 12 bp, Homo sapiens
cctcccaagctg

SEQ ID NO: 6098681 - DNA, 13 bp, Homo sapiens
cctcccaagctgt

SEQ ID NO: 6098682 - DNA, 16 bp, Homo sapiens
cctcccaagctgtgct

SEQ ID NO: 6098683 - DNA, 18 bp, Homo sapiens
cctcccaagctgtgctgg

SEQ ID NO: 6098684 - DNA, 19 bp, Homo sapiens
cctcccaaggactttccag

SEQ ID NO: 6098685 - DNA, 15 bp, Homo sapiens
cctcccaaggagaac

SEQ ID NO: 6098686 - DNA, 21 bp, Homo sapiens
cctcccaaggagaacaaatat

SEQ ID NO: 6098687 - DNA, 15 bp, Homo sapiens
cctcccaaggagcca

SEQ ID NO: 6098688 - DNA, 19 bp, Homo sapiens
cctcccaaggtcctctcag

SEQ ID NO: 6098689 - DNA, 20 bp, Homo sapiens
cctcccaaggtcctctcagt

SEQ ID NO: 6098690 - DNA, 18 bp, Homo sapiens
cctcccaagtagctggga

SEQ ID NO: 6098691 - DNA, 15 bp, Homo sapiens
cctcccaagtcccac

SEQ ID NO: 6098692 - DNA, 17 bp, Homo sapiens
cctcccaagtggtgcct

SEQ ID NO: 6098693 - DNA, 16 bp, Homo sapiens
cctcccaataaagctg

SEQ ID NO: 6098694 - DNA, 17 bp, Homo sapiens
cctcccaatcctctctc

SEQ ID NO: 6098695 - DNA, 18 bp, Homo sapiens
cctcccaatcctctctcc

SEQ ID NO: 6098696 - DNA, 22 bp, Homo sapiens
cctcccacaatctgggactttc

SEQ ID NO: 6098697 - DNA, 11 bp, Homo sapiens
cctcccacact

SEQ ID NO: 6098698 - DNA, 14 bp, Homo sapiens
cctcccacacttcc

SEQ ID NO: 6098699 - DNA, 15 bp, Homo sapiens
cctcccacacttgct

SEQ ID NO: 6098700 - DNA, 12 bp, Homo sapiens
cctcccacagac

SEQ ID NO: 6098701 - DNA, 13 bp, Homo sapiens
cctcccacagacc

SEQ ID NO: 6098702 - DNA, 14 bp, Homo sapiens
cctcccacagacct

SEQ ID NO: 6098703 - DNA, 18 bp, Homo sapiens
cctcccacagacctgcag

SEQ ID NO: 6098704 - DNA, 19 bp, Homo sapiens
cctcccacagacctgcagt

SEQ ID NO: 6098705 - DNA, 12 bp, Homo sapiens
cctcccacagcc

SEQ ID NO: 6098706 - DNA, 16 bp, Homo sapiens
cctcccaccaccccat

SEQ ID NO: 6098707 - DNA, 15 bp, Homo sapiens
cctcccaccaccctc

SEQ ID NO: 6098708 - DNA, 21 bp, Homo sapiens
cctcccaccaccctcccacca

SEQ ID NO: 6098709 - DNA, 14 bp, Homo sapiens
cctcccaccagagc

SEQ ID NO: 6098710 - DNA, 21 bp, Homo sapiens
cctcccaccatgcgctgctca

SEQ ID NO: 6098711 - DNA, 21 bp, Homo sapiens
cctcccacccacagccataga

SEQ ID NO: 6098712 - DNA, 13 bp, Homo sapiens
cctcccacccacc

SEQ ID NO: 6098713 - DNA, 12 bp, Homo sapiens
cctcccacccca

SEQ ID NO: 6098714 - DNA, 16 bp, Homo sapiens
cctcccaccccactcc

SEQ ID NO: 6098715 - DNA, 19 bp, Homo sapiens
cctcccaccccactccagc

SEQ ID NO: 6098716 - DNA, 20 bp, Homo sapiens
cctcccaccccactccagcc

SEQ ID NO: 6098717 - DNA, 21 bp, Homo sapiens
cctcccaccccactccagccc

SEQ ID NO: 6098718 - DNA, 12 bp, Homo sapiens
cctcccacccga

SEQ ID NO: 6098719 - DNA, 10 bp, Homo sapiens
cctcccaccg

SEQ ID NO: 6098720 - DNA, 16 bp, Homo sapiens
cctcccaccgctgcct

SEQ ID NO: 6098721 - DNA, 12 bp, Homo sapiens
cctcccacctct

SEQ ID NO: 6098722 - DNA, 19 bp, Homo sapiens
cctcccacctctttcttca

SEQ ID NO: 6098723 - DNA, 19 bp, Homo sapiens
cctcccacgcctcaccagc

SEQ ID NO: 6098724 - DNA, 20 bp, Homo sapiens
cctcccacgctgggacacag

SEQ ID NO: 6098725 - DNA, 14 bp, Homo sapiens
cctcccacggcacc

SEQ ID NO: 6098726 - DNA, 19 bp, Homo sapiens
cctcccactcccatctcct

SEQ ID NO: 6098727 - DNA, 15 bp, Homo sapiens
cctcccactcccatg

SEQ ID NO: 6098728 - DNA, 18 bp, Homo sapiens
cctcccactcccatggct

SEQ ID NO: 6098729 - DNA, 21 bp, Homo sapiens
cctcccactcctgctgcacag

SEQ ID NO: 6098730 - DNA, 13 bp, Homo sapiens
cctcccactcttg

SEQ ID NO: 6098731 - DNA, 19 bp, Homo sapiens
cctcccactgcccactggc

SEQ ID NO: 6098732 - DNA, 16 bp, Homo sapiens
cctcccactgggactc

SEQ ID NO: 6098733 - DNA, 12 bp, Homo sapiens
cctcccactttg

SEQ ID NO: 6098734 - DNA, 22 bp, Homo sapiens
cctcccactttgtctgtacata

SEQ ID NO: 6098735 - DNA, 11 bp, Homo sapiens
cctcccagaaa

SEQ ID NO: 6098736 - DNA, 21 bp, Homo sapiens
cctcccagaaacatctctggc

SEQ ID NO: 6098737 - DNA, 18 bp, Homo sapiens
cctcccagaacacactcc

SEQ ID NO: 6098738 - DNA, 17 bp, Homo sapiens
cctcccagacaggccct

SEQ ID NO: 6098739 - DNA, 18 bp, Homo sapiens
cctcccagacaggccctc

SEQ ID NO: 6098740 - DNA, 23 bp, Homo sapiens
cctcccagacaggccctccctgt

SEQ ID NO: 6098741 - DNA, 21 bp, Homo sapiens
cctcccagaggagccaccagt

SEQ ID NO: 6098742 - DNA, 16 bp, Homo sapiens
cctcccagagtgctgg

SEQ ID NO: 6098743 - DNA, 12 bp, Homo sapiens
cctcccagatcc

SEQ ID NO: 6098744 - DNA, 21 bp, Homo sapiens
cctcccagatcggatctgttg

SEQ ID NO: 6098745 - DNA, 16 bp, Homo sapiens
cctcccagcacaggca

SEQ ID NO: 6098746 - DNA, 16 bp, Homo sapiens
cctcccagccccaggg

SEQ ID NO: 6098747 - DNA, 18 bp, Homo sapiens
cctcccagccctatggat

SEQ ID NO: 6098748 - DNA, 20 bp, Homo sapiens
cctcccagccctgccaggag

SEQ ID NO: 6098749 - DNA, 18 bp, Homo sapiens
cctcccagccctgcccag

SEQ ID NO: 6098750 - DNA, 19 bp, Homo sapiens
cctcccagccctgcccaga

SEQ ID NO: 6098751 - DNA, 12 bp, Homo sapiens
cctcccagcctg

SEQ ID NO: 6098752 - DNA, 16 bp, Homo sapiens
cctcccagctgcttta

SEQ ID NO: 6098753 - DNA, 20 bp, Homo sapiens
cctcccagctgtaccggcca

SEQ ID NO: 6098754 - DNA, 21 bp, Homo sapiens
cctcccagcttaaatcctagc

SEQ ID NO: 6098755 - DNA, 24 bp, Homo sapiens
cctcccagcttaaatcctagcagg

SEQ ID NO: 6098756 - DNA, 18 bp, Homo sapiens
cctcccaggaagcccagg

SEQ ID NO: 6098757 - DNA, 20 bp, Homo sapiens
cctcccaggaagcccaggag

SEQ ID NO: 6098758 - DNA, 21 bp, Homo sapiens
cctcccaggaagcccaggagc

SEQ ID NO: 6098759 - DNA, 22 bp, Homo sapiens
cctcccaggaccctccactcac

SEQ ID NO: 6098760 - DNA, 24 bp, Homo sapiens
cctcccaggaccctccactcactg

SEQ ID NO: 6098761 - DNA, 17 bp, Homo sapiens
cctcccaggactctgac

SEQ ID NO: 6098762 - DNA, 22 bp, Homo sapiens
cctcccaggactctgaccccag

SEQ ID NO: 6098763 - DNA, 12 bp, Homo sapiens
cctcccaggcaa

SEQ ID NO: 6098764 - DNA, 19 bp, Homo sapiens
cctcccaggcaagcagctg

SEQ ID NO: 6098765 - DNA, 12 bp, Homo sapiens
cctcccaggcca

SEQ ID NO: 6098766 - DNA, 11 bp, Homo sapiens
cctcccaggcg

SEQ ID NO: 6098767 - DNA, 18 bp, Homo sapiens
cctcccaggctcaagcta

SEQ ID NO: 6098768 - DNA, 20 bp, Homo sapiens
cctcccaggggagccagctg

SEQ ID NO: 6098769 - DNA, 19 bp, Homo sapiens
cctcccagggttttaactt

SEQ ID NO: 6098770 - DNA, 15 bp, Homo sapiens
cctcccaggtttctt

SEQ ID NO: 6098771 - DNA, 23 bp, Homo sapiens
cctcccaggtttcttctctggag

SEQ ID NO: 6098772 - DNA, 12 bp, Homo sapiens
cctcccagtctc

SEQ ID NO: 6098773 - DNA, 20 bp, Homo sapiens
cctcccagtctcatctcctg

SEQ ID NO: 6098774 - DNA, 21 bp, Homo sapiens
cctcccagtgagaagggcctg

SEQ ID NO: 6098775 - DNA, 23 bp, Homo sapiens
cctcccagtgagaagggcctgct

SEQ ID NO: 6098776 - DNA, 19 bp, Homo sapiens
cctcccagtgagactgccc

SEQ ID NO: 6098777 - DNA, 19 bp, Homo sapiens
cctcccagtgccttctggg

SEQ ID NO: 6098778 - DNA, 22 bp, Homo sapiens
cctcccagttctacaagcatat

SEQ ID NO: 6098779 - DNA, 22 bp, Homo sapiens
cctcccataattgctttgccaa

SEQ ID NO: 6098780 - DNA, 11 bp, Homo sapiens
cctcccatccc

SEQ ID NO: 6098781 - DNA, 12 bp, Homo sapiens
cctcccatcccc

SEQ ID NO: 6098782 - DNA, 15 bp, Homo sapiens
cctcccatcccctca

SEQ ID NO: 6098783 - DNA, 17 bp, Homo sapiens
cctcccatcccctcaac

SEQ ID NO: 6098784 - DNA, 13 bp, Homo sapiens
cctcccatctcac

SEQ ID NO: 6098785 - DNA, 21 bp, Homo sapiens
cctcccatctccttcccccag

SEQ ID NO: 6098786 - DNA, 23 bp, Homo sapiens
cctcccatctccttcccccagcc

SEQ ID NO: 6098787 - DNA, 21 bp, Homo sapiens
cctcccatgagactgccctgc

SEQ ID NO: 6098788 - DNA, 16 bp, Homo sapiens
cctcccatggcccagc

SEQ ID NO: 6098789 - DNA, 24 bp, Homo sapiens
cctcccatggcccagcagcttggc

SEQ ID NO: 6098790 - DNA, 18 bp, Homo sapiens
cctcccatgttcaagcga

SEQ ID NO: 6098791 - DNA, 19 bp, Homo sapiens
cctcccatgttgcatgcct

SEQ ID NO: 6098792 - DNA, 21 bp, Homo sapiens
cctcccattgcccagtgagcc

SEQ ID NO: 6098793 - DNA, 21 bp, Homo sapiens
cgagagagcacccctctctgc

SEQ ID NO: 6098794 - DNA, 17 bp, Homo sapiens
cgagagaggtgggcagc

SEQ ID NO: 6098795 - DNA, 18 bp, Homo sapiens
cgagagaggtgggcagca

SEQ ID NO: 6098796 - DNA, 14 bp, Homo sapiens
cgagagcagcctgg

SEQ ID NO: 6098797 - DNA, 15 bp, Homo sapiens
cgagagcagcctggc

SEQ ID NO: 6098798 - DNA, 14 bp, Homo sapiens
cgagagcagtgggc

SEQ ID NO: 6098799 - DNA, 16 bp, Homo sapiens
cgagagcagtgggcag

SEQ ID NO: 6098800 - DNA, 14 bp, Homo sapiens
cgagagcctcgctt

SEQ ID NO: 6098801 - DNA, 21 bp, Homo sapiens
cgagagcctgctcccccaccc

SEQ ID NO: 6098802 - DNA, 12 bp, Homo sapiens
cgagagcgcagc

SEQ ID NO: 6098803 - DNA, 22 bp, Homo sapiens
cgagaggccagttgatctgctc

SEQ ID NO: 6098804 - DNA, 23 bp, Homo sapiens
cgagaggctggtgtatgcactgc

SEQ ID NO: 6098805 - DNA, 14 bp, Homo sapiens
cgagagggagaccc

SEQ ID NO: 6098806 - DNA, 12 bp, Homo sapiens
cgagagggctga

SEQ ID NO: 6098807 - DNA, 15 bp, Homo sapiens
cgagagggctgagcc

SEQ ID NO: 6098808 - DNA, 15 bp, Homo sapiens
cgagaggtccctgct

SEQ ID NO: 6098809 - DNA, 18 bp, Homo sapiens
cgagaggtccctgcttac

SEQ ID NO: 6098810 - DNA, 18 bp, Homo sapiens
cgagaggtgagctacttt

SEQ ID NO: 6098811 - DNA, 19 bp, Homo sapiens
cgagagtcagactgataga

SEQ ID NO: 6098812 - DNA, 17 bp, Homo sapiens
cgagagtctggccctag

SEQ ID NO: 6098813 - DNA, 15 bp, Homo sapiens
cgagagtctgtctca

SEQ ID NO: 6098814 - DNA, 14 bp, Homo sapiens
cgagagtgtgctct

SEQ ID NO: 6098815 - DNA, 13 bp, Homo sapiens
cgagataccccac

SEQ ID NO: 6098816 - DNA, 15 bp, Homo sapiens
cgagataggggaggg

SEQ ID NO: 6098817 - DNA, 20 bp, Homo sapiens
cgagataggggaggggggag

SEQ ID NO: 6098818 - DNA, 21 bp, Homo sapiens
cgagatcacaccactgtactc

SEQ ID NO: 6098819 - DNA, 18 bp, Homo sapiens
cgagatcgctggcagaga

SEQ ID NO: 6098820 - DNA, 17 bp, Homo sapiens
cgagatcgggaagcaga

SEQ ID NO: 6098821 - DNA, 16 bp, Homo sapiens
cgagatcggggtagaa

SEQ ID NO: 6098822 - DNA, 14 bp, Homo sapiens
cgagatctcaggag

SEQ ID NO: 6098823 - DNA, 23 bp, Homo sapiens
cgagatgtgacccaccagtgcct

SEQ ID NO: 6098824 - DNA, 21 bp, Homo sapiens
cgagatgttcgctcgtgcagt

SEQ ID NO: 6098825 - DNA, 23 bp, Homo sapiens
cgagattatcgttttcttaaagt

SEQ ID NO: 6098826 - DNA, 13 bp, Homo sapiens
cgagattcagact

SEQ ID NO: 6098827 - DNA, 16 bp, Homo sapiens
cgagattgcaccactg

SEQ ID NO: 6098828 - DNA, 19 bp, Homo sapiens
cgagattgcaccactgcac

SEQ ID NO: 6098829 - DNA, 22 bp, Homo sapiens
cgagatttcttttttatgtgat

SEQ ID NO: 6098830 - DNA, 23 bp, Homo sapiens
cgagcaaatcctggcaagtgacc

SEQ ID NO: 6098831 - DNA, 18 bp, Homo sapiens
cgagcaaccctctgaaga

SEQ ID NO: 6098832 - DNA, 20 bp, Homo sapiens
cgagcaaccctctgaagaag

SEQ ID NO: 6098833 - DNA, 14 bp, Homo sapiens
cgagcaagccggca

SEQ ID NO: 6098834 - DNA, 13 bp, Homo sapiens
cgagcaccctcat

SEQ ID NO: 6098835 - DNA, 16 bp, Homo sapiens
cgagcacggttgcctg

SEQ ID NO: 6098836 - DNA, 21 bp, Homo sapiens
cgagcacggttgcctgaggtc

SEQ ID NO: 6098837 - DNA, 14 bp, Homo sapiens
cgagcactggccag

SEQ ID NO: 6098838 - DNA, 19 bp, Homo sapiens
cgagcactggccagagagg

SEQ ID NO: 6098839 - DNA, 15 bp, Homo sapiens
cgagcagacacactg

SEQ ID NO: 6098840 - DNA, 16 bp, Homo sapiens
cgagcagagcgcagcc

SEQ ID NO: 6098841 - DNA, 15 bp, Homo sapiens
cgagcagcccagggc

SEQ ID NO: 6098842 - DNA, 13 bp, Homo sapiens
cgagcaggaggcc

SEQ ID NO: 6098843 - DNA, 18 bp, Homo sapiens
cgagcaggctactgtcag

SEQ ID NO: 6098844 - DNA, 17 bp, Homo sapiens
cgagcagtcctgcctca

SEQ ID NO: 6098845 - DNA, 23 bp, Homo sapiens
cgagcagtcctgcctcagcctcc

SEQ ID NO: 6098846 - DNA, 14 bp, Homo sapiens
cgagcatcccccaa

SEQ ID NO: 6098847 - DNA, 21 bp, Homo sapiens
cgagcatcccccaaagttcac

SEQ ID NO: 6098848 - DNA, 13 bp, Homo sapiens
cgagcatccccct

SEQ ID NO: 6098849 - DNA, 13 bp, Homo sapiens
cgagcatgcctgg

SEQ ID NO: 6098850 - DNA, 19 bp, Homo sapiens
cgagcatgcggagccagca

SEQ ID NO: 6098851 - DNA, 22 bp, Homo sapiens
cgagcatgggggctgccagcgt

SEQ ID NO: 6098852 - DNA, 15 bp, Homo sapiens
cgagcatgtcgtgga

SEQ ID NO: 6098853 - DNA, 14 bp, Homo sapiens
cgagccacaagctg

SEQ ID NO: 6098854 - DNA, 19 bp, Homo sapiens
cgagccacaagctgcactg

SEQ ID NO: 6098855 - DNA, 13 bp, Homo sapiens
cgagccacaggaa

SEQ ID NO: 6098856 - DNA, 16 bp, Homo sapiens
cgagccacaggaacgg

SEQ ID NO: 6098857 - DNA, 20 bp, Homo sapiens
cgagccacaggaacggccct

SEQ ID NO: 6098858 - DNA, 18 bp, Homo sapiens
cgagccaccatgcttgcc

SEQ ID NO: 6098859 - DNA, 22 bp, Homo sapiens
cgagccacgcagtgcctggagt

SEQ ID NO: 6098860 - DNA, 18 bp, Homo sapiens
cgagccagattaggcctg

SEQ ID NO: 6098861 - DNA, 20 bp, Homo sapiens
cgagccagattaggcctgga

SEQ ID NO: 6098862 - DNA, 21 bp, Homo sapiens
cgagccagattaggcctggag

SEQ ID NO: 6098863 - DNA, 18 bp, Homo sapiens
cgagccatagagcctgaa

SEQ ID NO: 6098864 - DNA, 18 bp, Homo sapiens
cgagccatgatgtggagt

SEQ ID NO: 6098865 - DNA, 22 bp, Homo sapiens
cgagccatttgtcccaagtgcc

SEQ ID NO: 6098866 - DNA, 14 bp, Homo sapiens
cgagccccctggat

SEQ ID NO: 6098867 - DNA, 16 bp, Homo sapiens
cgagccccctgtcctt

SEQ ID NO: 6098868 - DNA, 12 bp, Homo sapiens
cgagcccctcct

SEQ ID NO: 6098869 - DNA, 14 bp, Homo sapiens
cgagcccctccttc

SEQ ID NO: 6098870 - DNA, 15 bp, Homo sapiens
cgagcccctcggctc

SEQ ID NO: 6098871 - DNA, 21 bp, Homo sapiens
cgagcccctcggctctggagg

SEQ ID NO: 6098872 - DNA, 22 bp, Homo sapiens
cgagcccctcggctctggaggc

SEQ ID NO: 6098873 - DNA, 13 bp, Homo sapiens
cgagcccctgccc

SEQ ID NO: 6098874 - DNA, 20 bp, Homo sapiens
cgagcccctgcccacgccct

SEQ ID NO: 6098875 - DNA, 12 bp, Homo sapiens
cgagcccctgtt

SEQ ID NO: 6098876 - DNA, 22 bp, Homo sapiens
cgagcccctgtttctcctccat

SEQ ID NO: 6098877 - DNA, 17 bp, Homo sapiens
cgagccccttggggagc

SEQ ID NO: 6098878 - DNA, 17 bp, Homo sapiens
cgagccctcacaccctg

SEQ ID NO: 6098879 - DNA, 13 bp, Homo sapiens
cgagccctgactc

SEQ ID NO: 6098880 - DNA, 22 bp, Homo sapiens
cgagccctgactcctggactcc

SEQ ID NO: 6098881 - DNA, 19 bp, Homo sapiens
cgagccctggagagcccca

SEQ ID NO: 6098882 - DNA, 22 bp, Homo sapiens
cgagcccttgcccatgctgggc

SEQ ID NO: 6098883 - DNA, 16 bp, Homo sapiens
cgagccgagctctcct

SEQ ID NO: 6098884 - DNA, 20 bp, Homo sapiens
cgagccgagctctcctgggc

SEQ ID NO: 6098885 - DNA, 24 bp, Homo sapiens
cgagccgcctctggttccactcag

SEQ ID NO: 6098886 - DNA, 14 bp, Homo sapiens
cgagcctaatgaaa

SEQ ID NO: 6098887 - DNA, 15 bp, Homo sapiens
cgagcctaatgaaag

SEQ ID NO: 6098888 - DNA, 15 bp, Homo sapiens
cgagcctccagtcca

SEQ ID NO: 6098889 - DNA, 16 bp, Homo sapiens
cgagcctcctcagggg

SEQ ID NO: 6098890 - DNA, 17 bp, Homo sapiens
cgagcctcctcaggggg

SEQ ID NO: 6098891 - DNA, 19 bp, Homo sapiens
cgagcctctgtcactgcag

SEQ ID NO: 6098892 - DNA, 15 bp, Homo sapiens
cgagcctgaactgag

SEQ ID NO: 6098893 - DNA, 12 bp, Homo sapiens
cgagcctgtgcc

SEQ ID NO: 6098894 - DNA, 14 bp, Homo sapiens
cgagcgccctgcag

SEQ ID NO: 6098895 - DNA, 15 bp, Homo sapiens
cgagcgccctgcaga

SEQ ID NO: 6098896 - DNA, 19 bp, Homo sapiens
cgagcgccctgcagaccct

SEQ ID NO: 6098897 - DNA, 17 bp, Homo sapiens
cgagcgcgtgccttccc

SEQ ID NO: 6098898 - DNA, 18 bp, Homo sapiens
cgagcgcgtgccttcccc

SEQ ID NO: 6098899 - DNA, 16 bp, Homo sapiens
cgagcgttcccagcag

SEQ ID NO: 6098900 - DNA, 15 bp, Homo sapiens
cgagctacaaagcat

SEQ ID NO: 6098901 - DNA, 16 bp, Homo sapiens
cgagctactctcttgc

SEQ ID NO: 6098902 - DNA, 21 bp, Homo sapiens
cgagctactctcttgccagca

SEQ ID NO: 6098903 - DNA, 16 bp, Homo sapiens
cgagctcggggctggg

SEQ ID NO: 6098904 - DNA, 17 bp, Homo sapiens
cgagctcgtgtatcctg

SEQ ID NO: 6098905 - DNA, 19 bp, Homo sapiens
cgagctcgtgtatcctggg

SEQ ID NO: 6098906 - DNA, 20 bp, Homo sapiens
cgagctcgtgtatcctgggg

SEQ ID NO: 6098907 - DNA, 15 bp, Homo sapiens
cgagctctcctgggc

SEQ ID NO: 6098908 - DNA, 21 bp, Homo sapiens
cgagctctcctgggccagggt

SEQ ID NO: 6098909 - DNA, 22 bp, Homo sapiens
cgagctctcctgggccagggtc

SEQ ID NO: 6098910 - DNA, 23 bp, Homo sapiens
cgagctctcctgggccagggtct

SEQ ID NO: 6098911 - DNA, 17 bp, Homo sapiens
cgagctctgtagcctgg

SEQ ID NO: 6098912 - DNA, 18 bp, Homo sapiens
cgagctctgtagcctggt

SEQ ID NO: 6098913 - DNA, 11 bp, Homo sapiens
cgagctctgtg

SEQ ID NO: 6098914 - DNA, 16 bp, Homo sapiens
cgagctgaggactctg

SEQ ID NO: 6098915 - DNA, 14 bp, Homo sapiens
cgagctgctctgct

SEQ ID NO: 6098916 - DNA, 17 bp, Homo sapiens
cgagctgctttgtgggc

SEQ ID NO: 6098917 - DNA, 12 bp, Homo sapiens
cgagctggagcg

SEQ ID NO: 6098918 - DNA, 13 bp, Homo sapiens
cgagctgggggcc

SEQ ID NO: 6098919 - DNA, 16 bp, Homo sapiens
cgagctgggggccatg

SEQ ID NO: 6098920 - DNA, 12 bp, Homo sapiens
cgagctgggggg

SEQ ID NO: 6098921 - DNA, 22 bp, Homo sapiens
cgagctggggggttggcagccc

SEQ ID NO: 6098922 - DNA, 23 bp, Homo sapiens
cgagctggggggttggcagccca

SEQ ID NO: 6098923 - DNA, 14 bp, Homo sapiens
cgagctggtgcatt

SEQ ID NO: 6098924 - DNA, 21 bp, Homo sapiens
cgagctggtgcattacagaga

SEQ ID NO: 6098925 - DNA, 22 bp, Homo sapiens
cgagctggtgcattacagagag

SEQ ID NO: 6098926 - DNA, 12 bp, Homo sapiens
cgagctgtcccc

SEQ ID NO: 6098927 - DNA, 20 bp, Homo sapiens
cgagctgtcggagggctgga

SEQ ID NO: 6098928 - DNA, 22 bp, Homo sapiens
cgagcttgcctcagggccaagc

SEQ ID NO: 6098929 - DNA, 13 bp, Homo sapiens
cgagctttctctc

SEQ ID NO: 6098930 - DNA, 18 bp, Homo sapiens
cgaggaaaaacaacaaat

SEQ ID NO: 6098931 - DNA, 20 bp, Homo sapiens
cgaggaaaaggtccttgcct

SEQ ID NO: 6098932 - DNA, 23 bp, Homo sapiens
cgaggaaaaggtccttgcctcct

SEQ ID NO: 6098933 - DNA, 22 bp, Homo sapiens
cgaggaaacgaaacccactcta

SEQ ID NO: 6098934 - DNA, 13 bp, Homo sapiens
cgaggaaaggatt

SEQ ID NO: 6098935 - DNA, 16 bp, Homo sapiens
cgaggaactccaggac

SEQ ID NO: 6098936 - DNA, 14 bp, Homo sapiens
cgaggaagggccag

SEQ ID NO: 6098937 - DNA, 20 bp, Homo sapiens
cgaggaagggccagagcctg

SEQ ID NO: 6098938 - DNA, 21 bp, Homo sapiens
cgaggaagggccagagcctgg

SEQ ID NO: 6098939 - DNA, 17 bp, Homo sapiens
cgaggaatgtgaagcca

SEQ ID NO: 6098940 - DNA, 12 bp, Homo sapiens
cgaggacacagt

SEQ ID NO: 6098941 - DNA, 22 bp, Homo sapiens
cgaggacagcaatgcagagagg

SEQ ID NO: 6098942 - DNA, 18 bp, Homo sapiens
cgaggacagcctgcctct

SEQ ID NO: 6098943 - DNA, 21 bp, Homo sapiens
cgaggacagcctgcctctgcc

SEQ ID NO: 6098944 - DNA, 12 bp, Homo sapiens
cgaggacaggaa

SEQ ID NO: 6098945 - DNA, 12 bp, Homo sapiens
cgaggacaggga

SEQ ID NO: 6098946 - DNA, 13 bp, Homo sapiens
cgaggacagggag

SEQ ID NO: 6098947 - DNA, 21 bp, Homo sapiens
cgaggacatgaaactccacct

SEQ ID NO: 6098948 - DNA, 14 bp, Homo sapiens
cgaggacatttgtg

SEQ ID NO: 6098949 - DNA, 14 bp, Homo sapiens
cgaggaccactttg

SEQ ID NO: 6098950 - DNA, 23 bp, Homo sapiens
cgaggaccactttggagactggg

SEQ ID NO: 6098951 - DNA, 22 bp, Homo sapiens
cgaggacccatgaaacagcagc

SEQ ID NO: 6098952 - DNA, 15 bp, Homo sapiens
cgaggaccgggcact

SEQ ID NO: 6098953 - DNA, 17 bp, Homo sapiens
cgaggacgtgaagcctc

SEQ ID NO: 6098954 - DNA, 20 bp, Homo sapiens
cgaggactgtatttgtgact

SEQ ID NO: 6098955 - DNA, 21 bp, Homo sapiens
cgaggactgtatttgtgacta

SEQ ID NO: 6098956 - DNA, 20 bp, Homo sapiens
cgaggactttgattgcacat

SEQ ID NO: 6098957 - DNA, 17 bp, Homo sapiens
cgaggagccaggcaact

SEQ ID NO: 6098958 - DNA, 11 bp, Homo sapiens
cgaggagctgg

SEQ ID NO: 6098959 - DNA, 21 bp, Homo sapiens
cgaggagctggggcgggctag

SEQ ID NO: 6098960 - DNA, 17 bp, Homo sapiens
cgaggagcttccagtgc

SEQ ID NO: 6098961 - DNA, 15 bp, Homo sapiens
cgaggaggaggagta

SEQ ID NO: 6098962 - DNA, 23 bp, Homo sapiens
cgaggagggagagtctcccaggg

SEQ ID NO: 6098963 - DNA, 23 bp, Homo sapiens
cgaggaggggcccggtggcggca

SEQ ID NO: 6098964 - DNA, 18 bp, Homo sapiens
cgaggaggtgtctcaggc

SEQ ID NO: 6098965 - DNA, 22 bp, Homo sapiens
cgaggagtaacaatacaaatgg

SEQ ID NO: 6098966 - DNA, 23 bp, Homo sapiens
cgaggatgctgtcaggagatgga

SEQ ID NO: 6098967 - DNA, 18 bp, Homo sapiens
cgaggattaggggatggg

SEQ ID NO: 6098968 - DNA, 14 bp, Homo sapiens
cgaggattttaatt

SEQ ID NO: 6098969 - DNA, 23 bp, Homo sapiens
cgaggattttaattttttttagt

SEQ ID NO: 6098970 - DNA, 20 bp, Homo sapiens
cgaggcaccggacgctggag

SEQ ID NO: 6098971 - DNA, 20 bp, Homo sapiens
cgaggcaccggcgctgcagg

SEQ ID NO: 6098972 - DNA, 21 bp, Homo sapiens
cctcccattttagaaaatcag

SEQ ID NO: 6098973 - DNA, 23 bp, Homo sapiens
cctccccaaaagaaaccatgaca

SEQ ID NO: 6098974 - DNA, 19 bp, Homo sapiens
cctccccaaagccactgga

SEQ ID NO: 6098975 - DNA, 22 bp, Homo sapiens
cctccccaaagccactggaagg

SEQ ID NO: 6098976 - DNA, 16 bp, Homo sapiens
cctccccaacctgcaa

SEQ ID NO: 6098977 - DNA, 20 bp, Homo sapiens
cctccccaaggatgaccaca

SEQ ID NO: 6098978 - DNA, 22 bp, Homo sapiens
cctccccaaggatgaccacacc

SEQ ID NO: 6098979 - DNA, 14 bp, Homo sapiens
cctccccaatccat

SEQ ID NO: 6098980 - DNA, 19 bp, Homo sapiens
cctccccacacacaggcct

SEQ ID NO: 6098981 - DNA, 23 bp, Homo sapiens
cctccccacacacaggccttctg

SEQ ID NO: 6098982 - DNA, 16 bp, Homo sapiens
cctccccacactccac

SEQ ID NO: 6098983 - DNA, 17 bp, Homo sapiens
cctccccacactccact

SEQ ID NO: 6098984 - DNA, 19 bp, Homo sapiens
cctccccacactccactct

SEQ ID NO: 6098985 - DNA, 18 bp, Homo sapiens
cctccccacagtgccacc

SEQ ID NO: 6098986 - DNA, 16 bp, Homo sapiens
cctccccaccagagct

SEQ ID NO: 6098987 - DNA, 22 bp, Homo sapiens
cctccccaccagagctgcctcc

SEQ ID NO: 6098988 - DNA, 12 bp, Homo sapiens
cctccccaccca

SEQ ID NO: 6098989 - DNA, 13 bp, Homo sapiens
cctccccacccac

SEQ ID NO: 6098990 - DNA, 14 bp, Homo sapiens
cctccccacccagg

SEQ ID NO: 6098991 - DNA, 17 bp, Homo sapiens
cctccccaccctgtccc

SEQ ID NO: 6098992 - DNA, 22 bp, Homo sapiens
cctccccaccctgtcccaggca

SEQ ID NO: 6098993 - DNA, 13 bp, Homo sapiens
cctccccacctgc

SEQ ID NO: 6098994 - DNA, 13 bp, Homo sapiens
cctccccacctgt

SEQ ID NO: 6098995 - DNA, 16 bp, Homo sapiens
cctccccacctgtagc

SEQ ID NO: 6098996 - DNA, 15 bp, Homo sapiens
cctccccaccttccc

SEQ ID NO: 6098997 - DNA, 15 bp, Homo sapiens
cctccccacgccctc

SEQ ID NO: 6098998 - DNA, 17 bp, Homo sapiens
cctccccactccagcag

SEQ ID NO: 6098999 - DNA, 13 bp, Homo sapiens
cctccccagaatc

SEQ ID NO: 6099000 - DNA, 13 bp, Homo sapiens
cctccccagacag

SEQ ID NO: 6099001 - DNA, 17 bp, Homo sapiens
cctccccagacagggct

SEQ ID NO: 6099002 - DNA, 21 bp, Homo sapiens
cctccccagacagggctccag

SEQ ID NO: 6099003 - DNA, 22 bp, Homo sapiens
cctccccagacagggctccagc

SEQ ID NO: 6099004 - DNA, 20 bp, Homo sapiens
cctccccagagccctgcagt

SEQ ID NO: 6099005 - DNA, 22 bp, Homo sapiens
cctccccagatctgtcctgggg

SEQ ID NO: 6099006 - DNA, 17 bp, Homo sapiens
cctccccagcacctagg

SEQ ID NO: 6099007 - DNA, 16 bp, Homo sapiens
cctccccagcaggtgg

SEQ ID NO: 6099008 - DNA, 17 bp, Homo sapiens
cctccccagcaggtggg

SEQ ID NO: 6099009 - DNA, 14 bp, Homo sapiens
cctccccagcccag

SEQ ID NO: 6099010 - DNA, 14 bp, Homo sapiens
cctccccagccccc

SEQ ID NO: 6099011 - DNA, 19 bp, Homo sapiens
cctccccagccccctggca

SEQ ID NO: 6099012 - DNA, 22 bp, Homo sapiens
cctccccagcctgcgcctgctg

SEQ ID NO: 6099013 - DNA, 14 bp, Homo sapiens
cctccccagctccg

SEQ ID NO: 6099014 - DNA, 13 bp, Homo sapiens
cctccccaggccg

SEQ ID NO: 6099015 - DNA, 14 bp, Homo sapiens
cctccccaggctgg

SEQ ID NO: 6099016 - DNA, 11 bp, Homo sapiens
cctccccagta

SEQ ID NO: 6099017 - DNA, 23 bp, Homo sapiens
cctccccagtctacgttctccag

SEQ ID NO: 6099018 - DNA, 19 bp, Homo sapiens
cctccccagtgcaaatgca

SEQ ID NO: 6099019 - DNA, 12 bp, Homo sapiens
cctccccagtgt

SEQ ID NO: 6099020 - DNA, 16 bp, Homo sapiens
cctccccatacacaca

SEQ ID NO: 6099021 - DNA, 16 bp, Homo sapiens
cctccccatctgtcca

SEQ ID NO: 6099022 - DNA, 18 bp, Homo sapiens
cctccccatctgtccagc

SEQ ID NO: 6099023 - DNA, 15 bp, Homo sapiens
cctccccatctgtgt

SEQ ID NO: 6099024 - DNA, 23 bp, Homo sapiens
cctccccatctgtgttctaactt

SEQ ID NO: 6099025 - DNA, 22 bp, Homo sapiens
cctccccatggtgcagtgaaga

SEQ ID NO: 6099026 - DNA, 20 bp, Homo sapiens
cctccccatttcccatctgc

SEQ ID NO: 6099027 - DNA, 23 bp, Homo sapiens
cctccccatttcccatctgcacc

SEQ ID NO: 6099028 - DNA, 16 bp, Homo sapiens
cctcccccaaaccctg

SEQ ID NO: 6099029 - DNA, 21 bp, Homo sapiens
cctcccccaaaccctgcttct

SEQ ID NO: 6099030 - DNA, 13 bp, Homo sapiens
cctcccccaaagc

SEQ ID NO: 6099031 - DNA, 18 bp, Homo sapiens
cctcccccaacacctgct

SEQ ID NO: 6099032 - DNA, 20 bp, Homo sapiens
cctcccccaacacctgctgc

SEQ ID NO: 6099033 - DNA, 21 bp, Homo sapiens
cctcccccaacacctgctgcg

SEQ ID NO: 6099034 - DNA, 22 bp, Homo sapiens
cctcccccaacccccaccccac

SEQ ID NO: 6099035 - DNA, 15 bp, Homo sapiens
cctcccccacccacc

SEQ ID NO: 6099036 - DNA, 19 bp, Homo sapiens
cctcccccacccacctctc

SEQ ID NO: 6099037 - DNA, 21 bp, Homo sapiens
cctcccccacgtctctctgcc

SEQ ID NO: 6099038 - DNA, 22 bp, Homo sapiens
cctcccccacgtctctctgcct

SEQ ID NO: 6099039 - DNA, 23 bp, Homo sapiens
cctcccccacgtctctctgcctg

SEQ ID NO: 6099040 - DNA, 14 bp, Homo sapiens
cctcccccactcct

SEQ ID NO: 6099041 - DNA, 14 bp, Homo sapiens
cctcccccagagcc

SEQ ID NO: 6099042 - DNA, 17 bp, Homo sapiens
cctcccccagagccact

SEQ ID NO: 6099043 - DNA, 15 bp, Homo sapiens
cctcccccagagggg

SEQ ID NO: 6099044 - DNA, 14 bp, Homo sapiens
cctcccccagcaca

SEQ ID NO: 6099045 - DNA, 14 bp, Homo sapiens
cctcccccagcaga

SEQ ID NO: 6099046 - DNA, 16 bp, Homo sapiens
cctcccccagccagga

SEQ ID NO: 6099047 - DNA, 23 bp, Homo sapiens
cctcccccagccatgccagctgg

SEQ ID NO: 6099048 - DNA, 19 bp, Homo sapiens
cctcccccagcgtcagttt

SEQ ID NO: 6099049 - DNA, 16 bp, Homo sapiens
cctcccccagctcctt

SEQ ID NO: 6099050 - DNA, 13 bp, Homo sapiens
cctcccccaggct

SEQ ID NO: 6099051 - DNA, 15 bp, Homo sapiens
cctcccccaggctgc

SEQ ID NO: 6099052 - DNA, 12 bp, Homo sapiens
cctcccccagtg

SEQ ID NO: 6099053 - DNA, 16 bp, Homo sapiens
cctcccccatgggctg

SEQ ID NO: 6099054 - DNA, 17 bp, Homo sapiens
cctcccccattccctcc

SEQ ID NO: 6099055 - DNA, 11 bp, Homo sapiens
cctccccccac

SEQ ID NO: 6099056 - DNA, 17 bp, Homo sapiens
cctccccccactgcagg

SEQ ID NO: 6099057 - DNA, 19 bp, Homo sapiens
cctccccccagaccccgcc

SEQ ID NO: 6099058 - DNA, 22 bp, Homo sapiens
cctccccccagaccccgcccct

SEQ ID NO: 6099059 - DNA, 21 bp, Homo sapiens
cctccccccagctccctgcac

SEQ ID NO: 6099060 - DNA, 16 bp, Homo sapiens
cctcccccccatgcac

SEQ ID NO: 6099061 - DNA, 17 bp, Homo sapiens
cctcccccgcagacaga

SEQ ID NO: 6099062 - DNA, 14 bp, Homo sapiens
cctcccccgccacc

SEQ ID NO: 6099063 - DNA, 20 bp, Homo sapiens
cctcccccgccacctgtgtg

SEQ ID NO: 6099064 - DNA, 13 bp, Homo sapiens
cctcccccgcctc

SEQ ID NO: 6099065 - DNA, 18 bp, Homo sapiens
cctcccccggctgggcct

SEQ ID NO: 6099066 - DNA, 19 bp, Homo sapiens
cctcccccggctgggcctc

SEQ ID NO: 6099067 - DNA, 21 bp, Homo sapiens
cctcccccggggtctccacct

SEQ ID NO: 6099068 - DNA, 18 bp, Homo sapiens
cctcccccgtcctggagg

SEQ ID NO: 6099069 - DNA, 12 bp, Homo sapiens
cctccccctaca

SEQ ID NO: 6099070 - DNA, 21 bp, Homo sapiens
cctccccctaccgcatggcag

SEQ ID NO: 6099071 - DNA, 23 bp, Homo sapiens
cctccccctaccgcatggcagct

SEQ ID NO: 6099072 - DNA, 15 bp, Homo sapiens
cctccccctcaacct

SEQ ID NO: 6099073 - DNA, 13 bp, Homo sapiens
cctccccctcact

SEQ ID NO: 6099074 - DNA, 18 bp, Homo sapiens
cctccccctcctgctgtg

SEQ ID NO: 6099075 - DNA, 15 bp, Homo sapiens
cctccccctccttcc

SEQ ID NO: 6099076 - DNA, 13 bp, Homo sapiens
cctccccctgcca

SEQ ID NO: 6099077 - DNA, 15 bp, Homo sapiens
cctccccctgccaga

SEQ ID NO: 6099078 - DNA, 15 bp, Homo sapiens
cctccccctgccagt

SEQ ID NO: 6099079 - DNA, 17 bp, Homo sapiens
cctccccctgccagtgc

SEQ ID NO: 6099080 - DNA, 13 bp, Homo sapiens
cctccccctgcgc

SEQ ID NO: 6099081 - DNA, 14 bp, Homo sapiens
cctccccctgcgcc

SEQ ID NO: 6099082 - DNA, 14 bp, Homo sapiens
cctccccctgctgc

SEQ ID NO: 6099083 - DNA, 14 bp, Homo sapiens
cctcccccttcccc

SEQ ID NO: 6099084 - DNA, 20 bp, Homo sapiens
cctccccctttcacactgga

SEQ ID NO: 6099085 - DNA, 17 bp, Homo sapiens
cctccccctttggggta

SEQ ID NO: 6099086 - DNA, 21 bp, Homo sapiens
cctccccgaaaacccccagca

SEQ ID NO: 6099087 - DNA, 14 bp, Homo sapiens
cctccccgccccct

SEQ ID NO: 6099088 - DNA, 19 bp, Homo sapiens
cctccccgccccctgaaac

SEQ ID NO: 6099089 - DNA, 15 bp, Homo sapiens
cctccccgcccctgt

SEQ ID NO: 6099090 - DNA, 16 bp, Homo sapiens
cctccccgcccttttt

SEQ ID NO: 6099091 - DNA, 13 bp, Homo sapiens
cctccccgcctcc

SEQ ID NO: 6099092 - DNA, 16 bp, Homo sapiens
cctccccgcctcctcc

SEQ ID NO: 6099093 - DNA, 22 bp, Homo sapiens
cctccccgcctcctcccactgg

SEQ ID NO: 6099094 - DNA, 20 bp, Homo sapiens
cctccccgctctccctgtca

SEQ ID NO: 6099095 - DNA, 19 bp, Homo sapiens
cctccccggaagtgcctta

SEQ ID NO: 6099096 - DNA, 23 bp, Homo sapiens
cctccccggctcgagcagtcctg

SEQ ID NO: 6099097 - DNA, 13 bp, Homo sapiens
cctccccgggcag

SEQ ID NO: 6099098 - DNA, 17 bp, Homo sapiens
cctccccgggcagcaga

SEQ ID NO: 6099099 - DNA, 18 bp, Homo sapiens
cctccccgggcagcagag

SEQ ID NO: 6099100 - DNA, 19 bp, Homo sapiens
cctccccgggcagcagaga

SEQ ID NO: 6099101 - DNA, 18 bp, Homo sapiens
cctccccgggggtccccg

SEQ ID NO: 6099102 - DNA, 18 bp, Homo sapiens
cctccccgtccctgtccc

SEQ ID NO: 6099103 - DNA, 21 bp, Homo sapiens
cctccccgtccctgtccccca

SEQ ID NO: 6099104 - DNA, 23 bp, Homo sapiens
cctccccgtgtaaaaagcctcct

SEQ ID NO: 6099105 - DNA, 18 bp, Homo sapiens
cctcccctatccacccag

SEQ ID NO: 6099106 - DNA, 22 bp, Homo sapiens
cctcccctatccacccagccca

SEQ ID NO: 6099107 - DNA, 14 bp, Homo sapiens
cctcccctcaacag

SEQ ID NO: 6099108 - DNA, 14 bp, Homo sapiens
cctcccctcaagga

SEQ ID NO: 6099109 - DNA, 18 bp, Homo sapiens
cctcccctcacagcctct

SEQ ID NO: 6099110 - DNA, 17 bp, Homo sapiens
cctcccctcacccgctg

SEQ ID NO: 6099111 - DNA, 16 bp, Homo sapiens
cctcccctcagagccc

SEQ ID NO: 6099112 - DNA, 13 bp, Homo sapiens
cctcccctcagcc

SEQ ID NO: 6099113 - DNA, 16 bp, Homo sapiens
cctcccctcagcctgc

SEQ ID NO: 6099114 - DNA, 16 bp, Homo sapiens
cctcccctcagcgcag

SEQ ID NO: 6099115 - DNA, 16 bp, Homo sapiens
cctcccctccactcct

SEQ ID NO: 6099116 - DNA, 14 bp, Homo sapiens
cctcccctccatcc

SEQ ID NO: 6099117 - DNA, 14 bp, Homo sapiens
cctcccctccccca

SEQ ID NO: 6099118 - DNA, 18 bp, Homo sapiens
cctcccctccgcagcagg

SEQ ID NO: 6099119 - DNA, 21 bp, Homo sapiens
cctcccctccggactggtgcc

SEQ ID NO: 6099120 - DNA, 15 bp, Homo sapiens
cctcccctcctctcc

SEQ ID NO: 6099121 - DNA, 14 bp, Homo sapiens
cctcccctcctctg

SEQ ID NO: 6099122 - DNA, 15 bp, Homo sapiens
cctcccctcctctgc

SEQ ID NO: 6099123 - DNA, 17 bp, Homo sapiens
cctcccctcctctgctt

SEQ ID NO: 6099124 - DNA, 17 bp, Homo sapiens
cctcccctcctcttccc

SEQ ID NO: 6099125 - DNA, 15 bp, Homo sapiens
cctcccctccttgtc

SEQ ID NO: 6099126 - DNA, 20 bp, Homo sapiens
cctcccctctcatccccctg

SEQ ID NO: 6099127 - DNA, 15 bp, Homo sapiens
cctcccctctcctga

SEQ ID NO: 6099128 - DNA, 17 bp, Homo sapiens
cctcccctctccttcct

SEQ ID NO: 6099129 - DNA, 16 bp, Homo sapiens
cctcccctctctgcac

SEQ ID NO: 6099130 - DNA, 17 bp, Homo sapiens
cctcccctctcttgcac

SEQ ID NO: 6099131 - DNA, 14 bp, Homo sapiens
cctcccctcttgag

SEQ ID NO: 6099132 - DNA, 9 bp, Homo sapiens
cctcccctg

SEQ ID NO: 6099133 - DNA, 12 bp, Homo sapiens
cctcccctgagg

SEQ ID NO: 6099134 - DNA, 20 bp, Homo sapiens
cctcccctgaggatcccctg

SEQ ID NO: 6099135 - DNA, 13 bp, Homo sapiens
cctcccctgcaga

SEQ ID NO: 6099136 - DNA, 14 bp, Homo sapiens
cctcccctgccacc

SEQ ID NO: 6099137 - DNA, 16 bp, Homo sapiens
cctcccctgccagggc

SEQ ID NO: 6099138 - DNA, 13 bp, Homo sapiens
cctcccctgccct

SEQ ID NO: 6099139 - DNA, 13 bp, Homo sapiens
cctcccctgcgga

SEQ ID NO: 6099140 - DNA, 21 bp, Homo sapiens
cctcccctgctacctgctgag

SEQ ID NO: 6099141 - DNA, 16 bp, Homo sapiens
cctcccctgctcagaa

SEQ ID NO: 6099142 - DNA, 18 bp, Homo sapiens
cctcccctgctcccaggt

SEQ ID NO: 6099143 - DNA, 12 bp, Homo sapiens
cctcccctgctg

SEQ ID NO: 6099144 - DNA, 16 bp, Homo sapiens
cctcccctgctgaagg

SEQ ID NO: 6099145 - DNA, 14 bp, Homo sapiens
cctcccctggaagt

SEQ ID NO: 6099146 - DNA, 22 bp, Homo sapiens
cctcccctggagggggaatggc

SEQ ID NO: 6099147 - DNA, 23 bp, Homo sapiens
cctcccctggggacagcaagggc

SEQ ID NO: 6099148 - DNA, 17 bp, Homo sapiens
cctcccctggtcctgca

SEQ ID NO: 6099149 - DNA, 19 bp, Homo sapiens
cctcccctggtcctgcact

SEQ ID NO: 6099150 - DNA, 22 bp, Homo sapiens
cctcccctggtcctgcactgtc

SEQ ID NO: 6099151 - DNA, 13 bp, Homo sapiens
cctccccttccca

SEQ ID NO: 6099152 - DNA, 17 bp, Homo sapiens
cgaggcagaatggtggg

SEQ ID NO: 6099153 - DNA, 13 bp, Homo sapiens
cgaggcagaggac

SEQ ID NO: 6099154 - DNA, 15 bp, Homo sapiens
cgaggcagaggacag

SEQ ID NO: 6099155 - DNA, 16 bp, Homo sapiens
cgaggcaggggctctg

SEQ ID NO: 6099156 - DNA, 18 bp, Homo sapiens
cgaggcaggggctctgct

SEQ ID NO: 6099157 - DNA, 16 bp, Homo sapiens
cgaggcaggggctggg

SEQ ID NO: 6099158 - DNA, 20 bp, Homo sapiens
cgaggcaggggctgggcaga

SEQ ID NO: 6099159 - DNA, 22 bp, Homo sapiens
cgaggcatggggcatgtccttt

SEQ ID NO: 6099160 - DNA, 18 bp, Homo sapiens
cgaggccacattgctggc

SEQ ID NO: 6099161 - DNA, 20 bp, Homo sapiens
cgaggccacattgctggctg

SEQ ID NO: 6099162 - DNA, 20 bp, Homo sapiens
cgaggccactcagaggcccc

SEQ ID NO: 6099163 - DNA, 21 bp, Homo sapiens
cgaggcccagatccaaggccg

SEQ ID NO: 6099164 - DNA, 17 bp, Homo sapiens
cgaggcccagcgggcag

SEQ ID NO: 6099165 - DNA, 16 bp, Homo sapiens
cgaggcccccctctgc

SEQ ID NO: 6099166 - DNA, 20 bp, Homo sapiens
cgaggcccccctctgccttt

SEQ ID NO: 6099167 - DNA, 23 bp, Homo sapiens
cgaggccctcaatccaccttcag

SEQ ID NO: 6099168 - DNA, 19 bp, Homo sapiens
cgaggccctcgggcccagc

SEQ ID NO: 6099169 - DNA, 20 bp, Homo sapiens
cgaggccctcgggcccagcc

SEQ ID NO: 6099170 - DNA, 21 bp, Homo sapiens
cgaggccctcgggcccagccc

SEQ ID NO: 6099171 - DNA, 15 bp, Homo sapiens
cgaggccctgcatgg

SEQ ID NO: 6099172 - DNA, 20 bp, Homo sapiens
cgaggcctacagaggaggcc

SEQ ID NO: 6099173 - DNA, 23 bp, Homo sapiens
cgaggcctaccccgcagacacct

SEQ ID NO: 6099174 - DNA, 18 bp, Homo sapiens
cgaggcctagagtggcag

SEQ ID NO: 6099175 - DNA, 19 bp, Homo sapiens
cgaggcctagagtggcagc

SEQ ID NO: 6099176 - DNA, 16 bp, Homo sapiens
cgaggcctggccaatg

SEQ ID NO: 6099177 - DNA, 13 bp, Homo sapiens
cgaggcctggctc

SEQ ID NO: 6099178 - DNA, 16 bp, Homo sapiens
cgaggcgaagctgagc

SEQ ID NO: 6099179 - DNA, 17 bp, Homo sapiens
cgaggcgggggagcctg

SEQ ID NO: 6099180 - DNA, 17 bp, Homo sapiens
cgaggcggtttccagga

SEQ ID NO: 6099181 - DNA, 19 bp, Homo sapiens
cgaggcggtttccaggaag

SEQ ID NO: 6099182 - DNA, 20 bp, Homo sapiens
cgaggcggtttccaggaaga

SEQ ID NO: 6099183 - DNA, 22 bp, Homo sapiens
cgaggcggtttccaggaagagt

SEQ ID NO: 6099184 - DNA, 15 bp, Homo sapiens
cgaggctaaccctga

SEQ ID NO: 6099185 - DNA, 14 bp, Homo sapiens
cgaggctacagctc

SEQ ID NO: 6099186 - DNA, 18 bp, Homo sapiens
cgaggctctagaaatgcc

SEQ ID NO: 6099187 - DNA, 10 bp, Homo sapiens
cgaggctctt

SEQ ID NO: 6099188 - DNA, 13 bp, Homo sapiens
cgaggctgagaat

SEQ ID NO: 6099189 - DNA, 20 bp, Homo sapiens
cgaggctgagaatcagactg

SEQ ID NO: 6099190 - DNA, 21 bp, Homo sapiens
cgaggctgattcctctcattt

SEQ ID NO: 6099191 - DNA, 20 bp, Homo sapiens
cgaggctgcagtcagccctg

SEQ ID NO: 6099192 - DNA, 19 bp, Homo sapiens
cgaggctgccccaggccgg

SEQ ID NO: 6099193 - DNA, 14 bp, Homo sapiens
cgaggctgccccca

SEQ ID NO: 6099194 - DNA, 16 bp, Homo sapiens
cgaggctgcccccatc

SEQ ID NO: 6099195 - DNA, 23 bp, Homo sapiens
cgaggctgcccccatccagccac

SEQ ID NO: 6099196 - DNA, 21 bp, Homo sapiens
cgaggctgccccttggatcaa

SEQ ID NO: 6099197 - DNA, 14 bp, Homo sapiens
cgaggctgcctctg

SEQ ID NO: 6099198 - DNA, 16 bp, Homo sapiens
cgaggctgcctctggg

SEQ ID NO: 6099199 - DNA, 16 bp, Homo sapiens
cgaggctggagctggc

SEQ ID NO: 6099200 - DNA, 14 bp, Homo sapiens
cgaggctgggccaa

SEQ ID NO: 6099201 - DNA, 19 bp, Homo sapiens
cgaggctggtggttttcag

SEQ ID NO: 6099202 - DNA, 17 bp, Homo sapiens
cgagggaggaacacctg

SEQ ID NO: 6099203 - DNA, 10 bp, Homo sapiens
cgagggaggg

SEQ ID NO: 6099204 - DNA, 17 bp, Homo sapiens
cgagggaggggaggtgg

SEQ ID NO: 6099205 - DNA, 16 bp, Homo sapiens
cgagggcaacagggag

SEQ ID NO: 6099206 - DNA, 14 bp, Homo sapiens
cgagggccaggcac

SEQ ID NO: 6099207 - DNA, 23 bp, Homo sapiens
cgagggccaggcacccacatccc

SEQ ID NO: 6099208 - DNA, 18 bp, Homo sapiens
cgagggcccctctccaag

SEQ ID NO: 6099209 - DNA, 18 bp, Homo sapiens
cgagggccgcccgctccc

SEQ ID NO: 6099210 - DNA, 15 bp, Homo sapiens
cgagggccgcctgcc

SEQ ID NO: 6099211 - DNA, 16 bp, Homo sapiens
cgagggccgcctgcct

SEQ ID NO: 6099212 - DNA, 17 bp, Homo sapiens
cgagggccgcctgcctt

SEQ ID NO: 6099213 - DNA, 18 bp, Homo sapiens
cgagggcgaaggccattg

SEQ ID NO: 6099214 - DNA, 15 bp, Homo sapiens
cgagggcgcctgggt

SEQ ID NO: 6099215 - DNA, 16 bp, Homo sapiens
cgagggcgcctgggtc

SEQ ID NO: 6099216 - DNA, 16 bp, Homo sapiens
cgagggcggccaggga

SEQ ID NO: 6099217 - DNA, 19 bp, Homo sapiens
cgagggcggccagggacag

SEQ ID NO: 6099218 - DNA, 18 bp, Homo sapiens
cgagggctactcagcagt

SEQ ID NO: 6099219 - DNA, 13 bp, Homo sapiens
cgagggctgagga

SEQ ID NO: 6099220 - DNA, 23 bp, Homo sapiens
cgagggctgaggagcagccagga

SEQ ID NO: 6099221 - DNA, 11 bp, Homo sapiens
cgagggctggc

SEQ ID NO: 6099222 - DNA, 15 bp, Homo sapiens
cgagggctggctggc

SEQ ID NO: 6099223 - DNA, 19 bp, Homo sapiens
cgagggctggctggcctca

SEQ ID NO: 6099224 - DNA, 16 bp, Homo sapiens
cgaggggaaaggcctg

SEQ ID NO: 6099225 - DNA, 20 bp, Homo sapiens
cgaggggacccatgggggct

SEQ ID NO: 6099226 - DNA, 15 bp, Homo sapiens
cgaggggcagggaag

SEQ ID NO: 6099227 - DNA, 18 bp, Homo sapiens
cgaggggccagcagaggg

SEQ ID NO: 6099228 - DNA, 19 bp, Homo sapiens
cgaggggccagcagagggc

SEQ ID NO: 6099229 - DNA, 17 bp, Homo sapiens
cgaggggctcaggaaaa

SEQ ID NO: 6099230 - DNA, 20 bp, Homo sapiens
cgaggggctctcagctcagc

SEQ ID NO: 6099231 - DNA, 20 bp, Homo sapiens
cgagggggccggggggaggg

SEQ ID NO: 6099232 - DNA, 15 bp, Homo sapiens
cgaggggggccccgg

SEQ ID NO: 6099233 - DNA, 19 bp, Homo sapiens
cgaggggtgtcttgggcag

SEQ ID NO: 6099234 - DNA, 20 bp, Homo sapiens
cgaggggttggtgggagggt

SEQ ID NO: 6099235 - DNA, 23 bp, Homo sapiens
cgagggtcctggctcctgagggg

SEQ ID NO: 6099236 - DNA, 21 bp, Homo sapiens
cgagggtctcccctcctgcac

SEQ ID NO: 6099237 - DNA, 22 bp, Homo sapiens
cgagggtctcccctcctgcaca

SEQ ID NO: 6099238 - DNA, 18 bp, Homo sapiens
cgagggttccaggctgtg

SEQ ID NO: 6099239 - DNA, 16 bp, Homo sapiens
cgaggtatgaggtcta

SEQ ID NO: 6099240 - DNA, 21 bp, Homo sapiens
cgaggtcaacagagaaggcag

SEQ ID NO: 6099241 - DNA, 23 bp, Homo sapiens
cgaggtcaacagagaaggcagga

SEQ ID NO: 6099242 - DNA, 14 bp, Homo sapiens
cgaggtcagaggag

SEQ ID NO: 6099243 - DNA, 14 bp, Homo sapiens
cgaggtcaggagat

SEQ ID NO: 6099244 - DNA, 18 bp, Homo sapiens
cgaggtccctgctgccag

SEQ ID NO: 6099245 - DNA, 18 bp, Homo sapiens
cgaggtcctcctggcctg

SEQ ID NO: 6099246 - DNA, 14 bp, Homo sapiens
cgaggtcgctgcag

SEQ ID NO: 6099247 - DNA, 22 bp, Homo sapiens
cgaggtcgggcagcacaagtgt

SEQ ID NO: 6099248 - DNA, 22 bp, Homo sapiens
cgaggtggagggtagccctggg

SEQ ID NO: 6099249 - DNA, 23 bp, Homo sapiens
cgaggtggatcacagaggcttct

SEQ ID NO: 6099250 - DNA, 15 bp, Homo sapiens
cgaggtggctgcctg

SEQ ID NO: 6099251 - DNA, 16 bp, Homo sapiens
cgaggtggtagctctg

SEQ ID NO: 6099252 - DNA, 18 bp, Homo sapiens
cgaggtgtcaccctgcag

SEQ ID NO: 6099253 - DNA, 20 bp, Homo sapiens
cgaggttaaagaagctgcat

SEQ ID NO: 6099254 - DNA, 21 bp, Homo sapiens
cgaggttcccagggctggaga

SEQ ID NO: 6099255 - DNA, 17 bp, Homo sapiens
cgaggttgccccttccc

SEQ ID NO: 6099256 - DNA, 18 bp, Homo sapiens
cgaggttgtggggaggct

SEQ ID NO: 6099257 - DNA, 19 bp, Homo sapiens
cgaggttgtggggaggctg

SEQ ID NO: 6099258 - DNA, 21 bp, Homo sapiens
cgaggttgtggggaggctgca

SEQ ID NO: 6099259 - DNA, 15 bp, Homo sapiens
cgaggttttgaggcg

SEQ ID NO: 6099260 - DNA, 18 bp, Homo sapiens
cgagtaaagtctgggcca

SEQ ID NO: 6099261 - DNA, 19 bp, Homo sapiens
cgagtaaagtctgggccag

SEQ ID NO: 6099262 - DNA, 22 bp, Homo sapiens
cgagtaatgacgtgtgtggctg

SEQ ID NO: 6099263 - DNA, 20 bp, Homo sapiens
cgagtaattgcatttgcttt

SEQ ID NO: 6099264 - DNA, 12 bp, Homo sapiens
cgagtactgtgg

SEQ ID NO: 6099265 - DNA, 13 bp, Homo sapiens
cgagtactgtggg

SEQ ID NO: 6099266 - DNA, 20 bp, Homo sapiens
cgagtagaaaatgtgaccct

SEQ ID NO: 6099267 - DNA, 19 bp, Homo sapiens
cgagtagaggtttaaagaa

SEQ ID NO: 6099268 - DNA, 20 bp, Homo sapiens
cgagtagatgaacctgcagc

SEQ ID NO: 6099269 - DNA, 14 bp, Homo sapiens
cgagtagctgggat

SEQ ID NO: 6099270 - DNA, 13 bp, Homo sapiens
cgagtatgtgttt

SEQ ID NO: 6099271 - DNA, 14 bp, Homo sapiens
cgagtcaaagttga

SEQ ID NO: 6099272 - DNA, 20 bp, Homo sapiens
cgagtcaattaaacagctgg

SEQ ID NO: 6099273 - DNA, 16 bp, Homo sapiens
cgagtcacattctgct

SEQ ID NO: 6099274 - DNA, 19 bp, Homo sapiens
cgagtcaccctcctcacag

SEQ ID NO: 6099275 - DNA, 18 bp, Homo sapiens
cgagtcaccttccaggac

SEQ ID NO: 6099276 - DNA, 20 bp, Homo sapiens
cgagtcattcgttctgtgga

SEQ ID NO: 6099277 - DNA, 15 bp, Homo sapiens
cgagtccaaaatcat

SEQ ID NO: 6099278 - DNA, 18 bp, Homo sapiens
cgagtccaggagccccag

SEQ ID NO: 6099279 - DNA, 14 bp, Homo sapiens
cgagtccccccacc

SEQ ID NO: 6099280 - DNA, 16 bp, Homo sapiens
cgagtccccccacccc

SEQ ID NO: 6099281 - DNA, 17 bp, Homo sapiens
cgagtcccggagcccca

SEQ ID NO: 6099282 - DNA, 20 bp, Homo sapiens
cgagtctcttctccactgga

SEQ ID NO: 6099283 - DNA, 21 bp, Homo sapiens
cgagtctcttctccactggat

SEQ ID NO: 6099284 - DNA, 20 bp, Homo sapiens
cgagtctggagaccaggact

SEQ ID NO: 6099285 - DNA, 13 bp, Homo sapiens
cgagtctggggac

SEQ ID NO: 6099286 - DNA, 21 bp, Homo sapiens
cgagtctggggacctggcact

SEQ ID NO: 6099287 - DNA, 22 bp, Homo sapiens
cgagtctttctcactgcctttg

SEQ ID NO: 6099288 - DNA, 22 bp, Homo sapiens
cgagtgaatttctaaatgttgg

SEQ ID NO: 6099289 - DNA, 17 bp, Homo sapiens
cgagtgagctaccagga

SEQ ID NO: 6099290 - DNA, 21 bp, Homo sapiens
cgagtgagctaccaggaagag

SEQ ID NO: 6099291 - DNA, 18 bp, Homo sapiens
cgagtgatttccatctct

SEQ ID NO: 6099292 - DNA, 22 bp, Homo sapiens
cgagtgcactgcattcctgtgc

SEQ ID NO: 6099293 - DNA, 11 bp, Homo sapiens
cgagtgccagg

SEQ ID NO: 6099294 - DNA, 21 bp, Homo sapiens
cgagtgcccctgcaggggagg

SEQ ID NO: 6099295 - DNA, 21 bp, Homo sapiens
cgagtgcggcgtggagactgg

SEQ ID NO: 6099296 - DNA, 21 bp, Homo sapiens
cgagtgctaagtgtaggatat

SEQ ID NO: 6099297 - DNA, 21 bp, Homo sapiens
cgagtgcttccgctgcggtga

SEQ ID NO: 6099298 - DNA, 23 bp, Homo sapiens
cgagtggatagatgccctgctag

SEQ ID NO: 6099299 - DNA, 19 bp, Homo sapiens
cgagtggcgagtccagaca

SEQ ID NO: 6099300 - DNA, 13 bp, Homo sapiens
cgagtgggaagga

SEQ ID NO: 6099301 - DNA, 21 bp, Homo sapiens
cgagtggtctcctctcagctt

SEQ ID NO: 6099302 - DNA, 22 bp, Homo sapiens
cgagtggtctcctctcagcttc

SEQ ID NO: 6099303 - DNA, 14 bp, Homo sapiens
cgagtgtagctgtg

SEQ ID NO: 6099304 - DNA, 16 bp, Homo sapiens
cgagtgtagctgtgaa

SEQ ID NO: 6099305 - DNA, 22 bp, Homo sapiens
cgagtgtgaagcttccttggct

SEQ ID NO: 6099306 - DNA, 20 bp, Homo sapiens
cgagtgtggagctgcttcca

SEQ ID NO: 6099307 - DNA, 21 bp, Homo sapiens
cgagtgtggagctgcttccag

SEQ ID NO: 6099308 - DNA, 18 bp, Homo sapiens
cgagtgtgtgcatgtgtg

SEQ ID NO: 6099309 - DNA, 20 bp, Homo sapiens
cgagtgtttaaatgctgtgt

SEQ ID NO: 6099310 - DNA, 18 bp, Homo sapiens
cgagttacagacaaagcg

SEQ ID NO: 6099311 - DNA, 17 bp, Homo sapiens
cgagtttacttcatgag

SEQ ID NO: 6099312 - DNA, 23 bp, Homo sapiens
cgataaaaaaaaaaaaaaaatta

SEQ ID NO: 6099313 - DNA, 20 bp, Homo sapiens
cgataaaactaaatatatgt

SEQ ID NO: 6099314 - DNA, 13 bp, Homo sapiens
cgataaagtaaca

SEQ ID NO: 6099315 - DNA, 24 bp, Homo sapiens
cgataaagtaacagtatgtcagat

SEQ ID NO: 6099316 - DNA, 16 bp, Homo sapiens
cgataaggaagaaaca

SEQ ID NO: 6099317 - DNA, 20 bp, Homo sapiens
cgatacaccgggcctggaga

SEQ ID NO: 6099318 - DNA, 17 bp, Homo sapiens
cgatacctcagccctgg

SEQ ID NO: 6099319 - DNA, 17 bp, Homo sapiens
cgatacctggagcagag

SEQ ID NO: 6099320 - DNA, 19 bp, Homo sapiens
cgatactgcgactttctgc

SEQ ID NO: 6099321 - DNA, 23 bp, Homo sapiens
cgatactgcgactttctgcctgg

SEQ ID NO: 6099322 - DNA, 14 bp, Homo sapiens
cgatagtggtggtg

SEQ ID NO: 6099323 - DNA, 14 bp, Homo sapiens
cgatataagccata

SEQ ID NO: 6099324 - DNA, 15 bp, Homo sapiens
cgatatacagatgaa

SEQ ID NO: 6099325 - DNA, 15 bp, Homo sapiens
cgatatactctagat

SEQ ID NO: 6099326 - DNA, 19 bp, Homo sapiens
cgatatcaccatgatttaa

SEQ ID NO: 6099327 - DNA, 18 bp, Homo sapiens
cgatatgaaaaataaata

SEQ ID NO: 6099328 - DNA, 13 bp, Homo sapiens
cctccccttcccc

SEQ ID NO: 6099329 - DNA, 13 bp, Homo sapiens
cctccccttccct

SEQ ID NO: 6099330 - DNA, 15 bp, Homo sapiens
cctccccttcctgtt

SEQ ID NO: 6099331 - DNA, 16 bp, Homo sapiens
cctccccttcttcccg

SEQ ID NO: 6099332 - DNA, 14 bp, Homo sapiens
cctccccttgccag

SEQ ID NO: 6099333 - DNA, 12 bp, Homo sapiens
cctccccttggg

SEQ ID NO: 6099334 - DNA, 14 bp, Homo sapiens
cctccccttgggcg

SEQ ID NO: 6099335 - DNA, 18 bp, Homo sapiens
cctcccctttgaccctat

SEQ ID NO: 6099336 - DNA, 19 bp, Homo sapiens
cctccccttttaccactcc

SEQ ID NO: 6099337 - DNA, 22 bp, Homo sapiens
cctccccttttaccactcccag

SEQ ID NO: 6099338 - DNA, 17 bp, Homo sapiens
cctccccttttgccccc

SEQ ID NO: 6099339 - DNA, 22 bp, Homo sapiens
cctcccgaaaaatgtgtggttc

SEQ ID NO: 6099340 - DNA, 15 bp, Homo sapiens
cctcccgaagccacc

SEQ ID NO: 6099341 - DNA, 19 bp, Homo sapiens
cctcccgaatagctgggac

SEQ ID NO: 6099342 - DNA, 21 bp, Homo sapiens
cctcccgaatagctgggacta

SEQ ID NO: 6099343 - DNA, 21 bp, Homo sapiens
cctcccgacagcccatcacct

SEQ ID NO: 6099344 - DNA, 14 bp, Homo sapiens
cctcccgaggaggg

SEQ ID NO: 6099345 - DNA, 21 bp, Homo sapiens
cctcccgagtagctgggacta

SEQ ID NO: 6099346 - DNA, 19 bp, Homo sapiens
cctcccgagtagctgggat

SEQ ID NO: 6099347 - DNA, 21 bp, Homo sapiens
cctcccgagtagctgggatta

SEQ ID NO: 6099348 - DNA, 15 bp, Homo sapiens
cctcccgcaccccga

SEQ ID NO: 6099349 - DNA, 17 bp, Homo sapiens
cctcccgccccagcctc

SEQ ID NO: 6099350 - DNA, 19 bp, Homo sapiens
cctcccgccccgcccctcc

SEQ ID NO: 6099351 - DNA, 16 bp, Homo sapiens
cctcccgcccttccat

SEQ ID NO: 6099352 - DNA, 14 bp, Homo sapiens
cctcccgcttcctc

SEQ ID NO: 6099353 - DNA, 16 bp, Homo sapiens
cctcccgcttcctccg

SEQ ID NO: 6099354 - DNA, 19 bp, Homo sapiens
cctcccgcttcctccggct

SEQ ID NO: 6099355 - DNA, 22 bp, Homo sapiens
cctcccggccctgcctgctggt

SEQ ID NO: 6099356 - DNA, 18 bp, Homo sapiens
cctcccggcctggcttca

SEQ ID NO: 6099357 - DNA, 16 bp, Homo sapiens
cctcccggctccctcc

SEQ ID NO: 6099358 - DNA, 16 bp, Homo sapiens
cctcccggctgccccc

SEQ ID NO: 6099359 - DNA, 20 bp, Homo sapiens
cctcccggctttgcagggag

SEQ ID NO: 6099360 - DNA, 18 bp, Homo sapiens
cctcccgggaagcatcct

SEQ ID NO: 6099361 - DNA, 19 bp, Homo sapiens
cctcccgggaagcatcctc

SEQ ID NO: 6099362 - DNA, 17 bp, Homo sapiens
cctcccgggagcacaga

SEQ ID NO: 6099363 - DNA, 14 bp, Homo sapiens
cctcccgggccctc

SEQ ID NO: 6099364 - DNA, 21 bp, Homo sapiens
cctcccgggccctcccttgga

SEQ ID NO: 6099365 - DNA, 16 bp, Homo sapiens
cctcccggggtgcccg

SEQ ID NO: 6099366 - DNA, 17 bp, Homo sapiens
cctcccggggtgcccgt

SEQ ID NO: 6099367 - DNA, 22 bp, Homo sapiens
cctcccgggtctcaggcctcca

SEQ ID NO: 6099368 - DNA, 23 bp, Homo sapiens
cctcccgggtctcaggcctccag

SEQ ID NO: 6099369 - DNA, 20 bp, Homo sapiens
cctcccgggttcaagcttgt

SEQ ID NO: 6099370 - DNA, 11 bp, Homo sapiens
cctcctggcca

SEQ ID NO: 6099371 - DNA, 13 bp, Homo sapiens
cctcctggccaga

SEQ ID NO: 6099372 - DNA, 18 bp, Homo sapiens
cctcctggcctcagactg

SEQ ID NO: 6099373 - DNA, 18 bp, Homo sapiens
cctcctggcctgagcgca

SEQ ID NO: 6099374 - DNA, 18 bp, Homo sapiens
cctcctggctcaggccca

SEQ ID NO: 6099375 - DNA, 22 bp, Homo sapiens
cctcctggctgtgacacctggt

SEQ ID NO: 6099376 - DNA, 18 bp, Homo sapiens
cctcctgggaacacatct

SEQ ID NO: 6099377 - DNA, 23 bp, Homo sapiens
cctcctgggaacctccttacctg

SEQ ID NO: 6099378 - DNA, 23 bp, Homo sapiens
cctcctgggaagatgaggttctg

SEQ ID NO: 6099379 - DNA, 22 bp, Homo sapiens
cctcctgggaaggagggagctg

SEQ ID NO: 6099380 - DNA, 23 bp, Homo sapiens
cctcctgggaaggagggagctgc

SEQ ID NO: 6099381 - DNA, 17 bp, Homo sapiens
cctcctgggaatgaagc

SEQ ID NO: 6099382 - DNA, 12 bp, Homo sapiens
cctcctgggacc

SEQ ID NO: 6099383 - DNA, 17 bp, Homo sapiens
cctcctgggatctgctc

SEQ ID NO: 6099384 - DNA, 20 bp, Homo sapiens
cctcctgggattggctgtga

SEQ ID NO: 6099385 - DNA, 21 bp, Homo sapiens
cctcctgggcaccccaggcag

SEQ ID NO: 6099386 - DNA, 12 bp, Homo sapiens
cctcctgggcag

SEQ ID NO: 6099387 - DNA, 14 bp, Homo sapiens
cctcctgggcccag

SEQ ID NO: 6099388 - DNA, 18 bp, Homo sapiens
cctcctgggcccaggcag

SEQ ID NO: 6099389 - DNA, 14 bp, Homo sapiens
cctcctgggcccct

SEQ ID NO: 6099390 - DNA, 14 bp, Homo sapiens
cctcctgggccctg

SEQ ID NO: 6099391 - DNA, 19 bp, Homo sapiens
cctcctgggccctgggctg

SEQ ID NO: 6099392 - DNA, 19 bp, Homo sapiens
cctcctgggctccagaggg

SEQ ID NO: 6099393 - DNA, 12 bp, Homo sapiens
cctcctggggcc

SEQ ID NO: 6099394 - DNA, 16 bp, Homo sapiens
cctcctggggccaggc

SEQ ID NO: 6099395 - DNA, 21 bp, Homo sapiens
cctcctggggcgcgtgaggcc

SEQ ID NO: 6099396 - DNA, 22 bp, Homo sapiens
cctcctggggcgcgtgaggccc

SEQ ID NO: 6099397 - DNA, 14 bp, Homo sapiens
cctcctgggggctg

SEQ ID NO: 6099398 - DNA, 21 bp, Homo sapiens
cctcctgggggctggctccca

SEQ ID NO: 6099399 - DNA, 23 bp, Homo sapiens
cctcctgggggctggctcccagg

SEQ ID NO: 6099400 - DNA, 17 bp, Homo sapiens
cctcctgggttcaagca

SEQ ID NO: 6099401 - DNA, 17 bp, Homo sapiens
cctcctgggttcacgta

SEQ ID NO: 6099402 - DNA, 18 bp, Homo sapiens
cctcctggtcctggacac

SEQ ID NO: 6099403 - DNA, 21 bp, Homo sapiens
cctcctggtgtcaccccagag

SEQ ID NO: 6099404 - DNA, 22 bp, Homo sapiens
cctcctggtgtcaccccagagc

SEQ ID NO: 6099405 - DNA, 16 bp, Homo sapiens
cctcctggtttccttt

SEQ ID NO: 6099406 - DNA, 22 bp, Homo sapiens
cctcctgtaaatggtgtacata

SEQ ID NO: 6099407 - DNA, 18 bp, Homo sapiens
cctcctgtcactcactga

SEQ ID NO: 6099408 - DNA, 18 bp, Homo sapiens
cctcctgtctaatttgca

SEQ ID NO: 6099409 - DNA, 18 bp, Homo sapiens
cctcctgtctcgccagaa

SEQ ID NO: 6099410 - DNA, 16 bp, Homo sapiens
cctcctgtcttcccag

SEQ ID NO: 6099411 - DNA, 20 bp, Homo sapiens
cctcctgtgccccagctgcc

SEQ ID NO: 6099412 - DNA, 19 bp, Homo sapiens
cctcctgtgcctccctttt

SEQ ID NO: 6099413 - DNA, 13 bp, Homo sapiens
cctcctgtgcctg

SEQ ID NO: 6099414 - DNA, 20 bp, Homo sapiens
cctcctgtgcctggccccag

SEQ ID NO: 6099415 - DNA, 23 bp, Homo sapiens
cctcctgtgcctggccccagcct

SEQ ID NO: 6099416 - DNA, 15 bp, Homo sapiens
cctcctgtgctcagc

SEQ ID NO: 6099417 - DNA, 17 bp, Homo sapiens
cctcctgtggcctgcca

SEQ ID NO: 6099418 - DNA, 12 bp, Homo sapiens
cctcctgtgggg

SEQ ID NO: 6099419 - DNA, 18 bp, Homo sapiens
cctcctgtggggaaaggg

SEQ ID NO: 6099420 - DNA, 15 bp, Homo sapiens
cctcctgtgtcactg

SEQ ID NO: 6099421 - DNA, 13 bp, Homo sapiens
cctcctgtgtgac

SEQ ID NO: 6099422 - DNA, 23 bp, Homo sapiens
cctcctgtgtgtgcgcctacagg

SEQ ID NO: 6099423 - DNA, 20 bp, Homo sapiens
cctcctgtgttgtgctggga

SEQ ID NO: 6099424 - DNA, 20 bp, Homo sapiens
cctcctgttacttgcttctg

SEQ ID NO: 6099425 - DNA, 17 bp, Homo sapiens
cctcctgttcctgcctt

SEQ ID NO: 6099426 - DNA, 19 bp, Homo sapiens
cctcctgttctgcccacga

SEQ ID NO: 6099427 - DNA, 15 bp, Homo sapiens
cctcctgttgcaccc

SEQ ID NO: 6099428 - DNA, 17 bp, Homo sapiens
cctcctgttgcacccag

SEQ ID NO: 6099429 - DNA, 21 bp, Homo sapiens
cctcctgttgcacccagccct

SEQ ID NO: 6099430 - DNA, 14 bp, Homo sapiens
cctccttaatttaa

SEQ ID NO: 6099431 - DNA, 16 bp, Homo sapiens
cctccttacattaaaa

SEQ ID NO: 6099432 - DNA, 16 bp, Homo sapiens
cctccttagaaaagac

SEQ ID NO: 6099433 - DNA, 21 bp, Homo sapiens
cctccttagctttccctgtgc

SEQ ID NO: 6099434 - DNA, 18 bp, Homo sapiens
cctccttataagcccagc

SEQ ID NO: 6099435 - DNA, 18 bp, Homo sapiens
cctccttatcaaaggaca

SEQ ID NO: 6099436 - DNA, 23 bp, Homo sapiens
cctccttatcctacagtacaatc

SEQ ID NO: 6099437 - DNA, 12 bp, Homo sapiens
cctccttcagac

SEQ ID NO: 6099438 - DNA, 22 bp, Homo sapiens
cctccttcagacaccctcaacc

SEQ ID NO: 6099439 - DNA, 23 bp, Homo sapiens
cctccttcatatgaaaggtgcca

SEQ ID NO: 6099440 - DNA, 16 bp, Homo sapiens
cctccttccacctccc

SEQ ID NO: 6099441 - DNA, 17 bp, Homo sapiens
cctccttccacctccct

SEQ ID NO: 6099442 - DNA, 15 bp, Homo sapiens
cctccttccaggccc

SEQ ID NO: 6099443 - DNA, 12 bp, Homo sapiens
cctccttcccaa

SEQ ID NO: 6099444 - DNA, 12 bp, Homo sapiens
cctccttcccac

SEQ ID NO: 6099445 - DNA, 13 bp, Homo sapiens
cctccttcccagg

SEQ ID NO: 6099446 - DNA, 14 bp, Homo sapiens
cctccttcccatgc

SEQ ID NO: 6099447 - DNA, 12 bp, Homo sapiens
cctccttcccca

SEQ ID NO: 6099448 - DNA, 18 bp, Homo sapiens
cctccttccccaccccat

SEQ ID NO: 6099449 - DNA, 14 bp, Homo sapiens
cctccttcccccca

SEQ ID NO: 6099450 - DNA, 23 bp, Homo sapiens
cctccttccccccatctctgagt

SEQ ID NO: 6099451 - DNA, 13 bp, Homo sapiens
cctccttcccctg

SEQ ID NO: 6099452 - DNA, 14 bp, Homo sapiens
cctccttccctcac

SEQ ID NO: 6099453 - DNA, 22 bp, Homo sapiens
cctccttccctcacccccagca

SEQ ID NO: 6099454 - DNA, 14 bp, Homo sapiens
cctccttccctcct

SEQ ID NO: 6099455 - DNA, 16 bp, Homo sapiens
cctccttccctcctgt

SEQ ID NO: 6099456 - DNA, 12 bp, Homo sapiens
cctccttcctcc

SEQ ID NO: 6099457 - DNA, 23 bp, Homo sapiens
cctccttcctcttttccttccca

SEQ ID NO: 6099458 - DNA, 12 bp, Homo sapiens
cctccttcctgg

SEQ ID NO: 6099459 - DNA, 14 bp, Homo sapiens
cctccttccttgac

SEQ ID NO: 6099460 - DNA, 18 bp, Homo sapiens
cctccttccttgaccagc

SEQ ID NO: 6099461 - DNA, 13 bp, Homo sapiens
cctccttcctttt

SEQ ID NO: 6099462 - DNA, 15 bp, Homo sapiens
cctccttctcccctc

SEQ ID NO: 6099463 - DNA, 23 bp, Homo sapiens
cctccttctctgtctcatgtgtg

SEQ ID NO: 6099464 - DNA, 20 bp, Homo sapiens
cctccttctgagctcctgtc

SEQ ID NO: 6099465 - DNA, 21 bp, Homo sapiens
cctccttctgagctcctgtcc

SEQ ID NO: 6099466 - DNA, 21 bp, Homo sapiens
cctccttctgcagtcagactg

SEQ ID NO: 6099467 - DNA, 14 bp, Homo sapiens
cctccttctgctgc

SEQ ID NO: 6099468 - DNA, 18 bp, Homo sapiens
cctccttcttcagggact

SEQ ID NO: 6099469 - DNA, 14 bp, Homo sapiens
cctccttcttccac

SEQ ID NO: 6099470 - DNA, 16 bp, Homo sapiens
cctccttcttgccctg

SEQ ID NO: 6099471 - DNA, 16 bp, Homo sapiens
cctccttgagactgga

SEQ ID NO: 6099472 - DNA, 15 bp, Homo sapiens
cctccttgcaaccag

SEQ ID NO: 6099473 - DNA, 18 bp, Homo sapiens
cctccttgcaaccaggca

SEQ ID NO: 6099474 - DNA, 15 bp, Homo sapiens
cctccttgccagccc

SEQ ID NO: 6099475 - DNA, 14 bp, Homo sapiens
cctccttgccgctg

SEQ ID NO: 6099476 - DNA, 20 bp, Homo sapiens
cctccttgccgctgggagag

SEQ ID NO: 6099477 - DNA, 17 bp, Homo sapiens
cctccttgcctcctgtg

SEQ ID NO: 6099478 - DNA, 18 bp, Homo sapiens
cctccttgcctcctgtgt

SEQ ID NO: 6099479 - DNA, 14 bp, Homo sapiens
cctccttgcctgga

SEQ ID NO: 6099480 - DNA, 22 bp, Homo sapiens
cctccttgctgaccccaggtca

SEQ ID NO: 6099481 - DNA, 21 bp, Homo sapiens
cctccttggctttatgcaaat

SEQ ID NO: 6099482 - DNA, 23 bp, Homo sapiens
cctccttggctttatgcaaatac

SEQ ID NO: 6099483 - DNA, 12 bp, Homo sapiens
cctccttgggca

SEQ ID NO: 6099484 - DNA, 16 bp, Homo sapiens
cctccttggtgattcc

SEQ ID NO: 6099485 - DNA, 15 bp, Homo sapiens
cctccttggtgcctc

SEQ ID NO: 6099486 - DNA, 17 bp, Homo sapiens
cctccttggtgcctggc

SEQ ID NO: 6099487 - DNA, 15 bp, Homo sapiens
cctccttgtccaccc

SEQ ID NO: 6099488 - DNA, 14 bp, Homo sapiens
cctccttgtccagg

SEQ ID NO: 6099489 - DNA, 17 bp, Homo sapiens
cctccttgtccaggtct

SEQ ID NO: 6099490 - DNA, 20 bp, Homo sapiens
cctccttgtcttggcagcct

SEQ ID NO: 6099491 - DNA, 18 bp, Homo sapiens
cctccttgtgccttcttt

SEQ ID NO: 6099492 - DNA, 16 bp, Homo sapiens
cctcctttaccctcat

SEQ ID NO: 6099493 - DNA, 19 bp, Homo sapiens
cctcctttaccctcatctg

SEQ ID NO: 6099494 - DNA, 18 bp, Homo sapiens
cctcctttaccgaggaca

SEQ ID NO: 6099495 - DNA, 16 bp, Homo sapiens
cctcctttcagttcgt

SEQ ID NO: 6099496 - DNA, 19 bp, Homo sapiens
cctcctttcccctttctct

SEQ ID NO: 6099497 - DNA, 18 bp, Homo sapiens
cctcctttcccttattgc

SEQ ID NO: 6099498 - DNA, 21 bp, Homo sapiens
cctcctttcctcctctgactt

SEQ ID NO: 6099499 - DNA, 22 bp, Homo sapiens
cctcctttcctttgcccttacc

SEQ ID NO: 6099500 - DNA, 14 bp, Homo sapiens
cctcctttctcctc

SEQ ID NO: 6099501 - DNA, 13 bp, Homo sapiens
cctcctttctctg

SEQ ID NO: 6099502 - DNA, 15 bp, Homo sapiens
cctcctttctggctt

SEQ ID NO: 6099503 - DNA, 18 bp, Homo sapiens
cctcctttctgtgcccta

SEQ ID NO: 6099504 - DNA, 21 bp, Homo sapiens
cctcctttcttattctgtgag

SEQ ID NO: 6099505 - DNA, 22 bp, Homo sapiens
cctcctttctttgctgtttgca

SEQ ID NO: 6099506 - DNA, 16 bp, Homo sapiens
cctcctttgtaaacca

SEQ ID NO: 6099507 - DNA, 23 bp, Homo sapiens
cctcctttgtcttttttttcatc

SEQ ID NO: 6099508 - DNA, 18 bp, Homo sapiens
cctcctttgtgaggaagc

SEQ ID NO: 6099509 - DNA, 18 bp, Homo sapiens
cctccttttcacagttct

SEQ ID NO: 6099510 - DNA, 21 bp, Homo sapiens
cctccttttcttctagctttg

SEQ ID NO: 6099511 - DNA, 10 bp, Homo sapiens
cctccttttt

SEQ ID NO: 6099512 - DNA, 13 bp, Homo sapiens
cctcctttttatt

SEQ ID NO: 6099513 - DNA, 13 bp, Homo sapiens
cctcctttttcca

SEQ ID NO: 6099514 - DNA, 21 bp, Homo sapiens
cctcctttttccatgccctaa

SEQ ID NO: 6099515 - DNA, 20 bp, Homo sapiens
cctcgaaacacagaaacctt

SEQ ID NO: 6099516 - DNA, 16 bp, Homo sapiens
cgccggggctggccct

SEQ ID NO: 6099517 - DNA, 18 bp, Homo sapiens
cgccggggctggccctgc

SEQ ID NO: 6099518 - DNA, 22 bp, Homo sapiens
cgccggggctggccctgccctc

SEQ ID NO: 6099519 - DNA, 22 bp, Homo sapiens
cgccggggtcctgggaggctgc

SEQ ID NO: 6099520 - DNA, 16 bp, Homo sapiens
cgccggttggccggct

SEQ ID NO: 6099521 - DNA, 20 bp, Homo sapiens
cgccggttggccggctggcc

SEQ ID NO: 6099522 - DNA, 14 bp, Homo sapiens
cgccgtaattcttt

SEQ ID NO: 6099523 - DNA, 17 bp, Homo sapiens
cgccgtaattctttctg

SEQ ID NO: 6099524 - DNA, 21 bp, Homo sapiens
cgccgtaattctttctgtctc

SEQ ID NO: 6099525 - DNA, 16 bp, Homo sapiens
cgccgtccctcccagg

SEQ ID NO: 6099526 - DNA, 13 bp, Homo sapiens
cgccgtccggcgg

SEQ ID NO: 6099527 - DNA, 18 bp, Homo sapiens
cgccgtgagttctcaggg

SEQ ID NO: 6099528 - DNA, 22 bp, Homo sapiens
cgccgtgagttctcagggctcc

SEQ ID NO: 6099529 - DNA, 23 bp, Homo sapiens
cgccgtgagttctcagggctcct

SEQ ID NO: 6099530 - DNA, 22 bp, Homo sapiens
cgccgtgccggcggcagcccca

SEQ ID NO: 6099531 - DNA, 12 bp, Homo sapiens
cgccgtgcctgc

SEQ ID NO: 6099532 - DNA, 14 bp, Homo sapiens
cgccgtgctgggca

SEQ ID NO: 6099533 - DNA, 19 bp, Homo sapiens
cgccgtgctgggcagcccg

SEQ ID NO: 6099534 - DNA, 16 bp, Homo sapiens
cgccgtgctgtaaata

SEQ ID NO: 6099535 - DNA, 22 bp, Homo sapiens
cgccgtggtgacccctgctttg

SEQ ID NO: 6099536 - DNA, 18 bp, Homo sapiens
cgccgtgtctgtggccct

SEQ ID NO: 6099537 - DNA, 19 bp, Homo sapiens
cgccgtgtctgtggccctc

SEQ ID NO: 6099538 - DNA, 21 bp, Homo sapiens
cgccgtgtctgtggccctctc

SEQ ID NO: 6099539 - DNA, 14 bp, Homo sapiens
cgccgtgtttcctc

SEQ ID NO: 6099540 - DNA, 18 bp, Homo sapiens
cgcctaaggtcacagcta

SEQ ID NO: 6099541 - DNA, 21 bp, Homo sapiens
cgcctagagcgcggctggctc

SEQ ID NO: 6099542 - DNA, 17 bp, Homo sapiens
cgcctagaggtcccctc

SEQ ID NO: 6099543 - DNA, 15 bp, Homo sapiens
cgcctaggatttcag

SEQ ID NO: 6099544 - DNA, 18 bp, Homo sapiens
cgcctataatcccagcta

SEQ ID NO: 6099545 - DNA, 14 bp, Homo sapiens
cgcctatcttaggt

SEQ ID NO: 6099546 - DNA, 14 bp, Homo sapiens
cgcctatgccctgc

SEQ ID NO: 6099547 - DNA, 16 bp, Homo sapiens
cgcctatgccctgccc

SEQ ID NO: 6099548 - DNA, 13 bp, Homo sapiens
cgcctcaaaatgt

SEQ ID NO: 6099549 - DNA, 18 bp, Homo sapiens
cgcctcaaggaagagcca

SEQ ID NO: 6099550 - DNA, 20 bp, Homo sapiens
cgcctcaaggaagagccagc

SEQ ID NO: 6099551 - DNA, 21 bp, Homo sapiens
cgcctcaaggaagagccagcc

SEQ ID NO: 6099552 - DNA, 15 bp, Homo sapiens
cgcctcacctgcatc

SEQ ID NO: 6099553 - DNA, 21 bp, Homo sapiens
cgcctcacctgcatcctctcc

SEQ ID NO: 6099554 - DNA, 16 bp, Homo sapiens
cgcctcaccttccttg

SEQ ID NO: 6099555 - DNA, 21 bp, Homo sapiens
cgcctcactgcaaccttcacc

SEQ ID NO: 6099556 - DNA, 15 bp, Homo sapiens
cgcctcagccctcag

SEQ ID NO: 6099557 - DNA, 12 bp, Homo sapiens
cgcctcagcctc

SEQ ID NO: 6099558 - DNA, 13 bp, Homo sapiens
cgcctcagcctga

SEQ ID NO: 6099559 - DNA, 21 bp, Homo sapiens
cgcctcagcctgatcaggctt

SEQ ID NO: 6099560 - DNA, 17 bp, Homo sapiens
cgcctcaggaatgggct

SEQ ID NO: 6099561 - DNA, 18 bp, Homo sapiens
cgcctcagggccaggccc

SEQ ID NO: 6099562 - DNA, 16 bp, Homo sapiens
cgcctcattactgtga

SEQ ID NO: 6099563 - DNA, 16 bp, Homo sapiens
cgcctccaaccctagc

SEQ ID NO: 6099564 - DNA, 17 bp, Homo sapiens
cgcctccaaccctagca

SEQ ID NO: 6099565 - DNA, 21 bp, Homo sapiens
cgcctccactctagttctaga

SEQ ID NO: 6099566 - DNA, 11 bp, Homo sapiens
cgcctccagga

SEQ ID NO: 6099567 - DNA, 19 bp, Homo sapiens
cgcctccaggagcctaccc

SEQ ID NO: 6099568 - DNA, 18 bp, Homo sapiens
cgcctccatccaaggcca

SEQ ID NO: 6099569 - DNA, 14 bp, Homo sapiens
cgcctccatccaca

SEQ ID NO: 6099570 - DNA, 15 bp, Homo sapiens
cgcctcccacggcac

SEQ ID NO: 6099571 - DNA, 15 bp, Homo sapiens
cgcctcccagcctgg

SEQ ID NO: 6099572 - DNA, 12 bp, Homo sapiens
cgcctccccacc

SEQ ID NO: 6099573 - DNA, 24 bp, Homo sapiens
cgcctccccacggccgctccaggg

SEQ ID NO: 6099574 - DNA, 19 bp, Homo sapiens
cgcctccccatacttcctg

SEQ ID NO: 6099575 - DNA, 15 bp, Homo sapiens
cgcctcccccgcagg

SEQ ID NO: 6099576 - DNA, 22 bp, Homo sapiens
cgcctccccctcccccattccc

SEQ ID NO: 6099577 - DNA, 20 bp, Homo sapiens
cgcctcccgccaccctgtct

SEQ ID NO: 6099578 - DNA, 15 bp, Homo sapiens
cgcctcccgccgcct

SEQ ID NO: 6099579 - DNA, 16 bp, Homo sapiens
cgcctcccgccgcctc

SEQ ID NO: 6099580 - DNA, 22 bp, Homo sapiens
cgcctccctagttagcatccag

SEQ ID NO: 6099581 - DNA, 15 bp, Homo sapiens
cgcctccctccaccc

SEQ ID NO: 6099582 - DNA, 18 bp, Homo sapiens
cgcctccctccaccccag

SEQ ID NO: 6099583 - DNA, 23 bp, Homo sapiens
cgcctcccttatgcaggacatgt

SEQ ID NO: 6099584 - DNA, 14 bp, Homo sapiens
cgcctccgcccaaa

SEQ ID NO: 6099585 - DNA, 14 bp, Homo sapiens
cgcctcctactctg

SEQ ID NO: 6099586 - DNA, 10 bp, Homo sapiens
cgcctcctcc

SEQ ID NO: 6099587 - DNA, 15 bp, Homo sapiens
cgcctcctccagact

SEQ ID NO: 6099588 - DNA, 14 bp, Homo sapiens
cgcctcctccagct

SEQ ID NO: 6099589 - DNA, 16 bp, Homo sapiens
cgcctcctccagctcc

SEQ ID NO: 6099590 - DNA, 17 bp, Homo sapiens
cgcctcctccagctcct

SEQ ID NO: 6099591 - DNA, 22 bp, Homo sapiens
cgcctcctccagctcctgcccc

SEQ ID NO: 6099592 - DNA, 17 bp, Homo sapiens
cgcctcctcccactggg

SEQ ID NO: 6099593 - DNA, 17 bp, Homo sapiens
cgcctcctccctgcctg

SEQ ID NO: 6099594 - DNA, 14 bp, Homo sapiens
cgcctcctcctgca

SEQ ID NO: 6099595 - DNA, 21 bp, Homo sapiens
cgcctcctcggggctccaggc

SEQ ID NO: 6099596 - DNA, 13 bp, Homo sapiens
cgcctcctggcca

SEQ ID NO: 6099597 - DNA, 14 bp, Homo sapiens
cgcctcctggccag

SEQ ID NO: 6099598 - DNA, 22 bp, Homo sapiens
cgcctcgcccaccgcatgcccc

SEQ ID NO: 6099599 - DNA, 20 bp, Homo sapiens
cgcctcggagtgtggcctgg

SEQ ID NO: 6099600 - DNA, 17 bp, Homo sapiens
cgcctcggatcagctga

SEQ ID NO: 6099601 - DNA, 17 bp, Homo sapiens
cgcctcgggccgcctcc

SEQ ID NO: 6099602 - DNA, 18 bp, Homo sapiens
cgcctcgtgccagcagcc

SEQ ID NO: 6099603 - DNA, 19 bp, Homo sapiens
cgcctcgtgccagcagcct

SEQ ID NO: 6099604 - DNA, 18 bp, Homo sapiens
cgcctctcactctggcag

SEQ ID NO: 6099605 - DNA, 12 bp, Homo sapiens
cgcctctcccac

SEQ ID NO: 6099606 - DNA, 18 bp, Homo sapiens
cgcctctccccaccttct

SEQ ID NO: 6099607 - DNA, 15 bp, Homo sapiens
cgcctctcctcggtt

SEQ ID NO: 6099608 - DNA, 13 bp, Homo sapiens
cgcctctctcagc

SEQ ID NO: 6099609 - DNA, 23 bp, Homo sapiens
cgcctctctcagcccaggtctcc

SEQ ID NO: 6099610 - DNA, 21 bp, Homo sapiens
cgcctctgagccaggagcctc

SEQ ID NO: 6099611 - DNA, 22 bp, Homo sapiens
cgcctctgcaagggcagaacac

SEQ ID NO: 6099612 - DNA, 13 bp, Homo sapiens
cgcctctgcattc

SEQ ID NO: 6099613 - DNA, 13 bp, Homo sapiens
cgcctctgcctcc

SEQ ID NO: 6099614 - DNA, 14 bp, Homo sapiens
cgcctctggagccg

SEQ ID NO: 6099615 - DNA, 13 bp, Homo sapiens
cgcctctggccgc

SEQ ID NO: 6099616 - DNA, 18 bp, Homo sapiens
cgcctctggccgccaccc

SEQ ID NO: 6099617 - DNA, 21 bp, Homo sapiens
cgcctctgggctcacaccagc

SEQ ID NO: 6099618 - DNA, 16 bp, Homo sapiens
cgcctcttcctctggg

SEQ ID NO: 6099619 - DNA, 19 bp, Homo sapiens
cgcctcttcttcttcagaa

SEQ ID NO: 6099620 - DNA, 13 bp, Homo sapiens
cgcctgaaacttt

SEQ ID NO: 6099621 - DNA, 16 bp, Homo sapiens
cgcctgaaagccacaa

SEQ ID NO: 6099622 - DNA, 17 bp, Homo sapiens
cgcctgaaggcacagct

SEQ ID NO: 6099623 - DNA, 23 bp, Homo sapiens
cgcctgacaaccactggtctgta

SEQ ID NO: 6099624 - DNA, 16 bp, Homo sapiens
cgcctgagacagcacc

SEQ ID NO: 6099625 - DNA, 17 bp, Homo sapiens
cgcctgagacagcacca

SEQ ID NO: 6099626 - DNA, 18 bp, Homo sapiens
cgcctgagacagcaccac

SEQ ID NO: 6099627 - DNA, 13 bp, Homo sapiens
cgcctgagcccag

SEQ ID NO: 6099628 - DNA, 16 bp, Homo sapiens
cgcctgagcccaggga

SEQ ID NO: 6099629 - DNA, 18 bp, Homo sapiens
cgcctgagcccagggagg

SEQ ID NO: 6099630 - DNA, 21 bp, Homo sapiens
cgcctgagcccagggaggccg

SEQ ID NO: 6099631 - DNA, 14 bp, Homo sapiens
cgcctgagggaaga

SEQ ID NO: 6099632 - DNA, 15 bp, Homo sapiens
cgcctgagtcagtgc

SEQ ID NO: 6099633 - DNA, 21 bp, Homo sapiens
cgcctgagtcagtgctctcag

SEQ ID NO: 6099634 - DNA, 17 bp, Homo sapiens
cgcctgatggtgctgct

SEQ ID NO: 6099635 - DNA, 16 bp, Homo sapiens
cgcctgattggggcct

SEQ ID NO: 6099636 - DNA, 21 bp, Homo sapiens
cgcctgattggggcctcaccc

SEQ ID NO: 6099637 - DNA, 19 bp, Homo sapiens
cgcctgcaaacgctgcctg

SEQ ID NO: 6099638 - DNA, 21 bp, Homo sapiens
cgcctgcaaacgctgcctgcc

SEQ ID NO: 6099639 - DNA, 22 bp, Homo sapiens
cgcctgcaaacgctgcctgccc

SEQ ID NO: 6099640 - DNA, 22 bp, Homo sapiens
cgcctgcactcctcagggcagc

SEQ ID NO: 6099641 - DNA, 14 bp, Homo sapiens
cgcctgcagaggac

SEQ ID NO: 6099642 - DNA, 23 bp, Homo sapiens
cgcctgcaggcagagctggagcc

SEQ ID NO: 6099643 - DNA, 11 bp, Homo sapiens
cgcctgccacc

SEQ ID NO: 6099644 - DNA, 18 bp, Homo sapiens
cgcctgccacctctccca

SEQ ID NO: 6099645 - DNA, 20 bp, Homo sapiens
cgcctgccacctctcccagc

SEQ ID NO: 6099646 - DNA, 22 bp, Homo sapiens
cgcctgccataccgctggggaa

SEQ ID NO: 6099647 - DNA, 14 bp, Homo sapiens
cgcctgccatcttc

SEQ ID NO: 6099648 - DNA, 21 bp, Homo sapiens
cgcctgcccacctgcctggcc

SEQ ID NO: 6099649 - DNA, 14 bp, Homo sapiens
cgcctgcccagcct

SEQ ID NO: 6099650 - DNA, 12 bp, Homo sapiens
cgcctgccccca

SEQ ID NO: 6099651 - DNA, 12 bp, Homo sapiens
cgcctgcccgcc

SEQ ID NO: 6099652 - DNA, 14 bp, Homo sapiens
cgcctgccctccca

SEQ ID NO: 6099653 - DNA, 21 bp, Homo sapiens
cgcctgccctcccgcaccttc

SEQ ID NO: 6099654 - DNA, 16 bp, Homo sapiens
cgcctgccctcctctc

SEQ ID NO: 6099655 - DNA, 17 bp, Homo sapiens
cgcctgccctcctctcc

SEQ ID NO: 6099656 - DNA, 14 bp, Homo sapiens
cgcctgccctgccc

SEQ ID NO: 6099657 - DNA, 15 bp, Homo sapiens
cgcctgccctgcctg

SEQ ID NO: 6099658 - DNA, 17 bp, Homo sapiens
cgcctgccgtgcatggc

SEQ ID NO: 6099659 - DNA, 15 bp, Homo sapiens
cgcctgcctctgcct

SEQ ID NO: 6099660 - DNA, 12 bp, Homo sapiens
cgcctgcctgca

SEQ ID NO: 6099661 - DNA, 18 bp, Homo sapiens
cgcctgcctgccaccctg

SEQ ID NO: 6099662 - DNA, 16 bp, Homo sapiens
cgcctgccttctgggc

SEQ ID NO: 6099663 - DNA, 15 bp, Homo sapiens
cgcctgccttttcta

SEQ ID NO: 6099664 - DNA, 18 bp, Homo sapiens
cgcctgcgccccccagtg

SEQ ID NO: 6099665 - DNA, 18 bp, Homo sapiens
cgcctgcgcctccatcca

SEQ ID NO: 6099666 - DNA, 20 bp, Homo sapiens
cgcctgcgcctcctcctgca

SEQ ID NO: 6099667 - DNA, 14 bp, Homo sapiens
cgcctgcgctcctc

SEQ ID NO: 6099668 - DNA, 16 bp, Homo sapiens
cgcctgcgctcctctg

SEQ ID NO: 6099669 - DNA, 17 bp, Homo sapiens
cgcctgcgctcctctgc

SEQ ID NO: 6099670 - DNA, 14 bp, Homo sapiens
cgcctgcggactcc

SEQ ID NO: 6099671 - DNA, 16 bp, Homo sapiens
cgcctgcggactccat

SEQ ID NO: 6099672 - DNA, 17 bp, Homo sapiens
cgcctgcggactccatg

SEQ ID NO: 6099673 - DNA, 14 bp, Homo sapiens
cgcctgctacacag

SEQ ID NO: 6099674 - DNA, 15 bp, Homo sapiens
cgcctgctacacagg

SEQ ID NO: 6099675 - DNA, 16 bp, Homo sapiens
cgcctgctcctcactg

SEQ ID NO: 6099676 - DNA, 23 bp, Homo sapiens
cgcctgctcctcactggaggagc

SEQ ID NO: 6099677 - DNA, 13 bp, Homo sapiens
cgcctgcttcaca

SEQ ID NO: 6099678 - DNA, 14 bp, Homo sapiens
cgcctgcttcacac

SEQ ID NO: 6099679 - DNA, 14 bp, Homo sapiens
cgcctggagccctc

SEQ ID NO: 6099680 - DNA, 19 bp, Homo sapiens
cgcctggagggatgccccc

SEQ ID NO: 6099681 - DNA, 16 bp, Homo sapiens
cgcctggatttctggt

SEQ ID NO: 6099682 - DNA, 20 bp, Homo sapiens
cgcctggatttctggttctg

SEQ ID NO: 6099683 - DNA, 18 bp, Homo sapiens
cgcctggccaggagcagg

SEQ ID NO: 6099684 - DNA, 18 bp, Homo sapiens
cgcctggccagggcaggg

SEQ ID NO: 6099685 - DNA, 12 bp, Homo sapiens
cgcctggcccgg

SEQ ID NO: 6099686 - DNA, 17 bp, Homo sapiens
cgcctggccggctccag

SEQ ID NO: 6099687 - DNA, 22 bp, Homo sapiens
cgcctggccggctccagtttcc

SEQ ID NO: 6099688 - DNA, 11 bp, Homo sapiens
cgcctggcctc

SEQ ID NO: 6099689 - DNA, 13 bp, Homo sapiens
cgcctggcctcca

SEQ ID NO: 6099690 - DNA, 20 bp, Homo sapiens
cgcctggcctccaggcccgt

SEQ ID NO: 6099691 - DNA, 12 bp, Homo sapiens
cgcctggcctga

SEQ ID NO: 6099692 - DNA, 13 bp, Homo sapiens
cgcctggccttgt

SEQ ID NO: 6099693 - DNA, 15 bp, Homo sapiens
cgcctggctgctgct

SEQ ID NO: 6099694 - DNA, 20 bp, Homo sapiens
cgcctgggaaattgctccat

SEQ ID NO: 6099695 - DNA, 10 bp, Homo sapiens
cgcctgggat

SEQ ID NO: 6099696 - DNA, 17 bp, Homo sapiens
cgcctgggcaccgggac

SEQ ID NO: 6099697 - DNA, 14 bp, Homo sapiens
cctcgaaagtgtca

SEQ ID NO: 6099698 - DNA, 16 bp, Homo sapiens
cctcgaaccaaggcag

SEQ ID NO: 6099699 - DNA, 21 bp, Homo sapiens
cctcgaacccacactgcaaca

SEQ ID NO: 6099700 - DNA, 14 bp, Homo sapiens
cctcgaacccactc

SEQ ID NO: 6099701 - DNA, 13 bp, Homo sapiens
cctcgaagccatg

SEQ ID NO: 6099702 - DNA, 21 bp, Homo sapiens
cctcgaatgtgtgggcccaag

SEQ ID NO: 6099703 - DNA, 18 bp, Homo sapiens
cctcgaattctcagacga

SEQ ID NO: 6099704 - DNA, 22 bp, Homo sapiens
cctcgaattttatctgtggagt

SEQ ID NO: 6099705 - DNA, 17 bp, Homo sapiens
cctcgacagggcctgga

SEQ ID NO: 6099706 - DNA, 19 bp, Homo sapiens
cctcgacagggcctggagc

SEQ ID NO: 6099707 - DNA, 14 bp, Homo sapiens
cctcgaccaccccc

SEQ ID NO: 6099708 - DNA, 20 bp, Homo sapiens
cctcgacttgaccctttcct

SEQ ID NO: 6099709 - DNA, 12 bp, Homo sapiens
cctcgagaggca

SEQ ID NO: 6099710 - DNA, 20 bp, Homo sapiens
cctcgagccatagagcctga

SEQ ID NO: 6099711 - DNA, 20 bp, Homo sapiens
cctcgagccctcccccaaac

SEQ ID NO: 6099712 - DNA, 20 bp, Homo sapiens
cctcgagctctgtagcctgg

SEQ ID NO: 6099713 - DNA, 23 bp, Homo sapiens
cctcgagctctgtagcctggtct

SEQ ID NO: 6099714 - DNA, 18 bp, Homo sapiens
cctcgaggaactccagga

SEQ ID NO: 6099715 - DNA, 24 bp, Homo sapiens
cctcgaggaactccaggacgagga

SEQ ID NO: 6099716 - DNA, 12 bp, Homo sapiens
cctcgaggcacc

SEQ ID NO: 6099717 - DNA, 20 bp, Homo sapiens
cctcgaggcaccggcgctgc

SEQ ID NO: 6099718 - DNA, 19 bp, Homo sapiens
cctcgaggctcttccatcc

SEQ ID NO: 6099719 - DNA, 16 bp, Homo sapiens
cctcgagggcagggac

SEQ ID NO: 6099720 - DNA, 17 bp, Homo sapiens
cctcgagggcagggact

SEQ ID NO: 6099721 - DNA, 17 bp, Homo sapiens
cctcgagggccgcctgc

SEQ ID NO: 6099722 - DNA, 20 bp, Homo sapiens
cctcgagggccgcctgcctt

SEQ ID NO: 6099723 - DNA, 23 bp, Homo sapiens
cctcgaggggcccagggaagcct

SEQ ID NO: 6099724 - DNA, 18 bp, Homo sapiens
cctcgaggggcctcccgg

SEQ ID NO: 6099725 - DNA, 18 bp, Homo sapiens
cctcgaggtgccttcttc

SEQ ID NO: 6099726 - DNA, 19 bp, Homo sapiens
cctcgagtactgtgggcaa

SEQ ID NO: 6099727 - DNA, 16 bp, Homo sapiens
cctcgagtccccccac

SEQ ID NO: 6099728 - DNA, 22 bp, Homo sapiens
cctcgagtggcgagtccagaca

SEQ ID NO: 6099729 - DNA, 19 bp, Homo sapiens
cctcgatgtcctcctctgt

SEQ ID NO: 6099730 - DNA, 20 bp, Homo sapiens
cctcgatgtcctcctctgtg

SEQ ID NO: 6099731 - DNA, 15 bp, Homo sapiens
cctcgcaaccctgcc

SEQ ID NO: 6099732 - DNA, 21 bp, Homo sapiens
cctcgcaactgtccacgcgtg

SEQ ID NO: 6099733 - DNA, 14 bp, Homo sapiens
cctcgcacacaggg

SEQ ID NO: 6099734 - DNA, 22 bp, Homo sapiens
cctcgcacacagggctcacagg

SEQ ID NO: 6099735 - DNA, 23 bp, Homo sapiens
cctcgcacacagggctcacaggg

SEQ ID NO: 6099736 - DNA, 12 bp, Homo sapiens
cctcgcacaggc

SEQ ID NO: 6099737 - DNA, 13 bp, Homo sapiens
cctcgcacaggcc

SEQ ID NO: 6099738 - DNA, 20 bp, Homo sapiens
cctcgcacaggccctagctt

SEQ ID NO: 6099739 - DNA, 22 bp, Homo sapiens
cctcgcacagggcatgcctggc

SEQ ID NO: 6099740 - DNA, 19 bp, Homo sapiens
cctcgcacttgcagaggag

SEQ ID NO: 6099741 - DNA, 19 bp, Homo sapiens
cctcgcaggtctcagcccg

SEQ ID NO: 6099742 - DNA, 22 bp, Homo sapiens
cctcgcaggtctcagcccggga

SEQ ID NO: 6099743 - DNA, 18 bp, Homo sapiens
cctcgcatgccagagcct

SEQ ID NO: 6099744 - DNA, 17 bp, Homo sapiens
cctcgccacggggaggg

SEQ ID NO: 6099745 - DNA, 14 bp, Homo sapiens
cctcgccagcttct

SEQ ID NO: 6099746 - DNA, 15 bp, Homo sapiens
cctcgccagcttggc

SEQ ID NO: 6099747 - DNA, 19 bp, Homo sapiens
cctcgcccaccgcatgccc

SEQ ID NO: 6099748 - DNA, 12 bp, Homo sapiens
cctcgcccagtc

SEQ ID NO: 6099749 - DNA, 19 bp, Homo sapiens
cctcgcccagtcccagcag

SEQ ID NO: 6099750 - DNA, 14 bp, Homo sapiens
cctcgccccaaagt

SEQ ID NO: 6099751 - DNA, 22 bp, Homo sapiens
cctcgccccaaggttccagagg

SEQ ID NO: 6099752 - DNA, 12 bp, Homo sapiens
cctcgccccagc

SEQ ID NO: 6099753 - DNA, 14 bp, Homo sapiens
cctcgccccagcct

SEQ ID NO: 6099754 - DNA, 15 bp, Homo sapiens
cctcgccccagcctc

SEQ ID NO: 6099755 - DNA, 21 bp, Homo sapiens
cctcgccccagcctcattccc

SEQ ID NO: 6099756 - DNA, 20 bp, Homo sapiens
cctcgcccccaccagtgtag

SEQ ID NO: 6099757 - DNA, 22 bp, Homo sapiens
cctcgccccccgcccggcctcc

SEQ ID NO: 6099758 - DNA, 16 bp, Homo sapiens
cctcgcccctggcaga

SEQ ID NO: 6099759 - DNA, 18 bp, Homo sapiens
cctcgccctctcctttgt

SEQ ID NO: 6099760 - DNA, 15 bp, Homo sapiens
cctcgccctctctca

SEQ ID NO: 6099761 - DNA, 20 bp, Homo sapiens
cctcgccctctctcaccagc

SEQ ID NO: 6099762 - DNA, 22 bp, Homo sapiens
cctcgccctctctcaccagcct

SEQ ID NO: 6099763 - DNA, 23 bp, Homo sapiens
cctcgccctctctcaccagcctt

SEQ ID NO: 6099764 - DNA, 14 bp, Homo sapiens
cctcgccctgggtc

SEQ ID NO: 6099765 - DNA, 13 bp, Homo sapiens
cctcgccctgtcc

SEQ ID NO: 6099766 - DNA, 18 bp, Homo sapiens
cctcgccctgtccctccc

SEQ ID NO: 6099767 - DNA, 17 bp, Homo sapiens
cctcgcccttcagccca

SEQ ID NO: 6099768 - DNA, 22 bp, Homo sapiens
cctcgccggaccctctaacctc

SEQ ID NO: 6099769 - DNA, 18 bp, Homo sapiens
cctcgccggatctgaggg

SEQ ID NO: 6099770 - DNA, 16 bp, Homo sapiens
cctcgccgtccctccc

SEQ ID NO: 6099771 - DNA, 19 bp, Homo sapiens
cctcgccgtccctcccagg

SEQ ID NO: 6099772 - DNA, 21 bp, Homo sapiens
cctcgcctaccaatctctgct

SEQ ID NO: 6099773 - DNA, 16 bp, Homo sapiens
cctcgcctaggcctgt

SEQ ID NO: 6099774 - DNA, 14 bp, Homo sapiens
cctcgcctccccac

SEQ ID NO: 6099775 - DNA, 14 bp, Homo sapiens
cctcgcctcctact

SEQ ID NO: 6099776 - DNA, 14 bp, Homo sapiens
cctcgcctctccca

SEQ ID NO: 6099777 - DNA, 13 bp, Homo sapiens
cctcgcctgacaa

SEQ ID NO: 6099778 - DNA, 16 bp, Homo sapiens
cctcgcctgccctcct

SEQ ID NO: 6099779 - DNA, 18 bp, Homo sapiens
cctcgcctgccctcctct

SEQ ID NO: 6099780 - DNA, 20 bp, Homo sapiens
cctcgcctgccctcctctcc

SEQ ID NO: 6099781 - DNA, 12 bp, Homo sapiens
cctcgcctggcc

SEQ ID NO: 6099782 - DNA, 12 bp, Homo sapiens
cctcgcctgggc

SEQ ID NO: 6099783 - DNA, 13 bp, Homo sapiens
cctcgcctgggcc

SEQ ID NO: 6099784 - DNA, 19 bp, Homo sapiens
cctcgcctgggcccaggct

SEQ ID NO: 6099785 - DNA, 23 bp, Homo sapiens
cctcgcctgggcccaggctctgg

SEQ ID NO: 6099786 - DNA, 14 bp, Homo sapiens
cctcgcctgtcacc

SEQ ID NO: 6099787 - DNA, 17 bp, Homo sapiens
cctcgccttcaggagaa

SEQ ID NO: 6099788 - DNA, 19 bp, Homo sapiens
cctcgccttttaggctcag

SEQ ID NO: 6099789 - DNA, 15 bp, Homo sapiens
cctcgcgcccctgtc

SEQ ID NO: 6099790 - DNA, 16 bp, Homo sapiens
cctcgcgcccctgtcc

SEQ ID NO: 6099791 - DNA, 20 bp, Homo sapiens
cctcgcgcccctgtccatcc

SEQ ID NO: 6099792 - DNA, 18 bp, Homo sapiens
cctcgctcaccgctggcc

SEQ ID NO: 6099793 - DNA, 20 bp, Homo sapiens
cctcgctcagtcagtgcact

SEQ ID NO: 6099794 - DNA, 14 bp, Homo sapiens
cctcgctccaactc

SEQ ID NO: 6099795 - DNA, 17 bp, Homo sapiens
cctcgctccccactctg

SEQ ID NO: 6099796 - DNA, 19 bp, Homo sapiens
cctcgctccccactctgct

SEQ ID NO: 6099797 - DNA, 21 bp, Homo sapiens
cctcgctccccactctgctct

SEQ ID NO: 6099798 - DNA, 22 bp, Homo sapiens
cctcgctccccactctgctctg

SEQ ID NO: 6099799 - DNA, 23 bp, Homo sapiens
cctcgctccccactctgctctga

SEQ ID NO: 6099800 - DNA, 16 bp, Homo sapiens
cctcgctcccctctgg

SEQ ID NO: 6099801 - DNA, 17 bp, Homo sapiens
cctcgctcccctctgga

SEQ ID NO: 6099802 - DNA, 19 bp, Homo sapiens
cctcgctcccctctggaat

SEQ ID NO: 6099803 - DNA, 20 bp, Homo sapiens
cctcgctcccctctggaatc

SEQ ID NO: 6099804 - DNA, 14 bp, Homo sapiens
cctcgctcccttca

SEQ ID NO: 6099805 - DNA, 17 bp, Homo sapiens
cctcgctcctccttccc

SEQ ID NO: 6099806 - DNA, 15 bp, Homo sapiens
cctcgctctgttacc

SEQ ID NO: 6099807 - DNA, 21 bp, Homo sapiens
cctcgctctgttacccagggt

SEQ ID NO: 6099808 - DNA, 15 bp, Homo sapiens
cctcgctgccaccca

SEQ ID NO: 6099809 - DNA, 13 bp, Homo sapiens
cctcgctgcttct

SEQ ID NO: 6099810 - DNA, 17 bp, Homo sapiens
cctcgctggactctcag

SEQ ID NO: 6099811 - DNA, 18 bp, Homo sapiens
cctcgctggactctcagt

SEQ ID NO: 6099812 - DNA, 12 bp, Homo sapiens
cctcgctggccc

SEQ ID NO: 6099813 - DNA, 13 bp, Homo sapiens
cctcgctggcccc

SEQ ID NO: 6099814 - DNA, 14 bp, Homo sapiens
cctcgctggccccc

SEQ ID NO: 6099815 - DNA, 16 bp, Homo sapiens
cctcgctggcccccac

SEQ ID NO: 6099816 - DNA, 17 bp, Homo sapiens
cctcgctggcccccact

SEQ ID NO: 6099817 - DNA, 18 bp, Homo sapiens
cctcgctggcccccactg

SEQ ID NO: 6099818 - DNA, 14 bp, Homo sapiens
cctcgctgtcctgc

SEQ ID NO: 6099819 - DNA, 17 bp, Homo sapiens
cctcgctgtcctgctgt

SEQ ID NO: 6099820 - DNA, 13 bp, Homo sapiens
cctcgctgtgcca

SEQ ID NO: 6099821 - DNA, 14 bp, Homo sapiens
cctcgctgtgccac

SEQ ID NO: 6099822 - DNA, 16 bp, Homo sapiens
cctcgctgtgccacca

SEQ ID NO: 6099823 - DNA, 22 bp, Homo sapiens
cctcgctgtgccaccacccctc

SEQ ID NO: 6099824 - DNA, 19 bp, Homo sapiens
cctcgcttcataggcagag

SEQ ID NO: 6099825 - DNA, 14 bp, Homo sapiens
cctcgctttgaggt

SEQ ID NO: 6099826 - DNA, 15 bp, Homo sapiens
cctcgctttttcatc

SEQ ID NO: 6099827 - DNA, 21 bp, Homo sapiens
cctcgctttttcatccttctt

SEQ ID NO: 6099828 - DNA, 21 bp, Homo sapiens
cctcggaaccgctcacctaga

SEQ ID NO: 6099829 - DNA, 13 bp, Homo sapiens
cctcggaagagcc

SEQ ID NO: 6099830 - DNA, 22 bp, Homo sapiens
cctcggaagccgtctgactcca

SEQ ID NO: 6099831 - DNA, 19 bp, Homo sapiens
cctcggacagcccatctgc

SEQ ID NO: 6099832 - DNA, 22 bp, Homo sapiens
cctcggaccccactccggccct

SEQ ID NO: 6099833 - DNA, 13 bp, Homo sapiens
cctcggactccat

SEQ ID NO: 6099834 - DNA, 19 bp, Homo sapiens
cctcggacttagctgggag

SEQ ID NO: 6099835 - DNA, 23 bp, Homo sapiens
cctcggagacgggaccctgccca

SEQ ID NO: 6099836 - DNA, 14 bp, Homo sapiens
cctcggagagcagc

SEQ ID NO: 6099837 - DNA, 15 bp, Homo sapiens
cctcggagagcagca

SEQ ID NO: 6099838 - DNA, 16 bp, Homo sapiens
cctcggagccccccac

SEQ ID NO: 6099839 - DNA, 23 bp, Homo sapiens
cctcggagcctcatccgaggcag

SEQ ID NO: 6099840 - DNA, 17 bp, Homo sapiens
cctcggagctgccagcc

SEQ ID NO: 6099841 - DNA, 12 bp, Homo sapiens
cctcggagctgg

SEQ ID NO: 6099842 - DNA, 15 bp, Homo sapiens
cctcggagctggctg

SEQ ID NO: 6099843 - DNA, 18 bp, Homo sapiens
cctcggagctggctgtgc

SEQ ID NO: 6099844 - DNA, 14 bp, Homo sapiens
cctcggaggctcct

SEQ ID NO: 6099845 - DNA, 15 bp, Homo sapiens
cctcggaggctcctc

SEQ ID NO: 6099846 - DNA, 18 bp, Homo sapiens
cctcggaggtccagctgg

SEQ ID NO: 6099847 - DNA, 19 bp, Homo sapiens
cctcggaggtccagctggg

SEQ ID NO: 6099848 - DNA, 20 bp, Homo sapiens
cctcggaggtccagctgggc

SEQ ID NO: 6099849 - DNA, 16 bp, Homo sapiens
cctcggagtgtggcct

SEQ ID NO: 6099850 - DNA, 17 bp, Homo sapiens
cctcggagtgtggcctg

SEQ ID NO: 6099851 - DNA, 20 bp, Homo sapiens
cctcggagtgtggcctggat

SEQ ID NO: 6099852 - DNA, 16 bp, Homo sapiens
cctcggcacacactgt

SEQ ID NO: 6099853 - DNA, 18 bp, Homo sapiens
cctcggcaggcatggctg

SEQ ID NO: 6099854 - DNA, 21 bp, Homo sapiens
cctcggcattcacacacagcc

SEQ ID NO: 6099855 - DNA, 14 bp, Homo sapiens
cctcggccagagct

SEQ ID NO: 6099856 - DNA, 16 bp, Homo sapiens
cctcggccagagctcc

SEQ ID NO: 6099857 - DNA, 18 bp, Homo sapiens
cctcggccagagctccca

SEQ ID NO: 6099858 - DNA, 20 bp, Homo sapiens
cctcggccagagctcccagg

SEQ ID NO: 6099859 - DNA, 19 bp, Homo sapiens
cctcggcccatctgtccat

SEQ ID NO: 6099860 - DNA, 22 bp, Homo sapiens
cctcggcccatctgtccatcct

SEQ ID NO: 6099861 - DNA, 14 bp, Homo sapiens
cctcggcccctcac

SEQ ID NO: 6099862 - DNA, 18 bp, Homo sapiens
cctcggcccctcccacac

SEQ ID NO: 6099863 - DNA, 14 bp, Homo sapiens
cctcggccctccct

SEQ ID NO: 6099864 - DNA, 22 bp, Homo sapiens
cctcggccctgtagccctggcc

SEQ ID NO: 6099865 - DNA, 17 bp, Homo sapiens
cctcggccgtacatctc

SEQ ID NO: 6099866 - DNA, 18 bp, Homo sapiens
cctcggccgtacatctct

SEQ ID NO: 6099867 - DNA, 15 bp, Homo sapiens
cctcggcctccagac

SEQ ID NO: 6099868 - DNA, 23 bp, Homo sapiens
cctcggcctggctggccaggaca

SEQ ID NO: 6099869 - DNA, 14 bp, Homo sapiens
cctcggcctggctt

SEQ ID NO: 6099870 - DNA, 12 bp, Homo sapiens
cctcggctcctg

SEQ ID NO: 6099871 - DNA, 14 bp, Homo sapiens
cctcggctcctgct

SEQ ID NO: 6099872 - DNA, 15 bp, Homo sapiens
cctcggctcctgctg

SEQ ID NO: 6099873 - DNA, 17 bp, Homo sapiens
cctcggctggctcccct

SEQ ID NO: 6099874 - DNA, 22 bp, Homo sapiens
cctcggctggctcccctgcagc

SEQ ID NO: 6099875 - DNA, 20 bp, Homo sapiens
cgcctgggcaccgggacccc

SEQ ID NO: 6099876 - DNA, 14 bp, Homo sapiens
cgcctgggcccagg

SEQ ID NO: 6099877 - DNA, 15 bp, Homo sapiens
cgcctgggcccaggc

SEQ ID NO: 6099878 - DNA, 18 bp, Homo sapiens
cgcctgggcccaggctct

SEQ ID NO: 6099879 - DNA, 17 bp, Homo sapiens
cgcctgggtcatgggcc

SEQ ID NO: 6099880 - DNA, 22 bp, Homo sapiens
cgcctgggtcatgggcctgtgg

SEQ ID NO: 6099881 - DNA, 17 bp, Homo sapiens
cgcctgggtccagggga

SEQ ID NO: 6099882 - DNA, 16 bp, Homo sapiens
cgcctgtaatcccagc

SEQ ID NO: 6099883 - DNA, 20 bp, Homo sapiens
cgcctgtaatcccagcactt

SEQ ID NO: 6099884 - DNA, 18 bp, Homo sapiens
cgcctgtaatcccagcag

SEQ ID NO: 6099885 - DNA, 15 bp, Homo sapiens
cgcctgtagtcccag

SEQ ID NO: 6099886 - DNA, 17 bp, Homo sapiens
cgcctgtagtcctagcc

SEQ ID NO: 6099887 - DNA, 21 bp, Homo sapiens
cgcctgtcaataaatgttgaa

SEQ ID NO: 6099888 - DNA, 15 bp, Homo sapiens
cgcctgtccacagcc

SEQ ID NO: 6099889 - DNA, 16 bp, Homo sapiens
cgcctgtcccctcaca

SEQ ID NO: 6099890 - DNA, 16 bp, Homo sapiens
cgcctgtcctgcctct

SEQ ID NO: 6099891 - DNA, 20 bp, Homo sapiens
cgcctgtgcccttgctgggt

SEQ ID NO: 6099892 - DNA, 12 bp, Homo sapiens
cgccttaaactc

SEQ ID NO: 6099893 - DNA, 14 bp, Homo sapiens
cgccttaagctgat

SEQ ID NO: 6099894 - DNA, 14 bp, Homo sapiens
cgccttagagcctc

SEQ ID NO: 6099895 - DNA, 13 bp, Homo sapiens
cgccttcacagca

SEQ ID NO: 6099896 - DNA, 21 bp, Homo sapiens
cgccttcaggttcctcctagg

SEQ ID NO: 6099897 - DNA, 18 bp, Homo sapiens
cgccttcatgccagtgca

SEQ ID NO: 6099898 - DNA, 21 bp, Homo sapiens
cgccttcatgccagtgcatgc

SEQ ID NO: 6099899 - DNA, 18 bp, Homo sapiens
cgccttccaaaacctgct

SEQ ID NO: 6099900 - DNA, 14 bp, Homo sapiens
cgccttccctcctg

SEQ ID NO: 6099901 - DNA, 15 bp, Homo sapiens
cgccttcctcctcca

SEQ ID NO: 6099902 - DNA, 22 bp, Homo sapiens
cgccttcctcctccacagtgct

SEQ ID NO: 6099903 - DNA, 15 bp, Homo sapiens
cgccttcctctctgg

SEQ ID NO: 6099904 - DNA, 19 bp, Homo sapiens
cgccttccttgaccttcct

SEQ ID NO: 6099905 - DNA, 14 bp, Homo sapiens
cgccttcgtgcctg

SEQ ID NO: 6099906 - DNA, 18 bp, Homo sapiens
cgccttcgtgtgctgctg

SEQ ID NO: 6099907 - DNA, 12 bp, Homo sapiens
cgccttctcgga

SEQ ID NO: 6099908 - DNA, 19 bp, Homo sapiens
cgccttctggccgctgcag

SEQ ID NO: 6099909 - DNA, 22 bp, Homo sapiens
cgccttgagtgacatgcggctg

SEQ ID NO: 6099910 - DNA, 16 bp, Homo sapiens
cgccttgcccagcctg

SEQ ID NO: 6099911 - DNA, 15 bp, Homo sapiens
cgccttggcctccca

SEQ ID NO: 6099912 - DNA, 20 bp, Homo sapiens
cgccttggccttgcagctgg

SEQ ID NO: 6099913 - DNA, 19 bp, Homo sapiens
cgccttgtctcctactcct

SEQ ID NO: 6099914 - DNA, 13 bp, Homo sapiens
cgccttgtgagat

SEQ ID NO: 6099915 - DNA, 18 bp, Homo sapiens
cgccttgttcctgctctt

SEQ ID NO: 6099916 - DNA, 13 bp, Homo sapiens
cgcctttcccagg

SEQ ID NO: 6099917 - DNA, 23 bp, Homo sapiens
cgcctttccttttcgcctttcct

SEQ ID NO: 6099918 - DNA, 14 bp, Homo sapiens
cgcctttgtattat

SEQ ID NO: 6099919 - DNA, 13 bp, Homo sapiens
cgcctttgtcttg

SEQ ID NO: 6099920 - DNA, 16 bp, Homo sapiens
cgccttttcagccctt

SEQ ID NO: 6099921 - DNA, 17 bp, Homo sapiens
cgccttttcccccaccc

SEQ ID NO: 6099922 - DNA, 13 bp, Homo sapiens
cgccttttgtata

SEQ ID NO: 6099923 - DNA, 15 bp, Homo sapiens
cgccttttgtataca

SEQ ID NO: 6099924 - DNA, 16 bp, Homo sapiens
cgccttttgtatacat

SEQ ID NO: 6099925 - DNA, 16 bp, Homo sapiens
cgcctttttggcctgt

SEQ ID NO: 6099926 - DNA, 13 bp, Homo sapiens
cgcgaccacccct

SEQ ID NO: 6099927 - DNA, 18 bp, Homo sapiens
cgcgaccacccctgtgcg

SEQ ID NO: 6099928 - DNA, 15 bp, Homo sapiens
cgcgactaatttcaa

SEQ ID NO: 6099929 - DNA, 22 bp, Homo sapiens
cgcgactaatttcaaaatgctt

SEQ ID NO: 6099930 - DNA, 16 bp, Homo sapiens
cgcgacttctcaggac

SEQ ID NO: 6099931 - DNA, 15 bp, Homo sapiens
cgcgagaggctctga

SEQ ID NO: 6099932 - DNA, 20 bp, Homo sapiens
cgcgagggctactcagcagt

SEQ ID NO: 6099933 - DNA, 16 bp, Homo sapiens
cgcgatcccacacagg

SEQ ID NO: 6099934 - DNA, 21 bp, Homo sapiens
cgcgatgatgggctggagcag

SEQ ID NO: 6099935 - DNA, 22 bp, Homo sapiens
cgcgatgtggaactgctgccac

SEQ ID NO: 6099936 - DNA, 23 bp, Homo sapiens
cgcgatgtggaactgctgccact

SEQ ID NO: 6099937 - DNA, 14 bp, Homo sapiens
cgcgcacacacact

SEQ ID NO: 6099938 - DNA, 12 bp, Homo sapiens
cgcgcaccgcca

SEQ ID NO: 6099939 - DNA, 12 bp, Homo sapiens
cgcgcaggcctg

SEQ ID NO: 6099940 - DNA, 23 bp, Homo sapiens
cgcgccaaataatgtctctgtga

SEQ ID NO: 6099941 - DNA, 18 bp, Homo sapiens
cgcgccaccgagtgcctt

SEQ ID NO: 6099942 - DNA, 16 bp, Homo sapiens
cgcgccaggccctcag

SEQ ID NO: 6099943 - DNA, 16 bp, Homo sapiens
cgcgcccagcagaggc

SEQ ID NO: 6099944 - DNA, 18 bp, Homo sapiens
cgcgcccagcgctcgcca

SEQ ID NO: 6099945 - DNA, 15 bp, Homo sapiens
cgcgccccagtcact

SEQ ID NO: 6099946 - DNA, 18 bp, Homo sapiens
cgcgccccccgcgcccct

SEQ ID NO: 6099947 - DNA, 18 bp, Homo sapiens
cgcgcccctctgcgcccc

SEQ ID NO: 6099948 - DNA, 15 bp, Homo sapiens
cgcgcccctgggact

SEQ ID NO: 6099949 - DNA, 16 bp, Homo sapiens
cgcgcccgccgcctcc

SEQ ID NO: 6099950 - DNA, 17 bp, Homo sapiens
cgcgccgacgcctgtgc

SEQ ID NO: 6099951 - DNA, 11 bp, Homo sapiens
cgcgcctgcct

SEQ ID NO: 6099952 - DNA, 16 bp, Homo sapiens
cgcgcctgccttttct

SEQ ID NO: 6099953 - DNA, 15 bp, Homo sapiens
cgcgcctggcctaga

SEQ ID NO: 6099954 - DNA, 19 bp, Homo sapiens
cgcgccttctcccccccgg

SEQ ID NO: 6099955 - DNA, 23 bp, Homo sapiens
cgcgcgactgagaaccgtgacat

SEQ ID NO: 6099956 - DNA, 11 bp, Homo sapiens
cgcgcgcacac

SEQ ID NO: 6099957 - DNA, 14 bp, Homo sapiens
cgcgcgcccctgcc

SEQ ID NO: 6099958 - DNA, 15 bp, Homo sapiens
cgcgcgccggtgccg

SEQ ID NO: 6099959 - DNA, 18 bp, Homo sapiens
cgcgcggagacctcctga

SEQ ID NO: 6099960 - DNA, 19 bp, Homo sapiens
cgcgcgtccccctgccggc

SEQ ID NO: 6099961 - DNA, 18 bp, Homo sapiens
cgcgcgtctcccatcctg

SEQ ID NO: 6099962 - DNA, 17 bp, Homo sapiens
cgcgcgtgcccccagcg

SEQ ID NO: 6099963 - DNA, 16 bp, Homo sapiens
cgcgcgttcgcggcgg

SEQ ID NO: 6099964 - DNA, 19 bp, Homo sapiens
cgcgcgttcgcggcggtgg

SEQ ID NO: 6099965 - DNA, 14 bp, Homo sapiens
cgcgctcagatgcc

SEQ ID NO: 6099966 - DNA, 15 bp, Homo sapiens
cgcgctcgcccagca

SEQ ID NO: 6099967 - DNA, 16 bp, Homo sapiens
cgcgctcgcccagcag

SEQ ID NO: 6099968 - DNA, 20 bp, Homo sapiens
cgcgctcggggctgggcaga

SEQ ID NO: 6099969 - DNA, 13 bp, Homo sapiens
cgcgctctgcatg

SEQ ID NO: 6099970 - DNA, 16 bp, Homo sapiens
cgcgctctgcatgctc

SEQ ID NO: 6099971 - DNA, 13 bp, Homo sapiens
cgcgctctgctca

SEQ ID NO: 6099972 - DNA, 22 bp, Homo sapiens
cgcgctctttcttccctcgtga

SEQ ID NO: 6099973 - DNA, 15 bp, Homo sapiens
cgcgctgcctgtgtg

SEQ ID NO: 6099974 - DNA, 18 bp, Homo sapiens
cgcgctggaatccagaag

SEQ ID NO: 6099975 - DNA, 22 bp, Homo sapiens
cgcgctggaatccagaaggaag

SEQ ID NO: 6099976 - DNA, 14 bp, Homo sapiens
cgcgcttccctggg

SEQ ID NO: 6099977 - DNA, 16 bp, Homo sapiens
cgcgcttgctggccag

SEQ ID NO: 6099978 - DNA, 22 bp, Homo sapiens
cgcgctttcccctcctccctgg

SEQ ID NO: 6099979 - DNA, 20 bp, Homo sapiens
cgcggacgtgctggccttgg

SEQ ID NO: 6099980 - DNA, 14 bp, Homo sapiens
cgcggactcgcccc

SEQ ID NO: 6099981 - DNA, 12 bp, Homo sapiens
cgcggagccccc

SEQ ID NO: 6099982 - DNA, 14 bp, Homo sapiens
cgcggagcccccgc

SEQ ID NO: 6099983 - DNA, 16 bp, Homo sapiens
cgcggagcccccgccc

SEQ ID NO: 6099984 - DNA, 16 bp, Homo sapiens
cgcggagcctgcattt

SEQ ID NO: 6099985 - DNA, 20 bp, Homo sapiens
cgcggaggaggagggaggcc

SEQ ID NO: 6099986 - DNA, 17 bp, Homo sapiens
cgcggaggagttttctg

SEQ ID NO: 6099987 - DNA, 16 bp, Homo sapiens
cgcggatttctctttc

SEQ ID NO: 6099988 - DNA, 14 bp, Homo sapiens
cgcggccagccccg

SEQ ID NO: 6099989 - DNA, 15 bp, Homo sapiens
cgcggccagccccgg

SEQ ID NO: 6099990 - DNA, 19 bp, Homo sapiens
cgcggccagcgtcccaggg

SEQ ID NO: 6099991 - DNA, 14 bp, Homo sapiens
cgcggcccagaccc

SEQ ID NO: 6099992 - DNA, 15 bp, Homo sapiens
cgcggcccagaccca

SEQ ID NO: 6099993 - DNA, 20 bp, Homo sapiens
cgcggcccgcgcagctgcct

SEQ ID NO: 6099994 - DNA, 14 bp, Homo sapiens
cgcggccctcagta

SEQ ID NO: 6099995 - DNA, 13 bp, Homo sapiens
cgcggccgcccgc

SEQ ID NO: 6099996 - DNA, 19 bp, Homo sapiens
cgcggccgctctccgcccc

SEQ ID NO: 6099997 - DNA, 20 bp, Homo sapiens
cgcggcctgcaccgacccga

SEQ ID NO: 6099998 - DNA, 19 bp, Homo sapiens
cgcggccttgtctgggtgc

SEQ ID NO: 6099999 - DNA, 23 bp, Homo sapiens
cgcggccttgtctgggtgcagct

SEQ ID NO: 6100000 - DNA, 23 bp, Homo sapiens
cgcggcggagctggccccgccgc

SEQ ID NO: 6100001 - DNA, 20 bp, Homo sapiens
cgcggcggctctgcccacct

SEQ ID NO: 6100002 - DNA, 22 bp, Homo sapiens
cgcggctcccggggcagggcag

SEQ ID NO: 6100003 - DNA, 23 bp, Homo sapiens
cgcggctgctgcttctccctggg

SEQ ID NO: 6100004 - DNA, 12 bp, Homo sapiens
cgcggctgggag

SEQ ID NO: 6100005 - DNA, 15 bp, Homo sapiens
cgcggctgggagcct

SEQ ID NO: 6100006 - DNA, 21 bp, Homo sapiens
cgcggcttggccgccatccgg

SEQ ID NO: 6100007 - DNA, 16 bp, Homo sapiens
cgcgggaagccagccc

SEQ ID NO: 6100008 - DNA, 20 bp, Homo sapiens
cgcgggacagcggccccgcg

SEQ ID NO: 6100009 - DNA, 22 bp, Homo sapiens
cgcgggagacagcttctctgca

SEQ ID NO: 6100010 - DNA, 23 bp, Homo sapiens
cgcgggagccatgcgccccctcc

SEQ ID NO: 6100011 - DNA, 14 bp, Homo sapiens
cgcgggagggggcg

SEQ ID NO: 6100012 - DNA, 17 bp, Homo sapiens
cgcgggatggtgcagac

SEQ ID NO: 6100013 - DNA, 12 bp, Homo sapiens
cgcgggcacagc

SEQ ID NO: 6100014 - DNA, 16 bp, Homo sapiens
cgcgggcacagccagc

SEQ ID NO: 6100015 - DNA, 17 bp, Homo sapiens
cgcgggcagccacccaa

SEQ ID NO: 6100016 - DNA, 18 bp, Homo sapiens
cgcgggcagcgggccagg

SEQ ID NO: 6100017 - DNA, 19 bp, Homo sapiens
cgcgggcagcgggccaggc

SEQ ID NO: 6100018 - DNA, 22 bp, Homo sapiens
cgcgggcagcgggccaggcccg

SEQ ID NO: 6100019 - DNA, 14 bp, Homo sapiens
cgcgggccaggagg

SEQ ID NO: 6100020 - DNA, 15 bp, Homo sapiens
cgcgggcggccaggc

SEQ ID NO: 6100021 - DNA, 18 bp, Homo sapiens
cgcgggctttgttgctgg

SEQ ID NO: 6100022 - DNA, 18 bp, Homo sapiens
cgcggggaagctggcttt

SEQ ID NO: 6100023 - DNA, 16 bp, Homo sapiens
cgcggggaggccggcg

SEQ ID NO: 6100024 - DNA, 20 bp, Homo sapiens
cgcggggctgtcggcgctgc

SEQ ID NO: 6100025 - DNA, 20 bp, Homo sapiens
cgcgggtggctggagcccca

SEQ ID NO: 6100026 - DNA, 16 bp, Homo sapiens
cgcgggtgtgcggtct

SEQ ID NO: 6100027 - DNA, 13 bp, Homo sapiens
cgcgggttctaga

SEQ ID NO: 6100028 - DNA, 15 bp, Homo sapiens
cgcggtgctctggcg

SEQ ID NO: 6100029 - DNA, 13 bp, Homo sapiens
cgcggtggctcac

SEQ ID NO: 6100030 - DNA, 16 bp, Homo sapiens
cgcggtggctcacacc

SEQ ID NO: 6100031 - DNA, 23 bp, Homo sapiens
cgcgtaataggaatcaccctcct

SEQ ID NO: 6100032 - DNA, 15 bp, Homo sapiens
cgcgtccaaccccgg

SEQ ID NO: 6100033 - DNA, 21 bp, Homo sapiens
cgcgtccacatacactgcatt

SEQ ID NO: 6100034 - DNA, 12 bp, Homo sapiens
cgcgtcccagct

SEQ ID NO: 6100035 - DNA, 15 bp, Homo sapiens
cgcgtcccagctccc

SEQ ID NO: 6100036 - DNA, 17 bp, Homo sapiens
cgcgtcccagctcccct

SEQ ID NO: 6100037 - DNA, 13 bp, Homo sapiens
cgcgtccgagaag

SEQ ID NO: 6100038 - DNA, 20 bp, Homo sapiens
cgcgtccgagaaggcggaaa

SEQ ID NO: 6100039 - DNA, 21 bp, Homo sapiens
cgcgtcgccctcccaggctct

SEQ ID NO: 6100040 - DNA, 17 bp, Homo sapiens
cgcgtctaccctgggat

SEQ ID NO: 6100041 - DNA, 13 bp, Homo sapiens
cgcgtctcctgtt

SEQ ID NO: 6100042 - DNA, 21 bp, Homo sapiens
cgcgtctcctgtttttctggg

SEQ ID NO: 6100043 - DNA, 19 bp, Homo sapiens
cgcgtctgccccaccctca

SEQ ID NO: 6100044 - DNA, 12 bp, Homo sapiens
cgcgtcttcctg

SEQ ID NO: 6100045 - DNA, 19 bp, Homo sapiens
cgcgtgataaaactgggtt

SEQ ID NO: 6100046 - DNA, 16 bp, Homo sapiens
cgcgtgcacacaccag

SEQ ID NO: 6100047 - DNA, 19 bp, Homo sapiens
cgcgtgcacgtggagagct

SEQ ID NO: 6100048 - DNA, 13 bp, Homo sapiens
cgcgtgcccccag

SEQ ID NO: 6100049 - DNA, 17 bp, Homo sapiens
cgcgtgcccccagcgtg

SEQ ID NO: 6100050 - DNA, 19 bp, Homo sapiens
cgcgtgccctcgctgcttc

SEQ ID NO: 6100051 - DNA, 17 bp, Homo sapiens
cgcgtgccgggccccca

SEQ ID NO: 6100052 - DNA, 17 bp, Homo sapiens
cgcgtgccgtggcacca

SEQ ID NO: 6100053 - DNA, 16 bp, Homo sapiens
cgcgtggacagccgga

SEQ ID NO: 6100054 - DNA, 16 bp, Homo sapiens
cgcgtggcgtggcccg

SEQ ID NO: 6100055 - DNA, 23 bp, Homo sapiens
cgcgtgtccccggggcccagggg

SEQ ID NO: 6100056 - DNA, 14 bp, Homo sapiens
cgcgtgtgctcctc

SEQ ID NO: 6100057 - DNA, 17 bp, Homo sapiens
cgcgtgtgggtctctgg

SEQ ID NO: 6100058 - DNA, 17 bp, Homo sapiens
cgcgttgaaattgtaat

SEQ ID NO: 6100059 - DNA, 22 bp, Homo sapiens
cgcgttgaaattgtaattatat

SEQ ID NO: 6100060 - DNA, 17 bp, Homo sapiens
cgcgttgcctgtcgctt

SEQ ID NO: 6100061 - DNA, 18 bp, Homo sapiens
cgcgttgtgtatattaca

SEQ ID NO: 6100062 - DNA, 13 bp, Homo sapiens
cgctaaaagaaac

SEQ ID NO: 6100063 - DNA, 15 bp, Homo sapiens
cgctaaaagaaactt

SEQ ID NO: 6100064 - DNA, 22 bp, Homo sapiens
cgctaaagagcccttgcctccc

SEQ ID NO: 6100065 - DNA, 19 bp, Homo sapiens
cgctaaagggaccatctgc

SEQ ID NO: 6100066 - DNA, 22 bp, Homo sapiens
cgctaacccccagcccacagag

SEQ ID NO: 6100067 - DNA, 19 bp, Homo sapiens
cgctaacttgcttaaatgt

SEQ ID NO: 6100068 - DNA, 22 bp, Homo sapiens
cgctaacttgcttaaatgtgaa

SEQ ID NO: 6100069 - DNA, 22 bp, Homo sapiens
cgctaaggcttccggctgagct

SEQ ID NO: 6100070 - DNA, 15 bp, Homo sapiens
cgctaagtaaaaata

SEQ ID NO: 6100071 - DNA, 23 bp, Homo sapiens
cgctacaaaataaagctgttctc

SEQ ID NO: 6100072 - DNA, 19 bp, Homo sapiens
cgctacaattctgcagaaa

SEQ ID NO: 6100073 - DNA, 16 bp, Homo sapiens
cgctacaccactctgg

SEQ ID NO: 6100074 - DNA, 22 bp, Homo sapiens
cgctacatttccgccacatccc

SEQ ID NO: 6100075 - DNA, 16 bp, Homo sapiens
cgctacccgggaaggg

SEQ ID NO: 6100076 - DNA, 17 bp, Homo sapiens
cgctacccgggaagggg

SEQ ID NO: 6100077 - DNA, 18 bp, Homo sapiens
cgctacccgggaaggggg

SEQ ID NO: 6100078 - DNA, 21 bp, Homo sapiens
cgctacggggaaaatgcattt

SEQ ID NO: 6100079 - DNA, 20 bp, Homo sapiens
cgctactatgatttaatttg

SEQ ID NO: 6100080 - DNA, 12 bp, Homo sapiens
cgctagaagtct

SEQ ID NO: 6100081 - DNA, 18 bp, Homo sapiens
cgctagaggaagcagcca

SEQ ID NO: 6100082 - DNA, 22 bp, Homo sapiens
cgctagagtaaaagtcccagtt

SEQ ID NO: 6100083 - DNA, 23 bp, Homo sapiens
cgctagatgggcatggggtgggc

SEQ ID NO: 6100084 - DNA, 14 bp, Homo sapiens
cgctagcagccctt

SEQ ID NO: 6100085 - DNA, 15 bp, Homo sapiens
cgctagcagtggcag

SEQ ID NO: 6100086 - DNA, 15 bp, Homo sapiens
cgctaggagagactg

SEQ ID NO: 6100087 - DNA, 23 bp, Homo sapiens
cgctaggctcgccttccctcctg

SEQ ID NO: 6100088 - DNA, 14 bp, Homo sapiens
cgctagtgccttgc

SEQ ID NO: 6100089 - DNA, 15 bp, Homo sapiens
cgctagtgccttgcc

SEQ ID NO: 6100090 - DNA, 15 bp, Homo sapiens
cgctatccacagaac

SEQ ID NO: 6100091 - DNA, 14 bp, Homo sapiens
cgctatcttcacat

SEQ ID NO: 6100092 - DNA, 13 bp, Homo sapiens
cgctatgtagaat

SEQ ID NO: 6100093 - DNA, 13 bp, Homo sapiens
cgctatgtgactt

SEQ ID NO: 6100094 - DNA, 14 bp, Homo sapiens
cgctattacaaata

SEQ ID NO: 6100095 - DNA, 16 bp, Homo sapiens
cgctattcccaggcag

SEQ ID NO: 6100096 - DNA, 18 bp, Homo sapiens
cgctcaagaatcctctgg

SEQ ID NO: 6100097 - DNA, 15 bp, Homo sapiens
cgctcacctcagagc

SEQ ID NO: 6100098 - DNA, 17 bp, Homo sapiens
cgctcacctcagagcag

SEQ ID NO: 6100099 - DNA, 20 bp, Homo sapiens
cgctcacgctgacagcctcc

SEQ ID NO: 6100100 - DNA, 14 bp, Homo sapiens
cgctcactccaggt

SEQ ID NO: 6100101 - DNA, 12 bp, Homo sapiens
cgctcagacccc

SEQ ID NO: 6100102 - DNA, 17 bp, Homo sapiens
cgctcagacggcggcca

SEQ ID NO: 6100103 - DNA, 21 bp, Homo sapiens
cgctcagacggcggccaggca

SEQ ID NO: 6100104 - DNA, 22 bp, Homo sapiens
cgctcagacggcggccaggcac

SEQ ID NO: 6100105 - DNA, 23 bp, Homo sapiens
cgctcagacggcggccaggcaca

SEQ ID NO: 6100106 - DNA, 15 bp, Homo sapiens
cgctcagcccagctg

SEQ ID NO: 6100107 - DNA, 15 bp, Homo sapiens
cgctcagccccaggc

SEQ ID NO: 6100108 - DNA, 18 bp, Homo sapiens
cgctcagccccaggccag

SEQ ID NO: 6100109 - DNA, 19 bp, Homo sapiens
cgctcagccccaggccagc

SEQ ID NO: 6100110 - DNA, 22 bp, Homo sapiens
cgctcagccccaggccagctgc

SEQ ID NO: 6100111 - DNA, 16 bp, Homo sapiens
cgctcagccctccctg

SEQ ID NO: 6100112 - DNA, 23 bp, Homo sapiens
cgctcagctcatccatgcctcag

SEQ ID NO: 6100113 - DNA, 13 bp, Homo sapiens
cgctcaggaccca

SEQ ID NO: 6100114 - DNA, 16 bp, Homo sapiens
cgctcaggacccaggc

SEQ ID NO: 6100115 - DNA, 17 bp, Homo sapiens
cgctcaggacccaggcc

SEQ ID NO: 6100116 - DNA, 18 bp, Homo sapiens
cgctcaggacccaggccc

SEQ ID NO: 6100117 - DNA, 20 bp, Homo sapiens
cgctcaggacccaggccctc

SEQ ID NO: 6100118 - DNA, 12 bp, Homo sapiens
cgctcaggctgg

SEQ ID NO: 6100119 - DNA, 20 bp, Homo sapiens
cgctcagggccatgctgagg

SEQ ID NO: 6100120 - DNA, 16 bp, Homo sapiens
cgctcaggggcctgga

SEQ ID NO: 6100121 - DNA, 17 bp, Homo sapiens
cgctcaggggcctggag

SEQ ID NO: 6100122 - DNA, 19 bp, Homo sapiens
cgctcaggggcctggaggt

SEQ ID NO: 6100123 - DNA, 18 bp, Homo sapiens
cgctcaggggctccatgc

SEQ ID NO: 6100124 - DNA, 20 bp, Homo sapiens
cgctcaggggctccatgctg

SEQ ID NO: 6100125 - DNA, 16 bp, Homo sapiens
cgctcatcttgcaaag

SEQ ID NO: 6100126 - DNA, 20 bp, Homo sapiens
cgctcatgtcctgtcctggt

SEQ ID NO: 6100127 - DNA, 19 bp, Homo sapiens
cgctcattttaggcctcct

SEQ ID NO: 6100128 - DNA, 21 bp, Homo sapiens
cgctccactacccggcagggt

SEQ ID NO: 6100129 - DNA, 16 bp, Homo sapiens
cgctccagctgccccg

SEQ ID NO: 6100130 - DNA, 10 bp, Homo sapiens
cgctccaggt

SEQ ID NO: 6100131 - DNA, 16 bp, Homo sapiens
cgctccatcgcccagg

SEQ ID NO: 6100132 - DNA, 19 bp, Homo sapiens
cgctcccaacacaaggtgg

SEQ ID NO: 6100133 - DNA, 18 bp, Homo sapiens
cgctcccaacccccctcc

SEQ ID NO: 6100134 - DNA, 13 bp, Homo sapiens
cgctcccaccgcc

SEQ ID NO: 6100135 - DNA, 14 bp, Homo sapiens
cgctcccaccgccc

SEQ ID NO: 6100136 - DNA, 22 bp, Homo sapiens
cgctcccacctagtgccccaga

SEQ ID NO: 6100137 - DNA, 23 bp, Homo sapiens
cgctcccacctagtgccccagac

SEQ ID NO: 6100138 - DNA, 14 bp, Homo sapiens
cgctcccagtgtct

SEQ ID NO: 6100139 - DNA, 22 bp, Homo sapiens
cgctcccagtgtcttcctgtgg

SEQ ID NO: 6100140 - DNA, 15 bp, Homo sapiens
cgctccccacctacc

SEQ ID NO: 6100141 - DNA, 15 bp, Homo sapiens
cgctccccactctgc

SEQ ID NO: 6100142 - DNA, 19 bp, Homo sapiens
cgctcccccgcagtcccca

SEQ ID NO: 6100143 - DNA, 22 bp, Homo sapiens
cgctcccccgcagtccccagcc

SEQ ID NO: 6100144 - DNA, 17 bp, Homo sapiens
cgctccccgcctgttcc

SEQ ID NO: 6100145 - DNA, 19 bp, Homo sapiens
cgctccccgcctgttcccc

SEQ ID NO: 6100146 - DNA, 17 bp, Homo sapiens
cgctcccctccatcccc

SEQ ID NO: 6100147 - DNA, 18 bp, Homo sapiens
cgctcccctctggaatct

SEQ ID NO: 6100148 - DNA, 22 bp, Homo sapiens
cgctccccttggacctccaggg

SEQ ID NO: 6100149 - DNA, 22 bp, Homo sapiens
cgctcccgcatttctcatgctt

SEQ ID NO: 6100150 - DNA, 15 bp, Homo sapiens
cgctcccgctcccag

SEQ ID NO: 6100151 - DNA, 16 bp, Homo sapiens
cgctcccgctcccagg

SEQ ID NO: 6100152 - DNA, 10 bp, Homo sapiens
cgctccctgg

SEQ ID NO: 6100153 - DNA, 20 bp, Homo sapiens
cgctccctgtagctctgcct

SEQ ID NO: 6100154 - DNA, 13 bp, Homo sapiens
cgctccctgtcgc

SEQ ID NO: 6100155 - DNA, 15 bp, Homo sapiens
cgctccctgtcgcct

SEQ ID NO: 6100156 - DNA, 17 bp, Homo sapiens
cgctcccttccctccat

SEQ ID NO: 6100157 - DNA, 23 bp, Homo sapiens
cgctcccttggctttgaggccga

SEQ ID NO: 6100158 - DNA, 17 bp, Homo sapiens
cgctccggcagaggcag

SEQ ID NO: 6100159 - DNA, 19 bp, Homo sapiens
cgctccgtgttcctcggtg

SEQ ID NO: 6100160 - DNA, 12 bp, Homo sapiens
cgctcctcccag

SEQ ID NO: 6100161 - DNA, 20 bp, Homo sapiens
cgctcctcccagatggcttc

SEQ ID NO: 6100162 - DNA, 12 bp, Homo sapiens
cgctcctccctg

SEQ ID NO: 6100163 - DNA, 12 bp, Homo sapiens
cgctcctcctct

SEQ ID NO: 6100164 - DNA, 12 bp, Homo sapiens
cgctcctcctgt

SEQ ID NO: 6100165 - DNA, 15 bp, Homo sapiens
cgctcctcctgtgtg

SEQ ID NO: 6100166 - DNA, 14 bp, Homo sapiens
cgctcctccttccc

SEQ ID NO: 6100167 - DNA, 23 bp, Homo sapiens
cgctcctccttcccagggaccag

SEQ ID NO: 6100168 - DNA, 16 bp, Homo sapiens
cgctcctctgcagcct

SEQ ID NO: 6100169 - DNA, 14 bp, Homo sapiens
cgctcctgcagccc

SEQ ID NO: 6100170 - DNA, 18 bp, Homo sapiens
cgctcctgcagccccagc

SEQ ID NO: 6100171 - DNA, 15 bp, Homo sapiens
cgctcctgccgcaga

SEQ ID NO: 6100172 - DNA, 20 bp, Homo sapiens
cgctcctgccgcagagctgg

SEQ ID NO: 6100173 - DNA, 13 bp, Homo sapiens
cgctcctgcttcc

SEQ ID NO: 6100174 - DNA, 11 bp, Homo sapiens
cgctcctggct

SEQ ID NO: 6100175 - DNA, 21 bp, Homo sapiens
cgctcctgtctgccagccagc

SEQ ID NO: 6100176 - DNA, 13 bp, Homo sapiens
cgctcctgtgtct

SEQ ID NO: 6100177 - DNA, 20 bp, Homo sapiens
cgctcgatggacctcagcaa

SEQ ID NO: 6100178 - DNA, 14 bp, Homo sapiens
cgctcgcccagcag

SEQ ID NO: 6100179 - DNA, 15 bp, Homo sapiens
cgctcgcccagcagg

SEQ ID NO: 6100180 - DNA, 20 bp, Homo sapiens
cgctcgcccagcaggagaga

SEQ ID NO: 6100181 - DNA, 15 bp, Homo sapiens
cgctcgccccaccgg

SEQ ID NO: 6100182 - DNA, 17 bp, Homo sapiens
cgctcgctcgctctcgc

SEQ ID NO: 6100183 - DNA, 14 bp, Homo sapiens
cgctcggaggcccc

SEQ ID NO: 6100184 - DNA, 16 bp, Homo sapiens
cgctcggaggccccaa

SEQ ID NO: 6100185 - DNA, 20 bp, Homo sapiens
cgctcggaggccccaaagga

SEQ ID NO: 6100186 - DNA, 13 bp, Homo sapiens
cgctcggcaggaa

SEQ ID NO: 6100187 - DNA, 14 bp, Homo sapiens
cgctcggcaggaag

SEQ ID NO: 6100188 - DNA, 17 bp, Homo sapiens
cgctctaccctgcagct

SEQ ID NO: 6100189 - DNA, 21 bp, Homo sapiens
cgctctaccctgcagcttgga

SEQ ID NO: 6100190 - DNA, 14 bp, Homo sapiens
cgctctcagttctc

SEQ ID NO: 6100191 - DNA, 19 bp, Homo sapiens
cgctctccatcataggctg

SEQ ID NO: 6100192 - DNA, 18 bp, Homo sapiens
cgctctccccctgcagcc

SEQ ID NO: 6100193 - DNA, 12 bp, Homo sapiens
cgctctccctac

SEQ ID NO: 6100194 - DNA, 19 bp, Homo sapiens
cgctctccctaccttgcct

SEQ ID NO: 6100195 - DNA, 14 bp, Homo sapiens
cgctctccctgtca

SEQ ID NO: 6100196 - DNA, 14 bp, Homo sapiens
cgctctcctcgagc

SEQ ID NO: 6100197 - DNA, 20 bp, Homo sapiens
cgctctcctcgagccctccc

SEQ ID NO: 6100198 - DNA, 13 bp, Homo sapiens
cgctctcctgcca

SEQ ID NO: 6100199 - DNA, 12 bp, Homo sapiens
cgctctcctgga

SEQ ID NO: 6100200 - DNA, 17 bp, Homo sapiens
cgctctcgctctctctc

SEQ ID NO: 6100201 - DNA, 14 bp, Homo sapiens
cgctctctccaggc

SEQ ID NO: 6100202 - DNA, 17 bp, Homo sapiens
cgctctctctctttctc

SEQ ID NO: 6100203 - DNA, 12 bp, Homo sapiens
cgctctctctga

SEQ ID NO: 6100204 - DNA, 15 bp, Homo sapiens
cgctctctggccttc

SEQ ID NO: 6100205 - DNA, 15 bp, Homo sapiens
cgctctcttcctgcc

SEQ ID NO: 6100206 - DNA, 12 bp, Homo sapiens
cgctctgaggca

SEQ ID NO: 6100207 - DNA, 19 bp, Homo sapiens
cgctctgcatgcggcccag

SEQ ID NO: 6100208 - DNA, 21 bp, Homo sapiens
cgctctgcatgcggcccagcc

SEQ ID NO: 6100209 - DNA, 15 bp, Homo sapiens
cgctctgcatgctcc

SEQ ID NO: 6100210 - DNA, 19 bp, Homo sapiens
cgctctgcatgctcctctg

SEQ ID NO: 6100211 - DNA, 19 bp, Homo sapiens
cgctctgccatcagcccct

SEQ ID NO: 6100212 - DNA, 13 bp, Homo sapiens
cgctctgcccctc

SEQ ID NO: 6100213 - DNA, 14 bp, Homo sapiens
cgctctgcccctcc

SEQ ID NO: 6100214 - DNA, 22 bp, Homo sapiens
cgctctgcccctccgtccccag

SEQ ID NO: 6100215 - DNA, 18 bp, Homo sapiens
cgctctgccctccctggc

SEQ ID NO: 6100216 - DNA, 21 bp, Homo sapiens
cgctctgccctccctggcctc

SEQ ID NO: 6100217 - DNA, 19 bp, Homo sapiens
cgctctgccgccgcccgct

SEQ ID NO: 6100218 - DNA, 16 bp, Homo sapiens
cgctctgctggcctgg

SEQ ID NO: 6100219 - DNA, 17 bp, Homo sapiens
cgctctgctggcctggc

SEQ ID NO: 6100220 - DNA, 12 bp, Homo sapiens
cgctctggacag

SEQ ID NO: 6100221 - DNA, 13 bp, Homo sapiens
cgctctggacaga

SEQ ID NO: 6100222 - DNA, 18 bp, Homo sapiens
cgctctggatcctgcact

SEQ ID NO: 6100223 - DNA, 19 bp, Homo sapiens
cgctctgggagccacgcct

SEQ ID NO: 6100224 - DNA, 19 bp, Homo sapiens
cgctctgttgcccaggctg

SEQ ID NO: 6100225 - DNA, 16 bp, Homo sapiens
cgctcttcaccaggaa

SEQ ID NO: 6100226 - DNA, 17 bp, Homo sapiens
cgctcttcaccaggaag

SEQ ID NO: 6100227 - DNA, 23 bp, Homo sapiens
cgctcttcaccaggaagaaggcc

SEQ ID NO: 6100228 - DNA, 24 bp, Homo sapiens
cgctcttcgcgcccgcccctgcag

SEQ ID NO: 6100229 - DNA, 16 bp, Homo sapiens
cgctcttttccactcc

SEQ ID NO: 6100230 - DNA, 14 bp, Homo sapiens
cgctgaacccaccc

SEQ ID NO: 6100231 - DNA, 20 bp, Homo sapiens
cgctgaactgacaatgaagg

SEQ ID NO: 6100232 - DNA, 23 bp, Homo sapiens
cgctgaagatggagggggctggg

SEQ ID NO: 6100233 - DNA, 21 bp, Homo sapiens
cgctgaagcggtcagactgga

SEQ ID NO: 6100234 - DNA, 18 bp, Homo sapiens
cgctgaatgagaagtaaa

SEQ ID NO: 6100235 - DNA, 13 bp, Homo sapiens
cgctgacaatcag

SEQ ID NO: 6100236 - DNA, 17 bp, Homo sapiens
cctcggctgtctcctgt

SEQ ID NO: 6100237 - DNA, 13 bp, Homo sapiens
cctcggctgtgtg

SEQ ID NO: 6100238 - DNA, 18 bp, Homo sapiens
cctcggcttgtgggctgg

SEQ ID NO: 6100239 - DNA, 21 bp, Homo sapiens
cctcgggaacctcactcttgc

SEQ ID NO: 6100240 - DNA, 16 bp, Homo sapiens
cctcgggaagcagcca

SEQ ID NO: 6100241 - DNA, 18 bp, Homo sapiens
cctcgggaagcagccagc

SEQ ID NO: 6100242 - DNA, 21 bp, Homo sapiens
cctcgggatgaaaagccatat

SEQ ID NO: 6100243 - DNA, 12 bp, Homo sapiens
cctcgggatgcc

SEQ ID NO: 6100244 - DNA, 21 bp, Homo sapiens
cctcgggattggcgggtccac

SEQ ID NO: 6100245 - DNA, 13 bp, Homo sapiens
cctcgggcccacc

SEQ ID NO: 6100246 - DNA, 14 bp, Homo sapiens
cctcgggcccacct

SEQ ID NO: 6100247 - DNA, 21 bp, Homo sapiens
cctcgggcccacctggccacc

SEQ ID NO: 6100248 - DNA, 13 bp, Homo sapiens
cctcgggcccagc

SEQ ID NO: 6100249 - DNA, 18 bp, Homo sapiens
cctcgggcccagccccca

SEQ ID NO: 6100250 - DNA, 16 bp, Homo sapiens
cctcgggcccctgagc

SEQ ID NO: 6100251 - DNA, 17 bp, Homo sapiens
cctcgggcccctgagcc

SEQ ID NO: 6100252 - DNA, 12 bp, Homo sapiens
cctcgggccctg

SEQ ID NO: 6100253 - DNA, 17 bp, Homo sapiens
cctcgggccctgtggtg

SEQ ID NO: 6100254 - DNA, 17 bp, Homo sapiens
cctcgggccgaggccca

SEQ ID NO: 6100255 - DNA, 12 bp, Homo sapiens
cctcgggccgcc

SEQ ID NO: 6100256 - DNA, 15 bp, Homo sapiens
cctcgggccgcctcc

SEQ ID NO: 6100257 - DNA, 16 bp, Homo sapiens
cctcgggccgcctcct

SEQ ID NO: 6100258 - DNA, 20 bp, Homo sapiens
cctcgggccgcctcctccag

SEQ ID NO: 6100259 - DNA, 13 bp, Homo sapiens
cctcgggcctgct

SEQ ID NO: 6100260 - DNA, 19 bp, Homo sapiens
cctcgggcgagtcactgcc

SEQ ID NO: 6100261 - DNA, 20 bp, Homo sapiens
cctcgggcgcctgcgctcct

SEQ ID NO: 6100262 - DNA, 23 bp, Homo sapiens
cctcgggcgcctgcgctcctctg

SEQ ID NO: 6100263 - DNA, 16 bp, Homo sapiens
cctcgggctggtgtct

SEQ ID NO: 6100264 - DNA, 17 bp, Homo sapiens
cctcgggctggtgtctt

SEQ ID NO: 6100265 - DNA, 14 bp, Homo sapiens
cctcggggacacca

SEQ ID NO: 6100266 - DNA, 15 bp, Homo sapiens
cctcggggacaccag

SEQ ID NO: 6100267 - DNA, 19 bp, Homo sapiens
cctcggggacaccagagct

SEQ ID NO: 6100268 - DNA, 20 bp, Homo sapiens
cctcggggagagggggaggt

SEQ ID NO: 6100269 - DNA, 17 bp, Homo sapiens
cctcggggcagggcagg

SEQ ID NO: 6100270 - DNA, 13 bp, Homo sapiens
cctcgggggcctg

SEQ ID NO: 6100271 - DNA, 15 bp, Homo sapiens
cctcgggggcctgtg

SEQ ID NO: 6100272 - DNA, 23 bp, Homo sapiens
cctcggggggtcacaggcccaga

SEQ ID NO: 6100273 - DNA, 19 bp, Homo sapiens
cctcgggtctccccacctg

SEQ ID NO: 6100274 - DNA, 12 bp, Homo sapiens
cctcgggtgggg

SEQ ID NO: 6100275 - DNA, 14 bp, Homo sapiens
cctcgggtggggct

SEQ ID NO: 6100276 - DNA, 16 bp, Homo sapiens
cctcgggtggggctgg

SEQ ID NO: 6100277 - DNA, 17 bp, Homo sapiens
cctcggtcacctgtgct

SEQ ID NO: 6100278 - DNA, 18 bp, Homo sapiens
cctcggtcagcaccgtgg

SEQ ID NO: 6100279 - DNA, 22 bp, Homo sapiens
cctcggtctcccaaagtgctgg

SEQ ID NO: 6100280 - DNA, 15 bp, Homo sapiens
cctcggtctcccttc

SEQ ID NO: 6100281 - DNA, 14 bp, Homo sapiens
cctcggtggccatg

SEQ ID NO: 6100282 - DNA, 15 bp, Homo sapiens
cctcggtggccatgc

SEQ ID NO: 6100283 - DNA, 19 bp, Homo sapiens
cctcggtggccatgcttct

SEQ ID NO: 6100284 - DNA, 21 bp, Homo sapiens
cctcggtggccatgcttcttg

SEQ ID NO: 6100285 - DNA, 15 bp, Homo sapiens
cctcggtggctctgg

SEQ ID NO: 6100286 - DNA, 17 bp, Homo sapiens
cctcggtggctctgggg

SEQ ID NO: 6100287 - DNA, 18 bp, Homo sapiens
cctcggtggctgcacaga

SEQ ID NO: 6100288 - DNA, 18 bp, Homo sapiens
cctcggtgtggagaagcg

SEQ ID NO: 6100289 - DNA, 14 bp, Homo sapiens
cctcggtgttactt

SEQ ID NO: 6100290 - DNA, 21 bp, Homo sapiens
cctcggttgcggacctaggac

SEQ ID NO: 6100291 - DNA, 17 bp, Homo sapiens
cctcgtaccagccagga

SEQ ID NO: 6100292 - DNA, 21 bp, Homo sapiens
cctcgtccaaggcagttctgt

SEQ ID NO: 6100293 - DNA, 12 bp, Homo sapiens
cctcgtccaccc

SEQ ID NO: 6100294 - DNA, 19 bp, Homo sapiens
cctcgtccaccccccacac

SEQ ID NO: 6100295 - DNA, 22 bp, Homo sapiens
cctcgtccatcagggatctcag

SEQ ID NO: 6100296 - DNA, 23 bp, Homo sapiens
cctcgtccatcagggatctcaga

SEQ ID NO: 6100297 - DNA, 14 bp, Homo sapiens
cctcgtcccatcca

SEQ ID NO: 6100298 - DNA, 22 bp, Homo sapiens
cctcgtcccatccagctaccac

SEQ ID NO: 6100299 - DNA, 18 bp, Homo sapiens
cctcgtccggcctgcagc

SEQ ID NO: 6100300 - DNA, 22 bp, Homo sapiens
cctcgtccggcctgcagcccag

SEQ ID NO: 6100301 - DNA, 14 bp, Homo sapiens
cctcgtccgtctgt

SEQ ID NO: 6100302 - DNA, 16 bp, Homo sapiens
cctcgtccgtctgtct

SEQ ID NO: 6100303 - DNA, 19 bp, Homo sapiens
cctcgtcctccccctgcca

SEQ ID NO: 6100304 - DNA, 20 bp, Homo sapiens
cctcgtcctccccctgccag

SEQ ID NO: 6100305 - DNA, 14 bp, Homo sapiens
cctcgtcctgtccc

SEQ ID NO: 6100306 - DNA, 15 bp, Homo sapiens
cctcgtcctgtccca

SEQ ID NO: 6100307 - DNA, 17 bp, Homo sapiens
cctcgtctccctggtgc

SEQ ID NO: 6100308 - DNA, 22 bp, Homo sapiens
cctcgtctccctggtgcctctg

SEQ ID NO: 6100309 - DNA, 20 bp, Homo sapiens
cctcgtctcttgtgactcag

SEQ ID NO: 6100310 - DNA, 23 bp, Homo sapiens
cctcgtctttcatggaccaggtc

SEQ ID NO: 6100311 - DNA, 14 bp, Homo sapiens
cctcgtctttccca

SEQ ID NO: 6100312 - DNA, 18 bp, Homo sapiens
cctcgtctttgcttgtcc

SEQ ID NO: 6100313 - DNA, 19 bp, Homo sapiens
cctcgtgaagaggggaagt

SEQ ID NO: 6100314 - DNA, 15 bp, Homo sapiens
cctcgtgatctgccc

SEQ ID NO: 6100315 - DNA, 20 bp, Homo sapiens
cctcgtgatttgcctgcctg

SEQ ID NO: 6100316 - DNA, 14 bp, Homo sapiens
cctcgtgcagagct

SEQ ID NO: 6100317 - DNA, 19 bp, Homo sapiens
cctcgtgcagagctggggc

SEQ ID NO: 6100318 - DNA, 12 bp, Homo sapiens
cctcgtgccagc

SEQ ID NO: 6100319 - DNA, 12 bp, Homo sapiens
cctcgtgccagt

SEQ ID NO: 6100320 - DNA, 14 bp, Homo sapiens
cctcgtgccagtcg

SEQ ID NO: 6100321 - DNA, 22 bp, Homo sapiens
cctcgtgcccatcaagtgcagt

SEQ ID NO: 6100322 - DNA, 20 bp, Homo sapiens
cctcgtgcctgggggagaga

SEQ ID NO: 6100323 - DNA, 23 bp, Homo sapiens
cctcgtgctggcggacgcagctg

SEQ ID NO: 6100324 - DNA, 17 bp, Homo sapiens
cctcgtggacacctgcc

SEQ ID NO: 6100325 - DNA, 20 bp, Homo sapiens
cctcgtggacacctgccctg

SEQ ID NO: 6100326 - DNA, 22 bp, Homo sapiens
cctcgtggacacctgccctgcc

SEQ ID NO: 6100327 - DNA, 21 bp, Homo sapiens
cctcgtggagctcgcccctcc

SEQ ID NO: 6100328 - DNA, 22 bp, Homo sapiens
cctcgtggccagcccggctggt

SEQ ID NO: 6100329 - DNA, 23 bp, Homo sapiens
cctcgtggccttccccagcctct

SEQ ID NO: 6100330 - DNA, 20 bp, Homo sapiens
cctcgtgggtcccagagacc

SEQ ID NO: 6100331 - DNA, 21 bp, Homo sapiens
cctcgtgggtcccagagacct

SEQ ID NO: 6100332 - DNA, 18 bp, Homo sapiens
cctcgtggtccccaacag

SEQ ID NO: 6100333 - DNA, 16 bp, Homo sapiens
cctcgtgtcagctcag

SEQ ID NO: 6100334 - DNA, 21 bp, Homo sapiens
cctcgtgtcctgctagctgtc

SEQ ID NO: 6100335 - DNA, 23 bp, Homo sapiens
cctcgttagagaatggcctgaga

SEQ ID NO: 6100336 - DNA, 15 bp, Homo sapiens
cctcgttaggacaag

SEQ ID NO: 6100337 - DNA, 22 bp, Homo sapiens
cctcgttaggacaaggctgtgc

SEQ ID NO: 6100338 - DNA, 17 bp, Homo sapiens
cctcgttctccctggga

SEQ ID NO: 6100339 - DNA, 15 bp, Homo sapiens
cctcgttggaagagg

SEQ ID NO: 6100340 - DNA, 18 bp, Homo sapiens
cctcgttggagagcagca

SEQ ID NO: 6100341 - DNA, 17 bp, Homo sapiens
cctcgttgggccgctct

SEQ ID NO: 6100342 - DNA, 13 bp, Homo sapiens
cctcgtttgtgtt

SEQ ID NO: 6100343 - DNA, 14 bp, Homo sapiens
cctcgttttcaaag

SEQ ID NO: 6100344 - DNA, 22 bp, Homo sapiens
cctctaaaactagaaaaggaag

SEQ ID NO: 6100345 - DNA, 16 bp, Homo sapiens
cctctaaagaaacttg

SEQ ID NO: 6100346 - DNA, 16 bp, Homo sapiens
cctctaacaccacact

SEQ ID NO: 6100347 - DNA, 23 bp, Homo sapiens
cctctaacaccacactgaccaca

SEQ ID NO: 6100348 - DNA, 15 bp, Homo sapiens
cctctaaccccaggc

SEQ ID NO: 6100349 - DNA, 17 bp, Homo sapiens
cctctaaccccaggccc

SEQ ID NO: 6100350 - DNA, 19 bp, Homo sapiens
cctctaaccccaggccccg

SEQ ID NO: 6100351 - DNA, 21 bp, Homo sapiens
cctctaaccccaggccccgag

SEQ ID NO: 6100352 - DNA, 14 bp, Homo sapiens
cctctaactcactg

SEQ ID NO: 6100353 - DNA, 20 bp, Homo sapiens
cctctaactccctcctcaca

SEQ ID NO: 6100354 - DNA, 15 bp, Homo sapiens
cctctaactggacag

SEQ ID NO: 6100355 - DNA, 17 bp, Homo sapiens
cctctaactggacagcc

SEQ ID NO: 6100356 - DNA, 21 bp, Homo sapiens
cctctaacttggctcacactc

SEQ ID NO: 6100357 - DNA, 14 bp, Homo sapiens
cctctaaggccaag

SEQ ID NO: 6100358 - DNA, 15 bp, Homo sapiens
cctctaagtgctgct

SEQ ID NO: 6100359 - DNA, 19 bp, Homo sapiens
cctctaagtgctgctgtgg

SEQ ID NO: 6100360 - DNA, 22 bp, Homo sapiens
cctctaataaagctcctctgct

SEQ ID NO: 6100361 - DNA, 23 bp, Homo sapiens
cctctaataaagctcctctgctc

SEQ ID NO: 6100362 - DNA, 18 bp, Homo sapiens
cctctaatccagcaaagt

SEQ ID NO: 6100363 - DNA, 22 bp, Homo sapiens
cctctaatctgagctgcagcct

SEQ ID NO: 6100364 - DNA, 14 bp, Homo sapiens
cctctaatgagact

SEQ ID NO: 6100365 - DNA, 15 bp, Homo sapiens
cctctaatgctcacg

SEQ ID NO: 6100366 - DNA, 12 bp, Homo sapiens
cctctaattaaa

SEQ ID NO: 6100367 - DNA, 12 bp, Homo sapiens
cctctaattgaa

SEQ ID NO: 6100368 - DNA, 21 bp, Homo sapiens
cctctacagccgtcccgcgtt

SEQ ID NO: 6100369 - DNA, 16 bp, Homo sapiens
cctctaccagaactaa

SEQ ID NO: 6100370 - DNA, 22 bp, Homo sapiens
cctctaccagttggcagacagc

SEQ ID NO: 6100371 - DNA, 16 bp, Homo sapiens
cctctacccaaaccct

SEQ ID NO: 6100372 - DNA, 19 bp, Homo sapiens
cctctacccaaaccctagg

SEQ ID NO: 6100373 - DNA, 15 bp, Homo sapiens
cctctacctctctcc

SEQ ID NO: 6100374 - DNA, 18 bp, Homo sapiens
cctctacctctctcctct

SEQ ID NO: 6100375 - DNA, 13 bp, Homo sapiens
cctctacctggat

SEQ ID NO: 6100376 - DNA, 17 bp, Homo sapiens
cctctactaaaaagaag

SEQ ID NO: 6100377 - DNA, 21 bp, Homo sapiens
cctctactaggtctgctcctg

SEQ ID NO: 6100378 - DNA, 17 bp, Homo sapiens
cctctactgggaaggct

SEQ ID NO: 6100379 - DNA, 10 bp, Homo sapiens
cctctactgt

SEQ ID NO: 6100380 - DNA, 20 bp, Homo sapiens
cctctactgtctcctccctg

SEQ ID NO: 6100381 - DNA, 20 bp, Homo sapiens
cctctactgttgcacagcca

SEQ ID NO: 6100382 - DNA, 14 bp, Homo sapiens
cctctactttccag

SEQ ID NO: 6100383 - DNA, 15 bp, Homo sapiens
cctctagaacaccca

SEQ ID NO: 6100384 - DNA, 21 bp, Homo sapiens
cctctagaacacccactggcc

SEQ ID NO: 6100385 - DNA, 22 bp, Homo sapiens
cctctagaacacccactggcca

SEQ ID NO: 6100386 - DNA, 15 bp, Homo sapiens
cctctagaagccaag

SEQ ID NO: 6100387 - DNA, 17 bp, Homo sapiens
cctctagaatcccagca

SEQ ID NO: 6100388 - DNA, 21 bp, Homo sapiens
cctctagagccttcagcctta

SEQ ID NO: 6100389 - DNA, 14 bp, Homo sapiens
cctctagagctgga

SEQ ID NO: 6100390 - DNA, 14 bp, Homo sapiens
cctctagcaggcct

SEQ ID NO: 6100391 - DNA, 13 bp, Homo sapiens
cctctagctctgg

SEQ ID NO: 6100392 - DNA, 12 bp, Homo sapiens
cctctagctgaa

SEQ ID NO: 6100393 - DNA, 23 bp, Homo sapiens
cctctagctgaattgagcctaaa

SEQ ID NO: 6100394 - DNA, 15 bp, Homo sapiens
cctctagctgttctt

SEQ ID NO: 6100395 - DNA, 22 bp, Homo sapiens
cctctagctgttcttttttgta

SEQ ID NO: 6100396 - DNA, 15 bp, Homo sapiens
cctctagcttttcta

SEQ ID NO: 6100397 - DNA, 15 bp, Homo sapiens
cctctaggaaatgta

SEQ ID NO: 6100398 - DNA, 16 bp, Homo sapiens
cctctaggaggtctct

SEQ ID NO: 6100399 - DNA, 14 bp, Homo sapiens
cctctaggcctcag

SEQ ID NO: 6100400 - DNA, 16 bp, Homo sapiens
cctctaggctctgcct

SEQ ID NO: 6100401 - DNA, 17 bp, Homo sapiens
cctctaggctctgcctt

SEQ ID NO: 6100402 - DNA, 12 bp, Homo sapiens
cctctagggacc

SEQ ID NO: 6100403 - DNA, 19 bp, Homo sapiens
cctctagggacccctcctc

SEQ ID NO: 6100404 - DNA, 23 bp, Homo sapiens
cctctaggtaaactagcaaaagg

SEQ ID NO: 6100405 - DNA, 15 bp, Homo sapiens
cctctaggtccccat

SEQ ID NO: 6100406 - DNA, 22 bp, Homo sapiens
cctctaggtccccatactccta

SEQ ID NO: 6100407 - DNA, 19 bp, Homo sapiens
cctctagtccccaaggcct

SEQ ID NO: 6100408 - DNA, 22 bp, Homo sapiens
cctctagtccccaaggcctctc

SEQ ID NO: 6100409 - DNA, 21 bp, Homo sapiens
cctctagtgaatgtaggctgg

SEQ ID NO: 6100410 - DNA, 13 bp, Homo sapiens
cctctagtgcctt

SEQ ID NO: 6100411 - DNA, 15 bp, Homo sapiens
cctctagtgccttct

SEQ ID NO: 6100412 - DNA, 22 bp, Homo sapiens
cctctagtgtaccaagtgcttc

SEQ ID NO: 6100413 - DNA, 18 bp, Homo sapiens
cctctagttgagtttctg

SEQ ID NO: 6100414 - DNA, 15 bp, Homo sapiens
cgctgacagcctcct

SEQ ID NO: 6100415 - DNA, 17 bp, Homo sapiens
cgctgacagcctcctag

SEQ ID NO: 6100416 - DNA, 19 bp, Homo sapiens
cgctgacagcctcctaggc

SEQ ID NO: 6100417 - DNA, 20 bp, Homo sapiens
cgctgaccctgggcctggag

SEQ ID NO: 6100418 - DNA, 17 bp, Homo sapiens
cgctgactacagggccg

SEQ ID NO: 6100419 - DNA, 16 bp, Homo sapiens
cgctgacttcatggaa

SEQ ID NO: 6100420 - DNA, 16 bp, Homo sapiens
cgctgagactgtgctg

SEQ ID NO: 6100421 - DNA, 17 bp, Homo sapiens
cgctgagactgtgctgt

SEQ ID NO: 6100422 - DNA, 14 bp, Homo sapiens
cgctgagaggctgc

SEQ ID NO: 6100423 - DNA, 22 bp, Homo sapiens
cgctgagaggctgcctccgcac

SEQ ID NO: 6100424 - DNA, 21 bp, Homo sapiens
cgctgagcatggggcgctccc

SEQ ID NO: 6100425 - DNA, 15 bp, Homo sapiens
cgctgagccacctgc

SEQ ID NO: 6100426 - DNA, 20 bp, Homo sapiens
cgctgagcgcccccgagccc

SEQ ID NO: 6100427 - DNA, 15 bp, Homo sapiens
cgctgagctgagtgg

SEQ ID NO: 6100428 - DNA, 17 bp, Homo sapiens
cgctgagctgagtggcc

SEQ ID NO: 6100429 - DNA, 15 bp, Homo sapiens
cgctgaggtgtctgg

SEQ ID NO: 6100430 - DNA, 23 bp, Homo sapiens
cgctgaggtgtctggcctgaggt

SEQ ID NO: 6100431 - DNA, 16 bp, Homo sapiens
cgctgagtggcagggg

SEQ ID NO: 6100432 - DNA, 22 bp, Homo sapiens
cgctgagtggcggggcccctgc

SEQ ID NO: 6100433 - DNA, 23 bp, Homo sapiens
cgctgagtggggggtcgtgggcc

SEQ ID NO: 6100434 - DNA, 19 bp, Homo sapiens
cgctgataagcgttcatgg

SEQ ID NO: 6100435 - DNA, 13 bp, Homo sapiens
cgctgatatatgt

SEQ ID NO: 6100436 - DNA, 14 bp, Homo sapiens
cgctgatcattgga

SEQ ID NO: 6100437 - DNA, 13 bp, Homo sapiens
cgctgatgatata

SEQ ID NO: 6100438 - DNA, 15 bp, Homo sapiens
cgctgatgcagacac

SEQ ID NO: 6100439 - DNA, 13 bp, Homo sapiens
cgctgatgctggg

SEQ ID NO: 6100440 - DNA, 14 bp, Homo sapiens
cgctgatggagccc

SEQ ID NO: 6100441 - DNA, 17 bp, Homo sapiens
cgctgattcctaaggcc

SEQ ID NO: 6100442 - DNA, 19 bp, Homo sapiens
cgctgattcctaaggccca

SEQ ID NO: 6100443 - DNA, 21 bp, Homo sapiens
cgctgattcctaaggcccagc

SEQ ID NO: 6100444 - DNA, 15 bp, Homo sapiens
cgctgattcctcgtg

SEQ ID NO: 6100445 - DNA, 22 bp, Homo sapiens
cgctgcacacagacggcctagg

SEQ ID NO: 6100446 - DNA, 19 bp, Homo sapiens
cgctgcacatggcctgagc

SEQ ID NO: 6100447 - DNA, 21 bp, Homo sapiens
cgctgcacttgacaccaacca

SEQ ID NO: 6100448 - DNA, 13 bp, Homo sapiens
cgctgcagacccc

SEQ ID NO: 6100449 - DNA, 18 bp, Homo sapiens
cgctgcagaccccaggtt

SEQ ID NO: 6100450 - DNA, 18 bp, Homo sapiens
cgctgcagcctctgcctc

SEQ ID NO: 6100451 - DNA, 17 bp, Homo sapiens
cgctgcagggctcccat

SEQ ID NO: 6100452 - DNA, 18 bp, Homo sapiens
cgctgcagtcagcacaga

SEQ ID NO: 6100453 - DNA, 18 bp, Homo sapiens
cgctgcatacaggggagg

SEQ ID NO: 6100454 - DNA, 15 bp, Homo sapiens
cgctgcatgagacat

SEQ ID NO: 6100455 - DNA, 13 bp, Homo sapiens
cgctgccacccac

SEQ ID NO: 6100456 - DNA, 17 bp, Homo sapiens
cgctgccagcacagagc

SEQ ID NO: 6100457 - DNA, 19 bp, Homo sapiens
cgctgccagctctgtatca

SEQ ID NO: 6100458 - DNA, 12 bp, Homo sapiens
cgctgccaggac

SEQ ID NO: 6100459 - DNA, 13 bp, Homo sapiens
cgctgccaggaca

SEQ ID NO: 6100460 - DNA, 15 bp, Homo sapiens
cgctgccaggacacc

SEQ ID NO: 6100461 - DNA, 18 bp, Homo sapiens
cgctgccaggacacctgc

SEQ ID NO: 6100462 - DNA, 19 bp, Homo sapiens
cgctgccaggacacctgcc

SEQ ID NO: 6100463 - DNA, 20 bp, Homo sapiens
cgctgccatcaccgctgggt

SEQ ID NO: 6100464 - DNA, 18 bp, Homo sapiens
cgctgccatttccctgaa

SEQ ID NO: 6100465 - DNA, 21 bp, Homo sapiens
cgctgccatttccctgaacag

SEQ ID NO: 6100466 - DNA, 10 bp, Homo sapiens
cgctgcccag

SEQ ID NO: 6100467 - DNA, 14 bp, Homo sapiens
cgctgcccagccct

SEQ ID NO: 6100468 - DNA, 23 bp, Homo sapiens
cgctgcccagccctcccagctgg

SEQ ID NO: 6100469 - DNA, 12 bp, Homo sapiens
cgctgcccaggc

SEQ ID NO: 6100470 - DNA, 13 bp, Homo sapiens
cgctgcccaggct

SEQ ID NO: 6100471 - DNA, 18 bp, Homo sapiens
cgctgcccaggggagccc

SEQ ID NO: 6100472 - DNA, 21 bp, Homo sapiens
cgctgccccatctcccctcag

SEQ ID NO: 6100473 - DNA, 14 bp, Homo sapiens
cgctgcccccacag

SEQ ID NO: 6100474 - DNA, 16 bp, Homo sapiens
cgctgcccccaccctg

SEQ ID NO: 6100475 - DNA, 15 bp, Homo sapiens
cgctgcccgctcagc

SEQ ID NO: 6100476 - DNA, 20 bp, Homo sapiens
cgctgcccgctcagcccagc

SEQ ID NO: 6100477 - DNA, 19 bp, Homo sapiens
cgctgcccggcgccctctg

SEQ ID NO: 6100478 - DNA, 20 bp, Homo sapiens
cgctgcccggcgccctctgt

SEQ ID NO: 6100479 - DNA, 17 bp, Homo sapiens
cgctgccctgggtcctg

SEQ ID NO: 6100480 - DNA, 22 bp, Homo sapiens
cgctgccctgggtcctgcctgc

SEQ ID NO: 6100481 - DNA, 12 bp, Homo sapiens
cgctgccctgtg

SEQ ID NO: 6100482 - DNA, 13 bp, Homo sapiens
cgctgccctgtga

SEQ ID NO: 6100483 - DNA, 23 bp, Homo sapiens
cgctgccctgtgagagccacgct

SEQ ID NO: 6100484 - DNA, 13 bp, Homo sapiens
cgctgccctttgg

SEQ ID NO: 6100485 - DNA, 18 bp, Homo sapiens
cgctgccgctgcaccacg

SEQ ID NO: 6100486 - DNA, 20 bp, Homo sapiens
cgctgccgggagactgccag

SEQ ID NO: 6100487 - DNA, 20 bp, Homo sapiens
cgctgcctaagtggctgctg

SEQ ID NO: 6100488 - DNA, 16 bp, Homo sapiens
cgctgcctccatggca

SEQ ID NO: 6100489 - DNA, 18 bp, Homo sapiens
cgctgcctccatggcagc

SEQ ID NO: 6100490 - DNA, 15 bp, Homo sapiens
cgctgcctgcccaca

SEQ ID NO: 6100491 - DNA, 17 bp, Homo sapiens
cgctgcctggccaggcc

SEQ ID NO: 6100492 - DNA, 21 bp, Homo sapiens
cgctgcctggccaggccctgg

SEQ ID NO: 6100493 - DNA, 18 bp, Homo sapiens
cgctgcctggcgggcagc

SEQ ID NO: 6100494 - DNA, 19 bp, Homo sapiens
cgctgcctggcgggcagcc

SEQ ID NO: 6100495 - DNA, 22 bp, Homo sapiens
cgctgcctggcgggcagcccct

SEQ ID NO: 6100496 - DNA, 21 bp, Homo sapiens
cgctgcctggtctgtctggat

SEQ ID NO: 6100497 - DNA, 22 bp, Homo sapiens
cgctgcctttatcttgaagtca

SEQ ID NO: 6100498 - DNA, 20 bp, Homo sapiens
cgctgccttttgctgctgct

SEQ ID NO: 6100499 - DNA, 22 bp, Homo sapiens
cgctgcgcaaggcctcgctctt

SEQ ID NO: 6100500 - DNA, 15 bp, Homo sapiens
cgctgcgcagcctcc

SEQ ID NO: 6100501 - DNA, 13 bp, Homo sapiens
cgctgcgctgccc

SEQ ID NO: 6100502 - DNA, 14 bp, Homo sapiens
cgctgcgctgccct

SEQ ID NO: 6100503 - DNA, 15 bp, Homo sapiens
cgctgcgctgccctg

SEQ ID NO: 6100504 - DNA, 16 bp, Homo sapiens
cgctgcgctgccctgc

SEQ ID NO: 6100505 - DNA, 22 bp, Homo sapiens
cgctgcggacaccgtggcctgg

SEQ ID NO: 6100506 - DNA, 18 bp, Homo sapiens
cgctgcgggcccagctga

SEQ ID NO: 6100507 - DNA, 17 bp, Homo sapiens
cgctgcgtcctcatttc

SEQ ID NO: 6100508 - DNA, 23 bp, Homo sapiens
cgctgctacatcagactctagaa

SEQ ID NO: 6100509 - DNA, 16 bp, Homo sapiens
cgctgctccatgcaca

SEQ ID NO: 6100510 - DNA, 15 bp, Homo sapiens
cgctgctccttggct

SEQ ID NO: 6100511 - DNA, 18 bp, Homo sapiens
cgctgctctagctggcag

SEQ ID NO: 6100512 - DNA, 20 bp, Homo sapiens
cgctgctctagctggcagga

SEQ ID NO: 6100513 - DNA, 13 bp, Homo sapiens
cgctgctctccca

SEQ ID NO: 6100514 - DNA, 15 bp, Homo sapiens
cgctgctctcccagg

SEQ ID NO: 6100515 - DNA, 12 bp, Homo sapiens
cgctgctctgcc

SEQ ID NO: 6100516 - DNA, 20 bp, Homo sapiens
cgctgctcttatgccatttg

SEQ ID NO: 6100517 - DNA, 20 bp, Homo sapiens
cgctgctgcaggacattaat

SEQ ID NO: 6100518 - DNA, 18 bp, Homo sapiens
cgctgctgcgccctgggc

SEQ ID NO: 6100519 - DNA, 11 bp, Homo sapiens
cgctgctgcta

SEQ ID NO: 6100520 - DNA, 12 bp, Homo sapiens
cgctgctgcttt

SEQ ID NO: 6100521 - DNA, 13 bp, Homo sapiens
cgctgctgctttc

SEQ ID NO: 6100522 - DNA, 13 bp, Homo sapiens
cgctgctgtcaca

SEQ ID NO: 6100523 - DNA, 18 bp, Homo sapiens
cgctgctgtgacaggcag

SEQ ID NO: 6100524 - DNA, 20 bp, Homo sapiens
cgctgctttgcgctggtgga

SEQ ID NO: 6100525 - DNA, 18 bp, Homo sapiens
cgctggaatccagaagga

SEQ ID NO: 6100526 - DNA, 22 bp, Homo sapiens
cgctggaatccagaaggaagct

SEQ ID NO: 6100527 - DNA, 22 bp, Homo sapiens
cgctggacaacccagaactgga

SEQ ID NO: 6100528 - DNA, 19 bp, Homo sapiens
cgctggaccttgaactggg

SEQ ID NO: 6100529 - DNA, 15 bp, Homo sapiens
cgctggaccttttct

SEQ ID NO: 6100530 - DNA, 21 bp, Homo sapiens
cgctggagaccctgcgcccct

SEQ ID NO: 6100531 - DNA, 22 bp, Homo sapiens
cgctggagaccctgcgcccctg

SEQ ID NO: 6100532 - DNA, 14 bp, Homo sapiens
cgctggagagtcaa

SEQ ID NO: 6100533 - DNA, 14 bp, Homo sapiens
cgctggagatgcaa

SEQ ID NO: 6100534 - DNA, 12 bp, Homo sapiens
cgctggagccca

SEQ ID NO: 6100535 - DNA, 14 bp, Homo sapiens
cgctggagcccaca

SEQ ID NO: 6100536 - DNA, 22 bp, Homo sapiens
cgctggagccgcttccccagct

SEQ ID NO: 6100537 - DNA, 18 bp, Homo sapiens
cgctggaggtggggcctg

SEQ ID NO: 6100538 - DNA, 15 bp, Homo sapiens
cgctggcccagccgg

SEQ ID NO: 6100539 - DNA, 19 bp, Homo sapiens
cgctggcccagggtagggg

SEQ ID NO: 6100540 - DNA, 23 bp, Homo sapiens
cgctggcccagggtaggggaggg

SEQ ID NO: 6100541 - DNA, 12 bp, Homo sapiens
cgctggccccca

SEQ ID NO: 6100542 - DNA, 21 bp, Homo sapiens
cgctggcccccactggctgtg

SEQ ID NO: 6100543 - DNA, 19 bp, Homo sapiens
cgctggcccccccagcccc

SEQ ID NO: 6100544 - DNA, 23 bp, Homo sapiens
cgctggcccctttgggccctgca

SEQ ID NO: 6100545 - DNA, 15 bp, Homo sapiens
cgctggccctgccgt

SEQ ID NO: 6100546 - DNA, 20 bp, Homo sapiens
cgctggccgggggaggtggg

SEQ ID NO: 6100547 - DNA, 16 bp, Homo sapiens
cgctggcgagatacca

SEQ ID NO: 6100548 - DNA, 18 bp, Homo sapiens
cgctggctccctgggcag

SEQ ID NO: 6100549 - DNA, 13 bp, Homo sapiens
cgctggctgcact

SEQ ID NO: 6100550 - DNA, 14 bp, Homo sapiens
cgctggctttctct

SEQ ID NO: 6100551 - DNA, 19 bp, Homo sapiens
cgctggctttctctctggc

SEQ ID NO: 6100552 - DNA, 20 bp, Homo sapiens
cgctggctttgggaaagccc

SEQ ID NO: 6100553 - DNA, 18 bp, Homo sapiens
cgctgggacacagaccgg

SEQ ID NO: 6100554 - DNA, 19 bp, Homo sapiens
cgctgggagaaaagccaga

SEQ ID NO: 6100555 - DNA, 12 bp, Homo sapiens
cgctgggagagc

SEQ ID NO: 6100556 - DNA, 13 bp, Homo sapiens
cgctgggagagcc

SEQ ID NO: 6100557 - DNA, 21 bp, Homo sapiens
cgctgggatttcttcgctgct

SEQ ID NO: 6100558 - DNA, 18 bp, Homo sapiens
cgctgggcacttccctgc

SEQ ID NO: 6100559 - DNA, 20 bp, Homo sapiens
cgctgggcacttccctgctg

SEQ ID NO: 6100560 - DNA, 17 bp, Homo sapiens
cgctgggctgagcccct

SEQ ID NO: 6100561 - DNA, 22 bp, Homo sapiens
cgctgggcttcattccggactg

SEQ ID NO: 6100562 - DNA, 21 bp, Homo sapiens
cgctggggaacagagcgggcc

SEQ ID NO: 6100563 - DNA, 22 bp, Homo sapiens
cgctggggagcgaaagtttctt

SEQ ID NO: 6100564 - DNA, 22 bp, Homo sapiens
cgctgggtcctaattaccagtc

SEQ ID NO: 6100565 - DNA, 19 bp, Homo sapiens
cgctgggtcctctgcagtg

SEQ ID NO: 6100566 - DNA, 22 bp, Homo sapiens
cgctgggtggtaccctctggag

SEQ ID NO: 6100567 - DNA, 15 bp, Homo sapiens
cgctggtagagatgg

SEQ ID NO: 6100568 - DNA, 23 bp, Homo sapiens
cgctggtagagatggaggaggag

SEQ ID NO: 6100569 - DNA, 19 bp, Homo sapiens
cgctggtccctgccctccc

SEQ ID NO: 6100570 - DNA, 12 bp, Homo sapiens
cgctggtctgga

SEQ ID NO: 6100571 - DNA, 12 bp, Homo sapiens
cgctggtgctga

SEQ ID NO: 6100572 - DNA, 13 bp, Homo sapiens
cgctggtgctgag

SEQ ID NO: 6100573 - DNA, 18 bp, Homo sapiens
cgctggttccgccaggcg

SEQ ID NO: 6100574 - DNA, 14 bp, Homo sapiens
cgctgtcaaggccg

SEQ ID NO: 6100575 - DNA, 20 bp, Homo sapiens
cgctgtcaaggccgagggcc

SEQ ID NO: 6100576 - DNA, 22 bp, Homo sapiens
cgctgtcaaggccgagggccag

SEQ ID NO: 6100577 - DNA, 13 bp, Homo sapiens
cgctgtcactggc

SEQ ID NO: 6100578 - DNA, 20 bp, Homo sapiens
cgctgtcactggctggctcc

SEQ ID NO: 6100579 - DNA, 21 bp, Homo sapiens
cgctgtcactggctggctcct

SEQ ID NO: 6100580 - DNA, 22 bp, Homo sapiens
cgctgtcagccattcctgttcc

SEQ ID NO: 6100581 - DNA, 18 bp, Homo sapiens
cgctgtcaggattgcgag

SEQ ID NO: 6100582 - DNA, 20 bp, Homo sapiens
cgctgtcaggattgcgagag

SEQ ID NO: 6100583 - DNA, 13 bp, Homo sapiens
cgctgtcccaggc

SEQ ID NO: 6100584 - DNA, 11 bp, Homo sapiens
cgctgtcccct

SEQ ID NO: 6100585 - DNA, 16 bp, Homo sapiens
cgctgtcctctcgagc

SEQ ID NO: 6100586 - DNA, 23 bp, Homo sapiens
cgctgtcctctcgagcccagatg

SEQ ID NO: 6100587 - DNA, 10 bp, Homo sapiens
cgctgtcctg

SEQ ID NO: 6100588 - DNA, 14 bp, Homo sapiens
cgctgtcctgcgtt

SEQ ID NO: 6100589 - DNA, 16 bp, Homo sapiens
cgctgtcgccccaggc

SEQ ID NO: 6100590 - DNA, 23 bp, Homo sapiens
cgctgtcgccccaggccctccct

SEQ ID NO: 6100591 - DNA, 10 bp, Homo sapiens
cgctgtctct

SEQ ID NO: 6100592 - DNA, 22 bp, Homo sapiens
cgctgtgagatggatgtatttg

SEQ ID NO: 6100593 - DNA, 14 bp, Homo sapiens
cctctagtttactt

SEQ ID NO: 6100594 - DNA, 22 bp, Homo sapiens
cctctagttttttcttcctttt

SEQ ID NO: 6100595 - DNA, 13 bp, Homo sapiens
cctctatacatct

SEQ ID NO: 6100596 - DNA, 17 bp, Homo sapiens
cctctatacatctctcc

SEQ ID NO: 6100597 - DNA, 18 bp, Homo sapiens
cctctatactttgttctg

SEQ ID NO: 6100598 - DNA, 22 bp, Homo sapiens
cctctatcatggtgaaaagctc

SEQ ID NO: 6100599 - DNA, 18 bp, Homo sapiens
cctctatcccggctttgg

SEQ ID NO: 6100600 - DNA, 19 bp, Homo sapiens
cctctatccttttttcctt

SEQ ID NO: 6100601 - DNA, 17 bp, Homo sapiens
cctctatgctggctttt

SEQ ID NO: 6100602 - DNA, 14 bp, Homo sapiens
cctctatggaagga

SEQ ID NO: 6100603 - DNA, 22 bp, Homo sapiens
cctctatggaaggaggcctcca

SEQ ID NO: 6100604 - DNA, 23 bp, Homo sapiens
cctctatggaaggaggcctccac

SEQ ID NO: 6100605 - DNA, 23 bp, Homo sapiens
cctctattgatgtacagtctgtc

SEQ ID NO: 6100606 - DNA, 18 bp, Homo sapiens
cctctatttattagccaa

SEQ ID NO: 6100607 - DNA, 19 bp, Homo sapiens
cctctatttctagagacaa

SEQ ID NO: 6100608 - DNA, 12 bp, Homo sapiens
cctctattttgt

SEQ ID NO: 6100609 - DNA, 22 bp, Homo sapiens
cctctcaacagatctgtgggcc

SEQ ID NO: 6100610 - DNA, 17 bp, Homo sapiens
cctctcaactgcctcag

SEQ ID NO: 6100611 - DNA, 18 bp, Homo sapiens
cctctcaactgcctcagc

SEQ ID NO: 6100612 - DNA, 20 bp, Homo sapiens
cctctcaagctagtgtttct

SEQ ID NO: 6100613 - DNA, 21 bp, Homo sapiens
cctctcaccccactcctgtca

SEQ ID NO: 6100614 - DNA, 13 bp, Homo sapiens
cctctcacctcag

SEQ ID NO: 6100615 - DNA, 16 bp, Homo sapiens
cctctcacctctccct

SEQ ID NO: 6100616 - DNA, 14 bp, Homo sapiens
cctctcacctctgt

SEQ ID NO: 6100617 - DNA, 15 bp, Homo sapiens
cctctcaccttgtcc

SEQ ID NO: 6100618 - DNA, 14 bp, Homo sapiens
cctctcacgccacc

SEQ ID NO: 6100619 - DNA, 15 bp, Homo sapiens
cctctcacgggccct

SEQ ID NO: 6100620 - DNA, 17 bp, Homo sapiens
cctctcactagtgccaa

SEQ ID NO: 6100621 - DNA, 20 bp, Homo sapiens
cctctcactccagccaaaga

SEQ ID NO: 6100622 - DNA, 13 bp, Homo sapiens
cctctcactcctg

SEQ ID NO: 6100623 - DNA, 14 bp, Homo sapiens
cctctcactcctgc

SEQ ID NO: 6100624 - DNA, 18 bp, Homo sapiens
cctctcactcctgcctcc

SEQ ID NO: 6100625 - DNA, 22 bp, Homo sapiens
cctctcactctggcagcctcag

SEQ ID NO: 6100626 - DNA, 12 bp, Homo sapiens
cctctcactgcc

SEQ ID NO: 6100627 - DNA, 14 bp, Homo sapiens
cctctcactgcctc

SEQ ID NO: 6100628 - DNA, 12 bp, Homo sapiens
cctctcactgtc

SEQ ID NO: 6100629 - DNA, 14 bp, Homo sapiens
cctctcactgtctg

SEQ ID NO: 6100630 - DNA, 14 bp, Homo sapiens
cctctcactgtgtc

SEQ ID NO: 6100631 - DNA, 14 bp, Homo sapiens
cctctcagaacata

SEQ ID NO: 6100632 - DNA, 17 bp, Homo sapiens
cctctcagaactcctgt

SEQ ID NO: 6100633 - DNA, 18 bp, Homo sapiens
cctctcagagcaagcctt

SEQ ID NO: 6100634 - DNA, 21 bp, Homo sapiens
cctctcagagcaagcctttga

SEQ ID NO: 6100635 - DNA, 19 bp, Homo sapiens
cctctcagaggcctgctgc

SEQ ID NO: 6100636 - DNA, 20 bp, Homo sapiens
cctctcagagtgacagtcat

SEQ ID NO: 6100637 - DNA, 22 bp, Homo sapiens
cctctcagatcaccccagcctc

SEQ ID NO: 6100638 - DNA, 18 bp, Homo sapiens
cctctcagatccctcggt

SEQ ID NO: 6100639 - DNA, 14 bp, Homo sapiens
cctctcagcatagc

SEQ ID NO: 6100640 - DNA, 21 bp, Homo sapiens
cctctcagcatagcctgcctg

SEQ ID NO: 6100641 - DNA, 11 bp, Homo sapiens
cctctcagccc

SEQ ID NO: 6100642 - DNA, 20 bp, Homo sapiens
cctctcagcccctcagagaa

SEQ ID NO: 6100643 - DNA, 13 bp, Homo sapiens
cctctcagctcca

SEQ ID NO: 6100644 - DNA, 18 bp, Homo sapiens
cctctcagctccaggtgg

SEQ ID NO: 6100645 - DNA, 12 bp, Homo sapiens
cctctcaggaga

SEQ ID NO: 6100646 - DNA, 15 bp, Homo sapiens
cctctcaggatccaa

SEQ ID NO: 6100647 - DNA, 20 bp, Homo sapiens
cctctcaggcatgcctgtgt

SEQ ID NO: 6100648 - DNA, 23 bp, Homo sapiens
cctctcaggccggcagccccagc

SEQ ID NO: 6100649 - DNA, 15 bp, Homo sapiens
cctctcaggctgggc

SEQ ID NO: 6100650 - DNA, 17 bp, Homo sapiens
cctctcaggctgtgctt

SEQ ID NO: 6100651 - DNA, 14 bp, Homo sapiens
cctctcagggcctg

SEQ ID NO: 6100652 - DNA, 13 bp, Homo sapiens
cctctcaggtggg

SEQ ID NO: 6100653 - DNA, 18 bp, Homo sapiens
cctctcagtgccctccag

SEQ ID NO: 6100654 - DNA, 16 bp, Homo sapiens
cctctcatcagcccag

SEQ ID NO: 6100655 - DNA, 21 bp, Homo sapiens
cctctcatcatttgcattggg

SEQ ID NO: 6100656 - DNA, 23 bp, Homo sapiens
cctctcatcatttgcattgggca

SEQ ID NO: 6100657 - DNA, 20 bp, Homo sapiens
cctctcatccaggtcctttc

SEQ ID NO: 6100658 - DNA, 19 bp, Homo sapiens
cctctcatccccctgtgga

SEQ ID NO: 6100659 - DNA, 14 bp, Homo sapiens
cctctcatgtccct

SEQ ID NO: 6100660 - DNA, 16 bp, Homo sapiens
cctctcatgtttccct

SEQ ID NO: 6100661 - DNA, 18 bp, Homo sapiens
cctctcattccagaggaa

SEQ ID NO: 6100662 - DNA, 20 bp, Homo sapiens
cctctcatttagcctgtcct

SEQ ID NO: 6100663 - DNA, 15 bp, Homo sapiens
cctctcatttccagc

SEQ ID NO: 6100664 - DNA, 19 bp, Homo sapiens
cctctcatttccagcttct

SEQ ID NO: 6100665 - DNA, 18 bp, Homo sapiens
cctctccaaatcaaggat

SEQ ID NO: 6100666 - DNA, 21 bp, Homo sapiens
cctctccaaccactgtgccac

SEQ ID NO: 6100667 - DNA, 17 bp, Homo sapiens
cctctccaagacagcag

SEQ ID NO: 6100668 - DNA, 19 bp, Homo sapiens
cctctccaagacagcagca

SEQ ID NO: 6100669 - DNA, 20 bp, Homo sapiens
cctctccaagacagcagcag

SEQ ID NO: 6100670 - DNA, 19 bp, Homo sapiens
cctctccaagcgcctggct

SEQ ID NO: 6100671 - DNA, 22 bp, Homo sapiens
cctctccaagggcttctgcacc

SEQ ID NO: 6100672 - DNA, 23 bp, Homo sapiens
cctctccaagtctctctgtgaat

SEQ ID NO: 6100673 - DNA, 19 bp, Homo sapiens
cctctccaattgtaaaaaa

SEQ ID NO: 6100674 - DNA, 13 bp, Homo sapiens
cctctccacaccc

SEQ ID NO: 6100675 - DNA, 18 bp, Homo sapiens
cctctccacacccagcct

SEQ ID NO: 6100676 - DNA, 15 bp, Homo sapiens
cctctccacacccat

SEQ ID NO: 6100677 - DNA, 22 bp, Homo sapiens
cctctccacacccatgactgcc

SEQ ID NO: 6100678 - DNA, 23 bp, Homo sapiens
cctctccacacccatgactgccc

SEQ ID NO: 6100679 - DNA, 15 bp, Homo sapiens
cctctccacaggagc

SEQ ID NO: 6100680 - DNA, 22 bp, Homo sapiens
cctctccaccatcgtcttcttg

SEQ ID NO: 6100681 - DNA, 22 bp, Homo sapiens
cctctccacccagaggtctccc

SEQ ID NO: 6100682 - DNA, 13 bp, Homo sapiens
cctctccaccctc

SEQ ID NO: 6100683 - DNA, 20 bp, Homo sapiens
cctctccaccctcctctagc

SEQ ID NO: 6100684 - DNA, 23 bp, Homo sapiens
cctctccacctagtggctgtcca

SEQ ID NO: 6100685 - DNA, 16 bp, Homo sapiens
cctctccactccatgt

SEQ ID NO: 6100686 - DNA, 18 bp, Homo sapiens
cctctccactcttctctc

SEQ ID NO: 6100687 - DNA, 12 bp, Homo sapiens
cctctccactgc

SEQ ID NO: 6100688 - DNA, 13 bp, Homo sapiens
cctctccactgcc

SEQ ID NO: 6100689 - DNA, 14 bp, Homo sapiens
cctctccactgctg

SEQ ID NO: 6100690 - DNA, 16 bp, Homo sapiens
cctctccactgctgga

SEQ ID NO: 6100691 - DNA, 18 bp, Homo sapiens
cctctccactgctggaca

SEQ ID NO: 6100692 - DNA, 12 bp, Homo sapiens
cctctccactgt

SEQ ID NO: 6100693 - DNA, 18 bp, Homo sapiens
cctctccagcatcccagc

SEQ ID NO: 6100694 - DNA, 19 bp, Homo sapiens
cctctccagcatcccagcc

SEQ ID NO: 6100695 - DNA, 18 bp, Homo sapiens
cctctccagcctcagccc

SEQ ID NO: 6100696 - DNA, 22 bp, Homo sapiens
cctctccagccttctctctctg

SEQ ID NO: 6100697 - DNA, 15 bp, Homo sapiens
cctctccaggcctgt

SEQ ID NO: 6100698 - DNA, 17 bp, Homo sapiens
cctctccaggcctgtca

SEQ ID NO: 6100699 - DNA, 17 bp, Homo sapiens
cctctccaggtgctcat

SEQ ID NO: 6100700 - DNA, 19 bp, Homo sapiens
cctctccagtttgcacctg

SEQ ID NO: 6100701 - DNA, 23 bp, Homo sapiens
cctctccagtttgcacctgtccc

SEQ ID NO: 6100702 - DNA, 16 bp, Homo sapiens
cctctccatctcccaa

SEQ ID NO: 6100703 - DNA, 12 bp, Homo sapiens
cctctccatgca

SEQ ID NO: 6100704 - DNA, 20 bp, Homo sapiens
cctctccatgcaagtgctgt

SEQ ID NO: 6100705 - DNA, 18 bp, Homo sapiens
cctctccatgcccaacct

SEQ ID NO: 6100706 - DNA, 23 bp, Homo sapiens
cctctcccacagagtgctggact

SEQ ID NO: 6100707 - DNA, 16 bp, Homo sapiens
cctctcccacccaagg

SEQ ID NO: 6100708 - DNA, 22 bp, Homo sapiens
cctctcccacccggccacagct

SEQ ID NO: 6100709 - DNA, 24 bp, Homo sapiens
cctctcccacccggccacagctgc

SEQ ID NO: 6100710 - DNA, 18 bp, Homo sapiens
cctctcccaccctcttcc

SEQ ID NO: 6100711 - DNA, 19 bp, Homo sapiens
cctctcccaccctcttcct

SEQ ID NO: 6100712 - DNA, 11 bp, Homo sapiens
cctctcccagc

SEQ ID NO: 6100713 - DNA, 16 bp, Homo sapiens
cctctcccagccctca

SEQ ID NO: 6100714 - DNA, 17 bp, Homo sapiens
cctctcccagccctcag

SEQ ID NO: 6100715 - DNA, 19 bp, Homo sapiens
cctctcccaggcaggggcc

SEQ ID NO: 6100716 - DNA, 13 bp, Homo sapiens
cctctcccaggcc

SEQ ID NO: 6100717 - DNA, 17 bp, Homo sapiens
cctctcccaggccccat

SEQ ID NO: 6100718 - DNA, 16 bp, Homo sapiens
cctctcccaggcccga

SEQ ID NO: 6100719 - DNA, 18 bp, Homo sapiens
cctctcccaggcccgaga

SEQ ID NO: 6100720 - DNA, 12 bp, Homo sapiens
cctctcccaggg

SEQ ID NO: 6100721 - DNA, 23 bp, Homo sapiens
cctctcccagggatgctctttgt

SEQ ID NO: 6100722 - DNA, 15 bp, Homo sapiens
cctctcccaggtgtt

SEQ ID NO: 6100723 - DNA, 12 bp, Homo sapiens
cctctcccagtt

SEQ ID NO: 6100724 - DNA, 12 bp, Homo sapiens
cctctcccatca

SEQ ID NO: 6100725 - DNA, 13 bp, Homo sapiens
cctctcccatccc

SEQ ID NO: 6100726 - DNA, 17 bp, Homo sapiens
cctctcccatccccctg

SEQ ID NO: 6100727 - DNA, 16 bp, Homo sapiens
cctctcccattcaccc

SEQ ID NO: 6100728 - DNA, 12 bp, Homo sapiens
cctctccccaaa

SEQ ID NO: 6100729 - DNA, 20 bp, Homo sapiens
cctctccccaatccatgctt

SEQ ID NO: 6100730 - DNA, 21 bp, Homo sapiens
cctctccccaatccatgcttc

SEQ ID NO: 6100731 - DNA, 23 bp, Homo sapiens
cctctccccaatccatgcttcac

SEQ ID NO: 6100732 - DNA, 14 bp, Homo sapiens
cctctccccacccc

SEQ ID NO: 6100733 - DNA, 21 bp, Homo sapiens
cctctccccaccttcttggga

SEQ ID NO: 6100734 - DNA, 12 bp, Homo sapiens
cctctccccagc

SEQ ID NO: 6100735 - DNA, 15 bp, Homo sapiens
cctctccccagcaag

SEQ ID NO: 6100736 - DNA, 19 bp, Homo sapiens
cctctccccagcccagaga

SEQ ID NO: 6100737 - DNA, 17 bp, Homo sapiens
cctctccccagcctggc

SEQ ID NO: 6100738 - DNA, 18 bp, Homo sapiens
cctctccccagcctggca

SEQ ID NO: 6100739 - DNA, 19 bp, Homo sapiens
cctctccccattcggtgtg

SEQ ID NO: 6100740 - DNA, 19 bp, Homo sapiens
cctctcccccaaccccctg

SEQ ID NO: 6100741 - DNA, 20 bp, Homo sapiens
cctctcccccaaccccctgc

SEQ ID NO: 6100742 - DNA, 16 bp, Homo sapiens
cctctcccccacaaga

SEQ ID NO: 6100743 - DNA, 19 bp, Homo sapiens
cctctcccccccccctcca

SEQ ID NO: 6100744 - DNA, 17 bp, Homo sapiens
cctctccccctcctcca

SEQ ID NO: 6100745 - DNA, 12 bp, Homo sapiens
cctctccccctt

SEQ ID NO: 6100746 - DNA, 20 bp, Homo sapiens
cctctcccccttcagctcct

SEQ ID NO: 6100747 - DNA, 23 bp, Homo sapiens
cctctcccctaccactgtcttct

SEQ ID NO: 6100748 - DNA, 12 bp, Homo sapiens
cctctcccctcc

SEQ ID NO: 6100749 - DNA, 13 bp, Homo sapiens
cctctcccctcca

SEQ ID NO: 6100750 - DNA, 15 bp, Homo sapiens
cctctcccctccagc

SEQ ID NO: 6100751 - DNA, 17 bp, Homo sapiens
cctctcccctccagcct

SEQ ID NO: 6100752 - DNA, 16 bp, Homo sapiens
cctctcccctgccccc

SEQ ID NO: 6100753 - DNA, 23 bp, Homo sapiens
cctctcccctgccccctgcagga

SEQ ID NO: 6100754 - DNA, 22 bp, Homo sapiens
cctctcccgccagactgttaga

SEQ ID NO: 6100755 - DNA, 17 bp, Homo sapiens
cctctcccggctgcctg

SEQ ID NO: 6100756 - DNA, 18 bp, Homo sapiens
cctctcccgtctcgcctg

SEQ ID NO: 6100757 - DNA, 11 bp, Homo sapiens
cctctccctca

SEQ ID NO: 6100758 - DNA, 22 bp, Homo sapiens
cctctccctcaacaagggagag

SEQ ID NO: 6100759 - DNA, 13 bp, Homo sapiens
cctctccctcagt

SEQ ID NO: 6100760 - DNA, 19 bp, Homo sapiens
cctctccctcagtccttta

SEQ ID NO: 6100761 - DNA, 23 bp, Homo sapiens
cctctccctcctccaggaagcct

SEQ ID NO: 6100762 - DNA, 17 bp, Homo sapiens
cctctccctcctggcca

SEQ ID NO: 6100763 - DNA, 16 bp, Homo sapiens
cctctccctctctctt

SEQ ID NO: 6100764 - DNA, 18 bp, Homo sapiens
cctctccctctggtccca

SEQ ID NO: 6100765 - DNA, 18 bp, Homo sapiens
cctctccctgcatcctga

SEQ ID NO: 6100766 - DNA, 20 bp, Homo sapiens
cctctccctgcatcctgagg

SEQ ID NO: 6100767 - DNA, 13 bp, Homo sapiens
cctctccctgcca

SEQ ID NO: 6100768 - DNA, 14 bp, Homo sapiens
cctctccctgcctg

SEQ ID NO: 6100769 - DNA, 18 bp, Homo sapiens
cctctccctgcctgtggc

SEQ ID NO: 6100770 - DNA, 14 bp, Homo sapiens
cctctccctgggga

SEQ ID NO: 6100771 - DNA, 20 bp, Homo sapiens
cctctccctgtgttctgggc

SEQ ID NO: 6100772 - DNA, 16 bp, Homo sapiens
cgctgtgagcccctgg

SEQ ID NO: 6100773 - DNA, 15 bp, Homo sapiens
cgctgtgagtgagtg

SEQ ID NO: 6100774 - DNA, 15 bp, Homo sapiens
cgctgtgatgctgtg

SEQ ID NO: 6100775 - DNA, 17 bp, Homo sapiens
cgctgtgatgctgtgtg

SEQ ID NO: 6100776 - DNA, 20 bp, Homo sapiens
cgctgtgattggcaggaggc

SEQ ID NO: 6100777 - DNA, 21 bp, Homo sapiens
cgctgtgccaggcgaggccct

SEQ ID NO: 6100778 - DNA, 17 bp, Homo sapiens
cgctgtgcccccctcct

SEQ ID NO: 6100779 - DNA, 16 bp, Homo sapiens
cgctgtgctaggtctg

SEQ ID NO: 6100780 - DNA, 20 bp, Homo sapiens
cgctgtgctatcatgatgga

SEQ ID NO: 6100781 - DNA, 13 bp, Homo sapiens
cgctgtgctccag

SEQ ID NO: 6100782 - DNA, 15 bp, Homo sapiens
cgctgtgctgccctg

SEQ ID NO: 6100783 - DNA, 18 bp, Homo sapiens
cgctgtgctgccctgccc

SEQ ID NO: 6100784 - DNA, 23 bp, Homo sapiens
cgctgtgctgccctgcccacctg

SEQ ID NO: 6100785 - DNA, 15 bp, Homo sapiens
cgctgtgctggttct

SEQ ID NO: 6100786 - DNA, 18 bp, Homo sapiens
cgctgtggccggtgccag

SEQ ID NO: 6100787 - DNA, 12 bp, Homo sapiens
cgctgtggctcc

SEQ ID NO: 6100788 - DNA, 15 bp, Homo sapiens
cgctgtggctcctgc

SEQ ID NO: 6100789 - DNA, 20 bp, Homo sapiens
cgctgtggctcctgccttga

SEQ ID NO: 6100790 - DNA, 13 bp, Homo sapiens
cgctgtgtacaat

SEQ ID NO: 6100791 - DNA, 22 bp, Homo sapiens
cgctgtgttactaatgatcact

SEQ ID NO: 6100792 - DNA, 20 bp, Homo sapiens
cgctgttgatcccctctctg

SEQ ID NO: 6100793 - DNA, 21 bp, Homo sapiens
cgctgttgcccgccctccacc

SEQ ID NO: 6100794 - DNA, 14 bp, Homo sapiens
cgctgttgctgaat

SEQ ID NO: 6100795 - DNA, 17 bp, Homo sapiens
cgctgttgctgaatagg

SEQ ID NO: 6100796 - DNA, 20 bp, Homo sapiens
cgctgttggagcaaaccatt

SEQ ID NO: 6100797 - DNA, 17 bp, Homo sapiens
cgcttaaaggtgtcttc

SEQ ID NO: 6100798 - DNA, 16 bp, Homo sapiens
cgcttaaggtggaaag

SEQ ID NO: 6100799 - DNA, 15 bp, Homo sapiens
cgcttaatccaatat

SEQ ID NO: 6100800 - DNA, 17 bp, Homo sapiens
cgcttagaaacatgttc

SEQ ID NO: 6100801 - DNA, 13 bp, Homo sapiens
cgcttagcctgcc

SEQ ID NO: 6100802 - DNA, 14 bp, Homo sapiens
cgcttagcctgcct

SEQ ID NO: 6100803 - DNA, 15 bp, Homo sapiens
cgcttagcctgcctc

SEQ ID NO: 6100804 - DNA, 20 bp, Homo sapiens
cgcttagcctgcctcaccca

SEQ ID NO: 6100805 - DNA, 21 bp, Homo sapiens
cgcttagggtctgtcccgggt

SEQ ID NO: 6100806 - DNA, 19 bp, Homo sapiens
cgcttagtgctgctttgct

SEQ ID NO: 6100807 - DNA, 17 bp, Homo sapiens
cgcttagttcttgaatt

SEQ ID NO: 6100808 - DNA, 19 bp, Homo sapiens
cgcttagttcttgaattgt

SEQ ID NO: 6100809 - DNA, 14 bp, Homo sapiens
cgcttcaagctctc

SEQ ID NO: 6100810 - DNA, 12 bp, Homo sapiens
cgcttccagacc

SEQ ID NO: 6100811 - DNA, 16 bp, Homo sapiens
cgcttccagaccacct

SEQ ID NO: 6100812 - DNA, 23 bp, Homo sapiens
cgcttccagcttcctctgagccg

SEQ ID NO: 6100813 - DNA, 12 bp, Homo sapiens
cgcttcccagag

SEQ ID NO: 6100814 - DNA, 15 bp, Homo sapiens
cgcttccccacagaa

SEQ ID NO: 6100815 - DNA, 16 bp, Homo sapiens
cgcttccccacagaac

SEQ ID NO: 6100816 - DNA, 14 bp, Homo sapiens
cgcttccccagctc

SEQ ID NO: 6100817 - DNA, 16 bp, Homo sapiens
cgcttccccagctcag

SEQ ID NO: 6100818 - DNA, 13 bp, Homo sapiens
cgcttcccccata

SEQ ID NO: 6100819 - DNA, 15 bp, Homo sapiens
cgcttccccttgcca

SEQ ID NO: 6100820 - DNA, 22 bp, Homo sapiens
cgcttccctacccacagggcct

SEQ ID NO: 6100821 - DNA, 15 bp, Homo sapiens
cgcttccctccttca

SEQ ID NO: 6100822 - DNA, 17 bp, Homo sapiens
cgcttccggctcctgtg

SEQ ID NO: 6100823 - DNA, 17 bp, Homo sapiens
cgcttcctcagcctcca

SEQ ID NO: 6100824 - DNA, 18 bp, Homo sapiens
cgcttcctgagcagtccc

SEQ ID NO: 6100825 - DNA, 22 bp, Homo sapiens
cgcttcctggcctcccttctcc

SEQ ID NO: 6100826 - DNA, 23 bp, Homo sapiens
cgcttctccaatgctctggagtg

SEQ ID NO: 6100827 - DNA, 21 bp, Homo sapiens
cgcttctccccagagctgcct

SEQ ID NO: 6100828 - DNA, 13 bp, Homo sapiens
cgcttctcctcca

SEQ ID NO: 6100829 - DNA, 14 bp, Homo sapiens
cgcttctcctccag

SEQ ID NO: 6100830 - DNA, 15 bp, Homo sapiens
cgcttctcctgcagt

SEQ ID NO: 6100831 - DNA, 21 bp, Homo sapiens
cgcttctcctgcagtctgtgg

SEQ ID NO: 6100832 - DNA, 22 bp, Homo sapiens
cgcttctcctgcagtctgtgga

SEQ ID NO: 6100833 - DNA, 12 bp, Homo sapiens
cgcttctctgtg

SEQ ID NO: 6100834 - DNA, 12 bp, Homo sapiens
cgcttctgactg

SEQ ID NO: 6100835 - DNA, 19 bp, Homo sapiens
cgcttctgcagcctcggcc

SEQ ID NO: 6100836 - DNA, 13 bp, Homo sapiens
cgcttctgctgaa

SEQ ID NO: 6100837 - DNA, 21 bp, Homo sapiens
cgcttctggaggtggggaggg

SEQ ID NO: 6100838 - DNA, 20 bp, Homo sapiens
cgcttctgggaaacagtccc

SEQ ID NO: 6100839 - DNA, 16 bp, Homo sapiens
cgcttcttgcctctgt

SEQ ID NO: 6100840 - DNA, 18 bp, Homo sapiens
cgcttcttgcctctgtgc

SEQ ID NO: 6100841 - DNA, 22 bp, Homo sapiens
cgcttcttgcctctgtgctgtg

SEQ ID NO: 6100842 - DNA, 15 bp, Homo sapiens
cgcttgagcccagga

SEQ ID NO: 6100843 - DNA, 15 bp, Homo sapiens
cgcttgccaaagcag

SEQ ID NO: 6100844 - DNA, 18 bp, Homo sapiens
cgcttgcctcggctcctg

SEQ ID NO: 6100845 - DNA, 22 bp, Homo sapiens
cgcttgcctcggctcctgctgc

SEQ ID NO: 6100846 - DNA, 14 bp, Homo sapiens
cgcttgctctcctg

SEQ ID NO: 6100847 - DNA, 19 bp, Homo sapiens
cgcttgctggaacacaggg

SEQ ID NO: 6100848 - DNA, 23 bp, Homo sapiens
cgcttgctggaacacaggggcct

SEQ ID NO: 6100849 - DNA, 14 bp, Homo sapiens
cgcttgcttctgca

SEQ ID NO: 6100850 - DNA, 17 bp, Homo sapiens
cgcttgcttctgcagca

SEQ ID NO: 6100851 - DNA, 21 bp, Homo sapiens
cgcttgcttctgcagcaactc

SEQ ID NO: 6100852 - DNA, 23 bp, Homo sapiens
cgcttgcttctgcagcaactccc

SEQ ID NO: 6100853 - DNA, 14 bp, Homo sapiens
cgcttggagcagag

SEQ ID NO: 6100854 - DNA, 14 bp, Homo sapiens
cgcttggatctggg

SEQ ID NO: 6100855 - DNA, 18 bp, Homo sapiens
cgcttgtaaataccagga

SEQ ID NO: 6100856 - DNA, 19 bp, Homo sapiens
cgcttgtagaactcactct

SEQ ID NO: 6100857 - DNA, 13 bp, Homo sapiens
cgcttgtgacagt

SEQ ID NO: 6100858 - DNA, 14 bp, Homo sapiens
cgcttgtgacagtg

SEQ ID NO: 6100859 - DNA, 19 bp, Homo sapiens
cgcttgtgacagtgcctct

SEQ ID NO: 6100860 - DNA, 18 bp, Homo sapiens
cgcttgtggggacccagg

SEQ ID NO: 6100861 - DNA, 22 bp, Homo sapiens
cgcttgtggggacccaggctcc

SEQ ID NO: 6100862 - DNA, 13 bp, Homo sapiens
cgctttattttct

SEQ ID NO: 6100863 - DNA, 16 bp, Homo sapiens
cgctttcccctcctcc

SEQ ID NO: 6100864 - DNA, 14 bp, Homo sapiens
cgctttcctgagcc

SEQ ID NO: 6100865 - DNA, 14 bp, Homo sapiens
cgctttccttcctc

SEQ ID NO: 6100866 - DNA, 17 bp, Homo sapiens
cgctttctcctgtgccc

SEQ ID NO: 6100867 - DNA, 17 bp, Homo sapiens
cgctttgaaagaagcaa

SEQ ID NO: 6100868 - DNA, 21 bp, Homo sapiens
cgctttgaacgtgccagcagc

SEQ ID NO: 6100869 - DNA, 21 bp, Homo sapiens
cgctttgctgctaccgccctg

SEQ ID NO: 6100870 - DNA, 17 bp, Homo sapiens
cgctttgtgattccatg

SEQ ID NO: 6100871 - DNA, 21 bp, Homo sapiens
cgcttttaataaactgcaagt

SEQ ID NO: 6100872 - DNA, 14 bp, Homo sapiens
cgcttttccttggc

SEQ ID NO: 6100873 - DNA, 23 bp, Homo sapiens
cgcttttgccattagccaaggat

SEQ ID NO: 6100874 - DNA, 23 bp, Homo sapiens
cgcttttgtacgttaattaaaca

SEQ ID NO: 6100875 - DNA, 15 bp, Homo sapiens
cgctttttcatcctt

SEQ ID NO: 6100876 - DNA, 18 bp, Homo sapiens
cgctttttcatccttctt

SEQ ID NO: 6100877 - DNA, 16 bp, Homo sapiens
cgctttttgaaaaagc

SEQ ID NO: 6100878 - DNA, 17 bp, Homo sapiens
cggaaaaaaaaaaagaa

SEQ ID NO: 6100879 - DNA, 21 bp, Homo sapiens
cggaaaaaaaaaaagaaaaaa

SEQ ID NO: 6100880 - DNA, 21 bp, Homo sapiens
cggaaaacggtggaggccagg

SEQ ID NO: 6100881 - DNA, 18 bp, Homo sapiens
cggaaaatgccaatctct

SEQ ID NO: 6100882 - DNA, 23 bp, Homo sapiens
cggaaacaaaaatgatcctcagt

SEQ ID NO: 6100883 - DNA, 11 bp, Homo sapiens
cggaaacagaa

SEQ ID NO: 6100884 - DNA, 15 bp, Homo sapiens
cggaaacaggtgtgt

SEQ ID NO: 6100885 - DNA, 13 bp, Homo sapiens
cggaaacatagaa

SEQ ID NO: 6100886 - DNA, 15 bp, Homo sapiens
cggaaaccttgcagc

SEQ ID NO: 6100887 - DNA, 16 bp, Homo sapiens
cggaaaccttgcagca

SEQ ID NO: 6100888 - DNA, 17 bp, Homo sapiens
cggaaaccttgcagcat

SEQ ID NO: 6100889 - DNA, 18 bp, Homo sapiens
cggaaaccttgcagcatt

SEQ ID NO: 6100890 - DNA, 19 bp, Homo sapiens
cggaaactagtgtacattt

SEQ ID NO: 6100891 - DNA, 16 bp, Homo sapiens
cggaaagaagaaggtg

SEQ ID NO: 6100892 - DNA, 14 bp, Homo sapiens
cggaaagactgaaa

SEQ ID NO: 6100893 - DNA, 15 bp, Homo sapiens
cggaaagagagctgg

SEQ ID NO: 6100894 - DNA, 16 bp, Homo sapiens
cggaaagagagctgga

SEQ ID NO: 6100895 - DNA, 12 bp, Homo sapiens
cggaaagcagct

SEQ ID NO: 6100896 - DNA, 20 bp, Homo sapiens
cggaaagcagctcaaaggca

SEQ ID NO: 6100897 - DNA, 17 bp, Homo sapiens
cggaaagccctgtgctc

SEQ ID NO: 6100898 - DNA, 19 bp, Homo sapiens
cggaaagtgagagccagca

SEQ ID NO: 6100899 - DNA, 20 bp, Homo sapiens
cggaaatacactacaaatgt

SEQ ID NO: 6100900 - DNA, 13 bp, Homo sapiens
cggaacagctcct

SEQ ID NO: 6100901 - DNA, 16 bp, Homo sapiens
cggaaccacagggcca

SEQ ID NO: 6100902 - DNA, 17 bp, Homo sapiens
cggaaccacagggccag

SEQ ID NO: 6100903 - DNA, 17 bp, Homo sapiens
cggaacccaagcttaga

SEQ ID NO: 6100904 - DNA, 21 bp, Homo sapiens
cggaaccgctcacctagagcc

SEQ ID NO: 6100905 - DNA, 19 bp, Homo sapiens
cggaacggaggcttcagaa

SEQ ID NO: 6100906 - DNA, 16 bp, Homo sapiens
cggaactatgaaaagt

SEQ ID NO: 6100907 - DNA, 16 bp, Homo sapiens
cggaactgcatgctgc

SEQ ID NO: 6100908 - DNA, 17 bp, Homo sapiens
cggaactgcatgctgct

SEQ ID NO: 6100909 - DNA, 22 bp, Homo sapiens
cggaagaaccagaagtgcagcc

SEQ ID NO: 6100910 - DNA, 17 bp, Homo sapiens
cggaagaatcacttgaa

SEQ ID NO: 6100911 - DNA, 15 bp, Homo sapiens
cggaagagagggctg

SEQ ID NO: 6100912 - DNA, 13 bp, Homo sapiens
cggaagagccttg

SEQ ID NO: 6100913 - DNA, 20 bp, Homo sapiens
cggaagagttacaataaagt

SEQ ID NO: 6100914 - DNA, 22 bp, Homo sapiens
cggaagccaaaggcagctaaga

SEQ ID NO: 6100915 - DNA, 12 bp, Homo sapiens
cggaagccatag

SEQ ID NO: 6100916 - DNA, 18 bp, Homo sapiens
cggaagccatagggggct

SEQ ID NO: 6100917 - DNA, 24 bp, Homo sapiens
cggaagccccctcttcctccctgg

SEQ ID NO: 6100918 - DNA, 12 bp, Homo sapiens
cggaagcctgtc

SEQ ID NO: 6100919 - DNA, 19 bp, Homo sapiens
cggaagcgccaggctggag

SEQ ID NO: 6100920 - DNA, 14 bp, Homo sapiens
cggaagctcctggt

SEQ ID NO: 6100921 - DNA, 15 bp, Homo sapiens
cggaagctcctggta

SEQ ID NO: 6100922 - DNA, 16 bp, Homo sapiens
cggaaggagactgtgg

SEQ ID NO: 6100923 - DNA, 12 bp, Homo sapiens
cggaaggaggcc

SEQ ID NO: 6100924 - DNA, 16 bp, Homo sapiens
cggaaggcgctggagc

SEQ ID NO: 6100925 - DNA, 19 bp, Homo sapiens
cggaaggcgggctgaggag

SEQ ID NO: 6100926 - DNA, 23 bp, Homo sapiens
cggaagggactctgggctgtgcc

SEQ ID NO: 6100927 - DNA, 21 bp, Homo sapiens
cggaaggggacgctttgaagg

SEQ ID NO: 6100928 - DNA, 23 bp, Homo sapiens
cggaaggggcgctcctcccagct

SEQ ID NO: 6100929 - DNA, 16 bp, Homo sapiens
cggaagggggaagtct

SEQ ID NO: 6100930 - DNA, 17 bp, Homo sapiens
cggaaggggttcctcaa

SEQ ID NO: 6100931 - DNA, 15 bp, Homo sapiens
cggaagggtaaacaa

SEQ ID NO: 6100932 - DNA, 15 bp, Homo sapiens
cggaaggtcagttgc

SEQ ID NO: 6100933 - DNA, 20 bp, Homo sapiens
cggaagtaaacctgaacaaa

SEQ ID NO: 6100934 - DNA, 18 bp, Homo sapiens
cggaagtacttccctcag

SEQ ID NO: 6100935 - DNA, 14 bp, Homo sapiens
cggaagtggcctga

SEQ ID NO: 6100936 - DNA, 20 bp, Homo sapiens
cggaagtggcctgagaagag

SEQ ID NO: 6100937 - DNA, 12 bp, Homo sapiens
cggaagttttca

SEQ ID NO: 6100938 - DNA, 21 bp, Homo sapiens
cggaataaactagagaaggga

SEQ ID NO: 6100939 - DNA, 17 bp, Homo sapiens
cggaataagagacctgt

SEQ ID NO: 6100940 - DNA, 17 bp, Homo sapiens
cggaatagttggctagg

SEQ ID NO: 6100941 - DNA, 14 bp, Homo sapiens
cggaatccaagcta

SEQ ID NO: 6100942 - DNA, 20 bp, Homo sapiens
cggaatccaagctaatttct

SEQ ID NO: 6100943 - DNA, 21 bp, Homo sapiens
cggaatccaagctaatttcta

SEQ ID NO: 6100944 - DNA, 17 bp, Homo sapiens
cggaatcctgtcctcag

SEQ ID NO: 6100945 - DNA, 18 bp, Homo sapiens
cggaatcctgtcctcagc

SEQ ID NO: 6100946 - DNA, 20 bp, Homo sapiens
cggaatgaaccacatcttgc

SEQ ID NO: 6100947 - DNA, 13 bp, Homo sapiens
cggaattccaata

SEQ ID NO: 6100948 - DNA, 21 bp, Homo sapiens
cggaattctcgggaaattatt

SEQ ID NO: 6100949 - DNA, 13 bp, Homo sapiens
cggaatttacctg

SEQ ID NO: 6100950 - DNA, 22 bp, Homo sapiens
cggacaaaaccccccagatatc

SEQ ID NO: 6100951 - DNA, 12 bp, Homo sapiens
cctctcccttcc

SEQ ID NO: 6100952 - DNA, 17 bp, Homo sapiens
cctctcccttccctcct

SEQ ID NO: 6100953 - DNA, 13 bp, Homo sapiens
cctctcccttgga

SEQ ID NO: 6100954 - DNA, 19 bp, Homo sapiens
cctctcccttgggctctga

SEQ ID NO: 6100955 - DNA, 23 bp, Homo sapiens
cctctccgactctgcacccgcct

SEQ ID NO: 6100956 - DNA, 13 bp, Homo sapiens
cctctccgagctg

SEQ ID NO: 6100957 - DNA, 18 bp, Homo sapiens
cctctccgcacacctctg

SEQ ID NO: 6100958 - DNA, 23 bp, Homo sapiens
cctctccgcacacctctggctgt

SEQ ID NO: 6100959 - DNA, 22 bp, Homo sapiens
cctctccgcccctgagcccact

SEQ ID NO: 6100960 - DNA, 17 bp, Homo sapiens
cctctccgcgccctccg

SEQ ID NO: 6100961 - DNA, 22 bp, Homo sapiens
cctctccgcgggagaccccttg

SEQ ID NO: 6100962 - DNA, 14 bp, Homo sapiens
cctctccgtttatt

SEQ ID NO: 6100963 - DNA, 14 bp, Homo sapiens
cctctcctaacata

SEQ ID NO: 6100964 - DNA, 20 bp, Homo sapiens
cctctcctactcggctctgc

SEQ ID NO: 6100965 - DNA, 14 bp, Homo sapiens
cctctcctccacat

SEQ ID NO: 6100966 - DNA, 11 bp, Homo sapiens
cctctcctccc

SEQ ID NO: 6100967 - DNA, 14 bp, Homo sapiens
cctctcctcccagc

SEQ ID NO: 6100968 - DNA, 14 bp, Homo sapiens
cctctcctccccct

SEQ ID NO: 6100969 - DNA, 20 bp, Homo sapiens
cctctcctccccttcctgtt

SEQ ID NO: 6100970 - DNA, 13 bp, Homo sapiens
cctctcctccttg

SEQ ID NO: 6100971 - DNA, 12 bp, Homo sapiens
cctctcctcgtc

SEQ ID NO: 6100972 - DNA, 21 bp, Homo sapiens
cctctcctcgtccggcctgca

SEQ ID NO: 6100973 - DNA, 23 bp, Homo sapiens
cctctcctcgtccggcctgcagc

SEQ ID NO: 6100974 - DNA, 11 bp, Homo sapiens
cctctcctctc

SEQ ID NO: 6100975 - DNA, 22 bp, Homo sapiens
cctctcctctgtccccatagct

SEQ ID NO: 6100976 - DNA, 14 bp, Homo sapiens
cctctcctgcatcc

SEQ ID NO: 6100977 - DNA, 15 bp, Homo sapiens
cctctcctgcatccc

SEQ ID NO: 6100978 - DNA, 19 bp, Homo sapiens
cctctcctgcccaagcact

SEQ ID NO: 6100979 - DNA, 14 bp, Homo sapiens
cctctcctgcccag

SEQ ID NO: 6100980 - DNA, 13 bp, Homo sapiens
cctctcctgccct

SEQ ID NO: 6100981 - DNA, 14 bp, Homo sapiens
cctctcctgccctg

SEQ ID NO: 6100982 - DNA, 17 bp, Homo sapiens
cctctcctgccctgtga

SEQ ID NO: 6100983 - DNA, 18 bp, Homo sapiens
cctctcctgccctgtgat

SEQ ID NO: 6100984 - DNA, 12 bp, Homo sapiens
cctctcctgcct

SEQ ID NO: 6100985 - DNA, 13 bp, Homo sapiens
cctctcctgccta

SEQ ID NO: 6100986 - DNA, 15 bp, Homo sapiens
cctctcctgcctact

SEQ ID NO: 6100987 - DNA, 16 bp, Homo sapiens
cctctcctgcctactc

SEQ ID NO: 6100988 - DNA, 20 bp, Homo sapiens
cctctcctgcttcctctttt

SEQ ID NO: 6100989 - DNA, 10 bp, Homo sapiens
cctctcctgg

SEQ ID NO: 6100990 - DNA, 11 bp, Homo sapiens
cctctcctgga

SEQ ID NO: 6100991 - DNA, 18 bp, Homo sapiens
cctctcctggaaacagac

SEQ ID NO: 6100992 - DNA, 14 bp, Homo sapiens
cctctcctggagga

SEQ ID NO: 6100993 - DNA, 12 bp, Homo sapiens
cctctcctgggc

SEQ ID NO: 6100994 - DNA, 22 bp, Homo sapiens
cctctcctgggcagctgcctcc

SEQ ID NO: 6100995 - DNA, 23 bp, Homo sapiens
cctctccttcatgacagcctcca

SEQ ID NO: 6100996 - DNA, 13 bp, Homo sapiens
cctctccttccaa

SEQ ID NO: 6100997 - DNA, 12 bp, Homo sapiens
cctctccttcct

SEQ ID NO: 6100998 - DNA, 13 bp, Homo sapiens
cctctccttccta

SEQ ID NO: 6100999 - DNA, 15 bp, Homo sapiens
cctctccttcctgtg

SEQ ID NO: 6101000 - DNA, 22 bp, Homo sapiens
cctctccttgccccagtcctgg

SEQ ID NO: 6101001 - DNA, 21 bp, Homo sapiens
cctctccttgcccccagtgcc

SEQ ID NO: 6101002 - DNA, 22 bp, Homo sapiens
cctctccttgcccccagtgcct

SEQ ID NO: 6101003 - DNA, 15 bp, Homo sapiens
cctctccttgcctgg

SEQ ID NO: 6101004 - DNA, 16 bp, Homo sapiens
cctctccttgggctcc

SEQ ID NO: 6101005 - DNA, 16 bp, Homo sapiens
cctctcctttgtatat

SEQ ID NO: 6101006 - DNA, 14 bp, Homo sapiens
cctctcctttgttc

SEQ ID NO: 6101007 - DNA, 17 bp, Homo sapiens
cctctccttttgaggct

SEQ ID NO: 6101008 - DNA, 18 bp, Homo sapiens
cctctcgacggcacgcac

SEQ ID NO: 6101009 - DNA, 22 bp, Homo sapiens
cctctcgacggcacgcacttgc

SEQ ID NO: 6101010 - DNA, 16 bp, Homo sapiens
cctctcgagggcaggg

SEQ ID NO: 6101011 - DNA, 23 bp, Homo sapiens
cctctcgcacaatgcatgtgctg

SEQ ID NO: 6101012 - DNA, 21 bp, Homo sapiens
cctctcgccccatccctgctt

SEQ ID NO: 6101013 - DNA, 17 bp, Homo sapiens
cctctcgcgcccagcat

SEQ ID NO: 6101014 - DNA, 14 bp, Homo sapiens
cctctcgctcccct

SEQ ID NO: 6101015 - DNA, 21 bp, Homo sapiens
cctctcggaaggctggctggg

SEQ ID NO: 6101016 - DNA, 21 bp, Homo sapiens
cctctcggccccatcgcccca

SEQ ID NO: 6101017 - DNA, 12 bp, Homo sapiens
cctctcggctgc

SEQ ID NO: 6101018 - DNA, 17 bp, Homo sapiens
cctctcggctgccaggg

SEQ ID NO: 6101019 - DNA, 17 bp, Homo sapiens
cctctcgggctctctca

SEQ ID NO: 6101020 - DNA, 19 bp, Homo sapiens
cctctcgggctctctcacc

SEQ ID NO: 6101021 - DNA, 20 bp, Homo sapiens
cctctcgtcccgtccctccc

SEQ ID NO: 6101022 - DNA, 15 bp, Homo sapiens
cctctcgtttctgcc

SEQ ID NO: 6101023 - DNA, 17 bp, Homo sapiens
cctctcgtttctgccca

SEQ ID NO: 6101024 - DNA, 18 bp, Homo sapiens
cctctcgtttctgcccag

SEQ ID NO: 6101025 - DNA, 16 bp, Homo sapiens
cctctctaacctcctt

SEQ ID NO: 6101026 - DNA, 15 bp, Homo sapiens
cctctctacagtctc

SEQ ID NO: 6101027 - DNA, 15 bp, Homo sapiens
cctctctacccccca

SEQ ID NO: 6101028 - DNA, 19 bp, Homo sapiens
cctctctaccccccacctt

SEQ ID NO: 6101029 - DNA, 19 bp, Homo sapiens
cctctctactggagtggaa

SEQ ID NO: 6101030 - DNA, 15 bp, Homo sapiens
cctctctagggaccc

SEQ ID NO: 6101031 - DNA, 17 bp, Homo sapiens
cctctctatcctctctt

SEQ ID NO: 6101032 - DNA, 21 bp, Homo sapiens
cctctctatcctctcttcctc

SEQ ID NO: 6101033 - DNA, 22 bp, Homo sapiens
cctctctcagagcatctggctg

SEQ ID NO: 6101034 - DNA, 20 bp, Homo sapiens
cctctctcagcacagcctgg

SEQ ID NO: 6101035 - DNA, 15 bp, Homo sapiens
cctctctcagcccag

SEQ ID NO: 6101036 - DNA, 16 bp, Homo sapiens
cctctctcagcccagg

SEQ ID NO: 6101037 - DNA, 18 bp, Homo sapiens
cctctctcatatcactga

SEQ ID NO: 6101038 - DNA, 14 bp, Homo sapiens
cctctctcatgaga

SEQ ID NO: 6101039 - DNA, 20 bp, Homo sapiens
cctctctcccaccctaaggg

SEQ ID NO: 6101040 - DNA, 15 bp, Homo sapiens
cctctctcccagtct

SEQ ID NO: 6101041 - DNA, 14 bp, Homo sapiens
cctctctccccaaa

SEQ ID NO: 6101042 - DNA, 14 bp, Homo sapiens
cctctctcccctct

SEQ ID NO: 6101043 - DNA, 16 bp, Homo sapiens
cctctctccctctccc

SEQ ID NO: 6101044 - DNA, 16 bp, Homo sapiens
cctctctccctgcctc

SEQ ID NO: 6101045 - DNA, 17 bp, Homo sapiens
cctctctccctgcctca

SEQ ID NO: 6101046 - DNA, 16 bp, Homo sapiens
cctctctcctctccgc

SEQ ID NO: 6101047 - DNA, 14 bp, Homo sapiens
cctctctcctggac

SEQ ID NO: 6101048 - DNA, 15 bp, Homo sapiens
cctctctcctggact

SEQ ID NO: 6101049 - DNA, 23 bp, Homo sapiens
cctctctccttggccacagactg

SEQ ID NO: 6101050 - DNA, 16 bp, Homo sapiens
cctctctcggagccct

SEQ ID NO: 6101051 - DNA, 20 bp, Homo sapiens
cctctctcggagccctcaga

SEQ ID NO: 6101052 - DNA, 21 bp, Homo sapiens
cctctctcggagccctcagac

SEQ ID NO: 6101053 - DNA, 13 bp, Homo sapiens
cctctctctaagt

SEQ ID NO: 6101054 - DNA, 19 bp, Homo sapiens
cctctctctaccagtctat

SEQ ID NO: 6101055 - DNA, 11 bp, Homo sapiens
cctctctctcc

SEQ ID NO: 6101056 - DNA, 15 bp, Homo sapiens
cctctctctccctcc

SEQ ID NO: 6101057 - DNA, 17 bp, Homo sapiens
cctctctctccctccac

SEQ ID NO: 6101058 - DNA, 18 bp, Homo sapiens
cctctctctccctccact

SEQ ID NO: 6101059 - DNA, 16 bp, Homo sapiens
cctctctctccctccc

SEQ ID NO: 6101060 - DNA, 23 bp, Homo sapiens
cctctctctccctctttctagcc

SEQ ID NO: 6101061 - DNA, 15 bp, Homo sapiens
cctctctctctctat

SEQ ID NO: 6101062 - DNA, 16 bp, Homo sapiens
cctctctctctctcct

SEQ ID NO: 6101063 - DNA, 19 bp, Homo sapiens
cctctctctctctcctcag

SEQ ID NO: 6101064 - DNA, 15 bp, Homo sapiens
cctctctctcttcct

SEQ ID NO: 6101065 - DNA, 14 bp, Homo sapiens
cctctctctcttct

SEQ ID NO: 6101066 - DNA, 15 bp, Homo sapiens
cctctctctcttcta

SEQ ID NO: 6101067 - DNA, 15 bp, Homo sapiens
cctctctctgactct

SEQ ID NO: 6101068 - DNA, 13 bp, Homo sapiens
cctctctctgctc

SEQ ID NO: 6101069 - DNA, 18 bp, Homo sapiens
cctctctctgctcctcac

SEQ ID NO: 6101070 - DNA, 11 bp, Homo sapiens
cctctctctgg

SEQ ID NO: 6101071 - DNA, 15 bp, Homo sapiens
cctctctctggaaag

SEQ ID NO: 6101072 - DNA, 11 bp, Homo sapiens
cctctctctgt

SEQ ID NO: 6101073 - DNA, 13 bp, Homo sapiens
cctctctctgtgg

SEQ ID NO: 6101074 - DNA, 17 bp, Homo sapiens
cctctctctgtggggct

SEQ ID NO: 6101075 - DNA, 16 bp, Homo sapiens
cctctctcttctgctc

SEQ ID NO: 6101076 - DNA, 20 bp, Homo sapiens
cctctctcttctgctccacc

SEQ ID NO: 6101077 - DNA, 21 bp, Homo sapiens
cctctctgaactgcaacactg

SEQ ID NO: 6101078 - DNA, 21 bp, Homo sapiens
cctctctgaagcgactctcct

SEQ ID NO: 6101079 - DNA, 23 bp, Homo sapiens
cctctctgaagcgactctcctgt

SEQ ID NO: 6101080 - DNA, 18 bp, Homo sapiens
cctctctgaaggaggcca

SEQ ID NO: 6101081 - DNA, 19 bp, Homo sapiens
cctctctgagactgctaag

SEQ ID NO: 6101082 - DNA, 16 bp, Homo sapiens
cctctctgagtcaaat

SEQ ID NO: 6101083 - DNA, 17 bp, Homo sapiens
cctctctgagtcaaatc

SEQ ID NO: 6101084 - DNA, 19 bp, Homo sapiens
cctctctgagtcaaatcca

SEQ ID NO: 6101085 - DNA, 20 bp, Homo sapiens
cctctctgagtcaaatccag

SEQ ID NO: 6101086 - DNA, 18 bp, Homo sapiens
cctctctgagtctggact

SEQ ID NO: 6101087 - DNA, 12 bp, Homo sapiens
cctctctgcacc

SEQ ID NO: 6101088 - DNA, 17 bp, Homo sapiens
cctctctgcagacttcc

SEQ ID NO: 6101089 - DNA, 22 bp, Homo sapiens
cctctctgcagacttcccagct

SEQ ID NO: 6101090 - DNA, 15 bp, Homo sapiens
cctctctgcaggtcc

SEQ ID NO: 6101091 - DNA, 19 bp, Homo sapiens
cctctctgcaggtccctaa

SEQ ID NO: 6101092 - DNA, 20 bp, Homo sapiens
cctctctgcaggtccctaat

SEQ ID NO: 6101093 - DNA, 13 bp, Homo sapiens
cctctctgcagtc

SEQ ID NO: 6101094 - DNA, 13 bp, Homo sapiens
cctctctgcccca

SEQ ID NO: 6101095 - DNA, 19 bp, Homo sapiens
cctctctgccccacccaag

SEQ ID NO: 6101096 - DNA, 19 bp, Homo sapiens
cctctctgcctctcttctt

SEQ ID NO: 6101097 - DNA, 10 bp, Homo sapiens
cctctctgct

SEQ ID NO: 6101098 - DNA, 15 bp, Homo sapiens
cctctctgctccaga

SEQ ID NO: 6101099 - DNA, 22 bp, Homo sapiens
cctctctgctccagactcactt

SEQ ID NO: 6101100 - DNA, 14 bp, Homo sapiens
cctctctgctgggt

SEQ ID NO: 6101101 - DNA, 13 bp, Homo sapiens
cctctctggaaga

SEQ ID NO: 6101102 - DNA, 13 bp, Homo sapiens
cctctctggcctc

SEQ ID NO: 6101103 - DNA, 16 bp, Homo sapiens
cctctctggcctccca

SEQ ID NO: 6101104 - DNA, 22 bp, Homo sapiens
cctctctggcctcccacccgat

SEQ ID NO: 6101105 - DNA, 15 bp, Homo sapiens
cctctctggccttgc

SEQ ID NO: 6101106 - DNA, 13 bp, Homo sapiens
cctctctggctca

SEQ ID NO: 6101107 - DNA, 14 bp, Homo sapiens
cctctctggctcag

SEQ ID NO: 6101108 - DNA, 13 bp, Homo sapiens
cctctctgggcct

SEQ ID NO: 6101109 - DNA, 11 bp, Homo sapiens
cctctctgggg

SEQ ID NO: 6101110 - DNA, 16 bp, Homo sapiens
cctctctgggggaggc

SEQ ID NO: 6101111 - DNA, 19 bp, Homo sapiens
cctctctgggggaggcagg

SEQ ID NO: 6101112 - DNA, 21 bp, Homo sapiens
cctctctgggggaggcagggc

SEQ ID NO: 6101113 - DNA, 23 bp, Homo sapiens
cctctctgggggaggcagggctg

SEQ ID NO: 6101114 - DNA, 13 bp, Homo sapiens
cctctctgtccaa

SEQ ID NO: 6101115 - DNA, 12 bp, Homo sapiens
cctctctgtccc

SEQ ID NO: 6101116 - DNA, 13 bp, Homo sapiens
cctctctgtccct

SEQ ID NO: 6101117 - DNA, 18 bp, Homo sapiens
cctctctgtctgtctctc

SEQ ID NO: 6101118 - DNA, 12 bp, Homo sapiens
cctctctgtctt

SEQ ID NO: 6101119 - DNA, 24 bp, Homo sapiens
cctctctgtctttttccttcctga

SEQ ID NO: 6101120 - DNA, 19 bp, Homo sapiens
cctctctgtgtccctgctg

SEQ ID NO: 6101121 - DNA, 10 bp, Homo sapiens
cctctctgtt

SEQ ID NO: 6101122 - DNA, 16 bp, Homo sapiens
cctctctgttgccttt

SEQ ID NO: 6101123 - DNA, 21 bp, Homo sapiens
cctctcttaagatgtccaggg

SEQ ID NO: 6101124 - DNA, 17 bp, Homo sapiens
cctctcttaatgccacg

SEQ ID NO: 6101125 - DNA, 22 bp, Homo sapiens
cctctcttaccccgtccctttc

SEQ ID NO: 6101126 - DNA, 13 bp, Homo sapiens
cctctcttcagcc

SEQ ID NO: 6101127 - DNA, 21 bp, Homo sapiens
cctctcttcagcccctagtgc

SEQ ID NO: 6101128 - DNA, 14 bp, Homo sapiens
cctctcttccacag

SEQ ID NO: 6101129 - DNA, 12 bp, Homo sapiens
cctctcttcccc

SEQ ID NO: 6101130 - DNA, 16 bp, Homo sapiens
cctctcttccccttcc

SEQ ID NO: 6101131 - DNA, 12 bp, Homo sapiens
cctctcttccct

SEQ ID NO: 6101132 - DNA, 19 bp, Homo sapiens
cctctcttccgggagctgg

SEQ ID NO: 6101133 - DNA, 17 bp, Homo sapiens
cggacaaaagggccagg

SEQ ID NO: 6101134 - DNA, 12 bp, Homo sapiens
cggacaaaatat

SEQ ID NO: 6101135 - DNA, 22 bp, Homo sapiens
cggacaagcccaggacactgcc

SEQ ID NO: 6101136 - DNA, 13 bp, Homo sapiens
cggacaagtttta

SEQ ID NO: 6101137 - DNA, 13 bp, Homo sapiens
cggacaataaacc

SEQ ID NO: 6101138 - DNA, 22 bp, Homo sapiens
cggacaataaacctccgccaat

SEQ ID NO: 6101139 - DNA, 13 bp, Homo sapiens
cggacacccaggg

SEQ ID NO: 6101140 - DNA, 12 bp, Homo sapiens
cggacaccccct

SEQ ID NO: 6101141 - DNA, 14 bp, Homo sapiens
cggacaccgtggcc

SEQ ID NO: 6101142 - DNA, 19 bp, Homo sapiens
cggacaccgtggcctgggc

SEQ ID NO: 6101143 - DNA, 13 bp, Homo sapiens
cggacacggcttc

SEQ ID NO: 6101144 - DNA, 16 bp, Homo sapiens
cggacacttctcagga

SEQ ID NO: 6101145 - DNA, 14 bp, Homo sapiens
cggacacttttgag

SEQ ID NO: 6101146 - DNA, 16 bp, Homo sapiens
cggacagagcccccct

SEQ ID NO: 6101147 - DNA, 18 bp, Homo sapiens
cggacagccacggccagg

SEQ ID NO: 6101148 - DNA, 16 bp, Homo sapiens
cggacagctgcccaga

SEQ ID NO: 6101149 - DNA, 17 bp, Homo sapiens
cggacagctgcccagac

SEQ ID NO: 6101150 - DNA, 15 bp, Homo sapiens
cggacaggaggattc

SEQ ID NO: 6101151 - DNA, 14 bp, Homo sapiens
cggacagtcggaaa

SEQ ID NO: 6101152 - DNA, 18 bp, Homo sapiens
cggacagtcggaaaagcg

SEQ ID NO: 6101153 - DNA, 16 bp, Homo sapiens
cggacagtgcccatgc

SEQ ID NO: 6101154 - DNA, 16 bp, Homo sapiens
cggacatactctctgc

SEQ ID NO: 6101155 - DNA, 15 bp, Homo sapiens
cggacattctaatgc

SEQ ID NO: 6101156 - DNA, 22 bp, Homo sapiens
cggaccaagatgggcacatgag

SEQ ID NO: 6101157 - DNA, 21 bp, Homo sapiens
cggaccaccctcactggctct

SEQ ID NO: 6101158 - DNA, 16 bp, Homo sapiens
cggaccactcgaggcc

SEQ ID NO: 6101159 - DNA, 17 bp, Homo sapiens
cggaccactcgaggcct

SEQ ID NO: 6101160 - DNA, 18 bp, Homo sapiens
cggaccactcgaggcctg

SEQ ID NO: 6101161 - DNA, 17 bp, Homo sapiens
cggacccaccccaactc

SEQ ID NO: 6101162 - DNA, 23 bp, Homo sapiens
cggacccaccccaactctcccca

SEQ ID NO: 6101163 - DNA, 22 bp, Homo sapiens
cggaccccagctgtgagccttg

SEQ ID NO: 6101164 - DNA, 23 bp, Homo sapiens
cggacccccagagcacccccaag

SEQ ID NO: 6101165 - DNA, 20 bp, Homo sapiens
cggacccggaggccgaggcc

SEQ ID NO: 6101166 - DNA, 14 bp, Homo sapiens
cggaccctgtgtgg

SEQ ID NO: 6101167 - DNA, 12 bp, Homo sapiens
cggacccttccc

SEQ ID NO: 6101168 - DNA, 13 bp, Homo sapiens
cggacccttccca

SEQ ID NO: 6101169 - DNA, 18 bp, Homo sapiens
cggacccttcccagccct

SEQ ID NO: 6101170 - DNA, 17 bp, Homo sapiens
cggacccttctgggtcc

SEQ ID NO: 6101171 - DNA, 17 bp, Homo sapiens
cggaccgcatcctccag

SEQ ID NO: 6101172 - DNA, 20 bp, Homo sapiens
cggaccgcatcctccagggg

SEQ ID NO: 6101173 - DNA, 13 bp, Homo sapiens
cggaccgcgtaga

SEQ ID NO: 6101174 - DNA, 19 bp, Homo sapiens
cggaccggagcggctgagg

SEQ ID NO: 6101175 - DNA, 20 bp, Homo sapiens
cggaccggagcggctgagga

SEQ ID NO: 6101176 - DNA, 18 bp, Homo sapiens
cggacctacctccctccc

SEQ ID NO: 6101177 - DNA, 21 bp, Homo sapiens
cggacctacctccctccctct

SEQ ID NO: 6101178 - DNA, 21 bp, Homo sapiens
cggacctgagcccgcagccca

SEQ ID NO: 6101179 - DNA, 18 bp, Homo sapiens
cggacctggactagggcc

SEQ ID NO: 6101180 - DNA, 22 bp, Homo sapiens
cggacctgtggggccccagaga

SEQ ID NO: 6101181 - DNA, 21 bp, Homo sapiens
cggaccttgtagtgagccgag

SEQ ID NO: 6101182 - DNA, 13 bp, Homo sapiens
cggacgcagctgg

SEQ ID NO: 6101183 - DNA, 22 bp, Homo sapiens
cggacgcaggtgctgcggcgcg

SEQ ID NO: 6101184 - DNA, 13 bp, Homo sapiens
cggacgcatctca

SEQ ID NO: 6101185 - DNA, 15 bp, Homo sapiens
cggacgcatgcaggg

SEQ ID NO: 6101186 - DNA, 16 bp, Homo sapiens
cggacgctggagaccc

SEQ ID NO: 6101187 - DNA, 22 bp, Homo sapiens
cggacgctggagaccctgcgcc

SEQ ID NO: 6101188 - DNA, 15 bp, Homo sapiens
cggacgctggctccc

SEQ ID NO: 6101189 - DNA, 14 bp, Homo sapiens
cggacgctggctcg

SEQ ID NO: 6101190 - DNA, 20 bp, Homo sapiens
cggacggccaatggtgcttc

SEQ ID NO: 6101191 - DNA, 17 bp, Homo sapiens
cggacgggacagcggcc

SEQ ID NO: 6101192 - DNA, 18 bp, Homo sapiens
cggacgggacagcggccc

SEQ ID NO: 6101193 - DNA, 19 bp, Homo sapiens
cggacgggggagctttccc

SEQ ID NO: 6101194 - DNA, 15 bp, Homo sapiens
cggacgtcctgctgg

SEQ ID NO: 6101195 - DNA, 15 bp, Homo sapiens
cggacgtttccatca

SEQ ID NO: 6101196 - DNA, 22 bp, Homo sapiens
cggactaaactatctgtattta

SEQ ID NO: 6101197 - DNA, 21 bp, Homo sapiens
cggactaagcctacctgctct

SEQ ID NO: 6101198 - DNA, 19 bp, Homo sapiens
cggactcaccaacttgcca

SEQ ID NO: 6101199 - DNA, 20 bp, Homo sapiens
cggactcagactcctggctt

SEQ ID NO: 6101200 - DNA, 15 bp, Homo sapiens
cggactcccgggcca

SEQ ID NO: 6101201 - DNA, 17 bp, Homo sapiens
cggactcccgggccacg

SEQ ID NO: 6101202 - DNA, 22 bp, Homo sapiens
cggactcccgggccacgcccca

SEQ ID NO: 6101203 - DNA, 13 bp, Homo sapiens
cggactgaggtgc

SEQ ID NO: 6101204 - DNA, 14 bp, Homo sapiens
cggactggcagaag

SEQ ID NO: 6101205 - DNA, 15 bp, Homo sapiens
cggactggcagaagc

SEQ ID NO: 6101206 - DNA, 23 bp, Homo sapiens
cggactggcagaagcattgcctg

SEQ ID NO: 6101207 - DNA, 16 bp, Homo sapiens
cggacttactgcctga

SEQ ID NO: 6101208 - DNA, 16 bp, Homo sapiens
cggactttgcaggagt

SEQ ID NO: 6101209 - DNA, 15 bp, Homo sapiens
cggacttttctgcaa

SEQ ID NO: 6101210 - DNA, 17 bp, Homo sapiens
cggagaaattctcttta

SEQ ID NO: 6101211 - DNA, 21 bp, Homo sapiens
cggagaacatctgccttgctg

SEQ ID NO: 6101212 - DNA, 18 bp, Homo sapiens
cggagaacatgaatcaaa

SEQ ID NO: 6101213 - DNA, 22 bp, Homo sapiens
cggagaagaatagaggtcctca

SEQ ID NO: 6101214 - DNA, 16 bp, Homo sapiens
cggagaagagcgcagt

SEQ ID NO: 6101215 - DNA, 15 bp, Homo sapiens
cggagacccacagcc

SEQ ID NO: 6101216 - DNA, 14 bp, Homo sapiens
cggagacctcctga

SEQ ID NO: 6101217 - DNA, 15 bp, Homo sapiens
cggagacggagtccc

SEQ ID NO: 6101218 - DNA, 14 bp, Homo sapiens
cggagacgggaccg

SEQ ID NO: 6101219 - DNA, 21 bp, Homo sapiens
cggagacgtgatgaagggagg

SEQ ID NO: 6101220 - DNA, 17 bp, Homo sapiens
cggagactatggcctcg

SEQ ID NO: 6101221 - DNA, 12 bp, Homo sapiens
cggagagagcca

SEQ ID NO: 6101222 - DNA, 16 bp, Homo sapiens
cggagagagccaagac

SEQ ID NO: 6101223 - DNA, 15 bp, Homo sapiens
cggagagctggtgac

SEQ ID NO: 6101224 - DNA, 23 bp, Homo sapiens
cggagagctggtgactttgggga

SEQ ID NO: 6101225 - DNA, 21 bp, Homo sapiens
cggagaggaccccattctggg

SEQ ID NO: 6101226 - DNA, 14 bp, Homo sapiens
cggagaggccactg

SEQ ID NO: 6101227 - DNA, 12 bp, Homo sapiens
cggagaggctgt

SEQ ID NO: 6101228 - DNA, 16 bp, Homo sapiens
cggagaggctgtctgg

SEQ ID NO: 6101229 - DNA, 17 bp, Homo sapiens
cggagagggctagccct

SEQ ID NO: 6101230 - DNA, 22 bp, Homo sapiens
cggagagggctagccctgagcc

SEQ ID NO: 6101231 - DNA, 18 bp, Homo sapiens
cggagaggtggccgccat

SEQ ID NO: 6101232 - DNA, 17 bp, Homo sapiens
cggagagtacagtgagc

SEQ ID NO: 6101233 - DNA, 19 bp, Homo sapiens
cggagagtacagtgagcca

SEQ ID NO: 6101234 - DNA, 22 bp, Homo sapiens
cggagatagatgactttgcaga

SEQ ID NO: 6101235 - DNA, 18 bp, Homo sapiens
cggagatatgaagagcaa

SEQ ID NO: 6101236 - DNA, 16 bp, Homo sapiens
cggagcaaactctgct

SEQ ID NO: 6101237 - DNA, 17 bp, Homo sapiens
cggagcaaactctgctg

SEQ ID NO: 6101238 - DNA, 15 bp, Homo sapiens
cggagcacagccctg

SEQ ID NO: 6101239 - DNA, 16 bp, Homo sapiens
cggagcacagccctgg

SEQ ID NO: 6101240 - DNA, 19 bp, Homo sapiens
cggagcacagccctgggag

SEQ ID NO: 6101241 - DNA, 21 bp, Homo sapiens
cggagcacagccctgggaggg

SEQ ID NO: 6101242 - DNA, 12 bp, Homo sapiens
cggagcaccctt

SEQ ID NO: 6101243 - DNA, 12 bp, Homo sapiens
cggagcagcagg

SEQ ID NO: 6101244 - DNA, 23 bp, Homo sapiens
cggagcagcctccagtgctggct

SEQ ID NO: 6101245 - DNA, 13 bp, Homo sapiens
cggagcagccttt

SEQ ID NO: 6101246 - DNA, 19 bp, Homo sapiens
cggagcaggggtctgagcc

SEQ ID NO: 6101247 - DNA, 16 bp, Homo sapiens
cggagcagttggcctg

SEQ ID NO: 6101248 - DNA, 16 bp, Homo sapiens
cggagcatcccggagg

SEQ ID NO: 6101249 - DNA, 23 bp, Homo sapiens
cggagccaaaggccgtgcctggt

SEQ ID NO: 6101250 - DNA, 18 bp, Homo sapiens
cggagccactcctctgac

SEQ ID NO: 6101251 - DNA, 21 bp, Homo sapiens
cggagccactggggtgggagg

SEQ ID NO: 6101252 - DNA, 20 bp, Homo sapiens
cggagccatcaccctcaccc

SEQ ID NO: 6101253 - DNA, 13 bp, Homo sapiens
cggagcccagcct

SEQ ID NO: 6101254 - DNA, 14 bp, Homo sapiens
cggagcccagcctg

SEQ ID NO: 6101255 - DNA, 19 bp, Homo sapiens
cggagcccagcctgggagc

SEQ ID NO: 6101256 - DNA, 19 bp, Homo sapiens
cggagccccaagactctgc

SEQ ID NO: 6101257 - DNA, 18 bp, Homo sapiens
cggagccccccactcagt

SEQ ID NO: 6101258 - DNA, 18 bp, Homo sapiens
cggagcccccgcccctcc

SEQ ID NO: 6101259 - DNA, 19 bp, Homo sapiens
cggagcccccgcccctccc

SEQ ID NO: 6101260 - DNA, 13 bp, Homo sapiens
cggagcccctgaa

SEQ ID NO: 6101261 - DNA, 12 bp, Homo sapiens
cggagccgagcc

SEQ ID NO: 6101262 - DNA, 21 bp, Homo sapiens
cggagcctcatccgaggcagg

SEQ ID NO: 6101263 - DNA, 19 bp, Homo sapiens
cggagcctcatgttctctt

SEQ ID NO: 6101264 - DNA, 17 bp, Homo sapiens
cggagcctgcctccttc

SEQ ID NO: 6101265 - DNA, 22 bp, Homo sapiens
cggagcctgcctccttcagtga

SEQ ID NO: 6101266 - DNA, 16 bp, Homo sapiens
cggagcgaccctggct

SEQ ID NO: 6101267 - DNA, 17 bp, Homo sapiens
cggagcgaccctggctc

SEQ ID NO: 6101268 - DNA, 19 bp, Homo sapiens
cggagcgaccctggctctg

SEQ ID NO: 6101269 - DNA, 20 bp, Homo sapiens
cggagcgccctgcagggccg

SEQ ID NO: 6101270 - DNA, 14 bp, Homo sapiens
cggagcggctgagg

SEQ ID NO: 6101271 - DNA, 20 bp, Homo sapiens
cggagctaacactggcccct

SEQ ID NO: 6101272 - DNA, 23 bp, Homo sapiens
cggagctaagtcacccagagcac

SEQ ID NO: 6101273 - DNA, 13 bp, Homo sapiens
cggagctccagga

SEQ ID NO: 6101274 - DNA, 24 bp, Homo sapiens
cggagctccagtttctcttaagct

SEQ ID NO: 6101275 - DNA, 13 bp, Homo sapiens
cggagctcctggc

SEQ ID NO: 6101276 - DNA, 14 bp, Homo sapiens
cggagctcctggca

SEQ ID NO: 6101277 - DNA, 15 bp, Homo sapiens
cggagctctggcttt

SEQ ID NO: 6101278 - DNA, 16 bp, Homo sapiens
cggagctgcctgcagc

SEQ ID NO: 6101279 - DNA, 17 bp, Homo sapiens
cggagctgcctgcagca

SEQ ID NO: 6101280 - DNA, 16 bp, Homo sapiens
cggagctgctgagtga

SEQ ID NO: 6101281 - DNA, 13 bp, Homo sapiens
cggagctggcccc

SEQ ID NO: 6101282 - DNA, 16 bp, Homo sapiens
cggagctggccccgcc

SEQ ID NO: 6101283 - DNA, 12 bp, Homo sapiens
cggagctggctg

SEQ ID NO: 6101284 - DNA, 17 bp, Homo sapiens
cggagctggctgtgcct

SEQ ID NO: 6101285 - DNA, 15 bp, Homo sapiens
cggagcttgcctgcc

SEQ ID NO: 6101286 - DNA, 18 bp, Homo sapiens
cggagcttgcctgcctgc

SEQ ID NO: 6101287 - DNA, 13 bp, Homo sapiens
cggagcttggccc

SEQ ID NO: 6101288 - DNA, 20 bp, Homo sapiens
cggagcttggccctgcgccc

SEQ ID NO: 6101289 - DNA, 13 bp, Homo sapiens
cggaggaacagat

SEQ ID NO: 6101290 - DNA, 19 bp, Homo sapiens
cggaggaaggaggacccag

SEQ ID NO: 6101291 - DNA, 23 bp, Homo sapiens
cggaggaaggaggacccaggaca

SEQ ID NO: 6101292 - DNA, 12 bp, Homo sapiens
cggaggaaggtc

SEQ ID NO: 6101293 - DNA, 15 bp, Homo sapiens
cggaggaccagggct

SEQ ID NO: 6101294 - DNA, 17 bp, Homo sapiens
cggaggactgagccccc

SEQ ID NO: 6101295 - DNA, 18 bp, Homo sapiens
cggaggactggaactgca

SEQ ID NO: 6101296 - DNA, 22 bp, Homo sapiens
cggaggacttgggggcagagca

SEQ ID NO: 6101297 - DNA, 18 bp, Homo sapiens
cggaggagaaactctaga

SEQ ID NO: 6101298 - DNA, 11 bp, Homo sapiens
cggaggagaag

SEQ ID NO: 6101299 - DNA, 19 bp, Homo sapiens
cggaggagaagaaggaaat

SEQ ID NO: 6101300 - DNA, 17 bp, Homo sapiens
cggaggagaccagctca

SEQ ID NO: 6101301 - DNA, 23 bp, Homo sapiens
cggaggagcagcctcgaggctgg

SEQ ID NO: 6101302 - DNA, 15 bp, Homo sapiens
cggaggagctgcctg

SEQ ID NO: 6101303 - DNA, 16 bp, Homo sapiens
cggaggagctgcctgc

SEQ ID NO: 6101304 - DNA, 14 bp, Homo sapiens
cggaggaggaagag

SEQ ID NO: 6101305 - DNA, 18 bp, Homo sapiens
cggaggaggaagagggta

SEQ ID NO: 6101306 - DNA, 21 bp, Homo sapiens
cggaggagttttggcagccag

SEQ ID NO: 6101307 - DNA, 12 bp, Homo sapiens
cggaggcaaaag

SEQ ID NO: 6101308 - DNA, 14 bp, Homo sapiens
cggaggccaggccc

SEQ ID NO: 6101309 - DNA, 15 bp, Homo sapiens
cggaggccaggccct

SEQ ID NO: 6101310 - DNA, 15 bp, Homo sapiens
cggaggcccatgccc

SEQ ID NO: 6101311 - DNA, 15 bp, Homo sapiens
cggaggccccaaagg

SEQ ID NO: 6101312 - DNA, 17 bp, Homo sapiens
cggaggccccactgatg

SEQ ID NO: 6101313 - DNA, 21 bp, Homo sapiens
cctctcttcctatcccatccc

SEQ ID NO: 6101314 - DNA, 12 bp, Homo sapiens
cctctcttcctc

SEQ ID NO: 6101315 - DNA, 14 bp, Homo sapiens
cctctcttctgtgt

SEQ ID NO: 6101316 - DNA, 13 bp, Homo sapiens
cctctcttcttcc

SEQ ID NO: 6101317 - DNA, 17 bp, Homo sapiens
cctctcttgcacccgcc

SEQ ID NO: 6101318 - DNA, 18 bp, Homo sapiens
cctctcttgcacccgcct

SEQ ID NO: 6101319 - DNA, 21 bp, Homo sapiens
cctctcttgcacccgcctctc

SEQ ID NO: 6101320 - DNA, 13 bp, Homo sapiens
cctctcttgcccc

SEQ ID NO: 6101321 - DNA, 20 bp, Homo sapiens
cctctcttgccccttgtcct

SEQ ID NO: 6101322 - DNA, 15 bp, Homo sapiens
cctctcttgcctttc

SEQ ID NO: 6101323 - DNA, 21 bp, Homo sapiens
cctctcttggaccctgggagt

SEQ ID NO: 6101324 - DNA, 19 bp, Homo sapiens
cctctcttggcaattcctc

SEQ ID NO: 6101325 - DNA, 18 bp, Homo sapiens
cctctcttggtttccttc

SEQ ID NO: 6101326 - DNA, 19 bp, Homo sapiens
cctctcttggtttccttcc

SEQ ID NO: 6101327 - DNA, 23 bp, Homo sapiens
cctctctttctaagagacctgaa

SEQ ID NO: 6101328 - DNA, 23 bp, Homo sapiens
cctctctttgttctcagctcccc

SEQ ID NO: 6101329 - DNA, 18 bp, Homo sapiens
cctctcttttccccgcct

SEQ ID NO: 6101330 - DNA, 21 bp, Homo sapiens
cctctcttttccccgcctgca

SEQ ID NO: 6101331 - DNA, 20 bp, Homo sapiens
cctctcttttcctctctgtc

SEQ ID NO: 6101332 - DNA, 23 bp, Homo sapiens
cctctgaaaaccaatgttctctc

SEQ ID NO: 6101333 - DNA, 18 bp, Homo sapiens
cctctgaaaacggccctc

SEQ ID NO: 6101334 - DNA, 21 bp, Homo sapiens
cctctgaaacagctgccttag

SEQ ID NO: 6101335 - DNA, 22 bp, Homo sapiens
cctctgaaagatgcatcatctc

SEQ ID NO: 6101336 - DNA, 18 bp, Homo sapiens
cctctgaaagttgtacat

SEQ ID NO: 6101337 - DNA, 20 bp, Homo sapiens
cctctgaaattaaagaaatg

SEQ ID NO: 6101338 - DNA, 20 bp, Homo sapiens
cctctgaactgctgctggtc

SEQ ID NO: 6101339 - DNA, 15 bp, Homo sapiens
cctctgaagagctga

SEQ ID NO: 6101340 - DNA, 20 bp, Homo sapiens
cctctgaagttggacagcaa

SEQ ID NO: 6101341 - DNA, 21 bp, Homo sapiens
cctctgaatttaattctttca

SEQ ID NO: 6101342 - DNA, 17 bp, Homo sapiens
cctctgacacacagctc

SEQ ID NO: 6101343 - DNA, 13 bp, Homo sapiens
cctctgacagcag

SEQ ID NO: 6101344 - DNA, 19 bp, Homo sapiens
cctctgacagcagcatctc

SEQ ID NO: 6101345 - DNA, 18 bp, Homo sapiens
cctctgacagcagcctgt

SEQ ID NO: 6101346 - DNA, 19 bp, Homo sapiens
cctctgacagcagcctgtg

SEQ ID NO: 6101347 - DNA, 21 bp, Homo sapiens
cctctgacagcagcctgtgag

SEQ ID NO: 6101348 - DNA, 15 bp, Homo sapiens
cctctgacagtccac

SEQ ID NO: 6101349 - DNA, 17 bp, Homo sapiens
cctctgaccaacaggct

SEQ ID NO: 6101350 - DNA, 20 bp, Homo sapiens
cctctgaccaacaggctgtt

SEQ ID NO: 6101351 - DNA, 13 bp, Homo sapiens
cctctgacccctc

SEQ ID NO: 6101352 - DNA, 15 bp, Homo sapiens
cctctgacccctcct

SEQ ID NO: 6101353 - DNA, 16 bp, Homo sapiens
cctctgaccctccttc

SEQ ID NO: 6101354 - DNA, 14 bp, Homo sapiens
cctctgacctgcac

SEQ ID NO: 6101355 - DNA, 19 bp, Homo sapiens
cctctgacctgcaggccaa

SEQ ID NO: 6101356 - DNA, 19 bp, Homo sapiens
cctctgacgcaccactgcc

SEQ ID NO: 6101357 - DNA, 20 bp, Homo sapiens
cctctgacgcaccactgcca

SEQ ID NO: 6101358 - DNA, 16 bp, Homo sapiens
cctctgactcaaactc

SEQ ID NO: 6101359 - DNA, 15 bp, Homo sapiens
cctctgactcaccac

SEQ ID NO: 6101360 - DNA, 17 bp, Homo sapiens
cctctgactcagggctc

SEQ ID NO: 6101361 - DNA, 21 bp, Homo sapiens
cctctgactcagggctcctgg

SEQ ID NO: 6101362 - DNA, 20 bp, Homo sapiens
cctctgagaagctctgaaga

SEQ ID NO: 6101363 - DNA, 16 bp, Homo sapiens
cctctgagactccaga

SEQ ID NO: 6101364 - DNA, 19 bp, Homo sapiens
cctctgagcaactgtgcag

SEQ ID NO: 6101365 - DNA, 21 bp, Homo sapiens
cctctgagcaactgtgcagca

SEQ ID NO: 6101366 - DNA, 16 bp, Homo sapiens
cctctgagcagcctct

SEQ ID NO: 6101367 - DNA, 22 bp, Homo sapiens
cctctgagcagcctctgccagg

SEQ ID NO: 6101368 - DNA, 21 bp, Homo sapiens
cctctgagccaggagcctcct

SEQ ID NO: 6101369 - DNA, 15 bp, Homo sapiens
cctctgagcccaagc

SEQ ID NO: 6101370 - DNA, 16 bp, Homo sapiens
cctctgagcccaagct

SEQ ID NO: 6101371 - DNA, 18 bp, Homo sapiens
cctctgagcccagctgcc

SEQ ID NO: 6101372 - DNA, 19 bp, Homo sapiens
cctctgagcccagctgcct

SEQ ID NO: 6101373 - DNA, 14 bp, Homo sapiens
cctctgagccgcag

SEQ ID NO: 6101374 - DNA, 14 bp, Homo sapiens
cctctgagccttgg

SEQ ID NO: 6101375 - DNA, 14 bp, Homo sapiens
cctctgagctttgc

SEQ ID NO: 6101376 - DNA, 16 bp, Homo sapiens
cctctgaggccagcct

SEQ ID NO: 6101377 - DNA, 19 bp, Homo sapiens
cctctgaggccagcctggc

SEQ ID NO: 6101378 - DNA, 11 bp, Homo sapiens
cctctgaggct

SEQ ID NO: 6101379 - DNA, 14 bp, Homo sapiens
cctctgaggctcag

SEQ ID NO: 6101380 - DNA, 23 bp, Homo sapiens
cctctgaggctcagccctgagct

SEQ ID NO: 6101381 - DNA, 13 bp, Homo sapiens
cctctgaggctga

SEQ ID NO: 6101382 - DNA, 21 bp, Homo sapiens
cctctgagggaaagcccagaa

SEQ ID NO: 6101383 - DNA, 18 bp, Homo sapiens
cctctgagttttgatgct

SEQ ID NO: 6101384 - DNA, 21 bp, Homo sapiens
cctctgataatatattttcaa

SEQ ID NO: 6101385 - DNA, 19 bp, Homo sapiens
cctctgatacccagagcat

SEQ ID NO: 6101386 - DNA, 20 bp, Homo sapiens
cctctgatacccagagcatt

SEQ ID NO: 6101387 - DNA, 17 bp, Homo sapiens
cctctgatcacattctt

SEQ ID NO: 6101388 - DNA, 17 bp, Homo sapiens
cctctgatctgtgcagg

SEQ ID NO: 6101389 - DNA, 14 bp, Homo sapiens
cctctgcaaccccc

SEQ ID NO: 6101390 - DNA, 20 bp, Homo sapiens
cctctgcaagattctgtggg

SEQ ID NO: 6101391 - DNA, 19 bp, Homo sapiens
cctctgcacaagctgcacc

SEQ ID NO: 6101392 - DNA, 16 bp, Homo sapiens
cctctgcacccagaac

SEQ ID NO: 6101393 - DNA, 19 bp, Homo sapiens
cctctgcacctttgcacgt

SEQ ID NO: 6101394 - DNA, 15 bp, Homo sapiens
cctctgcacgctcaa

SEQ ID NO: 6101395 - DNA, 21 bp, Homo sapiens
cctctgcacgtgcacacacct

SEQ ID NO: 6101396 - DNA, 23 bp, Homo sapiens
cctctgcacgtgcacacacctgc

SEQ ID NO: 6101397 - DNA, 20 bp, Homo sapiens
cctctgcactactgacatgt

SEQ ID NO: 6101398 - DNA, 20 bp, Homo sapiens
cctctgcactcccctgctgg

SEQ ID NO: 6101399 - DNA, 21 bp, Homo sapiens
cctctgcactcccctgctggg

SEQ ID NO: 6101400 - DNA, 14 bp, Homo sapiens
cctctgcagcactt

SEQ ID NO: 6101401 - DNA, 13 bp, Homo sapiens
cctctgcagcctg

SEQ ID NO: 6101402 - DNA, 18 bp, Homo sapiens
cctctgcagcctgagctc

SEQ ID NO: 6101403 - DNA, 23 bp, Homo sapiens
cctctgcagcctgagctccaccc

SEQ ID NO: 6101404 - DNA, 12 bp, Homo sapiens
cctctgcagctg

SEQ ID NO: 6101405 - DNA, 15 bp, Homo sapiens
cctctgcagctgacc

SEQ ID NO: 6101406 - DNA, 16 bp, Homo sapiens
cctctgcagctgacct

SEQ ID NO: 6101407 - DNA, 13 bp, Homo sapiens
cctctgcaggaca

SEQ ID NO: 6101408 - DNA, 14 bp, Homo sapiens
cctctgcagggcag

SEQ ID NO: 6101409 - DNA, 18 bp, Homo sapiens
cctctgcagggcagcctg

SEQ ID NO: 6101410 - DNA, 23 bp, Homo sapiens
cctctgcagtcgcttgccaaagc

SEQ ID NO: 6101411 - DNA, 16 bp, Homo sapiens
cctctgcagtctcatt

SEQ ID NO: 6101412 - DNA, 18 bp, Homo sapiens
cctctgcagtctcatttc

SEQ ID NO: 6101413 - DNA, 21 bp, Homo sapiens
cctctgcagtctcatttctca

SEQ ID NO: 6101414 - DNA, 23 bp, Homo sapiens
cctctgcagtctctataccaata

SEQ ID NO: 6101415 - DNA, 17 bp, Homo sapiens
cctctgcagtgccttgg

SEQ ID NO: 6101416 - DNA, 16 bp, Homo sapiens
cctctgcatcctctgg

SEQ ID NO: 6101417 - DNA, 17 bp, Homo sapiens
cctctgcatcctctgga

SEQ ID NO: 6101418 - DNA, 20 bp, Homo sapiens
cctctgcatcttgctctgtg

SEQ ID NO: 6101419 - DNA, 19 bp, Homo sapiens
cctctgcattgacctggag

SEQ ID NO: 6101420 - DNA, 23 bp, Homo sapiens
cctctgcattgagcatattttct

SEQ ID NO: 6101421 - DNA, 19 bp, Homo sapiens
cctctgcattttgtacaaa

SEQ ID NO: 6101422 - DNA, 14 bp, Homo sapiens
cctctgccacagca

SEQ ID NO: 6101423 - DNA, 16 bp, Homo sapiens
cctctgccacagcaag

SEQ ID NO: 6101424 - DNA, 17 bp, Homo sapiens
cctctgccaccagagac

SEQ ID NO: 6101425 - DNA, 13 bp, Homo sapiens
cctctgccacctc

SEQ ID NO: 6101426 - DNA, 17 bp, Homo sapiens
cctctgccagcaggaat

SEQ ID NO: 6101427 - DNA, 14 bp, Homo sapiens
cctctgccatcctc

SEQ ID NO: 6101428 - DNA, 18 bp, Homo sapiens
cctctgccatcctccctg

SEQ ID NO: 6101429 - DNA, 22 bp, Homo sapiens
cctctgccatcctccctgttcc

SEQ ID NO: 6101430 - DNA, 18 bp, Homo sapiens
cctctgccatgtttttcc

SEQ ID NO: 6101431 - DNA, 23 bp, Homo sapiens
cctctgccatgtttttcccctgc

SEQ ID NO: 6101432 - DNA, 17 bp, Homo sapiens
cctctgcccactccctg

SEQ ID NO: 6101433 - DNA, 10 bp, Homo sapiens
cctctgcccc

SEQ ID NO: 6101434 - DNA, 11 bp, Homo sapiens
cctctgcccca

SEQ ID NO: 6101435 - DNA, 16 bp, Homo sapiens
cctctgccccaagagc

SEQ ID NO: 6101436 - DNA, 17 bp, Homo sapiens
cctctgccccaagagca

SEQ ID NO: 6101437 - DNA, 14 bp, Homo sapiens
cctctgccccaagc

SEQ ID NO: 6101438 - DNA, 17 bp, Homo sapiens
cctctgccccaagcagc

SEQ ID NO: 6101439 - DNA, 18 bp, Homo sapiens
cctctgccccaagcagcc

SEQ ID NO: 6101440 - DNA, 22 bp, Homo sapiens
cctctgccccaagcagccagcc

SEQ ID NO: 6101441 - DNA, 20 bp, Homo sapiens
cctctgccccaaggggccca

SEQ ID NO: 6101442 - DNA, 14 bp, Homo sapiens
cctctgccccaccc

SEQ ID NO: 6101443 - DNA, 15 bp, Homo sapiens
cctctgccccaccca

SEQ ID NO: 6101444 - DNA, 15 bp, Homo sapiens
cctctgccccaccct

SEQ ID NO: 6101445 - DNA, 19 bp, Homo sapiens
cctctgccccatcctccag

SEQ ID NO: 6101446 - DNA, 22 bp, Homo sapiens
cctctgccccatcctccagcag

SEQ ID NO: 6101447 - DNA, 12 bp, Homo sapiens
cctctgccccca

SEQ ID NO: 6101448 - DNA, 19 bp, Homo sapiens
cctctgccccgccctcctt

SEQ ID NO: 6101449 - DNA, 23 bp, Homo sapiens
cctctgccccgccctccttccca

SEQ ID NO: 6101450 - DNA, 15 bp, Homo sapiens
cctctgcccctccca

SEQ ID NO: 6101451 - DNA, 14 bp, Homo sapiens
cctctgcccctctt

SEQ ID NO: 6101452 - DNA, 16 bp, Homo sapiens
cctctgcccctcttcc

SEQ ID NO: 6101453 - DNA, 15 bp, Homo sapiens
cctctgcccctgcag

SEQ ID NO: 6101454 - DNA, 17 bp, Homo sapiens
cctctgcccctgcagct

SEQ ID NO: 6101455 - DNA, 15 bp, Homo sapiens
cctctgcccgcagag

SEQ ID NO: 6101456 - DNA, 12 bp, Homo sapiens
cctctgccctgc

SEQ ID NO: 6101457 - DNA, 14 bp, Homo sapiens
cctctgccctggat

SEQ ID NO: 6101458 - DNA, 12 bp, Homo sapiens
cctctgccctgt

SEQ ID NO: 6101459 - DNA, 15 bp, Homo sapiens
cctctgcccttcccc

SEQ ID NO: 6101460 - DNA, 19 bp, Homo sapiens
cctctgcccttcccctccc

SEQ ID NO: 6101461 - DNA, 19 bp, Homo sapiens
cctctgcccttcctgcagg

SEQ ID NO: 6101462 - DNA, 17 bp, Homo sapiens
cctctgcccttcctttc

SEQ ID NO: 6101463 - DNA, 21 bp, Homo sapiens
cctctgccgaccgcctgcttc

SEQ ID NO: 6101464 - DNA, 23 bp, Homo sapiens
cctctgccgaccgcctgcttcac

SEQ ID NO: 6101465 - DNA, 19 bp, Homo sapiens
cctctgccgctgccatgct

SEQ ID NO: 6101466 - DNA, 23 bp, Homo sapiens
cctctgccgctgcttccaggctg

SEQ ID NO: 6101467 - DNA, 22 bp, Homo sapiens
cctctgccggtcgggcagccag

SEQ ID NO: 6101468 - DNA, 17 bp, Homo sapiens
cctctgcctacagccag

SEQ ID NO: 6101469 - DNA, 18 bp, Homo sapiens
cctctgcctcatcctcct

SEQ ID NO: 6101470 - DNA, 20 bp, Homo sapiens
cctctgcctcatcctcctcc

SEQ ID NO: 6101471 - DNA, 15 bp, Homo sapiens
cctctgcctccaccc

SEQ ID NO: 6101472 - DNA, 14 bp, Homo sapiens
cctctgcctccagg

SEQ ID NO: 6101473 - DNA, 20 bp, Homo sapiens
cctctgcctccaggagggca

SEQ ID NO: 6101474 - DNA, 20 bp, Homo sapiens
cctctgcctgaagtcacaca

SEQ ID NO: 6101475 - DNA, 18 bp, Homo sapiens
cctctgcctgacagcatc

SEQ ID NO: 6101476 - DNA, 15 bp, Homo sapiens
cctctgcctgcactc

SEQ ID NO: 6101477 - DNA, 16 bp, Homo sapiens
cctctgcctgcactcc

SEQ ID NO: 6101478 - DNA, 17 bp, Homo sapiens
cctctgcctgcattctg

SEQ ID NO: 6101479 - DNA, 20 bp, Homo sapiens
cctctgccttagaggagccc

SEQ ID NO: 6101480 - DNA, 12 bp, Homo sapiens
cctctgccttgc

SEQ ID NO: 6101481 - DNA, 18 bp, Homo sapiens
cctctgccttgccctcct

SEQ ID NO: 6101482 - DNA, 20 bp, Homo sapiens
cctctgccttgccctcctgg

SEQ ID NO: 6101483 - DNA, 22 bp, Homo sapiens
cctctgccttgccctcctgggc

SEQ ID NO: 6101484 - DNA, 15 bp, Homo sapiens
cctctgcctttgagc

SEQ ID NO: 6101485 - DNA, 19 bp, Homo sapiens
cctctgcctttgagcttct

SEQ ID NO: 6101486 - DNA, 22 bp, Homo sapiens
cctctgcctttgagcttctcct

SEQ ID NO: 6101487 - DNA, 18 bp, Homo sapiens
cctctgcgccccagcgac

SEQ ID NO: 6101488 - DNA, 18 bp, Homo sapiens
cctctgcggaccccagct

SEQ ID NO: 6101489 - DNA, 21 bp, Homo sapiens
cctctgcggggaggacccggg

SEQ ID NO: 6101490 - DNA, 13 bp, Homo sapiens
cggaggcccctga

SEQ ID NO: 6101491 - DNA, 15 bp, Homo sapiens
cggaggccgaggcca

SEQ ID NO: 6101492 - DNA, 15 bp, Homo sapiens
cggaggccgggccct

SEQ ID NO: 6101493 - DNA, 21 bp, Homo sapiens
cggaggcctgcgaccctgggg

SEQ ID NO: 6101494 - DNA, 12 bp, Homo sapiens
cggaggccttgg

SEQ ID NO: 6101495 - DNA, 12 bp, Homo sapiens
cggaggcgccca

SEQ ID NO: 6101496 - DNA, 20 bp, Homo sapiens
cggaggcgcccacctgccca

SEQ ID NO: 6101497 - DNA, 17 bp, Homo sapiens
cggaggcggtgggcctg

SEQ ID NO: 6101498 - DNA, 19 bp, Homo sapiens
cggaggcgtggaggagagg

SEQ ID NO: 6101499 - DNA, 12 bp, Homo sapiens
cggaggctcctc

SEQ ID NO: 6101500 - DNA, 16 bp, Homo sapiens
cggaggctcctccctc

SEQ ID NO: 6101501 - DNA, 20 bp, Homo sapiens
cggaggctgaggcaggagaa

SEQ ID NO: 6101502 - DNA, 19 bp, Homo sapiens
cggaggctgcccccggccc

SEQ ID NO: 6101503 - DNA, 13 bp, Homo sapiens
cggaggctgggcc

SEQ ID NO: 6101504 - DNA, 20 bp, Homo sapiens
cggaggctgggcccctggga

SEQ ID NO: 6101505 - DNA, 21 bp, Homo sapiens
cggaggctgtgctccgccatg

SEQ ID NO: 6101506 - DNA, 18 bp, Homo sapiens
cggaggcttgtcagagct

SEQ ID NO: 6101507 - DNA, 20 bp, Homo sapiens
cggaggcttgtcagagctgg

SEQ ID NO: 6101508 - DNA, 23 bp, Homo sapiens
cggaggcttgtcagagctgggag

SEQ ID NO: 6101509 - DNA, 18 bp, Homo sapiens
cggagggaaactgtgaat

SEQ ID NO: 6101510 - DNA, 12 bp, Homo sapiens
cggagggaccag

SEQ ID NO: 6101511 - DNA, 11 bp, Homo sapiens
cggagggaggc

SEQ ID NO: 6101512 - DNA, 13 bp, Homo sapiens
cggagggaggcac

SEQ ID NO: 6101513 - DNA, 15 bp, Homo sapiens
cggagggaggcacca

SEQ ID NO: 6101514 - DNA, 13 bp, Homo sapiens
cggagggagggga

SEQ ID NO: 6101515 - DNA, 21 bp, Homo sapiens
cggagggaggggaggggtgaa

SEQ ID NO: 6101516 - DNA, 21 bp, Homo sapiens
cggagggagtcccagagccct

SEQ ID NO: 6101517 - DNA, 16 bp, Homo sapiens
cggagggatgcaggtg

SEQ ID NO: 6101518 - DNA, 13 bp, Homo sapiens
cggagggatggag

SEQ ID NO: 6101519 - DNA, 19 bp, Homo sapiens
cggagggctggggatgcgc

SEQ ID NO: 6101520 - DNA, 14 bp, Homo sapiens
cggaggggacccag

SEQ ID NO: 6101521 - DNA, 14 bp, Homo sapiens
cggaggggagtaga

SEQ ID NO: 6101522 - DNA, 15 bp, Homo sapiens
cggaggggcctggca

SEQ ID NO: 6101523 - DNA, 19 bp, Homo sapiens
cggaggggcttggagcaga

SEQ ID NO: 6101524 - DNA, 20 bp, Homo sapiens
cggaggggttgcgggggagc

SEQ ID NO: 6101525 - DNA, 15 bp, Homo sapiens
cggagggtctccctg

SEQ ID NO: 6101526 - DNA, 19 bp, Homo sapiens
cggagggtctccctgggca

SEQ ID NO: 6101527 - DNA, 20 bp, Homo sapiens
cggagggtctccctgggcac

SEQ ID NO: 6101528 - DNA, 22 bp, Homo sapiens
cggagggtgggggccacctgcc

SEQ ID NO: 6101529 - DNA, 20 bp, Homo sapiens
cggaggtccccggttgctgg

SEQ ID NO: 6101530 - DNA, 16 bp, Homo sapiens
cggaggtctctgggag

SEQ ID NO: 6101531 - DNA, 17 bp, Homo sapiens
cggaggtctctgggagc

SEQ ID NO: 6101532 - DNA, 20 bp, Homo sapiens
cggaggtctctgggagccca

SEQ ID NO: 6101533 - DNA, 22 bp, Homo sapiens
cggaggtctctgggagcccaga

SEQ ID NO: 6101534 - DNA, 23 bp, Homo sapiens
cggaggtgctgtccccactgccc

SEQ ID NO: 6101535 - DNA, 15 bp, Homo sapiens
cggaggtggtggagg

SEQ ID NO: 6101536 - DNA, 18 bp, Homo sapiens
cggaggtggtggaggagg

SEQ ID NO: 6101537 - DNA, 19 bp, Homo sapiens
cggaggtggtggaggagga

SEQ ID NO: 6101538 - DNA, 13 bp, Homo sapiens
cggagtagaaatt

SEQ ID NO: 6101539 - DNA, 14 bp, Homo sapiens
cggagtatgtgcag

SEQ ID NO: 6101540 - DNA, 18 bp, Homo sapiens
cggagtcactgcctggag

SEQ ID NO: 6101541 - DNA, 16 bp, Homo sapiens
cggagtccactcccag

SEQ ID NO: 6101542 - DNA, 16 bp, Homo sapiens
cggagtcccaccttgg

SEQ ID NO: 6101543 - DNA, 20 bp, Homo sapiens
cggagtcccaccttggctgc

SEQ ID NO: 6101544 - DNA, 16 bp, Homo sapiens
cggagtctcagtctgt

SEQ ID NO: 6101545 - DNA, 14 bp, Homo sapiens
cggagtgaagaggg

SEQ ID NO: 6101546 - DNA, 19 bp, Homo sapiens
cggagtgaagaggggcagc

SEQ ID NO: 6101547 - DNA, 13 bp, Homo sapiens
cggagtgaatgtg

SEQ ID NO: 6101548 - DNA, 15 bp, Homo sapiens
cggagtgaatgtggc

SEQ ID NO: 6101549 - DNA, 18 bp, Homo sapiens
cggagtgcctggagtcag

SEQ ID NO: 6101550 - DNA, 23 bp, Homo sapiens
cggagtgcggaccaccctcactg

SEQ ID NO: 6101551 - DNA, 22 bp, Homo sapiens
cggagtggggggacagagactc

SEQ ID NO: 6101552 - DNA, 14 bp, Homo sapiens
cggagtgtggcctg

SEQ ID NO: 6101553 - DNA, 18 bp, Homo sapiens
cggagtgttggggctggg

SEQ ID NO: 6101554 - DNA, 20 bp, Homo sapiens
cggagtgttggggctggggg

SEQ ID NO: 6101555 - DNA, 16 bp, Homo sapiens
cggagtttccatttgg

SEQ ID NO: 6101556 - DNA, 22 bp, Homo sapiens
cggagttttgctcttgtagccc

SEQ ID NO: 6101557 - DNA, 13 bp, Homo sapiens
cggataattttca

SEQ ID NO: 6101558 - DNA, 21 bp, Homo sapiens
cggataggcaggaacatacag

SEQ ID NO: 6101559 - DNA, 13 bp, Homo sapiens
cggataggctaat

SEQ ID NO: 6101560 - DNA, 18 bp, Homo sapiens
cggatcaaccaggcagag

SEQ ID NO: 6101561 - DNA, 19 bp, Homo sapiens
cggatcacaaggtcaggag

SEQ ID NO: 6101562 - DNA, 18 bp, Homo sapiens
cggatcaccgagagtagc

SEQ ID NO: 6101563 - DNA, 19 bp, Homo sapiens
cggatcatcaacaagattt

SEQ ID NO: 6101564 - DNA, 18 bp, Homo sapiens
cggatccagggaggctgg

SEQ ID NO: 6101565 - DNA, 21 bp, Homo sapiens
cggatccagggaggctggtcc

SEQ ID NO: 6101566 - DNA, 22 bp, Homo sapiens
cggatccagggaggctggtcct

SEQ ID NO: 6101567 - DNA, 19 bp, Homo sapiens
cggatcctaagcatctaag

SEQ ID NO: 6101568 - DNA, 22 bp, Homo sapiens
cggatcctgcactgactctgga

SEQ ID NO: 6101569 - DNA, 13 bp, Homo sapiens
cggatcctgctgg

SEQ ID NO: 6101570 - DNA, 17 bp, Homo sapiens
cggatcctgtgagtagg

SEQ ID NO: 6101571 - DNA, 15 bp, Homo sapiens
cggatcgaggacaag

SEQ ID NO: 6101572 - DNA, 19 bp, Homo sapiens
cggatctcacaggctgaga

SEQ ID NO: 6101573 - DNA, 13 bp, Homo sapiens
cggatctccaggc

SEQ ID NO: 6101574 - DNA, 18 bp, Homo sapiens
cggatctccaggcccagc

SEQ ID NO: 6101575 - DNA, 16 bp, Homo sapiens
cggatctgagaatctt

SEQ ID NO: 6101576 - DNA, 16 bp, Homo sapiens
cggatctgctgggctc

SEQ ID NO: 6101577 - DNA, 19 bp, Homo sapiens
cggatgaactcaatgcatg

SEQ ID NO: 6101578 - DNA, 19 bp, Homo sapiens
cggatgacaccctggcctg

SEQ ID NO: 6101579 - DNA, 18 bp, Homo sapiens
cggatgacagccaccctc

SEQ ID NO: 6101580 - DNA, 15 bp, Homo sapiens
cggatgaccaaacca

SEQ ID NO: 6101581 - DNA, 20 bp, Homo sapiens
cggatgaccaaaccagcctt

SEQ ID NO: 6101582 - DNA, 14 bp, Homo sapiens
cggatgaggtcatt

SEQ ID NO: 6101583 - DNA, 21 bp, Homo sapiens
cggatgatttccgtcatgctc

SEQ ID NO: 6101584 - DNA, 15 bp, Homo sapiens
cggatgcacagagat

SEQ ID NO: 6101585 - DNA, 19 bp, Homo sapiens
cggatgcccattcctgcct

SEQ ID NO: 6101586 - DNA, 19 bp, Homo sapiens
cggatgcgtgggcagagga

SEQ ID NO: 6101587 - DNA, 14 bp, Homo sapiens
cggatgctgcttcc

SEQ ID NO: 6101588 - DNA, 13 bp, Homo sapiens
cggatggaaggag

SEQ ID NO: 6101589 - DNA, 15 bp, Homo sapiens
cggatggcaggatcc

SEQ ID NO: 6101590 - DNA, 16 bp, Homo sapiens
cggatgggcacacaca

SEQ ID NO: 6101591 - DNA, 22 bp, Homo sapiens
cggatgtcccatctgctcctcc

SEQ ID NO: 6101592 - DNA, 20 bp, Homo sapiens
cggattattatttgtacttt

SEQ ID NO: 6101593 - DNA, 19 bp, Homo sapiens
cggattattttttcagacc

SEQ ID NO: 6101594 - DNA, 23 bp, Homo sapiens
cggattattttttcagaccgaaa

SEQ ID NO: 6101595 - DNA, 12 bp, Homo sapiens
cggattccagcc

SEQ ID NO: 6101596 - DNA, 16 bp, Homo sapiens
cggattccagcccaca

SEQ ID NO: 6101597 - DNA, 15 bp, Homo sapiens
cggattgcgttcctc

SEQ ID NO: 6101598 - DNA, 15 bp, Homo sapiens
cggattggccctgcc

SEQ ID NO: 6101599 - DNA, 19 bp, Homo sapiens
cggattggccctgcccctc

SEQ ID NO: 6101600 - DNA, 23 bp, Homo sapiens
cggattggcttgtgtgtttcact

SEQ ID NO: 6101601 - DNA, 11 bp, Homo sapiens
cggatttctaa

SEQ ID NO: 6101602 - DNA, 15 bp, Homo sapiens
cggatttggggtgga

SEQ ID NO: 6101603 - DNA, 15 bp, Homo sapiens
cggcaaacctttccc

SEQ ID NO: 6101604 - DNA, 22 bp, Homo sapiens
cggcaacagggcttctcttttt

SEQ ID NO: 6101605 - DNA, 14 bp, Homo sapiens
cggcaaccacatgt

SEQ ID NO: 6101606 - DNA, 23 bp, Homo sapiens
cggcaaccccagttctgctcctc

SEQ ID NO: 6101607 - DNA, 19 bp, Homo sapiens
cggcaaccgtggggaggcc

SEQ ID NO: 6101608 - DNA, 15 bp, Homo sapiens
cggcaacctgtaact

SEQ ID NO: 6101609 - DNA, 17 bp, Homo sapiens
cggcaacgtagcctggg

SEQ ID NO: 6101610 - DNA, 15 bp, Homo sapiens
cggcaagactccatc

SEQ ID NO: 6101611 - DNA, 20 bp, Homo sapiens
cggcaaggggcgcgcgcccc

SEQ ID NO: 6101612 - DNA, 19 bp, Homo sapiens
cggcaataaaagcccagga

SEQ ID NO: 6101613 - DNA, 16 bp, Homo sapiens
cggcaatttccggcca

SEQ ID NO: 6101614 - DNA, 16 bp, Homo sapiens
cggcacacactgtgcc

SEQ ID NO: 6101615 - DNA, 22 bp, Homo sapiens
cggcacagaggcagctgtgtgg

SEQ ID NO: 6101616 - DNA, 13 bp, Homo sapiens
cggcacagctggg

SEQ ID NO: 6101617 - DNA, 18 bp, Homo sapiens
cggcacagggtctgctct

SEQ ID NO: 6101618 - DNA, 19 bp, Homo sapiens
cggcacagggtctgctctt

SEQ ID NO: 6101619 - DNA, 21 bp, Homo sapiens
cggcacagggtctgctctttc

SEQ ID NO: 6101620 - DNA, 20 bp, Homo sapiens
cggcacccacaagtgccact

SEQ ID NO: 6101621 - DNA, 15 bp, Homo sapiens
cggcacccaggcctc

SEQ ID NO: 6101622 - DNA, 17 bp, Homo sapiens
cggcaccccctgcagct

SEQ ID NO: 6101623 - DNA, 20 bp, Homo sapiens
cggcaccccctgcagcttgt

SEQ ID NO: 6101624 - DNA, 15 bp, Homo sapiens
cggcaccctggtctg

SEQ ID NO: 6101625 - DNA, 14 bp, Homo sapiens
cggcaccgccagcc

SEQ ID NO: 6101626 - DNA, 18 bp, Homo sapiens
cggcacctacatccccag

SEQ ID NO: 6101627 - DNA, 23 bp, Homo sapiens
cggcacctacatccccaggtctc

SEQ ID NO: 6101628 - DNA, 22 bp, Homo sapiens
cggcacctgggccctggggcct

SEQ ID NO: 6101629 - DNA, 18 bp, Homo sapiens
cggcacgcacttgcctgt

SEQ ID NO: 6101630 - DNA, 21 bp, Homo sapiens
cggcacgcacttgcctgttgg

SEQ ID NO: 6101631 - DNA, 15 bp, Homo sapiens
cggcacgtcccatgt

SEQ ID NO: 6101632 - DNA, 11 bp, Homo sapiens
cggcactcatg

SEQ ID NO: 6101633 - DNA, 17 bp, Homo sapiens
cggcactccagcctggg

SEQ ID NO: 6101634 - DNA, 10 bp, Homo sapiens
cggcactgca

SEQ ID NO: 6101635 - DNA, 15 bp, Homo sapiens
cggcactgtggcctt

SEQ ID NO: 6101636 - DNA, 18 bp, Homo sapiens
cggcagaaaacagagcct

SEQ ID NO: 6101637 - DNA, 20 bp, Homo sapiens
cggcagaaaacagagcctgc

SEQ ID NO: 6101638 - DNA, 22 bp, Homo sapiens
cggcagaaaacagagcctgcct

SEQ ID NO: 6101639 - DNA, 23 bp, Homo sapiens
cggcagaaaacagagcctgccta

SEQ ID NO: 6101640 - DNA, 17 bp, Homo sapiens
cggcagagaccccagga

SEQ ID NO: 6101641 - DNA, 19 bp, Homo sapiens
cggcagagcaattccaggc

SEQ ID NO: 6101642 - DNA, 20 bp, Homo sapiens
cggcagagctctacaggcct

SEQ ID NO: 6101643 - DNA, 16 bp, Homo sapiens
cggcagcacctctgag

SEQ ID NO: 6101644 - DNA, 13 bp, Homo sapiens
cggcagcagccat

SEQ ID NO: 6101645 - DNA, 15 bp, Homo sapiens
cggcagccaccctgc

SEQ ID NO: 6101646 - DNA, 17 bp, Homo sapiens
cggcagccaccctgcca

SEQ ID NO: 6101647 - DNA, 18 bp, Homo sapiens
cggcagccaccctgccat

SEQ ID NO: 6101648 - DNA, 16 bp, Homo sapiens
cggcagccccacttca

SEQ ID NO: 6101649 - DNA, 18 bp, Homo sapiens
cggcagccccagcctgct

SEQ ID NO: 6101650 - DNA, 12 bp, Homo sapiens
cggcagccccat

SEQ ID NO: 6101651 - DNA, 19 bp, Homo sapiens
cggcagccccatccttccc

SEQ ID NO: 6101652 - DNA, 22 bp, Homo sapiens
cggcagccccccagtgtcccca

SEQ ID NO: 6101653 - DNA, 11 bp, Homo sapiens
cggcagcccct

SEQ ID NO: 6101654 - DNA, 21 bp, Homo sapiens
cggcagcctcaacctccctgg

SEQ ID NO: 6101655 - DNA, 23 bp, Homo sapiens
cggcagcctcaacctccctggct

SEQ ID NO: 6101656 - DNA, 16 bp, Homo sapiens
cggcagcctcaggggc

SEQ ID NO: 6101657 - DNA, 13 bp, Homo sapiens
cggcagcctggtt

SEQ ID NO: 6101658 - DNA, 17 bp, Homo sapiens
cggcagcctggttccct

SEQ ID NO: 6101659 - DNA, 18 bp, Homo sapiens
cggcagcgaggctgggct

SEQ ID NO: 6101660 - DNA, 14 bp, Homo sapiens
cggcagcgggcgga

SEQ ID NO: 6101661 - DNA, 20 bp, Homo sapiens
cggcagctcttctgggcaga

SEQ ID NO: 6101662 - DNA, 23 bp, Homo sapiens
cggcagctcttctgggcagagcc

SEQ ID NO: 6101663 - DNA, 20 bp, Homo sapiens
cggcagcttctgccccctgc

SEQ ID NO: 6101664 - DNA, 21 bp, Homo sapiens
cggcagcttctgccccctgca

SEQ ID NO: 6101665 - DNA, 23 bp, Homo sapiens
cggcagcttctgccccctgcaga

SEQ ID NO: 6101666 - DNA, 17 bp, Homo sapiens
cggcaggactgcagagc

SEQ ID NO: 6101667 - DNA, 21 bp, Homo sapiens
cggcaggagagtgtgtgggca

SEQ ID NO: 6101668 - DNA, 18 bp, Homo sapiens
cctctgcggggcagggcc

SEQ ID NO: 6101669 - DNA, 20 bp, Homo sapiens
cctctgcggggcagggcctt

SEQ ID NO: 6101670 - DNA, 18 bp, Homo sapiens
cctctgcgtcccccagcc

SEQ ID NO: 6101671 - DNA, 19 bp, Homo sapiens
cctctgcgtcccccagccc

SEQ ID NO: 6101672 - DNA, 22 bp, Homo sapiens
cctctgcgtcccccagccctca

SEQ ID NO: 6101673 - DNA, 19 bp, Homo sapiens
cctctgcgtctatcctgtg

SEQ ID NO: 6101674 - DNA, 12 bp, Homo sapiens
cctctgctaaat

SEQ ID NO: 6101675 - DNA, 21 bp, Homo sapiens
cctctgctacgttcctattgt

SEQ ID NO: 6101676 - DNA, 19 bp, Homo sapiens
cctctgctatgcattttct

SEQ ID NO: 6101677 - DNA, 13 bp, Homo sapiens
cctctgctcaccg

SEQ ID NO: 6101678 - DNA, 23 bp, Homo sapiens
cctctgctcaccgcccatcaggg

SEQ ID NO: 6101679 - DNA, 13 bp, Homo sapiens
cctctgctcagcc

SEQ ID NO: 6101680 - DNA, 14 bp, Homo sapiens
cctctgctcagcca

SEQ ID NO: 6101681 - DNA, 15 bp, Homo sapiens
cctctgctcagccaa

SEQ ID NO: 6101682 - DNA, 17 bp, Homo sapiens
cctctgctcagccaagc

SEQ ID NO: 6101683 - DNA, 20 bp, Homo sapiens
cctctgctcattaaactgat

SEQ ID NO: 6101684 - DNA, 19 bp, Homo sapiens
cctctgctccaacagacac

SEQ ID NO: 6101685 - DNA, 20 bp, Homo sapiens
cctctgctccaacagacacc

SEQ ID NO: 6101686 - DNA, 22 bp, Homo sapiens
cctctgctccaacagacaccct

SEQ ID NO: 6101687 - DNA, 13 bp, Homo sapiens
cctctgctccctc

SEQ ID NO: 6101688 - DNA, 14 bp, Homo sapiens
cctctgctccctct

SEQ ID NO: 6101689 - DNA, 13 bp, Homo sapiens
cctctgctcctgg

SEQ ID NO: 6101690 - DNA, 20 bp, Homo sapiens
cctctgctctgaggcttcca

SEQ ID NO: 6101691 - DNA, 20 bp, Homo sapiens
cctctgctgaatgcagggaa

SEQ ID NO: 6101692 - DNA, 19 bp, Homo sapiens
cctctgctgagtgctgggc

SEQ ID NO: 6101693 - DNA, 22 bp, Homo sapiens
cctctgctgagtgctgggcact

SEQ ID NO: 6101694 - DNA, 18 bp, Homo sapiens
cctctgctgcaacaagct

SEQ ID NO: 6101695 - DNA, 19 bp, Homo sapiens
cctctgctgcaacaagctc

SEQ ID NO: 6101696 - DNA, 15 bp, Homo sapiens
cctctgctgcatccc

SEQ ID NO: 6101697 - DNA, 11 bp, Homo sapiens
cctctgctgcc

SEQ ID NO: 6101698 - DNA, 14 bp, Homo sapiens
cctctgctgccatg

SEQ ID NO: 6101699 - DNA, 12 bp, Homo sapiens
cctctgctgccc

SEQ ID NO: 6101700 - DNA, 13 bp, Homo sapiens
cctctgctgccca

SEQ ID NO: 6101701 - DNA, 14 bp, Homo sapiens
cctctgctgcccac

SEQ ID NO: 6101702 - DNA, 19 bp, Homo sapiens
cctctgctgcccacggcca

SEQ ID NO: 6101703 - DNA, 13 bp, Homo sapiens
cctctgctgcccc

SEQ ID NO: 6101704 - DNA, 14 bp, Homo sapiens
cctctgctgccccc

SEQ ID NO: 6101705 - DNA, 22 bp, Homo sapiens
cctctgctgccgcccttcctgg

SEQ ID NO: 6101706 - DNA, 23 bp, Homo sapiens
cctctgctgccgcccttcctgga

SEQ ID NO: 6101707 - DNA, 20 bp, Homo sapiens
cctctgctgccggctctggg

SEQ ID NO: 6101708 - DNA, 14 bp, Homo sapiens
cctctgctgctgtc

SEQ ID NO: 6101709 - DNA, 22 bp, Homo sapiens
cctctgctggccgggcacagct

SEQ ID NO: 6101710 - DNA, 18 bp, Homo sapiens
cctctgctggctcaggag

SEQ ID NO: 6101711 - DNA, 11 bp, Homo sapiens
cctctgctggg

SEQ ID NO: 6101712 - DNA, 11 bp, Homo sapiens
cctctgctggt

SEQ ID NO: 6101713 - DNA, 20 bp, Homo sapiens
cctctgctggttcctgactg

SEQ ID NO: 6101714 - DNA, 20 bp, Homo sapiens
cctctgctgtcctgcagtag

SEQ ID NO: 6101715 - DNA, 16 bp, Homo sapiens
cctctgcttacttttt

SEQ ID NO: 6101716 - DNA, 18 bp, Homo sapiens
cctctgcttactttttat

SEQ ID NO: 6101717 - DNA, 13 bp, Homo sapiens
cctctgcttccca

SEQ ID NO: 6101718 - DNA, 15 bp, Homo sapiens
cctctgcttgccagc

SEQ ID NO: 6101719 - DNA, 18 bp, Homo sapiens
cctctgcttgccagccag

SEQ ID NO: 6101720 - DNA, 19 bp, Homo sapiens
cctctgcttgccagccagg

SEQ ID NO: 6101721 - DNA, 21 bp, Homo sapiens
cctctgcttgccatccctccc

SEQ ID NO: 6101722 - DNA, 17 bp, Homo sapiens
cctctgcttgtcattct

SEQ ID NO: 6101723 - DNA, 22 bp, Homo sapiens
cctctgctttctcctttaattg

SEQ ID NO: 6101724 - DNA, 17 bp, Homo sapiens
cctctggaaaactattg

SEQ ID NO: 6101725 - DNA, 14 bp, Homo sapiens
cctctggaaccccc

SEQ ID NO: 6101726 - DNA, 19 bp, Homo sapiens
cctctggaaccccccaggc

SEQ ID NO: 6101727 - DNA, 23 bp, Homo sapiens
cctctggaaccccccaggcccta

SEQ ID NO: 6101728 - DNA, 14 bp, Homo sapiens
cctctggaagggag

SEQ ID NO: 6101729 - DNA, 18 bp, Homo sapiens
cctctggaagggagggct

SEQ ID NO: 6101730 - DNA, 16 bp, Homo sapiens
cctctggaattgctca

SEQ ID NO: 6101731 - DNA, 14 bp, Homo sapiens
cctctggacagctt

SEQ ID NO: 6101732 - DNA, 12 bp, Homo sapiens
cctctggacagt

SEQ ID NO: 6101733 - DNA, 23 bp, Homo sapiens
cctctggacggcaggctcactgc

SEQ ID NO: 6101734 - DNA, 13 bp, Homo sapiens
cctctggactgga

SEQ ID NO: 6101735 - DNA, 16 bp, Homo sapiens
cctctggactggaaag

SEQ ID NO: 6101736 - DNA, 17 bp, Homo sapiens
cctctggactggaaagc

SEQ ID NO: 6101737 - DNA, 16 bp, Homo sapiens
cctctggactggctag

SEQ ID NO: 6101738 - DNA, 16 bp, Homo sapiens
cctctggagaaggcct

SEQ ID NO: 6101739 - DNA, 18 bp, Homo sapiens
cctctggagaaggcctgg

SEQ ID NO: 6101740 - DNA, 17 bp, Homo sapiens
cctctggagctttgcag

SEQ ID NO: 6101741 - DNA, 13 bp, Homo sapiens
cctctggaggcct

SEQ ID NO: 6101742 - DNA, 22 bp, Homo sapiens
cctctggagggctatggcctcc

SEQ ID NO: 6101743 - DNA, 14 bp, Homo sapiens
cctctggagtggcc

SEQ ID NO: 6101744 - DNA, 21 bp, Homo sapiens
cctctggagtggccactaagc

SEQ ID NO: 6101745 - DNA, 18 bp, Homo sapiens
cctctggatccctggagg

SEQ ID NO: 6101746 - DNA, 18 bp, Homo sapiens
cctctggatcctgctgtg

SEQ ID NO: 6101747 - DNA, 11 bp, Homo sapiens
cctctggatct

SEQ ID NO: 6101748 - DNA, 16 bp, Homo sapiens
cctctggatggcacca

SEQ ID NO: 6101749 - DNA, 21 bp, Homo sapiens
cctctggattaggtctctgtt

SEQ ID NO: 6101750 - DNA, 17 bp, Homo sapiens
cctctggattccctttt

SEQ ID NO: 6101751 - DNA, 14 bp, Homo sapiens
cctctggcacctgg

SEQ ID NO: 6101752 - DNA, 12 bp, Homo sapiens
cctctggccagg

SEQ ID NO: 6101753 - DNA, 19 bp, Homo sapiens
cctctggcccctcacccac

SEQ ID NO: 6101754 - DNA, 11 bp, Homo sapiens
cctctggccct

SEQ ID NO: 6101755 - DNA, 13 bp, Homo sapiens
cctctggccctcg

SEQ ID NO: 6101756 - DNA, 21 bp, Homo sapiens
cctctggccctcggtggctgc

SEQ ID NO: 6101757 - DNA, 12 bp, Homo sapiens
cctctggccctg

SEQ ID NO: 6101758 - DNA, 15 bp, Homo sapiens
cctctggccctgtgt

SEQ ID NO: 6101759 - DNA, 13 bp, Homo sapiens
cctctggcccttg

SEQ ID NO: 6101760 - DNA, 15 bp, Homo sapiens
cctctggccgccacc

SEQ ID NO: 6101761 - DNA, 20 bp, Homo sapiens
cctctggccgcctaggctca

SEQ ID NO: 6101762 - DNA, 16 bp, Homo sapiens
cctctggctagagtgg

SEQ ID NO: 6101763 - DNA, 20 bp, Homo sapiens
cctctggctccacacctcca

SEQ ID NO: 6101764 - DNA, 18 bp, Homo sapiens
cctctggctccccaaggc

SEQ ID NO: 6101765 - DNA, 11 bp, Homo sapiens
cctctggctgc

SEQ ID NO: 6101766 - DNA, 15 bp, Homo sapiens
cctctggcttccctg

SEQ ID NO: 6101767 - DNA, 20 bp, Homo sapiens
cctctggcttgacagcatga

SEQ ID NO: 6101768 - DNA, 21 bp, Homo sapiens
cctctggcttggccacagcca

SEQ ID NO: 6101769 - DNA, 17 bp, Homo sapiens
cctctggctttcccagg

SEQ ID NO: 6101770 - DNA, 19 bp, Homo sapiens
cctctggctttcccaggag

SEQ ID NO: 6101771 - DNA, 23 bp, Homo sapiens
cctctgggaaatgagaaggcagc

SEQ ID NO: 6101772 - DNA, 14 bp, Homo sapiens
cctctgggaacctc

SEQ ID NO: 6101773 - DNA, 17 bp, Homo sapiens
cctctgggaacctccca

SEQ ID NO: 6101774 - DNA, 20 bp, Homo sapiens
cctctgggaacctcccagag

SEQ ID NO: 6101775 - DNA, 22 bp, Homo sapiens
cctctgggaacctcccagaggt

SEQ ID NO: 6101776 - DNA, 16 bp, Homo sapiens
cctctgggaccccagc

SEQ ID NO: 6101777 - DNA, 17 bp, Homo sapiens
cctctgggagtccccat

SEQ ID NO: 6101778 - DNA, 14 bp, Homo sapiens
cctctgggcactgg

SEQ ID NO: 6101779 - DNA, 17 bp, Homo sapiens
cctctgggcagcctgct

SEQ ID NO: 6101780 - DNA, 18 bp, Homo sapiens
cctctgggcagcctgctt

SEQ ID NO: 6101781 - DNA, 17 bp, Homo sapiens
cctctgggcagtgtggc

SEQ ID NO: 6101782 - DNA, 11 bp, Homo sapiens
cctctgggccc

SEQ ID NO: 6101783 - DNA, 20 bp, Homo sapiens
cctctgggcctggggtgcat

SEQ ID NO: 6101784 - DNA, 17 bp, Homo sapiens
cctctgggcctgttctc

SEQ ID NO: 6101785 - DNA, 15 bp, Homo sapiens
cctctgggctcacac

SEQ ID NO: 6101786 - DNA, 17 bp, Homo sapiens
cctctgggctcacacca

SEQ ID NO: 6101787 - DNA, 20 bp, Homo sapiens
cctctggggaagatggagca

SEQ ID NO: 6101788 - DNA, 21 bp, Homo sapiens
cctctggggaagggaaccagc

SEQ ID NO: 6101789 - DNA, 12 bp, Homo sapiens
cctctggggcag

SEQ ID NO: 6101790 - DNA, 14 bp, Homo sapiens
cctctggggccctt

SEQ ID NO: 6101791 - DNA, 17 bp, Homo sapiens
cctctggggctctaggg

SEQ ID NO: 6101792 - DNA, 19 bp, Homo sapiens
cctctgggggctctggcca

SEQ ID NO: 6101793 - DNA, 21 bp, Homo sapiens
cctctgggggctctggccaag

SEQ ID NO: 6101794 - DNA, 23 bp, Homo sapiens
cctctgggggctctggccaaggg

SEQ ID NO: 6101795 - DNA, 20 bp, Homo sapiens
cctctgggggtcctctctga

SEQ ID NO: 6101796 - DNA, 23 bp, Homo sapiens
cctctggggttcatctagggaca

SEQ ID NO: 6101797 - DNA, 20 bp, Homo sapiens
cctctgggtcagtggtccac

SEQ ID NO: 6101798 - DNA, 22 bp, Homo sapiens
cctctgggtctcagtgtcctca

SEQ ID NO: 6101799 - DNA, 20 bp, Homo sapiens
cctctgggtgagtggctgac

SEQ ID NO: 6101800 - DNA, 23 bp, Homo sapiens
cctctgggttgttgtttttttct

SEQ ID NO: 6101801 - DNA, 23 bp, Homo sapiens
cctctggtaaacattcctccagc

SEQ ID NO: 6101802 - DNA, 15 bp, Homo sapiens
cctctggtcaggagg

SEQ ID NO: 6101803 - DNA, 16 bp, Homo sapiens
cctctggtccttctga

SEQ ID NO: 6101804 - DNA, 17 bp, Homo sapiens
cctctggtcgctcctgc

SEQ ID NO: 6101805 - DNA, 20 bp, Homo sapiens
cctctggtcgctcctgccca

SEQ ID NO: 6101806 - DNA, 21 bp, Homo sapiens
cctctggtcgctcctgcccac

SEQ ID NO: 6101807 - DNA, 15 bp, Homo sapiens
cctctggtggctcct

SEQ ID NO: 6101808 - DNA, 22 bp, Homo sapiens
cctctggtggctcctcctagga

SEQ ID NO: 6101809 - DNA, 16 bp, Homo sapiens
cctctggtgttcctgg

SEQ ID NO: 6101810 - DNA, 16 bp, Homo sapiens
cctctggttccactca

SEQ ID NO: 6101811 - DNA, 19 bp, Homo sapiens
cctctggttccactcagct

SEQ ID NO: 6101812 - DNA, 15 bp, Homo sapiens
cctctggttcctttc

SEQ ID NO: 6101813 - DNA, 18 bp, Homo sapiens
cctctggtttctgtgtgt

SEQ ID NO: 6101814 - DNA, 21 bp, Homo sapiens
cctctggtttggggcgaggca

SEQ ID NO: 6101815 - DNA, 23 bp, Homo sapiens
cctctggtttggggcgaggcaga

SEQ ID NO: 6101816 - DNA, 16 bp, Homo sapiens
cctctgtaagacaaca

SEQ ID NO: 6101817 - DNA, 15 bp, Homo sapiens
cctctgtacagagcc

SEQ ID NO: 6101818 - DNA, 16 bp, Homo sapiens
cctctgtacagagccc

SEQ ID NO: 6101819 - DNA, 18 bp, Homo sapiens
cctctgtacagagcccac

SEQ ID NO: 6101820 - DNA, 21 bp, Homo sapiens
cctctgtaccgcccggcagcc

SEQ ID NO: 6101821 - DNA, 18 bp, Homo sapiens
cctctgtaggcagcagag

SEQ ID NO: 6101822 - DNA, 13 bp, Homo sapiens
cctctgtcaccca

SEQ ID NO: 6101823 - DNA, 22 bp, Homo sapiens
cctctgtcacgttctggaacat

SEQ ID NO: 6101824 - DNA, 16 bp, Homo sapiens
cctctgtcagtcacag

SEQ ID NO: 6101825 - DNA, 15 bp, Homo sapiens
cctctgtcatcactc

SEQ ID NO: 6101826 - DNA, 19 bp, Homo sapiens
cctctgtcatcactccctg

SEQ ID NO: 6101827 - DNA, 20 bp, Homo sapiens
cctctgtccaaacatttcat

SEQ ID NO: 6101828 - DNA, 22 bp, Homo sapiens
cctctgtccacttgtgggtcct

SEQ ID NO: 6101829 - DNA, 20 bp, Homo sapiens
cctctgtccagccagctcct

SEQ ID NO: 6101830 - DNA, 15 bp, Homo sapiens
cctctgtccaggcac

SEQ ID NO: 6101831 - DNA, 14 bp, Homo sapiens
cctctgtccagggc

SEQ ID NO: 6101832 - DNA, 18 bp, Homo sapiens
cctctgtccagggccctg

SEQ ID NO: 6101833 - DNA, 15 bp, Homo sapiens
cctctgtcccacccc

SEQ ID NO: 6101834 - DNA, 18 bp, Homo sapiens
cctctgtcccacccctag

SEQ ID NO: 6101835 - DNA, 21 bp, Homo sapiens
cctctgtcccacccctagcca

SEQ ID NO: 6101836 - DNA, 20 bp, Homo sapiens
cctctgtccccacgagggga

SEQ ID NO: 6101837 - DNA, 14 bp, Homo sapiens
cctctgtccccata

SEQ ID NO: 6101838 - DNA, 14 bp, Homo sapiens
cctctgtccccttc

SEQ ID NO: 6101839 - DNA, 21 bp, Homo sapiens
cctctgtcctaaaccgtcccc

SEQ ID NO: 6101840 - DNA, 15 bp, Homo sapiens
cctctgtcctcccat

SEQ ID NO: 6101841 - DNA, 17 bp, Homo sapiens
cctctgtcctcccatcc

SEQ ID NO: 6101842 - DNA, 14 bp, Homo sapiens
cctctgtcctgact

SEQ ID NO: 6101843 - DNA, 19 bp, Homo sapiens
cctctgtcctggcccggga

SEQ ID NO: 6101844 - DNA, 10 bp, Homo sapiens
cctctgtcta

SEQ ID NO: 6101845 - DNA, 14 bp, Homo sapiens
cctctgtctaggac

SEQ ID NO: 6101846 - DNA, 15 bp, Homo sapiens
cctctgtctaggact

SEQ ID NO: 6101847 - DNA, 20 bp, Homo sapiens
cggcaggagcaggaacagag

SEQ ID NO: 6101848 - DNA, 23 bp, Homo sapiens
cggcaggagcaggaacagagact

SEQ ID NO: 6101849 - DNA, 12 bp, Homo sapiens
cggcaggccctg

SEQ ID NO: 6101850 - DNA, 13 bp, Homo sapiens
cggcaggccctgc

SEQ ID NO: 6101851 - DNA, 14 bp, Homo sapiens
cggcaggccctgca

SEQ ID NO: 6101852 - DNA, 17 bp, Homo sapiens
cggcaggcctgagaatg

SEQ ID NO: 6101853 - DNA, 21 bp, Homo sapiens
cggcaggcgtgtggcagccac

SEQ ID NO: 6101854 - DNA, 22 bp, Homo sapiens
cggcaggcgtgtggcagccaca

SEQ ID NO: 6101855 - DNA, 14 bp, Homo sapiens
cggcaggctcactg

SEQ ID NO: 6101856 - DNA, 17 bp, Homo sapiens
cggcaggctcactgcca

SEQ ID NO: 6101857 - DNA, 22 bp, Homo sapiens
cggcaggctcactgccaggcca

SEQ ID NO: 6101858 - DNA, 15 bp, Homo sapiens
cggcaggctgggttc

SEQ ID NO: 6101859 - DNA, 17 bp, Homo sapiens
cggcagggcaggagctt

SEQ ID NO: 6101860 - DNA, 20 bp, Homo sapiens
cggcagggcccccaataaac

SEQ ID NO: 6101861 - DNA, 22 bp, Homo sapiens
cggcagggcccccaataaacca

SEQ ID NO: 6101862 - DNA, 23 bp, Homo sapiens
cggcagggcgggcagagggctgg

SEQ ID NO: 6101863 - DNA, 23 bp, Homo sapiens
cggcaggggcccctcctctgtgc

SEQ ID NO: 6101864 - DNA, 19 bp, Homo sapiens
cggcaggggcctggagatc

SEQ ID NO: 6101865 - DNA, 18 bp, Homo sapiens
cggcaggggttggcagcg

SEQ ID NO: 6101866 - DNA, 16 bp, Homo sapiens
cggcagggtgggggag

SEQ ID NO: 6101867 - DNA, 18 bp, Homo sapiens
cggcaggtggcctaaggc

SEQ ID NO: 6101868 - DNA, 14 bp, Homo sapiens
cggcagtattttct

SEQ ID NO: 6101869 - DNA, 14 bp, Homo sapiens
cggcagtggctggg

SEQ ID NO: 6101870 - DNA, 20 bp, Homo sapiens
cggcagtggctgggggactg

SEQ ID NO: 6101871 - DNA, 13 bp, Homo sapiens
cggcagtgggcct

SEQ ID NO: 6101872 - DNA, 20 bp, Homo sapiens
cggcagttctgggtgctccc

SEQ ID NO: 6101873 - DNA, 21 bp, Homo sapiens
cggcagttctgggtgctccct

SEQ ID NO: 6101874 - DNA, 17 bp, Homo sapiens
cggcatagcacccgtgg

SEQ ID NO: 6101875 - DNA, 17 bp, Homo sapiens
cggcatcatttcccctc

SEQ ID NO: 6101876 - DNA, 18 bp, Homo sapiens
cggcatcatttcccctcc

SEQ ID NO: 6101877 - DNA, 13 bp, Homo sapiens
cggcatccgagcc

SEQ ID NO: 6101878 - DNA, 15 bp, Homo sapiens
cggcatccgagcccc

SEQ ID NO: 6101879 - DNA, 16 bp, Homo sapiens
cggcatccgagcccct

SEQ ID NO: 6101880 - DNA, 18 bp, Homo sapiens
cggcatccgagcccctgt

SEQ ID NO: 6101881 - DNA, 15 bp, Homo sapiens
cggcatcctgaaagc

SEQ ID NO: 6101882 - DNA, 23 bp, Homo sapiens
cggcatccttgcctgtctaaagc

SEQ ID NO: 6101883 - DNA, 20 bp, Homo sapiens
cggcatgagactcagtgcag

SEQ ID NO: 6101884 - DNA, 23 bp, Homo sapiens
cggcatgagactcagtgcagatg

SEQ ID NO: 6101885 - DNA, 17 bp, Homo sapiens
cggcatgaggccccgag

SEQ ID NO: 6101886 - DNA, 19 bp, Homo sapiens
cggcatgagggctgagatg

SEQ ID NO: 6101887 - DNA, 14 bp, Homo sapiens
cggcatgctggcct

SEQ ID NO: 6101888 - DNA, 20 bp, Homo sapiens
cggcatgctggcctgtggca

SEQ ID NO: 6101889 - DNA, 13 bp, Homo sapiens
cggcatggctggg

SEQ ID NO: 6101890 - DNA, 18 bp, Homo sapiens
cggcatgtttccagcaga

SEQ ID NO: 6101891 - DNA, 18 bp, Homo sapiens
cggcattcacacacagcc

SEQ ID NO: 6101892 - DNA, 23 bp, Homo sapiens
cggcattcacacacagcctggcc

SEQ ID NO: 6101893 - DNA, 14 bp, Homo sapiens
cggcatttcaaatg

SEQ ID NO: 6101894 - DNA, 14 bp, Homo sapiens
cggccaaggtgcca

SEQ ID NO: 6101895 - DNA, 17 bp, Homo sapiens
cggccaaggtgccacca

SEQ ID NO: 6101896 - DNA, 12 bp, Homo sapiens
cggccaatggaa

SEQ ID NO: 6101897 - DNA, 15 bp, Homo sapiens
cggccaatggaaacc

SEQ ID NO: 6101898 - DNA, 18 bp, Homo sapiens
cggccaatggtgcttccc

SEQ ID NO: 6101899 - DNA, 15 bp, Homo sapiens
cggccacacagctgc

SEQ ID NO: 6101900 - DNA, 17 bp, Homo sapiens
cggccacacagctgccg

SEQ ID NO: 6101901 - DNA, 15 bp, Homo sapiens
cggccacaccccaga

SEQ ID NO: 6101902 - DNA, 16 bp, Homo sapiens
cggccacaccccagac

SEQ ID NO: 6101903 - DNA, 19 bp, Homo sapiens
cggccacaccccagactcc

SEQ ID NO: 6101904 - DNA, 13 bp, Homo sapiens
cggccacagcact

SEQ ID NO: 6101905 - DNA, 16 bp, Homo sapiens
cggccacagcactaga

SEQ ID NO: 6101906 - DNA, 21 bp, Homo sapiens
cggccacatgccgcgtccctg

SEQ ID NO: 6101907 - DNA, 20 bp, Homo sapiens
cggccacattcagttcttat

SEQ ID NO: 6101908 - DNA, 11 bp, Homo sapiens
cggccaccctc

SEQ ID NO: 6101909 - DNA, 13 bp, Homo sapiens
cggccacctcacc

SEQ ID NO: 6101910 - DNA, 11 bp, Homo sapiens
cggccacctct

SEQ ID NO: 6101911 - DNA, 14 bp, Homo sapiens
cggccacctctgcg

SEQ ID NO: 6101912 - DNA, 15 bp, Homo sapiens
cggccacctgcggtg

SEQ ID NO: 6101913 - DNA, 21 bp, Homo sapiens
cggccacgcactgggccacgg

SEQ ID NO: 6101914 - DNA, 13 bp, Homo sapiens
cggccacgctccc

SEQ ID NO: 6101915 - DNA, 21 bp, Homo sapiens
cggccacgtcatgtctctaaa

SEQ ID NO: 6101916 - DNA, 11 bp, Homo sapiens
cggccactgca

SEQ ID NO: 6101917 - DNA, 14 bp, Homo sapiens
cggccactgcaacc

SEQ ID NO: 6101918 - DNA, 14 bp, Homo sapiens
cggccactgtgtct

SEQ ID NO: 6101919 - DNA, 21 bp, Homo sapiens
cggccactgtgtctctgtttc

SEQ ID NO: 6101920 - DNA, 15 bp, Homo sapiens
cggccagagctccca

SEQ ID NO: 6101921 - DNA, 17 bp, Homo sapiens
cggccagagctcccagg

SEQ ID NO: 6101922 - DNA, 22 bp, Homo sapiens
cggccagccccggccctgggct

SEQ ID NO: 6101923 - DNA, 20 bp, Homo sapiens
cggccagcccgtcctcctct

SEQ ID NO: 6101924 - DNA, 22 bp, Homo sapiens
cggccagcccgtcctcctctac

SEQ ID NO: 6101925 - DNA, 15 bp, Homo sapiens
cggccagcgggcaca

SEQ ID NO: 6101926 - DNA, 18 bp, Homo sapiens
cggccagcgggcacaggg

SEQ ID NO: 6101927 - DNA, 21 bp, Homo sapiens
cggccagcgggcacagggcac

SEQ ID NO: 6101928 - DNA, 18 bp, Homo sapiens
cggccagcgtcccagggt

SEQ ID NO: 6101929 - DNA, 23 bp, Homo sapiens
cggccagctcccccttgcccgcc

SEQ ID NO: 6101930 - DNA, 13 bp, Homo sapiens
cggccagctctgg

SEQ ID NO: 6101931 - DNA, 18 bp, Homo sapiens
cggccagctgggtgcccc

SEQ ID NO: 6101932 - DNA, 20 bp, Homo sapiens
cggccagctgggtgccccag

SEQ ID NO: 6101933 - DNA, 11 bp, Homo sapiens
cggccaggcac

SEQ ID NO: 6101934 - DNA, 13 bp, Homo sapiens
cggccaggcacag

SEQ ID NO: 6101935 - DNA, 18 bp, Homo sapiens
cggccaggcacagggccc

SEQ ID NO: 6101936 - DNA, 19 bp, Homo sapiens
cggccaggcacagggcccg

SEQ ID NO: 6101937 - DNA, 20 bp, Homo sapiens
cggccaggcacagggcccgc

SEQ ID NO: 6101938 - DNA, 13 bp, Homo sapiens
cggccaggcaccc

SEQ ID NO: 6101939 - DNA, 15 bp, Homo sapiens
cggccaggcacccat

SEQ ID NO: 6101940 - DNA, 16 bp, Homo sapiens
cggccaggcacccatg

SEQ ID NO: 6101941 - DNA, 12 bp, Homo sapiens
cggccaggcaga

SEQ ID NO: 6101942 - DNA, 12 bp, Homo sapiens
cggccaggcggg

SEQ ID NO: 6101943 - DNA, 19 bp, Homo sapiens
cggccaggctggagtgcag

SEQ ID NO: 6101944 - DNA, 20 bp, Homo sapiens
cggccaggctggagtgcagt

SEQ ID NO: 6101945 - DNA, 17 bp, Homo sapiens
cggccagggacccaaag

SEQ ID NO: 6101946 - DNA, 18 bp, Homo sapiens
cggccagggcctggtgtg

SEQ ID NO: 6101947 - DNA, 13 bp, Homo sapiens
cggccagggcggc

SEQ ID NO: 6101948 - DNA, 16 bp, Homo sapiens
cggccaggtgcctcct

SEQ ID NO: 6101949 - DNA, 17 bp, Homo sapiens
cggccaggtgcctcctg

SEQ ID NO: 6101950 - DNA, 18 bp, Homo sapiens
cggccaggtgcctcctga

SEQ ID NO: 6101951 - DNA, 13 bp, Homo sapiens
cggccaggtgggc

SEQ ID NO: 6101952 - DNA, 23 bp, Homo sapiens
cggccatgagactgatccctggc

SEQ ID NO: 6101953 - DNA, 14 bp, Homo sapiens
cggcccaagagccc

SEQ ID NO: 6101954 - DNA, 15 bp, Homo sapiens
cggcccaagagcccg

SEQ ID NO: 6101955 - DNA, 16 bp, Homo sapiens
cggcccaagcccgact

SEQ ID NO: 6101956 - DNA, 15 bp, Homo sapiens
cggcccacacccagg

SEQ ID NO: 6101957 - DNA, 16 bp, Homo sapiens
cggcccacgcagagcc

SEQ ID NO: 6101958 - DNA, 16 bp, Homo sapiens
cggcccacgccagctg

SEQ ID NO: 6101959 - DNA, 17 bp, Homo sapiens
cggcccactttcctgag

SEQ ID NO: 6101960 - DNA, 18 bp, Homo sapiens
cggcccagaagtttccct

SEQ ID NO: 6101961 - DNA, 21 bp, Homo sapiens
cggcccagaagtttccctcaa

SEQ ID NO: 6101962 - DNA, 20 bp, Homo sapiens
cggcccagagaccccttcct

SEQ ID NO: 6101963 - DNA, 21 bp, Homo sapiens
cggcccagcaccccctctcct

SEQ ID NO: 6101964 - DNA, 23 bp, Homo sapiens
cggcccagcaccccctctcctgg

SEQ ID NO: 6101965 - DNA, 15 bp, Homo sapiens
cggcccagccatggg

SEQ ID NO: 6101966 - DNA, 20 bp, Homo sapiens
cggcccagccatgggccctc

SEQ ID NO: 6101967 - DNA, 15 bp, Homo sapiens
cggcccagccccggg

SEQ ID NO: 6101968 - DNA, 12 bp, Homo sapiens
cggcccagcctc

SEQ ID NO: 6101969 - DNA, 13 bp, Homo sapiens
cggcccaggagcg

SEQ ID NO: 6101970 - DNA, 16 bp, Homo sapiens
cggcccaggccaggtg

SEQ ID NO: 6101971 - DNA, 13 bp, Homo sapiens
cggcccagtgcca

SEQ ID NO: 6101972 - DNA, 15 bp, Homo sapiens
cggcccagtgccact

SEQ ID NO: 6101973 - DNA, 18 bp, Homo sapiens
cggcccagtgccccctgg

SEQ ID NO: 6101974 - DNA, 19 bp, Homo sapiens
cggcccatctgtccatcct

SEQ ID NO: 6101975 - DNA, 20 bp, Homo sapiens
cggcccatctgtccatcctc

SEQ ID NO: 6101976 - DNA, 21 bp, Homo sapiens
cggccccaccagtgcctctcc

SEQ ID NO: 6101977 - DNA, 18 bp, Homo sapiens
cggccccaccccctgggc

SEQ ID NO: 6101978 - DNA, 22 bp, Homo sapiens
cggccccaccccctgggcagat

SEQ ID NO: 6101979 - DNA, 17 bp, Homo sapiens
cggccccacctccctgc

SEQ ID NO: 6101980 - DNA, 22 bp, Homo sapiens
cggccccagcacctcagcctgc

SEQ ID NO: 6101981 - DNA, 14 bp, Homo sapiens
cggccccagcttct

SEQ ID NO: 6101982 - DNA, 14 bp, Homo sapiens
cggccccaggctcc

SEQ ID NO: 6101983 - DNA, 13 bp, Homo sapiens
cggccccatcaga

SEQ ID NO: 6101984 - DNA, 21 bp, Homo sapiens
cggcccccagagcgcccctcc

SEQ ID NO: 6101985 - DNA, 22 bp, Homo sapiens
cggccccccgcacagccacccg

SEQ ID NO: 6101986 - DNA, 23 bp, Homo sapiens
cggccccccgcgctcgcccagca

SEQ ID NO: 6101987 - DNA, 12 bp, Homo sapiens
cggcccccctct

SEQ ID NO: 6101988 - DNA, 20 bp, Homo sapiens
cggcccccgcgcgcgtcccc

SEQ ID NO: 6101989 - DNA, 19 bp, Homo sapiens
cggccccgagagcaggctc

SEQ ID NO: 6101990 - DNA, 13 bp, Homo sapiens
cggccccgcaccc

SEQ ID NO: 6101991 - DNA, 18 bp, Homo sapiens
cggccccgcacccctcct

SEQ ID NO: 6101992 - DNA, 20 bp, Homo sapiens
cggccccgcacccctcctcc

SEQ ID NO: 6101993 - DNA, 21 bp, Homo sapiens
cggccccgcacccctcctcct

SEQ ID NO: 6101994 - DNA, 15 bp, Homo sapiens
cggccccgccgcaga

SEQ ID NO: 6101995 - DNA, 20 bp, Homo sapiens
cggccccgcggagcccccgc

SEQ ID NO: 6101996 - DNA, 18 bp, Homo sapiens
cggcccctcaccacctct

SEQ ID NO: 6101997 - DNA, 22 bp, Homo sapiens
cggcccctcctgactcatccgc

SEQ ID NO: 6101998 - DNA, 22 bp, Homo sapiens
cggcccctgcatccccttggct

SEQ ID NO: 6101999 - DNA, 13 bp, Homo sapiens
cggcccctgctgg

SEQ ID NO: 6102000 - DNA, 19 bp, Homo sapiens
cggcccctgctggttcagg

SEQ ID NO: 6102001 - DNA, 13 bp, Homo sapiens
cggcccctggcag

SEQ ID NO: 6102002 - DNA, 16 bp, Homo sapiens
cggcccctgtctgttc

SEQ ID NO: 6102003 - DNA, 16 bp, Homo sapiens
cggcccgatctttcta

SEQ ID NO: 6102004 - DNA, 14 bp, Homo sapiens
cggcccgccacctt

SEQ ID NO: 6102005 - DNA, 15 bp, Homo sapiens
cggcccgccaccttg

SEQ ID NO: 6102006 - DNA, 19 bp, Homo sapiens
cggcccgccgtgcctgcat

SEQ ID NO: 6102007 - DNA, 16 bp, Homo sapiens
cggcccgcctgcccag

SEQ ID NO: 6102008 - DNA, 21 bp, Homo sapiens
cggcccgcctgcccagactga

SEQ ID NO: 6102009 - DNA, 15 bp, Homo sapiens
cggcccgcgcagctg

SEQ ID NO: 6102010 - DNA, 19 bp, Homo sapiens
cggcccgcgcagctgccta

SEQ ID NO: 6102011 - DNA, 16 bp, Homo sapiens
cggcccgctgcagcct

SEQ ID NO: 6102012 - DNA, 21 bp, Homo sapiens
cggcccgctgcagcctctgcc

SEQ ID NO: 6102013 - DNA, 15 bp, Homo sapiens
cggcccggagcagca

SEQ ID NO: 6102014 - DNA, 16 bp, Homo sapiens
cggcccggagcagcag

SEQ ID NO: 6102015 - DNA, 13 bp, Homo sapiens
cggcccggccagc

SEQ ID NO: 6102016 - DNA, 22 bp, Homo sapiens
cggcccggccagcgggcacagg

SEQ ID NO: 6102017 - DNA, 15 bp, Homo sapiens
cggcccggcccacgc

SEQ ID NO: 6102018 - DNA, 18 bp, Homo sapiens
cggcccggcccacgcaga

SEQ ID NO: 6102019 - DNA, 16 bp, Homo sapiens
cggcccggcccctcac

SEQ ID NO: 6102020 - DNA, 14 bp, Homo sapiens
cggccctagcattg

SEQ ID NO: 6102021 - DNA, 21 bp, Homo sapiens
cggccctcagtagtccctgca

SEQ ID NO: 6102022 - DNA, 18 bp, Homo sapiens
cggccctcatctatgagg

SEQ ID NO: 6102023 - DNA, 20 bp, Homo sapiens
cggccctccagagccccaca

SEQ ID NO: 6102024 - DNA, 10 bp, Homo sapiens
cggccctccc

SEQ ID NO: 6102025 - DNA, 13 bp, Homo sapiens
cggccctcccagg

SEQ ID NO: 6102026 - DNA, 23 bp, Homo sapiens
cggccctcctaccctgcgcccag

SEQ ID NO: 6102027 - DNA, 22 bp, Homo sapiens
cctctgtctaggactgcagtgt

SEQ ID NO: 6102028 - DNA, 15 bp, Homo sapiens
cctctgtctcctccg

SEQ ID NO: 6102029 - DNA, 15 bp, Homo sapiens
cctctgtctcgagcg

SEQ ID NO: 6102030 - DNA, 18 bp, Homo sapiens
cctctgtctcgagcgccc

SEQ ID NO: 6102031 - DNA, 22 bp, Homo sapiens
cctctgtctctgctcttgcctg

SEQ ID NO: 6102032 - DNA, 17 bp, Homo sapiens
cctctgtctgagacagg

SEQ ID NO: 6102033 - DNA, 22 bp, Homo sapiens
cctctgtctgagacaggtgcct

SEQ ID NO: 6102034 - DNA, 14 bp, Homo sapiens
cctctgtctgccct

SEQ ID NO: 6102035 - DNA, 22 bp, Homo sapiens
cctctgtctggcaatgccacag

SEQ ID NO: 6102036 - DNA, 17 bp, Homo sapiens
cctctgtcttcaggctc

SEQ ID NO: 6102037 - DNA, 15 bp, Homo sapiens
cctctgtcttctcta

SEQ ID NO: 6102038 - DNA, 16 bp, Homo sapiens
cctctgtcttctggac

SEQ ID NO: 6102039 - DNA, 12 bp, Homo sapiens
cctctgtgaaat

SEQ ID NO: 6102040 - DNA, 19 bp, Homo sapiens
cctctgtgaccaactgttg

SEQ ID NO: 6102041 - DNA, 17 bp, Homo sapiens
cctctgtgacccctcct

SEQ ID NO: 6102042 - DNA, 15 bp, Homo sapiens
cctctgtgacctcag

SEQ ID NO: 6102043 - DNA, 16 bp, Homo sapiens
cctctgtgacctcagg

SEQ ID NO: 6102044 - DNA, 9 bp, Homo sapiens
cctctgtgc

SEQ ID NO: 6102045 - DNA, 14 bp, Homo sapiens
cctctgtgcagggc

SEQ ID NO: 6102046 - DNA, 12 bp, Homo sapiens
cctctgtgccac

SEQ ID NO: 6102047 - DNA, 21 bp, Homo sapiens
cctctgtgccacgctcctctg

SEQ ID NO: 6102048 - DNA, 22 bp, Homo sapiens
cctctgtgccagggcagcattt

SEQ ID NO: 6102049 - DNA, 14 bp, Homo sapiens
cctctgtgcctaat

SEQ ID NO: 6102050 - DNA, 15 bp, Homo sapiens
cctctgtgctccctc

SEQ ID NO: 6102051 - DNA, 13 bp, Homo sapiens
cctctgtgctgtg

SEQ ID NO: 6102052 - DNA, 16 bp, Homo sapiens
cctctgtggaagagat

SEQ ID NO: 6102053 - DNA, 20 bp, Homo sapiens
cctctgtggaagagattcct

SEQ ID NO: 6102054 - DNA, 14 bp, Homo sapiens
cctctgtggccagg

SEQ ID NO: 6102055 - DNA, 15 bp, Homo sapiens
cctctgtggccagga

SEQ ID NO: 6102056 - DNA, 17 bp, Homo sapiens
cctctgtggccaggagc

SEQ ID NO: 6102057 - DNA, 20 bp, Homo sapiens
cctctgtggccaggagccct

SEQ ID NO: 6102058 - DNA, 22 bp, Homo sapiens
cctctgtggccaggagccctgg

SEQ ID NO: 6102059 - DNA, 18 bp, Homo sapiens
cctctgtggcctgtctct

SEQ ID NO: 6102060 - DNA, 17 bp, Homo sapiens
cctctgtggtcacccat

SEQ ID NO: 6102061 - DNA, 16 bp, Homo sapiens
cctctgtggtgtctgc

SEQ ID NO: 6102062 - DNA, 21 bp, Homo sapiens
cctctgtgtagccgccctgag

SEQ ID NO: 6102063 - DNA, 23 bp, Homo sapiens
cctctgtgtcactggctgcctcc

SEQ ID NO: 6102064 - DNA, 19 bp, Homo sapiens
cctctgtgtcctctcccct

SEQ ID NO: 6102065 - DNA, 20 bp, Homo sapiens
cctctgtgtccttccctgca

SEQ ID NO: 6102066 - DNA, 16 bp, Homo sapiens
cctctgtgtctgctct

SEQ ID NO: 6102067 - DNA, 19 bp, Homo sapiens
cctctgtgtgctcctcctt

SEQ ID NO: 6102068 - DNA, 20 bp, Homo sapiens
cctctgttacatcctgctac

SEQ ID NO: 6102069 - DNA, 21 bp, Homo sapiens
cctctgttaggtccattttct

SEQ ID NO: 6102070 - DNA, 19 bp, Homo sapiens
cctctgttatttgtcctca

SEQ ID NO: 6102071 - DNA, 18 bp, Homo sapiens
cctctgttcaaagctgcc

SEQ ID NO: 6102072 - DNA, 15 bp, Homo sapiens
cctctgttccccacc

SEQ ID NO: 6102073 - DNA, 13 bp, Homo sapiens
cctctgttctctc

SEQ ID NO: 6102074 - DNA, 14 bp, Homo sapiens
cctctgttctctcc

SEQ ID NO: 6102075 - DNA, 21 bp, Homo sapiens
cctctgttctctcccctcaca

SEQ ID NO: 6102076 - DNA, 22 bp, Homo sapiens
cctctgttgccaaggctggagt

SEQ ID NO: 6102077 - DNA, 15 bp, Homo sapiens
cctctgttgtcctcc

SEQ ID NO: 6102078 - DNA, 18 bp, Homo sapiens
cctctgttgtcctcccct

SEQ ID NO: 6102079 - DNA, 23 bp, Homo sapiens
cctctgttgtcctccccttgggc

SEQ ID NO: 6102080 - DNA, 16 bp, Homo sapiens
cctctgtttgacaaac

SEQ ID NO: 6102081 - DNA, 23 bp, Homo sapiens
cctctgtttgtttggctgtccag

SEQ ID NO: 6102082 - DNA, 18 bp, Homo sapiens
cctcttaaaaaataaaaa

SEQ ID NO: 6102083 - DNA, 19 bp, Homo sapiens
cctcttaaaaaataaaaac

SEQ ID NO: 6102084 - DNA, 17 bp, Homo sapiens
cctcttaaagctgcctg

SEQ ID NO: 6102085 - DNA, 20 bp, Homo sapiens
cctcttaaagctgcctgtag

SEQ ID NO: 6102086 - DNA, 22 bp, Homo sapiens
cctcttaaagctgcctgtagtt

SEQ ID NO: 6102087 - DNA, 19 bp, Homo sapiens
cctcttaaattatatattt

SEQ ID NO: 6102088 - DNA, 22 bp, Homo sapiens
cctcttaagatctgactgccaa

SEQ ID NO: 6102089 - DNA, 23 bp, Homo sapiens
cctcttaaggaaaccactgtaca

SEQ ID NO: 6102090 - DNA, 14 bp, Homo sapiens
cctcttagaaaaac

SEQ ID NO: 6102091 - DNA, 20 bp, Homo sapiens
cctcttagacttctgctttc

SEQ ID NO: 6102092 - DNA, 23 bp, Homo sapiens
cctcttagatgcagttctgaaga

SEQ ID NO: 6102093 - DNA, 19 bp, Homo sapiens
cctcttagcctctggatct

SEQ ID NO: 6102094 - DNA, 18 bp, Homo sapiens
cctcttagcttttctgca

SEQ ID NO: 6102095 - DNA, 17 bp, Homo sapiens
cctcttaggtcccggga

SEQ ID NO: 6102096 - DNA, 22 bp, Homo sapiens
cctcttaggtcccgggaggaac

SEQ ID NO: 6102097 - DNA, 14 bp, Homo sapiens
cctcttatgggctg

SEQ ID NO: 6102098 - DNA, 19 bp, Homo sapiens
cctcttcaaagcagagtgg

SEQ ID NO: 6102099 - DNA, 14 bp, Homo sapiens
cctcttcaatcccc

SEQ ID NO: 6102100 - DNA, 15 bp, Homo sapiens
cctcttcaatcccca

SEQ ID NO: 6102101 - DNA, 22 bp, Homo sapiens
cctcttcacccaccccatggag

SEQ ID NO: 6102102 - DNA, 13 bp, Homo sapiens
cctcttcaccccc

SEQ ID NO: 6102103 - DNA, 21 bp, Homo sapiens
cctcttcaccccggcaggccc

SEQ ID NO: 6102104 - DNA, 13 bp, Homo sapiens
cctcttcactccc

SEQ ID NO: 6102105 - DNA, 13 bp, Homo sapiens
cctcttcagaggc

SEQ ID NO: 6102106 - DNA, 14 bp, Homo sapiens
cctcttcagcccct

SEQ ID NO: 6102107 - DNA, 14 bp, Homo sapiens
cctcttcagctgct

SEQ ID NO: 6102108 - DNA, 16 bp, Homo sapiens
cctcttcagctgctga

SEQ ID NO: 6102109 - DNA, 14 bp, Homo sapiens
cctcttcagctggg

SEQ ID NO: 6102110 - DNA, 13 bp, Homo sapiens
cctcttcaggcct

SEQ ID NO: 6102111 - DNA, 20 bp, Homo sapiens
cctcttcaggggtcacctcc

SEQ ID NO: 6102112 - DNA, 22 bp, Homo sapiens
cctcttcaggggtcacctcctc

SEQ ID NO: 6102113 - DNA, 22 bp, Homo sapiens
cctcttcatctgtgtagctgct

SEQ ID NO: 6102114 - DNA, 18 bp, Homo sapiens
cctcttcatggatggggg

SEQ ID NO: 6102115 - DNA, 19 bp, Homo sapiens
cctcttccactccttctct

SEQ ID NO: 6102116 - DNA, 21 bp, Homo sapiens
cctcttccaggaagcacaggc

SEQ ID NO: 6102117 - DNA, 24 bp, Homo sapiens
cctcttccaggaagcacaggccag

SEQ ID NO: 6102118 - DNA, 12 bp, Homo sapiens
cctcttccagtc

SEQ ID NO: 6102119 - DNA, 16 bp, Homo sapiens
cctcttcccacaagaa

SEQ ID NO: 6102120 - DNA, 22 bp, Homo sapiens
cctcttcccaccaactctctct

SEQ ID NO: 6102121 - DNA, 21 bp, Homo sapiens
cctcttcccatgactgcaccc

SEQ ID NO: 6102122 - DNA, 14 bp, Homo sapiens
cctcttccccagaa

SEQ ID NO: 6102123 - DNA, 22 bp, Homo sapiens
cctcttccccagaaaggagact

SEQ ID NO: 6102124 - DNA, 21 bp, Homo sapiens
cctcttccccagacgcctggc

SEQ ID NO: 6102125 - DNA, 12 bp, Homo sapiens
cctcttccccct

SEQ ID NO: 6102126 - DNA, 20 bp, Homo sapiens
cctcttcccccttcccctgc

SEQ ID NO: 6102127 - DNA, 13 bp, Homo sapiens
cctcttccctctg

SEQ ID NO: 6102128 - DNA, 16 bp, Homo sapiens
cctcttccctctgggc

SEQ ID NO: 6102129 - DNA, 18 bp, Homo sapiens
cctcttccctctgggcct

SEQ ID NO: 6102130 - DNA, 20 bp, Homo sapiens
cctcttccctctgggcctgt

SEQ ID NO: 6102131 - DNA, 21 bp, Homo sapiens
cctcttccctgaagagacagg

SEQ ID NO: 6102132 - DNA, 21 bp, Homo sapiens
cctcttccctggtaagaaaaa

SEQ ID NO: 6102133 - DNA, 13 bp, Homo sapiens
cctcttccctgtc

SEQ ID NO: 6102134 - DNA, 20 bp, Homo sapiens
cctcttccctgtcttcccca

SEQ ID NO: 6102135 - DNA, 22 bp, Homo sapiens
cctcttcccttagcctctccca

SEQ ID NO: 6102136 - DNA, 13 bp, Homo sapiens
cctcttcccttcc

SEQ ID NO: 6102137 - DNA, 16 bp, Homo sapiens
cctcttcccttcctcc

SEQ ID NO: 6102138 - DNA, 13 bp, Homo sapiens
cctcttcccttct

SEQ ID NO: 6102139 - DNA, 16 bp, Homo sapiens
cctcttccgaatgggt

SEQ ID NO: 6102140 - DNA, 20 bp, Homo sapiens
cctcttccgttggaaagaac

SEQ ID NO: 6102141 - DNA, 19 bp, Homo sapiens
cctcttcctactggtctct

SEQ ID NO: 6102142 - DNA, 15 bp, Homo sapiens
cctcttcctccctca

SEQ ID NO: 6102143 - DNA, 16 bp, Homo sapiens
cctcttcctccctggg

SEQ ID NO: 6102144 - DNA, 16 bp, Homo sapiens
cctcttcctcctgaca

SEQ ID NO: 6102145 - DNA, 11 bp, Homo sapiens
cctcttcctct

SEQ ID NO: 6102146 - DNA, 13 bp, Homo sapiens
cctcttcctctga

SEQ ID NO: 6102147 - DNA, 14 bp, Homo sapiens
cctcttcctctggg

SEQ ID NO: 6102148 - DNA, 14 bp, Homo sapiens
cctcttcctctggt

SEQ ID NO: 6102149 - DNA, 17 bp, Homo sapiens
cctcttcctcttgaccc

SEQ ID NO: 6102150 - DNA, 20 bp, Homo sapiens
cctcttcctcttgaccctgc

SEQ ID NO: 6102151 - DNA, 15 bp, Homo sapiens
cctcttcctgcctag

SEQ ID NO: 6102152 - DNA, 14 bp, Homo sapiens
cctcttcctggccg

SEQ ID NO: 6102153 - DNA, 13 bp, Homo sapiens
cctcttcctgtag

SEQ ID NO: 6102154 - DNA, 12 bp, Homo sapiens
cctcttccttcc

SEQ ID NO: 6102155 - DNA, 15 bp, Homo sapiens
cctcttccttctcta

SEQ ID NO: 6102156 - DNA, 15 bp, Homo sapiens
cctcttcctttagga

SEQ ID NO: 6102157 - DNA, 16 bp, Homo sapiens
cctcttcggccctcag

SEQ ID NO: 6102158 - DNA, 21 bp, Homo sapiens
cctcttctaaaatagcaataa

SEQ ID NO: 6102159 - DNA, 21 bp, Homo sapiens
cctcttctaacccaactgact

SEQ ID NO: 6102160 - DNA, 15 bp, Homo sapiens
cctcttctactcact

SEQ ID NO: 6102161 - DNA, 23 bp, Homo sapiens
cctcttctactcacttttcccac

SEQ ID NO: 6102162 - DNA, 16 bp, Homo sapiens
cctcttctcaagtgcc

SEQ ID NO: 6102163 - DNA, 19 bp, Homo sapiens
cctcttctcaagtgcctta

SEQ ID NO: 6102164 - DNA, 16 bp, Homo sapiens
cctcttctcagctcca

SEQ ID NO: 6102165 - DNA, 22 bp, Homo sapiens
cctcttctcagctccactctga

SEQ ID NO: 6102166 - DNA, 22 bp, Homo sapiens
cctcttctcctgcagcctgaga

SEQ ID NO: 6102167 - DNA, 13 bp, Homo sapiens
cctcttctctcct

SEQ ID NO: 6102168 - DNA, 14 bp, Homo sapiens
cctcttctctcctc

SEQ ID NO: 6102169 - DNA, 17 bp, Homo sapiens
cctcttctctgggccca

SEQ ID NO: 6102170 - DNA, 20 bp, Homo sapiens
cctcttctctgggcccagag

SEQ ID NO: 6102171 - DNA, 16 bp, Homo sapiens
cctcttctcttcctgt

SEQ ID NO: 6102172 - DNA, 12 bp, Homo sapiens
cctcttctgagc

SEQ ID NO: 6102173 - DNA, 14 bp, Homo sapiens
cctcttctgagctt

SEQ ID NO: 6102174 - DNA, 14 bp, Homo sapiens
cctcttctgcatct

SEQ ID NO: 6102175 - DNA, 21 bp, Homo sapiens
cctcttctggagatggaagct

SEQ ID NO: 6102176 - DNA, 17 bp, Homo sapiens
cctcttctgggagggca

SEQ ID NO: 6102177 - DNA, 21 bp, Homo sapiens
cctcttctgggagggcagcag

SEQ ID NO: 6102178 - DNA, 16 bp, Homo sapiens
cctcttctgggcctga

SEQ ID NO: 6102179 - DNA, 20 bp, Homo sapiens
cctcttctggtttcccttta

SEQ ID NO: 6102180 - DNA, 17 bp, Homo sapiens
cctcttcttacttgatg

SEQ ID NO: 6102181 - DNA, 22 bp, Homo sapiens
cctcttctttcagacttgccat

SEQ ID NO: 6102182 - DNA, 16 bp, Homo sapiens
cctcttctttgtgcct

SEQ ID NO: 6102183 - DNA, 17 bp, Homo sapiens
cctcttctttgtgcctt

SEQ ID NO: 6102184 - DNA, 19 bp, Homo sapiens
cctcttctttgtgcctttg

SEQ ID NO: 6102185 - DNA, 22 bp, Homo sapiens
cctcttctttgtgcctttggcc

SEQ ID NO: 6102186 - DNA, 18 bp, Homo sapiens
cctcttgaagagaaaaaa

SEQ ID NO: 6102187 - DNA, 16 bp, Homo sapiens
cctcttgaccctgcac

SEQ ID NO: 6102188 - DNA, 17 bp, Homo sapiens
cctcttgaccctgcacc

SEQ ID NO: 6102189 - DNA, 21 bp, Homo sapiens
cctcttgagagccccacccct

SEQ ID NO: 6102190 - DNA, 15 bp, Homo sapiens
cctcttgagcagtgg

SEQ ID NO: 6102191 - DNA, 13 bp, Homo sapiens
cctcttgagcctt

SEQ ID NO: 6102192 - DNA, 22 bp, Homo sapiens
cctcttgagttcctctgcagtt

SEQ ID NO: 6102193 - DNA, 16 bp, Homo sapiens
cctcttgattcctggt

SEQ ID NO: 6102194 - DNA, 15 bp, Homo sapiens
cctcttgcaggctga

SEQ ID NO: 6102195 - DNA, 15 bp, Homo sapiens
cctcttgcagggtct

SEQ ID NO: 6102196 - DNA, 13 bp, Homo sapiens
cctcttgccacat

SEQ ID NO: 6102197 - DNA, 15 bp, Homo sapiens
cctcttgccacatct

SEQ ID NO: 6102198 - DNA, 16 bp, Homo sapiens
cctcttgccacatctt

SEQ ID NO: 6102199 - DNA, 19 bp, Homo sapiens
cctcttgccacatcttgaa

SEQ ID NO: 6102200 - DNA, 11 bp, Homo sapiens
cctcttgccag

SEQ ID NO: 6102201 - DNA, 13 bp, Homo sapiens
cctcttgccagcc

SEQ ID NO: 6102202 - DNA, 18 bp, Homo sapiens
cctcttgccagcctcctt

SEQ ID NO: 6102203 - DNA, 13 bp, Homo sapiens
cctcttgcccatc

SEQ ID NO: 6102204 - DNA, 11 bp, Homo sapiens
cctcttgcctc

SEQ ID NO: 6102205 - DNA, 16 bp, Homo sapiens
cctcttgcctcctgga

SEQ ID NO: 6102206 - DNA, 13 bp, Homo sapiens
cggccctcctggg

SEQ ID NO: 6102207 - DNA, 14 bp, Homo sapiens
cggccctcctggga

SEQ ID NO: 6102208 - DNA, 16 bp, Homo sapiens
cggccctgaaccacga

SEQ ID NO: 6102209 - DNA, 23 bp, Homo sapiens
cggccctgaaccacgaggctgcc

SEQ ID NO: 6102210 - DNA, 19 bp, Homo sapiens
cggccctgcaggagcaggg

SEQ ID NO: 6102211 - DNA, 13 bp, Homo sapiens
cggccctgcccaa

SEQ ID NO: 6102212 - DNA, 20 bp, Homo sapiens
cggccctgccccacacaggc

SEQ ID NO: 6102213 - DNA, 16 bp, Homo sapiens
cggccctgccccatcc

SEQ ID NO: 6102214 - DNA, 22 bp, Homo sapiens
cggccctgccccatcctgggcc

SEQ ID NO: 6102215 - DNA, 15 bp, Homo sapiens
cggccctgcccctcc

SEQ ID NO: 6102216 - DNA, 16 bp, Homo sapiens
cggccctgcccctccc

SEQ ID NO: 6102217 - DNA, 10 bp, Homo sapiens
cggccctgcg

SEQ ID NO: 6102218 - DNA, 18 bp, Homo sapiens
cggccctgcgtcggccct

SEQ ID NO: 6102219 - DNA, 21 bp, Homo sapiens
cggccctgctgaagctgctgc

SEQ ID NO: 6102220 - DNA, 22 bp, Homo sapiens
cggccctgctgaagctgctgca

SEQ ID NO: 6102221 - DNA, 22 bp, Homo sapiens
cggccctggctggggacttggc

SEQ ID NO: 6102222 - DNA, 13 bp, Homo sapiens
cggccctggcttg

SEQ ID NO: 6102223 - DNA, 11 bp, Homo sapiens
cggccctgggg

SEQ ID NO: 6102224 - DNA, 12 bp, Homo sapiens
cggccctggggc

SEQ ID NO: 6102225 - DNA, 15 bp, Homo sapiens
cggccctgtagccct

SEQ ID NO: 6102226 - DNA, 18 bp, Homo sapiens
cggccctgtagccctggc

SEQ ID NO: 6102227 - DNA, 14 bp, Homo sapiens
cggccctgtcagag

SEQ ID NO: 6102228 - DNA, 17 bp, Homo sapiens
cggccctgtcccctgga

SEQ ID NO: 6102229 - DNA, 18 bp, Homo sapiens
cggccctgtcccctggag

SEQ ID NO: 6102230 - DNA, 15 bp, Homo sapiens
cggccctgtgtgcag

SEQ ID NO: 6102231 - DNA, 16 bp, Homo sapiens
cggcccttctgactgt

SEQ ID NO: 6102232 - DNA, 20 bp, Homo sapiens
cggcccttctgactgtttat

SEQ ID NO: 6102233 - DNA, 17 bp, Homo sapiens
cggccgaccaggctgga

SEQ ID NO: 6102234 - DNA, 15 bp, Homo sapiens
cggccgagctggttt

SEQ ID NO: 6102235 - DNA, 18 bp, Homo sapiens
cggccgatgggagtctcc

SEQ ID NO: 6102236 - DNA, 20 bp, Homo sapiens
cggccgatgggagtctccct

SEQ ID NO: 6102237 - DNA, 15 bp, Homo sapiens
cggccgcagagactg

SEQ ID NO: 6102238 - DNA, 13 bp, Homo sapiens
cggccgcattccc

SEQ ID NO: 6102239 - DNA, 16 bp, Homo sapiens
cggccgcattccctga

SEQ ID NO: 6102240 - DNA, 18 bp, Homo sapiens
cggccgccatagccccag

SEQ ID NO: 6102241 - DNA, 20 bp, Homo sapiens
cggccgccccccgcccctcg

SEQ ID NO: 6102242 - DNA, 23 bp, Homo sapiens
cggccgccccgccccagagctcc

SEQ ID NO: 6102243 - DNA, 20 bp, Homo sapiens
cggccgcccctcctcgtgaa

SEQ ID NO: 6102244 - DNA, 15 bp, Homo sapiens
cggccgccgccagga

SEQ ID NO: 6102245 - DNA, 18 bp, Homo sapiens
cggccgccgccaggactg

SEQ ID NO: 6102246 - DNA, 15 bp, Homo sapiens
cggccgcctgtcctt

SEQ ID NO: 6102247 - DNA, 23 bp, Homo sapiens
cggccgcctttgcgctctcgggt

SEQ ID NO: 6102248 - DNA, 15 bp, Homo sapiens
cggccgctccaccag

SEQ ID NO: 6102249 - DNA, 13 bp, Homo sapiens
cggccgctccagg

SEQ ID NO: 6102250 - DNA, 14 bp, Homo sapiens
cggccgctccaggg

SEQ ID NO: 6102251 - DNA, 14 bp, Homo sapiens
cggccgctctccgc

SEQ ID NO: 6102252 - DNA, 18 bp, Homo sapiens
cggccggacctctgagca

SEQ ID NO: 6102253 - DNA, 16 bp, Homo sapiens
cggccggccctggctt

SEQ ID NO: 6102254 - DNA, 15 bp, Homo sapiens
cggccggcctggcac

SEQ ID NO: 6102255 - DNA, 14 bp, Homo sapiens
cggccgggctgccc

SEQ ID NO: 6102256 - DNA, 15 bp, Homo sapiens
cggccgggctgccct

SEQ ID NO: 6102257 - DNA, 19 bp, Homo sapiens
cggccgggctgcccttcgc

SEQ ID NO: 6102258 - DNA, 21 bp, Homo sapiens
cggccgtgggccgggaggcag

SEQ ID NO: 6102259 - DNA, 17 bp, Homo sapiens
cggcctaggcacctccc

SEQ ID NO: 6102260 - DNA, 20 bp, Homo sapiens
cggcctagggcccccacagt

SEQ ID NO: 6102261 - DNA, 18 bp, Homo sapiens
cggcctattgcttgggtc

SEQ ID NO: 6102262 - DNA, 21 bp, Homo sapiens
cggcctattgcttgggtctct

SEQ ID NO: 6102263 - DNA, 21 bp, Homo sapiens
cggcctcaccaggcccacgag

SEQ ID NO: 6102264 - DNA, 22 bp, Homo sapiens
cggcctcaccaggcccacgagg

SEQ ID NO: 6102265 - DNA, 13 bp, Homo sapiens
cggcctcagggcg

SEQ ID NO: 6102266 - DNA, 19 bp, Homo sapiens
cggcctcagggcgctcaga

SEQ ID NO: 6102267 - DNA, 21 bp, Homo sapiens
cggcctcagggcgctcagacg

SEQ ID NO: 6102268 - DNA, 18 bp, Homo sapiens
cggcctcagggtctaagg

SEQ ID NO: 6102269 - DNA, 21 bp, Homo sapiens
cggcctccactcccccacctg

SEQ ID NO: 6102270 - DNA, 12 bp, Homo sapiens
cggcctccagga

SEQ ID NO: 6102271 - DNA, 13 bp, Homo sapiens
cggcctccaggag

SEQ ID NO: 6102272 - DNA, 17 bp, Homo sapiens
cggcctccaggaggggc

SEQ ID NO: 6102273 - DNA, 14 bp, Homo sapiens
cggcctccaggctg

SEQ ID NO: 6102274 - DNA, 18 bp, Homo sapiens
cggcctccaggctggggc

SEQ ID NO: 6102275 - DNA, 14 bp, Homo sapiens
cggcctccatcctg

SEQ ID NO: 6102276 - DNA, 16 bp, Homo sapiens
cggcctccatcctgag

SEQ ID NO: 6102277 - DNA, 21 bp, Homo sapiens
cggcctcccaaagtgctggga

SEQ ID NO: 6102278 - DNA, 21 bp, Homo sapiens
cggcctcccagagtgctggga

SEQ ID NO: 6102279 - DNA, 13 bp, Homo sapiens
cggcctcccaggt

SEQ ID NO: 6102280 - DNA, 19 bp, Homo sapiens
cggcctcccgaggaggggc

SEQ ID NO: 6102281 - DNA, 18 bp, Homo sapiens
cggcctccgaggctcccc

SEQ ID NO: 6102282 - DNA, 20 bp, Homo sapiens
cggcctccgaggctccccgc

SEQ ID NO: 6102283 - DNA, 20 bp, Homo sapiens
cggcctcctaaagtgctggg

SEQ ID NO: 6102284 - DNA, 23 bp, Homo sapiens
cggcctcctcggagagcagcagc

SEQ ID NO: 6102285 - DNA, 21 bp, Homo sapiens
cggcctccttctgagctcctg

SEQ ID NO: 6102286 - DNA, 17 bp, Homo sapiens
cggcctctaaccccagg

SEQ ID NO: 6102287 - DNA, 21 bp, Homo sapiens
cggcctctaaccccaggcccc

SEQ ID NO: 6102288 - DNA, 17 bp, Homo sapiens
cggcctctacggccccg

SEQ ID NO: 6102289 - DNA, 17 bp, Homo sapiens
cggcctctccctgcctg

SEQ ID NO: 6102290 - DNA, 21 bp, Homo sapiens
cggcctctccctgcctgtggc

SEQ ID NO: 6102291 - DNA, 19 bp, Homo sapiens
cggcctctctcttcccagc

SEQ ID NO: 6102292 - DNA, 14 bp, Homo sapiens
cggcctctctggcc

SEQ ID NO: 6102293 - DNA, 17 bp, Homo sapiens
cggcctcttctctcaga

SEQ ID NO: 6102294 - DNA, 19 bp, Homo sapiens
cggcctcttgagagcccca

SEQ ID NO: 6102295 - DNA, 15 bp, Homo sapiens
cggcctgatgctccc

SEQ ID NO: 6102296 - DNA, 16 bp, Homo sapiens
cggcctgatgctccct

SEQ ID NO: 6102297 - DNA, 17 bp, Homo sapiens
cggcctgcactccccca

SEQ ID NO: 6102298 - DNA, 19 bp, Homo sapiens
cggcctgcagaccctgcca

SEQ ID NO: 6102299 - DNA, 22 bp, Homo sapiens
cggcctgcagaccctgccaggg

SEQ ID NO: 6102300 - DNA, 18 bp, Homo sapiens
cggcctgcagcccagaac

SEQ ID NO: 6102301 - DNA, 15 bp, Homo sapiens
cggcctgcagtggtg

SEQ ID NO: 6102302 - DNA, 14 bp, Homo sapiens
cggcctgccaggag

SEQ ID NO: 6102303 - DNA, 15 bp, Homo sapiens
cggcctgccaggagg

SEQ ID NO: 6102304 - DNA, 22 bp, Homo sapiens
cggcctgccaggaggacccagg

SEQ ID NO: 6102305 - DNA, 12 bp, Homo sapiens
cggcctgcctgc

SEQ ID NO: 6102306 - DNA, 15 bp, Homo sapiens
cggcctgctcccagc

SEQ ID NO: 6102307 - DNA, 19 bp, Homo sapiens
cggcctgctcccagcagcc

SEQ ID NO: 6102308 - DNA, 15 bp, Homo sapiens
cggcctggcatgcag

SEQ ID NO: 6102309 - DNA, 12 bp, Homo sapiens
cggcctggcctt

SEQ ID NO: 6102310 - DNA, 15 bp, Homo sapiens
cggcctggctgcagc

SEQ ID NO: 6102311 - DNA, 17 bp, Homo sapiens
cggcctggctgcagctg

SEQ ID NO: 6102312 - DNA, 11 bp, Homo sapiens
cggcctggctt

SEQ ID NO: 6102313 - DNA, 14 bp, Homo sapiens
cggcctgggcacca

SEQ ID NO: 6102314 - DNA, 18 bp, Homo sapiens
cggcctggggacggagca

SEQ ID NO: 6102315 - DNA, 20 bp, Homo sapiens
cggcctggggccgggctggc

SEQ ID NO: 6102316 - DNA, 23 bp, Homo sapiens
cggcctggggccgggctggcttc

SEQ ID NO: 6102317 - DNA, 21 bp, Homo sapiens
cggcctgtgggtctctgaagg

SEQ ID NO: 6102318 - DNA, 20 bp, Homo sapiens
cggcctgttgggcagagctg

SEQ ID NO: 6102319 - DNA, 14 bp, Homo sapiens
cggccttgaagaca

SEQ ID NO: 6102320 - DNA, 19 bp, Homo sapiens
cggccttgaagacagagca

SEQ ID NO: 6102321 - DNA, 16 bp, Homo sapiens
cggccttgatcccctt

SEQ ID NO: 6102322 - DNA, 23 bp, Homo sapiens
cggccttgctttgtctggcctca

SEQ ID NO: 6102323 - DNA, 16 bp, Homo sapiens
cggccttggccttggg

SEQ ID NO: 6102324 - DNA, 23 bp, Homo sapiens
cggccttggccttggggccagac

SEQ ID NO: 6102325 - DNA, 18 bp, Homo sapiens
cggccttggtgaacacac

SEQ ID NO: 6102326 - DNA, 20 bp, Homo sapiens
cggcctttatgttttttgta

SEQ ID NO: 6102327 - DNA, 13 bp, Homo sapiens
cggcctttcccac

SEQ ID NO: 6102328 - DNA, 14 bp, Homo sapiens
cggcctttcccact

SEQ ID NO: 6102329 - DNA, 15 bp, Homo sapiens
cggcctttggcttca

SEQ ID NO: 6102330 - DNA, 20 bp, Homo sapiens
cggcgaccgccctccgcgaa

SEQ ID NO: 6102331 - DNA, 17 bp, Homo sapiens
cggcgacggagcactgc

SEQ ID NO: 6102332 - DNA, 16 bp, Homo sapiens
cggcgcagacaggcgg

SEQ ID NO: 6102333 - DNA, 13 bp, Homo sapiens
cggcgcagagccc

SEQ ID NO: 6102334 - DNA, 14 bp, Homo sapiens
cggcgcagagccct

SEQ ID NO: 6102335 - DNA, 20 bp, Homo sapiens
cggcgcagagccctccaggc

SEQ ID NO: 6102336 - DNA, 14 bp, Homo sapiens
cggcgcagcccctg

SEQ ID NO: 6102337 - DNA, 13 bp, Homo sapiens
cggcgccaccatc

SEQ ID NO: 6102338 - DNA, 22 bp, Homo sapiens
cggcgccccgcacccccgccag

SEQ ID NO: 6102339 - DNA, 18 bp, Homo sapiens
cggcgccctctgtcctga

SEQ ID NO: 6102340 - DNA, 18 bp, Homo sapiens
cggcgcctgccctgccca

SEQ ID NO: 6102341 - DNA, 22 bp, Homo sapiens
cggcgcctgccctgcccaagtg

SEQ ID NO: 6102342 - DNA, 13 bp, Homo sapiens
cggcgcggtggct

SEQ ID NO: 6102343 - DNA, 18 bp, Homo sapiens
cggcgctgattcctcgtg

SEQ ID NO: 6102344 - DNA, 20 bp, Homo sapiens
cggcgcttgccactagggct

SEQ ID NO: 6102345 - DNA, 15 bp, Homo sapiens
cggcggaaagcctct

SEQ ID NO: 6102346 - DNA, 22 bp, Homo sapiens
cggcggaattcaccagtgttcc

SEQ ID NO: 6102347 - DNA, 21 bp, Homo sapiens
cggcggagctggccccgccgc

SEQ ID NO: 6102348 - DNA, 23 bp, Homo sapiens
cggcggcagccccacttcacccc

SEQ ID NO: 6102349 - DNA, 15 bp, Homo sapiens
cggcggccacgcact

SEQ ID NO: 6102350 - DNA, 12 bp, Homo sapiens
cggcggccaggc

SEQ ID NO: 6102351 - DNA, 13 bp, Homo sapiens
cggcggccaggca

SEQ ID NO: 6102352 - DNA, 16 bp, Homo sapiens
cggcggccaggcacag

SEQ ID NO: 6102353 - DNA, 15 bp, Homo sapiens
cggcggcctcagagt

SEQ ID NO: 6102354 - DNA, 15 bp, Homo sapiens
cggcggctctgagca

SEQ ID NO: 6102355 - DNA, 16 bp, Homo sapiens
cggcggctctgagcag

SEQ ID NO: 6102356 - DNA, 20 bp, Homo sapiens
cggcggctctgagcaggggc

SEQ ID NO: 6102357 - DNA, 18 bp, Homo sapiens
cggcggctctgcccacct

SEQ ID NO: 6102358 - DNA, 17 bp, Homo sapiens
cggcgggatcctccaca

SEQ ID NO: 6102359 - DNA, 20 bp, Homo sapiens
cggcgggatcctccacagag

SEQ ID NO: 6102360 - DNA, 23 bp, Homo sapiens
cggcgggatcctccacagagagg

SEQ ID NO: 6102361 - DNA, 18 bp, Homo sapiens
cggcggggtgcctgctgt

SEQ ID NO: 6102362 - DNA, 14 bp, Homo sapiens
cggcgggtgacagc

SEQ ID NO: 6102363 - DNA, 18 bp, Homo sapiens
cggcgggtgctctgaggc

SEQ ID NO: 6102364 - DNA, 22 bp, Homo sapiens
cggcgggtgctctgaggcctca

SEQ ID NO: 6102365 - DNA, 16 bp, Homo sapiens
cggcgtacaggctggc

SEQ ID NO: 6102366 - DNA, 23 bp, Homo sapiens
cggcgtcagcctccagcctctgt

SEQ ID NO: 6102367 - DNA, 19 bp, Homo sapiens
cggcgtcttgcccagcagc

SEQ ID NO: 6102368 - DNA, 15 bp, Homo sapiens
cggcgtggagactgg

SEQ ID NO: 6102369 - DNA, 18 bp, Homo sapiens
cggcgtggagactggcag

SEQ ID NO: 6102370 - DNA, 13 bp, Homo sapiens
cggctaaaaagaa

SEQ ID NO: 6102371 - DNA, 20 bp, Homo sapiens
cggctaatgtttgtattttt

SEQ ID NO: 6102372 - DNA, 16 bp, Homo sapiens
cggctacatcaaatca

SEQ ID NO: 6102373 - DNA, 17 bp, Homo sapiens
cggctacccctcgactc

SEQ ID NO: 6102374 - DNA, 19 bp, Homo sapiens
cggctactggttacctgga

SEQ ID NO: 6102375 - DNA, 20 bp, Homo sapiens
cggctactggttacctggag

SEQ ID NO: 6102376 - DNA, 23 bp, Homo sapiens
cggctactggttacctggagaag

SEQ ID NO: 6102377 - DNA, 19 bp, Homo sapiens
cggctaggccggccagctc

SEQ ID NO: 6102378 - DNA, 16 bp, Homo sapiens
cggctcaagcccagga

SEQ ID NO: 6102379 - DNA, 20 bp, Homo sapiens
cggctcactgcaacctctgc

SEQ ID NO: 6102380 - DNA, 15 bp, Homo sapiens
cggctcactgcagcc

SEQ ID NO: 6102381 - DNA, 18 bp, Homo sapiens
cggctcactgcagcctca

SEQ ID NO: 6102382 - DNA, 17 bp, Homo sapiens
cggctcaggctctgctg

SEQ ID NO: 6102383 - DNA, 18 bp, Homo sapiens
cggctcaggctctgctgg

SEQ ID NO: 6102384 - DNA, 19 bp, Homo sapiens
cggctcagtgcaacctctg

SEQ ID NO: 6102385 - DNA, 13 bp, Homo sapiens
cctcttgcctcga

SEQ ID NO: 6102386 - DNA, 14 bp, Homo sapiens
cctcttgcctctct

SEQ ID NO: 6102387 - DNA, 16 bp, Homo sapiens
cctcttgcctctctca

SEQ ID NO: 6102388 - DNA, 18 bp, Homo sapiens
cctcttgcctctctcagg

SEQ ID NO: 6102389 - DNA, 17 bp, Homo sapiens
cctcttgcgggcctgga

SEQ ID NO: 6102390 - DNA, 12 bp, Homo sapiens
cctcttgctggt

SEQ ID NO: 6102391 - DNA, 15 bp, Homo sapiens
cctcttgctgtctct

SEQ ID NO: 6102392 - DNA, 18 bp, Homo sapiens
cctcttgctgtctctgct

SEQ ID NO: 6102393 - DNA, 23 bp, Homo sapiens
cctcttgctgtctctgctcgccc

SEQ ID NO: 6102394 - DNA, 17 bp, Homo sapiens
cctcttggacctctgct

SEQ ID NO: 6102395 - DNA, 19 bp, Homo sapiens
cctcttggacctctgctct

SEQ ID NO: 6102396 - DNA, 14 bp, Homo sapiens
cctcttggagaagt

SEQ ID NO: 6102397 - DNA, 20 bp, Homo sapiens
cctcttggagtctagaacat

SEQ ID NO: 6102398 - DNA, 17 bp, Homo sapiens
cctcttggataccagct

SEQ ID NO: 6102399 - DNA, 19 bp, Homo sapiens
cctcttggataccagctca

SEQ ID NO: 6102400 - DNA, 23 bp, Homo sapiens
cctcttggataccagctcagggg

SEQ ID NO: 6102401 - DNA, 18 bp, Homo sapiens
cctcttggattaaggaag

SEQ ID NO: 6102402 - DNA, 20 bp, Homo sapiens
cctcttggattaaggaagac

SEQ ID NO: 6102403 - DNA, 17 bp, Homo sapiens
cctcttggcacctgcct

SEQ ID NO: 6102404 - DNA, 18 bp, Homo sapiens
cctcttggcacctgccta

SEQ ID NO: 6102405 - DNA, 13 bp, Homo sapiens
cctcttggcctga

SEQ ID NO: 6102406 - DNA, 22 bp, Homo sapiens
cctcttggctatttctgtgtcc

SEQ ID NO: 6102407 - DNA, 17 bp, Homo sapiens
cctcttggcttctcagc

SEQ ID NO: 6102408 - DNA, 18 bp, Homo sapiens
cctcttggcttctcagcc

SEQ ID NO: 6102409 - DNA, 22 bp, Homo sapiens
cctcttggcttctcagcccctt

SEQ ID NO: 6102410 - DNA, 24 bp, Homo sapiens
cctcttgggcatgctcagcccttc

SEQ ID NO: 6102411 - DNA, 20 bp, Homo sapiens
cctcttgggggcactgctcc

SEQ ID NO: 6102412 - DNA, 13 bp, Homo sapiens
cctcttgggttca

SEQ ID NO: 6102413 - DNA, 21 bp, Homo sapiens
cctcttggtcttcccaggctg

SEQ ID NO: 6102414 - DNA, 21 bp, Homo sapiens
cctcttggtgggtgtggccag

SEQ ID NO: 6102415 - DNA, 22 bp, Homo sapiens
cctcttggtgggtgtggccagc

SEQ ID NO: 6102416 - DNA, 22 bp, Homo sapiens
cctcttggtgtcaaatttttaa

SEQ ID NO: 6102417 - DNA, 17 bp, Homo sapiens
cctcttgtaaataaagc

SEQ ID NO: 6102418 - DNA, 20 bp, Homo sapiens
cctcttgtaaataaagccct

SEQ ID NO: 6102419 - DNA, 19 bp, Homo sapiens
cctcttgtagtcttggcta

SEQ ID NO: 6102420 - DNA, 13 bp, Homo sapiens
cctcttgtcagtg

SEQ ID NO: 6102421 - DNA, 15 bp, Homo sapiens
cctcttgtcagtgta

SEQ ID NO: 6102422 - DNA, 13 bp, Homo sapiens
cctcttgtctccc

SEQ ID NO: 6102423 - DNA, 14 bp, Homo sapiens
cctcttgtctgatt

SEQ ID NO: 6102424 - DNA, 22 bp, Homo sapiens
cctcttgtcttcctatttcaga

SEQ ID NO: 6102425 - DNA, 15 bp, Homo sapiens
cctcttgtgctgagt

SEQ ID NO: 6102426 - DNA, 21 bp, Homo sapiens
cctcttgtgtaactaatttgt

SEQ ID NO: 6102427 - DNA, 17 bp, Homo sapiens
cctcttgttgcagagat

SEQ ID NO: 6102428 - DNA, 17 bp, Homo sapiens
cctctttaaaacaaaac

SEQ ID NO: 6102429 - DNA, 22 bp, Homo sapiens
cctctttaatgctgtctttgtg

SEQ ID NO: 6102430 - DNA, 15 bp, Homo sapiens
cctctttactccctt

SEQ ID NO: 6102431 - DNA, 14 bp, Homo sapiens
cctctttactctct

SEQ ID NO: 6102432 - DNA, 16 bp, Homo sapiens
cctctttactctctcc

SEQ ID NO: 6102433 - DNA, 18 bp, Homo sapiens
cctctttactctctccga

SEQ ID NO: 6102434 - DNA, 14 bp, Homo sapiens
cctctttcagctcc

SEQ ID NO: 6102435 - DNA, 11 bp, Homo sapiens
cctctttcagt

SEQ ID NO: 6102436 - DNA, 15 bp, Homo sapiens
cctctttcatccact

SEQ ID NO: 6102437 - DNA, 15 bp, Homo sapiens
cctctttcatctgta

SEQ ID NO: 6102438 - DNA, 17 bp, Homo sapiens
cctctttcccaccctcc

SEQ ID NO: 6102439 - DNA, 17 bp, Homo sapiens
cctctttccccactgaa

SEQ ID NO: 6102440 - DNA, 14 bp, Homo sapiens
cctctttcccctcc

SEQ ID NO: 6102441 - DNA, 22 bp, Homo sapiens
cctctttcccctcctttgtctt

SEQ ID NO: 6102442 - DNA, 16 bp, Homo sapiens
cctctttcccttccag

SEQ ID NO: 6102443 - DNA, 18 bp, Homo sapiens
cctctttcccttccagtt

SEQ ID NO: 6102444 - DNA, 21 bp, Homo sapiens
cctctttcctaacttccttta

SEQ ID NO: 6102445 - DNA, 15 bp, Homo sapiens
cctctttcctctctt

SEQ ID NO: 6102446 - DNA, 14 bp, Homo sapiens
cctctttcctctgt

SEQ ID NO: 6102447 - DNA, 18 bp, Homo sapiens
cctctttctacagcctaa

SEQ ID NO: 6102448 - DNA, 22 bp, Homo sapiens
cctctttctacattctcatcta

SEQ ID NO: 6102449 - DNA, 13 bp, Homo sapiens
cctctttctagcc

SEQ ID NO: 6102450 - DNA, 16 bp, Homo sapiens
cctctttctcccttct

SEQ ID NO: 6102451 - DNA, 15 bp, Homo sapiens
cctctttctctcccc

SEQ ID NO: 6102452 - DNA, 21 bp, Homo sapiens
cctctttctctccccaacccc

SEQ ID NO: 6102453 - DNA, 15 bp, Homo sapiens
cctctttctctcctt

SEQ ID NO: 6102454 - DNA, 15 bp, Homo sapiens
cctctttctctctgt

SEQ ID NO: 6102455 - DNA, 23 bp, Homo sapiens
cctctttctctctgtgtggcaaa

SEQ ID NO: 6102456 - DNA, 12 bp, Homo sapiens
cctctttctctt

SEQ ID NO: 6102457 - DNA, 18 bp, Homo sapiens
cctctttctctttcttcc

SEQ ID NO: 6102458 - DNA, 20 bp, Homo sapiens
cctctttctctttcttcctt

SEQ ID NO: 6102459 - DNA, 17 bp, Homo sapiens
cctctttcttcccatga

SEQ ID NO: 6102460 - DNA, 14 bp, Homo sapiens
cctctttcttgttt

SEQ ID NO: 6102461 - DNA, 21 bp, Homo sapiens
cctctttcttgtttgtcagca

SEQ ID NO: 6102462 - DNA, 20 bp, Homo sapiens
cctctttgacatttttgcca

SEQ ID NO: 6102463 - DNA, 12 bp, Homo sapiens
cctctttgagaa

SEQ ID NO: 6102464 - DNA, 18 bp, Homo sapiens
cctctttgagaccccagt

SEQ ID NO: 6102465 - DNA, 15 bp, Homo sapiens
cctctttgctttgct

SEQ ID NO: 6102466 - DNA, 17 bp, Homo sapiens
cctctttgctttgcttt

SEQ ID NO: 6102467 - DNA, 19 bp, Homo sapiens
cctctttggtctacactgt

SEQ ID NO: 6102468 - DNA, 22 bp, Homo sapiens
cctctttgtaatttaatgaaaa

SEQ ID NO: 6102469 - DNA, 22 bp, Homo sapiens
cctctttgtgtttttgttgttg

SEQ ID NO: 6102470 - DNA, 23 bp, Homo sapiens
cctctttgtgtttttgttgttgt

SEQ ID NO: 6102471 - DNA, 20 bp, Homo sapiens
cctctttgttcttcctgtct

SEQ ID NO: 6102472 - DNA, 15 bp, Homo sapiens
cctctttgttttgtt

SEQ ID NO: 6102473 - DNA, 17 bp, Homo sapiens
cctcttttacctgctgc

SEQ ID NO: 6102474 - DNA, 18 bp, Homo sapiens
cctcttttacctgctgct

SEQ ID NO: 6102475 - DNA, 19 bp, Homo sapiens
cctcttttacctgctgctt

SEQ ID NO: 6102476 - DNA, 22 bp, Homo sapiens
cctcttttacctgctgcttctc

SEQ ID NO: 6102477 - DNA, 15 bp, Homo sapiens
cctcttttcacattt

SEQ ID NO: 6102478 - DNA, 17 bp, Homo sapiens
cctcttttcacattttt

SEQ ID NO: 6102479 - DNA, 16 bp, Homo sapiens
cctcttttccctctct

SEQ ID NO: 6102480 - DNA, 21 bp, Homo sapiens
cctcttttcccttgtgtgagg

SEQ ID NO: 6102481 - DNA, 12 bp, Homo sapiens
cctcttttcctg

SEQ ID NO: 6102482 - DNA, 14 bp, Homo sapiens
cctcttttcctgct

SEQ ID NO: 6102483 - DNA, 16 bp, Homo sapiens
cctcttttcctggcag

SEQ ID NO: 6102484 - DNA, 17 bp, Homo sapiens
cctcttttcctggcagc

SEQ ID NO: 6102485 - DNA, 20 bp, Homo sapiens
cctcttttcttactcctcct

SEQ ID NO: 6102486 - DNA, 21 bp, Homo sapiens
cctcttttcttactcctcctc

SEQ ID NO: 6102487 - DNA, 14 bp, Homo sapiens
cctcttttgagact

SEQ ID NO: 6102488 - DNA, 20 bp, Homo sapiens
cctctttttccatcataatt

SEQ ID NO: 6102489 - DNA, 17 bp, Homo sapiens
cctctttttctctgtat

SEQ ID NO: 6102490 - DNA, 18 bp, Homo sapiens
cctctttttctctgtata

SEQ ID NO: 6102491 - DNA, 19 bp, Homo sapiens
cctcttttttcgtttgttt

SEQ ID NO: 6102492 - DNA, 12 bp, Homo sapiens
cctgaaaaactg

SEQ ID NO: 6102493 - DNA, 17 bp, Homo sapiens
cctgaaaacactgtgca

SEQ ID NO: 6102494 - DNA, 16 bp, Homo sapiens
cctgaaaacccagaga

SEQ ID NO: 6102495 - DNA, 17 bp, Homo sapiens
cctgaaaacccagagag

SEQ ID NO: 6102496 - DNA, 14 bp, Homo sapiens
cctgaaaagctgca

SEQ ID NO: 6102497 - DNA, 17 bp, Homo sapiens
cctgaaaagctgcattt

SEQ ID NO: 6102498 - DNA, 22 bp, Homo sapiens
cctgaaaagtaacttggctttc

SEQ ID NO: 6102499 - DNA, 14 bp, Homo sapiens
cctgaaaagttgaa

SEQ ID NO: 6102500 - DNA, 15 bp, Homo sapiens
cctgaaaatgttacc

SEQ ID NO: 6102501 - DNA, 22 bp, Homo sapiens
cctgaaaatgtttttctgccag

SEQ ID NO: 6102502 - DNA, 11 bp, Homo sapiens
cctgaaacact

SEQ ID NO: 6102503 - DNA, 17 bp, Homo sapiens
cctgaaacactggacct

SEQ ID NO: 6102504 - DNA, 18 bp, Homo sapiens
cctgaaacactggacctg

SEQ ID NO: 6102505 - DNA, 19 bp, Homo sapiens
cctgaaacactggacctgg

SEQ ID NO: 6102506 - DNA, 18 bp, Homo sapiens
cctgaaacatgtgcccct

SEQ ID NO: 6102507 - DNA, 20 bp, Homo sapiens
cctgaaacatgtgcccctgc

SEQ ID NO: 6102508 - DNA, 23 bp, Homo sapiens
cctgaaacatgtgcccctgccaa

SEQ ID NO: 6102509 - DNA, 23 bp, Homo sapiens
cctgaaacccagtaattctaccc

SEQ ID NO: 6102510 - DNA, 22 bp, Homo sapiens
cctgaaacccatttacttagga

SEQ ID NO: 6102511 - DNA, 21 bp, Homo sapiens
cctgaaacctcttcctaggcc

SEQ ID NO: 6102512 - DNA, 23 bp, Homo sapiens
cctgaaacctcttcctaggccac

SEQ ID NO: 6102513 - DNA, 17 bp, Homo sapiens
cctgaaacgctcctttg

SEQ ID NO: 6102514 - DNA, 19 bp, Homo sapiens
cctgaaacgctcctttgtg

SEQ ID NO: 6102515 - DNA, 15 bp, Homo sapiens
cctgaaactactgta

SEQ ID NO: 6102516 - DNA, 19 bp, Homo sapiens
cctgaaactatattttgtc

SEQ ID NO: 6102517 - DNA, 18 bp, Homo sapiens
cctgaaacttacacacaa

SEQ ID NO: 6102518 - DNA, 16 bp, Homo sapiens
cctgaaacttattttt

SEQ ID NO: 6102519 - DNA, 22 bp, Homo sapiens
cctgaaacttatttttttctga

SEQ ID NO: 6102520 - DNA, 20 bp, Homo sapiens
cctgaaagagaagatggcca

SEQ ID NO: 6102521 - DNA, 22 bp, Homo sapiens
cctgaaagagaggactggttct

SEQ ID NO: 6102522 - DNA, 13 bp, Homo sapiens
cctgaaagaggaa

SEQ ID NO: 6102523 - DNA, 19 bp, Homo sapiens
cctgaaagaggctgaggcc

SEQ ID NO: 6102524 - DNA, 17 bp, Homo sapiens
cctgaaagcaacagctg

SEQ ID NO: 6102525 - DNA, 19 bp, Homo sapiens
cctgaaagcaacagctgga

SEQ ID NO: 6102526 - DNA, 18 bp, Homo sapiens
cctgaaagccagcaaagc

SEQ ID NO: 6102527 - DNA, 22 bp, Homo sapiens
cctgaaagccagcaaagcctcc

SEQ ID NO: 6102528 - DNA, 12 bp, Homo sapiens
cctgaaagccct

SEQ ID NO: 6102529 - DNA, 13 bp, Homo sapiens
cctgaaagcctca

SEQ ID NO: 6102530 - DNA, 13 bp, Homo sapiens
cctgaaagcctgt

SEQ ID NO: 6102531 - DNA, 17 bp, Homo sapiens
cctgaaagcctgtctct

SEQ ID NO: 6102532 - DNA, 13 bp, Homo sapiens
cctgaaagcggct

SEQ ID NO: 6102533 - DNA, 18 bp, Homo sapiens
cctgaaagcggctgcctc

SEQ ID NO: 6102534 - DNA, 20 bp, Homo sapiens
cctgaaagcggctgcctcca

SEQ ID NO: 6102535 - DNA, 14 bp, Homo sapiens
cctgaaagctggga

SEQ ID NO: 6102536 - DNA, 22 bp, Homo sapiens
cctgaaagctgggagcgtgggc

SEQ ID NO: 6102537 - DNA, 19 bp, Homo sapiens
cctgaaaggaacactggct

SEQ ID NO: 6102538 - DNA, 17 bp, Homo sapiens
cctgaaagtaatttcaa

SEQ ID NO: 6102539 - DNA, 13 bp, Homo sapiens
cctgaaagtgaca

SEQ ID NO: 6102540 - DNA, 13 bp, Homo sapiens
cctgaaataaaca

SEQ ID NO: 6102541 - DNA, 14 bp, Homo sapiens
cctgaaataaacac

SEQ ID NO: 6102542 - DNA, 16 bp, Homo sapiens
cctgaaataaacactg

SEQ ID NO: 6102543 - DNA, 17 bp, Homo sapiens
cctgaaataaacactgg

SEQ ID NO: 6102544 - DNA, 18 bp, Homo sapiens
cctgaaataaacactggt

SEQ ID NO: 6102545 - DNA, 22 bp, Homo sapiens
cctgaaatatattttaaatgtg

SEQ ID NO: 6102546 - DNA, 20 bp, Homo sapiens
cctgaaatattttcttcctt

SEQ ID NO: 6102547 - DNA, 18 bp, Homo sapiens
cctgaaatcatctttgtt

SEQ ID NO: 6102548 - DNA, 17 bp, Homo sapiens
cctgaaatcctggttcc

SEQ ID NO: 6102549 - DNA, 18 bp, Homo sapiens
cctgaaatgacatttcac

SEQ ID NO: 6102550 - DNA, 19 bp, Homo sapiens
cctgaaatgacatttcact

SEQ ID NO: 6102551 - DNA, 17 bp, Homo sapiens
cctgaaatgtgtgtgat

SEQ ID NO: 6102552 - DNA, 19 bp, Homo sapiens
cctgaaatgtgtgtgatgt

SEQ ID NO: 6102553 - DNA, 16 bp, Homo sapiens
cctgaaatgtttccag

SEQ ID NO: 6102554 - DNA, 17 bp, Homo sapiens
cctgaaatgtttccagg

SEQ ID NO: 6102555 - DNA, 21 bp, Homo sapiens
cctgaaatgtttccaggcatg

SEQ ID NO: 6102556 - DNA, 13 bp, Homo sapiens
cctgaaattccaa

SEQ ID NO: 6102557 - DNA, 15 bp, Homo sapiens
cctgaaatttaaact

SEQ ID NO: 6102558 - DNA, 15 bp, Homo sapiens
cctgaaatttcagat

SEQ ID NO: 6102559 - DNA, 20 bp, Homo sapiens
cctgaacaaagcacctcaag

SEQ ID NO: 6102560 - DNA, 20 bp, Homo sapiens
cctgaacaaatcttgggtgg

SEQ ID NO: 6102561 - DNA, 17 bp, Homo sapiens
cctgaacaacgagcctt

SEQ ID NO: 6102562 - DNA, 17 bp, Homo sapiens
cctgaacaagaattgga

SEQ ID NO: 6102563 - DNA, 15 bp, Homo sapiens
cggctccactaggac

SEQ ID NO: 6102564 - DNA, 16 bp, Homo sapiens
cggctccagagcagga

SEQ ID NO: 6102565 - DNA, 16 bp, Homo sapiens
cggctccaggtccgga

SEQ ID NO: 6102566 - DNA, 19 bp, Homo sapiens
cggctccagtccccagaac

SEQ ID NO: 6102567 - DNA, 21 bp, Homo sapiens
cggctccatcaccagcccggg

SEQ ID NO: 6102568 - DNA, 18 bp, Homo sapiens
cggctcccacggagcatc

SEQ ID NO: 6102569 - DNA, 21 bp, Homo sapiens
cggctcccacggagcatctca

SEQ ID NO: 6102570 - DNA, 17 bp, Homo sapiens
cggctcccagcctcagc

SEQ ID NO: 6102571 - DNA, 15 bp, Homo sapiens
cggctccccatgtgt

SEQ ID NO: 6102572 - DNA, 14 bp, Homo sapiens
cggctcccccaggc

SEQ ID NO: 6102573 - DNA, 16 bp, Homo sapiens
cggctcccctcgacag

SEQ ID NO: 6102574 - DNA, 19 bp, Homo sapiens
cggctcccctctgcttctc

SEQ ID NO: 6102575 - DNA, 21 bp, Homo sapiens
cggctcccggggcagggcagc

SEQ ID NO: 6102576 - DNA, 20 bp, Homo sapiens
cggctccgagggcggccagg

SEQ ID NO: 6102577 - DNA, 13 bp, Homo sapiens
cggctcctcagag

SEQ ID NO: 6102578 - DNA, 14 bp, Homo sapiens
cggctcctcaggga

SEQ ID NO: 6102579 - DNA, 18 bp, Homo sapiens
cggctcctccccgatccc

SEQ ID NO: 6102580 - DNA, 23 bp, Homo sapiens
cggctcctcgagatcccaacact

SEQ ID NO: 6102581 - DNA, 19 bp, Homo sapiens
cggctcctcgcccccacca

SEQ ID NO: 6102582 - DNA, 23 bp, Homo sapiens
cggctcctctctaacctccttta

SEQ ID NO: 6102583 - DNA, 13 bp, Homo sapiens
cggctcctgatgg

SEQ ID NO: 6102584 - DNA, 12 bp, Homo sapiens
cggctcctgctg

SEQ ID NO: 6102585 - DNA, 13 bp, Homo sapiens
cggctcctgctgc

SEQ ID NO: 6102586 - DNA, 14 bp, Homo sapiens
cggctcctgctgca

SEQ ID NO: 6102587 - DNA, 21 bp, Homo sapiens
cggctcctggactcattgctt

SEQ ID NO: 6102588 - DNA, 14 bp, Homo sapiens
cggctcctggtgct

SEQ ID NO: 6102589 - DNA, 16 bp, Homo sapiens
cggctcggaggaagcc

SEQ ID NO: 6102590 - DNA, 15 bp, Homo sapiens
cggctcggcccagca

SEQ ID NO: 6102591 - DNA, 19 bp, Homo sapiens
cggctcggcccagcacccc

SEQ ID NO: 6102592 - DNA, 16 bp, Homo sapiens
cggctcgttcccccag

SEQ ID NO: 6102593 - DNA, 14 bp, Homo sapiens
cggctctagcccca

SEQ ID NO: 6102594 - DNA, 15 bp, Homo sapiens
cggctctagtacctt

SEQ ID NO: 6102595 - DNA, 13 bp, Homo sapiens
cggctctcacctg

SEQ ID NO: 6102596 - DNA, 14 bp, Homo sapiens
cggctctcctgaga

SEQ ID NO: 6102597 - DNA, 16 bp, Homo sapiens
cggctctcgtccctct

SEQ ID NO: 6102598 - DNA, 11 bp, Homo sapiens
cggctctgagc

SEQ ID NO: 6102599 - DNA, 13 bp, Homo sapiens
cggctctgagcag

SEQ ID NO: 6102600 - DNA, 15 bp, Homo sapiens
cggctctgagcaggg

SEQ ID NO: 6102601 - DNA, 17 bp, Homo sapiens
cggctctgaggctgccc

SEQ ID NO: 6102602 - DNA, 19 bp, Homo sapiens
cggctctgaggctgcccca

SEQ ID NO: 6102603 - DNA, 14 bp, Homo sapiens
cggctctgcccacc

SEQ ID NO: 6102604 - DNA, 15 bp, Homo sapiens
cggctctgcccacct

SEQ ID NO: 6102605 - DNA, 11 bp, Homo sapiens
cggctctgccg

SEQ ID NO: 6102606 - DNA, 17 bp, Homo sapiens
cggctctgggcctgagg

SEQ ID NO: 6102607 - DNA, 14 bp, Homo sapiens
cggctctgggctgg

SEQ ID NO: 6102608 - DNA, 15 bp, Homo sapiens
cggctctgggctggc

SEQ ID NO: 6102609 - DNA, 17 bp, Homo sapiens
cggctctgggctggctg

SEQ ID NO: 6102610 - DNA, 20 bp, Homo sapiens
cggctctggggtaggctgct

SEQ ID NO: 6102611 - DNA, 23 bp, Homo sapiens
cggctctggggtaggctgctccc

SEQ ID NO: 6102612 - DNA, 20 bp, Homo sapiens
cggctctggtcctcggagct

SEQ ID NO: 6102613 - DNA, 15 bp, Homo sapiens
cggctctggtggcca

SEQ ID NO: 6102614 - DNA, 16 bp, Homo sapiens
cggctctggtggccac

SEQ ID NO: 6102615 - DNA, 21 bp, Homo sapiens
cggctctggtggccactgagc

SEQ ID NO: 6102616 - DNA, 13 bp, Homo sapiens
cggctctggttcc

SEQ ID NO: 6102617 - DNA, 19 bp, Homo sapiens
cggctctggttcctccagc

SEQ ID NO: 6102618 - DNA, 20 bp, Homo sapiens
cggctctgtgcccggtgcca

SEQ ID NO: 6102619 - DNA, 15 bp, Homo sapiens
cggctcttcctggac

SEQ ID NO: 6102620 - DNA, 16 bp, Homo sapiens
cggctctttccttgct

SEQ ID NO: 6102621 - DNA, 18 bp, Homo sapiens
cggctctttccttgctca

SEQ ID NO: 6102622 - DNA, 14 bp, Homo sapiens
cggctgaccatgct

SEQ ID NO: 6102623 - DNA, 15 bp, Homo sapiens
cggctgaccctgtgc

SEQ ID NO: 6102624 - DNA, 16 bp, Homo sapiens
cggctgaccctgtgcc

SEQ ID NO: 6102625 - DNA, 14 bp, Homo sapiens
cggctgagagcccc

SEQ ID NO: 6102626 - DNA, 15 bp, Homo sapiens
cggctgagagcccca

SEQ ID NO: 6102627 - DNA, 14 bp, Homo sapiens
cggctgagccctgc

SEQ ID NO: 6102628 - DNA, 13 bp, Homo sapiens
cggctgagccttc

SEQ ID NO: 6102629 - DNA, 13 bp, Homo sapiens
cggctgagctggg

SEQ ID NO: 6102630 - DNA, 16 bp, Homo sapiens
cggctgagctgtgcca

SEQ ID NO: 6102631 - DNA, 21 bp, Homo sapiens
cggctgagctgtgccagctgc

SEQ ID NO: 6102632 - DNA, 21 bp, Homo sapiens
cggctgaggacggggcagagc

SEQ ID NO: 6102633 - DNA, 20 bp, Homo sapiens
cggctgcaattgtggacctt

SEQ ID NO: 6102634 - DNA, 21 bp, Homo sapiens
cggctgcacctgcagggagca

SEQ ID NO: 6102635 - DNA, 12 bp, Homo sapiens
cggctgcagagg

SEQ ID NO: 6102636 - DNA, 15 bp, Homo sapiens
cggctgcagaggcca

SEQ ID NO: 6102637 - DNA, 18 bp, Homo sapiens
cggctgccaggggctctg

SEQ ID NO: 6102638 - DNA, 17 bp, Homo sapiens
cggctgcccccatcacc

SEQ ID NO: 6102639 - DNA, 11 bp, Homo sapiens
cggctgccctt

SEQ ID NO: 6102640 - DNA, 16 bp, Homo sapiens
cggctgccgactcccc

SEQ ID NO: 6102641 - DNA, 16 bp, Homo sapiens
cggctgcctagccctc

SEQ ID NO: 6102642 - DNA, 15 bp, Homo sapiens
cggctgcctccatta

SEQ ID NO: 6102643 - DNA, 13 bp, Homo sapiens
cggctgcctcctg

SEQ ID NO: 6102644 - DNA, 12 bp, Homo sapiens
cggctgcctgcc

SEQ ID NO: 6102645 - DNA, 14 bp, Homo sapiens
cggctgctcctcca

SEQ ID NO: 6102646 - DNA, 12 bp, Homo sapiens
cggctgctcctt

SEQ ID NO: 6102647 - DNA, 17 bp, Homo sapiens
cggctgctcgcccagga

SEQ ID NO: 6102648 - DNA, 18 bp, Homo sapiens
cggctgctcgcccaggaa

SEQ ID NO: 6102649 - DNA, 19 bp, Homo sapiens
cggctgctcgcccaggaag

SEQ ID NO: 6102650 - DNA, 18 bp, Homo sapiens
cggctgctggcacagact

SEQ ID NO: 6102651 - DNA, 14 bp, Homo sapiens
cggctggaaagagg

SEQ ID NO: 6102652 - DNA, 21 bp, Homo sapiens
cggctggaaagaggagaagga

SEQ ID NO: 6102653 - DNA, 22 bp, Homo sapiens
cggctggaaagaggagaaggag

SEQ ID NO: 6102654 - DNA, 16 bp, Homo sapiens
cggctggaagaacatc

SEQ ID NO: 6102655 - DNA, 22 bp, Homo sapiens
cggctggacctggggtcccccc

SEQ ID NO: 6102656 - DNA, 23 bp, Homo sapiens
cggctggacttttgcagcttcct

SEQ ID NO: 6102657 - DNA, 12 bp, Homo sapiens
cggctggagaaa

SEQ ID NO: 6102658 - DNA, 23 bp, Homo sapiens
cggctggcagcccacccctcaac

SEQ ID NO: 6102659 - DNA, 14 bp, Homo sapiens
cggctggcctggag

SEQ ID NO: 6102660 - DNA, 13 bp, Homo sapiens
cggctggcctggc

SEQ ID NO: 6102661 - DNA, 14 bp, Homo sapiens
cggctggcctggcc

SEQ ID NO: 6102662 - DNA, 22 bp, Homo sapiens
cggctggcctggcccctcaggg

SEQ ID NO: 6102663 - DNA, 16 bp, Homo sapiens
cggctggctcccctgc

SEQ ID NO: 6102664 - DNA, 12 bp, Homo sapiens
cggctggctctg

SEQ ID NO: 6102665 - DNA, 13 bp, Homo sapiens
cggctggctctgt

SEQ ID NO: 6102666 - DNA, 23 bp, Homo sapiens
cggctgggaactgggccagcaga

SEQ ID NO: 6102667 - DNA, 23 bp, Homo sapiens
cggctgggagcctcgcccctcca

SEQ ID NO: 6102668 - DNA, 20 bp, Homo sapiens
cggctgggcacacgcctccc

SEQ ID NO: 6102669 - DNA, 15 bp, Homo sapiens
cggctgggcagggcc

SEQ ID NO: 6102670 - DNA, 16 bp, Homo sapiens
cggctgggcagggccg

SEQ ID NO: 6102671 - DNA, 22 bp, Homo sapiens
cggctgggcctccttcttccac

SEQ ID NO: 6102672 - DNA, 11 bp, Homo sapiens
cggctggggac

SEQ ID NO: 6102673 - DNA, 19 bp, Homo sapiens
cggctggggactgctacct

SEQ ID NO: 6102674 - DNA, 16 bp, Homo sapiens
cggctggggtcccagc

SEQ ID NO: 6102675 - DNA, 23 bp, Homo sapiens
cggctggggtcccagcagctgcc

SEQ ID NO: 6102676 - DNA, 14 bp, Homo sapiens
cggctgggtctgtg

SEQ ID NO: 6102677 - DNA, 17 bp, Homo sapiens
cggctggttttgtaaga

SEQ ID NO: 6102678 - DNA, 23 bp, Homo sapiens
cggctggttttgtaagatgctgg

SEQ ID NO: 6102679 - DNA, 18 bp, Homo sapiens
cggctgtccctcatggag

SEQ ID NO: 6102680 - DNA, 12 bp, Homo sapiens
cggctgtctcct

SEQ ID NO: 6102681 - DNA, 16 bp, Homo sapiens
cggctgtgacgcagcc

SEQ ID NO: 6102682 - DNA, 19 bp, Homo sapiens
cggctgtgaggcgggtggc

SEQ ID NO: 6102683 - DNA, 16 bp, Homo sapiens
cggctgtgattgctgc

SEQ ID NO: 6102684 - DNA, 18 bp, Homo sapiens
cggctgtgattgctgcca

SEQ ID NO: 6102685 - DNA, 23 bp, Homo sapiens
cggctgtgattgctgccaggcac

SEQ ID NO: 6102686 - DNA, 16 bp, Homo sapiens
cggctgtgctcagaga

SEQ ID NO: 6102687 - DNA, 13 bp, Homo sapiens
cggctgtgctggg

SEQ ID NO: 6102688 - DNA, 22 bp, Homo sapiens
cggctgtggaccgtggacaggc

SEQ ID NO: 6102689 - DNA, 13 bp, Homo sapiens
cggctgtggagca

SEQ ID NO: 6102690 - DNA, 14 bp, Homo sapiens
cggctgtggagcaa

SEQ ID NO: 6102691 - DNA, 15 bp, Homo sapiens
cggctgtgtatttct

SEQ ID NO: 6102692 - DNA, 18 bp, Homo sapiens
cggctgtgtatttctgta

SEQ ID NO: 6102693 - DNA, 14 bp, Homo sapiens
cggctgtttcctga

SEQ ID NO: 6102694 - DNA, 21 bp, Homo sapiens
cggctgtttcctgacagatgc

SEQ ID NO: 6102695 - DNA, 23 bp, Homo sapiens
cggctgtttcctgacagatgcct

SEQ ID NO: 6102696 - DNA, 16 bp, Homo sapiens
cggcttagccaagccc

SEQ ID NO: 6102697 - DNA, 19 bp, Homo sapiens
cggcttattagtgaaactg

SEQ ID NO: 6102698 - DNA, 14 bp, Homo sapiens
cggcttcaccaggg

SEQ ID NO: 6102699 - DNA, 16 bp, Homo sapiens
cggcttcactgaccag

SEQ ID NO: 6102700 - DNA, 22 bp, Homo sapiens
cggcttcctataacttcttcct

SEQ ID NO: 6102701 - DNA, 13 bp, Homo sapiens
cggcttcctcctt

SEQ ID NO: 6102702 - DNA, 19 bp, Homo sapiens
cggcttcctttcccaagcc

SEQ ID NO: 6102703 - DNA, 20 bp, Homo sapiens
cggcttcgttagaccgctct

SEQ ID NO: 6102704 - DNA, 22 bp, Homo sapiens
cggcttctcacgctttgtttac

SEQ ID NO: 6102705 - DNA, 20 bp, Homo sapiens
cggcttcttggaccttggcg

SEQ ID NO: 6102706 - DNA, 18 bp, Homo sapiens
cggcttggatcctgggct

SEQ ID NO: 6102707 - DNA, 21 bp, Homo sapiens
cggcttggatcctgggctggg

SEQ ID NO: 6102708 - DNA, 15 bp, Homo sapiens
cggcttggccgccat

SEQ ID NO: 6102709 - DNA, 18 bp, Homo sapiens
cggcttggccgccatccg

SEQ ID NO: 6102710 - DNA, 15 bp, Homo sapiens
cggcttggcttggct

SEQ ID NO: 6102711 - DNA, 23 bp, Homo sapiens
cggcttgtcttcgctggctccta

SEQ ID NO: 6102712 - DNA, 16 bp, Homo sapiens
cggcttgtgggctggt

SEQ ID NO: 6102713 - DNA, 17 bp, Homo sapiens
cggcttgtgggctggtg

SEQ ID NO: 6102714 - DNA, 21 bp, Homo sapiens
cggcttgttgacttcgcagcc

SEQ ID NO: 6102715 - DNA, 13 bp, Homo sapiens
cggctttctctgc

SEQ ID NO: 6102716 - DNA, 19 bp, Homo sapiens
cggctttctctgcctctgg

SEQ ID NO: 6102717 - DNA, 18 bp, Homo sapiens
cggcttttcagaagaaat

SEQ ID NO: 6102718 - DNA, 16 bp, Homo sapiens
cggcttttctcagctg

SEQ ID NO: 6102719 - DNA, 20 bp, Homo sapiens
cgggaaaaggagaggaaact

SEQ ID NO: 6102720 - DNA, 20 bp, Homo sapiens
cgggaaaggatggagtgttt

SEQ ID NO: 6102721 - DNA, 22 bp, Homo sapiens
cgggaaaggcatctaagacatt

SEQ ID NO: 6102722 - DNA, 13 bp, Homo sapiens
cgggaaattcagt

SEQ ID NO: 6102723 - DNA, 13 bp, Homo sapiens
cgggaaattctgc

SEQ ID NO: 6102724 - DNA, 16 bp, Homo sapiens
cgggaaattctgctgc

SEQ ID NO: 6102725 - DNA, 22 bp, Homo sapiens
cgggaacagtgtttcccataat

SEQ ID NO: 6102726 - DNA, 17 bp, Homo sapiens
cgggaacatgccccctg

SEQ ID NO: 6102727 - DNA, 13 bp, Homo sapiens
cgggaaccctctg

SEQ ID NO: 6102728 - DNA, 15 bp, Homo sapiens
cgggaaccctctggg

SEQ ID NO: 6102729 - DNA, 14 bp, Homo sapiens
cgggaacctcactc

SEQ ID NO: 6102730 - DNA, 16 bp, Homo sapiens
cgggaacctccccagc

SEQ ID NO: 6102731 - DNA, 12 bp, Homo sapiens
cgggaagagagg

SEQ ID NO: 6102732 - DNA, 20 bp, Homo sapiens
cgggaagagaggagttcaat

SEQ ID NO: 6102733 - DNA, 22 bp, Homo sapiens
cgggaagagaggagttcaatga

SEQ ID NO: 6102734 - DNA, 16 bp, Homo sapiens
cgggaagagccacctg

SEQ ID NO: 6102735 - DNA, 15 bp, Homo sapiens
cgggaagcagccagc

SEQ ID NO: 6102736 - DNA, 16 bp, Homo sapiens
cgggaagcagccagct

SEQ ID NO: 6102737 - DNA, 22 bp, Homo sapiens
cgggaagcagccagctccccac

SEQ ID NO: 6102738 - DNA, 18 bp, Homo sapiens
cgggaagcatcctcccca

SEQ ID NO: 6102739 - DNA, 21 bp, Homo sapiens
cgggaagcatcctccccacca

SEQ ID NO: 6102740 - DNA, 22 bp, Homo sapiens
cgggaagcctccgtcaggagag

SEQ ID NO: 6102741 - DNA, 15 bp, Homo sapiens
cgggaagctgacctt

SEQ ID NO: 6102742 - DNA, 15 bp, Homo sapiens
cgggaaggcctgagg

SEQ ID NO: 6102743 - DNA, 20 bp, Homo sapiens
cgggaaggcctgagggaagc

SEQ ID NO: 6102744 - DNA, 19 bp, Homo sapiens
cctgaacacttattgcttt

SEQ ID NO: 6102745 - DNA, 12 bp, Homo sapiens
cctgaacagatg

SEQ ID NO: 6102746 - DNA, 18 bp, Homo sapiens
cctgaacagatgtaaatc

SEQ ID NO: 6102747 - DNA, 18 bp, Homo sapiens
cctgaacatccttccttc

SEQ ID NO: 6102748 - DNA, 20 bp, Homo sapiens
cctgaacatccttccttccc

SEQ ID NO: 6102749 - DNA, 21 bp, Homo sapiens
cctgaacatccttccttccca

SEQ ID NO: 6102750 - DNA, 21 bp, Homo sapiens
cctgaaccacgaggctgcccc

SEQ ID NO: 6102751 - DNA, 21 bp, Homo sapiens
cctgaaccactgtggccttct

SEQ ID NO: 6102752 - DNA, 21 bp, Homo sapiens
cctgaaccagtcctgctgcct

SEQ ID NO: 6102753 - DNA, 22 bp, Homo sapiens
cctgaaccagtcctgctgcctg

SEQ ID NO: 6102754 - DNA, 23 bp, Homo sapiens
cctgaaccagtcctgctgcctgg

SEQ ID NO: 6102755 - DNA, 17 bp, Homo sapiens
cctgaacccacacctgg

SEQ ID NO: 6102756 - DNA, 18 bp, Homo sapiens
cctgaaccccagaggcag

SEQ ID NO: 6102757 - DNA, 16 bp, Homo sapiens
cctgaaccccatgggc

SEQ ID NO: 6102758 - DNA, 17 bp, Homo sapiens
cctgaaccccatgggct

SEQ ID NO: 6102759 - DNA, 19 bp, Homo sapiens
cctgaaccccatgggcttg

SEQ ID NO: 6102760 - DNA, 23 bp, Homo sapiens
cctgaaccccatgggcttggact

SEQ ID NO: 6102761 - DNA, 17 bp, Homo sapiens
cctgaacccctggccag

SEQ ID NO: 6102762 - DNA, 19 bp, Homo sapiens
cctgaacccctggccagct

SEQ ID NO: 6102763 - DNA, 20 bp, Homo sapiens
cctgaacccctggccagctc

SEQ ID NO: 6102764 - DNA, 22 bp, Homo sapiens
cctgaaccgactgaccctgagg

SEQ ID NO: 6102765 - DNA, 20 bp, Homo sapiens
cctgaaccgcacagctcagg

SEQ ID NO: 6102766 - DNA, 22 bp, Homo sapiens
cctgaaccgtgtgctcctcggc

SEQ ID NO: 6102767 - DNA, 13 bp, Homo sapiens
cctgaacctagga

SEQ ID NO: 6102768 - DNA, 16 bp, Homo sapiens
cctgaaccttcctgtc

SEQ ID NO: 6102769 - DNA, 15 bp, Homo sapiens
cctgaacctttcaaa

SEQ ID NO: 6102770 - DNA, 17 bp, Homo sapiens
cctgaacgttttcttct

SEQ ID NO: 6102771 - DNA, 18 bp, Homo sapiens
cctgaacgttttcttctt

SEQ ID NO: 6102772 - DNA, 16 bp, Homo sapiens
cctgaactcattctct

SEQ ID NO: 6102773 - DNA, 20 bp, Homo sapiens
cctgaactcattctcttctt

SEQ ID NO: 6102774 - DNA, 16 bp, Homo sapiens
cctgaactccagaggt

SEQ ID NO: 6102775 - DNA, 17 bp, Homo sapiens
cctgaactgaacaccat

SEQ ID NO: 6102776 - DNA, 17 bp, Homo sapiens
cctgaactgagccccag

SEQ ID NO: 6102777 - DNA, 13 bp, Homo sapiens
cctgaactgagga

SEQ ID NO: 6102778 - DNA, 14 bp, Homo sapiens
cctgaactggcccc

SEQ ID NO: 6102779 - DNA, 18 bp, Homo sapiens
cctgaactggccccagct

SEQ ID NO: 6102780 - DNA, 20 bp, Homo sapiens
cctgaactggccccagctcc

SEQ ID NO: 6102781 - DNA, 16 bp, Homo sapiens
cctgaactttctccct

SEQ ID NO: 6102782 - DNA, 18 bp, Homo sapiens
cctgaactttctccctca

SEQ ID NO: 6102783 - DNA, 19 bp, Homo sapiens
cctgaagaaacaaggcatt

SEQ ID NO: 6102784 - DNA, 16 bp, Homo sapiens
cctgaagaactatttt

SEQ ID NO: 6102785 - DNA, 16 bp, Homo sapiens
cctgaagaactctttt

SEQ ID NO: 6102786 - DNA, 12 bp, Homo sapiens
cctgaagactga

SEQ ID NO: 6102787 - DNA, 15 bp, Homo sapiens
cctgaagactgagga

SEQ ID NO: 6102788 - DNA, 13 bp, Homo sapiens
cctgaagagcatt

SEQ ID NO: 6102789 - DNA, 19 bp, Homo sapiens
cctgaagagcgctcctctg

SEQ ID NO: 6102790 - DNA, 21 bp, Homo sapiens
cctgaagagcgctcctctgcc

SEQ ID NO: 6102791 - DNA, 12 bp, Homo sapiens
cctgaagagctt

SEQ ID NO: 6102792 - DNA, 18 bp, Homo sapiens
cctgaagaggcgggccag

SEQ ID NO: 6102793 - DNA, 20 bp, Homo sapiens
cctgaagaggcgggccagcc

SEQ ID NO: 6102794 - DNA, 21 bp, Homo sapiens
cctgaagaggcgggccagcca

SEQ ID NO: 6102795 - DNA, 22 bp, Homo sapiens
cctgaagaggcgggccagccag

SEQ ID NO: 6102796 - DNA, 22 bp, Homo sapiens
cctgaagatcagagctgcagcc

SEQ ID NO: 6102797 - DNA, 13 bp, Homo sapiens
cctgaagatgtct

SEQ ID NO: 6102798 - DNA, 14 bp, Homo sapiens
cctgaagatgtctc

SEQ ID NO: 6102799 - DNA, 18 bp, Homo sapiens
cctgaagatttcagaggc

SEQ ID NO: 6102800 - DNA, 12 bp, Homo sapiens
cctgaagccaga

SEQ ID NO: 6102801 - DNA, 16 bp, Homo sapiens
cctgaagccagccttc

SEQ ID NO: 6102802 - DNA, 21 bp, Homo sapiens
cctgaagccaggccatggcta

SEQ ID NO: 6102803 - DNA, 16 bp, Homo sapiens
cctgaagcctccgtgg

SEQ ID NO: 6102804 - DNA, 15 bp, Homo sapiens
cctgaagcctctgcc

SEQ ID NO: 6102805 - DNA, 21 bp, Homo sapiens
cctgaagcctctgccctgcct

SEQ ID NO: 6102806 - DNA, 23 bp, Homo sapiens
cctgaagcctctgccctgcctcc

SEQ ID NO: 6102807 - DNA, 12 bp, Homo sapiens
cctgaagcctgg

SEQ ID NO: 6102808 - DNA, 13 bp, Homo sapiens
cctgaagcctgga

SEQ ID NO: 6102809 - DNA, 14 bp, Homo sapiens
cctgaagctggcct

SEQ ID NO: 6102810 - DNA, 17 bp, Homo sapiens
cctgaagctggcctgga

SEQ ID NO: 6102811 - DNA, 18 bp, Homo sapiens
cctgaagctggcctggac

SEQ ID NO: 6102812 - DNA, 21 bp, Homo sapiens
cctgaaggaacattccttagt

SEQ ID NO: 6102813 - DNA, 16 bp, Homo sapiens
cctgaaggacctcccc

SEQ ID NO: 6102814 - DNA, 18 bp, Homo sapiens
cctgaaggattctgggaa

SEQ ID NO: 6102815 - DNA, 21 bp, Homo sapiens
cctgaaggattctgggaatca

SEQ ID NO: 6102816 - DNA, 23 bp, Homo sapiens
cctgaaggattctgggaatcatg

SEQ ID NO: 6102817 - DNA, 12 bp, Homo sapiens
cctgaaggcagg

SEQ ID NO: 6102818 - DNA, 16 bp, Homo sapiens
cctgaaggcagggctc

SEQ ID NO: 6102819 - DNA, 19 bp, Homo sapiens
cctgaaggccccgcccagg

SEQ ID NO: 6102820 - DNA, 20 bp, Homo sapiens
cctgaaggccccgcccaggc

SEQ ID NO: 6102821 - DNA, 21 bp, Homo sapiens
cctgaaggccccgcccaggct

SEQ ID NO: 6102822 - DNA, 22 bp, Homo sapiens
cctgaaggccccgcccaggctt

SEQ ID NO: 6102823 - DNA, 13 bp, Homo sapiens
cctgaagggaact

SEQ ID NO: 6102824 - DNA, 15 bp, Homo sapiens
cctgaagggaactag

SEQ ID NO: 6102825 - DNA, 16 bp, Homo sapiens
cctgaagggaaggcaa

SEQ ID NO: 6102826 - DNA, 17 bp, Homo sapiens
cctgaagggaaggcaaa

SEQ ID NO: 6102827 - DNA, 21 bp, Homo sapiens
cctgaagggaaggcaaaggca

SEQ ID NO: 6102828 - DNA, 20 bp, Homo sapiens
cctgaagggtgacatcccag

SEQ ID NO: 6102829 - DNA, 12 bp, Homo sapiens
cctgaagggtgg

SEQ ID NO: 6102830 - DNA, 13 bp, Homo sapiens
cctgaagggtgga

SEQ ID NO: 6102831 - DNA, 20 bp, Homo sapiens
cctgaaggtattggcctgtt

SEQ ID NO: 6102832 - DNA, 13 bp, Homo sapiens
cctgaaggttcct

SEQ ID NO: 6102833 - DNA, 12 bp, Homo sapiens
cctgaagtattt

SEQ ID NO: 6102834 - DNA, 15 bp, Homo sapiens
cctgaagtcacacag

SEQ ID NO: 6102835 - DNA, 20 bp, Homo sapiens
cctgaagtcacacagtgagt

SEQ ID NO: 6102836 - DNA, 16 bp, Homo sapiens
cctgaagtgaccccag

SEQ ID NO: 6102837 - DNA, 18 bp, Homo sapiens
cctgaagtgaccccagct

SEQ ID NO: 6102838 - DNA, 22 bp, Homo sapiens
cctgaagtgaccccagctccag

SEQ ID NO: 6102839 - DNA, 17 bp, Homo sapiens
cctgaagtgacctcact

SEQ ID NO: 6102840 - DNA, 20 bp, Homo sapiens
cctgaagttatgtgtatgtg

SEQ ID NO: 6102841 - DNA, 19 bp, Homo sapiens
cctgaagttgctgctgtga

SEQ ID NO: 6102842 - DNA, 14 bp, Homo sapiens
cctgaataaaccaa

SEQ ID NO: 6102843 - DNA, 16 bp, Homo sapiens
cctgaataaaccagta

SEQ ID NO: 6102844 - DNA, 10 bp, Homo sapiens
cctgaataac

SEQ ID NO: 6102845 - DNA, 21 bp, Homo sapiens
cctgaatacccttttctgacc

SEQ ID NO: 6102846 - DNA, 22 bp, Homo sapiens
cctgaatagctcccagatttca

SEQ ID NO: 6102847 - DNA, 16 bp, Homo sapiens
cctgaatcagaggcag

SEQ ID NO: 6102848 - DNA, 14 bp, Homo sapiens
cctgaatcatgagc

SEQ ID NO: 6102849 - DNA, 16 bp, Homo sapiens
cctgaatcatgagcct

SEQ ID NO: 6102850 - DNA, 15 bp, Homo sapiens
cctgaatccagcatt

SEQ ID NO: 6102851 - DNA, 18 bp, Homo sapiens
cctgaatccatcaggact

SEQ ID NO: 6102852 - DNA, 13 bp, Homo sapiens
cctgaatctgacc

SEQ ID NO: 6102853 - DNA, 18 bp, Homo sapiens
cctgaatctgaccacaga

SEQ ID NO: 6102854 - DNA, 18 bp, Homo sapiens
cctgaatctgtgcaaaca

SEQ ID NO: 6102855 - DNA, 19 bp, Homo sapiens
cctgaatctgtgcaaacag

SEQ ID NO: 6102856 - DNA, 13 bp, Homo sapiens
cctgaatcttttt

SEQ ID NO: 6102857 - DNA, 21 bp, Homo sapiens
cctgaatgacctgcagtcagg

SEQ ID NO: 6102858 - DNA, 19 bp, Homo sapiens
cctgaatgaggcggagctc

SEQ ID NO: 6102859 - DNA, 15 bp, Homo sapiens
cctgaatgctctgta

SEQ ID NO: 6102860 - DNA, 16 bp, Homo sapiens
cctgaatgctctgtag

SEQ ID NO: 6102861 - DNA, 17 bp, Homo sapiens
cctgaatggagaataca

SEQ ID NO: 6102862 - DNA, 17 bp, Homo sapiens
cctgaatggctttgtct

SEQ ID NO: 6102863 - DNA, 22 bp, Homo sapiens
cctgaatggctttgtcttgaaa

SEQ ID NO: 6102864 - DNA, 21 bp, Homo sapiens
cctgaatggttccatgcctga

SEQ ID NO: 6102865 - DNA, 21 bp, Homo sapiens
cctgaatgtagcgtgtaagct

SEQ ID NO: 6102866 - DNA, 16 bp, Homo sapiens
cctgaattaaagtcta

SEQ ID NO: 6102867 - DNA, 13 bp, Homo sapiens
cctgaattattaa

SEQ ID NO: 6102868 - DNA, 18 bp, Homo sapiens
cctgaattcattgtctca

SEQ ID NO: 6102869 - DNA, 23 bp, Homo sapiens
cctgaattcattgtctcagtgaa

SEQ ID NO: 6102870 - DNA, 15 bp, Homo sapiens
cctgaattctttttc

SEQ ID NO: 6102871 - DNA, 14 bp, Homo sapiens
cctgaatttcttct

SEQ ID NO: 6102872 - DNA, 15 bp, Homo sapiens
cctgaatttgtatat

SEQ ID NO: 6102873 - DNA, 21 bp, Homo sapiens
cctgaattttgttgctgtttt

SEQ ID NO: 6102874 - DNA, 16 bp, Homo sapiens
cctgacaacactcatt

SEQ ID NO: 6102875 - DNA, 23 bp, Homo sapiens
cctgacaacactcattgacctga

SEQ ID NO: 6102876 - DNA, 15 bp, Homo sapiens
cctgacaacagcctg

SEQ ID NO: 6102877 - DNA, 19 bp, Homo sapiens
cctgacaacagcctgagaa

SEQ ID NO: 6102878 - DNA, 19 bp, Homo sapiens
cctgacaaccactggtctg

SEQ ID NO: 6102879 - DNA, 14 bp, Homo sapiens
cctgacaacttctg

SEQ ID NO: 6102880 - DNA, 15 bp, Homo sapiens
cctgacaacttctga

SEQ ID NO: 6102881 - DNA, 22 bp, Homo sapiens
cctgacaaggccagcacccaaa

SEQ ID NO: 6102882 - DNA, 13 bp, Homo sapiens
cctgacaatggca

SEQ ID NO: 6102883 - DNA, 14 bp, Homo sapiens
cctgacaatggcag

SEQ ID NO: 6102884 - DNA, 16 bp, Homo sapiens
cctgacaatggcagct

SEQ ID NO: 6102885 - DNA, 18 bp, Homo sapiens
cctgacaattatgaaaaa

SEQ ID NO: 6102886 - DNA, 22 bp, Homo sapiens
cctgacaattatgaaaaaatgt

SEQ ID NO: 6102887 - DNA, 14 bp, Homo sapiens
cctgacacaccagg

SEQ ID NO: 6102888 - DNA, 15 bp, Homo sapiens
cctgacacaccaggc

SEQ ID NO: 6102889 - DNA, 18 bp, Homo sapiens
cctgacacacctgcagcc

SEQ ID NO: 6102890 - DNA, 23 bp, Homo sapiens
cctgacacactaaccaagctgag

SEQ ID NO: 6102891 - DNA, 18 bp, Homo sapiens
cctgacacaggccagcct

SEQ ID NO: 6102892 - DNA, 16 bp, Homo sapiens
cctgacaccaggcaag

SEQ ID NO: 6102893 - DNA, 21 bp, Homo sapiens
cctgacaccaggcaagaaaag

SEQ ID NO: 6102894 - DNA, 23 bp, Homo sapiens
cctgacacccttctcccactctc

SEQ ID NO: 6102895 - DNA, 21 bp, Homo sapiens
cctgacaccgtccctcagtga

SEQ ID NO: 6102896 - DNA, 14 bp, Homo sapiens
cctgacacctgccg

SEQ ID NO: 6102897 - DNA, 20 bp, Homo sapiens
cctgacacctgccgctgctt

SEQ ID NO: 6102898 - DNA, 22 bp, Homo sapiens
cctgacacctgccgctgcttga

SEQ ID NO: 6102899 - DNA, 13 bp, Homo sapiens
cctgacactccct

SEQ ID NO: 6102900 - DNA, 17 bp, Homo sapiens
cctgacactgagcccca

SEQ ID NO: 6102901 - DNA, 22 bp, Homo sapiens
cctgacactgcggggcttggct

SEQ ID NO: 6102902 - DNA, 14 bp, Homo sapiens
cctgacactttaat

SEQ ID NO: 6102903 - DNA, 16 bp, Homo sapiens
cctgacagaaggactc

SEQ ID NO: 6102904 - DNA, 16 bp, Homo sapiens
cctgacagaaggtgcc

SEQ ID NO: 6102905 - DNA, 21 bp, Homo sapiens
cctgacagatctagttctctt

SEQ ID NO: 6102906 - DNA, 18 bp, Homo sapiens
cctgacagatgcctggtg

SEQ ID NO: 6102907 - DNA, 18 bp, Homo sapiens
cctgacagcaaacacagt

SEQ ID NO: 6102908 - DNA, 19 bp, Homo sapiens
cctgacagcaaacacagtc

SEQ ID NO: 6102909 - DNA, 16 bp, Homo sapiens
cctgacagcactcctc

SEQ ID NO: 6102910 - DNA, 20 bp, Homo sapiens
cctgacagccagaactctgt

SEQ ID NO: 6102911 - DNA, 18 bp, Homo sapiens
cctgacagccttccccag

SEQ ID NO: 6102912 - DNA, 19 bp, Homo sapiens
cctgacagccttccccagc

SEQ ID NO: 6102913 - DNA, 20 bp, Homo sapiens
cctgacagcgacagaaaacc

SEQ ID NO: 6102914 - DNA, 23 bp, Homo sapiens
cctgacagcgacagaaaacctca

SEQ ID NO: 6102915 - DNA, 13 bp, Homo sapiens
cctgacagcttga

SEQ ID NO: 6102916 - DNA, 13 bp, Homo sapiens
cctgacaggctgt

SEQ ID NO: 6102917 - DNA, 21 bp, Homo sapiens
cctgacaggttcccagcagct

SEQ ID NO: 6102918 - DNA, 17 bp, Homo sapiens
cctgacagtgtgggaca

SEQ ID NO: 6102919 - DNA, 18 bp, Homo sapiens
cctgacatcaaaaaaggc

SEQ ID NO: 6102920 - DNA, 13 bp, Homo sapiens
cctgacatcacag

SEQ ID NO: 6102921 - DNA, 22 bp, Homo sapiens
cctgacatgctaacctctctga

SEQ ID NO: 6102922 - DNA, 13 bp, Homo sapiens
cgggaagggacag

SEQ ID NO: 6102923 - DNA, 20 bp, Homo sapiens
cgggaagggcatgcacgggc

SEQ ID NO: 6102924 - DNA, 17 bp, Homo sapiens
cgggaataaccttccat

SEQ ID NO: 6102925 - DNA, 15 bp, Homo sapiens
cgggaatattgtttc

SEQ ID NO: 6102926 - DNA, 14 bp, Homo sapiens
cgggaatcacaggt

SEQ ID NO: 6102927 - DNA, 21 bp, Homo sapiens
cgggaatgaccgctctccctt

SEQ ID NO: 6102928 - DNA, 16 bp, Homo sapiens
cgggaatgagctgtgt

SEQ ID NO: 6102929 - DNA, 18 bp, Homo sapiens
cgggacacctgccctgcc

SEQ ID NO: 6102930 - DNA, 14 bp, Homo sapiens
cgggacagagtagc

SEQ ID NO: 6102931 - DNA, 16 bp, Homo sapiens
cgggacagcggcccgg

SEQ ID NO: 6102932 - DNA, 18 bp, Homo sapiens
cgggacagcggcccggcc

SEQ ID NO: 6102933 - DNA, 13 bp, Homo sapiens
cgggacaggactt

SEQ ID NO: 6102934 - DNA, 14 bp, Homo sapiens
cgggacaggacttg

SEQ ID NO: 6102935 - DNA, 16 bp, Homo sapiens
cgggacaggacttgtg

SEQ ID NO: 6102936 - DNA, 19 bp, Homo sapiens
cgggacatcacagggtggg

SEQ ID NO: 6102937 - DNA, 23 bp, Homo sapiens
cgggacatcacagggtgggcctc

SEQ ID NO: 6102938 - DNA, 17 bp, Homo sapiens
cgggacatgcagctctg

SEQ ID NO: 6102939 - DNA, 19 bp, Homo sapiens
cgggacatggttgggggaa

SEQ ID NO: 6102940 - DNA, 23 bp, Homo sapiens
cgggacatggttgggggaatgca

SEQ ID NO: 6102941 - DNA, 17 bp, Homo sapiens
cgggaccacagctgctg

SEQ ID NO: 6102942 - DNA, 17 bp, Homo sapiens
cgggaccacatctgtcc

SEQ ID NO: 6102943 - DNA, 18 bp, Homo sapiens
cgggaccaccctgagccg

SEQ ID NO: 6102944 - DNA, 23 bp, Homo sapiens
cgggaccagaaacctgggagaga

SEQ ID NO: 6102945 - DNA, 13 bp, Homo sapiens
cgggaccagctca

SEQ ID NO: 6102946 - DNA, 17 bp, Homo sapiens
cgggaccattgacctca

SEQ ID NO: 6102947 - DNA, 18 bp, Homo sapiens
cgggaccattgacctcag

SEQ ID NO: 6102948 - DNA, 19 bp, Homo sapiens
cgggacccacggagccctc

SEQ ID NO: 6102949 - DNA, 20 bp, Homo sapiens
cgggacccacggagccctcc

SEQ ID NO: 6102950 - DNA, 14 bp, Homo sapiens
cgggacccagggcc

SEQ ID NO: 6102951 - DNA, 19 bp, Homo sapiens
cgggacccccggcctccag

SEQ ID NO: 6102952 - DNA, 17 bp, Homo sapiens
cgggaccctgcccagag

SEQ ID NO: 6102953 - DNA, 15 bp, Homo sapiens
cgggaccgtcagcat

SEQ ID NO: 6102954 - DNA, 17 bp, Homo sapiens
cgggacctcccaggaca

SEQ ID NO: 6102955 - DNA, 21 bp, Homo sapiens
cgggacgagaccctacaggag

SEQ ID NO: 6102956 - DNA, 15 bp, Homo sapiens
cgggacgcttccaga

SEQ ID NO: 6102957 - DNA, 16 bp, Homo sapiens
cgggacgcttccagac

SEQ ID NO: 6102958 - DNA, 17 bp, Homo sapiens
cgggacgcttccagacc

SEQ ID NO: 6102959 - DNA, 18 bp, Homo sapiens
cgggacgcttccagacca

SEQ ID NO: 6102960 - DNA, 16 bp, Homo sapiens
cgggactcctccctgg

SEQ ID NO: 6102961 - DNA, 17 bp, Homo sapiens
cgggactcctccctggg

SEQ ID NO: 6102962 - DNA, 20 bp, Homo sapiens
cgggactcctccctgggggt

SEQ ID NO: 6102963 - DNA, 11 bp, Homo sapiens
cgggactctgc

SEQ ID NO: 6102964 - DNA, 13 bp, Homo sapiens
cgggactgacctt

SEQ ID NO: 6102965 - DNA, 23 bp, Homo sapiens
cgggactgaccttcggcagtggc

SEQ ID NO: 6102966 - DNA, 15 bp, Homo sapiens
cgggactgctgctct

SEQ ID NO: 6102967 - DNA, 19 bp, Homo sapiens
cgggagagagtgagagaga

SEQ ID NO: 6102968 - DNA, 20 bp, Homo sapiens
cgggagagagtgagagagag

SEQ ID NO: 6102969 - DNA, 14 bp, Homo sapiens
cgggagagccaggc

SEQ ID NO: 6102970 - DNA, 15 bp, Homo sapiens
cgggagagccaggct

SEQ ID NO: 6102971 - DNA, 14 bp, Homo sapiens
cgggagagcgccac

SEQ ID NO: 6102972 - DNA, 18 bp, Homo sapiens
cgggagagcgccacccgc

SEQ ID NO: 6102973 - DNA, 20 bp, Homo sapiens
cgggagagcgccacccgccc

SEQ ID NO: 6102974 - DNA, 19 bp, Homo sapiens
cgggagaggagatcagggc

SEQ ID NO: 6102975 - DNA, 16 bp, Homo sapiens
cgggagaggggacgca

SEQ ID NO: 6102976 - DNA, 20 bp, Homo sapiens
cgggagatccgccctgggct

SEQ ID NO: 6102977 - DNA, 14 bp, Homo sapiens
cgggagcacccaga

SEQ ID NO: 6102978 - DNA, 14 bp, Homo sapiens
cgggagcagtgtct

SEQ ID NO: 6102979 - DNA, 22 bp, Homo sapiens
cgggagcagttgacctttgcca

SEQ ID NO: 6102980 - DNA, 19 bp, Homo sapiens
cgggagcattggcccctga

SEQ ID NO: 6102981 - DNA, 22 bp, Homo sapiens
cgggagcattggcccctgagcc

SEQ ID NO: 6102982 - DNA, 14 bp, Homo sapiens
cgggagccagactg

SEQ ID NO: 6102983 - DNA, 22 bp, Homo sapiens
cgggagccatgcgccccctccg

SEQ ID NO: 6102984 - DNA, 14 bp, Homo sapiens
cgggagccctagcc

SEQ ID NO: 6102985 - DNA, 16 bp, Homo sapiens
cgggagccgcaggggc

SEQ ID NO: 6102986 - DNA, 17 bp, Homo sapiens
cgggagccgctggcaga

SEQ ID NO: 6102987 - DNA, 15 bp, Homo sapiens
cgggagcctccctgc

SEQ ID NO: 6102988 - DNA, 19 bp, Homo sapiens
cgggagcctccctgcctca

SEQ ID NO: 6102989 - DNA, 13 bp, Homo sapiens
cgggagcctcctc

SEQ ID NO: 6102990 - DNA, 17 bp, Homo sapiens
cgggagccttgtcagtg

SEQ ID NO: 6102991 - DNA, 20 bp, Homo sapiens
cgggagcgagtaaagtctgg

SEQ ID NO: 6102992 - DNA, 11 bp, Homo sapiens
cgggagctgca

SEQ ID NO: 6102993 - DNA, 14 bp, Homo sapiens
cgggagctgcacac

SEQ ID NO: 6102994 - DNA, 10 bp, Homo sapiens
cgggagctgg

SEQ ID NO: 6102995 - DNA, 21 bp, Homo sapiens
cgggagctgggagccaggctc

SEQ ID NO: 6102996 - DNA, 14 bp, Homo sapiens
cgggagctgggccc

SEQ ID NO: 6102997 - DNA, 17 bp, Homo sapiens
cgggagctgggccctgc

SEQ ID NO: 6102998 - DNA, 22 bp, Homo sapiens
cgggagctggtgacagccttgg

SEQ ID NO: 6102999 - DNA, 18 bp, Homo sapiens
cgggagctttgagacagg

SEQ ID NO: 6103000 - DNA, 22 bp, Homo sapiens
cgggagcttttggtgagaaggt

SEQ ID NO: 6103001 - DNA, 22 bp, Homo sapiens
cgggaggaatcttttactgtgg

SEQ ID NO: 6103002 - DNA, 18 bp, Homo sapiens
cgggaggaatttctgagt

SEQ ID NO: 6103003 - DNA, 12 bp, Homo sapiens
cgggaggaggat

SEQ ID NO: 6103004 - DNA, 21 bp, Homo sapiens
cgggaggatgttctgggacac

SEQ ID NO: 6103005 - DNA, 15 bp, Homo sapiens
cgggaggcaccagct

SEQ ID NO: 6103006 - DNA, 17 bp, Homo sapiens
cgggaggcaccagctct

SEQ ID NO: 6103007 - DNA, 18 bp, Homo sapiens
cgggaggcaccagctctg

SEQ ID NO: 6103008 - DNA, 16 bp, Homo sapiens
cgggaggcagagtttg

SEQ ID NO: 6103009 - DNA, 15 bp, Homo sapiens
cgggaggccccagct

SEQ ID NO: 6103010 - DNA, 16 bp, Homo sapiens
cgggaggccccagctc

SEQ ID NO: 6103011 - DNA, 13 bp, Homo sapiens
cgggaggccctgg

SEQ ID NO: 6103012 - DNA, 16 bp, Homo sapiens
cgggaggccctggccc

SEQ ID NO: 6103013 - DNA, 18 bp, Homo sapiens
cgggaggctgagacagga

SEQ ID NO: 6103014 - DNA, 23 bp, Homo sapiens
cgggaggctgagacaggagaatc

SEQ ID NO: 6103015 - DNA, 12 bp, Homo sapiens
cgggaggctggg

SEQ ID NO: 6103016 - DNA, 15 bp, Homo sapiens
cgggaggctggggcc

SEQ ID NO: 6103017 - DNA, 24 bp, Homo sapiens
cgggagggagtctcaggaggaggc

SEQ ID NO: 6103018 - DNA, 11 bp, Homo sapiens
cgggaggggag

SEQ ID NO: 6103019 - DNA, 18 bp, Homo sapiens
cgggaggtcgaggcagga

SEQ ID NO: 6103020 - DNA, 20 bp, Homo sapiens
cgggaggtggaggttgcagt

SEQ ID NO: 6103021 - DNA, 12 bp, Homo sapiens
cgggagtagcaa

SEQ ID NO: 6103022 - DNA, 15 bp, Homo sapiens
cgggagtcagggacc

SEQ ID NO: 6103023 - DNA, 21 bp, Homo sapiens
cgggagtctcctcactgccac

SEQ ID NO: 6103024 - DNA, 22 bp, Homo sapiens
cgggagtctcctcactgccact

SEQ ID NO: 6103025 - DNA, 18 bp, Homo sapiens
cgggagtggccatctgga

SEQ ID NO: 6103026 - DNA, 21 bp, Homo sapiens
cgggagtggccatctggaaat

SEQ ID NO: 6103027 - DNA, 19 bp, Homo sapiens
cgggatcaaacctttctgg

SEQ ID NO: 6103028 - DNA, 23 bp, Homo sapiens
cgggatcaaacctttctggcctg

SEQ ID NO: 6103029 - DNA, 23 bp, Homo sapiens
cgggatcctccacagagaggagg

SEQ ID NO: 6103030 - DNA, 20 bp, Homo sapiens
cgggatcctgatggcaccca

SEQ ID NO: 6103031 - DNA, 13 bp, Homo sapiens
cgggatcctgccc

SEQ ID NO: 6103032 - DNA, 15 bp, Homo sapiens
cgggatgacctccag

SEQ ID NO: 6103033 - DNA, 17 bp, Homo sapiens
cgggatgacctccagaa

SEQ ID NO: 6103034 - DNA, 23 bp, Homo sapiens
cgggatgattgcttgagctcagg

SEQ ID NO: 6103035 - DNA, 20 bp, Homo sapiens
cgggatgctctttaaataat

SEQ ID NO: 6103036 - DNA, 12 bp, Homo sapiens
cgggatgggctc

SEQ ID NO: 6103037 - DNA, 16 bp, Homo sapiens
cgggatggttctggct

SEQ ID NO: 6103038 - DNA, 13 bp, Homo sapiens
cgggatggttggt

SEQ ID NO: 6103039 - DNA, 16 bp, Homo sapiens
cgggatgtcagcagac

SEQ ID NO: 6103040 - DNA, 17 bp, Homo sapiens
cgggattacagaaacac

SEQ ID NO: 6103041 - DNA, 16 bp, Homo sapiens
cgggattccctggtgg

SEQ ID NO: 6103042 - DNA, 14 bp, Homo sapiens
cgggcaaagaaaac

SEQ ID NO: 6103043 - DNA, 18 bp, Homo sapiens
cgggcaaagagctcccga

SEQ ID NO: 6103044 - DNA, 12 bp, Homo sapiens
cgggcaagggcc

SEQ ID NO: 6103045 - DNA, 17 bp, Homo sapiens
cgggcaagtgagagggg

SEQ ID NO: 6103046 - DNA, 20 bp, Homo sapiens
cgggcaagtgagaggggagg

SEQ ID NO: 6103047 - DNA, 14 bp, Homo sapiens
cgggcacagccagc

SEQ ID NO: 6103048 - DNA, 15 bp, Homo sapiens
cgggcacagccagcc

SEQ ID NO: 6103049 - DNA, 14 bp, Homo sapiens
cgggcacagggcac

SEQ ID NO: 6103050 - DNA, 14 bp, Homo sapiens
cgggcaccaggggc

SEQ ID NO: 6103051 - DNA, 17 bp, Homo sapiens
cgggcaccaggggccaa

SEQ ID NO: 6103052 - DNA, 14 bp, Homo sapiens
cgggcacccacaag

SEQ ID NO: 6103053 - DNA, 16 bp, Homo sapiens
cgggcacccacaagcc

SEQ ID NO: 6103054 - DNA, 17 bp, Homo sapiens
cgggcacggtcacacgg

SEQ ID NO: 6103055 - DNA, 22 bp, Homo sapiens
cgggcactcagaagacactgat

SEQ ID NO: 6103056 - DNA, 14 bp, Homo sapiens
cgggcagagggctg

SEQ ID NO: 6103057 - DNA, 15 bp, Homo sapiens
cgggcagagggctgg

SEQ ID NO: 6103058 - DNA, 16 bp, Homo sapiens
cgggcagagggctgga

SEQ ID NO: 6103059 - DNA, 19 bp, Homo sapiens
cgggcagagggctggaggc

SEQ ID NO: 6103060 - DNA, 22 bp, Homo sapiens
cgggcagagggctggaggccca

SEQ ID NO: 6103061 - DNA, 12 bp, Homo sapiens
cgggcagcacag

SEQ ID NO: 6103062 - DNA, 15 bp, Homo sapiens
cgggcagcacagcaa

SEQ ID NO: 6103063 - DNA, 15 bp, Homo sapiens
cgggcagcagagaga

SEQ ID NO: 6103064 - DNA, 12 bp, Homo sapiens
cgggcagccaca

SEQ ID NO: 6103065 - DNA, 15 bp, Homo sapiens
cgggcagccagcaga

SEQ ID NO: 6103066 - DNA, 14 bp, Homo sapiens
cgggcagcccagcc

SEQ ID NO: 6103067 - DNA, 15 bp, Homo sapiens
cgggcagcccagcct

SEQ ID NO: 6103068 - DNA, 17 bp, Homo sapiens
cgggcagcccagcctct

SEQ ID NO: 6103069 - DNA, 21 bp, Homo sapiens
cgggcagcccagcctctgtcc

SEQ ID NO: 6103070 - DNA, 12 bp, Homo sapiens
cgggcagcccct

SEQ ID NO: 6103071 - DNA, 14 bp, Homo sapiens
cgggcagcgggcca

SEQ ID NO: 6103072 - DNA, 15 bp, Homo sapiens
cgggcagggctccca

SEQ ID NO: 6103073 - DNA, 16 bp, Homo sapiens
cgggcagggctcccac

SEQ ID NO: 6103074 - DNA, 22 bp, Homo sapiens
cgggcaggggagccagggtaga

SEQ ID NO: 6103075 - DNA, 23 bp, Homo sapiens
cgggcaggggagggtcagccagg

SEQ ID NO: 6103076 - DNA, 20 bp, Homo sapiens
cgggcaggggtcagagcact

SEQ ID NO: 6103077 - DNA, 17 bp, Homo sapiens
cgggcaggtcctgccca

SEQ ID NO: 6103078 - DNA, 23 bp, Homo sapiens
cgggcaggtcctgcccatgtgtc

SEQ ID NO: 6103079 - DNA, 16 bp, Homo sapiens
cgggcaggtgaccgcc

SEQ ID NO: 6103080 - DNA, 14 bp, Homo sapiens
cgggcagtcctgtg

SEQ ID NO: 6103081 - DNA, 20 bp, Homo sapiens
cgggcagtcctgtgtgagga

SEQ ID NO: 6103082 - DNA, 17 bp, Homo sapiens
cgggcagtctgctctgc

SEQ ID NO: 6103083 - DNA, 20 bp, Homo sapiens
cgggcagtgacgtgagtggg

SEQ ID NO: 6103084 - DNA, 16 bp, Homo sapiens
cgggcagtggaggctg

SEQ ID NO: 6103085 - DNA, 22 bp, Homo sapiens
cgggcagtggaggctgctgtga

SEQ ID NO: 6103086 - DNA, 14 bp, Homo sapiens
cgggcatctttggg

SEQ ID NO: 6103087 - DNA, 16 bp, Homo sapiens
cgggcatgatggtgca

SEQ ID NO: 6103088 - DNA, 16 bp, Homo sapiens
cgggcatggcagccct

SEQ ID NO: 6103089 - DNA, 16 bp, Homo sapiens
cgggcatgggcctctc

SEQ ID NO: 6103090 - DNA, 19 bp, Homo sapiens
cgggcatgggcctctctgg

SEQ ID NO: 6103091 - DNA, 20 bp, Homo sapiens
cgggcatgggcctctctggg

SEQ ID NO: 6103092 - DNA, 22 bp, Homo sapiens
cgggcatggtggcatgtgcctg

SEQ ID NO: 6103093 - DNA, 21 bp, Homo sapiens
cgggcatggtggctcatgcct

SEQ ID NO: 6103094 - DNA, 18 bp, Homo sapiens
cgggcatgtctgcctgga

SEQ ID NO: 6103095 - DNA, 20 bp, Homo sapiens
cgggcatgtctgcctggagt

SEQ ID NO: 6103096 - DNA, 21 bp, Homo sapiens
cgggccaagttcgccaccggg

SEQ ID NO: 6103097 - DNA, 18 bp, Homo sapiens
cgggccacacgtggctgg

SEQ ID NO: 6103098 - DNA, 12 bp, Homo sapiens
cgggccacagag

SEQ ID NO: 6103099 - DNA, 14 bp, Homo sapiens
cgggccacagagaa

SEQ ID NO: 6103100 - DNA, 12 bp, Homo sapiens
cgggccacaggg

SEQ ID NO: 6103101 - DNA, 13 bp, Homo sapiens
cgggccacagggc

SEQ ID NO: 6103102 - DNA, 23 bp, Homo sapiens
cctgaccaaacagccaactagcc

SEQ ID NO: 6103103 - DNA, 13 bp, Homo sapiens
cctgaccaaagac

SEQ ID NO: 6103104 - DNA, 20 bp, Homo sapiens
cctgaccaacagttccttca

SEQ ID NO: 6103105 - DNA, 18 bp, Homo sapiens
cctgaccaccctgcctgt

SEQ ID NO: 6103106 - DNA, 19 bp, Homo sapiens
cctgaccaccctgcctgtg

SEQ ID NO: 6103107 - DNA, 15 bp, Homo sapiens
cctgaccactcagag

SEQ ID NO: 6103108 - DNA, 18 bp, Homo sapiens
cctgaccagggcaaggcc

SEQ ID NO: 6103109 - DNA, 21 bp, Homo sapiens
cctgaccaggggccctacctg

SEQ ID NO: 6103110 - DNA, 22 bp, Homo sapiens
cctgaccaggggccctacctgg

SEQ ID NO: 6103111 - DNA, 23 bp, Homo sapiens
cctgaccaggggccctacctggg

SEQ ID NO: 6103112 - DNA, 21 bp, Homo sapiens
cctgaccagttgcagtcactc

SEQ ID NO: 6103113 - DNA, 20 bp, Homo sapiens
cctgaccataatcctagccc

SEQ ID NO: 6103114 - DNA, 13 bp, Homo sapiens
cctgacccaacac

SEQ ID NO: 6103115 - DNA, 13 bp, Homo sapiens
cctgacccaggcc

SEQ ID NO: 6103116 - DNA, 22 bp, Homo sapiens
cctgacccagggactctccaaa

SEQ ID NO: 6103117 - DNA, 15 bp, Homo sapiens
cctgacccagtcccc

SEQ ID NO: 6103118 - DNA, 20 bp, Homo sapiens
cctgacccatcccttttcct

SEQ ID NO: 6103119 - DNA, 14 bp, Homo sapiens
cctgaccccaggca

SEQ ID NO: 6103120 - DNA, 21 bp, Homo sapiens
cctgaccccaggccacctgtc

SEQ ID NO: 6103121 - DNA, 17 bp, Homo sapiens
cctgaccccattcctga

SEQ ID NO: 6103122 - DNA, 16 bp, Homo sapiens
cctgaccccctgtcct

SEQ ID NO: 6103123 - DNA, 22 bp, Homo sapiens
cctgaccccgccatgcatgcag

SEQ ID NO: 6103124 - DNA, 20 bp, Homo sapiens
cctgacccctccctgcaggg

SEQ ID NO: 6103125 - DNA, 21 bp, Homo sapiens
cctgacccctccctgcagggg

SEQ ID NO: 6103126 - DNA, 23 bp, Homo sapiens
cctgacccctccctgcaggggct

SEQ ID NO: 6103127 - DNA, 15 bp, Homo sapiens
cctgacccctgcacc

SEQ ID NO: 6103128 - DNA, 13 bp, Homo sapiens
cctgacccctgcc

SEQ ID NO: 6103129 - DNA, 16 bp, Homo sapiens
cctgacccctgcctgt

SEQ ID NO: 6103130 - DNA, 15 bp, Homo sapiens
cctgacccctgctca

SEQ ID NO: 6103131 - DNA, 15 bp, Homo sapiens
cctgaccccttgctc

SEQ ID NO: 6103132 - DNA, 21 bp, Homo sapiens
cctgaccccttgctcccttca

SEQ ID NO: 6103133 - DNA, 23 bp, Homo sapiens
cctgacccgctcggacttactgc

SEQ ID NO: 6103134 - DNA, 22 bp, Homo sapiens
cctgacccggattggccctgcc

SEQ ID NO: 6103135 - DNA, 23 bp, Homo sapiens
cctgacccggattggccctgccc

SEQ ID NO: 6103136 - DNA, 18 bp, Homo sapiens
cctgaccctcatctttct

SEQ ID NO: 6103137 - DNA, 19 bp, Homo sapiens
cctgaccctcatctttctt

SEQ ID NO: 6103138 - DNA, 22 bp, Homo sapiens
cctgaccctcatctttcttcca

SEQ ID NO: 6103139 - DNA, 19 bp, Homo sapiens
cctgaccctcccactccca

SEQ ID NO: 6103140 - DNA, 19 bp, Homo sapiens
cctgaccctcccggcctgg

SEQ ID NO: 6103141 - DNA, 16 bp, Homo sapiens
cctgaccctccctacc

SEQ ID NO: 6103142 - DNA, 17 bp, Homo sapiens
cctgaccctccctacct

SEQ ID NO: 6103143 - DNA, 18 bp, Homo sapiens
cctgaccctccctacctg

SEQ ID NO: 6103144 - DNA, 21 bp, Homo sapiens
cctgacccttctctcacttct

SEQ ID NO: 6103145 - DNA, 17 bp, Homo sapiens
cctgaccgctgcccagg

SEQ ID NO: 6103146 - DNA, 20 bp, Homo sapiens
cctgaccgctgcccaggtgg

SEQ ID NO: 6103147 - DNA, 23 bp, Homo sapiens
cctgacctaaattagataaattg

SEQ ID NO: 6103148 - DNA, 16 bp, Homo sapiens
cctgacctaacctagg

SEQ ID NO: 6103149 - DNA, 17 bp, Homo sapiens
cctgacctaacctagga

SEQ ID NO: 6103150 - DNA, 18 bp, Homo sapiens
cctgacctaccccagcca

SEQ ID NO: 6103151 - DNA, 19 bp, Homo sapiens
cctgacctaccccagccag

SEQ ID NO: 6103152 - DNA, 20 bp, Homo sapiens
cctgacctaccccagccagg

SEQ ID NO: 6103153 - DNA, 22 bp, Homo sapiens
cctgacctaccccagccaggct

SEQ ID NO: 6103154 - DNA, 14 bp, Homo sapiens
cctgacctcacaga

SEQ ID NO: 6103155 - DNA, 13 bp, Homo sapiens
cctgacctcaggc

SEQ ID NO: 6103156 - DNA, 14 bp, Homo sapiens
cctgacctccagtc

SEQ ID NO: 6103157 - DNA, 17 bp, Homo sapiens
cctgacctccagtcctg

SEQ ID NO: 6103158 - DNA, 22 bp, Homo sapiens
cctgacctccagtcctgctggc

SEQ ID NO: 6103159 - DNA, 15 bp, Homo sapiens
cctgacctccatatg

SEQ ID NO: 6103160 - DNA, 15 bp, Homo sapiens
cctgacctcccagcc

SEQ ID NO: 6103161 - DNA, 18 bp, Homo sapiens
cctgacctcccagcccta

SEQ ID NO: 6103162 - DNA, 17 bp, Homo sapiens
cctgacctccgcccctg

SEQ ID NO: 6103163 - DNA, 19 bp, Homo sapiens
cctgacctcctggactgta

SEQ ID NO: 6103164 - DNA, 12 bp, Homo sapiens
cctgacctctga

SEQ ID NO: 6103165 - DNA, 20 bp, Homo sapiens
cctgacctctgaagagctga

SEQ ID NO: 6103166 - DNA, 15 bp, Homo sapiens
cctgacctctgcaag

SEQ ID NO: 6103167 - DNA, 13 bp, Homo sapiens
cctgacctcttgc

SEQ ID NO: 6103168 - DNA, 15 bp, Homo sapiens
cctgacctcttgctg

SEQ ID NO: 6103169 - DNA, 20 bp, Homo sapiens
cctgacctcttgctgtctct

SEQ ID NO: 6103170 - DNA, 21 bp, Homo sapiens
cctgacctcttgctgtctctg

SEQ ID NO: 6103171 - DNA, 15 bp, Homo sapiens
cctgacctgaggctc

SEQ ID NO: 6103172 - DNA, 13 bp, Homo sapiens
cctgacctgcggg

SEQ ID NO: 6103173 - DNA, 15 bp, Homo sapiens
cctgacctggccccc

SEQ ID NO: 6103174 - DNA, 13 bp, Homo sapiens
cctgacctgtcca

SEQ ID NO: 6103175 - DNA, 14 bp, Homo sapiens
cctgacctgtgagc

SEQ ID NO: 6103176 - DNA, 22 bp, Homo sapiens
cctgacctgtgagcccagctgg

SEQ ID NO: 6103177 - DNA, 22 bp, Homo sapiens
cctgaccttctccagggacaga

SEQ ID NO: 6103178 - DNA, 15 bp, Homo sapiens
cctgaccttggaatc

SEQ ID NO: 6103179 - DNA, 24 bp, Homo sapiens
cctgaccttggctgactggggctg

SEQ ID NO: 6103180 - DNA, 15 bp, Homo sapiens
cctgaccttgtgatc

SEQ ID NO: 6103181 - DNA, 17 bp, Homo sapiens
cctgacgaaactggccc

SEQ ID NO: 6103182 - DNA, 21 bp, Homo sapiens
cctgacgaaactggccccgga

SEQ ID NO: 6103183 - DNA, 18 bp, Homo sapiens
cctgacgatcttccccct

SEQ ID NO: 6103184 - DNA, 19 bp, Homo sapiens
cctgacgatcttccccctt

SEQ ID NO: 6103185 - DNA, 22 bp, Homo sapiens
cctgacgatcttcccccttccc

SEQ ID NO: 6103186 - DNA, 14 bp, Homo sapiens
cctgacgccctgcg

SEQ ID NO: 6103187 - DNA, 12 bp, Homo sapiens
cctgacgctcag

SEQ ID NO: 6103188 - DNA, 22 bp, Homo sapiens
cctgacgtctgccaccagcgcc

SEQ ID NO: 6103189 - DNA, 23 bp, Homo sapiens
cctgacgtctgccaccagcgccc

SEQ ID NO: 6103190 - DNA, 14 bp, Homo sapiens
cctgacgtgggcat

SEQ ID NO: 6103191 - DNA, 17 bp, Homo sapiens
cctgacgttaggaccag

SEQ ID NO: 6103192 - DNA, 17 bp, Homo sapiens
cctgactaaactaccac

SEQ ID NO: 6103193 - DNA, 22 bp, Homo sapiens
cctgactaaactaccacctcag

SEQ ID NO: 6103194 - DNA, 22 bp, Homo sapiens
cctgactagaactcctgtcttc

SEQ ID NO: 6103195 - DNA, 21 bp, Homo sapiens
cctgactcaattatttgcata

SEQ ID NO: 6103196 - DNA, 15 bp, Homo sapiens
cctgactcagtgacc

SEQ ID NO: 6103197 - DNA, 13 bp, Homo sapiens
cctgactcatccg

SEQ ID NO: 6103198 - DNA, 16 bp, Homo sapiens
cctgactccagtgagc

SEQ ID NO: 6103199 - DNA, 17 bp, Homo sapiens
cctgactccctgtgggg

SEQ ID NO: 6103200 - DNA, 15 bp, Homo sapiens
cctgactcctctaag

SEQ ID NO: 6103201 - DNA, 16 bp, Homo sapiens
cctgactcctctggct

SEQ ID NO: 6103202 - DNA, 13 bp, Homo sapiens
cctgactcctgga

SEQ ID NO: 6103203 - DNA, 17 bp, Homo sapiens
cctgactcctggactcc

SEQ ID NO: 6103204 - DNA, 18 bp, Homo sapiens
cctgactcgtctgactgt

SEQ ID NO: 6103205 - DNA, 17 bp, Homo sapiens
cctgactctctgtgacc

SEQ ID NO: 6103206 - DNA, 18 bp, Homo sapiens
cctgactctgaaatctga

SEQ ID NO: 6103207 - DNA, 12 bp, Homo sapiens
cctgactctgcc

SEQ ID NO: 6103208 - DNA, 14 bp, Homo sapiens
cctgactctgcccc

SEQ ID NO: 6103209 - DNA, 22 bp, Homo sapiens
cctgactctgccccctgctggc

SEQ ID NO: 6103210 - DNA, 13 bp, Homo sapiens
cctgactgacaca

SEQ ID NO: 6103211 - DNA, 15 bp, Homo sapiens
cctgactgacacagg

SEQ ID NO: 6103212 - DNA, 22 bp, Homo sapiens
cctgactgcccagcatttgggt

SEQ ID NO: 6103213 - DNA, 13 bp, Homo sapiens
cctgactgctcag

SEQ ID NO: 6103214 - DNA, 18 bp, Homo sapiens
cctgactgctcggtcagg

SEQ ID NO: 6103215 - DNA, 19 bp, Homo sapiens
cctgactgggggcagacat

SEQ ID NO: 6103216 - DNA, 21 bp, Homo sapiens
cctgactggtgctataggctg

SEQ ID NO: 6103217 - DNA, 16 bp, Homo sapiens
cctgactggttgtcag

SEQ ID NO: 6103218 - DNA, 17 bp, Homo sapiens
cctgactggttgtcaga

SEQ ID NO: 6103219 - DNA, 13 bp, Homo sapiens
cctgactgtctcc

SEQ ID NO: 6103220 - DNA, 12 bp, Homo sapiens
cctgactgtggg

SEQ ID NO: 6103221 - DNA, 24 bp, Homo sapiens
cctgactgtgttcagtgccttgga

SEQ ID NO: 6103222 - DNA, 19 bp, Homo sapiens
cctgacttcaggggctgcc

SEQ ID NO: 6103223 - DNA, 14 bp, Homo sapiens
cctgacttcccagc

SEQ ID NO: 6103224 - DNA, 15 bp, Homo sapiens
cctgacttcccagct

SEQ ID NO: 6103225 - DNA, 14 bp, Homo sapiens
cctgacttctcccc

SEQ ID NO: 6103226 - DNA, 13 bp, Homo sapiens
cctgacttctgga

SEQ ID NO: 6103227 - DNA, 15 bp, Homo sapiens
cctgacttctggaga

SEQ ID NO: 6103228 - DNA, 16 bp, Homo sapiens
cctgacttctggagat

SEQ ID NO: 6103229 - DNA, 15 bp, Homo sapiens
cctgacttctgttta

SEQ ID NO: 6103230 - DNA, 16 bp, Homo sapiens
cctgacttgagccact

SEQ ID NO: 6103231 - DNA, 14 bp, Homo sapiens
cctgacttgcttta

SEQ ID NO: 6103232 - DNA, 15 bp, Homo sapiens
cctgacttggctggg

SEQ ID NO: 6103233 - DNA, 22 bp, Homo sapiens
cctgacttttacagcttttctc

SEQ ID NO: 6103234 - DNA, 23 bp, Homo sapiens
cctgacttttacagcttttctct

SEQ ID NO: 6103235 - DNA, 14 bp, Homo sapiens
cctgagaaacacta

SEQ ID NO: 6103236 - DNA, 21 bp, Homo sapiens
cctgagaaacactatttgtga

SEQ ID NO: 6103237 - DNA, 23 bp, Homo sapiens
cctgagaaacgtccatctctctc

SEQ ID NO: 6103238 - DNA, 17 bp, Homo sapiens
cctgagaaagcccacct

SEQ ID NO: 6103239 - DNA, 14 bp, Homo sapiens
cctgagaaagctca

SEQ ID NO: 6103240 - DNA, 23 bp, Homo sapiens
cctgagaactgaattttgggact

SEQ ID NO: 6103241 - DNA, 19 bp, Homo sapiens
cctgagaagaagtggctgc

SEQ ID NO: 6103242 - DNA, 23 bp, Homo sapiens
cctgagaagaagtggctgccaca

SEQ ID NO: 6103243 - DNA, 12 bp, Homo sapiens
cctgagaagaga

SEQ ID NO: 6103244 - DNA, 15 bp, Homo sapiens
cctgagaagctgctc

SEQ ID NO: 6103245 - DNA, 22 bp, Homo sapiens
cctgagaagctgctccaggcct

SEQ ID NO: 6103246 - DNA, 14 bp, Homo sapiens
cctgagaaggcgag

SEQ ID NO: 6103247 - DNA, 15 bp, Homo sapiens
cctgagaaggggcag

SEQ ID NO: 6103248 - DNA, 22 bp, Homo sapiens
cctgagaagtgtctaaaaacac

SEQ ID NO: 6103249 - DNA, 12 bp, Homo sapiens
cctgagaatgag

SEQ ID NO: 6103250 - DNA, 17 bp, Homo sapiens
cctgagaatgagtggga

SEQ ID NO: 6103251 - DNA, 22 bp, Homo sapiens
cctgagaatgagtgggaatccg

SEQ ID NO: 6103252 - DNA, 15 bp, Homo sapiens
cctgagaatgttacc

SEQ ID NO: 6103253 - DNA, 23 bp, Homo sapiens
cctgagaattgaggggaggtggc

SEQ ID NO: 6103254 - DNA, 19 bp, Homo sapiens
cctgagacacatgggtgct

SEQ ID NO: 6103255 - DNA, 15 bp, Homo sapiens
cctgagacagcacca

SEQ ID NO: 6103256 - DNA, 19 bp, Homo sapiens
cctgagacagtgcgttgca

SEQ ID NO: 6103257 - DNA, 18 bp, Homo sapiens
cctgagaccacagagaga

SEQ ID NO: 6103258 - DNA, 16 bp, Homo sapiens
cctgagaccaccccca

SEQ ID NO: 6103259 - DNA, 14 bp, Homo sapiens
cctgagaccagggt

SEQ ID NO: 6103260 - DNA, 18 bp, Homo sapiens
cctgagacccctggcctc

SEQ ID NO: 6103261 - DNA, 19 bp, Homo sapiens
cctgagacccctggcctcc

SEQ ID NO: 6103262 - DNA, 15 bp, Homo sapiens
cctgagaccctggga

SEQ ID NO: 6103263 - DNA, 21 bp, Homo sapiens
cctgagaccctgggagagaag

SEQ ID NO: 6103264 - DNA, 14 bp, Homo sapiens
cctgagacctccac

SEQ ID NO: 6103265 - DNA, 16 bp, Homo sapiens
cctgagacctccactc

SEQ ID NO: 6103266 - DNA, 19 bp, Homo sapiens
cctgagacctccactccac

SEQ ID NO: 6103267 - DNA, 22 bp, Homo sapiens
cctgagacgggcatcgcaggag

SEQ ID NO: 6103268 - DNA, 14 bp, Homo sapiens
cctgagactccaga

SEQ ID NO: 6103269 - DNA, 16 bp, Homo sapiens
cctgagactcccgcct

SEQ ID NO: 6103270 - DNA, 20 bp, Homo sapiens
cctgagactcccgcctttga

SEQ ID NO: 6103271 - DNA, 14 bp, Homo sapiens
cctgagactggaaa

SEQ ID NO: 6103272 - DNA, 22 bp, Homo sapiens
cctgagactgtcggagaggctg

SEQ ID NO: 6103273 - DNA, 22 bp, Homo sapiens
cctgagagagaatagagctgcc

SEQ ID NO: 6103274 - DNA, 16 bp, Homo sapiens
cctgagagcatctcag

SEQ ID NO: 6103275 - DNA, 16 bp, Homo sapiens
cctgagagctcacagt

SEQ ID NO: 6103276 - DNA, 13 bp, Homo sapiens
cctgagaggcagg

SEQ ID NO: 6103277 - DNA, 18 bp, Homo sapiens
cctgagaggcaggcatag

SEQ ID NO: 6103278 - DNA, 17 bp, Homo sapiens
cctgagagtttcctcag

SEQ ID NO: 6103279 - DNA, 18 bp, Homo sapiens
cctgagatacttcccaaa

SEQ ID NO: 6103280 - DNA, 14 bp, Homo sapiens
cgggccacagggca

SEQ ID NO: 6103281 - DNA, 20 bp, Homo sapiens
cgggccactccttcctgccc

SEQ ID NO: 6103282 - DNA, 16 bp, Homo sapiens
cgggccagccaggcgg

SEQ ID NO: 6103283 - DNA, 20 bp, Homo sapiens
cgggccagccaggcgggctc

SEQ ID NO: 6103284 - DNA, 16 bp, Homo sapiens
cgggccaggaggctgc

SEQ ID NO: 6103285 - DNA, 15 bp, Homo sapiens
cgggccaggcccgca

SEQ ID NO: 6103286 - DNA, 14 bp, Homo sapiens
cgggccaggccctg

SEQ ID NO: 6103287 - DNA, 11 bp, Homo sapiens
cgggccagggt

SEQ ID NO: 6103288 - DNA, 12 bp, Homo sapiens
cgggccagggtg

SEQ ID NO: 6103289 - DNA, 15 bp, Homo sapiens
cgggccaggtctggc

SEQ ID NO: 6103290 - DNA, 19 bp, Homo sapiens
cgggccagtttctctgcct

SEQ ID NO: 6103291 - DNA, 14 bp, Homo sapiens
cgggccatgaggga

SEQ ID NO: 6103292 - DNA, 16 bp, Homo sapiens
cgggccatgagggaca

SEQ ID NO: 6103293 - DNA, 22 bp, Homo sapiens
cgggccatgagggacagggtct

SEQ ID NO: 6103294 - DNA, 11 bp, Homo sapiens
cgggcccacct

SEQ ID NO: 6103295 - DNA, 13 bp, Homo sapiens
cgggcccacctgg

SEQ ID NO: 6103296 - DNA, 16 bp, Homo sapiens
cgggcccacctggcca

SEQ ID NO: 6103297 - DNA, 17 bp, Homo sapiens
cgggcccacctggccac

SEQ ID NO: 6103298 - DNA, 20 bp, Homo sapiens
cgggcccacctggccacctg

SEQ ID NO: 6103299 - DNA, 19 bp, Homo sapiens
cgggcccagaccggcttct

SEQ ID NO: 6103300 - DNA, 14 bp, Homo sapiens
cgggcccagaggag

SEQ ID NO: 6103301 - DNA, 12 bp, Homo sapiens
cgggcccagccc

SEQ ID NO: 6103302 - DNA, 15 bp, Homo sapiens
cgggcccagccccca

SEQ ID NO: 6103303 - DNA, 13 bp, Homo sapiens
cgggcccagctga

SEQ ID NO: 6103304 - DNA, 12 bp, Homo sapiens
cgggcccaggca

SEQ ID NO: 6103305 - DNA, 13 bp, Homo sapiens
cgggcccaggcca

SEQ ID NO: 6103306 - DNA, 13 bp, Homo sapiens
cgggcccagggac

SEQ ID NO: 6103307 - DNA, 23 bp, Homo sapiens
cgggcccatgaagaaagcccctc

SEQ ID NO: 6103308 - DNA, 21 bp, Homo sapiens
cgggccccatcctcatccctg

SEQ ID NO: 6103309 - DNA, 22 bp, Homo sapiens
cgggccccatcctcatccctga

SEQ ID NO: 6103310 - DNA, 13 bp, Homo sapiens
cgggcccccgccc

SEQ ID NO: 6103311 - DNA, 15 bp, Homo sapiens
cgggcccccgccccg

SEQ ID NO: 6103312 - DNA, 22 bp, Homo sapiens
cgggcccctctctagggacccc

SEQ ID NO: 6103313 - DNA, 13 bp, Homo sapiens
cgggcccctgcct

SEQ ID NO: 6103314 - DNA, 14 bp, Homo sapiens
cgggcccctgcctg

SEQ ID NO: 6103315 - DNA, 15 bp, Homo sapiens
cgggcccctgcctgc

SEQ ID NO: 6103316 - DNA, 16 bp, Homo sapiens
cgggcccctgcctgcc

SEQ ID NO: 6103317 - DNA, 15 bp, Homo sapiens
cgggcccctgggctt

SEQ ID NO: 6103318 - DNA, 19 bp, Homo sapiens
cgggcccgcactcaggagc

SEQ ID NO: 6103319 - DNA, 18 bp, Homo sapiens
cgggcccgctcaacctct

SEQ ID NO: 6103320 - DNA, 22 bp, Homo sapiens
cgggcccgttgaggatgaggcc

SEQ ID NO: 6103321 - DNA, 15 bp, Homo sapiens
cgggccctccctccc

SEQ ID NO: 6103322 - DNA, 22 bp, Homo sapiens
cgggccctctctccgccccgga

SEQ ID NO: 6103323 - DNA, 13 bp, Homo sapiens
cgggccctggagc

SEQ ID NO: 6103324 - DNA, 14 bp, Homo sapiens
cgggccctgggccc

SEQ ID NO: 6103325 - DNA, 20 bp, Homo sapiens
cgggcccttcttgctgccct

SEQ ID NO: 6103326 - DNA, 16 bp, Homo sapiens
cgggccgaccctgcgg

SEQ ID NO: 6103327 - DNA, 18 bp, Homo sapiens
cgggccgaggcccagcgg

SEQ ID NO: 6103328 - DNA, 22 bp, Homo sapiens
cgggccgaggcccagcgggcag

SEQ ID NO: 6103329 - DNA, 13 bp, Homo sapiens
cgggccgcctcct

SEQ ID NO: 6103330 - DNA, 17 bp, Homo sapiens
cgggccggccagctggg

SEQ ID NO: 6103331 - DNA, 16 bp, Homo sapiens
cgggccgtaggggctc

SEQ ID NO: 6103332 - DNA, 22 bp, Homo sapiens
cgggccgtaggggctcctgagt

SEQ ID NO: 6103333 - DNA, 19 bp, Homo sapiens
cgggcctcagtttccccat

SEQ ID NO: 6103334 - DNA, 15 bp, Homo sapiens
cgggcctcccaccgc

SEQ ID NO: 6103335 - DNA, 15 bp, Homo sapiens
cgggcctcggcctgg

SEQ ID NO: 6103336 - DNA, 17 bp, Homo sapiens
cgggcctcggcctggct

SEQ ID NO: 6103337 - DNA, 21 bp, Homo sapiens
cgggcctctgcttgccagcca

SEQ ID NO: 6103338 - DNA, 14 bp, Homo sapiens
cgggcctcttccct

SEQ ID NO: 6103339 - DNA, 15 bp, Homo sapiens
cgggcctgcctctga

SEQ ID NO: 6103340 - DNA, 13 bp, Homo sapiens
cgggcctggactg

SEQ ID NO: 6103341 - DNA, 16 bp, Homo sapiens
cgggcctggagaacta

SEQ ID NO: 6103342 - DNA, 17 bp, Homo sapiens
cgggcctgtacagtctg

SEQ ID NO: 6103343 - DNA, 16 bp, Homo sapiens
cgggcctgtccacagg

SEQ ID NO: 6103344 - DNA, 22 bp, Homo sapiens
cgggcctgtccacaggcttctg

SEQ ID NO: 6103345 - DNA, 20 bp, Homo sapiens
cgggcctgtttggtgaggac

SEQ ID NO: 6103346 - DNA, 23 bp, Homo sapiens
cgggcctgtttggtgaggacctg

SEQ ID NO: 6103347 - DNA, 12 bp, Homo sapiens
cgggcgagaagg

SEQ ID NO: 6103348 - DNA, 17 bp, Homo sapiens
cgggcgcactgcctctc

SEQ ID NO: 6103349 - DNA, 20 bp, Homo sapiens
cgggcgcatgcctcccaggc

SEQ ID NO: 6103350 - DNA, 14 bp, Homo sapiens
cgggcgccatcttc

SEQ ID NO: 6103351 - DNA, 14 bp, Homo sapiens
cgggcgcctgcgct

SEQ ID NO: 6103352 - DNA, 18 bp, Homo sapiens
cgggcgcctgcgctcctc

SEQ ID NO: 6103353 - DNA, 20 bp, Homo sapiens
cgggcgcctgcgctcctctg

SEQ ID NO: 6103354 - DNA, 17 bp, Homo sapiens
cgggcgctcgctcaggt

SEQ ID NO: 6103355 - DNA, 17 bp, Homo sapiens
cgggcgctgcagcctcc

SEQ ID NO: 6103356 - DNA, 19 bp, Homo sapiens
cgggcgctgcagcctccct

SEQ ID NO: 6103357 - DNA, 18 bp, Homo sapiens
cgggcgctgtggctcctg

SEQ ID NO: 6103358 - DNA, 19 bp, Homo sapiens
cgggcgctgtggctcctgc

SEQ ID NO: 6103359 - DNA, 20 bp, Homo sapiens
cgggcgctgtggctcctgcc

SEQ ID NO: 6103360 - DNA, 13 bp, Homo sapiens
cgggcggaggcgg

SEQ ID NO: 6103361 - DNA, 15 bp, Homo sapiens
cgggcggaggcggct

SEQ ID NO: 6103362 - DNA, 22 bp, Homo sapiens
cgggcggaggggatccagccac

SEQ ID NO: 6103363 - DNA, 21 bp, Homo sapiens
cgggcggtcaggggttcgaga

SEQ ID NO: 6103364 - DNA, 21 bp, Homo sapiens
cgggcggtcctactgctgtga

SEQ ID NO: 6103365 - DNA, 14 bp, Homo sapiens
cgggcggtcctgca

SEQ ID NO: 6103366 - DNA, 16 bp, Homo sapiens
cgggcggtcctgcaca

SEQ ID NO: 6103367 - DNA, 17 bp, Homo sapiens
cgggcggtcctgcacag

SEQ ID NO: 6103368 - DNA, 18 bp, Homo sapiens
cgggcgtcaggggtgcac

SEQ ID NO: 6103369 - DNA, 17 bp, Homo sapiens
cgggcgtgggtctctgg

SEQ ID NO: 6103370 - DNA, 19 bp, Homo sapiens
cgggcgtgggtctctgggg

SEQ ID NO: 6103371 - DNA, 19 bp, Homo sapiens
cgggctaacgggaggctgg

SEQ ID NO: 6103372 - DNA, 21 bp, Homo sapiens
cgggctaacgggaggctgggc

SEQ ID NO: 6103373 - DNA, 23 bp, Homo sapiens
cgggctaacgggaggctgggcac

SEQ ID NO: 6103374 - DNA, 15 bp, Homo sapiens
cgggctcagcaaaag

SEQ ID NO: 6103375 - DNA, 14 bp, Homo sapiens
cgggctcagctctg

SEQ ID NO: 6103376 - DNA, 15 bp, Homo sapiens
cgggctcagctctgg

SEQ ID NO: 6103377 - DNA, 20 bp, Homo sapiens
cgggctcagggaccacagca

SEQ ID NO: 6103378 - DNA, 16 bp, Homo sapiens
cgggctccctcctctg

SEQ ID NO: 6103379 - DNA, 20 bp, Homo sapiens
cgggctccctcctctggcag

SEQ ID NO: 6103380 - DNA, 21 bp, Homo sapiens
cgggctccctcctctggcagg

SEQ ID NO: 6103381 - DNA, 17 bp, Homo sapiens
cgggctccctggcagga

SEQ ID NO: 6103382 - DNA, 21 bp, Homo sapiens
cgggctccctggcaggatgct

SEQ ID NO: 6103383 - DNA, 14 bp, Homo sapiens
cgggctcctgtgcc

SEQ ID NO: 6103384 - DNA, 14 bp, Homo sapiens
cgggctccttcccc

SEQ ID NO: 6103385 - DNA, 15 bp, Homo sapiens
cgggctcggaggcta

SEQ ID NO: 6103386 - DNA, 15 bp, Homo sapiens
cgggctcgggtctgg

SEQ ID NO: 6103387 - DNA, 16 bp, Homo sapiens
cgggctctatgcctgc

SEQ ID NO: 6103388 - DNA, 23 bp, Homo sapiens
cgggctctatgcctgcactggga

SEQ ID NO: 6103389 - DNA, 15 bp, Homo sapiens
cgggctctcctgccc

SEQ ID NO: 6103390 - DNA, 12 bp, Homo sapiens
cgggctctgcct

SEQ ID NO: 6103391 - DNA, 13 bp, Homo sapiens
cgggctctgcctc

SEQ ID NO: 6103392 - DNA, 16 bp, Homo sapiens
cgggctctgcctccca

SEQ ID NO: 6103393 - DNA, 19 bp, Homo sapiens
cgggctgactgggccacag

SEQ ID NO: 6103394 - DNA, 16 bp, Homo sapiens
cgggctgaggccagag

SEQ ID NO: 6103395 - DNA, 15 bp, Homo sapiens
cgggctgagggcctg

SEQ ID NO: 6103396 - DNA, 22 bp, Homo sapiens
cgggctgcccttcgctgccagg

SEQ ID NO: 6103397 - DNA, 15 bp, Homo sapiens
cgggctgcctgcccc

SEQ ID NO: 6103398 - DNA, 16 bp, Homo sapiens
cgggctgcctgggctg

SEQ ID NO: 6103399 - DNA, 15 bp, Homo sapiens
cgggctggagaaaga

SEQ ID NO: 6103400 - DNA, 22 bp, Homo sapiens
cgggctggagaaagagctgcct

SEQ ID NO: 6103401 - DNA, 13 bp, Homo sapiens
cgggctggccctg

SEQ ID NO: 6103402 - DNA, 14 bp, Homo sapiens
cgggctggccctgt

SEQ ID NO: 6103403 - DNA, 15 bp, Homo sapiens
cgggctggccctgtg

SEQ ID NO: 6103404 - DNA, 18 bp, Homo sapiens
cgggctggccctgtgcag

SEQ ID NO: 6103405 - DNA, 15 bp, Homo sapiens
cgggctggcctgaca

SEQ ID NO: 6103406 - DNA, 20 bp, Homo sapiens
cgggctgggagctctgcaga

SEQ ID NO: 6103407 - DNA, 17 bp, Homo sapiens
cgggctgggcagctgtt

SEQ ID NO: 6103408 - DNA, 20 bp, Homo sapiens
cgggctgtagatcaggtttg

SEQ ID NO: 6103409 - DNA, 22 bp, Homo sapiens
cgggctgtccgtgtgcctcctg

SEQ ID NO: 6103410 - DNA, 16 bp, Homo sapiens
cgggctgtctgggtgt

SEQ ID NO: 6103411 - DNA, 22 bp, Homo sapiens
cgggctgtgcccggccccaccc

SEQ ID NO: 6103412 - DNA, 20 bp, Homo sapiens
cgggctgttctggtggcccc

SEQ ID NO: 6103413 - DNA, 17 bp, Homo sapiens
cgggcttccctggcctc

SEQ ID NO: 6103414 - DNA, 20 bp, Homo sapiens
cgggctttaatagtcacctt

SEQ ID NO: 6103415 - DNA, 20 bp, Homo sapiens
cgggcttttctggggcccag

SEQ ID NO: 6103416 - DNA, 23 bp, Homo sapiens
cgggcttttctggggcccaggaa

SEQ ID NO: 6103417 - DNA, 17 bp, Homo sapiens
cggggaactggccaagc

SEQ ID NO: 6103418 - DNA, 20 bp, Homo sapiens
cggggaactggccaagctga

SEQ ID NO: 6103419 - DNA, 12 bp, Homo sapiens
cggggaagagat

SEQ ID NO: 6103420 - DNA, 21 bp, Homo sapiens
cggggaagctgccagcccaga

SEQ ID NO: 6103421 - DNA, 13 bp, Homo sapiens
cggggaaggattt

SEQ ID NO: 6103422 - DNA, 13 bp, Homo sapiens
cggggaagtgctc

SEQ ID NO: 6103423 - DNA, 16 bp, Homo sapiens
cggggacagaggcctg

SEQ ID NO: 6103424 - DNA, 15 bp, Homo sapiens
cggggacagctcctt

SEQ ID NO: 6103425 - DNA, 16 bp, Homo sapiens
cggggacaggctggaa

SEQ ID NO: 6103426 - DNA, 20 bp, Homo sapiens
cggggacaggtgacagtggc

SEQ ID NO: 6103427 - DNA, 18 bp, Homo sapiens
cggggaccactgggcccc

SEQ ID NO: 6103428 - DNA, 20 bp, Homo sapiens
cggggaccactgggcccctc

SEQ ID NO: 6103429 - DNA, 10 bp, Homo sapiens
cggggaccag

SEQ ID NO: 6103430 - DNA, 17 bp, Homo sapiens
cggggaccctgccgagg

SEQ ID NO: 6103431 - DNA, 23 bp, Homo sapiens
cggggacctggatagttaagggc

SEQ ID NO: 6103432 - DNA, 20 bp, Homo sapiens
cggggaccttggtctgatcg

SEQ ID NO: 6103433 - DNA, 14 bp, Homo sapiens
cggggactcagccc

SEQ ID NO: 6103434 - DNA, 17 bp, Homo sapiens
cggggagaaacccagag

SEQ ID NO: 6103435 - DNA, 20 bp, Homo sapiens
cggggagaagatagggaaca

SEQ ID NO: 6103436 - DNA, 13 bp, Homo sapiens
cggggagaggggg

SEQ ID NO: 6103437 - DNA, 19 bp, Homo sapiens
cggggagagggggaggttg

SEQ ID NO: 6103438 - DNA, 13 bp, Homo sapiens
cggggagctgagg

SEQ ID NO: 6103439 - DNA, 22 bp, Homo sapiens
cggggaggaggaacgggcagcc

SEQ ID NO: 6103440 - DNA, 14 bp, Homo sapiens
cggggaggaggagc

SEQ ID NO: 6103441 - DNA, 20 bp, Homo sapiens
cggggaggaggagctgccgc

SEQ ID NO: 6103442 - DNA, 23 bp, Homo sapiens
cggggaggaggttgtgtcactga

SEQ ID NO: 6103443 - DNA, 21 bp, Homo sapiens
cggggaggcaggggtcctgca

SEQ ID NO: 6103444 - DNA, 13 bp, Homo sapiens
cggggaggccaag

SEQ ID NO: 6103445 - DNA, 19 bp, Homo sapiens
cggggaggccaagtgcagg

SEQ ID NO: 6103446 - DNA, 23 bp, Homo sapiens
cggggaggcccccccagaagcaa

SEQ ID NO: 6103447 - DNA, 10 bp, Homo sapiens
cggggagggc

SEQ ID NO: 6103448 - DNA, 15 bp, Homo sapiens
cggggaggggcagag

SEQ ID NO: 6103449 - DNA, 15 bp, Homo sapiens
cggggagggggacgc

SEQ ID NO: 6103450 - DNA, 19 bp, Homo sapiens
cggggagtttctttcctgc

SEQ ID NO: 6103451 - DNA, 18 bp, Homo sapiens
cggggatcatctctgtga

SEQ ID NO: 6103452 - DNA, 23 bp, Homo sapiens
cggggatcccccgccccatcctc

SEQ ID NO: 6103453 - DNA, 23 bp, Homo sapiens
cggggatggattggcctccaggg

SEQ ID NO: 6103454 - DNA, 14 bp, Homo sapiens
cggggatgtgtcct

SEQ ID NO: 6103455 - DNA, 21 bp, Homo sapiens
cggggcaaagctgctgggcca

SEQ ID NO: 6103456 - DNA, 18 bp, Homo sapiens
cggggcaagagggaaggt

SEQ ID NO: 6103457 - DNA, 16 bp, Homo sapiens
cggggcaaggtctcct

SEQ ID NO: 6103458 - DNA, 16 bp, Homo sapiens
cggggcactggctgct

SEQ ID NO: 6103459 - DNA, 15 bp, Homo sapiens
cggggcagagccacc

SEQ ID NO: 6103460 - DNA, 17 bp, Homo sapiens
cctgagatcccctgagc

SEQ ID NO: 6103461 - DNA, 17 bp, Homo sapiens
cctgagatctctgcagg

SEQ ID NO: 6103462 - DNA, 18 bp, Homo sapiens
cctgagatctctgcagga

SEQ ID NO: 6103463 - DNA, 16 bp, Homo sapiens
cctgagatgcaggtga

SEQ ID NO: 6103464 - DNA, 21 bp, Homo sapiens
cctgagatgctgggagggctg

SEQ ID NO: 6103465 - DNA, 19 bp, Homo sapiens
cctgagatggatggacaga

SEQ ID NO: 6103466 - DNA, 22 bp, Homo sapiens
cctgagatggatggacagacag

SEQ ID NO: 6103467 - DNA, 20 bp, Homo sapiens
cctgagatggccctctggta

SEQ ID NO: 6103468 - DNA, 20 bp, Homo sapiens
cctgagatgtaggctccacc

SEQ ID NO: 6103469 - DNA, 22 bp, Homo sapiens
cctgagattattccttcttcta

SEQ ID NO: 6103470 - DNA, 11 bp, Homo sapiens
cctgagattct

SEQ ID NO: 6103471 - DNA, 15 bp, Homo sapiens
cctgagattctggga

SEQ ID NO: 6103472 - DNA, 20 bp, Homo sapiens
cctgagattctgggaaaggt

SEQ ID NO: 6103473 - DNA, 23 bp, Homo sapiens
cctgagattctgggaaaggtgct

SEQ ID NO: 6103474 - DNA, 23 bp, Homo sapiens
cctgagattctttaaggagatag

SEQ ID NO: 6103475 - DNA, 19 bp, Homo sapiens
cctgagatttattaaagaa

SEQ ID NO: 6103476 - DNA, 15 bp, Homo sapiens
cctgagatttcatct

SEQ ID NO: 6103477 - DNA, 23 bp, Homo sapiens
cctgagatttcatctgctctcct

SEQ ID NO: 6103478 - DNA, 14 bp, Homo sapiens
cctgagcaactctt

SEQ ID NO: 6103479 - DNA, 15 bp, Homo sapiens
cctgagcaactcttg

SEQ ID NO: 6103480 - DNA, 23 bp, Homo sapiens
cctgagcaactcttgattatcca

SEQ ID NO: 6103481 - DNA, 19 bp, Homo sapiens
cctgagcaatgtctgtgct

SEQ ID NO: 6103482 - DNA, 20 bp, Homo sapiens
cctgagcaatgtctgtgcta

SEQ ID NO: 6103483 - DNA, 19 bp, Homo sapiens
cctgagcacccgctgacat

SEQ ID NO: 6103484 - DNA, 22 bp, Homo sapiens
cctgagcacctcccagcccctg

SEQ ID NO: 6103485 - DNA, 15 bp, Homo sapiens
cctgagcactgccag

SEQ ID NO: 6103486 - DNA, 21 bp, Homo sapiens
cctgagcagaatactggtctc

SEQ ID NO: 6103487 - DNA, 22 bp, Homo sapiens
cctgagcaggcaggggcttggc

SEQ ID NO: 6103488 - DNA, 23 bp, Homo sapiens
cctgagcaggcaggggcttggct

SEQ ID NO: 6103489 - DNA, 22 bp, Homo sapiens
cctgagcagggtccacagctgg

SEQ ID NO: 6103490 - DNA, 15 bp, Homo sapiens
cctgagcagtccctg

SEQ ID NO: 6103491 - DNA, 17 bp, Homo sapiens
cctgagcagtccctgct

SEQ ID NO: 6103492 - DNA, 20 bp, Homo sapiens
cctgagcagtctacttctgt

SEQ ID NO: 6103493 - DNA, 22 bp, Homo sapiens
cctgagcagtctacttctgtgt

SEQ ID NO: 6103494 - DNA, 13 bp, Homo sapiens
cctgagcatccag

SEQ ID NO: 6103495 - DNA, 17 bp, Homo sapiens
cctgagcattcaggcag

SEQ ID NO: 6103496 - DNA, 13 bp, Homo sapiens
cctgagccaagct

SEQ ID NO: 6103497 - DNA, 16 bp, Homo sapiens
cctgagccagatttca

SEQ ID NO: 6103498 - DNA, 14 bp, Homo sapiens
cctgagccagcagg

SEQ ID NO: 6103499 - DNA, 15 bp, Homo sapiens
cctgagccagcaggg

SEQ ID NO: 6103500 - DNA, 21 bp, Homo sapiens
cctgagccagggaacagcccc

SEQ ID NO: 6103501 - DNA, 19 bp, Homo sapiens
cctgagcccaaccaggccc

SEQ ID NO: 6103502 - DNA, 20 bp, Homo sapiens
cctgagcccaaccaggccct

SEQ ID NO: 6103503 - DNA, 23 bp, Homo sapiens
cctgagcccagaaaaaaggactg

SEQ ID NO: 6103504 - DNA, 14 bp, Homo sapiens
cctgagcccaggga

SEQ ID NO: 6103505 - DNA, 16 bp, Homo sapiens
cctgagcccagggagg

SEQ ID NO: 6103506 - DNA, 17 bp, Homo sapiens
cctgagcccagggaggc

SEQ ID NO: 6103507 - DNA, 16 bp, Homo sapiens
cctgagccccagggag

SEQ ID NO: 6103508 - DNA, 17 bp, Homo sapiens
cctgagccccagggaga

SEQ ID NO: 6103509 - DNA, 21 bp, Homo sapiens
cctgagccccagggtgcccag

SEQ ID NO: 6103510 - DNA, 18 bp, Homo sapiens
cctgagcccccacccggg

SEQ ID NO: 6103511 - DNA, 18 bp, Homo sapiens
cctgagcccccagcttcc

SEQ ID NO: 6103512 - DNA, 13 bp, Homo sapiens
cctgagccccctg

SEQ ID NO: 6103513 - DNA, 15 bp, Homo sapiens
cctgagccccctgca

SEQ ID NO: 6103514 - DNA, 17 bp, Homo sapiens
cctgagccccctgcacc

SEQ ID NO: 6103515 - DNA, 23 bp, Homo sapiens
cctgagccccctgcacccacccc

SEQ ID NO: 6103516 - DNA, 14 bp, Homo sapiens
cctgagcccctcag

SEQ ID NO: 6103517 - DNA, 14 bp, Homo sapiens
cctgagccccttcc

SEQ ID NO: 6103518 - DNA, 20 bp, Homo sapiens
cctgagcccctttgcctgtc

SEQ ID NO: 6103519 - DNA, 18 bp, Homo sapiens
cctgagcccgaatttctc

SEQ ID NO: 6103520 - DNA, 17 bp, Homo sapiens
cctgagcccgcagccca

SEQ ID NO: 6103521 - DNA, 20 bp, Homo sapiens
cctgagcccggccctccccc

SEQ ID NO: 6103522 - DNA, 15 bp, Homo sapiens
cctgagccctaaaca

SEQ ID NO: 6103523 - DNA, 21 bp, Homo sapiens
cctgagccctactccctgcag

SEQ ID NO: 6103524 - DNA, 16 bp, Homo sapiens
cctgagccggccccag

SEQ ID NO: 6103525 - DNA, 11 bp, Homo sapiens
cctgagcctca

SEQ ID NO: 6103526 - DNA, 12 bp, Homo sapiens
cctgagcctgcc

SEQ ID NO: 6103527 - DNA, 18 bp, Homo sapiens
cctgagcctgccccagct

SEQ ID NO: 6103528 - DNA, 21 bp, Homo sapiens
cctgagcctgccccagctggg

SEQ ID NO: 6103529 - DNA, 13 bp, Homo sapiens
cctgagcctgccg

SEQ ID NO: 6103530 - DNA, 11 bp, Homo sapiens
cctgagcctgg

SEQ ID NO: 6103531 - DNA, 15 bp, Homo sapiens
cctgagcctggccat

SEQ ID NO: 6103532 - DNA, 12 bp, Homo sapiens
cctgagcctgtc

SEQ ID NO: 6103533 - DNA, 14 bp, Homo sapiens
cctgagcctgtctc

SEQ ID NO: 6103534 - DNA, 16 bp, Homo sapiens
cctgagcctgtctctc

SEQ ID NO: 6103535 - DNA, 12 bp, Homo sapiens
cctgagcctgtg

SEQ ID NO: 6103536 - DNA, 15 bp, Homo sapiens
cctgagcctgtgggt

SEQ ID NO: 6103537 - DNA, 19 bp, Homo sapiens
cctgagcctgttcccactc

SEQ ID NO: 6103538 - DNA, 23 bp, Homo sapiens
cctgagccttagaatctgtagag

SEQ ID NO: 6103539 - DNA, 19 bp, Homo sapiens
cctgagccttagctcccag

SEQ ID NO: 6103540 - DNA, 21 bp, Homo sapiens
cctgagcgagtggagtctgcc

SEQ ID NO: 6103541 - DNA, 23 bp, Homo sapiens
cctgagcgagtggagtctgccac

SEQ ID NO: 6103542 - DNA, 21 bp, Homo sapiens
cctgagcgcctggatttctgg

SEQ ID NO: 6103543 - DNA, 12 bp, Homo sapiens
cctgagcgctcc

SEQ ID NO: 6103544 - DNA, 16 bp, Homo sapiens
cctgagcgctcctgcc

SEQ ID NO: 6103545 - DNA, 21 bp, Homo sapiens
cctgagcgctgtggactgtcc

SEQ ID NO: 6103546 - DNA, 22 bp, Homo sapiens
cctgagcgctgtggactgtcct

SEQ ID NO: 6103547 - DNA, 23 bp, Homo sapiens
cctgagcgctgtggactgtcctg

SEQ ID NO: 6103548 - DNA, 18 bp, Homo sapiens
cctgagcggaccttccca

SEQ ID NO: 6103549 - DNA, 19 bp, Homo sapiens
cctgagcggaggctcggcc

SEQ ID NO: 6103550 - DNA, 20 bp, Homo sapiens
cctgagcggcaccctggtct

SEQ ID NO: 6103551 - DNA, 21 bp, Homo sapiens
cctgagcgggagtcagggacc

SEQ ID NO: 6103552 - DNA, 23 bp, Homo sapiens
cctgagcgggagtcagggacctg

SEQ ID NO: 6103553 - DNA, 11 bp, Homo sapiens
cctgagctaga

SEQ ID NO: 6103554 - DNA, 21 bp, Homo sapiens
cctgagctagaagctggagga

SEQ ID NO: 6103555 - DNA, 22 bp, Homo sapiens
cctgagctcaaatctctgttac

SEQ ID NO: 6103556 - DNA, 16 bp, Homo sapiens
cctgagctcacagagt

SEQ ID NO: 6103557 - DNA, 13 bp, Homo sapiens
cctgagctcactc

SEQ ID NO: 6103558 - DNA, 14 bp, Homo sapiens
cctgagctcagcgt

SEQ ID NO: 6103559 - DNA, 13 bp, Homo sapiens
cctgagctcaggc

SEQ ID NO: 6103560 - DNA, 18 bp, Homo sapiens
cctgagctcaggctgagc

SEQ ID NO: 6103561 - DNA, 20 bp, Homo sapiens
cctgagctcaggctgagccc

SEQ ID NO: 6103562 - DNA, 19 bp, Homo sapiens
cctgagctccaccctcccc

SEQ ID NO: 6103563 - DNA, 12 bp, Homo sapiens
cctgagctcccc

SEQ ID NO: 6103564 - DNA, 17 bp, Homo sapiens
cctgagctcggggacag

SEQ ID NO: 6103565 - DNA, 19 bp, Homo sapiens
cctgagctcggggacaggt

SEQ ID NO: 6103566 - DNA, 20 bp, Homo sapiens
cctgagctcggggggctctg

SEQ ID NO: 6103567 - DNA, 22 bp, Homo sapiens
cctgagctcggggggctctgcc

SEQ ID NO: 6103568 - DNA, 23 bp, Homo sapiens
cctgagctcggggggctctgcct

SEQ ID NO: 6103569 - DNA, 15 bp, Homo sapiens
cctgagctcggtgga

SEQ ID NO: 6103570 - DNA, 22 bp, Homo sapiens
cctgagctcggtggacccaggg

SEQ ID NO: 6103571 - DNA, 22 bp, Homo sapiens
cctgagctcgtgatctgcccgc

SEQ ID NO: 6103572 - DNA, 14 bp, Homo sapiens
cctgagctctgata

SEQ ID NO: 6103573 - DNA, 17 bp, Homo sapiens
cctgagctgaccagccg

SEQ ID NO: 6103574 - DNA, 21 bp, Homo sapiens
cctgagctgcagctgagcctg

SEQ ID NO: 6103575 - DNA, 14 bp, Homo sapiens
cctgagctgcttca

SEQ ID NO: 6103576 - DNA, 20 bp, Homo sapiens
cctgagctggcctcacctgg

SEQ ID NO: 6103577 - DNA, 20 bp, Homo sapiens
cctgagctggcgtcacctgt

SEQ ID NO: 6103578 - DNA, 12 bp, Homo sapiens
cctgagctggga

SEQ ID NO: 6103579 - DNA, 13 bp, Homo sapiens
cctgagctgggga

SEQ ID NO: 6103580 - DNA, 23 bp, Homo sapiens
cctgagctggggcctggagaggg

SEQ ID NO: 6103581 - DNA, 17 bp, Homo sapiens
cctgagctgtcccctgg

SEQ ID NO: 6103582 - DNA, 20 bp, Homo sapiens
cctgagctgtcgctgcctcc

SEQ ID NO: 6103583 - DNA, 17 bp, Homo sapiens
cctgagctttccgggga

SEQ ID NO: 6103584 - DNA, 17 bp, Homo sapiens
cctgagctttggacaca

SEQ ID NO: 6103585 - DNA, 13 bp, Homo sapiens
cctgaggaactgt

SEQ ID NO: 6103586 - DNA, 19 bp, Homo sapiens
cctgaggaagagggactgt

SEQ ID NO: 6103587 - DNA, 12 bp, Homo sapiens
cctgaggaagcg

SEQ ID NO: 6103588 - DNA, 11 bp, Homo sapiens
cctgaggaata

SEQ ID NO: 6103589 - DNA, 13 bp, Homo sapiens
cctgaggaataaa

SEQ ID NO: 6103590 - DNA, 17 bp, Homo sapiens
cctgaggacagaaagac

SEQ ID NO: 6103591 - DNA, 22 bp, Homo sapiens
cctgaggacagaaagaccctga

SEQ ID NO: 6103592 - DNA, 17 bp, Homo sapiens
cctgaggacagctgtcc

SEQ ID NO: 6103593 - DNA, 22 bp, Homo sapiens
cctgaggacaggggcatctctg

SEQ ID NO: 6103594 - DNA, 17 bp, Homo sapiens
cctgaggagccctgagg

SEQ ID NO: 6103595 - DNA, 20 bp, Homo sapiens
cctgaggagccctgaggacc

SEQ ID NO: 6103596 - DNA, 21 bp, Homo sapiens
cctgaggagccctgaggacct

SEQ ID NO: 6103597 - DNA, 21 bp, Homo sapiens
cctgaggagctgttggcctgg

SEQ ID NO: 6103598 - DNA, 18 bp, Homo sapiens
cctgaggaggaggacaca

SEQ ID NO: 6103599 - DNA, 23 bp, Homo sapiens
cctgaggaggaggacacagcaca

SEQ ID NO: 6103600 - DNA, 12 bp, Homo sapiens
cctgaggaggcc

SEQ ID NO: 6103601 - DNA, 15 bp, Homo sapiens
cctgaggaggccgct

SEQ ID NO: 6103602 - DNA, 16 bp, Homo sapiens
cctgaggagggccctg

SEQ ID NO: 6103603 - DNA, 21 bp, Homo sapiens
cctgaggagggccctgaggaa

SEQ ID NO: 6103604 - DNA, 18 bp, Homo sapiens
cctgaggagtctgaggtc

SEQ ID NO: 6103605 - DNA, 21 bp, Homo sapiens
cctgaggagtctgaggtcctg

SEQ ID NO: 6103606 - DNA, 19 bp, Homo sapiens
cctgaggagtgtcctgtct

SEQ ID NO: 6103607 - DNA, 14 bp, Homo sapiens
cctgaggatcagaa

SEQ ID NO: 6103608 - DNA, 17 bp, Homo sapiens
cctgaggatcagaaagt

SEQ ID NO: 6103609 - DNA, 20 bp, Homo sapiens
cctgaggatcccctgtcccc

SEQ ID NO: 6103610 - DNA, 23 bp, Homo sapiens
cctgaggatcccctgtcccctgg

SEQ ID NO: 6103611 - DNA, 13 bp, Homo sapiens
cctgaggatgagc

SEQ ID NO: 6103612 - DNA, 15 bp, Homo sapiens
cctgaggatgagctg

SEQ ID NO: 6103613 - DNA, 19 bp, Homo sapiens
cctgaggatgggtcagagc

SEQ ID NO: 6103614 - DNA, 14 bp, Homo sapiens
cctgaggcagaacc

SEQ ID NO: 6103615 - DNA, 20 bp, Homo sapiens
cctgaggcagaacctggtgg

SEQ ID NO: 6103616 - DNA, 12 bp, Homo sapiens
cctgaggcagcc

SEQ ID NO: 6103617 - DNA, 18 bp, Homo sapiens
cctgaggcagcccagctc

SEQ ID NO: 6103618 - DNA, 14 bp, Homo sapiens
cctgaggcaggaga

SEQ ID NO: 6103619 - DNA, 16 bp, Homo sapiens
cctgaggcaggagggc

SEQ ID NO: 6103620 - DNA, 23 bp, Homo sapiens
cctgaggcatgagaatcacttga

SEQ ID NO: 6103621 - DNA, 15 bp, Homo sapiens
cctgaggccaaatat

SEQ ID NO: 6103622 - DNA, 17 bp, Homo sapiens
cctgaggccaaatattg

SEQ ID NO: 6103623 - DNA, 22 bp, Homo sapiens
cctgaggccaaatattgatctg

SEQ ID NO: 6103624 - DNA, 24 bp, Homo sapiens
cctgaggccaaatattgatctgta

SEQ ID NO: 6103625 - DNA, 15 bp, Homo sapiens
cctgaggccagtggc

SEQ ID NO: 6103626 - DNA, 12 bp, Homo sapiens
cctgaggcccag

SEQ ID NO: 6103627 - DNA, 14 bp, Homo sapiens
cctgaggcccagag

SEQ ID NO: 6103628 - DNA, 16 bp, Homo sapiens
cctgaggcccagaggg

SEQ ID NO: 6103629 - DNA, 18 bp, Homo sapiens
cctgaggcccagagggcc

SEQ ID NO: 6103630 - DNA, 22 bp, Homo sapiens
cctgaggccctcactgagcctc

SEQ ID NO: 6103631 - DNA, 23 bp, Homo sapiens
cctgaggccctcactgagcctca

SEQ ID NO: 6103632 - DNA, 12 bp, Homo sapiens
cctgaggccctt

SEQ ID NO: 6103633 - DNA, 17 bp, Homo sapiens
cctgaggcccttctctc

SEQ ID NO: 6103634 - DNA, 13 bp, Homo sapiens
cctgaggcctaga

SEQ ID NO: 6103635 - DNA, 16 bp, Homo sapiens
cctgaggcctcatttt

SEQ ID NO: 6103636 - DNA, 17 bp, Homo sapiens
cctgaggcctccaagga

SEQ ID NO: 6103637 - DNA, 17 bp, Homo sapiens
cggggcagagctcagag

SEQ ID NO: 6103638 - DNA, 21 bp, Homo sapiens
cggggcagcggggctggccat

SEQ ID NO: 6103639 - DNA, 21 bp, Homo sapiens
cggggcaggaggcctggcctt

SEQ ID NO: 6103640 - DNA, 14 bp, Homo sapiens
cggggcaggccagg

SEQ ID NO: 6103641 - DNA, 15 bp, Homo sapiens
cggggcaggccaggg

SEQ ID NO: 6103642 - DNA, 16 bp, Homo sapiens
cggggcaggccagggg

SEQ ID NO: 6103643 - DNA, 16 bp, Homo sapiens
cggggcaggtgcagcc

SEQ ID NO: 6103644 - DNA, 20 bp, Homo sapiens
cggggcagtactcctccctg

SEQ ID NO: 6103645 - DNA, 19 bp, Homo sapiens
cggggcatgctggggcaag

SEQ ID NO: 6103646 - DNA, 12 bp, Homo sapiens
cggggcatggac

SEQ ID NO: 6103647 - DNA, 19 bp, Homo sapiens
cggggcatggacagggcca

SEQ ID NO: 6103648 - DNA, 22 bp, Homo sapiens
cggggcatggacagggccaggg

SEQ ID NO: 6103649 - DNA, 22 bp, Homo sapiens
cggggccagcatccatgcggcc

SEQ ID NO: 6103650 - DNA, 17 bp, Homo sapiens
cggggccagcttggcag

SEQ ID NO: 6103651 - DNA, 14 bp, Homo sapiens
cggggccaggatgg

SEQ ID NO: 6103652 - DNA, 11 bp, Homo sapiens
cggggccatgg

SEQ ID NO: 6103653 - DNA, 22 bp, Homo sapiens
cggggcccagcgctctcctgga

SEQ ID NO: 6103654 - DNA, 14 bp, Homo sapiens
cggggcccagggca

SEQ ID NO: 6103655 - DNA, 21 bp, Homo sapiens
cggggcccagggcaagctccg

SEQ ID NO: 6103656 - DNA, 14 bp, Homo sapiens
cggggccccagggc

SEQ ID NO: 6103657 - DNA, 15 bp, Homo sapiens
cggggccccagggct

SEQ ID NO: 6103658 - DNA, 16 bp, Homo sapiens
cggggccccctggtca

SEQ ID NO: 6103659 - DNA, 17 bp, Homo sapiens
cggggcccgccccaggc

SEQ ID NO: 6103660 - DNA, 19 bp, Homo sapiens
cggggcccgccccaggccc

SEQ ID NO: 6103661 - DNA, 17 bp, Homo sapiens
cggggccgacattgtct

SEQ ID NO: 6103662 - DNA, 17 bp, Homo sapiens
cggggccggtgagggga

SEQ ID NO: 6103663 - DNA, 17 bp, Homo sapiens
cggggcctccaacccat

SEQ ID NO: 6103664 - DNA, 18 bp, Homo sapiens
cggggcctcgggacctca

SEQ ID NO: 6103665 - DNA, 15 bp, Homo sapiens
cggggcctgcctagc

SEQ ID NO: 6103666 - DNA, 13 bp, Homo sapiens
cggggcctgctgg

SEQ ID NO: 6103667 - DNA, 16 bp, Homo sapiens
cggggcctggacaggc

SEQ ID NO: 6103668 - DNA, 18 bp, Homo sapiens
cggggcctggacaggcgg

SEQ ID NO: 6103669 - DNA, 19 bp, Homo sapiens
cggggcctggacaggcggg

SEQ ID NO: 6103670 - DNA, 24 bp, Homo sapiens
cggggcctggactgcacaggcagc

SEQ ID NO: 6103671 - DNA, 14 bp, Homo sapiens
cggggcctgtctca

SEQ ID NO: 6103672 - DNA, 18 bp, Homo sapiens
cggggcctgtctcagtga

SEQ ID NO: 6103673 - DNA, 19 bp, Homo sapiens
cggggcgatgctccctcag

SEQ ID NO: 6103674 - DNA, 15 bp, Homo sapiens
cggggcgccccaaga

SEQ ID NO: 6103675 - DNA, 23 bp, Homo sapiens
cggggcgggggcccgaaagctga

SEQ ID NO: 6103676 - DNA, 18 bp, Homo sapiens
cggggctcactctggccc

SEQ ID NO: 6103677 - DNA, 19 bp, Homo sapiens
cggggctcactctggcccc

SEQ ID NO: 6103678 - DNA, 12 bp, Homo sapiens
cggggctcagcc

SEQ ID NO: 6103679 - DNA, 14 bp, Homo sapiens
cggggctccaggct

SEQ ID NO: 6103680 - DNA, 14 bp, Homo sapiens
cggggctccccacg

SEQ ID NO: 6103681 - DNA, 17 bp, Homo sapiens
cggggctccccacgccc

SEQ ID NO: 6103682 - DNA, 16 bp, Homo sapiens
cggggctcgaggctgg

SEQ ID NO: 6103683 - DNA, 17 bp, Homo sapiens
cggggctcgaggctggt

SEQ ID NO: 6103684 - DNA, 17 bp, Homo sapiens
cggggctcttctcattt

SEQ ID NO: 6103685 - DNA, 14 bp, Homo sapiens
cggggctgaagcca

SEQ ID NO: 6103686 - DNA, 20 bp, Homo sapiens
cggggctgaagccacacagc

SEQ ID NO: 6103687 - DNA, 15 bp, Homo sapiens
cggggctgctggcct

SEQ ID NO: 6103688 - DNA, 16 bp, Homo sapiens
cggggctgctggcctg

SEQ ID NO: 6103689 - DNA, 17 bp, Homo sapiens
cggggctgctggcctgg

SEQ ID NO: 6103690 - DNA, 22 bp, Homo sapiens
cggggctgctggcctggccctt

SEQ ID NO: 6103691 - DNA, 12 bp, Homo sapiens
cggggctggcaa

SEQ ID NO: 6103692 - DNA, 16 bp, Homo sapiens
cggggctggcaagcag

SEQ ID NO: 6103693 - DNA, 19 bp, Homo sapiens
cggggctggcaagcaggga

SEQ ID NO: 6103694 - DNA, 13 bp, Homo sapiens
cggggctggccag

SEQ ID NO: 6103695 - DNA, 19 bp, Homo sapiens
cggggctggccagctgtgc

SEQ ID NO: 6103696 - DNA, 18 bp, Homo sapiens
cggggctgggggctgcag

SEQ ID NO: 6103697 - DNA, 22 bp, Homo sapiens
cggggctgtgcgggcgcccgga

SEQ ID NO: 6103698 - DNA, 11 bp, Homo sapiens
cggggcttcac

SEQ ID NO: 6103699 - DNA, 22 bp, Homo sapiens
cggggcttcaccatcttggcca

SEQ ID NO: 6103700 - DNA, 23 bp, Homo sapiens
cggggcttctgcggggctgagac

SEQ ID NO: 6103701 - DNA, 12 bp, Homo sapiens
cggggcttctgg

SEQ ID NO: 6103702 - DNA, 16 bp, Homo sapiens
cggggcttctgggcgc

SEQ ID NO: 6103703 - DNA, 14 bp, Homo sapiens
cggggcttggctga

SEQ ID NO: 6103704 - DNA, 18 bp, Homo sapiens
cggggcttttaaaaggaa

SEQ ID NO: 6103705 - DNA, 20 bp, Homo sapiens
cggggcttttaaaaggaaaa

SEQ ID NO: 6103706 - DNA, 14 bp, Homo sapiens
cgggggagcagaga

SEQ ID NO: 6103707 - DNA, 17 bp, Homo sapiens
cgggggagcagagagag

SEQ ID NO: 6103708 - DNA, 16 bp, Homo sapiens
cgggggagcaggcagt

SEQ ID NO: 6103709 - DNA, 23 bp, Homo sapiens
cgggggagcaggcagtggggctg

SEQ ID NO: 6103710 - DNA, 14 bp, Homo sapiens
cgggggagcccagt

SEQ ID NO: 6103711 - DNA, 15 bp, Homo sapiens
cgggggagcccagtg

SEQ ID NO: 6103712 - DNA, 16 bp, Homo sapiens
cgggggagcctggagc

SEQ ID NO: 6103713 - DNA, 17 bp, Homo sapiens
cgggggagcctggagcc

SEQ ID NO: 6103714 - DNA, 16 bp, Homo sapiens
cgggggagctggaaat

SEQ ID NO: 6103715 - DNA, 18 bp, Homo sapiens
cgggggagctggaaataa

SEQ ID NO: 6103716 - DNA, 14 bp, Homo sapiens
cgggggaggaaggg

SEQ ID NO: 6103717 - DNA, 14 bp, Homo sapiens
cgggggaggggccc

SEQ ID NO: 6103718 - DNA, 21 bp, Homo sapiens
cgggggaggggccctcaggcc

SEQ ID NO: 6103719 - DNA, 22 bp, Homo sapiens
cgggggaggggccctcaggcca

SEQ ID NO: 6103720 - DNA, 18 bp, Homo sapiens
cgggggatcctggagccc

SEQ ID NO: 6103721 - DNA, 19 bp, Homo sapiens
cgggggatcctggagcccc

SEQ ID NO: 6103722 - DNA, 22 bp, Homo sapiens
cgggggcaacgattcacagcct

SEQ ID NO: 6103723 - DNA, 15 bp, Homo sapiens
cgggggcagagaggg

SEQ ID NO: 6103724 - DNA, 12 bp, Homo sapiens
cgggggcagctg

SEQ ID NO: 6103725 - DNA, 13 bp, Homo sapiens
cgggggcagctga

SEQ ID NO: 6103726 - DNA, 22 bp, Homo sapiens
cgggggcagtgctcacccacac

SEQ ID NO: 6103727 - DNA, 16 bp, Homo sapiens
cgggggcagtgtgagg

SEQ ID NO: 6103728 - DNA, 21 bp, Homo sapiens
cgggggccaactcacccttgg

SEQ ID NO: 6103729 - DNA, 20 bp, Homo sapiens
cgggggcccaagtggggtgc

SEQ ID NO: 6103730 - DNA, 18 bp, Homo sapiens
cgggggcccgaaagctga

SEQ ID NO: 6103731 - DNA, 22 bp, Homo sapiens
cgggggcccgaaagctgagacc

SEQ ID NO: 6103732 - DNA, 15 bp, Homo sapiens
cgggggcctgtggtg

SEQ ID NO: 6103733 - DNA, 15 bp, Homo sapiens
cgggggccttgaaga

SEQ ID NO: 6103734 - DNA, 14 bp, Homo sapiens
cgggggcgcctgga

SEQ ID NO: 6103735 - DNA, 17 bp, Homo sapiens
cgggggcggcccagcct

SEQ ID NO: 6103736 - DNA, 19 bp, Homo sapiens
cgggggcggcccagcctct

SEQ ID NO: 6103737 - DNA, 20 bp, Homo sapiens
cgggggctcttcccctagac

SEQ ID NO: 6103738 - DNA, 14 bp, Homo sapiens
cgggggctgcttct

SEQ ID NO: 6103739 - DNA, 13 bp, Homo sapiens
cggggggagggga

SEQ ID NO: 6103740 - DNA, 22 bp, Homo sapiens
cggggggagggttggggagggg

SEQ ID NO: 6103741 - DNA, 20 bp, Homo sapiens
cggggggccccagtcagcct

SEQ ID NO: 6103742 - DNA, 18 bp, Homo sapiens
cggggggccgggggaggg

SEQ ID NO: 6103743 - DNA, 17 bp, Homo sapiens
cggggggcgagggaggg

SEQ ID NO: 6103744 - DNA, 18 bp, Homo sapiens
cggggggctcctgcccag

SEQ ID NO: 6103745 - DNA, 17 bp, Homo sapiens
cggggggggcgcctgga

SEQ ID NO: 6103746 - DNA, 20 bp, Homo sapiens
cggggggggtaggagaggag

SEQ ID NO: 6103747 - DNA, 22 bp, Homo sapiens
cggggggggtaggagaggagaa

SEQ ID NO: 6103748 - DNA, 19 bp, Homo sapiens
cggggggtcacaggcccag

SEQ ID NO: 6103749 - DNA, 18 bp, Homo sapiens
cgggggtctatacattcc

SEQ ID NO: 6103750 - DNA, 12 bp, Homo sapiens
cgggggtgctgg

SEQ ID NO: 6103751 - DNA, 16 bp, Homo sapiens
cgggggtgctggggcc

SEQ ID NO: 6103752 - DNA, 19 bp, Homo sapiens
cgggggtgctggggccagg

SEQ ID NO: 6103753 - DNA, 23 bp, Homo sapiens
cgggggtgctggggccagggcag

SEQ ID NO: 6103754 - DNA, 17 bp, Homo sapiens
cgggggttaggggtgga

SEQ ID NO: 6103755 - DNA, 20 bp, Homo sapiens
cgggggttccgtgtccaccc

SEQ ID NO: 6103756 - DNA, 22 bp, Homo sapiens
cgggggttgtggcccccgcccc

SEQ ID NO: 6103757 - DNA, 21 bp, Homo sapiens
cgggggtttgagccctggacc

SEQ ID NO: 6103758 - DNA, 19 bp, Homo sapiens
cggggtagaggctgggagg

SEQ ID NO: 6103759 - DNA, 21 bp, Homo sapiens
cggggtatataaattggggtg

SEQ ID NO: 6103760 - DNA, 18 bp, Homo sapiens
cggggtccaggcccgtgg

SEQ ID NO: 6103761 - DNA, 22 bp, Homo sapiens
cggggtcccaggacctgagcct

SEQ ID NO: 6103762 - DNA, 16 bp, Homo sapiens
cggggtcccccctcca

SEQ ID NO: 6103763 - DNA, 14 bp, Homo sapiens
cggggtccccgccc

SEQ ID NO: 6103764 - DNA, 12 bp, Homo sapiens
cggggtcctggg

SEQ ID NO: 6103765 - DNA, 16 bp, Homo sapiens
cggggtctccacctca

SEQ ID NO: 6103766 - DNA, 16 bp, Homo sapiens
cggggtctcctggacc

SEQ ID NO: 6103767 - DNA, 17 bp, Homo sapiens
cggggtctcctggacct

SEQ ID NO: 6103768 - DNA, 22 bp, Homo sapiens
cggggtctgtgctgtgcctgct

SEQ ID NO: 6103769 - DNA, 22 bp, Homo sapiens
cggggtgagggggggctccctg

SEQ ID NO: 6103770 - DNA, 23 bp, Homo sapiens
cggggtgagtccattctcccagg

SEQ ID NO: 6103771 - DNA, 17 bp, Homo sapiens
cggggtgcacaggaggg

SEQ ID NO: 6103772 - DNA, 16 bp, Homo sapiens
cggggtgcccacaggc

SEQ ID NO: 6103773 - DNA, 15 bp, Homo sapiens
cggggtgctgtggtg

SEQ ID NO: 6103774 - DNA, 12 bp, Homo sapiens
cggggtggagca

SEQ ID NO: 6103775 - DNA, 16 bp, Homo sapiens
cggggtggccacagcg

SEQ ID NO: 6103776 - DNA, 12 bp, Homo sapiens
cggggtggggag

SEQ ID NO: 6103777 - DNA, 13 bp, Homo sapiens
cggggtggggagg

SEQ ID NO: 6103778 - DNA, 19 bp, Homo sapiens
cggggtggggtgcctgagc

SEQ ID NO: 6103779 - DNA, 21 bp, Homo sapiens
cggggtgggtgggtgggcagg

SEQ ID NO: 6103780 - DNA, 18 bp, Homo sapiens
cggggtgtaacttcctgc

SEQ ID NO: 6103781 - DNA, 23 bp, Homo sapiens
cggggtgtaacttcctgctgcac

SEQ ID NO: 6103782 - DNA, 21 bp, Homo sapiens
cggggtgtggaatcaccggga

SEQ ID NO: 6103783 - DNA, 18 bp, Homo sapiens
cggggtgtgtcatttcta

SEQ ID NO: 6103784 - DNA, 21 bp, Homo sapiens
cggggttagagccaagctgca

SEQ ID NO: 6103785 - DNA, 22 bp, Homo sapiens
cggggttagagccaagctgcac

SEQ ID NO: 6103786 - DNA, 23 bp, Homo sapiens
cggggttcccgtgtgcctgagcg

SEQ ID NO: 6103787 - DNA, 13 bp, Homo sapiens
cggggttccctcc

SEQ ID NO: 6103788 - DNA, 21 bp, Homo sapiens
cggggttggctgttccagact

SEQ ID NO: 6103789 - DNA, 16 bp, Homo sapiens
cggggttggggtggga

SEQ ID NO: 6103790 - DNA, 20 bp, Homo sapiens
cggggttggggtgggagggc

SEQ ID NO: 6103791 - DNA, 15 bp, Homo sapiens
cggggtttcatcatg

SEQ ID NO: 6103792 - DNA, 19 bp, Homo sapiens
cgggtaacagtgaggctgg

SEQ ID NO: 6103793 - DNA, 20 bp, Homo sapiens
cgggtaacagtgaggctggg

SEQ ID NO: 6103794 - DNA, 18 bp, Homo sapiens
cgggtacctcagtttctc

SEQ ID NO: 6103795 - DNA, 18 bp, Homo sapiens
cgggtcaccctgctttgg

SEQ ID NO: 6103796 - DNA, 17 bp, Homo sapiens
cgggtcaccctgtgacc

SEQ ID NO: 6103797 - DNA, 11 bp, Homo sapiens
cgggtcactgc

SEQ ID NO: 6103798 - DNA, 12 bp, Homo sapiens
cgggtcactgct

SEQ ID NO: 6103799 - DNA, 15 bp, Homo sapiens
cgggtcatctgtacc

SEQ ID NO: 6103800 - DNA, 15 bp, Homo sapiens
cgggtccccagctcc

SEQ ID NO: 6103801 - DNA, 15 bp, Homo sapiens
cgggtcccggccgcg

SEQ ID NO: 6103802 - DNA, 18 bp, Homo sapiens
cgggtcgggggcaggtgc

SEQ ID NO: 6103803 - DNA, 16 bp, Homo sapiens
cgggtctcaggcctcc

SEQ ID NO: 6103804 - DNA, 13 bp, Homo sapiens
cgggtctccttgg

SEQ ID NO: 6103805 - DNA, 23 bp, Homo sapiens
cgggtctctcactgttgcagtgg

SEQ ID NO: 6103806 - DNA, 13 bp, Homo sapiens
cgggtctgcctct

SEQ ID NO: 6103807 - DNA, 18 bp, Homo sapiens
cgggtctgtcagggttgg

SEQ ID NO: 6103808 - DNA, 11 bp, Homo sapiens
cgggtctgtgg

SEQ ID NO: 6103809 - DNA, 13 bp, Homo sapiens
cgggtctgtggga

SEQ ID NO: 6103810 - DNA, 16 bp, Homo sapiens
cgggtgacgcccacct

SEQ ID NO: 6103811 - DNA, 19 bp, Homo sapiens
cgggtgatgagacctgggg

SEQ ID NO: 6103812 - DNA, 15 bp, Homo sapiens
cgggtgatggccagc

SEQ ID NO: 6103813 - DNA, 21 bp, Homo sapiens
cgggtgcacagagacggtctg

SEQ ID NO: 6103814 - DNA, 19 bp, Homo sapiens
cgggtgccaaataaatgct

SEQ ID NO: 6103815 - DNA, 17 bp, Homo sapiens
cgggtgccccccatgcc

SEQ ID NO: 6103816 - DNA, 15 bp, Homo sapiens
cctgaggctcaagag

SEQ ID NO: 6103817 - DNA, 17 bp, Homo sapiens
cctgaggctcaagaggc

SEQ ID NO: 6103818 - DNA, 17 bp, Homo sapiens
cctgaggctccacttgg

SEQ ID NO: 6103819 - DNA, 18 bp, Homo sapiens
cctgaggctccacttggt

SEQ ID NO: 6103820 - DNA, 22 bp, Homo sapiens
cctgaggctctctaagaaaaga

SEQ ID NO: 6103821 - DNA, 14 bp, Homo sapiens
cctgaggctgagac

SEQ ID NO: 6103822 - DNA, 15 bp, Homo sapiens
cctgaggctggactc

SEQ ID NO: 6103823 - DNA, 19 bp, Homo sapiens
cctgaggctggactccaga

SEQ ID NO: 6103824 - DNA, 20 bp, Homo sapiens
cctgaggctggcatcctggc

SEQ ID NO: 6103825 - DNA, 21 bp, Homo sapiens
cctgaggctggcatcctggct

SEQ ID NO: 6103826 - DNA, 20 bp, Homo sapiens
cctgaggctggtagcagaat

SEQ ID NO: 6103827 - DNA, 15 bp, Homo sapiens
cctgaggctgtggtc

SEQ ID NO: 6103828 - DNA, 22 bp, Homo sapiens
cctgaggctttggatttgacat

SEQ ID NO: 6103829 - DNA, 18 bp, Homo sapiens
cctgagggaaaggccagc

SEQ ID NO: 6103830 - DNA, 19 bp, Homo sapiens
cctgagggaaaggccagca

SEQ ID NO: 6103831 - DNA, 20 bp, Homo sapiens
cctgagggaaaggccagcac

SEQ ID NO: 6103832 - DNA, 21 bp, Homo sapiens
cctgagggaaaggccagcact

SEQ ID NO: 6103833 - DNA, 22 bp, Homo sapiens
cctgagggaaaggccagcactc

SEQ ID NO: 6103834 - DNA, 19 bp, Homo sapiens
cctgagggaagagtagctg

SEQ ID NO: 6103835 - DNA, 17 bp, Homo sapiens
cctgagggaagcccacc

SEQ ID NO: 6103836 - DNA, 20 bp, Homo sapiens
cctgagggacgagcagagcg

SEQ ID NO: 6103837 - DNA, 22 bp, Homo sapiens
cctgagggacgagcagagcgca

SEQ ID NO: 6103838 - DNA, 13 bp, Homo sapiens
cctgagggagctc

SEQ ID NO: 6103839 - DNA, 21 bp, Homo sapiens
cctgagggaggacctggggca

SEQ ID NO: 6103840 - DNA, 23 bp, Homo sapiens
cctgagggcagaaaggttctgcc

SEQ ID NO: 6103841 - DNA, 14 bp, Homo sapiens
cctgagggcccctc

SEQ ID NO: 6103842 - DNA, 22 bp, Homo sapiens
cctgagggcggagcgcctcctt

SEQ ID NO: 6103843 - DNA, 14 bp, Homo sapiens
cctgagggctcctc

SEQ ID NO: 6103844 - DNA, 19 bp, Homo sapiens
cctgagggctcctccatgg

SEQ ID NO: 6103845 - DNA, 15 bp, Homo sapiens
cctgaggggagacag

SEQ ID NO: 6103846 - DNA, 18 bp, Homo sapiens
cctgaggggagacagagc

SEQ ID NO: 6103847 - DNA, 20 bp, Homo sapiens
cctgaggggcagcctgcctt

SEQ ID NO: 6103848 - DNA, 23 bp, Homo sapiens
cctgaggggcatctgcccctccc

SEQ ID NO: 6103849 - DNA, 12 bp, Homo sapiens
cctgaggggcct

SEQ ID NO: 6103850 - DNA, 19 bp, Homo sapiens
cctgaggggctggggaggg

SEQ ID NO: 6103851 - DNA, 20 bp, Homo sapiens
cctgaggggctggggagggg

SEQ ID NO: 6103852 - DNA, 21 bp, Homo sapiens
cctgaggggctggggaggggg

SEQ ID NO: 6103853 - DNA, 15 bp, Homo sapiens
cctgagggggaagtg

SEQ ID NO: 6103854 - DNA, 18 bp, Homo sapiens
cctgagggtccacctgga

SEQ ID NO: 6103855 - DNA, 19 bp, Homo sapiens
cctgagggtccacctggag

SEQ ID NO: 6103856 - DNA, 20 bp, Homo sapiens
cctgagggtccacctggaga

SEQ ID NO: 6103857 - DNA, 21 bp, Homo sapiens
cctgagggtccacctggagag

SEQ ID NO: 6103858 - DNA, 13 bp, Homo sapiens
cctgagggtctgt

SEQ ID NO: 6103859 - DNA, 18 bp, Homo sapiens
cctgagggtctgtaggtt

SEQ ID NO: 6103860 - DNA, 16 bp, Homo sapiens
cctgagggtggagact

SEQ ID NO: 6103861 - DNA, 16 bp, Homo sapiens
cctgagggttttctca

SEQ ID NO: 6103862 - DNA, 14 bp, Homo sapiens
cctgaggtaacagg

SEQ ID NO: 6103863 - DNA, 17 bp, Homo sapiens
cctgaggtatctgtgtt

SEQ ID NO: 6103864 - DNA, 15 bp, Homo sapiens
cctgaggtcactgct

SEQ ID NO: 6103865 - DNA, 19 bp, Homo sapiens
cctgaggtcatcggcgtgg

SEQ ID NO: 6103866 - DNA, 17 bp, Homo sapiens
cctgaggtcatctgtaa

SEQ ID NO: 6103867 - DNA, 14 bp, Homo sapiens
cctgaggtcatgca

SEQ ID NO: 6103868 - DNA, 12 bp, Homo sapiens
cctgaggtgccc

SEQ ID NO: 6103869 - DNA, 22 bp, Homo sapiens
cctgaggtgcccactccgccag

SEQ ID NO: 6103870 - DNA, 14 bp, Homo sapiens
cctgaggtgcctcc

SEQ ID NO: 6103871 - DNA, 17 bp, Homo sapiens
cctgaggtgcctcccag

SEQ ID NO: 6103872 - DNA, 19 bp, Homo sapiens
cctgaggtgcctcccagtg

SEQ ID NO: 6103873 - DNA, 23 bp, Homo sapiens
cctgaggtgcctcccagtggcct

SEQ ID NO: 6103874 - DNA, 18 bp, Homo sapiens
cctgaggtggatttactg

SEQ ID NO: 6103875 - DNA, 22 bp, Homo sapiens
cctgaggtgggagaatcactta

SEQ ID NO: 6103876 - DNA, 17 bp, Homo sapiens
cctgaggtgggcccagg

SEQ ID NO: 6103877 - DNA, 23 bp, Homo sapiens
cctgaggtgggcccaggaccagc

SEQ ID NO: 6103878 - DNA, 16 bp, Homo sapiens
cctgaggtgggctggg

SEQ ID NO: 6103879 - DNA, 15 bp, Homo sapiens
cctgaggtgtggggg

SEQ ID NO: 6103880 - DNA, 17 bp, Homo sapiens
cctgaggtgtgggggct

SEQ ID NO: 6103881 - DNA, 21 bp, Homo sapiens
cctgaggttaaacggtgccca

SEQ ID NO: 6103882 - DNA, 22 bp, Homo sapiens
cctgaggttaaacggtgcccat

SEQ ID NO: 6103883 - DNA, 23 bp, Homo sapiens
cctgagtaatcgcttaaagatgt

SEQ ID NO: 6103884 - DNA, 21 bp, Homo sapiens
cctgagtactccacactgcac

SEQ ID NO: 6103885 - DNA, 23 bp, Homo sapiens
cctgagtactccacactgcacaa

SEQ ID NO: 6103886 - DNA, 20 bp, Homo sapiens
cctgagtagaaaggccttta

SEQ ID NO: 6103887 - DNA, 21 bp, Homo sapiens
cctgagtagaaaggcctttaa

SEQ ID NO: 6103888 - DNA, 15 bp, Homo sapiens
cctgagtagctggat

SEQ ID NO: 6103889 - DNA, 15 bp, Homo sapiens
cctgagtagctggga

SEQ ID NO: 6103890 - DNA, 21 bp, Homo sapiens
cctgagtagctgggattacag

SEQ ID NO: 6103891 - DNA, 18 bp, Homo sapiens
cctgagtagctgggcctg

SEQ ID NO: 6103892 - DNA, 19 bp, Homo sapiens
cctgagtagctgggcctgt

SEQ ID NO: 6103893 - DNA, 18 bp, Homo sapiens
cctgagtcaactggagca

SEQ ID NO: 6103894 - DNA, 22 bp, Homo sapiens
cctgagtcaactggagcaagaa

SEQ ID NO: 6103895 - DNA, 15 bp, Homo sapiens
cctgagtcaccagga

SEQ ID NO: 6103896 - DNA, 19 bp, Homo sapiens
cctgagtcacccctctgtc

SEQ ID NO: 6103897 - DNA, 23 bp, Homo sapiens
cctgagtcacccctctgtccagc

SEQ ID NO: 6103898 - DNA, 23 bp, Homo sapiens
cctgagtcaccctacctgtgcct

SEQ ID NO: 6103899 - DNA, 13 bp, Homo sapiens
cctgagtcagtgc

SEQ ID NO: 6103900 - DNA, 14 bp, Homo sapiens
cctgagtcagtgct

SEQ ID NO: 6103901 - DNA, 15 bp, Homo sapiens
cctgagtccagaatg

SEQ ID NO: 6103902 - DNA, 20 bp, Homo sapiens
cctgagtccgcctgcgcctc

SEQ ID NO: 6103903 - DNA, 13 bp, Homo sapiens
cctgagtcctgag

SEQ ID NO: 6103904 - DNA, 14 bp, Homo sapiens
cctgagtcctggtc

SEQ ID NO: 6103905 - DNA, 16 bp, Homo sapiens
cctgagtcctggtccc

SEQ ID NO: 6103906 - DNA, 17 bp, Homo sapiens
cctgagtcctggtccct

SEQ ID NO: 6103907 - DNA, 21 bp, Homo sapiens
cctgagtcctggtccctctga

SEQ ID NO: 6103908 - DNA, 22 bp, Homo sapiens
cctgagtcctggtccctctgag

SEQ ID NO: 6103909 - DNA, 18 bp, Homo sapiens
cctgagtcggccccacat

SEQ ID NO: 6103910 - DNA, 21 bp, Homo sapiens
cctgagtcggccccacatggg

SEQ ID NO: 6103911 - DNA, 18 bp, Homo sapiens
cctgagtcgtgacctgct

SEQ ID NO: 6103912 - DNA, 18 bp, Homo sapiens
cctgagtctcctgtgccc

SEQ ID NO: 6103913 - DNA, 13 bp, Homo sapiens
cctgagtctgggc

SEQ ID NO: 6103914 - DNA, 17 bp, Homo sapiens
cctgagtctgggcagct

SEQ ID NO: 6103915 - DNA, 18 bp, Homo sapiens
cctgagtcttggcctgcc

SEQ ID NO: 6103916 - DNA, 16 bp, Homo sapiens
cctgagtgagagggga

SEQ ID NO: 6103917 - DNA, 18 bp, Homo sapiens
cctgagtgagaggggagg

SEQ ID NO: 6103918 - DNA, 23 bp, Homo sapiens
cctgagtgagaggggaggccaag

SEQ ID NO: 6103919 - DNA, 14 bp, Homo sapiens
cctgagtgaggtgt

SEQ ID NO: 6103920 - DNA, 21 bp, Homo sapiens
cctgagtgcgggctgaggcca

SEQ ID NO: 6103921 - DNA, 14 bp, Homo sapiens
cctgagtgcgtgga

SEQ ID NO: 6103922 - DNA, 15 bp, Homo sapiens
cctgagtgcttgctt

SEQ ID NO: 6103923 - DNA, 17 bp, Homo sapiens
cctgagtgcttgctttt

SEQ ID NO: 6103924 - DNA, 19 bp, Homo sapiens
cctgagtgcttgcttttca

SEQ ID NO: 6103925 - DNA, 22 bp, Homo sapiens
cctgagtggatatgcgaatctt

SEQ ID NO: 6103926 - DNA, 14 bp, Homo sapiens
cctgagtggatctc

SEQ ID NO: 6103927 - DNA, 18 bp, Homo sapiens
cctgagtggatctccaag

SEQ ID NO: 6103928 - DNA, 20 bp, Homo sapiens
cctgagtggatctccaagga

SEQ ID NO: 6103929 - DNA, 13 bp, Homo sapiens
cctgagtgggctg

SEQ ID NO: 6103930 - DNA, 18 bp, Homo sapiens
cctgagtgggctgggccc

SEQ ID NO: 6103931 - DNA, 20 bp, Homo sapiens
cctgagtggtcactggtcag

SEQ ID NO: 6103932 - DNA, 21 bp, Homo sapiens
cctgagtggtcactggtcagg

SEQ ID NO: 6103933 - DNA, 23 bp, Homo sapiens
cctgagtggtcactggtcagggc

SEQ ID NO: 6103934 - DNA, 21 bp, Homo sapiens
cctgagtggtgaggggccact

SEQ ID NO: 6103935 - DNA, 20 bp, Homo sapiens
cctgagtgtgggcttctgaa

SEQ ID NO: 6103936 - DNA, 21 bp, Homo sapiens
cctgagttcccaaagggaggg

SEQ ID NO: 6103937 - DNA, 18 bp, Homo sapiens
cctgagttcccgggagct

SEQ ID NO: 6103938 - DNA, 21 bp, Homo sapiens
cctgagttcccgggagctggg

SEQ ID NO: 6103939 - DNA, 21 bp, Homo sapiens
cctgagttcctagccaccgcc

SEQ ID NO: 6103940 - DNA, 22 bp, Homo sapiens
cctgagttcctgaggtgatgaa

SEQ ID NO: 6103941 - DNA, 16 bp, Homo sapiens
cctgagttctgacact

SEQ ID NO: 6103942 - DNA, 13 bp, Homo sapiens
cctgagttgaaga

SEQ ID NO: 6103943 - DNA, 23 bp, Homo sapiens
cctgagttgcaccattctttctt

SEQ ID NO: 6103944 - DNA, 20 bp, Homo sapiens
cctgagttgcttttcagctg

SEQ ID NO: 6103945 - DNA, 23 bp, Homo sapiens
cctgagttggcgttgtgggcagg

SEQ ID NO: 6103946 - DNA, 17 bp, Homo sapiens
cctgagttgggcagcca

SEQ ID NO: 6103947 - DNA, 19 bp, Homo sapiens
cctgagttgggcagccagg

SEQ ID NO: 6103948 - DNA, 13 bp, Homo sapiens
cctgagtttggga

SEQ ID NO: 6103949 - DNA, 18 bp, Homo sapiens
cctgataaagcacagctg

SEQ ID NO: 6103950 - DNA, 19 bp, Homo sapiens
cctgataacaagcaaggat

SEQ ID NO: 6103951 - DNA, 19 bp, Homo sapiens
cctgataagggagagggaa

SEQ ID NO: 6103952 - DNA, 20 bp, Homo sapiens
cctgataataaagtgactga

SEQ ID NO: 6103953 - DNA, 16 bp, Homo sapiens
cctgataccctgcttg

SEQ ID NO: 6103954 - DNA, 22 bp, Homo sapiens
cctgatagctacccacagagca

SEQ ID NO: 6103955 - DNA, 23 bp, Homo sapiens
cctgatagctacccacagagcaa

SEQ ID NO: 6103956 - DNA, 18 bp, Homo sapiens
cctgatagtcacctgctg

SEQ ID NO: 6103957 - DNA, 16 bp, Homo sapiens
cctgatatccaacaga

SEQ ID NO: 6103958 - DNA, 14 bp, Homo sapiens
cctgatatgattta

SEQ ID NO: 6103959 - DNA, 20 bp, Homo sapiens
cctgatatgatttaaaacat

SEQ ID NO: 6103960 - DNA, 15 bp, Homo sapiens
cctgatcacctcagg

SEQ ID NO: 6103961 - DNA, 20 bp, Homo sapiens
cctgatcactcccagcactc

SEQ ID NO: 6103962 - DNA, 14 bp, Homo sapiens
cctgatcagaccac

SEQ ID NO: 6103963 - DNA, 14 bp, Homo sapiens
cctgatcagaggca

SEQ ID NO: 6103964 - DNA, 20 bp, Homo sapiens
cctgatcaggcttcctggtg

SEQ ID NO: 6103965 - DNA, 22 bp, Homo sapiens
cctgatcattacatggctgtgg

SEQ ID NO: 6103966 - DNA, 14 bp, Homo sapiens
cctgatccaggaaa

SEQ ID NO: 6103967 - DNA, 14 bp, Homo sapiens
cctgatcccacccc

SEQ ID NO: 6103968 - DNA, 21 bp, Homo sapiens
cctgatcccagacccattcct

SEQ ID NO: 6103969 - DNA, 13 bp, Homo sapiens
cctgatccctgaa

SEQ ID NO: 6103970 - DNA, 22 bp, Homo sapiens
cctgatcccttccacctgctct

SEQ ID NO: 6103971 - DNA, 23 bp, Homo sapiens
cctgatcccttccacctgctctg

SEQ ID NO: 6103972 - DNA, 19 bp, Homo sapiens
cctgatcctaaccctgggc

SEQ ID NO: 6103973 - DNA, 20 bp, Homo sapiens
cctgatcctaaccctgggct

SEQ ID NO: 6103974 - DNA, 21 bp, Homo sapiens
cctgatcctaaccctgggctc

SEQ ID NO: 6103975 - DNA, 22 bp, Homo sapiens
cctgatcctaaccctgggctcc

SEQ ID NO: 6103976 - DNA, 19 bp, Homo sapiens
cctgatcctggaggcccag

SEQ ID NO: 6103977 - DNA, 13 bp, Homo sapiens
cctgatctctgac

SEQ ID NO: 6103978 - DNA, 17 bp, Homo sapiens
cctgatctctgacctct

SEQ ID NO: 6103979 - DNA, 19 bp, Homo sapiens
cctgatctctgacctctgc

SEQ ID NO: 6103980 - DNA, 12 bp, Homo sapiens
cctgatctctgc

SEQ ID NO: 6103981 - DNA, 14 bp, Homo sapiens
cctgatctctgctc

SEQ ID NO: 6103982 - DNA, 17 bp, Homo sapiens
cctgatctcttcctgtt

SEQ ID NO: 6103983 - DNA, 21 bp, Homo sapiens
cctgatctttgggcatcagaa

SEQ ID NO: 6103984 - DNA, 19 bp, Homo sapiens
cctgatgacacccaccctg

SEQ ID NO: 6103985 - DNA, 21 bp, Homo sapiens
cctgatgacacccaccctgtg

SEQ ID NO: 6103986 - DNA, 22 bp, Homo sapiens
cctgatgacacccaccctgtgc

SEQ ID NO: 6103987 - DNA, 17 bp, Homo sapiens
cctgatgacccaggctg

SEQ ID NO: 6103988 - DNA, 20 bp, Homo sapiens
cctgatgacgggatgctctt

SEQ ID NO: 6103989 - DNA, 17 bp, Homo sapiens
cctgatgagatttttaa

SEQ ID NO: 6103990 - DNA, 23 bp, Homo sapiens
cctgatgagggggaattcctgga

SEQ ID NO: 6103991 - DNA, 21 bp, Homo sapiens
cgggtgccccccatgccctcc

SEQ ID NO: 6103992 - DNA, 11 bp, Homo sapiens
cgggtgcctgt

SEQ ID NO: 6103993 - DNA, 18 bp, Homo sapiens
cgggtgcgtgaccggccc

SEQ ID NO: 6103994 - DNA, 21 bp, Homo sapiens
cgggtgcgtgaccggcccgcc

SEQ ID NO: 6103995 - DNA, 15 bp, Homo sapiens
cgggtgctcagggct

SEQ ID NO: 6103996 - DNA, 23 bp, Homo sapiens
cgggtgctggaagtctccatgaa

SEQ ID NO: 6103997 - DNA, 23 bp, Homo sapiens
cgggtggaaaagaatccctgcag

SEQ ID NO: 6103998 - DNA, 18 bp, Homo sapiens
cgggtggctagtcagaga

SEQ ID NO: 6103999 - DNA, 12 bp, Homo sapiens
cgggtggctgca

SEQ ID NO: 6104000 - DNA, 22 bp, Homo sapiens
cgggtgggactcttccctggga

SEQ ID NO: 6104001 - DNA, 15 bp, Homo sapiens
cgggtgggcctggcc

SEQ ID NO: 6104002 - DNA, 16 bp, Homo sapiens
cgggtgggcctggcct

SEQ ID NO: 6104003 - DNA, 18 bp, Homo sapiens
cgggtgggcctggcctga

SEQ ID NO: 6104004 - DNA, 20 bp, Homo sapiens
cgggtgggcctggcctgagc

SEQ ID NO: 6104005 - DNA, 14 bp, Homo sapiens
cgggtggggaaagg

SEQ ID NO: 6104006 - DNA, 14 bp, Homo sapiens
cgggtggggcctgc

SEQ ID NO: 6104007 - DNA, 14 bp, Homo sapiens
cgggtgggggaggg

SEQ ID NO: 6104008 - DNA, 23 bp, Homo sapiens
cgggtgggggtggaataaaatac

SEQ ID NO: 6104009 - DNA, 14 bp, Homo sapiens
cgggtggtccccgt

SEQ ID NO: 6104010 - DNA, 20 bp, Homo sapiens
cgggtgtcacggccaggcag

SEQ ID NO: 6104011 - DNA, 21 bp, Homo sapiens
cgggtgtcacggccaggcaga

SEQ ID NO: 6104012 - DNA, 20 bp, Homo sapiens
cgggtgtgcctgccctggag

SEQ ID NO: 6104013 - DNA, 22 bp, Homo sapiens
cgggtgtggagaccaggctcct

SEQ ID NO: 6104014 - DNA, 14 bp, Homo sapiens
cgggtgtggcctca

SEQ ID NO: 6104015 - DNA, 17 bp, Homo sapiens
cgggtgtggcctcagcc

SEQ ID NO: 6104016 - DNA, 18 bp, Homo sapiens
cgggtgtggcctcagccc

SEQ ID NO: 6104017 - DNA, 19 bp, Homo sapiens
cgggtgtggcctcagccct

SEQ ID NO: 6104018 - DNA, 19 bp, Homo sapiens
cgggtgtgtgtctgcagca

SEQ ID NO: 6104019 - DNA, 14 bp, Homo sapiens
cgggttagcctggt

SEQ ID NO: 6104020 - DNA, 13 bp, Homo sapiens
cgggttcagcctg

SEQ ID NO: 6104021 - DNA, 18 bp, Homo sapiens
cgggttcagcctggcctg

SEQ ID NO: 6104022 - DNA, 13 bp, Homo sapiens
cgggttctagacg

SEQ ID NO: 6104023 - DNA, 21 bp, Homo sapiens
cgggttctagacgcccctccc

SEQ ID NO: 6104024 - DNA, 15 bp, Homo sapiens
cgggttctcccatga

SEQ ID NO: 6104025 - DNA, 12 bp, Homo sapiens
cgggttgaaaga

SEQ ID NO: 6104026 - DNA, 14 bp, Homo sapiens
cgggttgaaagaca

SEQ ID NO: 6104027 - DNA, 19 bp, Homo sapiens
cgggttgaaagacatcaat

SEQ ID NO: 6104028 - DNA, 22 bp, Homo sapiens
cgggttggaggcctcaccctgc

SEQ ID NO: 6104029 - DNA, 17 bp, Homo sapiens
cgggttgtgtgtctgtt

SEQ ID NO: 6104030 - DNA, 21 bp, Homo sapiens
cgggttgtgttttttttcctt

SEQ ID NO: 6104031 - DNA, 23 bp, Homo sapiens
cgggttgtgttttttttcctttg

SEQ ID NO: 6104032 - DNA, 15 bp, Homo sapiens
cgggtttctctgtgg

SEQ ID NO: 6104033 - DNA, 15 bp, Homo sapiens
cggtaagtgttctca

SEQ ID NO: 6104034 - DNA, 13 bp, Homo sapiens
cggtacacagcca

SEQ ID NO: 6104035 - DNA, 16 bp, Homo sapiens
cggtaccagcctgact

SEQ ID NO: 6104036 - DNA, 22 bp, Homo sapiens
cggtaccttccatacacagagg

SEQ ID NO: 6104037 - DNA, 21 bp, Homo sapiens
cggtagccagcacacagggca

SEQ ID NO: 6104038 - DNA, 17 bp, Homo sapiens
cggtagggaggcagcct

SEQ ID NO: 6104039 - DNA, 17 bp, Homo sapiens
cggtaggggctgcaggg

SEQ ID NO: 6104040 - DNA, 12 bp, Homo sapiens
cggtatcctaaa

SEQ ID NO: 6104041 - DNA, 15 bp, Homo sapiens
cggtatctggcttcc

SEQ ID NO: 6104042 - DNA, 20 bp, Homo sapiens
cggtatctggcttccctgga

SEQ ID NO: 6104043 - DNA, 16 bp, Homo sapiens
cggtatgacttaattt

SEQ ID NO: 6104044 - DNA, 18 bp, Homo sapiens
cggtattaaaatggagcg

SEQ ID NO: 6104045 - DNA, 16 bp, Homo sapiens
cggtattatgcttctt

SEQ ID NO: 6104046 - DNA, 14 bp, Homo sapiens
cggtcacacctcac

SEQ ID NO: 6104047 - DNA, 22 bp, Homo sapiens
cggtcacacctcactgtcatct

SEQ ID NO: 6104048 - DNA, 17 bp, Homo sapiens
cggtcacacggccaccc

SEQ ID NO: 6104049 - DNA, 18 bp, Homo sapiens
cggtcactcaggcctctg

SEQ ID NO: 6104050 - DNA, 19 bp, Homo sapiens
cggtcactcaggcctctgc

SEQ ID NO: 6104051 - DNA, 12 bp, Homo sapiens
cggtcactgatg

SEQ ID NO: 6104052 - DNA, 22 bp, Homo sapiens
cggtcactgcccacctgccagg

SEQ ID NO: 6104053 - DNA, 12 bp, Homo sapiens
cggtcagactgg

SEQ ID NO: 6104054 - DNA, 15 bp, Homo sapiens
cggtcagactggagg

SEQ ID NO: 6104055 - DNA, 19 bp, Homo sapiens
cggtcagatttgctgttca

SEQ ID NO: 6104056 - DNA, 16 bp, Homo sapiens
cggtcagcccctggca

SEQ ID NO: 6104057 - DNA, 13 bp, Homo sapiens
cggtcagcggggc

SEQ ID NO: 6104058 - DNA, 17 bp, Homo sapiens
cggtcatagtttcctga

SEQ ID NO: 6104059 - DNA, 15 bp, Homo sapiens
cggtcatgtgtgcat

SEQ ID NO: 6104060 - DNA, 14 bp, Homo sapiens
cggtccaacgccgc

SEQ ID NO: 6104061 - DNA, 11 bp, Homo sapiens
cggtccacagg

SEQ ID NO: 6104062 - DNA, 15 bp, Homo sapiens
cggtccacaggtcca

SEQ ID NO: 6104063 - DNA, 19 bp, Homo sapiens
cggtccacaggtccaagga

SEQ ID NO: 6104064 - DNA, 20 bp, Homo sapiens
cggtccacaggtccaaggac

SEQ ID NO: 6104065 - DNA, 14 bp, Homo sapiens
cggtccacccagga

SEQ ID NO: 6104066 - DNA, 15 bp, Homo sapiens
cggtccacccaggag

SEQ ID NO: 6104067 - DNA, 17 bp, Homo sapiens
cggtccagaggaggtgc

SEQ ID NO: 6104068 - DNA, 16 bp, Homo sapiens
cggtccagctggcctg

SEQ ID NO: 6104069 - DNA, 14 bp, Homo sapiens
cggtcccacactgg

SEQ ID NO: 6104070 - DNA, 13 bp, Homo sapiens
cggtcccagcctg

SEQ ID NO: 6104071 - DNA, 14 bp, Homo sapiens
cggtcccagcctgg

SEQ ID NO: 6104072 - DNA, 16 bp, Homo sapiens
cggtcccagcctgggc

SEQ ID NO: 6104073 - DNA, 12 bp, Homo sapiens
cggtcccagctc

SEQ ID NO: 6104074 - DNA, 16 bp, Homo sapiens
cggtcccaggccgcat

SEQ ID NO: 6104075 - DNA, 23 bp, Homo sapiens
cggtccccacagactgccccagc

SEQ ID NO: 6104076 - DNA, 20 bp, Homo sapiens
cggtccccactttattgcca

SEQ ID NO: 6104077 - DNA, 14 bp, Homo sapiens
cggtccccatcccc

SEQ ID NO: 6104078 - DNA, 15 bp, Homo sapiens
cggtccccatcccca

SEQ ID NO: 6104079 - DNA, 19 bp, Homo sapiens
cggtccccatccccaccag

SEQ ID NO: 6104080 - DNA, 16 bp, Homo sapiens
cggtcccccaggaggc

SEQ ID NO: 6104081 - DNA, 20 bp, Homo sapiens
cggtcccccatgccaccacc

SEQ ID NO: 6104082 - DNA, 16 bp, Homo sapiens
cggtcccccctcactc

SEQ ID NO: 6104083 - DNA, 21 bp, Homo sapiens
cggtcccccctcactccacac

SEQ ID NO: 6104084 - DNA, 19 bp, Homo sapiens
cggtccccttcccaggggc

SEQ ID NO: 6104085 - DNA, 21 bp, Homo sapiens
cggtccctgcagaagccagaa

SEQ ID NO: 6104086 - DNA, 18 bp, Homo sapiens
cggtcccttccatgccct

SEQ ID NO: 6104087 - DNA, 19 bp, Homo sapiens
cggtcccttgagacctcag

SEQ ID NO: 6104088 - DNA, 18 bp, Homo sapiens
cggtccgcccgcttccct

SEQ ID NO: 6104089 - DNA, 13 bp, Homo sapiens
cggtccgcggcct

SEQ ID NO: 6104090 - DNA, 15 bp, Homo sapiens
cggtccggcgccccg

SEQ ID NO: 6104091 - DNA, 13 bp, Homo sapiens
cggtcctggcccc

SEQ ID NO: 6104092 - DNA, 15 bp, Homo sapiens
cggtcctggccccag

SEQ ID NO: 6104093 - DNA, 13 bp, Homo sapiens
cggtcctggtgcc

SEQ ID NO: 6104094 - DNA, 22 bp, Homo sapiens
cggtcctttaggcagcctgccg

SEQ ID NO: 6104095 - DNA, 21 bp, Homo sapiens
cggtcctttgttggcttcttt

SEQ ID NO: 6104096 - DNA, 19 bp, Homo sapiens
cggtcgccccgtgtttgcg

SEQ ID NO: 6104097 - DNA, 15 bp, Homo sapiens
cggtcgggcagccag

SEQ ID NO: 6104098 - DNA, 16 bp, Homo sapiens
cggtcgggcagccagc

SEQ ID NO: 6104099 - DNA, 22 bp, Homo sapiens
cggtcgggttttattgtttaaa

SEQ ID NO: 6104100 - DNA, 20 bp, Homo sapiens
cggtctcccaaagtgctggg

SEQ ID NO: 6104101 - DNA, 19 bp, Homo sapiens
cggtctcccttccgtccat

SEQ ID NO: 6104102 - DNA, 15 bp, Homo sapiens
cggtctcctgactgg

SEQ ID NO: 6104103 - DNA, 22 bp, Homo sapiens
cggtctcggatcaggctcccag

SEQ ID NO: 6104104 - DNA, 15 bp, Homo sapiens
cggtctgacagtcct

SEQ ID NO: 6104105 - DNA, 12 bp, Homo sapiens
cggtctgagcta

SEQ ID NO: 6104106 - DNA, 16 bp, Homo sapiens
cggtctgcaagtcaga

SEQ ID NO: 6104107 - DNA, 20 bp, Homo sapiens
cggtctgcaagtcagaggat

SEQ ID NO: 6104108 - DNA, 14 bp, Homo sapiens
cggtctgctttgga

SEQ ID NO: 6104109 - DNA, 21 bp, Homo sapiens
cggtctgctttggatgatttt

SEQ ID NO: 6104110 - DNA, 13 bp, Homo sapiens
cggtcttgggcac

SEQ ID NO: 6104111 - DNA, 17 bp, Homo sapiens
cggtctttatgaattat

SEQ ID NO: 6104112 - DNA, 16 bp, Homo sapiens
cggtcttttgtatttt

SEQ ID NO: 6104113 - DNA, 13 bp, Homo sapiens
cggtgaatggctt

SEQ ID NO: 6104114 - DNA, 21 bp, Homo sapiens
cggtgacaaagatggctcaga

SEQ ID NO: 6104115 - DNA, 17 bp, Homo sapiens
cggtgacacaggtcagg

SEQ ID NO: 6104116 - DNA, 18 bp, Homo sapiens
cggtgacacaggtcaggg

SEQ ID NO: 6104117 - DNA, 16 bp, Homo sapiens
cggtgaccactcttct

SEQ ID NO: 6104118 - DNA, 23 bp, Homo sapiens
cggtgaccgcctcctgctctgca

SEQ ID NO: 6104119 - DNA, 16 bp, Homo sapiens
cggtgagactctgagg

SEQ ID NO: 6104120 - DNA, 12 bp, Homo sapiens
cggtgagccggg

SEQ ID NO: 6104121 - DNA, 18 bp, Homo sapiens
cggtgaggagtccagcac

SEQ ID NO: 6104122 - DNA, 14 bp, Homo sapiens
cggtgaggcagggg

SEQ ID NO: 6104123 - DNA, 16 bp, Homo sapiens
cggtgaggggaggggc

SEQ ID NO: 6104124 - DNA, 21 bp, Homo sapiens
cggtgaggggaggggcctccc

SEQ ID NO: 6104125 - DNA, 22 bp, Homo sapiens
cggtgagggtgcggggcctgca

SEQ ID NO: 6104126 - DNA, 16 bp, Homo sapiens
cggtgaggtgggggca

SEQ ID NO: 6104127 - DNA, 15 bp, Homo sapiens
cggtgagtgatggca

SEQ ID NO: 6104128 - DNA, 15 bp, Homo sapiens
cggtgatcagcagag

SEQ ID NO: 6104129 - DNA, 23 bp, Homo sapiens
cggtgatgccttccgacaccact

SEQ ID NO: 6104130 - DNA, 16 bp, Homo sapiens
cggtgcacaggcctct

SEQ ID NO: 6104131 - DNA, 17 bp, Homo sapiens
cggtgcacaggcctctg

SEQ ID NO: 6104132 - DNA, 22 bp, Homo sapiens
cggtgcacaggcctctgcctgc

SEQ ID NO: 6104133 - DNA, 23 bp, Homo sapiens
cggtgcacaggcctctgcctgct

SEQ ID NO: 6104134 - DNA, 13 bp, Homo sapiens
cggtgcagcctct

SEQ ID NO: 6104135 - DNA, 23 bp, Homo sapiens
cggtgcagcctctaactcctggg

SEQ ID NO: 6104136 - DNA, 23 bp, Homo sapiens
cggtgcagcggtggaaggagcct

SEQ ID NO: 6104137 - DNA, 17 bp, Homo sapiens
cggtgcagctgaggttc

SEQ ID NO: 6104138 - DNA, 17 bp, Homo sapiens
cggtgcagggcctggca

SEQ ID NO: 6104139 - DNA, 18 bp, Homo sapiens
cggtgcagggcctggcat

SEQ ID NO: 6104140 - DNA, 13 bp, Homo sapiens
cggtgcagtctgg

SEQ ID NO: 6104141 - DNA, 23 bp, Homo sapiens
cggtgcatacacccccacctcct

SEQ ID NO: 6104142 - DNA, 18 bp, Homo sapiens
cggtgcatccacgcacac

SEQ ID NO: 6104143 - DNA, 15 bp, Homo sapiens
cggtgcatctggcac

SEQ ID NO: 6104144 - DNA, 17 bp, Homo sapiens
cggtgccaaacccagcc

SEQ ID NO: 6104145 - DNA, 16 bp, Homo sapiens
cggtgccaagggcccc

SEQ ID NO: 6104146 - DNA, 17 bp, Homo sapiens
cggtgccaggttttctg

SEQ ID NO: 6104147 - DNA, 17 bp, Homo sapiens
cggtgccatgaagggac

SEQ ID NO: 6104148 - DNA, 23 bp, Homo sapiens
cggtgcccaaacaccagtcacct

SEQ ID NO: 6104149 - DNA, 15 bp, Homo sapiens
cggtgcccaagccag

SEQ ID NO: 6104150 - DNA, 20 bp, Homo sapiens
cggtgcccaagccagaggct

SEQ ID NO: 6104151 - DNA, 12 bp, Homo sapiens
cggtgcccacct

SEQ ID NO: 6104152 - DNA, 16 bp, Homo sapiens
cggtgcctaagaagtt

SEQ ID NO: 6104153 - DNA, 19 bp, Homo sapiens
cggtgcctgggtggccatc

SEQ ID NO: 6104154 - DNA, 21 bp, Homo sapiens
cggtgcctgggtggccatcct

SEQ ID NO: 6104155 - DNA, 20 bp, Homo sapiens
cggtgcctgggtggggctgc

SEQ ID NO: 6104156 - DNA, 11 bp, Homo sapiens
cggtgcctggt

SEQ ID NO: 6104157 - DNA, 23 bp, Homo sapiens
cggtgccttccaccctgccctgg

SEQ ID NO: 6104158 - DNA, 20 bp, Homo sapiens
cggtgcgcacaccgccagca

SEQ ID NO: 6104159 - DNA, 17 bp, Homo sapiens
cggtgcgtggctgtggc

SEQ ID NO: 6104160 - DNA, 24 bp, Homo sapiens
cggtgcgtggctgtggcacagact

SEQ ID NO: 6104161 - DNA, 15 bp, Homo sapiens
cggtgcgttctcctg

SEQ ID NO: 6104162 - DNA, 22 bp, Homo sapiens
cggtgctatctcccccagcccc

SEQ ID NO: 6104163 - DNA, 23 bp, Homo sapiens
cggtgctatctcccccagcccca

SEQ ID NO: 6104164 - DNA, 22 bp, Homo sapiens
cggtgctcactcccaagggaca

SEQ ID NO: 6104165 - DNA, 14 bp, Homo sapiens
cggtgctccaggca

SEQ ID NO: 6104166 - DNA, 15 bp, Homo sapiens
cggtgctccaggcag

SEQ ID NO: 6104167 - DNA, 23 bp, Homo sapiens
cggtgctccatctccgcctccac

SEQ ID NO: 6104168 - DNA, 22 bp, Homo sapiens
cggtgctcgcttctcctccagg

SEQ ID NO: 6104169 - DNA, 12 bp, Homo sapiens
cggtgctctggc

SEQ ID NO: 6104170 - DNA, 17 bp, Homo sapiens
cctgatgatttttattt

SEQ ID NO: 6104171 - DNA, 13 bp, Homo sapiens
cctgatgcagcct

SEQ ID NO: 6104172 - DNA, 22 bp, Homo sapiens
cctgatgcaggtcagcccatgg

SEQ ID NO: 6104173 - DNA, 16 bp, Homo sapiens
cctgatgcccctgaca

SEQ ID NO: 6104174 - DNA, 20 bp, Homo sapiens
cctgatgcgtctacccagac

SEQ ID NO: 6104175 - DNA, 22 bp, Homo sapiens
cctgatgcgtctacccagactc

SEQ ID NO: 6104176 - DNA, 13 bp, Homo sapiens
cctgatgctgaca

SEQ ID NO: 6104177 - DNA, 20 bp, Homo sapiens
cctgatgcttcttcagagac

SEQ ID NO: 6104178 - DNA, 22 bp, Homo sapiens
cctgatgcttcttcagagactc

SEQ ID NO: 6104179 - DNA, 19 bp, Homo sapiens
cctgatgcttttgtctaat

SEQ ID NO: 6104180 - DNA, 21 bp, Homo sapiens
cctgatggaagtaaagcctca

SEQ ID NO: 6104181 - DNA, 13 bp, Homo sapiens
cctgatggaccct

SEQ ID NO: 6104182 - DNA, 14 bp, Homo sapiens
cctgatggaccctc

SEQ ID NO: 6104183 - DNA, 18 bp, Homo sapiens
cctgatggacctgccccg

SEQ ID NO: 6104184 - DNA, 14 bp, Homo sapiens
cctgatggagagga

SEQ ID NO: 6104185 - DNA, 13 bp, Homo sapiens
cctgatggagagt

SEQ ID NO: 6104186 - DNA, 15 bp, Homo sapiens
cctgatggccaggcc

SEQ ID NO: 6104187 - DNA, 18 bp, Homo sapiens
cctgatggcctttggacc

SEQ ID NO: 6104188 - DNA, 21 bp, Homo sapiens
cctgatggcctttggacccag

SEQ ID NO: 6104189 - DNA, 21 bp, Homo sapiens
cctgatggtacaggaaagctc

SEQ ID NO: 6104190 - DNA, 18 bp, Homo sapiens
cctgatggtcagctccct

SEQ ID NO: 6104191 - DNA, 21 bp, Homo sapiens
cctgatggtcagctcccttct

SEQ ID NO: 6104192 - DNA, 18 bp, Homo sapiens
cctgatggtgctgctcag

SEQ ID NO: 6104193 - DNA, 22 bp, Homo sapiens
cctgatggtgtcattctgcctg

SEQ ID NO: 6104194 - DNA, 17 bp, Homo sapiens
cctgatgtcagctgctg

SEQ ID NO: 6104195 - DNA, 17 bp, Homo sapiens
cctgatgtgggagctga

SEQ ID NO: 6104196 - DNA, 17 bp, Homo sapiens
cctgatgttaaaattcc

SEQ ID NO: 6104197 - DNA, 14 bp, Homo sapiens
cctgatgtttttcc

SEQ ID NO: 6104198 - DNA, 15 bp, Homo sapiens
cctgatgtttttctg

SEQ ID NO: 6104199 - DNA, 19 bp, Homo sapiens
cctgatgtttttctgtgtt

SEQ ID NO: 6104200 - DNA, 12 bp, Homo sapiens
cctgattaaaga

SEQ ID NO: 6104201 - DNA, 13 bp, Homo sapiens
cctgattaaagaa

SEQ ID NO: 6104202 - DNA, 20 bp, Homo sapiens
cctgattaaagtgccttcag

SEQ ID NO: 6104203 - DNA, 13 bp, Homo sapiens
cctgattaaatgt

SEQ ID NO: 6104204 - DNA, 22 bp, Homo sapiens
cctgattaatatgtgggaatta

SEQ ID NO: 6104205 - DNA, 18 bp, Homo sapiens
cctgattattttagctaa

SEQ ID NO: 6104206 - DNA, 19 bp, Homo sapiens
cctgattcactgcctatga

SEQ ID NO: 6104207 - DNA, 16 bp, Homo sapiens
cctgattcactggcct

SEQ ID NO: 6104208 - DNA, 21 bp, Homo sapiens
cctgattcatactccttttgg

SEQ ID NO: 6104209 - DNA, 16 bp, Homo sapiens
cctgattcatatttaa

SEQ ID NO: 6104210 - DNA, 20 bp, Homo sapiens
cctgattcggggctgacctt

SEQ ID NO: 6104211 - DNA, 14 bp, Homo sapiens
cctgattctccctg

SEQ ID NO: 6104212 - DNA, 16 bp, Homo sapiens
cctgattctccctggt

SEQ ID NO: 6104213 - DNA, 13 bp, Homo sapiens
cctgattcttgat

SEQ ID NO: 6104214 - DNA, 22 bp, Homo sapiens
cctgattcttgattcctggctc

SEQ ID NO: 6104215 - DNA, 13 bp, Homo sapiens
cctgattgacctg

SEQ ID NO: 6104216 - DNA, 14 bp, Homo sapiens
cctgattgatcaca

SEQ ID NO: 6104217 - DNA, 23 bp, Homo sapiens
cctgattgctctggaagcctgct

SEQ ID NO: 6104218 - DNA, 14 bp, Homo sapiens
cctgattggccact

SEQ ID NO: 6104219 - DNA, 14 bp, Homo sapiens
cctgattggggcct

SEQ ID NO: 6104220 - DNA, 20 bp, Homo sapiens
cctgattgtgtatattcata

SEQ ID NO: 6104221 - DNA, 17 bp, Homo sapiens
cctgatttacagtttca

SEQ ID NO: 6104222 - DNA, 20 bp, Homo sapiens
cctgatttacagtttcaaaa

SEQ ID NO: 6104223 - DNA, 18 bp, Homo sapiens
cctgatttaggagaagcc

SEQ ID NO: 6104224 - DNA, 19 bp, Homo sapiens
cctgatttaggagaagcca

SEQ ID NO: 6104225 - DNA, 22 bp, Homo sapiens
cctgatttattgaaatttttct

SEQ ID NO: 6104226 - DNA, 22 bp, Homo sapiens
cctgatttcagcacaataaata

SEQ ID NO: 6104227 - DNA, 14 bp, Homo sapiens
cctgatttcaggga

SEQ ID NO: 6104228 - DNA, 16 bp, Homo sapiens
cctgatttcagggaaa

SEQ ID NO: 6104229 - DNA, 21 bp, Homo sapiens
cctgatttcttattgaatttg

SEQ ID NO: 6104230 - DNA, 15 bp, Homo sapiens
cctgatttcttcagg

SEQ ID NO: 6104231 - DNA, 17 bp, Homo sapiens
cctgatttgctgggcag

SEQ ID NO: 6104232 - DNA, 18 bp, Homo sapiens
cctgatttggtacttttg

SEQ ID NO: 6104233 - DNA, 18 bp, Homo sapiens
cctgattttaattgtgaa

SEQ ID NO: 6104234 - DNA, 11 bp, Homo sapiens
cctgatttttc

SEQ ID NO: 6104235 - DNA, 16 bp, Homo sapiens
cctgattttttttcct

SEQ ID NO: 6104236 - DNA, 15 bp, Homo sapiens
cctgcaaaaaatact

SEQ ID NO: 6104237 - DNA, 16 bp, Homo sapiens
cctgcaaaaacccttg

SEQ ID NO: 6104238 - DNA, 21 bp, Homo sapiens
cctgcaaaaatataaccatta

SEQ ID NO: 6104239 - DNA, 22 bp, Homo sapiens
cctgcaaaaattcagagtcctt

SEQ ID NO: 6104240 - DNA, 21 bp, Homo sapiens
cctgcaaaactccaggcagga

SEQ ID NO: 6104241 - DNA, 21 bp, Homo sapiens
cctgcaaaattacctacccca

SEQ ID NO: 6104242 - DNA, 19 bp, Homo sapiens
cctgcaaacagaacagggt

SEQ ID NO: 6104243 - DNA, 16 bp, Homo sapiens
cctgcaaacctgctgg

SEQ ID NO: 6104244 - DNA, 16 bp, Homo sapiens
cctgcaaacgctgcct

SEQ ID NO: 6104245 - DNA, 17 bp, Homo sapiens
cctgcaaacgctgcctg

SEQ ID NO: 6104246 - DNA, 16 bp, Homo sapiens
cctgcaaactcactgc

SEQ ID NO: 6104247 - DNA, 16 bp, Homo sapiens
cctgcaaactgggaac

SEQ ID NO: 6104248 - DNA, 20 bp, Homo sapiens
cctgcaaactgggaacccct

SEQ ID NO: 6104249 - DNA, 22 bp, Homo sapiens
cctgcaaactgggaaccccttt

SEQ ID NO: 6104250 - DNA, 14 bp, Homo sapiens
cctgcaaaggccct

SEQ ID NO: 6104251 - DNA, 23 bp, Homo sapiens
cctgcaaaggcccttgtcattgc

SEQ ID NO: 6104252 - DNA, 20 bp, Homo sapiens
cctgcaaccaaactcccatc

SEQ ID NO: 6104253 - DNA, 22 bp, Homo sapiens
cctgcaaccaaactcccatcag

SEQ ID NO: 6104254 - DNA, 22 bp, Homo sapiens
cctgcaaccactctgtggccag

SEQ ID NO: 6104255 - DNA, 15 bp, Homo sapiens
cctgcaactcagccc

SEQ ID NO: 6104256 - DNA, 16 bp, Homo sapiens
cctgcaactcagcccc

SEQ ID NO: 6104257 - DNA, 17 bp, Homo sapiens
cctgcaagaagcgccga

SEQ ID NO: 6104258 - DNA, 20 bp, Homo sapiens
cctgcaagacacaggctcag

SEQ ID NO: 6104259 - DNA, 21 bp, Homo sapiens
cctgcaagagtgggctttcca

SEQ ID NO: 6104260 - DNA, 15 bp, Homo sapiens
cctgcaagatggaca

SEQ ID NO: 6104261 - DNA, 21 bp, Homo sapiens
cctgcaagatggacacgagcc

SEQ ID NO: 6104262 - DNA, 15 bp, Homo sapiens
cctgcaagccccagg

SEQ ID NO: 6104263 - DNA, 17 bp, Homo sapiens
cctgcaagccccagggc

SEQ ID NO: 6104264 - DNA, 21 bp, Homo sapiens
cctgcaagcctgtctgagact

SEQ ID NO: 6104265 - DNA, 17 bp, Homo sapiens
cctgcaagccttctaaa

SEQ ID NO: 6104266 - DNA, 20 bp, Homo sapiens
cctgcaagctccgcctcccg

SEQ ID NO: 6104267 - DNA, 12 bp, Homo sapiens
cctgcaaggact

SEQ ID NO: 6104268 - DNA, 14 bp, Homo sapiens
cctgcaaggcccac

SEQ ID NO: 6104269 - DNA, 16 bp, Homo sapiens
cctgcaaggcccacag

SEQ ID NO: 6104270 - DNA, 19 bp, Homo sapiens
cctgcaaggcccacaggag

SEQ ID NO: 6104271 - DNA, 20 bp, Homo sapiens
cctgcaagggctccccactg

SEQ ID NO: 6104272 - DNA, 17 bp, Homo sapiens
cctgcaagtcagtccag

SEQ ID NO: 6104273 - DNA, 14 bp, Homo sapiens
cctgcaagtgcccg

SEQ ID NO: 6104274 - DNA, 16 bp, Homo sapiens
cctgcaagtgcccgcc

SEQ ID NO: 6104275 - DNA, 19 bp, Homo sapiens
cctgcaagtgcccgccctg

SEQ ID NO: 6104276 - DNA, 20 bp, Homo sapiens
cctgcaagtgcccgccctgc

SEQ ID NO: 6104277 - DNA, 21 bp, Homo sapiens
cctgcaagtgcccgccctgcc

SEQ ID NO: 6104278 - DNA, 17 bp, Homo sapiens
cctgcaagtggacgtgg

SEQ ID NO: 6104279 - DNA, 15 bp, Homo sapiens
cctgcaagttgctct

SEQ ID NO: 6104280 - DNA, 16 bp, Homo sapiens
cctgcaagttgctctg

SEQ ID NO: 6104281 - DNA, 15 bp, Homo sapiens
cctgcaatcactttt

SEQ ID NO: 6104282 - DNA, 14 bp, Homo sapiens
cctgcaatcccagc

SEQ ID NO: 6104283 - DNA, 16 bp, Homo sapiens
cctgcaatctccaggg

SEQ ID NO: 6104284 - DNA, 17 bp, Homo sapiens
cctgcaatctccagggc

SEQ ID NO: 6104285 - DNA, 20 bp, Homo sapiens
cctgcaatctccagggctgc

SEQ ID NO: 6104286 - DNA, 19 bp, Homo sapiens
cctgcaatgaagtctctga

SEQ ID NO: 6104287 - DNA, 22 bp, Homo sapiens
cctgcaatgcgtcttgtgaaat

SEQ ID NO: 6104288 - DNA, 19 bp, Homo sapiens
cctgcaatgtatcccttct

SEQ ID NO: 6104289 - DNA, 16 bp, Homo sapiens
cctgcaattctacagt

SEQ ID NO: 6104290 - DNA, 12 bp, Homo sapiens
cctgcacaaaca

SEQ ID NO: 6104291 - DNA, 17 bp, Homo sapiens
cctgcacaaacatagac

SEQ ID NO: 6104292 - DNA, 19 bp, Homo sapiens
cctgcacaataaaaatgtt

SEQ ID NO: 6104293 - DNA, 12 bp, Homo sapiens
cctgcacacaag

SEQ ID NO: 6104294 - DNA, 12 bp, Homo sapiens
cctgcacacacc

SEQ ID NO: 6104295 - DNA, 23 bp, Homo sapiens
cctgcacacagagtgagggagga

SEQ ID NO: 6104296 - DNA, 16 bp, Homo sapiens
cctgcacacaggacag

SEQ ID NO: 6104297 - DNA, 17 bp, Homo sapiens
cctgcacacaggacagc

SEQ ID NO: 6104298 - DNA, 13 bp, Homo sapiens
cctgcacacaggg

SEQ ID NO: 6104299 - DNA, 17 bp, Homo sapiens
cctgcacacagggcagt

SEQ ID NO: 6104300 - DNA, 16 bp, Homo sapiens
cctgcacacccctgca

SEQ ID NO: 6104301 - DNA, 17 bp, Homo sapiens
cctgcacaccctgggcc

SEQ ID NO: 6104302 - DNA, 19 bp, Homo sapiens
cctgcacaccctgggccac

SEQ ID NO: 6104303 - DNA, 20 bp, Homo sapiens
cctgcacaccctgggccacg

SEQ ID NO: 6104304 - DNA, 23 bp, Homo sapiens
cctgcacaccgtccctctccccg

SEQ ID NO: 6104305 - DNA, 16 bp, Homo sapiens
cctgcacacggcacag

SEQ ID NO: 6104306 - DNA, 13 bp, Homo sapiens
cctgcacactcca

SEQ ID NO: 6104307 - DNA, 17 bp, Homo sapiens
cctgcacagatacctca

SEQ ID NO: 6104308 - DNA, 19 bp, Homo sapiens
cctgcacagatacctcatc

SEQ ID NO: 6104309 - DNA, 20 bp, Homo sapiens
cctgcacagatacctcatca

SEQ ID NO: 6104310 - DNA, 20 bp, Homo sapiens
cctgcacagattcccaggcc

SEQ ID NO: 6104311 - DNA, 23 bp, Homo sapiens
cctgcacagattcccaggccagg

SEQ ID NO: 6104312 - DNA, 21 bp, Homo sapiens
cctgcacagcaggctgccagt

SEQ ID NO: 6104313 - DNA, 16 bp, Homo sapiens
cctgcacagcctctag

SEQ ID NO: 6104314 - DNA, 22 bp, Homo sapiens
cctgcacaggcttgctgtatga

SEQ ID NO: 6104315 - DNA, 21 bp, Homo sapiens
cctgcacaggtggctgtttct

SEQ ID NO: 6104316 - DNA, 20 bp, Homo sapiens
cctgcacagtggtccagggt

SEQ ID NO: 6104317 - DNA, 19 bp, Homo sapiens
cctgcacagtgtcccccag

SEQ ID NO: 6104318 - DNA, 15 bp, Homo sapiens
cctgcacataaactc

SEQ ID NO: 6104319 - DNA, 22 bp, Homo sapiens
cctgcacatcatgagccttcag

SEQ ID NO: 6104320 - DNA, 23 bp, Homo sapiens
cctgcacattgggtggggctcct

SEQ ID NO: 6104321 - DNA, 13 bp, Homo sapiens
cctgcacattgtt

SEQ ID NO: 6104322 - DNA, 16 bp, Homo sapiens
cctgcacccacccctg

SEQ ID NO: 6104323 - DNA, 21 bp, Homo sapiens
cctgcacccacccctgcccag

SEQ ID NO: 6104324 - DNA, 23 bp, Homo sapiens
cctgcacccacccctgcccaggc

SEQ ID NO: 6104325 - DNA, 13 bp, Homo sapiens
cctgcacccgtac

SEQ ID NO: 6104326 - DNA, 16 bp, Homo sapiens
cctgcaccctcctagg

SEQ ID NO: 6104327 - DNA, 17 bp, Homo sapiens
cctgcaccctctgctat

SEQ ID NO: 6104328 - DNA, 14 bp, Homo sapiens
cctgcaccctcttc

SEQ ID NO: 6104329 - DNA, 23 bp, Homo sapiens
cctgcaccctcttctcctctggc

SEQ ID NO: 6104330 - DNA, 12 bp, Homo sapiens
cctgcaccctgg

SEQ ID NO: 6104331 - DNA, 20 bp, Homo sapiens
cctgcaccctggaaagggga

SEQ ID NO: 6104332 - DNA, 13 bp, Homo sapiens
cctgcacccttcc

SEQ ID NO: 6104333 - DNA, 14 bp, Homo sapiens
cctgcacccttcca

SEQ ID NO: 6104334 - DNA, 17 bp, Homo sapiens
cctgcacccttccctct

SEQ ID NO: 6104335 - DNA, 19 bp, Homo sapiens
cctgcacccttccctcttc

SEQ ID NO: 6104336 - DNA, 15 bp, Homo sapiens
cctgcacccttcctc

SEQ ID NO: 6104337 - DNA, 19 bp, Homo sapiens
cctgcacccttcctcctcc

SEQ ID NO: 6104338 - DNA, 22 bp, Homo sapiens
cctgcaccgaccccgggccgga

SEQ ID NO: 6104339 - DNA, 20 bp, Homo sapiens
cctgcaccgacccgaggccc

SEQ ID NO: 6104340 - DNA, 22 bp, Homo sapiens
cctgcaccgacccgaggcccag

SEQ ID NO: 6104341 - DNA, 19 bp, Homo sapiens
cctgcaccgccgcagaagc

SEQ ID NO: 6104342 - DNA, 23 bp, Homo sapiens
cctgcaccgccgcagaagcagcc

SEQ ID NO: 6104343 - DNA, 20 bp, Homo sapiens
cctgcacctccccccactgc

SEQ ID NO: 6104344 - DNA, 22 bp, Homo sapiens
cctgcacctccccccactgcag

SEQ ID NO: 6104345 - DNA, 12 bp, Homo sapiens
cctgcacctctc

SEQ ID NO: 6104346 - DNA, 13 bp, Homo sapiens
cctgcacctctgg

SEQ ID NO: 6104347 - DNA, 13 bp, Homo sapiens
cggtgctctggcg

SEQ ID NO: 6104348 - DNA, 15 bp, Homo sapiens
cggtgctctggcggc

SEQ ID NO: 6104349 - DNA, 22 bp, Homo sapiens
cggtgctgaacgacagtcccag

SEQ ID NO: 6104350 - DNA, 18 bp, Homo sapiens
cggtgctgggggcacagc

SEQ ID NO: 6104351 - DNA, 19 bp, Homo sapiens
cggtgctgggggcacagct

SEQ ID NO: 6104352 - DNA, 22 bp, Homo sapiens
cggtgctgtcctcaggtggcca

SEQ ID NO: 6104353 - DNA, 19 bp, Homo sapiens
cggtgctgtgagggagggg

SEQ ID NO: 6104354 - DNA, 23 bp, Homo sapiens
cggtgcttccaacaaggacagcc

SEQ ID NO: 6104355 - DNA, 14 bp, Homo sapiens
cggtgcttgtgtca

SEQ ID NO: 6104356 - DNA, 20 bp, Homo sapiens
cggtgcttgtgtcactagca

SEQ ID NO: 6104357 - DNA, 21 bp, Homo sapiens
cggtggacttagctctgagga

SEQ ID NO: 6104358 - DNA, 15 bp, Homo sapiens
cggtggaggccaggg

SEQ ID NO: 6104359 - DNA, 17 bp, Homo sapiens
cggtggcatgcatggag

SEQ ID NO: 6104360 - DNA, 19 bp, Homo sapiens
cggtggcatgcatggagga

SEQ ID NO: 6104361 - DNA, 19 bp, Homo sapiens
cggtggccacagcgtgctg

SEQ ID NO: 6104362 - DNA, 13 bp, Homo sapiens
cggtggccatgct

SEQ ID NO: 6104363 - DNA, 20 bp, Homo sapiens
cggtggccatgcttcttgcc

SEQ ID NO: 6104364 - DNA, 21 bp, Homo sapiens
cggtggccatgcttcttgccc

SEQ ID NO: 6104365 - DNA, 16 bp, Homo sapiens
cggtggcggcagggcc

SEQ ID NO: 6104366 - DNA, 22 bp, Homo sapiens
cggtggctaaaggtcccaaggc

SEQ ID NO: 6104367 - DNA, 14 bp, Homo sapiens
cggtggctgccccg

SEQ ID NO: 6104368 - DNA, 17 bp, Homo sapiens
cggtggctgccccggcc

SEQ ID NO: 6104369 - DNA, 13 bp, Homo sapiens
cggtggctgcctt

SEQ ID NO: 6104370 - DNA, 16 bp, Homo sapiens
cggtgggaaggaaagg

SEQ ID NO: 6104371 - DNA, 16 bp, Homo sapiens
cggtgggacagcccca

SEQ ID NO: 6104372 - DNA, 19 bp, Homo sapiens
cggtgggaccctgtccggc

SEQ ID NO: 6104373 - DNA, 18 bp, Homo sapiens
cggtgggcacccaccctg

SEQ ID NO: 6104374 - DNA, 14 bp, Homo sapiens
cggtgggcactgtt

SEQ ID NO: 6104375 - DNA, 12 bp, Homo sapiens
cggtgggcagtg

SEQ ID NO: 6104376 - DNA, 15 bp, Homo sapiens
cggtgggccagagct

SEQ ID NO: 6104377 - DNA, 15 bp, Homo sapiens
cggtgggccgaggcc

SEQ ID NO: 6104378 - DNA, 23 bp, Homo sapiens
cggtgggcgcctgtcgggcccgc

SEQ ID NO: 6104379 - DNA, 22 bp, Homo sapiens
cggtgggggggagaaggcctcc

SEQ ID NO: 6104380 - DNA, 10 bp, Homo sapiens
cggtgggggt

SEQ ID NO: 6104381 - DNA, 14 bp, Homo sapiens
cggtgggtcacaca

SEQ ID NO: 6104382 - DNA, 14 bp, Homo sapiens
cggtggtgcccgtg

SEQ ID NO: 6104383 - DNA, 17 bp, Homo sapiens
cggtggtgcccgtgccc

SEQ ID NO: 6104384 - DNA, 21 bp, Homo sapiens
cggtggtgcccgtgcccgcag

SEQ ID NO: 6104385 - DNA, 21 bp, Homo sapiens
cggtggttgggtgtgggcagt

SEQ ID NO: 6104386 - DNA, 22 bp, Homo sapiens
cggtggttgttggggcttcttg

SEQ ID NO: 6104387 - DNA, 21 bp, Homo sapiens
cggtggtttgccatgtcgctt

SEQ ID NO: 6104388 - DNA, 18 bp, Homo sapiens
cggtggttttgtgcttta

SEQ ID NO: 6104389 - DNA, 15 bp, Homo sapiens
cggtgtacagtttaa

SEQ ID NO: 6104390 - DNA, 21 bp, Homo sapiens
cggtgtccatttatagaataa

SEQ ID NO: 6104391 - DNA, 15 bp, Homo sapiens
cggtgtccccaccat

SEQ ID NO: 6104392 - DNA, 22 bp, Homo sapiens
cggtgtccccaccatctgctgt

SEQ ID NO: 6104393 - DNA, 11 bp, Homo sapiens
cggtgtctctc

SEQ ID NO: 6104394 - DNA, 19 bp, Homo sapiens
cggtgtctgcagctcctgg

SEQ ID NO: 6104395 - DNA, 14 bp, Homo sapiens
cggtgtgctgccaa

SEQ ID NO: 6104396 - DNA, 16 bp, Homo sapiens
cggtgtgctgccaact

SEQ ID NO: 6104397 - DNA, 18 bp, Homo sapiens
cggtgtggactacaggac

SEQ ID NO: 6104398 - DNA, 18 bp, Homo sapiens
cggtgtggagaagcggct

SEQ ID NO: 6104399 - DNA, 17 bp, Homo sapiens
cggtgtggccctgcaag

SEQ ID NO: 6104400 - DNA, 13 bp, Homo sapiens
cggtgtgggggcc

SEQ ID NO: 6104401 - DNA, 21 bp, Homo sapiens
cggtgtggttgggggtgggag

SEQ ID NO: 6104402 - DNA, 22 bp, Homo sapiens
cggtgtggttgggggtgggagg

SEQ ID NO: 6104403 - DNA, 18 bp, Homo sapiens
cggtgttaattttgctaa

SEQ ID NO: 6104404 - DNA, 18 bp, Homo sapiens
cggtgttattccaaggga

SEQ ID NO: 6104405 - DNA, 13 bp, Homo sapiens
cggtgttctaaga

SEQ ID NO: 6104406 - DNA, 14 bp, Homo sapiens
cggtgttgcagaga

SEQ ID NO: 6104407 - DNA, 17 bp, Homo sapiens
cggtgtttggaggctgc

SEQ ID NO: 6104408 - DNA, 21 bp, Homo sapiens
cggtgtttggaggctgctgcc

SEQ ID NO: 6104409 - DNA, 23 bp, Homo sapiens
cggtgtttggaggctgctgcccc

SEQ ID NO: 6104410 - DNA, 19 bp, Homo sapiens
cggtgtttggcaatgctaa

SEQ ID NO: 6104411 - DNA, 17 bp, Homo sapiens
cggttaagaaagcactt

SEQ ID NO: 6104412 - DNA, 21 bp, Homo sapiens
cggttagcgggccgggcgggg

SEQ ID NO: 6104413 - DNA, 20 bp, Homo sapiens
cggttatgaaattcaccccc

SEQ ID NO: 6104414 - DNA, 18 bp, Homo sapiens
cggttattcgcccacccg

SEQ ID NO: 6104415 - DNA, 13 bp, Homo sapiens
cggttcaccagcc

SEQ ID NO: 6104416 - DNA, 16 bp, Homo sapiens
cggttcaccagcctct

SEQ ID NO: 6104417 - DNA, 17 bp, Homo sapiens
cggttcccacaagcctg

SEQ ID NO: 6104418 - DNA, 21 bp, Homo sapiens
cggttccccgcaacccacagc

SEQ ID NO: 6104419 - DNA, 19 bp, Homo sapiens
cggttccctccccagctcc

SEQ ID NO: 6104420 - DNA, 14 bp, Homo sapiens
cggttccctgccta

SEQ ID NO: 6104421 - DNA, 19 bp, Homo sapiens
cggttcctcgttctccctg

SEQ ID NO: 6104422 - DNA, 13 bp, Homo sapiens
cggttcctggtga

SEQ ID NO: 6104423 - DNA, 14 bp, Homo sapiens
cggttcctggtgac

SEQ ID NO: 6104424 - DNA, 19 bp, Homo sapiens
cggttcctggtgactcctg

SEQ ID NO: 6104425 - DNA, 15 bp, Homo sapiens
cggttctaaggctca

SEQ ID NO: 6104426 - DNA, 14 bp, Homo sapiens
cggttgaaacctgt

SEQ ID NO: 6104427 - DNA, 11 bp, Homo sapiens
cggttgcagtc

SEQ ID NO: 6104428 - DNA, 17 bp, Homo sapiens
cggttgcagtcactgtg

SEQ ID NO: 6104429 - DNA, 14 bp, Homo sapiens
cggttgccatggag

SEQ ID NO: 6104430 - DNA, 22 bp, Homo sapiens
cggttgccatggagatctgaag

SEQ ID NO: 6104431 - DNA, 19 bp, Homo sapiens
cggttgcttctggctcctc

SEQ ID NO: 6104432 - DNA, 20 bp, Homo sapiens
cggttggaggctctcatgtc

SEQ ID NO: 6104433 - DNA, 16 bp, Homo sapiens
cggttgggaggcaggt

SEQ ID NO: 6104434 - DNA, 15 bp, Homo sapiens
cggttgtaaatacaa

SEQ ID NO: 6104435 - DNA, 15 bp, Homo sapiens
cggttgtcttgaaac

SEQ ID NO: 6104436 - DNA, 21 bp, Homo sapiens
cggttgttctttcctcacatt

SEQ ID NO: 6104437 - DNA, 14 bp, Homo sapiens
cggtttaactgtcc

SEQ ID NO: 6104438 - DNA, 17 bp, Homo sapiens
cggtttaactgtcccag

SEQ ID NO: 6104439 - DNA, 16 bp, Homo sapiens
cggtttagatgaatgc

SEQ ID NO: 6104440 - DNA, 15 bp, Homo sapiens
cggtttatataagct

SEQ ID NO: 6104441 - DNA, 14 bp, Homo sapiens
cggtttcagaagct

SEQ ID NO: 6104442 - DNA, 18 bp, Homo sapiens
cggtttccaaggtgcaca

SEQ ID NO: 6104443 - DNA, 16 bp, Homo sapiens
cggtttccacttgtgg

SEQ ID NO: 6104444 - DNA, 13 bp, Homo sapiens
cggtttccaggga

SEQ ID NO: 6104445 - DNA, 19 bp, Homo sapiens
cggtttcccatttgttgct

SEQ ID NO: 6104446 - DNA, 19 bp, Homo sapiens
cggtttctagcctctgaga

SEQ ID NO: 6104447 - DNA, 13 bp, Homo sapiens
cggtttctgttct

SEQ ID NO: 6104448 - DNA, 15 bp, Homo sapiens
cggtttgaagcctgg

SEQ ID NO: 6104449 - DNA, 16 bp, Homo sapiens
cggtttgggagaacac

SEQ ID NO: 6104450 - DNA, 14 bp, Homo sapiens
cggtttgggagaga

SEQ ID NO: 6104451 - DNA, 21 bp, Homo sapiens
cggtttggggagcagagacac

SEQ ID NO: 6104452 - DNA, 23 bp, Homo sapiens
cggtttggtttgttgtaaataaa

SEQ ID NO: 6104453 - DNA, 13 bp, Homo sapiens
cggtttgtgagag

SEQ ID NO: 6104454 - DNA, 23 bp, Homo sapiens
cggttttcagctattagcaactg

SEQ ID NO: 6104455 - DNA, 16 bp, Homo sapiens
cggttttcctcagctc

SEQ ID NO: 6104456 - DNA, 13 bp, Homo sapiens
cggtttttattaa

SEQ ID NO: 6104457 - DNA, 15 bp, Homo sapiens
cggttttttcacttc

SEQ ID NO: 6104458 - DNA, 15 bp, Homo sapiens
cggtttttttcctgt

SEQ ID NO: 6104459 - DNA, 23 bp, Homo sapiens
cggtttttttctttggctgcagg

SEQ ID NO: 6104460 - DNA, 22 bp, Homo sapiens
cgtaaaagagataataagatta

SEQ ID NO: 6104461 - DNA, 16 bp, Homo sapiens
cgtaaagctagaaatg

SEQ ID NO: 6104462 - DNA, 16 bp, Homo sapiens
cgtaaagtacttgtag

SEQ ID NO: 6104463 - DNA, 18 bp, Homo sapiens
cgtaaagtacttgtagtt

SEQ ID NO: 6104464 - DNA, 20 bp, Homo sapiens
cgtaaatcatatttccctta

SEQ ID NO: 6104465 - DNA, 19 bp, Homo sapiens
cgtaacagcaggagcatgg

SEQ ID NO: 6104466 - DNA, 15 bp, Homo sapiens
cgtaacagtgtaaag

SEQ ID NO: 6104467 - DNA, 23 bp, Homo sapiens
cgtaaccagccagatcctcttgg

SEQ ID NO: 6104468 - DNA, 23 bp, Homo sapiens
cgtaaccagttttttcacctcca

SEQ ID NO: 6104469 - DNA, 19 bp, Homo sapiens
cgtaacccaactctcctgg

SEQ ID NO: 6104470 - DNA, 14 bp, Homo sapiens
cgtaacggccttga

SEQ ID NO: 6104471 - DNA, 21 bp, Homo sapiens
cgtaacttattatcactttgg

SEQ ID NO: 6104472 - DNA, 22 bp, Homo sapiens
cgtaagaccaccttcccttcct

SEQ ID NO: 6104473 - DNA, 12 bp, Homo sapiens
cgtaaggctgta

SEQ ID NO: 6104474 - DNA, 16 bp, Homo sapiens
cgtaagtacagagaag

SEQ ID NO: 6104475 - DNA, 17 bp, Homo sapiens
cgtaataattattatta

SEQ ID NO: 6104476 - DNA, 15 bp, Homo sapiens
cgtaatagcttctgt

SEQ ID NO: 6104477 - DNA, 15 bp, Homo sapiens
cgtaatcctcctgag

SEQ ID NO: 6104478 - DNA, 17 bp, Homo sapiens
cgtaattatgtaccatg

SEQ ID NO: 6104479 - DNA, 14 bp, Homo sapiens
cgtaattcttattc

SEQ ID NO: 6104480 - DNA, 23 bp, Homo sapiens
cgtaattctttctgtctcccttc

SEQ ID NO: 6104481 - DNA, 12 bp, Homo sapiens
cgtaatttaact

SEQ ID NO: 6104482 - DNA, 16 bp, Homo sapiens
cgtacaaccccctcca

SEQ ID NO: 6104483 - DNA, 19 bp, Homo sapiens
cgtacaaccccctccaccc

SEQ ID NO: 6104484 - DNA, 23 bp, Homo sapiens
cgtacaaccccctccacccccca

SEQ ID NO: 6104485 - DNA, 21 bp, Homo sapiens
cgtacaagtagttctgtattt

SEQ ID NO: 6104486 - DNA, 12 bp, Homo sapiens
cgtacacagaga

SEQ ID NO: 6104487 - DNA, 15 bp, Homo sapiens
cgtacacagagaagg

SEQ ID NO: 6104488 - DNA, 16 bp, Homo sapiens
cgtacacattttattt

SEQ ID NO: 6104489 - DNA, 22 bp, Homo sapiens
cgtacacattttattttattat

SEQ ID NO: 6104490 - DNA, 17 bp, Homo sapiens
cgtacaggctggcgcag

SEQ ID NO: 6104491 - DNA, 22 bp, Homo sapiens
cgtacagttcttcgggaagaga

SEQ ID NO: 6104492 - DNA, 17 bp, Homo sapiens
cgtacattcaatgttta

SEQ ID NO: 6104493 - DNA, 23 bp, Homo sapiens
cgtaccaccatgcactgtaaata

SEQ ID NO: 6104494 - DNA, 12 bp, Homo sapiens
cgtaccagccag

SEQ ID NO: 6104495 - DNA, 17 bp, Homo sapiens
cgtacccagccatgtgt

SEQ ID NO: 6104496 - DNA, 18 bp, Homo sapiens
cgtacccccgtggtcttt

SEQ ID NO: 6104497 - DNA, 22 bp, Homo sapiens
cgtacccccgtggtctttgaat

SEQ ID NO: 6104498 - DNA, 23 bp, Homo sapiens
cgtacccccgtggtctttgaata

SEQ ID NO: 6104499 - DNA, 16 bp, Homo sapiens
cgtaccgcttccttag

SEQ ID NO: 6104500 - DNA, 21 bp, Homo sapiens
cgtacctcttcccatgactgc

SEQ ID NO: 6104501 - DNA, 15 bp, Homo sapiens
cgtacgcccaggaca

SEQ ID NO: 6104502 - DNA, 23 bp, Homo sapiens
cgtactagagggcattgactggt

SEQ ID NO: 6104503 - DNA, 13 bp, Homo sapiens
cgtactcaggagc

SEQ ID NO: 6104504 - DNA, 14 bp, Homo sapiens
cgtactcctcagac

SEQ ID NO: 6104505 - DNA, 18 bp, Homo sapiens
cgtactcggcttcctgtg

SEQ ID NO: 6104506 - DNA, 17 bp, Homo sapiens
cgtactctcacatgtgg

SEQ ID NO: 6104507 - DNA, 13 bp, Homo sapiens
cgtactctctctc

SEQ ID NO: 6104508 - DNA, 15 bp, Homo sapiens
cgtactttcacatct

SEQ ID NO: 6104509 - DNA, 23 bp, Homo sapiens
cgtagagttggcctttttacagg

SEQ ID NO: 6104510 - DNA, 14 bp, Homo sapiens
cgtagatgatttca

SEQ ID NO: 6104511 - DNA, 13 bp, Homo sapiens
cgtagatgctgcc

SEQ ID NO: 6104512 - DNA, 16 bp, Homo sapiens
cgtagatgctgcctag

SEQ ID NO: 6104513 - DNA, 12 bp, Homo sapiens
cgtagccacagg

SEQ ID NO: 6104514 - DNA, 16 bp, Homo sapiens
cgtagccagctgctcc

SEQ ID NO: 6104515 - DNA, 19 bp, Homo sapiens
cgtagccagctgctcccca

SEQ ID NO: 6104516 - DNA, 20 bp, Homo sapiens
cgtagccatctccgtggcca

SEQ ID NO: 6104517 - DNA, 11 bp, Homo sapiens
cgtagcctggg

SEQ ID NO: 6104518 - DNA, 20 bp, Homo sapiens
cgtagcggttggtgacttgt

SEQ ID NO: 6104519 - DNA, 13 bp, Homo sapiens
cgtagctctctta

SEQ ID NO: 6104520 - DNA, 14 bp, Homo sapiens
cgtagctctgctgc

SEQ ID NO: 6104521 - DNA, 17 bp, Homo sapiens
cgtagctctgctgctga

SEQ ID NO: 6104522 - DNA, 13 bp, Homo sapiens
cgtagctgccagt

SEQ ID NO: 6104523 - DNA, 22 bp, Homo sapiens
cgtagcttctaccatgaacaga

SEQ ID NO: 6104524 - DNA, 21 bp, Homo sapiens
cgtaggatgaaaagattcttc

SEQ ID NO: 6104525 - DNA, 20 bp, Homo sapiens
cgtaggcagccacggccccg

SEQ ID NO: 6104526 - DNA, 12 bp, Homo sapiens
cctgcacctgcc

SEQ ID NO: 6104527 - DNA, 15 bp, Homo sapiens
cctgcacctgccccg

SEQ ID NO: 6104528 - DNA, 16 bp, Homo sapiens
cctgcacctgccccgt

SEQ ID NO: 6104529 - DNA, 12 bp, Homo sapiens
cctgcacctgct

SEQ ID NO: 6104530 - DNA, 16 bp, Homo sapiens
cctgcacctgctgcgt

SEQ ID NO: 6104531 - DNA, 17 bp, Homo sapiens
cctgcacctgcttctca

SEQ ID NO: 6104532 - DNA, 14 bp, Homo sapiens
cctgcacctggcct

SEQ ID NO: 6104533 - DNA, 16 bp, Homo sapiens
cctgcacggtgggcct

SEQ ID NO: 6104534 - DNA, 17 bp, Homo sapiens
cctgcacggtgggcctt

SEQ ID NO: 6104535 - DNA, 18 bp, Homo sapiens
cctgcacggtgggccttg

SEQ ID NO: 6104536 - DNA, 20 bp, Homo sapiens
cctgcacggtgggccttgct

SEQ ID NO: 6104537 - DNA, 21 bp, Homo sapiens
cctgcacggtgggccttgctg

SEQ ID NO: 6104538 - DNA, 22 bp, Homo sapiens
cctgcacggtgggccttgctgg

SEQ ID NO: 6104539 - DNA, 23 bp, Homo sapiens
cctgcacggtgggccttgctggg

SEQ ID NO: 6104540 - DNA, 18 bp, Homo sapiens
cctgcacgtatacaccca

SEQ ID NO: 6104541 - DNA, 18 bp, Homo sapiens
cctgcacgtcatgggagg

SEQ ID NO: 6104542 - DNA, 15 bp, Homo sapiens
cctgcacgttcataa

SEQ ID NO: 6104543 - DNA, 17 bp, Homo sapiens
cctgcactaacagagtg

SEQ ID NO: 6104544 - DNA, 12 bp, Homo sapiens
cctgcactccag

SEQ ID NO: 6104545 - DNA, 13 bp, Homo sapiens
cctgcactccaga

SEQ ID NO: 6104546 - DNA, 15 bp, Homo sapiens
cctgcactccagaat

SEQ ID NO: 6104547 - DNA, 16 bp, Homo sapiens
cctgcactccatccag

SEQ ID NO: 6104548 - DNA, 21 bp, Homo sapiens
cctgcactccctcctggagct

SEQ ID NO: 6104549 - DNA, 23 bp, Homo sapiens
cctgcactcctcagggcagcctc

SEQ ID NO: 6104550 - DNA, 18 bp, Homo sapiens
cctgcactgaaacctgag

SEQ ID NO: 6104551 - DNA, 18 bp, Homo sapiens
cctgcactgactctggaa

SEQ ID NO: 6104552 - DNA, 15 bp, Homo sapiens
cctgcactggagtcc

SEQ ID NO: 6104553 - DNA, 23 bp, Homo sapiens
cctgcactggagtccagtctctt

SEQ ID NO: 6104554 - DNA, 12 bp, Homo sapiens
cctgcactggga

SEQ ID NO: 6104555 - DNA, 21 bp, Homo sapiens
cctgcactgggaaggaaacaa

SEQ ID NO: 6104556 - DNA, 14 bp, Homo sapiens
cctgcactggggag

SEQ ID NO: 6104557 - DNA, 17 bp, Homo sapiens
cctgcactgtcctgctc

SEQ ID NO: 6104558 - DNA, 14 bp, Homo sapiens
cctgcacttacttg

SEQ ID NO: 6104559 - DNA, 15 bp, Homo sapiens
cctgcacttcatatc

SEQ ID NO: 6104560 - DNA, 18 bp, Homo sapiens
cctgcacttcatcccgga

SEQ ID NO: 6104561 - DNA, 19 bp, Homo sapiens
cctgcacttgcagactcta

SEQ ID NO: 6104562 - DNA, 18 bp, Homo sapiens
cctgcacttgggggctca

SEQ ID NO: 6104563 - DNA, 22 bp, Homo sapiens
cctgcactttgggtttttaact

SEQ ID NO: 6104564 - DNA, 23 bp, Homo sapiens
cctgcactttgggtttttaactc

SEQ ID NO: 6104565 - DNA, 18 bp, Homo sapiens
cctgcagacacctggact

SEQ ID NO: 6104566 - DNA, 22 bp, Homo sapiens
cctgcagaccacactctgcctg

SEQ ID NO: 6104567 - DNA, 14 bp, Homo sapiens
cctgcagaccctgc

SEQ ID NO: 6104568 - DNA, 16 bp, Homo sapiens
cctgcagaccctgcca

SEQ ID NO: 6104569 - DNA, 17 bp, Homo sapiens
cctgcagaccctgccag

SEQ ID NO: 6104570 - DNA, 20 bp, Homo sapiens
cctgcagacctcaagccatc

SEQ ID NO: 6104571 - DNA, 13 bp, Homo sapiens
cctgcagacctgg

SEQ ID NO: 6104572 - DNA, 15 bp, Homo sapiens
cctgcagacctggct

SEQ ID NO: 6104573 - DNA, 16 bp, Homo sapiens
cctgcagacctggctg

SEQ ID NO: 6104574 - DNA, 21 bp, Homo sapiens
cctgcagacctggctgggcct

SEQ ID NO: 6104575 - DNA, 20 bp, Homo sapiens
cctgcagacgtctggccctg

SEQ ID NO: 6104576 - DNA, 16 bp, Homo sapiens
cctgcagagagaagcc

SEQ ID NO: 6104577 - DNA, 12 bp, Homo sapiens
cctgcagagatg

SEQ ID NO: 6104578 - DNA, 19 bp, Homo sapiens
cctgcagagcaataacact

SEQ ID NO: 6104579 - DNA, 20 bp, Homo sapiens
cctgcagagcaataacacta

SEQ ID NO: 6104580 - DNA, 14 bp, Homo sapiens
cctgcagagcacac

SEQ ID NO: 6104581 - DNA, 14 bp, Homo sapiens
cctgcagagcagga

SEQ ID NO: 6104582 - DNA, 12 bp, Homo sapiens
cctgcagaggcc

SEQ ID NO: 6104583 - DNA, 14 bp, Homo sapiens
cctgcagagggcac

SEQ ID NO: 6104584 - DNA, 19 bp, Homo sapiens
cctgcagaggggaaaccag

SEQ ID NO: 6104585 - DNA, 19 bp, Homo sapiens
cctgcagaggtctgtgctg

SEQ ID NO: 6104586 - DNA, 22 bp, Homo sapiens
cctgcagaggtctgtgctgagg

SEQ ID NO: 6104587 - DNA, 21 bp, Homo sapiens
cctgcagatgccaccctagcc

SEQ ID NO: 6104588 - DNA, 23 bp, Homo sapiens
cctgcagattctgagcaaaggcc

SEQ ID NO: 6104589 - DNA, 21 bp, Homo sapiens
cctgcagcaaacactccaccc

SEQ ID NO: 6104590 - DNA, 12 bp, Homo sapiens
cctgcagcacat

SEQ ID NO: 6104591 - DNA, 22 bp, Homo sapiens
cctgcagcacatgcgggctcgc

SEQ ID NO: 6104592 - DNA, 23 bp, Homo sapiens
cctgcagcacggacaataaacct

SEQ ID NO: 6104593 - DNA, 22 bp, Homo sapiens
cctgcagcactttttccttctg

SEQ ID NO: 6104594 - DNA, 23 bp, Homo sapiens
cctgcagcaggaatatatgtgtg

SEQ ID NO: 6104595 - DNA, 14 bp, Homo sapiens
cctgcagcaggcag

SEQ ID NO: 6104596 - DNA, 20 bp, Homo sapiens
cctgcagccaaacagagcct

SEQ ID NO: 6104597 - DNA, 16 bp, Homo sapiens
cctgcagccagaaagg

SEQ ID NO: 6104598 - DNA, 17 bp, Homo sapiens
cctgcagccagaaagga

SEQ ID NO: 6104599 - DNA, 13 bp, Homo sapiens
cctgcagccagct

SEQ ID NO: 6104600 - DNA, 13 bp, Homo sapiens
cctgcagccagga

SEQ ID NO: 6104601 - DNA, 15 bp, Homo sapiens
cctgcagccagggct

SEQ ID NO: 6104602 - DNA, 22 bp, Homo sapiens
cctgcagcccaaaacccagggc

SEQ ID NO: 6104603 - DNA, 12 bp, Homo sapiens
cctgcagcccag

SEQ ID NO: 6104604 - DNA, 15 bp, Homo sapiens
cctgcagcccaggcc

SEQ ID NO: 6104605 - DNA, 17 bp, Homo sapiens
cctgcagccccagaaga

SEQ ID NO: 6104606 - DNA, 18 bp, Homo sapiens
cctgcagccccaggcctc

SEQ ID NO: 6104607 - DNA, 22 bp, Homo sapiens
cctgcagccccgcgcctccttc

SEQ ID NO: 6104608 - DNA, 14 bp, Homo sapiens
cctgcagcccctaa

SEQ ID NO: 6104609 - DNA, 17 bp, Homo sapiens
cctgcagcccctaagtg

SEQ ID NO: 6104610 - DNA, 22 bp, Homo sapiens
cctgcagcccctcctcctcggg

SEQ ID NO: 6104611 - DNA, 18 bp, Homo sapiens
cctgcagcccgtgtccag

SEQ ID NO: 6104612 - DNA, 17 bp, Homo sapiens
cctgcagccctggccca

SEQ ID NO: 6104613 - DNA, 12 bp, Homo sapiens
cctgcagcctcc

SEQ ID NO: 6104614 - DNA, 16 bp, Homo sapiens
cctgcagcctccccca

SEQ ID NO: 6104615 - DNA, 17 bp, Homo sapiens
cctgcagcctccctccg

SEQ ID NO: 6104616 - DNA, 18 bp, Homo sapiens
cctgcagcctgaccccag

SEQ ID NO: 6104617 - DNA, 24 bp, Homo sapiens
cctgcagcctgagatggatggaca

SEQ ID NO: 6104618 - DNA, 16 bp, Homo sapiens
cctgcagcctgcagga

SEQ ID NO: 6104619 - DNA, 19 bp, Homo sapiens
cctgcagcctgcaggacct

SEQ ID NO: 6104620 - DNA, 17 bp, Homo sapiens
cctgcagcctgggtctg

SEQ ID NO: 6104621 - DNA, 14 bp, Homo sapiens
cctgcagccttttc

SEQ ID NO: 6104622 - DNA, 15 bp, Homo sapiens
cctgcagccttttct

SEQ ID NO: 6104623 - DNA, 22 bp, Homo sapiens
cctgcagcggaagggactctgg

SEQ ID NO: 6104624 - DNA, 18 bp, Homo sapiens
cctgcagctcctctgcct

SEQ ID NO: 6104625 - DNA, 15 bp, Homo sapiens
cctgcagctctcatg

SEQ ID NO: 6104626 - DNA, 21 bp, Homo sapiens
cctgcagctgagattccagaa

SEQ ID NO: 6104627 - DNA, 14 bp, Homo sapiens
cctgcagctggaat

SEQ ID NO: 6104628 - DNA, 20 bp, Homo sapiens
cctgcagctggaatgtgcca

SEQ ID NO: 6104629 - DNA, 12 bp, Homo sapiens
cctgcagcttgt

SEQ ID NO: 6104630 - DNA, 18 bp, Homo sapiens
cctgcagcttgtagccag

SEQ ID NO: 6104631 - DNA, 19 bp, Homo sapiens
cctgcagcttgtagccagc

SEQ ID NO: 6104632 - DNA, 21 bp, Homo sapiens
cctgcagcttgtagccagccg

SEQ ID NO: 6104633 - DNA, 22 bp, Homo sapiens
cctgcaggaaagaaatcagctt

SEQ ID NO: 6104634 - DNA, 17 bp, Homo sapiens
cctgcaggaacgagcac

SEQ ID NO: 6104635 - DNA, 13 bp, Homo sapiens
cctgcaggaagga

SEQ ID NO: 6104636 - DNA, 17 bp, Homo sapiens
cctgcaggaaggagctg

SEQ ID NO: 6104637 - DNA, 20 bp, Homo sapiens
cctgcaggaaggagctgcct

SEQ ID NO: 6104638 - DNA, 23 bp, Homo sapiens
cctgcaggaaggagctgcctgga

SEQ ID NO: 6104639 - DNA, 21 bp, Homo sapiens
cctgcaggaccctgtcctgca

SEQ ID NO: 6104640 - DNA, 17 bp, Homo sapiens
cctgcaggacctcgtgc

SEQ ID NO: 6104641 - DNA, 22 bp, Homo sapiens
cctgcaggactctatccctggc

SEQ ID NO: 6104642 - DNA, 20 bp, Homo sapiens
cctgcaggagagagcagcac

SEQ ID NO: 6104643 - DNA, 23 bp, Homo sapiens
cctgcaggagagagcagcactcc

SEQ ID NO: 6104644 - DNA, 15 bp, Homo sapiens
cctgcaggagcaggg

SEQ ID NO: 6104645 - DNA, 17 bp, Homo sapiens
cctgcaggagcagggcg

SEQ ID NO: 6104646 - DNA, 15 bp, Homo sapiens
cctgcaggaggcctg

SEQ ID NO: 6104647 - DNA, 17 bp, Homo sapiens
cctgcaggaggcctggg

SEQ ID NO: 6104648 - DNA, 20 bp, Homo sapiens
cctgcaggaggcctgggagg

SEQ ID NO: 6104649 - DNA, 20 bp, Homo sapiens
cctgcaggcacagaggaggt

SEQ ID NO: 6104650 - DNA, 14 bp, Homo sapiens
cctgcaggcagcca

SEQ ID NO: 6104651 - DNA, 16 bp, Homo sapiens
cctgcaggcagccagg

SEQ ID NO: 6104652 - DNA, 19 bp, Homo sapiens
cctgcaggcagccaggcca

SEQ ID NO: 6104653 - DNA, 20 bp, Homo sapiens
cctgcaggcagccaggccac

SEQ ID NO: 6104654 - DNA, 21 bp, Homo sapiens
cctgcaggcagccaggccaca

SEQ ID NO: 6104655 - DNA, 23 bp, Homo sapiens
cctgcaggcagccaggccacaag

SEQ ID NO: 6104656 - DNA, 16 bp, Homo sapiens
cctgcaggcaggcaga

SEQ ID NO: 6104657 - DNA, 20 bp, Homo sapiens
cctgcaggcaggtgggggct

SEQ ID NO: 6104658 - DNA, 14 bp, Homo sapiens
cctgcaggccaggc

SEQ ID NO: 6104659 - DNA, 17 bp, Homo sapiens
cctgcaggccaggccag

SEQ ID NO: 6104660 - DNA, 18 bp, Homo sapiens
cctgcaggccaggccagc

SEQ ID NO: 6104661 - DNA, 14 bp, Homo sapiens
cctgcaggccagtc

SEQ ID NO: 6104662 - DNA, 20 bp, Homo sapiens
cctgcaggccagtcccacgg

SEQ ID NO: 6104663 - DNA, 21 bp, Homo sapiens
cctgcaggccagtcccacggc

SEQ ID NO: 6104664 - DNA, 13 bp, Homo sapiens
cctgcaggcccca

SEQ ID NO: 6104665 - DNA, 18 bp, Homo sapiens
cctgcaggccccagccaa

SEQ ID NO: 6104666 - DNA, 15 bp, Homo sapiens
cctgcaggcggggct

SEQ ID NO: 6104667 - DNA, 15 bp, Homo sapiens
cctgcaggctccatg

SEQ ID NO: 6104668 - DNA, 17 bp, Homo sapiens
cctgcaggctccatgca

SEQ ID NO: 6104669 - DNA, 21 bp, Homo sapiens
cctgcaggctccatgcacctc

SEQ ID NO: 6104670 - DNA, 15 bp, Homo sapiens
cctgcaggctggaga

SEQ ID NO: 6104671 - DNA, 19 bp, Homo sapiens
cctgcaggctggagactgg

SEQ ID NO: 6104672 - DNA, 20 bp, Homo sapiens
cctgcaggcttaggtcctca

SEQ ID NO: 6104673 - DNA, 13 bp, Homo sapiens
cctgcagggagca

SEQ ID NO: 6104674 - DNA, 14 bp, Homo sapiens
cctgcagggagcag

SEQ ID NO: 6104675 - DNA, 17 bp, Homo sapiens
cctgcagggagcagcac

SEQ ID NO: 6104676 - DNA, 18 bp, Homo sapiens
cctgcagggagccttctg

SEQ ID NO: 6104677 - DNA, 15 bp, Homo sapiens
cctgcagggccaagc

SEQ ID NO: 6104678 - DNA, 15 bp, Homo sapiens
cctgcagggccatct

SEQ ID NO: 6104679 - DNA, 12 bp, Homo sapiens
cctgcagggcct

SEQ ID NO: 6104680 - DNA, 23 bp, Homo sapiens
cctgcaggggagcacggagccgc

SEQ ID NO: 6104681 - DNA, 23 bp, Homo sapiens
cctgcaggggagggtccaatctc

SEQ ID NO: 6104682 - DNA, 11 bp, Homo sapiens
cctgcaggggg

SEQ ID NO: 6104683 - DNA, 13 bp, Homo sapiens
cctgcagggggag

SEQ ID NO: 6104684 - DNA, 20 bp, Homo sapiens
cctgcagggggaggaggact

SEQ ID NO: 6104685 - DNA, 14 bp, Homo sapiens
cctgcagggtaggg

SEQ ID NO: 6104686 - DNA, 23 bp, Homo sapiens
cctgcagggtagggggcctgagt

SEQ ID NO: 6104687 - DNA, 23 bp, Homo sapiens
cctgcagggtggtgctgggactg

SEQ ID NO: 6104688 - DNA, 20 bp, Homo sapiens
cctgcaggtccggggaggag

SEQ ID NO: 6104689 - DNA, 15 bp, Homo sapiens
cctgcaggtgctgct

SEQ ID NO: 6104690 - DNA, 17 bp, Homo sapiens
cctgcaggttgggccat

SEQ ID NO: 6104691 - DNA, 18 bp, Homo sapiens
cctgcagtactttacctc

SEQ ID NO: 6104692 - DNA, 15 bp, Homo sapiens
cctgcagtcacagct

SEQ ID NO: 6104693 - DNA, 18 bp, Homo sapiens
cctgcagtcacgtgaggc

SEQ ID NO: 6104694 - DNA, 18 bp, Homo sapiens
cctgcagtcagggcccag

SEQ ID NO: 6104695 - DNA, 17 bp, Homo sapiens
cctgcagtcccacactg

SEQ ID NO: 6104696 - DNA, 22 bp, Homo sapiens
cctgcagtcccacactgtgcag

SEQ ID NO: 6104697 - DNA, 15 bp, Homo sapiens
cctgcagtctgtgga

SEQ ID NO: 6104698 - DNA, 19 bp, Homo sapiens
cctgcagtcttctgggctg

SEQ ID NO: 6104699 - DNA, 16 bp, Homo sapiens
cctgcagtgaggggcc

SEQ ID NO: 6104700 - DNA, 17 bp, Homo sapiens
cctgcagtgaggggccc

SEQ ID NO: 6104701 - DNA, 18 bp, Homo sapiens
cctgcagtgaggggccct

SEQ ID NO: 6104702 - DNA, 19 bp, Homo sapiens
cctgcagtgattcagcagg

SEQ ID NO: 6104703 - DNA, 19 bp, Homo sapiens
cctgcagtgttcgcttggc

SEQ ID NO: 6104704 - DNA, 21 bp, Homo sapiens
cgtaggcagcctctctgctat

SEQ ID NO: 6104705 - DNA, 20 bp, Homo sapiens
cgtaggctacagagaagcct

SEQ ID NO: 6104706 - DNA, 14 bp, Homo sapiens
cgtaggggaggggt

SEQ ID NO: 6104707 - DNA, 19 bp, Homo sapiens
cgtagggtggcactgggag

SEQ ID NO: 6104708 - DNA, 17 bp, Homo sapiens
cgtagtagggtcaggcc

SEQ ID NO: 6104709 - DNA, 17 bp, Homo sapiens
cgtagtctcctgggtgt

SEQ ID NO: 6104710 - DNA, 21 bp, Homo sapiens
cgtagtgtagatttgttttgt

SEQ ID NO: 6104711 - DNA, 19 bp, Homo sapiens
cgtagttaacttgaagaaa

SEQ ID NO: 6104712 - DNA, 22 bp, Homo sapiens
cgtataaaagcctgtttaagag

SEQ ID NO: 6104713 - DNA, 15 bp, Homo sapiens
cgtataaatatcagt

SEQ ID NO: 6104714 - DNA, 13 bp, Homo sapiens
cgtataataaaac

SEQ ID NO: 6104715 - DNA, 13 bp, Homo sapiens
cgtataatcttgt

SEQ ID NO: 6104716 - DNA, 17 bp, Homo sapiens
cgtataatgctttctga

SEQ ID NO: 6104717 - DNA, 22 bp, Homo sapiens
cgtataatttagtcccttaaaa

SEQ ID NO: 6104718 - DNA, 14 bp, Homo sapiens
cgtatacacccaga

SEQ ID NO: 6104719 - DNA, 14 bp, Homo sapiens
cgtatacatttgtt

SEQ ID NO: 6104720 - DNA, 22 bp, Homo sapiens
cgtataccgtgccactttccac

SEQ ID NO: 6104721 - DNA, 20 bp, Homo sapiens
cgtatacttaaaatgacaaa

SEQ ID NO: 6104722 - DNA, 20 bp, Homo sapiens
cgtatagaaaaagcacagct

SEQ ID NO: 6104723 - DNA, 16 bp, Homo sapiens
cgtatagaagtcttca

SEQ ID NO: 6104724 - DNA, 19 bp, Homo sapiens
cgtataggatgtcagacaa

SEQ ID NO: 6104725 - DNA, 16 bp, Homo sapiens
cgtataggcatgtaaa

SEQ ID NO: 6104726 - DNA, 18 bp, Homo sapiens
cgtatatataagaaagac

SEQ ID NO: 6104727 - DNA, 17 bp, Homo sapiens
cgtatatctatatatac

SEQ ID NO: 6104728 - DNA, 18 bp, Homo sapiens
cgtatatttcattgaata

SEQ ID NO: 6104729 - DNA, 14 bp, Homo sapiens
cgtatatttctcat

SEQ ID NO: 6104730 - DNA, 14 bp, Homo sapiens
cgtatcacagtgtt

SEQ ID NO: 6104731 - DNA, 21 bp, Homo sapiens
cgtatcaggaaagcatggctc

SEQ ID NO: 6104732 - DNA, 12 bp, Homo sapiens
cgtatgaaaatg

SEQ ID NO: 6104733 - DNA, 21 bp, Homo sapiens
cgtatgaaaatgagttgtgaa

SEQ ID NO: 6104734 - DNA, 19 bp, Homo sapiens
cgtatgcaagtctgtgagt

SEQ ID NO: 6104735 - DNA, 14 bp, Homo sapiens
cgtatgcactccct

SEQ ID NO: 6104736 - DNA, 20 bp, Homo sapiens
cgtatgcactcccttgagga

SEQ ID NO: 6104737 - DNA, 20 bp, Homo sapiens
cgtatgcagtgtagatttta

SEQ ID NO: 6104738 - DNA, 16 bp, Homo sapiens
cgtatgcatgctaaat

SEQ ID NO: 6104739 - DNA, 17 bp, Homo sapiens
cgtatggaatgcttctt

SEQ ID NO: 6104740 - DNA, 15 bp, Homo sapiens
cgtatggctttattt

SEQ ID NO: 6104741 - DNA, 23 bp, Homo sapiens
cgtatgtcggcacgtcccatgtg

SEQ ID NO: 6104742 - DNA, 18 bp, Homo sapiens
cgtatgtctggttctcaa

SEQ ID NO: 6104743 - DNA, 16 bp, Homo sapiens
cgtatgtgtgcaggag

SEQ ID NO: 6104744 - DNA, 17 bp, Homo sapiens
cgtatgtgtgcaggagc

SEQ ID NO: 6104745 - DNA, 17 bp, Homo sapiens
cgtatgttcgttgcagc

SEQ ID NO: 6104746 - DNA, 15 bp, Homo sapiens
cgtattacatttttg

SEQ ID NO: 6104747 - DNA, 15 bp, Homo sapiens
cgtattagttgccaa

SEQ ID NO: 6104748 - DNA, 16 bp, Homo sapiens
cgtattagttgccaat

SEQ ID NO: 6104749 - DNA, 15 bp, Homo sapiens
cgtattggtccagct

SEQ ID NO: 6104750 - DNA, 19 bp, Homo sapiens
cgtattgtgaaatttgtta

SEQ ID NO: 6104751 - DNA, 16 bp, Homo sapiens
cgtatttctccagacc

SEQ ID NO: 6104752 - DNA, 22 bp, Homo sapiens
cgtatttcttttttttaataag

SEQ ID NO: 6104753 - DNA, 22 bp, Homo sapiens
cgtattttaaaagccacataga

SEQ ID NO: 6104754 - DNA, 18 bp, Homo sapiens
cgtcaaagaaaatgccta

SEQ ID NO: 6104755 - DNA, 21 bp, Homo sapiens
cgtcaacgttgtactgtatgt

SEQ ID NO: 6104756 - DNA, 12 bp, Homo sapiens
cgtcaagacatt

SEQ ID NO: 6104757 - DNA, 13 bp, Homo sapiens
cgtcaagacattt

SEQ ID NO: 6104758 - DNA, 15 bp, Homo sapiens
cgtcaagacatttgc

SEQ ID NO: 6104759 - DNA, 14 bp, Homo sapiens
cgtcaaggaaaggg

SEQ ID NO: 6104760 - DNA, 23 bp, Homo sapiens
cgtcaagttgcagatctttttgt

SEQ ID NO: 6104761 - DNA, 15 bp, Homo sapiens
cgtcaatgtgaaata

SEQ ID NO: 6104762 - DNA, 15 bp, Homo sapiens
cgtcacactcttcag

SEQ ID NO: 6104763 - DNA, 19 bp, Homo sapiens
cgtcaccaaggtggcttct

SEQ ID NO: 6104764 - DNA, 14 bp, Homo sapiens
cgtcaccacctctc

SEQ ID NO: 6104765 - DNA, 23 bp, Homo sapiens
cgtcaccagaattagtcctcaca

SEQ ID NO: 6104766 - DNA, 19 bp, Homo sapiens
cgtcaccatccaccttccc

SEQ ID NO: 6104767 - DNA, 21 bp, Homo sapiens
cgtcacccctgtttctggcac

SEQ ID NO: 6104768 - DNA, 16 bp, Homo sapiens
cgtcaccctcctgagc

SEQ ID NO: 6104769 - DNA, 17 bp, Homo sapiens
cgtcaccctcctgagcc

SEQ ID NO: 6104770 - DNA, 16 bp, Homo sapiens
cgtcacccttatttat

SEQ ID NO: 6104771 - DNA, 12 bp, Homo sapiens
cgtcacctcaga

SEQ ID NO: 6104772 - DNA, 15 bp, Homo sapiens
cgtcactccagtgct

SEQ ID NO: 6104773 - DNA, 16 bp, Homo sapiens
cgtcactccagtgctc

SEQ ID NO: 6104774 - DNA, 21 bp, Homo sapiens
cgtcactccagtgctcagctg

SEQ ID NO: 6104775 - DNA, 23 bp, Homo sapiens
cgtcactccagtgctcagctgtg

SEQ ID NO: 6104776 - DNA, 13 bp, Homo sapiens
cgtcactgccaga

SEQ ID NO: 6104777 - DNA, 19 bp, Homo sapiens
cgtcactgcccaccaaagg

SEQ ID NO: 6104778 - DNA, 17 bp, Homo sapiens
cgtcactttatttcatt

SEQ ID NO: 6104779 - DNA, 15 bp, Homo sapiens
cgtcagacttttctt

SEQ ID NO: 6104780 - DNA, 14 bp, Homo sapiens
cgtcagcatcactg

SEQ ID NO: 6104781 - DNA, 22 bp, Homo sapiens
cgtcagcatcactgatgggaat

SEQ ID NO: 6104782 - DNA, 18 bp, Homo sapiens
cgtcagccatcagccatg

SEQ ID NO: 6104783 - DNA, 15 bp, Homo sapiens
cgtcagcctccagcc

SEQ ID NO: 6104784 - DNA, 18 bp, Homo sapiens
cgtcagcctccagcctct

SEQ ID NO: 6104785 - DNA, 13 bp, Homo sapiens
cgtcagcctccct

SEQ ID NO: 6104786 - DNA, 14 bp, Homo sapiens
cgtcagcctgtgaa

SEQ ID NO: 6104787 - DNA, 15 bp, Homo sapiens
cgtcagcttctccca

SEQ ID NO: 6104788 - DNA, 15 bp, Homo sapiens
cgtcaggagcagcat

SEQ ID NO: 6104789 - DNA, 17 bp, Homo sapiens
cgtcaggagcagcatca

SEQ ID NO: 6104790 - DNA, 20 bp, Homo sapiens
cgtcaggagcagcatcattc

SEQ ID NO: 6104791 - DNA, 15 bp, Homo sapiens
cgtcaggaggtgcct

SEQ ID NO: 6104792 - DNA, 17 bp, Homo sapiens
cgtcaggcacgtctcct

SEQ ID NO: 6104793 - DNA, 15 bp, Homo sapiens
cgtcaggccacagcc

SEQ ID NO: 6104794 - DNA, 22 bp, Homo sapiens
cgtcaggccacagcccctggca

SEQ ID NO: 6104795 - DNA, 16 bp, Homo sapiens
cgtcagggttggtgtg

SEQ ID NO: 6104796 - DNA, 19 bp, Homo sapiens
cgtcagggttggtgtgctg

SEQ ID NO: 6104797 - DNA, 22 bp, Homo sapiens
cgtcaggtactcctgccaggga

SEQ ID NO: 6104798 - DNA, 15 bp, Homo sapiens
cgtcagtattttccc

SEQ ID NO: 6104799 - DNA, 20 bp, Homo sapiens
cgtcagtcgatattcccagg

SEQ ID NO: 6104800 - DNA, 22 bp, Homo sapiens
cgtcagtcgatattcccagggc

SEQ ID NO: 6104801 - DNA, 15 bp, Homo sapiens
cgtcagtgcctaccc

SEQ ID NO: 6104802 - DNA, 14 bp, Homo sapiens
cgtcagtgctgtgc

SEQ ID NO: 6104803 - DNA, 17 bp, Homo sapiens
cgtcagtgttcatgcga

SEQ ID NO: 6104804 - DNA, 16 bp, Homo sapiens
cgtcagtttcactccc

SEQ ID NO: 6104805 - DNA, 18 bp, Homo sapiens
cgtcagtttcactccctc

SEQ ID NO: 6104806 - DNA, 22 bp, Homo sapiens
cgtcagtttcactccctcttgg

SEQ ID NO: 6104807 - DNA, 17 bp, Homo sapiens
cgtcataactagaactg

SEQ ID NO: 6104808 - DNA, 14 bp, Homo sapiens
cgtcataggcttct

SEQ ID NO: 6104809 - DNA, 19 bp, Homo sapiens
cgtcatcacttttcagtga

SEQ ID NO: 6104810 - DNA, 20 bp, Homo sapiens
cgtcatcggaggctgggccc

SEQ ID NO: 6104811 - DNA, 13 bp, Homo sapiens
cgtcatctcaggg

SEQ ID NO: 6104812 - DNA, 22 bp, Homo sapiens
cgtcatgctgtccgtgcttgct

SEQ ID NO: 6104813 - DNA, 19 bp, Homo sapiens
cgtcatggcttaatgttta

SEQ ID NO: 6104814 - DNA, 21 bp, Homo sapiens
cgtcatgggccccccatgcat

SEQ ID NO: 6104815 - DNA, 20 bp, Homo sapiens
cgtcatgttggccaggctgg

SEQ ID NO: 6104816 - DNA, 15 bp, Homo sapiens
cgtcattgctgctgc

SEQ ID NO: 6104817 - DNA, 23 bp, Homo sapiens
cgtcattttgaatcatcatgtga

SEQ ID NO: 6104818 - DNA, 17 bp, Homo sapiens
cgtccaaccccggggca

SEQ ID NO: 6104819 - DNA, 21 bp, Homo sapiens
cgtccaaggcagttctgtgtc

SEQ ID NO: 6104820 - DNA, 22 bp, Homo sapiens
cgtccaaggcagttctgtgtcc

SEQ ID NO: 6104821 - DNA, 17 bp, Homo sapiens
cgtccaagggacagccc

SEQ ID NO: 6104822 - DNA, 14 bp, Homo sapiens
cgtccacagcttcc

SEQ ID NO: 6104823 - DNA, 16 bp, Homo sapiens
cgtccacagcttcctg

SEQ ID NO: 6104824 - DNA, 14 bp, Homo sapiens
cgtccacaggggca

SEQ ID NO: 6104825 - DNA, 17 bp, Homo sapiens
cgtccacaggggcaggc

SEQ ID NO: 6104826 - DNA, 23 bp, Homo sapiens
cgtccacaggggcaggcctggga

SEQ ID NO: 6104827 - DNA, 12 bp, Homo sapiens
cgtccaccaggc

SEQ ID NO: 6104828 - DNA, 16 bp, Homo sapiens
cgtccaccaggcctca

SEQ ID NO: 6104829 - DNA, 19 bp, Homo sapiens
cgtccaccaggcctcactg

SEQ ID NO: 6104830 - DNA, 15 bp, Homo sapiens
cgtccacccaggctg

SEQ ID NO: 6104831 - DNA, 19 bp, Homo sapiens
cgtccacccaggctgcact

SEQ ID NO: 6104832 - DNA, 23 bp, Homo sapiens
cgtccacccaggctgcactgcag

SEQ ID NO: 6104833 - DNA, 11 bp, Homo sapiens
cgtccaccccc

SEQ ID NO: 6104834 - DNA, 20 bp, Homo sapiens
cgtccaccccccacacacac

SEQ ID NO: 6104835 - DNA, 20 bp, Homo sapiens
cgtccacccgtttccaagcc

SEQ ID NO: 6104836 - DNA, 21 bp, Homo sapiens
cgtccaccctgagctcgggga

SEQ ID NO: 6104837 - DNA, 18 bp, Homo sapiens
cgtccactacgctcctgt

SEQ ID NO: 6104838 - DNA, 13 bp, Homo sapiens
cgtccagcctgcc

SEQ ID NO: 6104839 - DNA, 17 bp, Homo sapiens
cgtccagctcagccctg

SEQ ID NO: 6104840 - DNA, 22 bp, Homo sapiens
cgtccagctcagccctggcctg

SEQ ID NO: 6104841 - DNA, 17 bp, Homo sapiens
cgtccagctgcccttcc

SEQ ID NO: 6104842 - DNA, 19 bp, Homo sapiens
cgtccaggagcctgtgcct

SEQ ID NO: 6104843 - DNA, 12 bp, Homo sapiens
cgtccaggcccc

SEQ ID NO: 6104844 - DNA, 21 bp, Homo sapiens
cgtccaggccgcgccctttcc

SEQ ID NO: 6104845 - DNA, 21 bp, Homo sapiens
cgtccaggttcaacccacagc

SEQ ID NO: 6104846 - DNA, 14 bp, Homo sapiens
cgtccatagctcct

SEQ ID NO: 6104847 - DNA, 17 bp, Homo sapiens
cgtccatcccccttctt

SEQ ID NO: 6104848 - DNA, 19 bp, Homo sapiens
cgtccatccgactgcccct

SEQ ID NO: 6104849 - DNA, 13 bp, Homo sapiens
cgtccatctccct

SEQ ID NO: 6104850 - DNA, 14 bp, Homo sapiens
cgtccatctctctc

SEQ ID NO: 6104851 - DNA, 18 bp, Homo sapiens
cgtccatctctctccctt

SEQ ID NO: 6104852 - DNA, 16 bp, Homo sapiens
cgtccatggcaccagc

SEQ ID NO: 6104853 - DNA, 19 bp, Homo sapiens
cgtccatttcttatttaat

SEQ ID NO: 6104854 - DNA, 11 bp, Homo sapiens
cgtcccagagg

SEQ ID NO: 6104855 - DNA, 15 bp, Homo sapiens
cgtcccagaggccgc

SEQ ID NO: 6104856 - DNA, 21 bp, Homo sapiens
cgtcccagaggccgctgcccc

SEQ ID NO: 6104857 - DNA, 15 bp, Homo sapiens
cgtcccagcatccct

SEQ ID NO: 6104858 - DNA, 18 bp, Homo sapiens
cgtcccagcggcctcagg

SEQ ID NO: 6104859 - DNA, 11 bp, Homo sapiens
cgtcccagctc

SEQ ID NO: 6104860 - DNA, 13 bp, Homo sapiens
cgtcccagctccc

SEQ ID NO: 6104861 - DNA, 14 bp, Homo sapiens
cgtcccagctcccc

SEQ ID NO: 6104862 - DNA, 20 bp, Homo sapiens
cgtcccaggctgccggctcc

SEQ ID NO: 6104863 - DNA, 11 bp, Homo sapiens
cgtccccagac

SEQ ID NO: 6104864 - DNA, 21 bp, Homo sapiens
cgtccccagaccagtagtgac

SEQ ID NO: 6104865 - DNA, 22 bp, Homo sapiens
cgtccccagaccagtagtgacc

SEQ ID NO: 6104866 - DNA, 23 bp, Homo sapiens
cgtccccagaccagtagtgacca

SEQ ID NO: 6104867 - DNA, 14 bp, Homo sapiens
cgtccccagggtgc

SEQ ID NO: 6104868 - DNA, 13 bp, Homo sapiens
cgtcccccagccc

SEQ ID NO: 6104869 - DNA, 14 bp, Homo sapiens
cgtcccccagccct

SEQ ID NO: 6104870 - DNA, 23 bp, Homo sapiens
cgtcccccagccctcaggccagt

SEQ ID NO: 6104871 - DNA, 13 bp, Homo sapiens
cgtccccccatcc

SEQ ID NO: 6104872 - DNA, 14 bp, Homo sapiens
cgtccccccatccc

SEQ ID NO: 6104873 - DNA, 16 bp, Homo sapiens
cgtccccccatcccgt

SEQ ID NO: 6104874 - DNA, 17 bp, Homo sapiens
cgtccccccccaacctt

SEQ ID NO: 6104875 - DNA, 22 bp, Homo sapiens
cgtccccccccaacctttccct

SEQ ID NO: 6104876 - DNA, 16 bp, Homo sapiens
cgtccccccccaggcc

SEQ ID NO: 6104877 - DNA, 17 bp, Homo sapiens
cgtccccccccaggccc

SEQ ID NO: 6104878 - DNA, 16 bp, Homo sapiens
cgtcccccgccgcgcc

SEQ ID NO: 6104879 - DNA, 17 bp, Homo sapiens
cgtcccccgccgcgcca

SEQ ID NO: 6104880 - DNA, 19 bp, Homo sapiens
cgtcccccgccgcgccagt

SEQ ID NO: 6104881 - DNA, 14 bp, Homo sapiens
cgtccccctccctg

SEQ ID NO: 6104882 - DNA, 16 bp, Homo sapiens
cgtccccctccctgcc

SEQ ID NO: 6104883 - DNA, 21 bp, Homo sapiens
cctgcagtgttcgcttggctc

SEQ ID NO: 6104884 - DNA, 20 bp, Homo sapiens
cctgcagttaattagcattc

SEQ ID NO: 6104885 - DNA, 13 bp, Homo sapiens
cctgcagtttctt

SEQ ID NO: 6104886 - DNA, 21 bp, Homo sapiens
cctgcagtttcttgtgtagat

SEQ ID NO: 6104887 - DNA, 15 bp, Homo sapiens
cctgcagtttggccc

SEQ ID NO: 6104888 - DNA, 17 bp, Homo sapiens
cctgcagtttggccctg

SEQ ID NO: 6104889 - DNA, 21 bp, Homo sapiens
cctgcagtttggccctggagc

SEQ ID NO: 6104890 - DNA, 14 bp, Homo sapiens
cctgcagtttttaa

SEQ ID NO: 6104891 - DNA, 18 bp, Homo sapiens
cctgcagtttttaatttg

SEQ ID NO: 6104892 - DNA, 15 bp, Homo sapiens
cctgcataggctcct

SEQ ID NO: 6104893 - DNA, 16 bp, Homo sapiens
cctgcataggctcctt

SEQ ID NO: 6104894 - DNA, 22 bp, Homo sapiens
cctgcataggctccttcctgtg

SEQ ID NO: 6104895 - DNA, 21 bp, Homo sapiens
cctgcatatctctagtccctg

SEQ ID NO: 6104896 - DNA, 22 bp, Homo sapiens
cctgcatatctctagtccctgt

SEQ ID NO: 6104897 - DNA, 15 bp, Homo sapiens
cctgcatatgcttct

SEQ ID NO: 6104898 - DNA, 23 bp, Homo sapiens
cctgcatcccaggatgctgggtg

SEQ ID NO: 6104899 - DNA, 21 bp, Homo sapiens
cctgcatccccttggctgtga

SEQ ID NO: 6104900 - DNA, 21 bp, Homo sapiens
cctgcatcccgatacctcagc

SEQ ID NO: 6104901 - DNA, 13 bp, Homo sapiens
cctgcatccctcc

SEQ ID NO: 6104902 - DNA, 17 bp, Homo sapiens
cctgcatccctccaccc

SEQ ID NO: 6104903 - DNA, 23 bp, Homo sapiens
cctgcatcccttggcccctctct

SEQ ID NO: 6104904 - DNA, 19 bp, Homo sapiens
cctgcatccgtagttccct

SEQ ID NO: 6104905 - DNA, 14 bp, Homo sapiens
cctgcatcctgagg

SEQ ID NO: 6104906 - DNA, 19 bp, Homo sapiens
cctgcatcctgaggccagt

SEQ ID NO: 6104907 - DNA, 22 bp, Homo sapiens
cctgcatcctgaggccagtggc

SEQ ID NO: 6104908 - DNA, 16 bp, Homo sapiens
cctgcatctaagccca

SEQ ID NO: 6104909 - DNA, 17 bp, Homo sapiens
cctgcatctagctggag

SEQ ID NO: 6104910 - DNA, 15 bp, Homo sapiens
cctgcatctctgtga

SEQ ID NO: 6104911 - DNA, 18 bp, Homo sapiens
cctgcatctctgtgaagc

SEQ ID NO: 6104912 - DNA, 19 bp, Homo sapiens
cctgcatctgaccagcagc

SEQ ID NO: 6104913 - DNA, 19 bp, Homo sapiens
cctgcatctgtctgctctg

SEQ ID NO: 6104914 - DNA, 20 bp, Homo sapiens
cctgcatctgtctgctctgc

SEQ ID NO: 6104915 - DNA, 20 bp, Homo sapiens
cctgcatcttcttgcatcta

SEQ ID NO: 6104916 - DNA, 16 bp, Homo sapiens
cctgcatgaaagcatt

SEQ ID NO: 6104917 - DNA, 23 bp, Homo sapiens
cctgcatgcagcaacacccaagt

SEQ ID NO: 6104918 - DNA, 13 bp, Homo sapiens
cctgcatgcctgg

SEQ ID NO: 6104919 - DNA, 16 bp, Homo sapiens
cctgcatgcctggccc

SEQ ID NO: 6104920 - DNA, 17 bp, Homo sapiens
cctgcatgcctggcccc

SEQ ID NO: 6104921 - DNA, 15 bp, Homo sapiens
cctgcatggcatcct

SEQ ID NO: 6104922 - DNA, 18 bp, Homo sapiens
cctgcatggcatcctcca

SEQ ID NO: 6104923 - DNA, 20 bp, Homo sapiens
cctgcatggcatcctccagc

SEQ ID NO: 6104924 - DNA, 21 bp, Homo sapiens
cctgcatggcatcctccagcc

SEQ ID NO: 6104925 - DNA, 22 bp, Homo sapiens
cctgcatggcatcctccagccc

SEQ ID NO: 6104926 - DNA, 16 bp, Homo sapiens
cctgcatggctgagct

SEQ ID NO: 6104927 - DNA, 18 bp, Homo sapiens
cctgcatgggccagcccc

SEQ ID NO: 6104928 - DNA, 17 bp, Homo sapiens
cctgcatggtcaagcct

SEQ ID NO: 6104929 - DNA, 18 bp, Homo sapiens
cctgcatggtcaagcctc

SEQ ID NO: 6104930 - DNA, 19 bp, Homo sapiens
cctgcatgtcggggcccct

SEQ ID NO: 6104931 - DNA, 12 bp, Homo sapiens
cctgcatgtgta

SEQ ID NO: 6104932 - DNA, 13 bp, Homo sapiens
cctgcatgtgtat

SEQ ID NO: 6104933 - DNA, 15 bp, Homo sapiens
cctgcatgttctgtg

SEQ ID NO: 6104934 - DNA, 18 bp, Homo sapiens
cctgcattactccttcag

SEQ ID NO: 6104935 - DNA, 16 bp, Homo sapiens
cctgcattcacccaga

SEQ ID NO: 6104936 - DNA, 16 bp, Homo sapiens
cctgcattcgcagcag

SEQ ID NO: 6104937 - DNA, 23 bp, Homo sapiens
cctgcattctgcacgctgcccag

SEQ ID NO: 6104938 - DNA, 16 bp, Homo sapiens
cctgcattctttctgt

SEQ ID NO: 6104939 - DNA, 16 bp, Homo sapiens
cctgcattggaactgg

SEQ ID NO: 6104940 - DNA, 19 bp, Homo sapiens
cctgcattggaactggagg

SEQ ID NO: 6104941 - DNA, 21 bp, Homo sapiens
cctgcattggaactggaggca

SEQ ID NO: 6104942 - DNA, 23 bp, Homo sapiens
cctgcattggaactggaggcagg

SEQ ID NO: 6104943 - DNA, 16 bp, Homo sapiens
cctgcattggcctggc

SEQ ID NO: 6104944 - DNA, 22 bp, Homo sapiens
cctgcattggcctggcctccag

SEQ ID NO: 6104945 - DNA, 18 bp, Homo sapiens
cctgcatttaagaacaga

SEQ ID NO: 6104946 - DNA, 16 bp, Homo sapiens
cctgcatttctgagtt

SEQ ID NO: 6104947 - DNA, 12 bp, Homo sapiens
cctgccaaagta

SEQ ID NO: 6104948 - DNA, 21 bp, Homo sapiens
cctgccaaagtgcctgggaag

SEQ ID NO: 6104949 - DNA, 23 bp, Homo sapiens
cctgccaactccatgaccaggcc

SEQ ID NO: 6104950 - DNA, 18 bp, Homo sapiens
cctgccaagcctggagcc

SEQ ID NO: 6104951 - DNA, 21 bp, Homo sapiens
cctgccaaggccggagaccca

SEQ ID NO: 6104952 - DNA, 22 bp, Homo sapiens
cctgccaaggccggagacccac

SEQ ID NO: 6104953 - DNA, 23 bp, Homo sapiens
cctgccaaggccggagacccaca

SEQ ID NO: 6104954 - DNA, 22 bp, Homo sapiens
cctgccaagtggtttctatgag

SEQ ID NO: 6104955 - DNA, 22 bp, Homo sapiens
cctgccaatgccacagccaagc

SEQ ID NO: 6104956 - DNA, 13 bp, Homo sapiens
cctgccaatgctc

SEQ ID NO: 6104957 - DNA, 13 bp, Homo sapiens
cctgccaattgct

SEQ ID NO: 6104958 - DNA, 22 bp, Homo sapiens
cctgccacaaaccaccaggact

SEQ ID NO: 6104959 - DNA, 23 bp, Homo sapiens
cctgccacaaaccaccaggactg

SEQ ID NO: 6104960 - DNA, 17 bp, Homo sapiens
cctgccacaatgtgata

SEQ ID NO: 6104961 - DNA, 15 bp, Homo sapiens
cctgccacactcagt

SEQ ID NO: 6104962 - DNA, 20 bp, Homo sapiens
cctgccacactgatggctca

SEQ ID NO: 6104963 - DNA, 17 bp, Homo sapiens
cctgccacatccagctt

SEQ ID NO: 6104964 - DNA, 17 bp, Homo sapiens
cctgccacatggagccc

SEQ ID NO: 6104965 - DNA, 17 bp, Homo sapiens
cctgccaccaccctgtc

SEQ ID NO: 6104966 - DNA, 18 bp, Homo sapiens
cctgccaccaccctgtct

SEQ ID NO: 6104967 - DNA, 15 bp, Homo sapiens
cctgccaccacgccc

SEQ ID NO: 6104968 - DNA, 16 bp, Homo sapiens
cctgccaccactataa

SEQ ID NO: 6104969 - DNA, 13 bp, Homo sapiens
cctgccaccagca

SEQ ID NO: 6104970 - DNA, 16 bp, Homo sapiens
cctgccaccagcatcc

SEQ ID NO: 6104971 - DNA, 19 bp, Homo sapiens
cctgccacccccaggtctt

SEQ ID NO: 6104972 - DNA, 22 bp, Homo sapiens
cctgccacccccttccctggga

SEQ ID NO: 6104973 - DNA, 23 bp, Homo sapiens
cctgccacccccttccctgggag

SEQ ID NO: 6104974 - DNA, 17 bp, Homo sapiens
cctgccaccctcctgcg

SEQ ID NO: 6104975 - DNA, 19 bp, Homo sapiens
cctgccaccctctgctgca

SEQ ID NO: 6104976 - DNA, 22 bp, Homo sapiens
cctgccaccctctgctgcacag

SEQ ID NO: 6104977 - DNA, 13 bp, Homo sapiens
cctgccaccctgt

SEQ ID NO: 6104978 - DNA, 14 bp, Homo sapiens
cctgccaccctgta

SEQ ID NO: 6104979 - DNA, 15 bp, Homo sapiens
cctgccaccgactgc

SEQ ID NO: 6104980 - DNA, 19 bp, Homo sapiens
cctgccaccgactgcccag

SEQ ID NO: 6104981 - DNA, 19 bp, Homo sapiens
cctgccaccgccagaggac

SEQ ID NO: 6104982 - DNA, 22 bp, Homo sapiens
cctgccaccgccagaggacaag

SEQ ID NO: 6104983 - DNA, 18 bp, Homo sapiens
cctgccaccgtcacacag

SEQ ID NO: 6104984 - DNA, 14 bp, Homo sapiens
cctgccacctcctg

SEQ ID NO: 6104985 - DNA, 16 bp, Homo sapiens
cctgccacctcctgcc

SEQ ID NO: 6104986 - DNA, 17 bp, Homo sapiens
cctgccacctcctgcct

SEQ ID NO: 6104987 - DNA, 19 bp, Homo sapiens
cctgccacctcctgcctca

SEQ ID NO: 6104988 - DNA, 17 bp, Homo sapiens
cctgccacctctcccag

SEQ ID NO: 6104989 - DNA, 13 bp, Homo sapiens
cctgccacctgga

SEQ ID NO: 6104990 - DNA, 17 bp, Homo sapiens
cctgccacctggacccc

SEQ ID NO: 6104991 - DNA, 21 bp, Homo sapiens
cctgccacctggacccctgca

SEQ ID NO: 6104992 - DNA, 16 bp, Homo sapiens
cctgccacctggggca

SEQ ID NO: 6104993 - DNA, 12 bp, Homo sapiens
cctgccacctgt

SEQ ID NO: 6104994 - DNA, 17 bp, Homo sapiens
cctgccacctgtctgtc

SEQ ID NO: 6104995 - DNA, 17 bp, Homo sapiens
cctgccacgtcccgctg

SEQ ID NO: 6104996 - DNA, 17 bp, Homo sapiens
cctgccactaggctggg

SEQ ID NO: 6104997 - DNA, 15 bp, Homo sapiens
cctgccactcactag

SEQ ID NO: 6104998 - DNA, 18 bp, Homo sapiens
cctgccactcactaggcc

SEQ ID NO: 6104999 - DNA, 14 bp, Homo sapiens
cctgccactcaggc

SEQ ID NO: 6105000 - DNA, 14 bp, Homo sapiens
cctgccactcctca

SEQ ID NO: 6105001 - DNA, 16 bp, Homo sapiens
cctgccactctcctga

SEQ ID NO: 6105002 - DNA, 19 bp, Homo sapiens
cctgccactctcctgagga

SEQ ID NO: 6105003 - DNA, 22 bp, Homo sapiens
cctgccactctctgggactctc

SEQ ID NO: 6105004 - DNA, 15 bp, Homo sapiens
cctgccactgggctc

SEQ ID NO: 6105005 - DNA, 19 bp, Homo sapiens
cctgccactgggctctgga

SEQ ID NO: 6105006 - DNA, 20 bp, Homo sapiens
cctgccactgggctctggac

SEQ ID NO: 6105007 - DNA, 14 bp, Homo sapiens
cctgccactgtgtg

SEQ ID NO: 6105008 - DNA, 23 bp, Homo sapiens
cctgccacttcaacccccagcta

SEQ ID NO: 6105009 - DNA, 23 bp, Homo sapiens
cctgccactttggtacatggcca

SEQ ID NO: 6105010 - DNA, 19 bp, Homo sapiens
cctgccagacggcacccac

SEQ ID NO: 6105011 - DNA, 21 bp, Homo sapiens
cctgccagagcccaagtgcca

SEQ ID NO: 6105012 - DNA, 23 bp, Homo sapiens
cctgccagaggatgctctttccc

SEQ ID NO: 6105013 - DNA, 14 bp, Homo sapiens
cctgccagaggcct

SEQ ID NO: 6105014 - DNA, 18 bp, Homo sapiens
cctgccagaggcctggtg

SEQ ID NO: 6105015 - DNA, 18 bp, Homo sapiens
cctgccagcacgcctggc

SEQ ID NO: 6105016 - DNA, 22 bp, Homo sapiens
cctgccagcaggccagggactc

SEQ ID NO: 6105017 - DNA, 14 bp, Homo sapiens
cctgccagcagggg

SEQ ID NO: 6105018 - DNA, 12 bp, Homo sapiens
cctgccagccac

SEQ ID NO: 6105019 - DNA, 12 bp, Homo sapiens
cctgccagccat

SEQ ID NO: 6105020 - DNA, 18 bp, Homo sapiens
cctgccagccatcacaag

SEQ ID NO: 6105021 - DNA, 20 bp, Homo sapiens
cctgccagcccagctggcct

SEQ ID NO: 6105022 - DNA, 12 bp, Homo sapiens
cctgccagcccc

SEQ ID NO: 6105023 - DNA, 13 bp, Homo sapiens
cctgccagcccct

SEQ ID NO: 6105024 - DNA, 14 bp, Homo sapiens
cctgccagcccctg

SEQ ID NO: 6105025 - DNA, 22 bp, Homo sapiens
cctgccagcccggctcggccca

SEQ ID NO: 6105026 - DNA, 19 bp, Homo sapiens
cctgccagccgaccctcct

SEQ ID NO: 6105027 - DNA, 13 bp, Homo sapiens
cctgccagcctgg

SEQ ID NO: 6105028 - DNA, 16 bp, Homo sapiens
cctgccagcctggctt

SEQ ID NO: 6105029 - DNA, 20 bp, Homo sapiens
cctgccagcggtttcctggt

SEQ ID NO: 6105030 - DNA, 14 bp, Homo sapiens
cctgccagctctgt

SEQ ID NO: 6105031 - DNA, 14 bp, Homo sapiens
cctgccagctgcac

SEQ ID NO: 6105032 - DNA, 16 bp, Homo sapiens
cctgccagctgcactg

SEQ ID NO: 6105033 - DNA, 18 bp, Homo sapiens
cctgccagctgcactgat

SEQ ID NO: 6105034 - DNA, 15 bp, Homo sapiens
cctgccagctgcctt

SEQ ID NO: 6105035 - DNA, 14 bp, Homo sapiens
cctgccaggaagcc

SEQ ID NO: 6105036 - DNA, 17 bp, Homo sapiens
cctgccaggaagccagc

SEQ ID NO: 6105037 - DNA, 11 bp, Homo sapiens
cctgccaggag

SEQ ID NO: 6105038 - DNA, 21 bp, Homo sapiens
cctgccaggagctttggacct

SEQ ID NO: 6105039 - DNA, 23 bp, Homo sapiens
cctgccaggaggacccagggctc

SEQ ID NO: 6105040 - DNA, 19 bp, Homo sapiens
cctgccaggcacaggcagg

SEQ ID NO: 6105041 - DNA, 22 bp, Homo sapiens
cctgccaggcacaggcagggca

SEQ ID NO: 6105042 - DNA, 14 bp, Homo sapiens
cctgccaggcaggg

SEQ ID NO: 6105043 - DNA, 22 bp, Homo sapiens
cctgccaggcaggggtgggggt

SEQ ID NO: 6105044 - DNA, 17 bp, Homo sapiens
cctgccaggccctccag

SEQ ID NO: 6105045 - DNA, 12 bp, Homo sapiens
cctgccaggccg

SEQ ID NO: 6105046 - DNA, 13 bp, Homo sapiens
cctgccaggcctc

SEQ ID NO: 6105047 - DNA, 19 bp, Homo sapiens
cctgccaggctcctctccc

SEQ ID NO: 6105048 - DNA, 13 bp, Homo sapiens
cctgccaggctct

SEQ ID NO: 6105049 - DNA, 18 bp, Homo sapiens
cctgccaggctctccctc

SEQ ID NO: 6105050 - DNA, 13 bp, Homo sapiens
cctgccaggctgt

SEQ ID NO: 6105051 - DNA, 22 bp, Homo sapiens
cctgccaggctgtcagcgcctc

SEQ ID NO: 6105052 - DNA, 20 bp, Homo sapiens
cctgccagggaactggcctg

SEQ ID NO: 6105053 - DNA, 20 bp, Homo sapiens
cctgccagggagacagagct

SEQ ID NO: 6105054 - DNA, 17 bp, Homo sapiens
cctgccagggcagggcc

SEQ ID NO: 6105055 - DNA, 13 bp, Homo sapiens
cctgccagggccc

SEQ ID NO: 6105056 - DNA, 14 bp, Homo sapiens
cctgccagtcccag

SEQ ID NO: 6105057 - DNA, 12 bp, Homo sapiens
cctgccagtcct

SEQ ID NO: 6105058 - DNA, 20 bp, Homo sapiens
cctgccagtcctagctgcac

SEQ ID NO: 6105059 - DNA, 20 bp, Homo sapiens
cctgccagtgaagtccttca

SEQ ID NO: 6105060 - DNA, 13 bp, Homo sapiens
cctgccagtgcca

SEQ ID NO: 6105061 - DNA, 17 bp, Homo sapiens
cgtccccctccctgccc

SEQ ID NO: 6105062 - DNA, 21 bp, Homo sapiens
cgtccccctctggctccagct

SEQ ID NO: 6105063 - DNA, 22 bp, Homo sapiens
cgtccccctctggctccagctg

SEQ ID NO: 6105064 - DNA, 16 bp, Homo sapiens
cgtccccggcccctgc

SEQ ID NO: 6105065 - DNA, 13 bp, Homo sapiens
cgtcccctcaagc

SEQ ID NO: 6105066 - DNA, 14 bp, Homo sapiens
cgtcccctcaagcc

SEQ ID NO: 6105067 - DNA, 18 bp, Homo sapiens
cgtcccctccgccgtgcc

SEQ ID NO: 6105068 - DNA, 15 bp, Homo sapiens
cgtcccctccttccc

SEQ ID NO: 6105069 - DNA, 16 bp, Homo sapiens
cgtcccctccttccct

SEQ ID NO: 6105070 - DNA, 22 bp, Homo sapiens
cgtcccctccttccctcacccc

SEQ ID NO: 6105071 - DNA, 14 bp, Homo sapiens
cgtcccctctcccc

SEQ ID NO: 6105072 - DNA, 16 bp, Homo sapiens
cgtcccctctcccctt

SEQ ID NO: 6105073 - DNA, 17 bp, Homo sapiens
cgtcccctctccccttg

SEQ ID NO: 6105074 - DNA, 13 bp, Homo sapiens
cgtcccctgcagc

SEQ ID NO: 6105075 - DNA, 17 bp, Homo sapiens
cgtcccctgcagcctgg

SEQ ID NO: 6105076 - DNA, 18 bp, Homo sapiens
cgtcccctgcagcctggg

SEQ ID NO: 6105077 - DNA, 20 bp, Homo sapiens
cgtcccctgcagcctgggtc

SEQ ID NO: 6105078 - DNA, 17 bp, Homo sapiens
cgtcccgagggcgcctg

SEQ ID NO: 6105079 - DNA, 17 bp, Homo sapiens
cgtcccgcgttcaagac

SEQ ID NO: 6105080 - DNA, 18 bp, Homo sapiens
cgtcccgctgcctcctgc

SEQ ID NO: 6105081 - DNA, 14 bp, Homo sapiens
cgtcccgctgctgt

SEQ ID NO: 6105082 - DNA, 14 bp, Homo sapiens
cgtcccggccccgc

SEQ ID NO: 6105083 - DNA, 22 bp, Homo sapiens
cgtcccggccccgcgcgtgccc

SEQ ID NO: 6105084 - DNA, 24 bp, Homo sapiens
cgtcccgggcactgtcatgcccag

SEQ ID NO: 6105085 - DNA, 16 bp, Homo sapiens
cgtccctagcagtgaa

SEQ ID NO: 6105086 - DNA, 20 bp, Homo sapiens
cgtccctatatcagggcctg

SEQ ID NO: 6105087 - DNA, 23 bp, Homo sapiens
cgtccctcccaggtcgggcagtg

SEQ ID NO: 6105088 - DNA, 17 bp, Homo sapiens
cgtccctcgagctctgt

SEQ ID NO: 6105089 - DNA, 13 bp, Homo sapiens
cgtccctctgcct

SEQ ID NO: 6105090 - DNA, 20 bp, Homo sapiens
cgtccctctgtccacttgtg

SEQ ID NO: 6105091 - DNA, 17 bp, Homo sapiens
cgtccctgacttcccag

SEQ ID NO: 6105092 - DNA, 17 bp, Homo sapiens
cgtccctgagggccctt

SEQ ID NO: 6105093 - DNA, 14 bp, Homo sapiens
cgtccctgcccatg

SEQ ID NO: 6105094 - DNA, 20 bp, Homo sapiens
cgtccctgcggaagccacag

SEQ ID NO: 6105095 - DNA, 22 bp, Homo sapiens
cgtccctgcggaagccacaggg

SEQ ID NO: 6105096 - DNA, 23 bp, Homo sapiens
cgtccctgcggaagccacagggt

SEQ ID NO: 6105097 - DNA, 21 bp, Homo sapiens
cgtcccttggaaagttcagcc

SEQ ID NO: 6105098 - DNA, 21 bp, Homo sapiens
cgtcccttggatcagaggtca

SEQ ID NO: 6105099 - DNA, 17 bp, Homo sapiens
cgtcccttggtgagaaa

SEQ ID NO: 6105100 - DNA, 16 bp, Homo sapiens
cgtccctttccctgca

SEQ ID NO: 6105101 - DNA, 19 bp, Homo sapiens
cgtccctttccctgcatcc

SEQ ID NO: 6105102 - DNA, 14 bp, Homo sapiens
cgtccgcccgccca

SEQ ID NO: 6105103 - DNA, 15 bp, Homo sapiens
cgtccgccctgctcc

SEQ ID NO: 6105104 - DNA, 20 bp, Homo sapiens
cgtccggcagttctgggtgc

SEQ ID NO: 6105105 - DNA, 22 bp, Homo sapiens
cgtccggcggccccgccgcaga

SEQ ID NO: 6105106 - DNA, 20 bp, Homo sapiens
cgtccggggtggtggacagg

SEQ ID NO: 6105107 - DNA, 20 bp, Homo sapiens
cgtccgtgggttgctaactg

SEQ ID NO: 6105108 - DNA, 22 bp, Homo sapiens
cgtcctatctcccccaacccac

SEQ ID NO: 6105109 - DNA, 14 bp, Homo sapiens
cgtcctcagcaccc

SEQ ID NO: 6105110 - DNA, 20 bp, Homo sapiens
cgtcctcatttcccctccca

SEQ ID NO: 6105111 - DNA, 13 bp, Homo sapiens
cgtcctccccctg

SEQ ID NO: 6105112 - DNA, 15 bp, Homo sapiens
cgtcctccccctgcc

SEQ ID NO: 6105113 - DNA, 16 bp, Homo sapiens
cgtcctcccgggccct

SEQ ID NO: 6105114 - DNA, 18 bp, Homo sapiens
cgtcctcccgggccctcc

SEQ ID NO: 6105115 - DNA, 15 bp, Homo sapiens
cgtcctccctcagcc

SEQ ID NO: 6105116 - DNA, 21 bp, Homo sapiens
cgtcctccctcagcctcccct

SEQ ID NO: 6105117 - DNA, 21 bp, Homo sapiens
cgtcctcctcacctcatgccc

SEQ ID NO: 6105118 - DNA, 13 bp, Homo sapiens
cgtcctcctctgt

SEQ ID NO: 6105119 - DNA, 16 bp, Homo sapiens
cgtcctcgagcaactg

SEQ ID NO: 6105120 - DNA, 17 bp, Homo sapiens
cgtcctctccctcctgg

SEQ ID NO: 6105121 - DNA, 23 bp, Homo sapiens
cgtcctgacggcgcccccagtgt

SEQ ID NO: 6105122 - DNA, 11 bp, Homo sapiens
cgtcctgaggg

SEQ ID NO: 6105123 - DNA, 13 bp, Homo sapiens
cgtcctgatccct

SEQ ID NO: 6105124 - DNA, 16 bp, Homo sapiens
cgtcctgatccctcca

SEQ ID NO: 6105125 - DNA, 19 bp, Homo sapiens
cgtcctgatccctccaccc

SEQ ID NO: 6105126 - DNA, 12 bp, Homo sapiens
cgtcctgcagag

SEQ ID NO: 6105127 - DNA, 14 bp, Homo sapiens
cgtcctgcagagga

SEQ ID NO: 6105128 - DNA, 20 bp, Homo sapiens
cgtcctgccacctggggcag

SEQ ID NO: 6105129 - DNA, 13 bp, Homo sapiens
cgtcctgccctgc

SEQ ID NO: 6105130 - DNA, 14 bp, Homo sapiens
cgtcctgcctggca

SEQ ID NO: 6105131 - DNA, 16 bp, Homo sapiens
cgtcctgctcgccctg

SEQ ID NO: 6105132 - DNA, 18 bp, Homo sapiens
cgtcctgctcgccctgtg

SEQ ID NO: 6105133 - DNA, 20 bp, Homo sapiens
cgtcctgctcgccctgtgcc

SEQ ID NO: 6105134 - DNA, 23 bp, Homo sapiens
cgtcctgctcgccctgtgccctc

SEQ ID NO: 6105135 - DNA, 12 bp, Homo sapiens
cgtcctgctgga

SEQ ID NO: 6105136 - DNA, 14 bp, Homo sapiens
cgtcctgctggagt

SEQ ID NO: 6105137 - DNA, 11 bp, Homo sapiens
cgtcctggaat

SEQ ID NO: 6105138 - DNA, 12 bp, Homo sapiens
cgtcctgggtgc

SEQ ID NO: 6105139 - DNA, 22 bp, Homo sapiens
cgtcctgggtgctgtcatgccc

SEQ ID NO: 6105140 - DNA, 15 bp, Homo sapiens
cgtcctgtcactgat

SEQ ID NO: 6105141 - DNA, 16 bp, Homo sapiens
cgtcctgtcactgatg

SEQ ID NO: 6105142 - DNA, 18 bp, Homo sapiens
cgtcctgtcactgatgga

SEQ ID NO: 6105143 - DNA, 14 bp, Homo sapiens
cgtcctgtcagtgc

SEQ ID NO: 6105144 - DNA, 16 bp, Homo sapiens
cgtcctgtcagtgccg

SEQ ID NO: 6105145 - DNA, 22 bp, Homo sapiens
cgtccttccatatccctgccca

SEQ ID NO: 6105146 - DNA, 21 bp, Homo sapiens
cgtcctttcctctcctctctg

SEQ ID NO: 6105147 - DNA, 16 bp, Homo sapiens
cgtcgaggaccgggca

SEQ ID NO: 6105148 - DNA, 17 bp, Homo sapiens
cgtcgaggggctctcag

SEQ ID NO: 6105149 - DNA, 16 bp, Homo sapiens
cgtcgccctcccaggc

SEQ ID NO: 6105150 - DNA, 16 bp, Homo sapiens
cgtcgcgctggacagc

SEQ ID NO: 6105151 - DNA, 14 bp, Homo sapiens
cgtcgctgtccgtc

SEQ ID NO: 6105152 - DNA, 14 bp, Homo sapiens
cgtcggaatggtaa

SEQ ID NO: 6105153 - DNA, 17 bp, Homo sapiens
cgtcggactgcccccag

SEQ ID NO: 6105154 - DNA, 22 bp, Homo sapiens
cgtcggactgcccccagaaagc

SEQ ID NO: 6105155 - DNA, 18 bp, Homo sapiens
cgtcggagctgcctgcag

SEQ ID NO: 6105156 - DNA, 19 bp, Homo sapiens
cgtcggagctgcctgcagc

SEQ ID NO: 6105157 - DNA, 21 bp, Homo sapiens
cgtcggagctgcctgcagcac

SEQ ID NO: 6105158 - DNA, 21 bp, Homo sapiens
cgtcggccctgcgtcggccct

SEQ ID NO: 6105159 - DNA, 23 bp, Homo sapiens
cgtcgggcgtgggtctctgggga

SEQ ID NO: 6105160 - DNA, 19 bp, Homo sapiens
cgtcgggcttccctggcct

SEQ ID NO: 6105161 - DNA, 21 bp, Homo sapiens
cgtcggggaggctcctgcctg

SEQ ID NO: 6105162 - DNA, 15 bp, Homo sapiens
cgtcggtcctggtgc

SEQ ID NO: 6105163 - DNA, 16 bp, Homo sapiens
cgtcgtgtgctgaaga

SEQ ID NO: 6105164 - DNA, 18 bp, Homo sapiens
cgtctaaccacagctcct

SEQ ID NO: 6105165 - DNA, 19 bp, Homo sapiens
cgtctacatttcacattat

SEQ ID NO: 6105166 - DNA, 15 bp, Homo sapiens
cgtctaccctgggat

SEQ ID NO: 6105167 - DNA, 14 bp, Homo sapiens
cgtctacctgaggg

SEQ ID NO: 6105168 - DNA, 22 bp, Homo sapiens
cgtctacgtatgcatgctaaat

SEQ ID NO: 6105169 - DNA, 21 bp, Homo sapiens
cgtctactcattccccggggc

SEQ ID NO: 6105170 - DNA, 19 bp, Homo sapiens
cgtctactgcaagagccaa

SEQ ID NO: 6105171 - DNA, 15 bp, Homo sapiens
cgtctcactgtgtgt

SEQ ID NO: 6105172 - DNA, 11 bp, Homo sapiens
cgtctcagtgt

SEQ ID NO: 6105173 - DNA, 17 bp, Homo sapiens
cgtctcatcctcctttc

SEQ ID NO: 6105174 - DNA, 13 bp, Homo sapiens
cgtctcatctccc

SEQ ID NO: 6105175 - DNA, 15 bp, Homo sapiens
cgtctcatcttctct

SEQ ID NO: 6105176 - DNA, 15 bp, Homo sapiens
cgtctcatgtaaaat

SEQ ID NO: 6105177 - DNA, 21 bp, Homo sapiens
cgtctcattttgtccatgtcc

SEQ ID NO: 6105178 - DNA, 22 bp, Homo sapiens
cgtctcattttgtccatgtccc

SEQ ID NO: 6105179 - DNA, 14 bp, Homo sapiens
cgtctccatctctg

SEQ ID NO: 6105180 - DNA, 12 bp, Homo sapiens
cgtctcccagat

SEQ ID NO: 6105181 - DNA, 14 bp, Homo sapiens
cgtctcccatcctg

SEQ ID NO: 6105182 - DNA, 11 bp, Homo sapiens
cgtctccccat

SEQ ID NO: 6105183 - DNA, 20 bp, Homo sapiens
cgtctccccatgctgggctc

SEQ ID NO: 6105184 - DNA, 21 bp, Homo sapiens
cgtctccccatgctgggctca

SEQ ID NO: 6105185 - DNA, 15 bp, Homo sapiens
cgtctcccccagagt

SEQ ID NO: 6105186 - DNA, 14 bp, Homo sapiens
cgtctcccccgtgt

SEQ ID NO: 6105187 - DNA, 11 bp, Homo sapiens
cgtctccctcg

SEQ ID NO: 6105188 - DNA, 22 bp, Homo sapiens
cgtctccctggtgcctctgtgc

SEQ ID NO: 6105189 - DNA, 20 bp, Homo sapiens
cgtctcccttggccacggcc

SEQ ID NO: 6105190 - DNA, 12 bp, Homo sapiens
cgtctcctccct

SEQ ID NO: 6105191 - DNA, 17 bp, Homo sapiens
cgtctcctcctcgaagc

SEQ ID NO: 6105192 - DNA, 16 bp, Homo sapiens
cgtctcctctccagcc

SEQ ID NO: 6105193 - DNA, 18 bp, Homo sapiens
cgtctcggcccctctgat

SEQ ID NO: 6105194 - DNA, 16 bp, Homo sapiens
cgtctcggccttcaca

SEQ ID NO: 6105195 - DNA, 13 bp, Homo sapiens
cgtctctcccacc

SEQ ID NO: 6105196 - DNA, 16 bp, Homo sapiens
cgtctctctgcctgct

SEQ ID NO: 6105197 - DNA, 19 bp, Homo sapiens
cgtctctctttctccctca

SEQ ID NO: 6105198 - DNA, 15 bp, Homo sapiens
cgtctctgccctggg

SEQ ID NO: 6105199 - DNA, 18 bp, Homo sapiens
cgtctctgccctgggctc

SEQ ID NO: 6105200 - DNA, 23 bp, Homo sapiens
cgtctctggagcggaatttacct

SEQ ID NO: 6105201 - DNA, 20 bp, Homo sapiens
cgtctcttttaccctggccc

SEQ ID NO: 6105202 - DNA, 21 bp, Homo sapiens
cgtctcttttaccctggcccc

SEQ ID NO: 6105203 - DNA, 13 bp, Homo sapiens
cgtctctttttgg

SEQ ID NO: 6105204 - DNA, 19 bp, Homo sapiens
cgtctgacaaatgtgtatg

SEQ ID NO: 6105205 - DNA, 20 bp, Homo sapiens
cgtctgacaggcaatgctgg

SEQ ID NO: 6105206 - DNA, 19 bp, Homo sapiens
cgtctgaccccagcccaga

SEQ ID NO: 6105207 - DNA, 21 bp, Homo sapiens
cgtctgaccccagcccagaca

SEQ ID NO: 6105208 - DNA, 16 bp, Homo sapiens
cgtctgaccctctgcg

SEQ ID NO: 6105209 - DNA, 14 bp, Homo sapiens
cgtctgactccctc

SEQ ID NO: 6105210 - DNA, 21 bp, Homo sapiens
cgtctgactccctccccaccc

SEQ ID NO: 6105211 - DNA, 13 bp, Homo sapiens
cgtctgactctgg

SEQ ID NO: 6105212 - DNA, 17 bp, Homo sapiens
cgtctgactctgggttc

SEQ ID NO: 6105213 - DNA, 17 bp, Homo sapiens
cgtctgagcggccgcct

SEQ ID NO: 6105214 - DNA, 16 bp, Homo sapiens
cgtctgagctggggtg

SEQ ID NO: 6105215 - DNA, 16 bp, Homo sapiens
cgtctgcacttctgtt

SEQ ID NO: 6105216 - DNA, 13 bp, Homo sapiens
cgtctgcagggtg

SEQ ID NO: 6105217 - DNA, 23 bp, Homo sapiens
cgtctgccaccagcgcccccact

SEQ ID NO: 6105218 - DNA, 16 bp, Homo sapiens
cgtctgccaggcccat

SEQ ID NO: 6105219 - DNA, 15 bp, Homo sapiens
cgtctgcccaccatt

SEQ ID NO: 6105220 - DNA, 10 bp, Homo sapiens
cgtctgcccc

SEQ ID NO: 6105221 - DNA, 15 bp, Homo sapiens
cgtctgcctggaaat

SEQ ID NO: 6105222 - DNA, 22 bp, Homo sapiens
cgtctgcctggaaattctggaa

SEQ ID NO: 6105223 - DNA, 14 bp, Homo sapiens
cgtctgccttggca

SEQ ID NO: 6105224 - DNA, 21 bp, Homo sapiens
cgtctgctcttctgtgcccag

SEQ ID NO: 6105225 - DNA, 15 bp, Homo sapiens
cgtctggaagtccaa

SEQ ID NO: 6105226 - DNA, 16 bp, Homo sapiens
cgtctggactgttctg

SEQ ID NO: 6105227 - DNA, 16 bp, Homo sapiens
cgtctggcgagccctt

SEQ ID NO: 6105228 - DNA, 21 bp, Homo sapiens
cgtctggcgagcccttagcct

SEQ ID NO: 6105229 - DNA, 22 bp, Homo sapiens
cgtctggcgagcccttagcctt

SEQ ID NO: 6105230 - DNA, 13 bp, Homo sapiens
cgtctggctccct

SEQ ID NO: 6105231 - DNA, 14 bp, Homo sapiens
cgtctggctccctg

SEQ ID NO: 6105232 - DNA, 22 bp, Homo sapiens
cgtctgggagaaattgacagat

SEQ ID NO: 6105233 - DNA, 19 bp, Homo sapiens
cgtctggggttcagcccct

SEQ ID NO: 6105234 - DNA, 23 bp, Homo sapiens
cgtctggggttcagcccctcctc

SEQ ID NO: 6105235 - DNA, 15 bp, Homo sapiens
cgtctgtatattttg

SEQ ID NO: 6105236 - DNA, 18 bp, Homo sapiens
cgtctgtcaggggcttgg

SEQ ID NO: 6105237 - DNA, 15 bp, Homo sapiens
cgtctgtccatctgc

SEQ ID NO: 6105238 - DNA, 20 bp, Homo sapiens
cgtctgtccatctgcccgcc

SEQ ID NO: 6105239 - DNA, 13 bp, Homo sapiens
cgtctgtgaatgc

SEQ ID NO: 6105240 - DNA, 20 bp, Homo sapiens
cgtctgtgtggtggagccag

SEQ ID NO: 6105241 - DNA, 18 bp, Homo sapiens
cctgccagtgccagggtg

SEQ ID NO: 6105242 - DNA, 13 bp, Homo sapiens
cctgccagtgcct

SEQ ID NO: 6105243 - DNA, 18 bp, Homo sapiens
cctgccagtgccttacct

SEQ ID NO: 6105244 - DNA, 18 bp, Homo sapiens
cctgccatcatgtttaca

SEQ ID NO: 6105245 - DNA, 13 bp, Homo sapiens
cctgccatcctca

SEQ ID NO: 6105246 - DNA, 15 bp, Homo sapiens
cctgccatcttccca

SEQ ID NO: 6105247 - DNA, 17 bp, Homo sapiens
cctgccatcttcccagc

SEQ ID NO: 6105248 - DNA, 15 bp, Homo sapiens
cctgccatgccagga

SEQ ID NO: 6105249 - DNA, 19 bp, Homo sapiens
cctgccatgccaggaacct

SEQ ID NO: 6105250 - DNA, 22 bp, Homo sapiens
cctgccatggaactgtttcctt

SEQ ID NO: 6105251 - DNA, 23 bp, Homo sapiens
cctgccatggaggcgccttcctg

SEQ ID NO: 6105252 - DNA, 14 bp, Homo sapiens
cctgccatggctgt

SEQ ID NO: 6105253 - DNA, 14 bp, Homo sapiens
cctgccatgggcca

SEQ ID NO: 6105254 - DNA, 15 bp, Homo sapiens
cctgccatgggccag

SEQ ID NO: 6105255 - DNA, 23 bp, Homo sapiens
cctgccatgggccagcctagccc

SEQ ID NO: 6105256 - DNA, 22 bp, Homo sapiens
cctgccatgggtgcagaccctg

SEQ ID NO: 6105257 - DNA, 23 bp, Homo sapiens
cctgccatgtacctcccctgcct

SEQ ID NO: 6105258 - DNA, 20 bp, Homo sapiens
cctgccatgtgtgagtcact

SEQ ID NO: 6105259 - DNA, 17 bp, Homo sapiens
cctgccatgtttagtga

SEQ ID NO: 6105260 - DNA, 18 bp, Homo sapiens
cctgccattcttctggtg

SEQ ID NO: 6105261 - DNA, 23 bp, Homo sapiens
cctgccattcttctggtgctact

SEQ ID NO: 6105262 - DNA, 16 bp, Homo sapiens
cctgccattggcctct

SEQ ID NO: 6105263 - DNA, 17 bp, Homo sapiens
cctgccattggcctctt

SEQ ID NO: 6105264 - DNA, 19 bp, Homo sapiens
cctgccattggcctcttgt

SEQ ID NO: 6105265 - DNA, 23 bp, Homo sapiens
cctgccattggcctcttgtccct

SEQ ID NO: 6105266 - DNA, 18 bp, Homo sapiens
cctgccatttaaaaagtt

SEQ ID NO: 6105267 - DNA, 13 bp, Homo sapiens
cctgccatttttt

SEQ ID NO: 6105268 - DNA, 14 bp, Homo sapiens
cctgccatttttta

SEQ ID NO: 6105269 - DNA, 9 bp, Homo sapiens
cctgcccaa

SEQ ID NO: 6105270 - DNA, 19 bp, Homo sapiens
cctgcccaaactccccttc

SEQ ID NO: 6105271 - DNA, 20 bp, Homo sapiens
cctgcccaaactccccttcc

SEQ ID NO: 6105272 - DNA, 18 bp, Homo sapiens
cctgcccaacctctgtgg

SEQ ID NO: 6105273 - DNA, 16 bp, Homo sapiens
cctgcccaagcccagg

SEQ ID NO: 6105274 - DNA, 17 bp, Homo sapiens
cctgcccaagtgaccag

SEQ ID NO: 6105275 - DNA, 20 bp, Homo sapiens
cctgcccaagtggctcttgg

SEQ ID NO: 6105276 - DNA, 19 bp, Homo sapiens
cctgcccaatcctccctgg

SEQ ID NO: 6105277 - DNA, 22 bp, Homo sapiens
cctgcccaatgctttgggaggc

SEQ ID NO: 6105278 - DNA, 20 bp, Homo sapiens
cctgcccacaactcccttgc

SEQ ID NO: 6105279 - DNA, 21 bp, Homo sapiens
cctgcccacaactcccttgca

SEQ ID NO: 6105280 - DNA, 14 bp, Homo sapiens
cctgcccacccccg

SEQ ID NO: 6105281 - DNA, 17 bp, Homo sapiens
cctgcccacccccggga

SEQ ID NO: 6105282 - DNA, 12 bp, Homo sapiens
cctgcccacccg

SEQ ID NO: 6105283 - DNA, 12 bp, Homo sapiens
cctgcccaccct

SEQ ID NO: 6105284 - DNA, 17 bp, Homo sapiens
cctgcccaccctaccag

SEQ ID NO: 6105285 - DNA, 22 bp, Homo sapiens
cctgcccaccctaccagctcct

SEQ ID NO: 6105286 - DNA, 13 bp, Homo sapiens
cctgcccacctct

SEQ ID NO: 6105287 - DNA, 12 bp, Homo sapiens
cctgcccacctg

SEQ ID NO: 6105288 - DNA, 14 bp, Homo sapiens
cctgcccacctggc

SEQ ID NO: 6105289 - DNA, 15 bp, Homo sapiens
cctgcccacctggcc

SEQ ID NO: 6105290 - DNA, 17 bp, Homo sapiens
cctgcccacctggcctc

SEQ ID NO: 6105291 - DNA, 13 bp, Homo sapiens
cctgcccacctgt

SEQ ID NO: 6105292 - DNA, 13 bp, Homo sapiens
cctgcccacgccc

SEQ ID NO: 6105293 - DNA, 17 bp, Homo sapiens
cctgcccacgcccttgg

SEQ ID NO: 6105294 - DNA, 20 bp, Homo sapiens
cctgcccacgcccttggagc

SEQ ID NO: 6105295 - DNA, 17 bp, Homo sapiens
cctgcccacgggaggac

SEQ ID NO: 6105296 - DNA, 16 bp, Homo sapiens
cctgcccactctgacc

SEQ ID NO: 6105297 - DNA, 17 bp, Homo sapiens
cctgcccactgctgcag

SEQ ID NO: 6105298 - DNA, 19 bp, Homo sapiens
cctgcccacttagccgtcc

SEQ ID NO: 6105299 - DNA, 20 bp, Homo sapiens
cctgcccacttcagcccagc

SEQ ID NO: 6105300 - DNA, 13 bp, Homo sapiens
cctgcccagactg

SEQ ID NO: 6105301 - DNA, 18 bp, Homo sapiens
cctgcccagactgatgag

SEQ ID NO: 6105302 - DNA, 22 bp, Homo sapiens
cctgcccagatcagccagaagc

SEQ ID NO: 6105303 - DNA, 14 bp, Homo sapiens
cctgcccagcacct

SEQ ID NO: 6105304 - DNA, 16 bp, Homo sapiens
cctgcccagcacctcc

SEQ ID NO: 6105305 - DNA, 18 bp, Homo sapiens
cctgcccagcacctcctc

SEQ ID NO: 6105306 - DNA, 21 bp, Homo sapiens
cctgcccagcacctcctccgt

SEQ ID NO: 6105307 - DNA, 12 bp, Homo sapiens
cctgcccagcca

SEQ ID NO: 6105308 - DNA, 14 bp, Homo sapiens
cctgcccagccagc

SEQ ID NO: 6105309 - DNA, 13 bp, Homo sapiens
cctgcccagccca

SEQ ID NO: 6105310 - DNA, 18 bp, Homo sapiens
cctgcccagccccctggt

SEQ ID NO: 6105311 - DNA, 17 bp, Homo sapiens
cctgcccagcctcaatg

SEQ ID NO: 6105312 - DNA, 15 bp, Homo sapiens
cctgcccagcctggg

SEQ ID NO: 6105313 - DNA, 15 bp, Homo sapiens
cctgcccagcctgtg

SEQ ID NO: 6105314 - DNA, 14 bp, Homo sapiens
cctgcccagctccc

SEQ ID NO: 6105315 - DNA, 14 bp, Homo sapiens
cctgcccagctcct

SEQ ID NO: 6105316 - DNA, 18 bp, Homo sapiens
cctgcccaggagcagctt

SEQ ID NO: 6105317 - DNA, 15 bp, Homo sapiens
cctgcccaggccaca

SEQ ID NO: 6105318 - DNA, 16 bp, Homo sapiens
cctgcccaggccacag

SEQ ID NO: 6105319 - DNA, 22 bp, Homo sapiens
cctgcccaggcccctgccaccc

SEQ ID NO: 6105320 - DNA, 15 bp, Homo sapiens
cctgcccagtccccc

SEQ ID NO: 6105321 - DNA, 16 bp, Homo sapiens
cctgcccagtccccca

SEQ ID NO: 6105322 - DNA, 22 bp, Homo sapiens
cctgcccagtcccccaacccca

SEQ ID NO: 6105323 - DNA, 20 bp, Homo sapiens
cctgcccagttagcccggcc

SEQ ID NO: 6105324 - DNA, 19 bp, Homo sapiens
cctgcccagttggaggaga

SEQ ID NO: 6105325 - DNA, 16 bp, Homo sapiens
cctgcccatgccccag

SEQ ID NO: 6105326 - DNA, 22 bp, Homo sapiens
cctgcccatgtcgcgctcagca

SEQ ID NO: 6105327 - DNA, 12 bp, Homo sapiens
cctgcccatgtg

SEQ ID NO: 6105328 - DNA, 16 bp, Homo sapiens
cctgcccatgtgtccc

SEQ ID NO: 6105329 - DNA, 22 bp, Homo sapiens
cctgcccattagagaagtattt

SEQ ID NO: 6105330 - DNA, 16 bp, Homo sapiens
cctgcccattggagag

SEQ ID NO: 6105331 - DNA, 23 bp, Homo sapiens
cctgccccaaataacttcagtcc

SEQ ID NO: 6105332 - DNA, 14 bp, Homo sapiens
cctgccccaactcc

SEQ ID NO: 6105333 - DNA, 17 bp, Homo sapiens
cctgccccaactgcagg

SEQ ID NO: 6105334 - DNA, 23 bp, Homo sapiens
cctgccccaagtggtgagcaagc

SEQ ID NO: 6105335 - DNA, 18 bp, Homo sapiens
cctgccccacacaggcct

SEQ ID NO: 6105336 - DNA, 16 bp, Homo sapiens
cctgccccacacggac

SEQ ID NO: 6105337 - DNA, 21 bp, Homo sapiens
cctgccccaccacgcatgctc

SEQ ID NO: 6105338 - DNA, 18 bp, Homo sapiens
cctgccccaccccacctc

SEQ ID NO: 6105339 - DNA, 16 bp, Homo sapiens
cctgccccaccccatc

SEQ ID NO: 6105340 - DNA, 21 bp, Homo sapiens
cctgccccaccccatccagcc

SEQ ID NO: 6105341 - DNA, 21 bp, Homo sapiens
cctgccccagagaagcctcag

SEQ ID NO: 6105342 - DNA, 22 bp, Homo sapiens
cctgccccagagaagcctcagt

SEQ ID NO: 6105343 - DNA, 14 bp, Homo sapiens
cctgccccagccca

SEQ ID NO: 6105344 - DNA, 15 bp, Homo sapiens
cctgccccagcccaa

SEQ ID NO: 6105345 - DNA, 17 bp, Homo sapiens
cctgccccagcccaagt

SEQ ID NO: 6105346 - DNA, 13 bp, Homo sapiens
cctgccccagcgc

SEQ ID NO: 6105347 - DNA, 15 bp, Homo sapiens
cctgccccagcgcgg

SEQ ID NO: 6105348 - DNA, 17 bp, Homo sapiens
cctgccccagcgcggct

SEQ ID NO: 6105349 - DNA, 16 bp, Homo sapiens
cctgccccagctctct

SEQ ID NO: 6105350 - DNA, 16 bp, Homo sapiens
cctgccccagctgggc

SEQ ID NO: 6105351 - DNA, 18 bp, Homo sapiens
cctgccccagctgggctg

SEQ ID NO: 6105352 - DNA, 19 bp, Homo sapiens
cctgccccagctgggctgt

SEQ ID NO: 6105353 - DNA, 15 bp, Homo sapiens
cctgccccaggcctg

SEQ ID NO: 6105354 - DNA, 16 bp, Homo sapiens
cctgccccaggcctga

SEQ ID NO: 6105355 - DNA, 18 bp, Homo sapiens
cctgccccaggcctgaaa

SEQ ID NO: 6105356 - DNA, 13 bp, Homo sapiens
cctgccccaggct

SEQ ID NO: 6105357 - DNA, 17 bp, Homo sapiens
cctgccccagggctccc

SEQ ID NO: 6105358 - DNA, 13 bp, Homo sapiens
cctgccccatccc

SEQ ID NO: 6105359 - DNA, 14 bp, Homo sapiens
cctgccccatccca

SEQ ID NO: 6105360 - DNA, 15 bp, Homo sapiens
cctgccccatcctgg

SEQ ID NO: 6105361 - DNA, 19 bp, Homo sapiens
cctgccccatcctgggcct

SEQ ID NO: 6105362 - DNA, 14 bp, Homo sapiens
cctgcccccaaagg

SEQ ID NO: 6105363 - DNA, 15 bp, Homo sapiens
cctgcccccaaataa

SEQ ID NO: 6105364 - DNA, 20 bp, Homo sapiens
cctgcccccaaggaggcagc

SEQ ID NO: 6105365 - DNA, 22 bp, Homo sapiens
cctgcccccaaggaggcagcct

SEQ ID NO: 6105366 - DNA, 16 bp, Homo sapiens
cctgcccccaatccat

SEQ ID NO: 6105367 - DNA, 17 bp, Homo sapiens
cctgcccccacacccac

SEQ ID NO: 6105368 - DNA, 22 bp, Homo sapiens
cctgcccccacacctggccctg

SEQ ID NO: 6105369 - DNA, 14 bp, Homo sapiens
cctgcccccacagc

SEQ ID NO: 6105370 - DNA, 16 bp, Homo sapiens
cctgcccccacagctc

SEQ ID NO: 6105371 - DNA, 18 bp, Homo sapiens
cctgcccccacagctcct

SEQ ID NO: 6105372 - DNA, 18 bp, Homo sapiens
cctgcccccaccccaggc

SEQ ID NO: 6105373 - DNA, 14 bp, Homo sapiens
cctgcccccacttc

SEQ ID NO: 6105374 - DNA, 18 bp, Homo sapiens
cctgcccccagcactcct

SEQ ID NO: 6105375 - DNA, 15 bp, Homo sapiens
cctgcccccagcccc

SEQ ID NO: 6105376 - DNA, 14 bp, Homo sapiens
cctgcccccaggac

SEQ ID NO: 6105377 - DNA, 15 bp, Homo sapiens
cctgcccccaggact

SEQ ID NO: 6105378 - DNA, 20 bp, Homo sapiens
cctgcccccaggactgggcc

SEQ ID NO: 6105379 - DNA, 14 bp, Homo sapiens
cctgccccccaagg

SEQ ID NO: 6105380 - DNA, 23 bp, Homo sapiens
cctgccccccacattctggctcc

SEQ ID NO: 6105381 - DNA, 14 bp, Homo sapiens
cctgccccccagcc

SEQ ID NO: 6105382 - DNA, 18 bp, Homo sapiens
cctgccccccagtctccc

SEQ ID NO: 6105383 - DNA, 19 bp, Homo sapiens
cctgccccccctaagagac

SEQ ID NO: 6105384 - DNA, 22 bp, Homo sapiens
cctgccccccctaagagacaca

SEQ ID NO: 6105385 - DNA, 12 bp, Homo sapiens
cctgcccccctt

SEQ ID NO: 6105386 - DNA, 15 bp, Homo sapiens
cctgcccccgacagc

SEQ ID NO: 6105387 - DNA, 20 bp, Homo sapiens
cctgcccccgcatcccctgc

SEQ ID NO: 6105388 - DNA, 17 bp, Homo sapiens
cctgcccccgtcccacc

SEQ ID NO: 6105389 - DNA, 22 bp, Homo sapiens
cctgccccctatcttgtcctgg

SEQ ID NO: 6105390 - DNA, 19 bp, Homo sapiens
cctgccccctgcaggaagg

SEQ ID NO: 6105391 - DNA, 20 bp, Homo sapiens
cctgccccctgcaggaagga

SEQ ID NO: 6105392 - DNA, 15 bp, Homo sapiens
cctgccccctgccag

SEQ ID NO: 6105393 - DNA, 18 bp, Homo sapiens
cctgccccctgccagccg

SEQ ID NO: 6105394 - DNA, 18 bp, Homo sapiens
cctgccccctgccagtga

SEQ ID NO: 6105395 - DNA, 15 bp, Homo sapiens
cctgccccctggctg

SEQ ID NO: 6105396 - DNA, 16 bp, Homo sapiens
cctgccccctggctga

SEQ ID NO: 6105397 - DNA, 17 bp, Homo sapiens
cctgccccctggctgac

SEQ ID NO: 6105398 - DNA, 21 bp, Homo sapiens
cctgccccctggctgactggc

SEQ ID NO: 6105399 - DNA, 16 bp, Homo sapiens
cctgccccctggtgga

SEQ ID NO: 6105400 - DNA, 23 bp, Homo sapiens
cctgcccccttctcccacactgc

SEQ ID NO: 6105401 - DNA, 21 bp, Homo sapiens
cctgccccgcaggcctgcctt

SEQ ID NO: 6105402 - DNA, 22 bp, Homo sapiens
cctgccccgcccagctgcacct

SEQ ID NO: 6105403 - DNA, 14 bp, Homo sapiens
cctgccccgccccc

SEQ ID NO: 6105404 - DNA, 20 bp, Homo sapiens
cctgccccgcccccagtccc

SEQ ID NO: 6105405 - DNA, 19 bp, Homo sapiens
cctgccccgccccccagag

SEQ ID NO: 6105406 - DNA, 21 bp, Homo sapiens
cctgccccgccccccagagcc

SEQ ID NO: 6105407 - DNA, 23 bp, Homo sapiens
cctgccccgccccccagagccag

SEQ ID NO: 6105408 - DNA, 20 bp, Homo sapiens
cctgccccgccttcgtgtgc

SEQ ID NO: 6105409 - DNA, 19 bp, Homo sapiens
cctgccccggacctacctc

SEQ ID NO: 6105410 - DNA, 18 bp, Homo sapiens
cctgccccggagctggag

SEQ ID NO: 6105411 - DNA, 15 bp, Homo sapiens
cctgccccggccact

SEQ ID NO: 6105412 - DNA, 12 bp, Homo sapiens
cctgcccctagg

SEQ ID NO: 6105413 - DNA, 22 bp, Homo sapiens
cctgcccctcaactctcctcca

SEQ ID NO: 6105414 - DNA, 20 bp, Homo sapiens
cctgcccctccccaaaagaa

SEQ ID NO: 6105415 - DNA, 21 bp, Homo sapiens
cctgcccctccccaaaagaaa

SEQ ID NO: 6105416 - DNA, 22 bp, Homo sapiens
cctgcccctccccaaaagaaac

SEQ ID NO: 6105417 - DNA, 17 bp, Homo sapiens
cctgcccctccccagcc

SEQ ID NO: 6105418 - DNA, 15 bp, Homo sapiens
cctgcccctccctct

SEQ ID NO: 6105419 - DNA, 16 bp, Homo sapiens
cctgcccctcccttca

SEQ ID NO: 6105420 - DNA, 20 bp, Homo sapiens
cgtctgtgtgtgacccctcc

SEQ ID NO: 6105421 - DNA, 19 bp, Homo sapiens
cgtctgtgtgtgcctgtgt

SEQ ID NO: 6105422 - DNA, 14 bp, Homo sapiens
cgtctgttccccct

SEQ ID NO: 6105423 - DNA, 14 bp, Homo sapiens
cgtcttcacactgc

SEQ ID NO: 6105424 - DNA, 16 bp, Homo sapiens
cgtcttcacactgcgc

SEQ ID NO: 6105425 - DNA, 13 bp, Homo sapiens
cgtcttcagccta

SEQ ID NO: 6105426 - DNA, 14 bp, Homo sapiens
cgtcttcagcctag

SEQ ID NO: 6105427 - DNA, 15 bp, Homo sapiens
cgtcttcatctccct

SEQ ID NO: 6105428 - DNA, 19 bp, Homo sapiens
cgtcttcatctccctgcca

SEQ ID NO: 6105429 - DNA, 22 bp, Homo sapiens
cgtcttcccagcggttcctgtg

SEQ ID NO: 6105430 - DNA, 21 bp, Homo sapiens
cgtcttccgcccctgcctgcc

SEQ ID NO: 6105431 - DNA, 17 bp, Homo sapiens
cgtcttccgtctccccc

SEQ ID NO: 6105432 - DNA, 13 bp, Homo sapiens
cgtcttcctcctc

SEQ ID NO: 6105433 - DNA, 17 bp, Homo sapiens
cgtcttcgccctctgaa

SEQ ID NO: 6105434 - DNA, 18 bp, Homo sapiens
cgtcttcgccctctgaaa

SEQ ID NO: 6105435 - DNA, 21 bp, Homo sapiens
cgtcttcgccctctgaaatta

SEQ ID NO: 6105436 - DNA, 13 bp, Homo sapiens
cgtcttctccaac

SEQ ID NO: 6105437 - DNA, 19 bp, Homo sapiens
cgtcttctgtatactgtgg

SEQ ID NO: 6105438 - DNA, 23 bp, Homo sapiens
cgtcttgcccagcagctcaagaa

SEQ ID NO: 6105439 - DNA, 17 bp, Homo sapiens
cgtcttgcttgggaagg

SEQ ID NO: 6105440 - DNA, 16 bp, Homo sapiens
cgtcttgggtcgccct

SEQ ID NO: 6105441 - DNA, 22 bp, Homo sapiens
cgtcttgggtcgccctaccctc

SEQ ID NO: 6105442 - DNA, 23 bp, Homo sapiens
cgtcttggtttggttcatggtga

SEQ ID NO: 6105443 - DNA, 15 bp, Homo sapiens
cgtcttgtattttct

SEQ ID NO: 6105444 - DNA, 12 bp, Homo sapiens
cgtcttgtgaaa

SEQ ID NO: 6105445 - DNA, 11 bp, Homo sapiens
cgtctttccca

SEQ ID NO: 6105446 - DNA, 10 bp, Homo sapiens
cgtctttgca

SEQ ID NO: 6105447 - DNA, 21 bp, Homo sapiens
cgtctttggaggaacagctcc

SEQ ID NO: 6105448 - DNA, 18 bp, Homo sapiens
cgtctttggttcctcatg

SEQ ID NO: 6105449 - DNA, 17 bp, Homo sapiens
cgtctttttgtttgttt

SEQ ID NO: 6105450 - DNA, 16 bp, Homo sapiens
cgtgaaaacactcgtg

SEQ ID NO: 6105451 - DNA, 22 bp, Homo sapiens
cgtgaaaaccaaccctgtgggc

SEQ ID NO: 6105452 - DNA, 12 bp, Homo sapiens
cgtgaaacacac

SEQ ID NO: 6105453 - DNA, 15 bp, Homo sapiens
cgtgaaacacaccag

SEQ ID NO: 6105454 - DNA, 24 bp, Homo sapiens
cgtgaaacacaccaggctgtgggc

SEQ ID NO: 6105455 - DNA, 13 bp, Homo sapiens
cgtgaaaccctgt

SEQ ID NO: 6105456 - DNA, 13 bp, Homo sapiens
cgtgaaagccaga

SEQ ID NO: 6105457 - DNA, 23 bp, Homo sapiens
cgtgaaagtgcatttttgtaaat

SEQ ID NO: 6105458 - DNA, 17 bp, Homo sapiens
cgtgaaagttgtgatct

SEQ ID NO: 6105459 - DNA, 11 bp, Homo sapiens
cgtgaaatact

SEQ ID NO: 6105460 - DNA, 17 bp, Homo sapiens
cgtgaaatttgcctctg

SEQ ID NO: 6105461 - DNA, 14 bp, Homo sapiens
cgtgaaccagaggg

SEQ ID NO: 6105462 - DNA, 14 bp, Homo sapiens
cgtgaactgcagtg

SEQ ID NO: 6105463 - DNA, 15 bp, Homo sapiens
cgtgaactgcagtga

SEQ ID NO: 6105464 - DNA, 22 bp, Homo sapiens
cgtgaagaaataaatgaaactt

SEQ ID NO: 6105465 - DNA, 22 bp, Homo sapiens
cgtgaagagaaagacagtattt

SEQ ID NO: 6105466 - DNA, 20 bp, Homo sapiens
cgtgaagaggggaagtctct

SEQ ID NO: 6105467 - DNA, 16 bp, Homo sapiens
cgtgaagatactttgt

SEQ ID NO: 6105468 - DNA, 18 bp, Homo sapiens
cgtgaagatactttgtat

SEQ ID NO: 6105469 - DNA, 22 bp, Homo sapiens
cgtgaagatactttgtattgtc

SEQ ID NO: 6105470 - DNA, 15 bp, Homo sapiens
cgtgaagcagtgcct

SEQ ID NO: 6105471 - DNA, 17 bp, Homo sapiens
cgtgaagggcaccgaga

SEQ ID NO: 6105472 - DNA, 21 bp, Homo sapiens
cgtgaataagttgattctgtc

SEQ ID NO: 6105473 - DNA, 22 bp, Homo sapiens
cgtgaataagttgattctgtcc

SEQ ID NO: 6105474 - DNA, 15 bp, Homo sapiens
cgtgaatgtctcagc

SEQ ID NO: 6105475 - DNA, 16 bp, Homo sapiens
cgtgaatgtctcagcg

SEQ ID NO: 6105476 - DNA, 14 bp, Homo sapiens
cgtgacaacacttg

SEQ ID NO: 6105477 - DNA, 21 bp, Homo sapiens
cgtgacactctccttgcagtt

SEQ ID NO: 6105478 - DNA, 15 bp, Homo sapiens
cgtgacactgtgggt

SEQ ID NO: 6105479 - DNA, 15 bp, Homo sapiens
cgtgacagactcctg

SEQ ID NO: 6105480 - DNA, 16 bp, Homo sapiens
cgtgacagactcctga

SEQ ID NO: 6105481 - DNA, 17 bp, Homo sapiens
cgtgacagcctctgact

SEQ ID NO: 6105482 - DNA, 21 bp, Homo sapiens
cgtgacaggctcgtcagccac

SEQ ID NO: 6105483 - DNA, 20 bp, Homo sapiens
cgtgaccaattgccctgcca

SEQ ID NO: 6105484 - DNA, 22 bp, Homo sapiens
cgtgaccaattgccctgccagg

SEQ ID NO: 6105485 - DNA, 12 bp, Homo sapiens
cgtgaccagccc

SEQ ID NO: 6105486 - DNA, 14 bp, Homo sapiens
cgtgaccagccccg

SEQ ID NO: 6105487 - DNA, 16 bp, Homo sapiens
cgtgaccctgtgcccc

SEQ ID NO: 6105488 - DNA, 14 bp, Homo sapiens
cgtgacccttcagg

SEQ ID NO: 6105489 - DNA, 19 bp, Homo sapiens
cgtgacccttcagggccag

SEQ ID NO: 6105490 - DNA, 20 bp, Homo sapiens
cgtgacccttcagggccaga

SEQ ID NO: 6105491 - DNA, 18 bp, Homo sapiens
cgtgaccggcccgccacc

SEQ ID NO: 6105492 - DNA, 22 bp, Homo sapiens
cgtgacctgctaggccagagcc

SEQ ID NO: 6105493 - DNA, 12 bp, Homo sapiens
cgtgacctggtc

SEQ ID NO: 6105494 - DNA, 14 bp, Homo sapiens
cgtgacgctgaata

SEQ ID NO: 6105495 - DNA, 15 bp, Homo sapiens
cgtgactcacccaag

SEQ ID NO: 6105496 - DNA, 17 bp, Homo sapiens
cgtgactcacccaagca

SEQ ID NO: 6105497 - DNA, 17 bp, Homo sapiens
cgtgactgccccaactc

SEQ ID NO: 6105498 - DNA, 20 bp, Homo sapiens
cgtgactgccccaactcctg

SEQ ID NO: 6105499 - DNA, 22 bp, Homo sapiens
cgtgactgccccaactcctgga

SEQ ID NO: 6105500 - DNA, 19 bp, Homo sapiens
cgtgactggcctgctggat

SEQ ID NO: 6105501 - DNA, 16 bp, Homo sapiens
cgtgacttcagactct

SEQ ID NO: 6105502 - DNA, 22 bp, Homo sapiens
cgtgagaaatagctgaaaaggg

SEQ ID NO: 6105503 - DNA, 12 bp, Homo sapiens
cgtgagacacaa

SEQ ID NO: 6105504 - DNA, 21 bp, Homo sapiens
cgtgagacgccaccattcctg

SEQ ID NO: 6105505 - DNA, 14 bp, Homo sapiens
cgtgagagaaagag

SEQ ID NO: 6105506 - DNA, 17 bp, Homo sapiens
cgtgagagaaagagaga

SEQ ID NO: 6105507 - DNA, 23 bp, Homo sapiens
cgtgagagaaagagagaagccag

SEQ ID NO: 6105508 - DNA, 19 bp, Homo sapiens
cgtgagagcccaatcactg

SEQ ID NO: 6105509 - DNA, 21 bp, Homo sapiens
cgtgagcaccaccagggctcc

SEQ ID NO: 6105510 - DNA, 14 bp, Homo sapiens
cgtgagcatgcaca

SEQ ID NO: 6105511 - DNA, 22 bp, Homo sapiens
cgtgagccaccatgcctggccc

SEQ ID NO: 6105512 - DNA, 14 bp, Homo sapiens
cgtgagccaccgcg

SEQ ID NO: 6105513 - DNA, 14 bp, Homo sapiens
cgtgagccacctcg

SEQ ID NO: 6105514 - DNA, 15 bp, Homo sapiens
cgtgagccactgcac

SEQ ID NO: 6105515 - DNA, 20 bp, Homo sapiens
cgtgagccactgcaccgggc

SEQ ID NO: 6105516 - DNA, 21 bp, Homo sapiens
cgtgagccactgcgcccggcc

SEQ ID NO: 6105517 - DNA, 13 bp, Homo sapiens
cgtgagccccatc

SEQ ID NO: 6105518 - DNA, 16 bp, Homo sapiens
cgtgagccccatcttc

SEQ ID NO: 6105519 - DNA, 19 bp, Homo sapiens
cgtgagcgacaaagatgat

SEQ ID NO: 6105520 - DNA, 15 bp, Homo sapiens
cgtgagcgccccgcc

SEQ ID NO: 6105521 - DNA, 14 bp, Homo sapiens
cgtgagctgagcag

SEQ ID NO: 6105522 - DNA, 22 bp, Homo sapiens
cgtgagctgcccggcgcctgcc

SEQ ID NO: 6105523 - DNA, 15 bp, Homo sapiens
cgtgagctggggact

SEQ ID NO: 6105524 - DNA, 22 bp, Homo sapiens
cgtgagctggggactcagggac

SEQ ID NO: 6105525 - DNA, 12 bp, Homo sapiens
cgtgaggagggg

SEQ ID NO: 6105526 - DNA, 13 bp, Homo sapiens
cgtgaggccaaga

SEQ ID NO: 6105527 - DNA, 14 bp, Homo sapiens
cgtgaggccagaga

SEQ ID NO: 6105528 - DNA, 16 bp, Homo sapiens
cgtgaggccagagaca

SEQ ID NO: 6105529 - DNA, 13 bp, Homo sapiens
cgtgaggcccctg

SEQ ID NO: 6105530 - DNA, 17 bp, Homo sapiens
cgtgaggcccctgtgca

SEQ ID NO: 6105531 - DNA, 13 bp, Homo sapiens
cgtgaggcctggg

SEQ ID NO: 6105532 - DNA, 16 bp, Homo sapiens
cgtgagtcctggcatg

SEQ ID NO: 6105533 - DNA, 19 bp, Homo sapiens
cgtgagtcctggcatggga

SEQ ID NO: 6105534 - DNA, 15 bp, Homo sapiens
cgtgagtgtgacttt

SEQ ID NO: 6105535 - DNA, 15 bp, Homo sapiens
cgtgagtgtgtgagc

SEQ ID NO: 6105536 - DNA, 21 bp, Homo sapiens
cgtgagttctcagggctcctg

SEQ ID NO: 6105537 - DNA, 16 bp, Homo sapiens
cgtgataaatatatgg

SEQ ID NO: 6105538 - DNA, 14 bp, Homo sapiens
cgtgataatttttg

SEQ ID NO: 6105539 - DNA, 22 bp, Homo sapiens
cgtgatagaagaaaagcactgg

SEQ ID NO: 6105540 - DNA, 22 bp, Homo sapiens
cgtgatatccacaaatgctatt

SEQ ID NO: 6105541 - DNA, 22 bp, Homo sapiens
cgtgatcaaagccacactctgg

SEQ ID NO: 6105542 - DNA, 16 bp, Homo sapiens
cgtgatcactgagcca

SEQ ID NO: 6105543 - DNA, 22 bp, Homo sapiens
cgtgatccatccatctccaggg

SEQ ID NO: 6105544 - DNA, 21 bp, Homo sapiens
cgtgatcccctgcttctggct

SEQ ID NO: 6105545 - DNA, 17 bp, Homo sapiens
cgtgatccgcctgcctc

SEQ ID NO: 6105546 - DNA, 18 bp, Homo sapiens
cgtgatccgcctgcctct

SEQ ID NO: 6105547 - DNA, 19 bp, Homo sapiens
cgtgatccgcctgcctctg

SEQ ID NO: 6105548 - DNA, 14 bp, Homo sapiens
cgtgatctcagctc

SEQ ID NO: 6105549 - DNA, 21 bp, Homo sapiens
cgtgatctctgttacaaaaga

SEQ ID NO: 6105550 - DNA, 16 bp, Homo sapiens
cgtgatcttattgctt

SEQ ID NO: 6105551 - DNA, 14 bp, Homo sapiens
cgtgatcttggctc

SEQ ID NO: 6105552 - DNA, 22 bp, Homo sapiens
cgtgatgctatgcatgtctgac

SEQ ID NO: 6105553 - DNA, 15 bp, Homo sapiens
cgtgatggaccaaag

SEQ ID NO: 6105554 - DNA, 20 bp, Homo sapiens
cgtgatggcaggtgcctgta

SEQ ID NO: 6105555 - DNA, 15 bp, Homo sapiens
cgtgatgggctaggc

SEQ ID NO: 6105556 - DNA, 13 bp, Homo sapiens
cgtgatgtggagg

SEQ ID NO: 6105557 - DNA, 20 bp, Homo sapiens
cgtgatgtggaggaagagcc

SEQ ID NO: 6105558 - DNA, 21 bp, Homo sapiens
cgtgatgtggaggaagagcca

SEQ ID NO: 6105559 - DNA, 23 bp, Homo sapiens
cgtgatgtggaggaagagccacc

SEQ ID NO: 6105560 - DNA, 13 bp, Homo sapiens
cgtgattctgttc

SEQ ID NO: 6105561 - DNA, 14 bp, Homo sapiens
cgtgattcttgaaa

SEQ ID NO: 6105562 - DNA, 16 bp, Homo sapiens
cgtgattgacccttta

SEQ ID NO: 6105563 - DNA, 21 bp, Homo sapiens
cgtgatttggaagagaggcac

SEQ ID NO: 6105564 - DNA, 20 bp, Homo sapiens
cgtgcaacggaagccaggcc

SEQ ID NO: 6105565 - DNA, 13 bp, Homo sapiens
cgtgcaaggactc

SEQ ID NO: 6105566 - DNA, 17 bp, Homo sapiens
cgtgcacaaaccttctt

SEQ ID NO: 6105567 - DNA, 22 bp, Homo sapiens
cgtgcacaaaccttcttttcaa

SEQ ID NO: 6105568 - DNA, 23 bp, Homo sapiens
cgtgcacaaaccttcttttcaat

SEQ ID NO: 6105569 - DNA, 12 bp, Homo sapiens
cgtgcacacacc

SEQ ID NO: 6105570 - DNA, 19 bp, Homo sapiens
cgtgcacacaccagagccc

SEQ ID NO: 6105571 - DNA, 20 bp, Homo sapiens
cgtgcacacaccagagccca

SEQ ID NO: 6105572 - DNA, 13 bp, Homo sapiens
cgtgcacacacct

SEQ ID NO: 6105573 - DNA, 14 bp, Homo sapiens
cgtgcacacacctg

SEQ ID NO: 6105574 - DNA, 18 bp, Homo sapiens
cgtgcacacacctgcaca

SEQ ID NO: 6105575 - DNA, 14 bp, Homo sapiens
cgtgcacagcgcgg

SEQ ID NO: 6105576 - DNA, 19 bp, Homo sapiens
cgtgcacggggccagcatc

SEQ ID NO: 6105577 - DNA, 15 bp, Homo sapiens
cgtgcactgacagcc

SEQ ID NO: 6105578 - DNA, 17 bp, Homo sapiens
cgtgcagactggagggg

SEQ ID NO: 6105579 - DNA, 20 bp, Homo sapiens
cgtgcagagctgcacttggc

SEQ ID NO: 6105580 - DNA, 12 bp, Homo sapiens
cgtgcaggactc

SEQ ID NO: 6105581 - DNA, 12 bp, Homo sapiens
cgtgcagggcca

SEQ ID NO: 6105582 - DNA, 14 bp, Homo sapiens
cgtgcagtatctca

SEQ ID NO: 6105583 - DNA, 15 bp, Homo sapiens
cgtgcataaaaactg

SEQ ID NO: 6105584 - DNA, 13 bp, Homo sapiens
cgtgcatcccaga

SEQ ID NO: 6105585 - DNA, 17 bp, Homo sapiens
cgtgcatccctgagaca

SEQ ID NO: 6105586 - DNA, 14 bp, Homo sapiens
cgtgcatgctctgc

SEQ ID NO: 6105587 - DNA, 17 bp, Homo sapiens
cgtgcatgctctgcagc

SEQ ID NO: 6105588 - DNA, 20 bp, Homo sapiens
cgtgcatggctcctgtctgg

SEQ ID NO: 6105589 - DNA, 19 bp, Homo sapiens
cgtgcattagcacagattt

SEQ ID NO: 6105590 - DNA, 12 bp, Homo sapiens
cgtgcattgtgc

SEQ ID NO: 6105591 - DNA, 12 bp, Homo sapiens
cgtgcatttgtg

SEQ ID NO: 6105592 - DNA, 20 bp, Homo sapiens
cgtgccaaagtctcccttct

SEQ ID NO: 6105593 - DNA, 16 bp, Homo sapiens
cgtgccaacagagagg

SEQ ID NO: 6105594 - DNA, 14 bp, Homo sapiens
cgtgccaaccccac

SEQ ID NO: 6105595 - DNA, 23 bp, Homo sapiens
cgtgccaagtccaggtcctggtg

SEQ ID NO: 6105596 - DNA, 22 bp, Homo sapiens
cgtgccacatcaataacaacag

SEQ ID NO: 6105597 - DNA, 19 bp, Homo sapiens
cgtgccaccccgagggctg

SEQ ID NO: 6105598 - DNA, 17 bp, Homo sapiens
cgtgccacgcgctctgc

SEQ ID NO: 6105599 - DNA, 21 bp, Homo sapiens
cgtgccacgcgctctgcatgc

SEQ ID NO: 6105600 - DNA, 15 bp, Homo sapiens
cctgcccctctcccg

SEQ ID NO: 6105601 - DNA, 17 bp, Homo sapiens
cctgcccctctgttctc

SEQ ID NO: 6105602 - DNA, 12 bp, Homo sapiens
cctgcccctctt

SEQ ID NO: 6105603 - DNA, 14 bp, Homo sapiens
cctgcccctctttc

SEQ ID NO: 6105604 - DNA, 23 bp, Homo sapiens
cctgcccctctttctctttcttc

SEQ ID NO: 6105605 - DNA, 12 bp, Homo sapiens
cctgcccctgca

SEQ ID NO: 6105606 - DNA, 15 bp, Homo sapiens
cctgcccctgcccca

SEQ ID NO: 6105607 - DNA, 16 bp, Homo sapiens
cctgcccctgcccgag

SEQ ID NO: 6105608 - DNA, 18 bp, Homo sapiens
cctgcccctgcccgagag

SEQ ID NO: 6105609 - DNA, 13 bp, Homo sapiens
cctgcccctgcct

SEQ ID NO: 6105610 - DNA, 13 bp, Homo sapiens
cctgcccctgtgg

SEQ ID NO: 6105611 - DNA, 23 bp, Homo sapiens
cctgccccttctacactctcctg

SEQ ID NO: 6105612 - DNA, 24 bp, Homo sapiens
cctgccccttgtcctctcagagcc

SEQ ID NO: 6105613 - DNA, 21 bp, Homo sapiens
cctgcccctttcttccccacc

SEQ ID NO: 6105614 - DNA, 16 bp, Homo sapiens
cctgcccgagagctct

SEQ ID NO: 6105615 - DNA, 17 bp, Homo sapiens
cctgcccgagagctctt

SEQ ID NO: 6105616 - DNA, 18 bp, Homo sapiens
cctgcccgagggcagccc

SEQ ID NO: 6105617 - DNA, 22 bp, Homo sapiens
cctgcccgagggcagccccctc

SEQ ID NO: 6105618 - DNA, 23 bp, Homo sapiens
cctgcccgaggtcgctgcagccc

SEQ ID NO: 6105619 - DNA, 21 bp, Homo sapiens
cctgcccgatccagattccca

SEQ ID NO: 6105620 - DNA, 15 bp, Homo sapiens
cctgcccgcacagca

SEQ ID NO: 6105621 - DNA, 15 bp, Homo sapiens
cctgcccgcaccctg

SEQ ID NO: 6105622 - DNA, 16 bp, Homo sapiens
cctgcccgcaccctgg

SEQ ID NO: 6105623 - DNA, 19 bp, Homo sapiens
cctgcccgcaccctggcct

SEQ ID NO: 6105624 - DNA, 21 bp, Homo sapiens
cctgcccgcaccctggcctgg

SEQ ID NO: 6105625 - DNA, 19 bp, Homo sapiens
cctgcccgcagacctctgg

SEQ ID NO: 6105626 - DNA, 15 bp, Homo sapiens
cctgcccgcccgccg

SEQ ID NO: 6105627 - DNA, 16 bp, Homo sapiens
cctgcccggctgcgga

SEQ ID NO: 6105628 - DNA, 16 bp, Homo sapiens
cctgcccggggagctg

SEQ ID NO: 6105629 - DNA, 18 bp, Homo sapiens
cctgcccggggagctgca

SEQ ID NO: 6105630 - DNA, 22 bp, Homo sapiens
cctgcccggggagctgcagagc

SEQ ID NO: 6105631 - DNA, 15 bp, Homo sapiens
cctgcccgtaaacac

SEQ ID NO: 6105632 - DNA, 22 bp, Homo sapiens
cctgcccgtaaacacgcctgca

SEQ ID NO: 6105633 - DNA, 23 bp, Homo sapiens
cctgcccgtaaacacgcctgcaa

SEQ ID NO: 6105634 - DNA, 19 bp, Homo sapiens
cctgcccgtctctctccca

SEQ ID NO: 6105635 - DNA, 18 bp, Homo sapiens
cctgcccgtgccctggtg

SEQ ID NO: 6105636 - DNA, 15 bp, Homo sapiens
cctgcccgtgtacat

SEQ ID NO: 6105637 - DNA, 22 bp, Homo sapiens
cctgcccgttgccgggcctgga

SEQ ID NO: 6105638 - DNA, 22 bp, Homo sapiens
cctgccctagagcacactgtag

SEQ ID NO: 6105639 - DNA, 14 bp, Homo sapiens
cctgccctagctcc

SEQ ID NO: 6105640 - DNA, 14 bp, Homo sapiens
cctgccctcaaggg

SEQ ID NO: 6105641 - DNA, 13 bp, Homo sapiens
cctgccctcactc

SEQ ID NO: 6105642 - DNA, 16 bp, Homo sapiens
cctgccctcactccct

SEQ ID NO: 6105643 - DNA, 13 bp, Homo sapiens
cctgccctccagc

SEQ ID NO: 6105644 - DNA, 18 bp, Homo sapiens
cctgccctccagctgctg

SEQ ID NO: 6105645 - DNA, 15 bp, Homo sapiens
cctgccctcccaagt

SEQ ID NO: 6105646 - DNA, 20 bp, Homo sapiens
cctgccctccccagagcact

SEQ ID NO: 6105647 - DNA, 21 bp, Homo sapiens
cctgccctcccctgctcccag

SEQ ID NO: 6105648 - DNA, 15 bp, Homo sapiens
cctgccctcccgcac

SEQ ID NO: 6105649 - DNA, 21 bp, Homo sapiens
cctgccctcctacagcactcc

SEQ ID NO: 6105650 - DNA, 14 bp, Homo sapiens
cctgccctcctctc

SEQ ID NO: 6105651 - DNA, 19 bp, Homo sapiens
cctgccctcctgagcctcc

SEQ ID NO: 6105652 - DNA, 15 bp, Homo sapiens
cctgccctcgggtct

SEQ ID NO: 6105653 - DNA, 16 bp, Homo sapiens
cctgccctcgggtctc

SEQ ID NO: 6105654 - DNA, 17 bp, Homo sapiens
cctgccctctatttatt

SEQ ID NO: 6105655 - DNA, 13 bp, Homo sapiens
cctgccctctctg

SEQ ID NO: 6105656 - DNA, 15 bp, Homo sapiens
cctgccctctgcccc

SEQ ID NO: 6105657 - DNA, 23 bp, Homo sapiens
cctgccctctgctctgcctggag

SEQ ID NO: 6105658 - DNA, 14 bp, Homo sapiens
cctgccctgaggag

SEQ ID NO: 6105659 - DNA, 11 bp, Homo sapiens
cctgccctgca

SEQ ID NO: 6105660 - DNA, 12 bp, Homo sapiens
cctgccctgcac

SEQ ID NO: 6105661 - DNA, 11 bp, Homo sapiens
cctgccctgcc

SEQ ID NO: 6105662 - DNA, 15 bp, Homo sapiens
cctgccctgccacct

SEQ ID NO: 6105663 - DNA, 18 bp, Homo sapiens
cctgccctgccacctgtc

SEQ ID NO: 6105664 - DNA, 21 bp, Homo sapiens
cctgccctgccacctgtctgt

SEQ ID NO: 6105665 - DNA, 14 bp, Homo sapiens
cctgccctgcccag

SEQ ID NO: 6105666 - DNA, 14 bp, Homo sapiens
cctgccctgcctga

SEQ ID NO: 6105667 - DNA, 13 bp, Homo sapiens
cctgccctgcctt

SEQ ID NO: 6105668 - DNA, 14 bp, Homo sapiens
cctgccctgccttg

SEQ ID NO: 6105669 - DNA, 16 bp, Homo sapiens
cctgccctgccttgcc

SEQ ID NO: 6105670 - DNA, 23 bp, Homo sapiens
cctgccctgctatttcaggccct

SEQ ID NO: 6105671 - DNA, 15 bp, Homo sapiens
cctgccctgctgagc

SEQ ID NO: 6105672 - DNA, 16 bp, Homo sapiens
cctgccctgctgagca

SEQ ID NO: 6105673 - DNA, 10 bp, Homo sapiens
cctgccctgg

SEQ ID NO: 6105674 - DNA, 12 bp, Homo sapiens
cctgccctggag

SEQ ID NO: 6105675 - DNA, 13 bp, Homo sapiens
cctgccctggagg

SEQ ID NO: 6105676 - DNA, 12 bp, Homo sapiens
cctgccctggcc

SEQ ID NO: 6105677 - DNA, 13 bp, Homo sapiens
cctgccctggcca

SEQ ID NO: 6105678 - DNA, 13 bp, Homo sapiens
cctgccctggcct

SEQ ID NO: 6105679 - DNA, 15 bp, Homo sapiens
cctgccctggcctac

SEQ ID NO: 6105680 - DNA, 17 bp, Homo sapiens
cctgccctgggcgagcc

SEQ ID NO: 6105681 - DNA, 20 bp, Homo sapiens
cctgccctgtacctctctct

SEQ ID NO: 6105682 - DNA, 21 bp, Homo sapiens
cctgccctgtcaggaggcaga

SEQ ID NO: 6105683 - DNA, 21 bp, Homo sapiens
cctgccctgtccctgtccccc

SEQ ID NO: 6105684 - DNA, 23 bp, Homo sapiens
cctgccctgtgccgcactctggc

SEQ ID NO: 6105685 - DNA, 14 bp, Homo sapiens
cctgccctgtgggc

SEQ ID NO: 6105686 - DNA, 15 bp, Homo sapiens
cctgccctgtgggcc

SEQ ID NO: 6105687 - DNA, 20 bp, Homo sapiens
cctgccctgttagctttcca

SEQ ID NO: 6105688 - DNA, 19 bp, Homo sapiens
cctgcccttacctgccagg

SEQ ID NO: 6105689 - DNA, 16 bp, Homo sapiens
cctgcccttcagcatc

SEQ ID NO: 6105690 - DNA, 17 bp, Homo sapiens
cctgcccttcagcatcc

SEQ ID NO: 6105691 - DNA, 20 bp, Homo sapiens
cctgcccttcctcagggccc

SEQ ID NO: 6105692 - DNA, 17 bp, Homo sapiens
cctgcccttcctcctga

SEQ ID NO: 6105693 - DNA, 20 bp, Homo sapiens
cctgcccttggcaccaccag

SEQ ID NO: 6105694 - DNA, 22 bp, Homo sapiens
cctgcccttggcaccaccaggg

SEQ ID NO: 6105695 - DNA, 14 bp, Homo sapiens
cctgcccttgtttt

SEQ ID NO: 6105696 - DNA, 14 bp, Homo sapiens
cctgcccttttcct

SEQ ID NO: 6105697 - DNA, 19 bp, Homo sapiens
cctgccgaaaacaggagca

SEQ ID NO: 6105698 - DNA, 16 bp, Homo sapiens
cctgccgaacacacat

SEQ ID NO: 6105699 - DNA, 18 bp, Homo sapiens
cctgccgacctcgtcctc

SEQ ID NO: 6105700 - DNA, 18 bp, Homo sapiens
cctgccgacggagccact

SEQ ID NO: 6105701 - DNA, 12 bp, Homo sapiens
cctgccgagggg

SEQ ID NO: 6105702 - DNA, 15 bp, Homo sapiens
cctgccgaggtgtgg

SEQ ID NO: 6105703 - DNA, 21 bp, Homo sapiens
cctgccgcagacgggcacaga

SEQ ID NO: 6105704 - DNA, 23 bp, Homo sapiens
cctgccgcagacgggcacagaca

SEQ ID NO: 6105705 - DNA, 16 bp, Homo sapiens
cctgccgcagagctgg

SEQ ID NO: 6105706 - DNA, 17 bp, Homo sapiens
cctgccgcagagctggc

SEQ ID NO: 6105707 - DNA, 17 bp, Homo sapiens
cctgccgcccccgcctg

SEQ ID NO: 6105708 - DNA, 15 bp, Homo sapiens
cctgccgccctgtgg

SEQ ID NO: 6105709 - DNA, 14 bp, Homo sapiens
cctgccgcctcaat

SEQ ID NO: 6105710 - DNA, 13 bp, Homo sapiens
cctgccgcctgtg

SEQ ID NO: 6105711 - DNA, 15 bp, Homo sapiens
cctgccgcctgtgcc

SEQ ID NO: 6105712 - DNA, 14 bp, Homo sapiens
cctgccgctgcacc

SEQ ID NO: 6105713 - DNA, 14 bp, Homo sapiens
cctgccgctgcagg

SEQ ID NO: 6105714 - DNA, 16 bp, Homo sapiens
cctgccggagaggaag

SEQ ID NO: 6105715 - DNA, 18 bp, Homo sapiens
cctgccggagaggaagag

SEQ ID NO: 6105716 - DNA, 18 bp, Homo sapiens
cctgccggccgcccagac

SEQ ID NO: 6105717 - DNA, 16 bp, Homo sapiens
cctgccgggcaggtcc

SEQ ID NO: 6105718 - DNA, 18 bp, Homo sapiens
cctgccggtgcacaggcc

SEQ ID NO: 6105719 - DNA, 20 bp, Homo sapiens
cctgccggtgcacaggcctc

SEQ ID NO: 6105720 - DNA, 20 bp, Homo sapiens
cctgccgtaagttactggct

SEQ ID NO: 6105721 - DNA, 16 bp, Homo sapiens
cctgccgtgcatggct

SEQ ID NO: 6105722 - DNA, 18 bp, Homo sapiens
cctgccgtgcatggctcc

SEQ ID NO: 6105723 - DNA, 20 bp, Homo sapiens
cctgccgtgcatggctcctg

SEQ ID NO: 6105724 - DNA, 22 bp, Homo sapiens
cctgccgtttcccctccttggc

SEQ ID NO: 6105725 - DNA, 21 bp, Homo sapiens
cctgcctaaattaaattgggc

SEQ ID NO: 6105726 - DNA, 15 bp, Homo sapiens
cctgcctaaatttca

SEQ ID NO: 6105727 - DNA, 20 bp, Homo sapiens
cctgcctacacacacagcct

SEQ ID NO: 6105728 - DNA, 14 bp, Homo sapiens
cctgcctacatccc

SEQ ID NO: 6105729 - DNA, 19 bp, Homo sapiens
cctgcctacattccctggc

SEQ ID NO: 6105730 - DNA, 22 bp, Homo sapiens
cctgcctacattccctggcctg

SEQ ID NO: 6105731 - DNA, 12 bp, Homo sapiens
cctgcctacgcc

SEQ ID NO: 6105732 - DNA, 23 bp, Homo sapiens
cctgcctagctcttgggcctgac

SEQ ID NO: 6105733 - DNA, 16 bp, Homo sapiens
cctgcctatccatcct

SEQ ID NO: 6105734 - DNA, 17 bp, Homo sapiens
cctgcctatcctctgta

SEQ ID NO: 6105735 - DNA, 19 bp, Homo sapiens
cctgcctattatctgtcag

SEQ ID NO: 6105736 - DNA, 19 bp, Homo sapiens
cctgcctcacatctccctt

SEQ ID NO: 6105737 - DNA, 16 bp, Homo sapiens
cctgcctcaccacgga

SEQ ID NO: 6105738 - DNA, 22 bp, Homo sapiens
cctgcctcaccagccctggcaa

SEQ ID NO: 6105739 - DNA, 16 bp, Homo sapiens
cctgcctcaccctccc

SEQ ID NO: 6105740 - DNA, 12 bp, Homo sapiens
cctgcctcagcc

SEQ ID NO: 6105741 - DNA, 13 bp, Homo sapiens
cctgcctcagcct

SEQ ID NO: 6105742 - DNA, 19 bp, Homo sapiens
cctgcctcagcctcctgag

SEQ ID NO: 6105743 - DNA, 16 bp, Homo sapiens
cctgcctcagccttcc

SEQ ID NO: 6105744 - DNA, 17 bp, Homo sapiens
cctgcctcagccttcca

SEQ ID NO: 6105745 - DNA, 19 bp, Homo sapiens
cctgcctcagccttctgag

SEQ ID NO: 6105746 - DNA, 20 bp, Homo sapiens
cctgcctcagccttctgagt

SEQ ID NO: 6105747 - DNA, 14 bp, Homo sapiens
cctgcctcagctac

SEQ ID NO: 6105748 - DNA, 16 bp, Homo sapiens
cctgcctcagtggcag

SEQ ID NO: 6105749 - DNA, 17 bp, Homo sapiens
cctgcctcagtggcagc

SEQ ID NO: 6105750 - DNA, 18 bp, Homo sapiens
cctgcctcagtggcagca

SEQ ID NO: 6105751 - DNA, 22 bp, Homo sapiens
cctgcctcatcttccttctcag

SEQ ID NO: 6105752 - DNA, 13 bp, Homo sapiens
cctgcctccaaga

SEQ ID NO: 6105753 - DNA, 21 bp, Homo sapiens
cctgcctccacccacagtgga

SEQ ID NO: 6105754 - DNA, 19 bp, Homo sapiens
cctgcctccaccctctgag

SEQ ID NO: 6105755 - DNA, 21 bp, Homo sapiens
cctgcctccaccgagccagct

SEQ ID NO: 6105756 - DNA, 12 bp, Homo sapiens
cctgcctccagg

SEQ ID NO: 6105757 - DNA, 14 bp, Homo sapiens
cctgcctccaggaa

SEQ ID NO: 6105758 - DNA, 15 bp, Homo sapiens
cctgcctccaggaac

SEQ ID NO: 6105759 - DNA, 15 bp, Homo sapiens
cctgcctccagggct

SEQ ID NO: 6105760 - DNA, 16 bp, Homo sapiens
cctgcctccagggctg

SEQ ID NO: 6105761 - DNA, 20 bp, Homo sapiens
cctgcctccagggctggact

SEQ ID NO: 6105762 - DNA, 22 bp, Homo sapiens
cctgcctcccagccctgccagg

SEQ ID NO: 6105763 - DNA, 17 bp, Homo sapiens
cctgcctcccattctgc

SEQ ID NO: 6105764 - DNA, 19 bp, Homo sapiens
cctgcctcccctccgcagc

SEQ ID NO: 6105765 - DNA, 22 bp, Homo sapiens
cctgcctcccgcccccttggct

SEQ ID NO: 6105766 - DNA, 12 bp, Homo sapiens
cctgcctccctt

SEQ ID NO: 6105767 - DNA, 17 bp, Homo sapiens
cctgcctcccttgactt

SEQ ID NO: 6105768 - DNA, 18 bp, Homo sapiens
cctgcctccgctggcttt

SEQ ID NO: 6105769 - DNA, 13 bp, Homo sapiens
cctgcctccggcc

SEQ ID NO: 6105770 - DNA, 15 bp, Homo sapiens
cctgcctccggccct

SEQ ID NO: 6105771 - DNA, 19 bp, Homo sapiens
cctgcctccggcctgcact

SEQ ID NO: 6105772 - DNA, 21 bp, Homo sapiens
cctgcctccggcctgcactcc

SEQ ID NO: 6105773 - DNA, 11 bp, Homo sapiens
cctgcctccta

SEQ ID NO: 6105774 - DNA, 15 bp, Homo sapiens
cctgcctcctaggct

SEQ ID NO: 6105775 - DNA, 11 bp, Homo sapiens
cctgcctcctc

SEQ ID NO: 6105776 - DNA, 13 bp, Homo sapiens
cctgcctcctcat

SEQ ID NO: 6105777 - DNA, 14 bp, Homo sapiens
cctgcctcctcatc

SEQ ID NO: 6105778 - DNA, 16 bp, Homo sapiens
cctgcctcctcatcag

SEQ ID NO: 6105779 - DNA, 17 bp, Homo sapiens
cctgcctcctccctccc

SEQ ID NO: 6105780 - DNA, 20 bp, Homo sapiens
cctgcctcctccctcccagc

SEQ ID NO: 6105781 - DNA, 22 bp, Homo sapiens
cgtgccacgcgctctgcatgct

SEQ ID NO: 6105782 - DNA, 12 bp, Homo sapiens
cgtgccagcagc

SEQ ID NO: 6105783 - DNA, 17 bp, Homo sapiens
cgtgccagcagcctcgc

SEQ ID NO: 6105784 - DNA, 18 bp, Homo sapiens
cgtgccagcagcctcgca

SEQ ID NO: 6105785 - DNA, 21 bp, Homo sapiens
cgtgccagcagcctcgcacag

SEQ ID NO: 6105786 - DNA, 17 bp, Homo sapiens
cgtgccagctctagttt

SEQ ID NO: 6105787 - DNA, 13 bp, Homo sapiens
cgtgccaggagca

SEQ ID NO: 6105788 - DNA, 19 bp, Homo sapiens
cgtgccaggagcaatggga

SEQ ID NO: 6105789 - DNA, 20 bp, Homo sapiens
cgtgccagtcgcgctgcctg

SEQ ID NO: 6105790 - DNA, 21 bp, Homo sapiens
cgtgccagtcgcgctgcctgt

SEQ ID NO: 6105791 - DNA, 22 bp, Homo sapiens
cgtgccagtcgcgctgcctgtg

SEQ ID NO: 6105792 - DNA, 16 bp, Homo sapiens
cgtgccagtgtcccca

SEQ ID NO: 6105793 - DNA, 20 bp, Homo sapiens
cgtgccattacactccagcc

SEQ ID NO: 6105794 - DNA, 14 bp, Homo sapiens
cgtgccattgtctt

SEQ ID NO: 6105795 - DNA, 18 bp, Homo sapiens
cgtgccattgtctttcct

SEQ ID NO: 6105796 - DNA, 14 bp, Homo sapiens
cgtgcccaggccct

SEQ ID NO: 6105797 - DNA, 23 bp, Homo sapiens
cgtgcccaggcccttggctgcag

SEQ ID NO: 6105798 - DNA, 15 bp, Homo sapiens
cgtgccccacctccc

SEQ ID NO: 6105799 - DNA, 13 bp, Homo sapiens
cgtgcccccagag

SEQ ID NO: 6105800 - DNA, 23 bp, Homo sapiens
cgtgcccccagagtgtagggggc

SEQ ID NO: 6105801 - DNA, 14 bp, Homo sapiens
cgtgccccccagtt

SEQ ID NO: 6105802 - DNA, 20 bp, Homo sapiens
cgtgcccccgcctgccaccg

SEQ ID NO: 6105803 - DNA, 14 bp, Homo sapiens
cgtgcccctgggat

SEQ ID NO: 6105804 - DNA, 19 bp, Homo sapiens
cgtgccccttccctgggtt

SEQ ID NO: 6105805 - DNA, 19 bp, Homo sapiens
cgtgcccctttccttcact

SEQ ID NO: 6105806 - DNA, 20 bp, Homo sapiens
cgtgcccctttccttcactg

SEQ ID NO: 6105807 - DNA, 16 bp, Homo sapiens
cgtgcccgcccacctc

SEQ ID NO: 6105808 - DNA, 19 bp, Homo sapiens
cgtgcccgcccacctctgc

SEQ ID NO: 6105809 - DNA, 19 bp, Homo sapiens
cgtgcccggctaatttttt

SEQ ID NO: 6105810 - DNA, 14 bp, Homo sapiens
cgtgccctgtttcc

SEQ ID NO: 6105811 - DNA, 23 bp, Homo sapiens
cgtgccctttggggttgcccagc

SEQ ID NO: 6105812 - DNA, 14 bp, Homo sapiens
cgtgccgagccagc

SEQ ID NO: 6105813 - DNA, 15 bp, Homo sapiens
cgtgccgcctgcact

SEQ ID NO: 6105814 - DNA, 21 bp, Homo sapiens
cgtgccggcggcagccccact

SEQ ID NO: 6105815 - DNA, 22 bp, Homo sapiens
cgtgccggcggcagccccactt

SEQ ID NO: 6105816 - DNA, 21 bp, Homo sapiens
cgtgccgggagaggactctgc

SEQ ID NO: 6105817 - DNA, 14 bp, Homo sapiens
cgtgccgggccccc

SEQ ID NO: 6105818 - DNA, 13 bp, Homo sapiens
cgtgccgtggagc

SEQ ID NO: 6105819 - DNA, 22 bp, Homo sapiens
cgtgccgtggagcttggagccc

SEQ ID NO: 6105820 - DNA, 15 bp, Homo sapiens
cgtgccgtggcacca

SEQ ID NO: 6105821 - DNA, 22 bp, Homo sapiens
cgtgccgtgtgagtgtgacagg

SEQ ID NO: 6105822 - DNA, 19 bp, Homo sapiens
cgtgccgttactctccaac

SEQ ID NO: 6105823 - DNA, 17 bp, Homo sapiens
cgtgcctccaccaccac

SEQ ID NO: 6105824 - DNA, 20 bp, Homo sapiens
cgtgcctccaccaccactgg

SEQ ID NO: 6105825 - DNA, 21 bp, Homo sapiens
cgtgcctccaccaccactggc

SEQ ID NO: 6105826 - DNA, 22 bp, Homo sapiens
cgtgcctccaccaccactggcc

SEQ ID NO: 6105827 - DNA, 22 bp, Homo sapiens
cgtgcctcgtgggttcttcctc

SEQ ID NO: 6105828 - DNA, 15 bp, Homo sapiens
cgtgcctgagaccag

SEQ ID NO: 6105829 - DNA, 16 bp, Homo sapiens
cgtgcctgagaccagg

SEQ ID NO: 6105830 - DNA, 17 bp, Homo sapiens
cgtgcctgagaccaggg

SEQ ID NO: 6105831 - DNA, 22 bp, Homo sapiens
cgtgcctgcattcgcagcagct

SEQ ID NO: 6105832 - DNA, 12 bp, Homo sapiens
cgtgcctggcca

SEQ ID NO: 6105833 - DNA, 14 bp, Homo sapiens
cgtgcctggccaga

SEQ ID NO: 6105834 - DNA, 15 bp, Homo sapiens
cgtgcctggctgatt

SEQ ID NO: 6105835 - DNA, 12 bp, Homo sapiens
cgtgcctgggag

SEQ ID NO: 6105836 - DNA, 16 bp, Homo sapiens
cgtgcctgggcccctc

SEQ ID NO: 6105837 - DNA, 15 bp, Homo sapiens
cgtgcctgtagtgcc

SEQ ID NO: 6105838 - DNA, 14 bp, Homo sapiens
cgtgcctgtgtcca

SEQ ID NO: 6105839 - DNA, 16 bp, Homo sapiens
cgtgccttttgcaccc

SEQ ID NO: 6105840 - DNA, 19 bp, Homo sapiens
cgtgccttttgcacccctc

SEQ ID NO: 6105841 - DNA, 23 bp, Homo sapiens
cgtgccttttgcacccctcccat

SEQ ID NO: 6105842 - DNA, 20 bp, Homo sapiens
cgtgcgcagccgcgctctgc

SEQ ID NO: 6105843 - DNA, 23 bp, Homo sapiens
cgtgcgcagccgcgctctgcccc

SEQ ID NO: 6105844 - DNA, 21 bp, Homo sapiens
cgtgcggcccgtgcgcagccg

SEQ ID NO: 6105845 - DNA, 22 bp, Homo sapiens
cgtgcggcccgtgcgcagccgc

SEQ ID NO: 6105846 - DNA, 17 bp, Homo sapiens
cgtgcgggaaattcagt

SEQ ID NO: 6105847 - DNA, 14 bp, Homo sapiens
cgtgcggggccccg

SEQ ID NO: 6105848 - DNA, 17 bp, Homo sapiens
cgtgcgtgttagtgtgt

SEQ ID NO: 6105849 - DNA, 19 bp, Homo sapiens
cgtgcgtgttagtgtgtgt

SEQ ID NO: 6105850 - DNA, 22 bp, Homo sapiens
cgtgcgtgttagtgtgtgtgca

SEQ ID NO: 6105851 - DNA, 19 bp, Homo sapiens
cgtgcgtgttttctgactg

SEQ ID NO: 6105852 - DNA, 14 bp, Homo sapiens
cgtgctaaattttc

SEQ ID NO: 6105853 - DNA, 16 bp, Homo sapiens
cgtgctaaggacttgt

SEQ ID NO: 6105854 - DNA, 15 bp, Homo sapiens
cgtgctcactgtgta

SEQ ID NO: 6105855 - DNA, 14 bp, Homo sapiens
cgtgctcaggtcat

SEQ ID NO: 6105856 - DNA, 16 bp, Homo sapiens
cgtgctccagcctggc

SEQ ID NO: 6105857 - DNA, 17 bp, Homo sapiens
cgtgctccagcctggct

SEQ ID NO: 6105858 - DNA, 13 bp, Homo sapiens
cgtgctcccctgc

SEQ ID NO: 6105859 - DNA, 22 bp, Homo sapiens
cgtgctccgtagctctgctgct

SEQ ID NO: 6105860 - DNA, 12 bp, Homo sapiens
cgtgctcctctg

SEQ ID NO: 6105861 - DNA, 14 bp, Homo sapiens
cgtgctcctctgcc

SEQ ID NO: 6105862 - DNA, 15 bp, Homo sapiens
cgtgctcctctgccc

SEQ ID NO: 6105863 - DNA, 17 bp, Homo sapiens
cgtgctcttctgttctc

SEQ ID NO: 6105864 - DNA, 19 bp, Homo sapiens
cgtgctcttctgttctcaa

SEQ ID NO: 6105865 - DNA, 20 bp, Homo sapiens
cgtgctcttctgttctcaaa

SEQ ID NO: 6105866 - DNA, 22 bp, Homo sapiens
cgtgctctttgttttgtgtctc

SEQ ID NO: 6105867 - DNA, 17 bp, Homo sapiens
cgtgctgacagctgctc

SEQ ID NO: 6105868 - DNA, 16 bp, Homo sapiens
cgtgctgcctctcttc

SEQ ID NO: 6105869 - DNA, 14 bp, Homo sapiens
cgtgctggccccag

SEQ ID NO: 6105870 - DNA, 20 bp, Homo sapiens
cgtgctggcgacactcaggg

SEQ ID NO: 6105871 - DNA, 21 bp, Homo sapiens
cgtgctggcggacgcagctgg

SEQ ID NO: 6105872 - DNA, 14 bp, Homo sapiens
cgtgctgggacagc

SEQ ID NO: 6105873 - DNA, 15 bp, Homo sapiens
cgtgctgggcagccc

SEQ ID NO: 6105874 - DNA, 15 bp, Homo sapiens
cgtgctgtgctctgg

SEQ ID NO: 6105875 - DNA, 18 bp, Homo sapiens
cgtgctgtgggcctcagg

SEQ ID NO: 6105876 - DNA, 19 bp, Homo sapiens
cgtgctgtgggcctcaggc

SEQ ID NO: 6105877 - DNA, 20 bp, Homo sapiens
cgtgcttagcctcctgacct

SEQ ID NO: 6105878 - DNA, 14 bp, Homo sapiens
cgtgcttctttgta

SEQ ID NO: 6105879 - DNA, 14 bp, Homo sapiens
cgtgcttgctggtg

SEQ ID NO: 6105880 - DNA, 12 bp, Homo sapiens
cgtggaaacaca

SEQ ID NO: 6105881 - DNA, 15 bp, Homo sapiens
cgtggaaagggtgct

SEQ ID NO: 6105882 - DNA, 16 bp, Homo sapiens
cgtggaacctctgtct

SEQ ID NO: 6105883 - DNA, 15 bp, Homo sapiens
cgtggaacgtttttc

SEQ ID NO: 6105884 - DNA, 13 bp, Homo sapiens
cgtggacacctgc

SEQ ID NO: 6105885 - DNA, 15 bp, Homo sapiens
cgtggacacctgccc

SEQ ID NO: 6105886 - DNA, 14 bp, Homo sapiens
cgtggacagcgctg

SEQ ID NO: 6105887 - DNA, 20 bp, Homo sapiens
cgtggactccagactctctg

SEQ ID NO: 6105888 - DNA, 14 bp, Homo sapiens
cgtggactcctctt

SEQ ID NO: 6105889 - DNA, 15 bp, Homo sapiens
cgtggactctgtgct

SEQ ID NO: 6105890 - DNA, 15 bp, Homo sapiens
cgtggactgagtggg

SEQ ID NO: 6105891 - DNA, 14 bp, Homo sapiens
cgtggactgcagtc

SEQ ID NO: 6105892 - DNA, 19 bp, Homo sapiens
cgtggagaattggccagag

SEQ ID NO: 6105893 - DNA, 19 bp, Homo sapiens
cgtggagactggcaggcgg

SEQ ID NO: 6105894 - DNA, 15 bp, Homo sapiens
cgtggagagctagga

SEQ ID NO: 6105895 - DNA, 18 bp, Homo sapiens
cgtggagagctaggagca

SEQ ID NO: 6105896 - DNA, 13 bp, Homo sapiens
cgtggagagggat

SEQ ID NO: 6105897 - DNA, 18 bp, Homo sapiens
cgtggagatagtgccagg

SEQ ID NO: 6105898 - DNA, 18 bp, Homo sapiens
cgtggagcagaatcagta

SEQ ID NO: 6105899 - DNA, 12 bp, Homo sapiens
cgtggagccaca

SEQ ID NO: 6105900 - DNA, 18 bp, Homo sapiens
cgtggagccacaggcaga

SEQ ID NO: 6105901 - DNA, 20 bp, Homo sapiens
cgtggagccacaggcagacg

SEQ ID NO: 6105902 - DNA, 16 bp, Homo sapiens
cgtggagccagggagc

SEQ ID NO: 6105903 - DNA, 22 bp, Homo sapiens
cgtggagccattgaacagctgt

SEQ ID NO: 6105904 - DNA, 23 bp, Homo sapiens
cgtggagccctactcacacatta

SEQ ID NO: 6105905 - DNA, 19 bp, Homo sapiens
cgtggagctcgcccctccc

SEQ ID NO: 6105906 - DNA, 20 bp, Homo sapiens
cgtggagcttaagccactgc

SEQ ID NO: 6105907 - DNA, 15 bp, Homo sapiens
cgtggagcttggagc

SEQ ID NO: 6105908 - DNA, 16 bp, Homo sapiens
cgtggagcttggagcc

SEQ ID NO: 6105909 - DNA, 18 bp, Homo sapiens
cgtggaggaatgctcccc

SEQ ID NO: 6105910 - DNA, 16 bp, Homo sapiens
cgtggaggagaggaga

SEQ ID NO: 6105911 - DNA, 15 bp, Homo sapiens
cgtggaggctgctcg

SEQ ID NO: 6105912 - DNA, 13 bp, Homo sapiens
cgtggagggaggc

SEQ ID NO: 6105913 - DNA, 15 bp, Homo sapiens
cgtggagggaggccc

SEQ ID NO: 6105914 - DNA, 19 bp, Homo sapiens
cgtggagggaggccccagg

SEQ ID NO: 6105915 - DNA, 23 bp, Homo sapiens
cgtggaggggtaggggctgggaa

SEQ ID NO: 6105916 - DNA, 14 bp, Homo sapiens
cgtggagggtaggg

SEQ ID NO: 6105917 - DNA, 17 bp, Homo sapiens
cgtggagggtaggggag

SEQ ID NO: 6105918 - DNA, 21 bp, Homo sapiens
cgtggagggtaggggagtgtg

SEQ ID NO: 6105919 - DNA, 19 bp, Homo sapiens
cgtggaggtgaagtccctg

SEQ ID NO: 6105920 - DNA, 22 bp, Homo sapiens
cgtggaggtgaagtccctgttc

SEQ ID NO: 6105921 - DNA, 23 bp, Homo sapiens
cgtggaggttctgtattttaaga

SEQ ID NO: 6105922 - DNA, 17 bp, Homo sapiens
cgtggagtcgagctggc

SEQ ID NO: 6105923 - DNA, 16 bp, Homo sapiens
cgtggatacagagcca

SEQ ID NO: 6105924 - DNA, 18 bp, Homo sapiens
cgtggatacagagccacg

SEQ ID NO: 6105925 - DNA, 20 bp, Homo sapiens
cgtggatcgagtgtagctgt

SEQ ID NO: 6105926 - DNA, 15 bp, Homo sapiens
cgtggatctccttcc

SEQ ID NO: 6105927 - DNA, 18 bp, Homo sapiens
cgtggatgcgcagtgcct

SEQ ID NO: 6105928 - DNA, 15 bp, Homo sapiens
cgtggatttgtactt

SEQ ID NO: 6105929 - DNA, 14 bp, Homo sapiens
cgtggcaaatataa

SEQ ID NO: 6105930 - DNA, 15 bp, Homo sapiens
cgtggcaaatataaa

SEQ ID NO: 6105931 - DNA, 17 bp, Homo sapiens
cgtggcaaatataaaac

SEQ ID NO: 6105932 - DNA, 17 bp, Homo sapiens
cgtggcaaccctcagct

SEQ ID NO: 6105933 - DNA, 18 bp, Homo sapiens
cgtggcaaccctcagctg

SEQ ID NO: 6105934 - DNA, 17 bp, Homo sapiens
cgtggcaactgtggaag

SEQ ID NO: 6105935 - DNA, 17 bp, Homo sapiens
cgtggcacacactgacc

SEQ ID NO: 6105936 - DNA, 18 bp, Homo sapiens
cgtggcacacactgacca

SEQ ID NO: 6105937 - DNA, 15 bp, Homo sapiens
cgtggcacagctggg

SEQ ID NO: 6105938 - DNA, 16 bp, Homo sapiens
cgtggcagcttgctgg

SEQ ID NO: 6105939 - DNA, 19 bp, Homo sapiens
cgtggcagcttgctgggct

SEQ ID NO: 6105940 - DNA, 11 bp, Homo sapiens
cgtggcaggac

SEQ ID NO: 6105941 - DNA, 22 bp, Homo sapiens
cgtggcatttcaattcctggcc

SEQ ID NO: 6105942 - DNA, 21 bp, Homo sapiens
cgtggcatttccgtggacagc

SEQ ID NO: 6105943 - DNA, 17 bp, Homo sapiens
cgtggccacgggggcag

SEQ ID NO: 6105944 - DNA, 21 bp, Homo sapiens
cgtggccacgggggcagtgtg

SEQ ID NO: 6105945 - DNA, 13 bp, Homo sapiens
cgtggccagaggc

SEQ ID NO: 6105946 - DNA, 14 bp, Homo sapiens
cgtggccaggagcc

SEQ ID NO: 6105947 - DNA, 19 bp, Homo sapiens
cgtggcccaaggctggcag

SEQ ID NO: 6105948 - DNA, 16 bp, Homo sapiens
cgtggcccagagaagc

SEQ ID NO: 6105949 - DNA, 11 bp, Homo sapiens
cgtggcccagg

SEQ ID NO: 6105950 - DNA, 20 bp, Homo sapiens
cgtggccccagcctggccca

SEQ ID NO: 6105951 - DNA, 18 bp, Homo sapiens
cgtggccccgccctcagg

SEQ ID NO: 6105952 - DNA, 19 bp, Homo sapiens
cgtggccccgtgaactcac

SEQ ID NO: 6105953 - DNA, 15 bp, Homo sapiens
cgtggccctgccctc

SEQ ID NO: 6105954 - DNA, 14 bp, Homo sapiens
cgtggcccttcctg

SEQ ID NO: 6105955 - DNA, 20 bp, Homo sapiens
cgtggcccttcctggacagc

SEQ ID NO: 6105956 - DNA, 21 bp, Homo sapiens
cgtggcctcgtgaggggcaag

SEQ ID NO: 6105957 - DNA, 15 bp, Homo sapiens
cgtggcctcttgagc

SEQ ID NO: 6105958 - DNA, 18 bp, Homo sapiens
cgtggcctgagtcctggt

SEQ ID NO: 6105959 - DNA, 13 bp, Homo sapiens
cgtggcctgcacc

SEQ ID NO: 6105960 - DNA, 23 bp, Homo sapiens
cctgcctcctccctcccagctgc

SEQ ID NO: 6105961 - DNA, 12 bp, Homo sapiens
cctgcctcctgc

SEQ ID NO: 6105962 - DNA, 18 bp, Homo sapiens
cctgcctcctgccacccc

SEQ ID NO: 6105963 - DNA, 14 bp, Homo sapiens
cctgcctcctgcct

SEQ ID NO: 6105964 - DNA, 17 bp, Homo sapiens
cctgcctcctgcctatg

SEQ ID NO: 6105965 - DNA, 20 bp, Homo sapiens
cctgcctcctggaggaccag

SEQ ID NO: 6105966 - DNA, 19 bp, Homo sapiens
cctgcctcctggctcaggc

SEQ ID NO: 6105967 - DNA, 16 bp, Homo sapiens
cctgcctccttgaaag

SEQ ID NO: 6105968 - DNA, 21 bp, Homo sapiens
cctgcctcctttgtgaggaag

SEQ ID NO: 6105969 - DNA, 14 bp, Homo sapiens
cctgcctcgagggc

SEQ ID NO: 6105970 - DNA, 19 bp, Homo sapiens
cctgcctcgagggccgcct

SEQ ID NO: 6105971 - DNA, 22 bp, Homo sapiens
cctgcctcgagggccgcctgcc

SEQ ID NO: 6105972 - DNA, 23 bp, Homo sapiens
cctgcctcgagggccgcctgcct

SEQ ID NO: 6105973 - DNA, 21 bp, Homo sapiens
cctgcctctaatctgagctgc

SEQ ID NO: 6105974 - DNA, 14 bp, Homo sapiens
cctgcctctaccca

SEQ ID NO: 6105975 - DNA, 20 bp, Homo sapiens
cctgcctctatccctggcca

SEQ ID NO: 6105976 - DNA, 15 bp, Homo sapiens
cctgcctctcccagg

SEQ ID NO: 6105977 - DNA, 16 bp, Homo sapiens
cctgcctctccgcccc

SEQ ID NO: 6105978 - DNA, 17 bp, Homo sapiens
cctgcctctccgcccct

SEQ ID NO: 6105979 - DNA, 18 bp, Homo sapiens
cctgcctctccgcccctg

SEQ ID NO: 6105980 - DNA, 22 bp, Homo sapiens
cctgcctctccgcccctgagcc

SEQ ID NO: 6105981 - DNA, 23 bp, Homo sapiens
cctgcctctccgcccctgagccc

SEQ ID NO: 6105982 - DNA, 17 bp, Homo sapiens
cctgcctctctcatggc

SEQ ID NO: 6105983 - DNA, 18 bp, Homo sapiens
cctgcctctctgctccag

SEQ ID NO: 6105984 - DNA, 19 bp, Homo sapiens
cctgcctctctgctccaga

SEQ ID NO: 6105985 - DNA, 10 bp, Homo sapiens
cctgcctctg

SEQ ID NO: 6105986 - DNA, 20 bp, Homo sapiens
cctgcctctgaactgctgct

SEQ ID NO: 6105987 - DNA, 13 bp, Homo sapiens
cctgcctctgacc

SEQ ID NO: 6105988 - DNA, 14 bp, Homo sapiens
cctgcctctgccac

SEQ ID NO: 6105989 - DNA, 18 bp, Homo sapiens
cctgcctctgccacagca

SEQ ID NO: 6105990 - DNA, 23 bp, Homo sapiens
cctgcctctgccatgcccagaga

SEQ ID NO: 6105991 - DNA, 14 bp, Homo sapiens
cctgcctctgcctc

SEQ ID NO: 6105992 - DNA, 16 bp, Homo sapiens
cctgcctctgcctccc

SEQ ID NO: 6105993 - DNA, 13 bp, Homo sapiens
cctgcctctgtgt

SEQ ID NO: 6105994 - DNA, 22 bp, Homo sapiens
cctgcctctgtgtagccgccct

SEQ ID NO: 6105995 - DNA, 14 bp, Homo sapiens
cctgcctctgtttg

SEQ ID NO: 6105996 - DNA, 22 bp, Homo sapiens
cctgcctcttgtttctgtgccc

SEQ ID NO: 6105997 - DNA, 21 bp, Homo sapiens
cctgcctgaccatcccatgag

SEQ ID NO: 6105998 - DNA, 18 bp, Homo sapiens
cctgcctgacccatccct

SEQ ID NO: 6105999 - DNA, 14 bp, Homo sapiens
cctgcctgagacca

SEQ ID NO: 6106000 - DNA, 13 bp, Homo sapiens
cctgcctgagccc

SEQ ID NO: 6106001 - DNA, 21 bp, Homo sapiens
cctgcctgagcccaggagctg

SEQ ID NO: 6106002 - DNA, 15 bp, Homo sapiens
cctgcctgaggagga

SEQ ID NO: 6106003 - DNA, 22 bp, Homo sapiens
cctgcctgaggaggaggacaca

SEQ ID NO: 6106004 - DNA, 21 bp, Homo sapiens
cctgcctgagggcccctctgc

SEQ ID NO: 6106005 - DNA, 20 bp, Homo sapiens
cctgcctgagtttccagcct

SEQ ID NO: 6106006 - DNA, 13 bp, Homo sapiens
cctgcctgcacct

SEQ ID NO: 6106007 - DNA, 16 bp, Homo sapiens
cctgcctgcagcaggc

SEQ ID NO: 6106008 - DNA, 16 bp, Homo sapiens
cctgcctgcagccagg

SEQ ID NO: 6106009 - DNA, 18 bp, Homo sapiens
cctgcctgcagccagggc

SEQ ID NO: 6106010 - DNA, 19 bp, Homo sapiens
cctgcctgcagccagggct

SEQ ID NO: 6106011 - DNA, 13 bp, Homo sapiens
cctgcctgccccc

SEQ ID NO: 6106012 - DNA, 18 bp, Homo sapiens
cctgcctgcccccacacc

SEQ ID NO: 6106013 - DNA, 14 bp, Homo sapiens
cctgcctgccctgt

SEQ ID NO: 6106014 - DNA, 16 bp, Homo sapiens
cctgcctgccctgtca

SEQ ID NO: 6106015 - DNA, 19 bp, Homo sapiens
cctgcctgccctgtcagga

SEQ ID NO: 6106016 - DNA, 17 bp, Homo sapiens
cctgcctgccgctgcac

SEQ ID NO: 6106017 - DNA, 15 bp, Homo sapiens
cctgcctgcctccac

SEQ ID NO: 6106018 - DNA, 16 bp, Homo sapiens
cctgcctgcctccacc

SEQ ID NO: 6106019 - DNA, 20 bp, Homo sapiens
cctgcctgccttctcccctc

SEQ ID NO: 6106020 - DNA, 17 bp, Homo sapiens
cctgcctgcgaaaccca

SEQ ID NO: 6106021 - DNA, 12 bp, Homo sapiens
cctgcctggagc

SEQ ID NO: 6106022 - DNA, 13 bp, Homo sapiens
cctgcctggagga

SEQ ID NO: 6106023 - DNA, 17 bp, Homo sapiens
cctgcctggaggacctg

SEQ ID NO: 6106024 - DNA, 15 bp, Homo sapiens
cctgcctggaggctc

SEQ ID NO: 6106025 - DNA, 19 bp, Homo sapiens
cctgcctggaggctcctct

SEQ ID NO: 6106026 - DNA, 12 bp, Homo sapiens
cctgcctggcac

SEQ ID NO: 6106027 - DNA, 12 bp, Homo sapiens
cctgcctggccc

SEQ ID NO: 6106028 - DNA, 15 bp, Homo sapiens
cctgcctggccccca

SEQ ID NO: 6106029 - DNA, 15 bp, Homo sapiens
cctgcctggcccctc

SEQ ID NO: 6106030 - DNA, 20 bp, Homo sapiens
cctgcctggccctcctctgg

SEQ ID NO: 6106031 - DNA, 14 bp, Homo sapiens
cctgcctggccggc

SEQ ID NO: 6106032 - DNA, 15 bp, Homo sapiens
cctgcctggccggcc

SEQ ID NO: 6106033 - DNA, 13 bp, Homo sapiens
cctgcctgggaca

SEQ ID NO: 6106034 - DNA, 23 bp, Homo sapiens
cctgcctggggcgggcccctcat

SEQ ID NO: 6106035 - DNA, 18 bp, Homo sapiens
cctgcctgggtgggacag

SEQ ID NO: 6106036 - DNA, 12 bp, Homo sapiens
cctgcctggtcc

SEQ ID NO: 6106037 - DNA, 18 bp, Homo sapiens
cctgcctggttctaggct

SEQ ID NO: 6106038 - DNA, 14 bp, Homo sapiens
cctgcctgtactac

SEQ ID NO: 6106039 - DNA, 18 bp, Homo sapiens
cctgcctgtctgtctctc

SEQ ID NO: 6106040 - DNA, 14 bp, Homo sapiens
cctgcctgtgcatg

SEQ ID NO: 6106041 - DNA, 23 bp, Homo sapiens
cctgcctgtgcccgcatgtgtgc

SEQ ID NO: 6106042 - DNA, 12 bp, Homo sapiens
cctgcctgtgct

SEQ ID NO: 6106043 - DNA, 13 bp, Homo sapiens
cctgcctgtggag

SEQ ID NO: 6106044 - DNA, 18 bp, Homo sapiens
cctgcctgtggagacagc

SEQ ID NO: 6106045 - DNA, 18 bp, Homo sapiens
cctgcctgtggaggtgac

SEQ ID NO: 6106046 - DNA, 12 bp, Homo sapiens
cctgcctgtggc

SEQ ID NO: 6106047 - DNA, 23 bp, Homo sapiens
cctgcctgtggcgccgtctccag

SEQ ID NO: 6106048 - DNA, 12 bp, Homo sapiens
cctgcctgtgtg

SEQ ID NO: 6106049 - DNA, 12 bp, Homo sapiens
cctgcctgtgtt

SEQ ID NO: 6106050 - DNA, 15 bp, Homo sapiens
cctgcctgttctcca

SEQ ID NO: 6106051 - DNA, 20 bp, Homo sapiens
cctgcctgttggcaggccca

SEQ ID NO: 6106052 - DNA, 20 bp, Homo sapiens
cctgcctgttgggccaggag

SEQ ID NO: 6106053 - DNA, 21 bp, Homo sapiens
cctgccttaccgagagccaaa

SEQ ID NO: 6106054 - DNA, 12 bp, Homo sapiens
cctgccttcctc

SEQ ID NO: 6106055 - DNA, 14 bp, Homo sapiens
cctgccttcctcct

SEQ ID NO: 6106056 - DNA, 15 bp, Homo sapiens
cctgccttcctctga

SEQ ID NO: 6106057 - DNA, 14 bp, Homo sapiens
cctgccttctcttc

SEQ ID NO: 6106058 - DNA, 16 bp, Homo sapiens
cctgccttctgtcctg

SEQ ID NO: 6106059 - DNA, 22 bp, Homo sapiens
cctgccttcttccttgaggggc

SEQ ID NO: 6106060 - DNA, 18 bp, Homo sapiens
cctgccttcttcggggaa

SEQ ID NO: 6106061 - DNA, 23 bp, Homo sapiens
cctgccttgaacaacccaatctg

SEQ ID NO: 6106062 - DNA, 16 bp, Homo sapiens
cctgccttgaagccac

SEQ ID NO: 6106063 - DNA, 17 bp, Homo sapiens
cctgccttgaagccact

SEQ ID NO: 6106064 - DNA, 18 bp, Homo sapiens
cctgccttgatgaagccc

SEQ ID NO: 6106065 - DNA, 19 bp, Homo sapiens
cctgccttgatgaagcctg

SEQ ID NO: 6106066 - DNA, 20 bp, Homo sapiens
cctgccttgccgctcccctt

SEQ ID NO: 6106067 - DNA, 17 bp, Homo sapiens
cctgccttgctgccttc

SEQ ID NO: 6106068 - DNA, 15 bp, Homo sapiens
cctgccttggcctcc

SEQ ID NO: 6106069 - DNA, 20 bp, Homo sapiens
cctgccttggcctcccaaag

SEQ ID NO: 6106070 - DNA, 19 bp, Homo sapiens
cctgccttggcctcccaag

SEQ ID NO: 6106071 - DNA, 18 bp, Homo sapiens
cctgccttgggccttgct

SEQ ID NO: 6106072 - DNA, 16 bp, Homo sapiens
cctgccttgtttggat

SEQ ID NO: 6106073 - DNA, 16 bp, Homo sapiens
cctgcctttccatcca

SEQ ID NO: 6106074 - DNA, 21 bp, Homo sapiens
cctgcctttgaaattccccca

SEQ ID NO: 6106075 - DNA, 13 bp, Homo sapiens
cctgcctttgatg

SEQ ID NO: 6106076 - DNA, 11 bp, Homo sapiens
cctgcctttta

SEQ ID NO: 6106077 - DNA, 22 bp, Homo sapiens
cctgccttttagttcctgtgca

SEQ ID NO: 6106078 - DNA, 19 bp, Homo sapiens
cctgccttttctagtttta

SEQ ID NO: 6106079 - DNA, 17 bp, Homo sapiens
cctgcgacagcttgtga

SEQ ID NO: 6106080 - DNA, 14 bp, Homo sapiens
cctgcgaccctggg

SEQ ID NO: 6106081 - DNA, 20 bp, Homo sapiens
cctgcgagacccaaggctca

SEQ ID NO: 6106082 - DNA, 13 bp, Homo sapiens
cctgcgagacgca

SEQ ID NO: 6106083 - DNA, 20 bp, Homo sapiens
cctgcgagagaccctacaga

SEQ ID NO: 6106084 - DNA, 17 bp, Homo sapiens
cctgcgaggctatgagt

SEQ ID NO: 6106085 - DNA, 22 bp, Homo sapiens
cctgcgagggccgcccgctccc

SEQ ID NO: 6106086 - DNA, 23 bp, Homo sapiens
cctgcgcaaagggcgggcctgtt

SEQ ID NO: 6106087 - DNA, 15 bp, Homo sapiens
cctgcgcaagtgcct

SEQ ID NO: 6106088 - DNA, 16 bp, Homo sapiens
cctgcgcaccaggctg

SEQ ID NO: 6106089 - DNA, 13 bp, Homo sapiens
cctgcgcaccccg

SEQ ID NO: 6106090 - DNA, 15 bp, Homo sapiens
cctgcgcaccccgtt

SEQ ID NO: 6106091 - DNA, 14 bp, Homo sapiens
cctgcgcaggccct

SEQ ID NO: 6106092 - DNA, 18 bp, Homo sapiens
cctgcgcagggccctctg

SEQ ID NO: 6106093 - DNA, 19 bp, Homo sapiens
cctgcgcagggccctctgg

SEQ ID NO: 6106094 - DNA, 16 bp, Homo sapiens
cctgcgcccagagctg

SEQ ID NO: 6106095 - DNA, 18 bp, Homo sapiens
cctgcgcccagagctggc

SEQ ID NO: 6106096 - DNA, 20 bp, Homo sapiens
cctgcgcccagagctggcct

SEQ ID NO: 6106097 - DNA, 20 bp, Homo sapiens
cctgcgcccagtccttccac

SEQ ID NO: 6106098 - DNA, 22 bp, Homo sapiens
cctgcgcccagtccttccacct

SEQ ID NO: 6106099 - DNA, 19 bp, Homo sapiens
cctgcgccccccagtggac

SEQ ID NO: 6106100 - DNA, 17 bp, Homo sapiens
cctgcgccccgcccaca

SEQ ID NO: 6106101 - DNA, 12 bp, Homo sapiens
cctgcgcccctg

SEQ ID NO: 6106102 - DNA, 14 bp, Homo sapiens
cctgcgcccctgcc

SEQ ID NO: 6106103 - DNA, 17 bp, Homo sapiens
cctgcgccctccctccc

SEQ ID NO: 6106104 - DNA, 23 bp, Homo sapiens
cctgcgccctccctccctccaca

SEQ ID NO: 6106105 - DNA, 21 bp, Homo sapiens
cctgcgccctgacatgctaac

SEQ ID NO: 6106106 - DNA, 13 bp, Homo sapiens
cctgcgccctgtg

SEQ ID NO: 6106107 - DNA, 19 bp, Homo sapiens
cctgcgcccttgaggggcc

SEQ ID NO: 6106108 - DNA, 15 bp, Homo sapiens
cctgcgcctccagag

SEQ ID NO: 6106109 - DNA, 14 bp, Homo sapiens
cctgcgcctccatc

SEQ ID NO: 6106110 - DNA, 21 bp, Homo sapiens
cctgcgcctccatccatctgt

SEQ ID NO: 6106111 - DNA, 14 bp, Homo sapiens
cctgcgcctgcacc

SEQ ID NO: 6106112 - DNA, 14 bp, Homo sapiens
cctgcgcctgcgcc

SEQ ID NO: 6106113 - DNA, 18 bp, Homo sapiens
cctgcgcctgctgcctgc

SEQ ID NO: 6106114 - DNA, 13 bp, Homo sapiens
cctgcgcgcagct

SEQ ID NO: 6106115 - DNA, 21 bp, Homo sapiens
cctgcgcgggaccatctggaa

SEQ ID NO: 6106116 - DNA, 22 bp, Homo sapiens
cctgcgctaacactgtcctgtc

SEQ ID NO: 6106117 - DNA, 14 bp, Homo sapiens
cctgcgctcctctg

SEQ ID NO: 6106118 - DNA, 18 bp, Homo sapiens
cctgcgctcctctgcagc

SEQ ID NO: 6106119 - DNA, 19 bp, Homo sapiens
cctgcgctcctctgcagcc

SEQ ID NO: 6106120 - DNA, 20 bp, Homo sapiens
cctgcgctcggcaggaagga

SEQ ID NO: 6106121 - DNA, 17 bp, Homo sapiens
cctgcgctctctttgca

SEQ ID NO: 6106122 - DNA, 18 bp, Homo sapiens
cctgcggaagccacaggg

SEQ ID NO: 6106123 - DNA, 20 bp, Homo sapiens
cctgcggaagccacagggtg

SEQ ID NO: 6106124 - DNA, 21 bp, Homo sapiens
cctgcggaagccacagggtga

SEQ ID NO: 6106125 - DNA, 18 bp, Homo sapiens
cctgcggactccatggcc

SEQ ID NO: 6106126 - DNA, 20 bp, Homo sapiens
cctgcggagaccctgagtcc

SEQ ID NO: 6106127 - DNA, 18 bp, Homo sapiens
cctgcggagccggcacct

SEQ ID NO: 6106128 - DNA, 18 bp, Homo sapiens
cctgcggaggcggtggca

SEQ ID NO: 6106129 - DNA, 22 bp, Homo sapiens
cctgcggcaggactgcagagca

SEQ ID NO: 6106130 - DNA, 20 bp, Homo sapiens
cctgcggcccaatccaaggt

SEQ ID NO: 6106131 - DNA, 19 bp, Homo sapiens
cctgcggccgggctgccct

SEQ ID NO: 6106132 - DNA, 20 bp, Homo sapiens
cctgcggccgtcaccccgcc

SEQ ID NO: 6106133 - DNA, 17 bp, Homo sapiens
cctgcggcctgctggag

SEQ ID NO: 6106134 - DNA, 17 bp, Homo sapiens
cctgcggcgccagcctc

SEQ ID NO: 6106135 - DNA, 13 bp, Homo sapiens
cctgcggctctgg

SEQ ID NO: 6106136 - DNA, 15 bp, Homo sapiens
cctgcggctctggaa

SEQ ID NO: 6106137 - DNA, 13 bp, Homo sapiens
cctgcggctgctg

SEQ ID NO: 6106138 - DNA, 18 bp, Homo sapiens
cctgcgggaagctgacct

SEQ ID NO: 6106139 - DNA, 13 bp, Homo sapiens
cctgcgggccaca

SEQ ID NO: 6106140 - DNA, 21 bp, Homo sapiens
cgtggcctgcataggctcctt

SEQ ID NO: 6106141 - DNA, 22 bp, Homo sapiens
cgtggcctgcggccgggctgcc

SEQ ID NO: 6106142 - DNA, 20 bp, Homo sapiens
cgtggcctggcatctgtgtg

SEQ ID NO: 6106143 - DNA, 21 bp, Homo sapiens
cgtggcctggcatctgtgtgc

SEQ ID NO: 6106144 - DNA, 13 bp, Homo sapiens
cgtggcctgggct

SEQ ID NO: 6106145 - DNA, 12 bp, Homo sapiens
cgtggcctgggg

SEQ ID NO: 6106146 - DNA, 15 bp, Homo sapiens
cgtggccttgggagg

SEQ ID NO: 6106147 - DNA, 22 bp, Homo sapiens
cgtggctccagaatgtgctgcc

SEQ ID NO: 6106148 - DNA, 23 bp, Homo sapiens
cgtggctccagaatgtgctgcct

SEQ ID NO: 6106149 - DNA, 14 bp, Homo sapiens
cgtggctctgctgg

SEQ ID NO: 6106150 - DNA, 21 bp, Homo sapiens
cgtggctctgggagagccagc

SEQ ID NO: 6106151 - DNA, 17 bp, Homo sapiens
cgtggctgacccccctc

SEQ ID NO: 6106152 - DNA, 18 bp, Homo sapiens
cgtggctgctgtgggaaa

SEQ ID NO: 6106153 - DNA, 12 bp, Homo sapiens
cgtggctgcttc

SEQ ID NO: 6106154 - DNA, 12 bp, Homo sapiens
cgtggctgggaa

SEQ ID NO: 6106155 - DNA, 13 bp, Homo sapiens
cgtggctgtggca

SEQ ID NO: 6106156 - DNA, 15 bp, Homo sapiens
cgtggctgtggcaca

SEQ ID NO: 6106157 - DNA, 23 bp, Homo sapiens
cgtggctgtggcatccagagtcc

SEQ ID NO: 6106158 - DNA, 18 bp, Homo sapiens
cgtggcttcccgctcagc

SEQ ID NO: 6106159 - DNA, 19 bp, Homo sapiens
cgtggcttcccgctcagcc

SEQ ID NO: 6106160 - DNA, 20 bp, Homo sapiens
cgtggcttcccgctcagccc

SEQ ID NO: 6106161 - DNA, 21 bp, Homo sapiens
cgtggcttcccgctcagccct

SEQ ID NO: 6106162 - DNA, 14 bp, Homo sapiens
cgtggcttctgcag

SEQ ID NO: 6106163 - DNA, 21 bp, Homo sapiens
cgtggcttggggattgtacac

SEQ ID NO: 6106164 - DNA, 22 bp, Homo sapiens
cgtggcttggggattgtacacg

SEQ ID NO: 6106165 - DNA, 15 bp, Homo sapiens
cgtggcttgtagaat

SEQ ID NO: 6106166 - DNA, 17 bp, Homo sapiens
cgtgggaatttcaatgc

SEQ ID NO: 6106167 - DNA, 17 bp, Homo sapiens
cgtgggacccaggctcc

SEQ ID NO: 6106168 - DNA, 19 bp, Homo sapiens
cgtgggacccaggctccca

SEQ ID NO: 6106169 - DNA, 22 bp, Homo sapiens
cgtgggacccaggctcccagcc

SEQ ID NO: 6106170 - DNA, 20 bp, Homo sapiens
cgtgggacggtgcccaagcc

SEQ ID NO: 6106171 - DNA, 17 bp, Homo sapiens
cgtgggacgtggtcagg

SEQ ID NO: 6106172 - DNA, 15 bp, Homo sapiens
cgtgggagaggcaga

SEQ ID NO: 6106173 - DNA, 18 bp, Homo sapiens
cgtgggaggcagaaacct

SEQ ID NO: 6106174 - DNA, 23 bp, Homo sapiens
cgtgggagtatgttatttctctg

SEQ ID NO: 6106175 - DNA, 14 bp, Homo sapiens
cgtgggcagtgcca

SEQ ID NO: 6106176 - DNA, 21 bp, Homo sapiens
cgtgggccccaccctcgggga

SEQ ID NO: 6106177 - DNA, 18 bp, Homo sapiens
cgtgggccctgcaggctg

SEQ ID NO: 6106178 - DNA, 19 bp, Homo sapiens
cgtgggccctgcaggctgc

SEQ ID NO: 6106179 - DNA, 17 bp, Homo sapiens
cgtgggccgggaggcag

SEQ ID NO: 6106180 - DNA, 15 bp, Homo sapiens
cgtgggctcccctct

SEQ ID NO: 6106181 - DNA, 20 bp, Homo sapiens
cgtgggctcccctcttcctc

SEQ ID NO: 6106182 - DNA, 20 bp, Homo sapiens
cgtgggctcccgtgttttgt

SEQ ID NO: 6106183 - DNA, 17 bp, Homo sapiens
cgtgggctccctgactg

SEQ ID NO: 6106184 - DNA, 14 bp, Homo sapiens
cgtgggctctgcca

SEQ ID NO: 6106185 - DNA, 13 bp, Homo sapiens
cgtgggctctggc

SEQ ID NO: 6106186 - DNA, 15 bp, Homo sapiens
cgtgggctctggctc

SEQ ID NO: 6106187 - DNA, 18 bp, Homo sapiens
cgtgggctctggctccct

SEQ ID NO: 6106188 - DNA, 18 bp, Homo sapiens
cgtggggaaggggtgcag

SEQ ID NO: 6106189 - DNA, 17 bp, Homo sapiens
cgtggggaatgggcagg

SEQ ID NO: 6106190 - DNA, 14 bp, Homo sapiens
cgtggggacttctg

SEQ ID NO: 6106191 - DNA, 23 bp, Homo sapiens
cgtggggaggccatttgctgccc

SEQ ID NO: 6106192 - DNA, 20 bp, Homo sapiens
cgtggggcagcacagagagg

SEQ ID NO: 6106193 - DNA, 22 bp, Homo sapiens
cgtggggcagggagctgggccc

SEQ ID NO: 6106194 - DNA, 23 bp, Homo sapiens
cgtggggcagggagctgggcccg

SEQ ID NO: 6106195 - DNA, 20 bp, Homo sapiens
cgtgggggaactgacgctgg

SEQ ID NO: 6106196 - DNA, 21 bp, Homo sapiens
cgtgggggaactgacgctgga

SEQ ID NO: 6106197 - DNA, 22 bp, Homo sapiens
cgtgggggtggccactcctggg

SEQ ID NO: 6106198 - DNA, 17 bp, Homo sapiens
cgtggggtaacatctgt

SEQ ID NO: 6106199 - DNA, 23 bp, Homo sapiens
cgtggggtgcgggatacagctga

SEQ ID NO: 6106200 - DNA, 17 bp, Homo sapiens
cgtgggtacccaggctg

SEQ ID NO: 6106201 - DNA, 21 bp, Homo sapiens
cgtgggtcactacagggagaa

SEQ ID NO: 6106202 - DNA, 11 bp, Homo sapiens
cgtgggtcaga

SEQ ID NO: 6106203 - DNA, 12 bp, Homo sapiens
cgtgggtcagaa

SEQ ID NO: 6106204 - DNA, 18 bp, Homo sapiens
cgtgggtcccagagacct

SEQ ID NO: 6106205 - DNA, 16 bp, Homo sapiens
cgtgggtctctgggga

SEQ ID NO: 6106206 - DNA, 17 bp, Homo sapiens
cgtgggtctctggggac

SEQ ID NO: 6106207 - DNA, 18 bp, Homo sapiens
cgtgggtgccctctccaa

SEQ ID NO: 6106208 - DNA, 13 bp, Homo sapiens
cgtgggtggagga

SEQ ID NO: 6106209 - DNA, 13 bp, Homo sapiens
cgtgggtgtgtgc

SEQ ID NO: 6106210 - DNA, 14 bp, Homo sapiens
cgtgggttgctaac

SEQ ID NO: 6106211 - DNA, 14 bp, Homo sapiens
cgtggtagaagcca

SEQ ID NO: 6106212 - DNA, 15 bp, Homo sapiens
cgtggtagaagccag

SEQ ID NO: 6106213 - DNA, 16 bp, Homo sapiens
cgtggtagaggcctgg

SEQ ID NO: 6106214 - DNA, 15 bp, Homo sapiens
cgtggtatgtctgcc

SEQ ID NO: 6106215 - DNA, 17 bp, Homo sapiens
cgtggtatgtctgccat

SEQ ID NO: 6106216 - DNA, 15 bp, Homo sapiens
cgtggtcaagcactc

SEQ ID NO: 6106217 - DNA, 15 bp, Homo sapiens
cgtggtcactgctgt

SEQ ID NO: 6106218 - DNA, 17 bp, Homo sapiens
cgtggtcactgctgtca

SEQ ID NO: 6106219 - DNA, 14 bp, Homo sapiens
cgtggtcagagtgc

SEQ ID NO: 6106220 - DNA, 13 bp, Homo sapiens
cgtggtccagctc

SEQ ID NO: 6106221 - DNA, 15 bp, Homo sapiens
cgtggtccagctctt

SEQ ID NO: 6106222 - DNA, 22 bp, Homo sapiens
cgtggtcccgaggaagggccag

SEQ ID NO: 6106223 - DNA, 16 bp, Homo sapiens
cgtggtccctgaggat

SEQ ID NO: 6106224 - DNA, 17 bp, Homo sapiens
cgtggtctccttgcact

SEQ ID NO: 6106225 - DNA, 20 bp, Homo sapiens
cgtggtctttgaataaagtc

SEQ ID NO: 6106226 - DNA, 16 bp, Homo sapiens
cgtggtgacccctgct

SEQ ID NO: 6106227 - DNA, 15 bp, Homo sapiens
cgtggtgatttagca

SEQ ID NO: 6106228 - DNA, 16 bp, Homo sapiens
cgtggtgcctgcacac

SEQ ID NO: 6106229 - DNA, 21 bp, Homo sapiens
cgtggtggaagaggggacagg

SEQ ID NO: 6106230 - DNA, 19 bp, Homo sapiens
cgtggtggctcatgcctgt

SEQ ID NO: 6106231 - DNA, 16 bp, Homo sapiens
cgtggtgggactccag

SEQ ID NO: 6106232 - DNA, 21 bp, Homo sapiens
cgtggtgggggaggagcctct

SEQ ID NO: 6106233 - DNA, 17 bp, Homo sapiens
cgtggtggtccctgggt

SEQ ID NO: 6106234 - DNA, 14 bp, Homo sapiens
cgtggtgtgaggcc

SEQ ID NO: 6106235 - DNA, 20 bp, Homo sapiens
cgtggtgtgtccctggacac

SEQ ID NO: 6106236 - DNA, 22 bp, Homo sapiens
cgtggtgtgtccctggacacag

SEQ ID NO: 6106237 - DNA, 17 bp, Homo sapiens
cgtggttcactttggtc

SEQ ID NO: 6106238 - DNA, 14 bp, Homo sapiens
cgtggttcttaaat

SEQ ID NO: 6106239 - DNA, 21 bp, Homo sapiens
cgtggttgccgtctctggccc

SEQ ID NO: 6106240 - DNA, 22 bp, Homo sapiens
cgtggttgccgtctctggcccc

SEQ ID NO: 6106241 - DNA, 23 bp, Homo sapiens
cgtggttgccgtctctggcccct

SEQ ID NO: 6106242 - DNA, 18 bp, Homo sapiens
cgtgtaaaaagcctcctt

SEQ ID NO: 6106243 - DNA, 14 bp, Homo sapiens
cgtgtaaataattt

SEQ ID NO: 6106244 - DNA, 18 bp, Homo sapiens
cgtgtaaataatttatta

SEQ ID NO: 6106245 - DNA, 20 bp, Homo sapiens
cgtgtaaataatttattaca

SEQ ID NO: 6106246 - DNA, 18 bp, Homo sapiens
cgtgtaaatatgtacatt

SEQ ID NO: 6106247 - DNA, 15 bp, Homo sapiens
cgtgtaactgtagtg

SEQ ID NO: 6106248 - DNA, 16 bp, Homo sapiens
cgtgtaatattctctg

SEQ ID NO: 6106249 - DNA, 16 bp, Homo sapiens
cgtgtagccccgggct

SEQ ID NO: 6106250 - DNA, 21 bp, Homo sapiens
cgtgtagccccgggctgaccc

SEQ ID NO: 6106251 - DNA, 17 bp, Homo sapiens
cgtgtaggaacctgcac

SEQ ID NO: 6106252 - DNA, 23 bp, Homo sapiens
cgtgtagtggaagagcagcctga

SEQ ID NO: 6106253 - DNA, 13 bp, Homo sapiens
cgtgtagtttctg

SEQ ID NO: 6106254 - DNA, 17 bp, Homo sapiens
cgtgtatagtatctgta

SEQ ID NO: 6106255 - DNA, 23 bp, Homo sapiens
cgtgtatagtgcctaaaattgta

SEQ ID NO: 6106256 - DNA, 13 bp, Homo sapiens
cgtgtatatgtgc

SEQ ID NO: 6106257 - DNA, 17 bp, Homo sapiens
cgtgtatatgtgcttgt

SEQ ID NO: 6106258 - DNA, 17 bp, Homo sapiens
cgtgtatgtttcttctt

SEQ ID NO: 6106259 - DNA, 13 bp, Homo sapiens
cgtgtattcagga

SEQ ID NO: 6106260 - DNA, 16 bp, Homo sapiens
cgtgtatttattacat

SEQ ID NO: 6106261 - DNA, 17 bp, Homo sapiens
cgtgtatttattaccgt

SEQ ID NO: 6106262 - DNA, 16 bp, Homo sapiens
cgtgtattttcattac

SEQ ID NO: 6106263 - DNA, 15 bp, Homo sapiens
cgtgtcaagctgctc

SEQ ID NO: 6106264 - DNA, 16 bp, Homo sapiens
cgtgtcaatttccctc

SEQ ID NO: 6106265 - DNA, 18 bp, Homo sapiens
cgtgtcaatttccctcag

SEQ ID NO: 6106266 - DNA, 12 bp, Homo sapiens
cgtgtcaggtgg

SEQ ID NO: 6106267 - DNA, 17 bp, Homo sapiens
cgtgtcagtaatttata

SEQ ID NO: 6106268 - DNA, 12 bp, Homo sapiens
cgtgtccagcac

SEQ ID NO: 6106269 - DNA, 18 bp, Homo sapiens
cgtgtcccaaggagctga

SEQ ID NO: 6106270 - DNA, 17 bp, Homo sapiens
cgtgtccccggcctcag

SEQ ID NO: 6106271 - DNA, 17 bp, Homo sapiens
cgtgtcccgcggtgctg

SEQ ID NO: 6106272 - DNA, 18 bp, Homo sapiens
cgtgtcccgcggtgctga

SEQ ID NO: 6106273 - DNA, 15 bp, Homo sapiens
cgtgtccctctcgga

SEQ ID NO: 6106274 - DNA, 21 bp, Homo sapiens
cgtgtcccttcccagcgctgc

SEQ ID NO: 6106275 - DNA, 17 bp, Homo sapiens
cgtgtcctcctctgagg

SEQ ID NO: 6106276 - DNA, 18 bp, Homo sapiens
cgtgtcctcctctgagga

SEQ ID NO: 6106277 - DNA, 16 bp, Homo sapiens
cgtgtcctgctagctg

SEQ ID NO: 6106278 - DNA, 20 bp, Homo sapiens
cgtgtcctgctagctgtctc

SEQ ID NO: 6106279 - DNA, 15 bp, Homo sapiens
cgtgtctcagcctct

SEQ ID NO: 6106280 - DNA, 13 bp, Homo sapiens
cgtgtctctccca

SEQ ID NO: 6106281 - DNA, 14 bp, Homo sapiens
cgtgtctctcccac

SEQ ID NO: 6106282 - DNA, 21 bp, Homo sapiens
cgtgtctctgccatgtggcag

SEQ ID NO: 6106283 - DNA, 15 bp, Homo sapiens
cgtgtctgtggccct

SEQ ID NO: 6106284 - DNA, 16 bp, Homo sapiens
cgtgtctgtggccctc

SEQ ID NO: 6106285 - DNA, 21 bp, Homo sapiens
cgtgtcttttaaaaactcctg

SEQ ID NO: 6106286 - DNA, 18 bp, Homo sapiens
cgtgtgaagccacggaag

SEQ ID NO: 6106287 - DNA, 18 bp, Homo sapiens
cgtgtgacctccatactg

SEQ ID NO: 6106288 - DNA, 20 bp, Homo sapiens
cgtgtgatttgtctctgagc

SEQ ID NO: 6106289 - DNA, 15 bp, Homo sapiens
cgtgtgatttttctg

SEQ ID NO: 6106290 - DNA, 18 bp, Homo sapiens
cgtgtgcatagcgtcctg

SEQ ID NO: 6106291 - DNA, 14 bp, Homo sapiens
cgtgtgcccaccag

SEQ ID NO: 6106292 - DNA, 19 bp, Homo sapiens
cgtgtgccccaagaggcta

SEQ ID NO: 6106293 - DNA, 13 bp, Homo sapiens
cgtgtgcctgagc

SEQ ID NO: 6106294 - DNA, 14 bp, Homo sapiens
cgtgtgcctgagcg

SEQ ID NO: 6106295 - DNA, 16 bp, Homo sapiens
cgtgtgcgtgcatgtg

SEQ ID NO: 6106296 - DNA, 20 bp, Homo sapiens
cgtgtgcgtgttcctttgct

SEQ ID NO: 6106297 - DNA, 16 bp, Homo sapiens
cgtgtggactgtgcct

SEQ ID NO: 6106298 - DNA, 13 bp, Homo sapiens
cgtgtggagcaga

SEQ ID NO: 6106299 - DNA, 14 bp, Homo sapiens
cgtgtggagggctg

SEQ ID NO: 6106300 - DNA, 18 bp, Homo sapiens
cgtgtggatcttgccaca

SEQ ID NO: 6106301 - DNA, 23 bp, Homo sapiens
cgtgtggatcttgccacatttct

SEQ ID NO: 6106302 - DNA, 21 bp, Homo sapiens
cgtgtggcaatagtgggccct

SEQ ID NO: 6106303 - DNA, 20 bp, Homo sapiens
cgtgtggccctgtgggagtc

SEQ ID NO: 6106304 - DNA, 23 bp, Homo sapiens
cgtgtggccctgtgggagtccac

SEQ ID NO: 6106305 - DNA, 22 bp, Homo sapiens
cgtgtggcctccgtcctgtcac

SEQ ID NO: 6106306 - DNA, 13 bp, Homo sapiens
cgtgtggcctggg

SEQ ID NO: 6106307 - DNA, 15 bp, Homo sapiens
cgtgtggctcctggt

SEQ ID NO: 6106308 - DNA, 23 bp, Homo sapiens
cgtgtgggccgtggcttgggctg

SEQ ID NO: 6106309 - DNA, 22 bp, Homo sapiens
cgtgtgggctttaaaagaaaaa

SEQ ID NO: 6106310 - DNA, 16 bp, Homo sapiens
cgtgtgggtctctggg

SEQ ID NO: 6106311 - DNA, 18 bp, Homo sapiens
cgtgtgtagagttaagaa

SEQ ID NO: 6106312 - DNA, 17 bp, Homo sapiens
cgtgtgtccatgtgttc

SEQ ID NO: 6106313 - DNA, 15 bp, Homo sapiens
cgtgtgtccctgtgg

SEQ ID NO: 6106314 - DNA, 22 bp, Homo sapiens
cgtgtgtctcatgccagcagca

SEQ ID NO: 6106315 - DNA, 15 bp, Homo sapiens
cgtgtgtggctggga

SEQ ID NO: 6106316 - DNA, 16 bp, Homo sapiens
cgtgtgtggctgggac

SEQ ID NO: 6106317 - DNA, 17 bp, Homo sapiens
cgtgtgtggctgggacc

SEQ ID NO: 6106318 - DNA, 21 bp, Homo sapiens
cgtgtgtgggtggatataaat

SEQ ID NO: 6106319 - DNA, 16 bp, Homo sapiens
cctgcgggccacaggg

SEQ ID NO: 6106320 - DNA, 17 bp, Homo sapiens
cctgcgggccacagggc

SEQ ID NO: 6106321 - DNA, 14 bp, Homo sapiens
cctgcgggccaggg

SEQ ID NO: 6106322 - DNA, 17 bp, Homo sapiens
cctgcgggccagggtcc

SEQ ID NO: 6106323 - DNA, 18 bp, Homo sapiens
cctgcgggccagggtcct

SEQ ID NO: 6106324 - DNA, 17 bp, Homo sapiens
cctgcgggcccctggtg

SEQ ID NO: 6106325 - DNA, 21 bp, Homo sapiens
cctgcgggcgcgggcagccac

SEQ ID NO: 6106326 - DNA, 12 bp, Homo sapiens
cctgcgggctgc

SEQ ID NO: 6106327 - DNA, 17 bp, Homo sapiens
cctgcggggcagcaggg

SEQ ID NO: 6106328 - DNA, 18 bp, Homo sapiens
cctgcggggttccctgcg

SEQ ID NO: 6106329 - DNA, 19 bp, Homo sapiens
cctgcggggttccctgcgc

SEQ ID NO: 6106330 - DNA, 20 bp, Homo sapiens
cctgcggggttccctgcgcg

SEQ ID NO: 6106331 - DNA, 20 bp, Homo sapiens
cctgcgggtcctcagctgct

SEQ ID NO: 6106332 - DNA, 24 bp, Homo sapiens
cctgcgggtgaacaaagcagccac

SEQ ID NO: 6106333 - DNA, 16 bp, Homo sapiens
cctgcggtcaaggcca

SEQ ID NO: 6106334 - DNA, 17 bp, Homo sapiens
cctgcggtcaaggccag

SEQ ID NO: 6106335 - DNA, 22 bp, Homo sapiens
cctgcggtcaggctgggcagcc

SEQ ID NO: 6106336 - DNA, 16 bp, Homo sapiens
cctgcggtgctatctc

SEQ ID NO: 6106337 - DNA, 15 bp, Homo sapiens
cctgcggtggaggga

SEQ ID NO: 6106338 - DNA, 23 bp, Homo sapiens
cctgcgtaaccctcgccctgtcc

SEQ ID NO: 6106339 - DNA, 19 bp, Homo sapiens
cctgcgtcatggctcaagg

SEQ ID NO: 6106340 - DNA, 19 bp, Homo sapiens
cctgcgtcccagcctgcac

SEQ ID NO: 6106341 - DNA, 19 bp, Homo sapiens
cctgcgtcctcctcacctc

SEQ ID NO: 6106342 - DNA, 23 bp, Homo sapiens
cctgcgtcgaagctttgaaggcc

SEQ ID NO: 6106343 - DNA, 20 bp, Homo sapiens
cctgcgtctccatatgtgta

SEQ ID NO: 6106344 - DNA, 14 bp, Homo sapiens
cctgcgtctcctgc

SEQ ID NO: 6106345 - DNA, 19 bp, Homo sapiens
cctgcgtgcgctggttccg

SEQ ID NO: 6106346 - DNA, 12 bp, Homo sapiens
cctgcgtggcct

SEQ ID NO: 6106347 - DNA, 14 bp, Homo sapiens
cctgcgtggcctga

SEQ ID NO: 6106348 - DNA, 15 bp, Homo sapiens
cctgcgtggcctgag

SEQ ID NO: 6106349 - DNA, 15 bp, Homo sapiens
cctgcgtggcctggg

SEQ ID NO: 6106350 - DNA, 17 bp, Homo sapiens
cctgcgtggcctggggc

SEQ ID NO: 6106351 - DNA, 22 bp, Homo sapiens
cctgcgtggcctggggctgccg

SEQ ID NO: 6106352 - DNA, 12 bp, Homo sapiens
cctgcgtggggg

SEQ ID NO: 6106353 - DNA, 16 bp, Homo sapiens
cctgcgtgtgtctgtg

SEQ ID NO: 6106354 - DNA, 18 bp, Homo sapiens
cctgcgtgtgtctgtgtt

SEQ ID NO: 6106355 - DNA, 14 bp, Homo sapiens
cctgcgtgtgttct

SEQ ID NO: 6106356 - DNA, 16 bp, Homo sapiens
cctgcgtgtgttctct

SEQ ID NO: 6106357 - DNA, 17 bp, Homo sapiens
cctgcgttctccccatg

SEQ ID NO: 6106358 - DNA, 19 bp, Homo sapiens
cctgcgttcttgtgacaga

SEQ ID NO: 6106359 - DNA, 13 bp, Homo sapiens
cctgcgttggagc

SEQ ID NO: 6106360 - DNA, 17 bp, Homo sapiens
cctgcgttggtccagag

SEQ ID NO: 6106361 - DNA, 22 bp, Homo sapiens
cctgcgttttggaagctctgaa

SEQ ID NO: 6106362 - DNA, 20 bp, Homo sapiens
cctgctaaggaacaatgccg

SEQ ID NO: 6106363 - DNA, 16 bp, Homo sapiens
cctgctaaggctcctc

SEQ ID NO: 6106364 - DNA, 18 bp, Homo sapiens
cctgctaaggctcctcct

SEQ ID NO: 6106365 - DNA, 13 bp, Homo sapiens
cctgctaatagct

SEQ ID NO: 6106366 - DNA, 21 bp, Homo sapiens
cctgctaattccccagattgc

SEQ ID NO: 6106367 - DNA, 17 bp, Homo sapiens
cctgctacacaggcagg

SEQ ID NO: 6106368 - DNA, 18 bp, Homo sapiens
cctgctacacaggcagga

SEQ ID NO: 6106369 - DNA, 17 bp, Homo sapiens
cctgctacactcatccg

SEQ ID NO: 6106370 - DNA, 17 bp, Homo sapiens
cctgctaccaaggccca

SEQ ID NO: 6106371 - DNA, 18 bp, Homo sapiens
cctgctaccaaggcccag

SEQ ID NO: 6106372 - DNA, 21 bp, Homo sapiens
cctgctacctttgtctcacga

SEQ ID NO: 6106373 - DNA, 16 bp, Homo sapiens
cctgctactctgttcc

SEQ ID NO: 6106374 - DNA, 14 bp, Homo sapiens
cctgctagaaatgg

SEQ ID NO: 6106375 - DNA, 18 bp, Homo sapiens
cctgctagacgcaccgcc

SEQ ID NO: 6106376 - DNA, 19 bp, Homo sapiens
cctgctagagcaacccctg

SEQ ID NO: 6106377 - DNA, 23 bp, Homo sapiens
cctgctagatgagaattcagctg

SEQ ID NO: 6106378 - DNA, 13 bp, Homo sapiens
cctgctagcacag

SEQ ID NO: 6106379 - DNA, 21 bp, Homo sapiens
cctgctagcacagaggcctga

SEQ ID NO: 6106380 - DNA, 22 bp, Homo sapiens
cctgctagcacagaggcctgac

SEQ ID NO: 6106381 - DNA, 14 bp, Homo sapiens
cctgctagcaggcc

SEQ ID NO: 6106382 - DNA, 17 bp, Homo sapiens
cctgctagcaggccccc

SEQ ID NO: 6106383 - DNA, 14 bp, Homo sapiens
cctgctagcggctg

SEQ ID NO: 6106384 - DNA, 16 bp, Homo sapiens
cctgctagctgtctct

SEQ ID NO: 6106385 - DNA, 17 bp, Homo sapiens
cctgctagctgtctctc

SEQ ID NO: 6106386 - DNA, 20 bp, Homo sapiens
cctgctagctgtctctcttg

SEQ ID NO: 6106387 - DNA, 14 bp, Homo sapiens
cctgctaggccaga

SEQ ID NO: 6106388 - DNA, 18 bp, Homo sapiens
cctgctaggccagagccc

SEQ ID NO: 6106389 - DNA, 15 bp, Homo sapiens
cctgctagtcgcccc

SEQ ID NO: 6106390 - DNA, 18 bp, Homo sapiens
cctgctagtcgcccctca

SEQ ID NO: 6106391 - DNA, 22 bp, Homo sapiens
cctgctagtcgcccctcagagc

SEQ ID NO: 6106392 - DNA, 14 bp, Homo sapiens
cctgctatccagcc

SEQ ID NO: 6106393 - DNA, 15 bp, Homo sapiens
cctgctatccagccg

SEQ ID NO: 6106394 - DNA, 21 bp, Homo sapiens
cctgctatgacagctggctag

SEQ ID NO: 6106395 - DNA, 21 bp, Homo sapiens
cctgctatttcaggccctcag

SEQ ID NO: 6106396 - DNA, 18 bp, Homo sapiens
cctgctatttcccaagct

SEQ ID NO: 6106397 - DNA, 21 bp, Homo sapiens
cctgctcaactctacccctgc

SEQ ID NO: 6106398 - DNA, 22 bp, Homo sapiens
cctgctcaactctacccctgct

SEQ ID NO: 6106399 - DNA, 23 bp, Homo sapiens
cctgctcaactctacccctgctc

SEQ ID NO: 6106400 - DNA, 14 bp, Homo sapiens
cctgctcacatctg

SEQ ID NO: 6106401 - DNA, 16 bp, Homo sapiens
cctgctcaccacctgc

SEQ ID NO: 6106402 - DNA, 17 bp, Homo sapiens
cctgctcaccacctgcc

SEQ ID NO: 6106403 - DNA, 19 bp, Homo sapiens
cctgctcacccgcctcttg

SEQ ID NO: 6106404 - DNA, 15 bp, Homo sapiens
cctgctcactgggcc

SEQ ID NO: 6106405 - DNA, 17 bp, Homo sapiens
cctgctcagatgctggt

SEQ ID NO: 6106406 - DNA, 20 bp, Homo sapiens
cctgctcagcaattcagacc

SEQ ID NO: 6106407 - DNA, 13 bp, Homo sapiens
cctgctcagcagc

SEQ ID NO: 6106408 - DNA, 22 bp, Homo sapiens
cctgctcagcagccagtctcag

SEQ ID NO: 6106409 - DNA, 21 bp, Homo sapiens
cctgctcagcagtgagagcag

SEQ ID NO: 6106410 - DNA, 12 bp, Homo sapiens
cctgctcagccc

SEQ ID NO: 6106411 - DNA, 13 bp, Homo sapiens
cctgctcagccca

SEQ ID NO: 6106412 - DNA, 14 bp, Homo sapiens
cctgctcagcccat

SEQ ID NO: 6106413 - DNA, 17 bp, Homo sapiens
cctgctcagctggccgg

SEQ ID NO: 6106414 - DNA, 20 bp, Homo sapiens
cctgctcagctggccgggtt

SEQ ID NO: 6106415 - DNA, 22 bp, Homo sapiens
cctgctcaggcctcacctggct

SEQ ID NO: 6106416 - DNA, 20 bp, Homo sapiens
cctgctcagtgcttgggctc

SEQ ID NO: 6106417 - DNA, 23 bp, Homo sapiens
cctgctcattatgccacttcctt

SEQ ID NO: 6106418 - DNA, 23 bp, Homo sapiens
cctgctcattcctcacgcccttc

SEQ ID NO: 6106419 - DNA, 12 bp, Homo sapiens
cctgctccacag

SEQ ID NO: 6106420 - DNA, 15 bp, Homo sapiens
cctgctccaccagca

SEQ ID NO: 6106421 - DNA, 22 bp, Homo sapiens
cctgctccaccagcagcatggc

SEQ ID NO: 6106422 - DNA, 13 bp, Homo sapiens
cctgctccagaag

SEQ ID NO: 6106423 - DNA, 14 bp, Homo sapiens
cctgctccagacct

SEQ ID NO: 6106424 - DNA, 23 bp, Homo sapiens
cctgctccagcagcacacctcag

SEQ ID NO: 6106425 - DNA, 11 bp, Homo sapiens
cctgctccagt

SEQ ID NO: 6106426 - DNA, 13 bp, Homo sapiens
cctgctcccacag

SEQ ID NO: 6106427 - DNA, 19 bp, Homo sapiens
cctgctcccacgcctgctt

SEQ ID NO: 6106428 - DNA, 15 bp, Homo sapiens
cctgctcccagcagc

SEQ ID NO: 6106429 - DNA, 23 bp, Homo sapiens
cctgctcccagcagccctaagga

SEQ ID NO: 6106430 - DNA, 16 bp, Homo sapiens
cctgctcccagcctgc

SEQ ID NO: 6106431 - DNA, 18 bp, Homo sapiens
cctgctcccagcctgctg

SEQ ID NO: 6106432 - DNA, 16 bp, Homo sapiens
cctgctcccagctctc

SEQ ID NO: 6106433 - DNA, 13 bp, Homo sapiens
cctgctcccaggc

SEQ ID NO: 6106434 - DNA, 16 bp, Homo sapiens
cctgctcccaggcccc

SEQ ID NO: 6106435 - DNA, 20 bp, Homo sapiens
cctgctcccaggccccaggc

SEQ ID NO: 6106436 - DNA, 15 bp, Homo sapiens
cctgctcccagggac

SEQ ID NO: 6106437 - DNA, 17 bp, Homo sapiens
cctgctcccatcctcac

SEQ ID NO: 6106438 - DNA, 20 bp, Homo sapiens
cctgctcccatcctgtgtgt

SEQ ID NO: 6106439 - DNA, 19 bp, Homo sapiens
cctgctcccattcctccct

SEQ ID NO: 6106440 - DNA, 22 bp, Homo sapiens
cctgctcccattcctccctccg

SEQ ID NO: 6106441 - DNA, 14 bp, Homo sapiens
cctgctcccccacc

SEQ ID NO: 6106442 - DNA, 15 bp, Homo sapiens
cctgctcccctttgg

SEQ ID NO: 6106443 - DNA, 18 bp, Homo sapiens
cctgctcccggctctgag

SEQ ID NO: 6106444 - DNA, 20 bp, Homo sapiens
cctgctccctctccccctta

SEQ ID NO: 6106445 - DNA, 15 bp, Homo sapiens
cctgctccctgcctc

SEQ ID NO: 6106446 - DNA, 16 bp, Homo sapiens
cctgctccctgctccc

SEQ ID NO: 6106447 - DNA, 17 bp, Homo sapiens
cctgctccctgctttgg

SEQ ID NO: 6106448 - DNA, 23 bp, Homo sapiens
cctgctccctgtctgtgtcccag

SEQ ID NO: 6106449 - DNA, 20 bp, Homo sapiens
cctgctcccttcgctctgct

SEQ ID NO: 6106450 - DNA, 18 bp, Homo sapiens
cctgctccgctgcctgga

SEQ ID NO: 6106451 - DNA, 17 bp, Homo sapiens
cctgctccgctgctcct

SEQ ID NO: 6106452 - DNA, 15 bp, Homo sapiens
cctgctccgtggact

SEQ ID NO: 6106453 - DNA, 18 bp, Homo sapiens
cctgctcctagcaccctg

SEQ ID NO: 6106454 - DNA, 20 bp, Homo sapiens
cctgctcctcacccctgtag

SEQ ID NO: 6106455 - DNA, 15 bp, Homo sapiens
cctgctcctcatggg

SEQ ID NO: 6106456 - DNA, 11 bp, Homo sapiens
cctgctcctcc

SEQ ID NO: 6106457 - DNA, 14 bp, Homo sapiens
cctgctcctcccaa

SEQ ID NO: 6106458 - DNA, 13 bp, Homo sapiens
cctgctcctccct

SEQ ID NO: 6106459 - DNA, 19 bp, Homo sapiens
cctgctcctccctgccccc

SEQ ID NO: 6106460 - DNA, 17 bp, Homo sapiens
cctgctcctccctggct

SEQ ID NO: 6106461 - DNA, 21 bp, Homo sapiens
cctgctcctcctgccctgtcc

SEQ ID NO: 6106462 - DNA, 13 bp, Homo sapiens
cctgctcctgcag

SEQ ID NO: 6106463 - DNA, 16 bp, Homo sapiens
cctgctcctgcagcat

SEQ ID NO: 6106464 - DNA, 15 bp, Homo sapiens
cctgctcctgcccac

SEQ ID NO: 6106465 - DNA, 16 bp, Homo sapiens
cctgctcctgcccacg

SEQ ID NO: 6106466 - DNA, 19 bp, Homo sapiens
cctgctcctttctgcccag

SEQ ID NO: 6106467 - DNA, 12 bp, Homo sapiens
cctgctcgccct

SEQ ID NO: 6106468 - DNA, 15 bp, Homo sapiens
cctgctcgccctgtg

SEQ ID NO: 6106469 - DNA, 17 bp, Homo sapiens
cctgctcgccctgtgcc

SEQ ID NO: 6106470 - DNA, 18 bp, Homo sapiens
cctgctcgccctgtgccc

SEQ ID NO: 6106471 - DNA, 15 bp, Homo sapiens
cctgctcgctccctg

SEQ ID NO: 6106472 - DNA, 21 bp, Homo sapiens
cctgctcggcaccgccagccg

SEQ ID NO: 6106473 - DNA, 18 bp, Homo sapiens
cctgctcgtccccaagtg

SEQ ID NO: 6106474 - DNA, 20 bp, Homo sapiens
cctgctctaacacctgccta

SEQ ID NO: 6106475 - DNA, 16 bp, Homo sapiens
cctgctctacccatga

SEQ ID NO: 6106476 - DNA, 17 bp, Homo sapiens
cctgctctacccatgag

SEQ ID NO: 6106477 - DNA, 20 bp, Homo sapiens
cctgctctacccatgagcct

SEQ ID NO: 6106478 - DNA, 18 bp, Homo sapiens
cctgctctagtgggacag

SEQ ID NO: 6106479 - DNA, 19 bp, Homo sapiens
cctgctctagtgggacagc

SEQ ID NO: 6106480 - DNA, 23 bp, Homo sapiens
cctgctctccaagtctcagtggc

SEQ ID NO: 6106481 - DNA, 19 bp, Homo sapiens
cctgctctccggcgcagac

SEQ ID NO: 6106482 - DNA, 12 bp, Homo sapiens
cctgctctcctc

SEQ ID NO: 6106483 - DNA, 16 bp, Homo sapiens
cctgctctcctcttct

SEQ ID NO: 6106484 - DNA, 18 bp, Homo sapiens
cctgctctcctcttgcca

SEQ ID NO: 6106485 - DNA, 21 bp, Homo sapiens
cctgctctcctcttgccactg

SEQ ID NO: 6106486 - DNA, 22 bp, Homo sapiens
cctgctctcctcttgccactgc

SEQ ID NO: 6106487 - DNA, 17 bp, Homo sapiens
cctgctctccttgccct

SEQ ID NO: 6106488 - DNA, 18 bp, Homo sapiens
cctgctctccttgccctg

SEQ ID NO: 6106489 - DNA, 20 bp, Homo sapiens
cctgctctccttgccctggg

SEQ ID NO: 6106490 - DNA, 22 bp, Homo sapiens
cctgctctcgaggcagcagtgg

SEQ ID NO: 6106491 - DNA, 14 bp, Homo sapiens
cctgctctctaccc

SEQ ID NO: 6106492 - DNA, 16 bp, Homo sapiens
cctgctctctacccag

SEQ ID NO: 6106493 - DNA, 19 bp, Homo sapiens
cctgctctctacccagccc

SEQ ID NO: 6106494 - DNA, 13 bp, Homo sapiens
cctgctctctgct

SEQ ID NO: 6106495 - DNA, 16 bp, Homo sapiens
cctgctctctgctcat

SEQ ID NO: 6106496 - DNA, 13 bp, Homo sapiens
cctgctctcttca

SEQ ID NO: 6106497 - DNA, 16 bp, Homo sapiens
cctgctctcttcagga

SEQ ID NO: 6106498 - DNA, 23 bp, Homo sapiens
cgtgtgtgggtggatataaatat

SEQ ID NO: 6106499 - DNA, 15 bp, Homo sapiens
cgtgtgtgtatgtgt

SEQ ID NO: 6106500 - DNA, 12 bp, Homo sapiens
cgtgtgtgtgcg

SEQ ID NO: 6106501 - DNA, 23 bp, Homo sapiens
cgtgtgtgtggccggcctcctcc

SEQ ID NO: 6106502 - DNA, 19 bp, Homo sapiens
cgtgtgtgtgtatgtgtgt

SEQ ID NO: 6106503 - DNA, 23 bp, Homo sapiens
cgtgtgtgtgtatgtgtgtgtgt

SEQ ID NO: 6106504 - DNA, 18 bp, Homo sapiens
cgtgtgtttagaagccta

SEQ ID NO: 6106505 - DNA, 19 bp, Homo sapiens
cgtgtgtttgtatgtctgt

SEQ ID NO: 6106506 - DNA, 20 bp, Homo sapiens
cgtgtgtttgtatgtctgtg

SEQ ID NO: 6106507 - DNA, 17 bp, Homo sapiens
cgtgtgtttttctatta

SEQ ID NO: 6106508 - DNA, 21 bp, Homo sapiens
cgtgttaattataaacagcag

SEQ ID NO: 6106509 - DNA, 23 bp, Homo sapiens
cgtgttaattataaacagcaggg

SEQ ID NO: 6106510 - DNA, 19 bp, Homo sapiens
cgtgttactgttgcactga

SEQ ID NO: 6106511 - DNA, 21 bp, Homo sapiens
cgtgttaggaggctgcatgct

SEQ ID NO: 6106512 - DNA, 18 bp, Homo sapiens
cgtgttagtgtgtgtgca

SEQ ID NO: 6106513 - DNA, 22 bp, Homo sapiens
cgtgttagtgtgtgtgcatgtg

SEQ ID NO: 6106514 - DNA, 15 bp, Homo sapiens
cgtgttatgactcca

SEQ ID NO: 6106515 - DNA, 15 bp, Homo sapiens
cgtgttcagcagaac

SEQ ID NO: 6106516 - DNA, 14 bp, Homo sapiens
cgtgttcaggacac

SEQ ID NO: 6106517 - DNA, 22 bp, Homo sapiens
cgtgttccagccaaagcatgcc

SEQ ID NO: 6106518 - DNA, 15 bp, Homo sapiens
cgtgttcccctcttg

SEQ ID NO: 6106519 - DNA, 19 bp, Homo sapiens
cgtgttcccctcttgtctc

SEQ ID NO: 6106520 - DNA, 17 bp, Homo sapiens
cgtgttcctttgctctt

SEQ ID NO: 6106521 - DNA, 19 bp, Homo sapiens
cgtgttcgaaagtctgaaa

SEQ ID NO: 6106522 - DNA, 19 bp, Homo sapiens
cgtgttctatagagcctgg

SEQ ID NO: 6106523 - DNA, 18 bp, Homo sapiens
cgtgttctcctccaaatg

SEQ ID NO: 6106524 - DNA, 14 bp, Homo sapiens
cgtgttggtatttt

SEQ ID NO: 6106525 - DNA, 13 bp, Homo sapiens
cgtgttgtcattg

SEQ ID NO: 6106526 - DNA, 17 bp, Homo sapiens
cgtgttgtgttctttat

SEQ ID NO: 6106527 - DNA, 18 bp, Homo sapiens
cgtgttgtgttctttata

SEQ ID NO: 6106528 - DNA, 14 bp, Homo sapiens
cgtgtttacaaaag

SEQ ID NO: 6106529 - DNA, 20 bp, Homo sapiens
cgtgtttctctaaggaatta

SEQ ID NO: 6106530 - DNA, 15 bp, Homo sapiens
cgtgtttctgactct

SEQ ID NO: 6106531 - DNA, 13 bp, Homo sapiens
cgtgtttgcttaa

SEQ ID NO: 6106532 - DNA, 17 bp, Homo sapiens
cgtgtttgcttaaaata

SEQ ID NO: 6106533 - DNA, 14 bp, Homo sapiens
cgtgttttcaagga

SEQ ID NO: 6106534 - DNA, 21 bp, Homo sapiens
cgtgtttttggttttctcctt

SEQ ID NO: 6106535 - DNA, 22 bp, Homo sapiens
cgtgtttttggttttctccttc

SEQ ID NO: 6106536 - DNA, 14 bp, Homo sapiens
cgttaaaaacagat

SEQ ID NO: 6106537 - DNA, 21 bp, Homo sapiens
cgttaaaaacagatttggaaa

SEQ ID NO: 6106538 - DNA, 21 bp, Homo sapiens
cgttaaaagtgtacaagttgc

SEQ ID NO: 6106539 - DNA, 20 bp, Homo sapiens
cgttaacactacttaaaagt

SEQ ID NO: 6106540 - DNA, 18 bp, Homo sapiens
cgttaactgcattttaca

SEQ ID NO: 6106541 - DNA, 21 bp, Homo sapiens
cgttaagaatttggggcagga

SEQ ID NO: 6106542 - DNA, 23 bp, Homo sapiens
cgttaagcacaagacacagaata

SEQ ID NO: 6106543 - DNA, 12 bp, Homo sapiens
cgttaagcagta

SEQ ID NO: 6106544 - DNA, 13 bp, Homo sapiens
cgttaagggcaga

SEQ ID NO: 6106545 - DNA, 19 bp, Homo sapiens
cgttaatagattatttcat

SEQ ID NO: 6106546 - DNA, 17 bp, Homo sapiens
cgttaatcttgctgctt

SEQ ID NO: 6106547 - DNA, 13 bp, Homo sapiens
cgttaattaaaca

SEQ ID NO: 6106548 - DNA, 20 bp, Homo sapiens
cgttaattttcctttgtcat

SEQ ID NO: 6106549 - DNA, 21 bp, Homo sapiens
cgttactagcagtcacttgat

SEQ ID NO: 6106550 - DNA, 17 bp, Homo sapiens
cgttactcccctggctg

SEQ ID NO: 6106551 - DNA, 17 bp, Homo sapiens
cgttagaggaaaaatat

SEQ ID NO: 6106552 - DNA, 19 bp, Homo sapiens
cgttaggaataacactgca

SEQ ID NO: 6106553 - DNA, 23 bp, Homo sapiens
cgttaggacaaggctgtgccagg

SEQ ID NO: 6106554 - DNA, 19 bp, Homo sapiens
cgttaggattcaggcagca

SEQ ID NO: 6106555 - DNA, 20 bp, Homo sapiens
cgttaggcatttcctgctga

SEQ ID NO: 6106556 - DNA, 13 bp, Homo sapiens
cgttaggccaggc

SEQ ID NO: 6106557 - DNA, 18 bp, Homo sapiens
cgttaggcccgggcccct

SEQ ID NO: 6106558 - DNA, 23 bp, Homo sapiens
cgttaggcccgggcccctggcac

SEQ ID NO: 6106559 - DNA, 16 bp, Homo sapiens
cgttagggaagagaaa

SEQ ID NO: 6106560 - DNA, 14 bp, Homo sapiens
cgttagtgggcagg

SEQ ID NO: 6106561 - DNA, 22 bp, Homo sapiens
cgttatagtccatggtccatca

SEQ ID NO: 6106562 - DNA, 13 bp, Homo sapiens
cgttatatattgt

SEQ ID NO: 6106563 - DNA, 23 bp, Homo sapiens
cgttatctaatagggcaattaat

SEQ ID NO: 6106564 - DNA, 22 bp, Homo sapiens
cgttatctcattgcaaaaatat

SEQ ID NO: 6106565 - DNA, 17 bp, Homo sapiens
cgttatgtaagtttcta

SEQ ID NO: 6106566 - DNA, 17 bp, Homo sapiens
cgttcaaaacattccaa

SEQ ID NO: 6106567 - DNA, 15 bp, Homo sapiens
cgttcaaaagtggag

SEQ ID NO: 6106568 - DNA, 12 bp, Homo sapiens
cgttcaaattct

SEQ ID NO: 6106569 - DNA, 16 bp, Homo sapiens
cgttcaagaggcgtgt

SEQ ID NO: 6106570 - DNA, 15 bp, Homo sapiens
cgttcaataagcatt

SEQ ID NO: 6106571 - DNA, 15 bp, Homo sapiens
cgttcacctccctgc

SEQ ID NO: 6106572 - DNA, 16 bp, Homo sapiens
cgttcacctccctgct

SEQ ID NO: 6106573 - DNA, 13 bp, Homo sapiens
cgttcaccttctt

SEQ ID NO: 6106574 - DNA, 18 bp, Homo sapiens
cgttcacttccccttcca

SEQ ID NO: 6106575 - DNA, 14 bp, Homo sapiens
cgttcagcccctga

SEQ ID NO: 6106576 - DNA, 13 bp, Homo sapiens
cgttcagcctgtc

SEQ ID NO: 6106577 - DNA, 13 bp, Homo sapiens
cgttcagggaggg

SEQ ID NO: 6106578 - DNA, 15 bp, Homo sapiens
cgttcagggaggggc

SEQ ID NO: 6106579 - DNA, 19 bp, Homo sapiens
cgttcagtgtcccaggcag

SEQ ID NO: 6106580 - DNA, 14 bp, Homo sapiens
cgttcatctgagga

SEQ ID NO: 6106581 - DNA, 21 bp, Homo sapiens
cgttcatgggggagggggcag

SEQ ID NO: 6106582 - DNA, 17 bp, Homo sapiens
cgttcatgttctgtgat

SEQ ID NO: 6106583 - DNA, 12 bp, Homo sapiens
cgttccacagtt

SEQ ID NO: 6106584 - DNA, 14 bp, Homo sapiens
cgttccacagttgc

SEQ ID NO: 6106585 - DNA, 10 bp, Homo sapiens
cgttccagcc

SEQ ID NO: 6106586 - DNA, 15 bp, Homo sapiens
cgttccagctgacat

SEQ ID NO: 6106587 - DNA, 19 bp, Homo sapiens
cgttccaggagcacacggc

SEQ ID NO: 6106588 - DNA, 22 bp, Homo sapiens
cgttccaggagcacacggccct

SEQ ID NO: 6106589 - DNA, 17 bp, Homo sapiens
cgttcccacctctgagg

SEQ ID NO: 6106590 - DNA, 14 bp, Homo sapiens
cgttcccagcaggg

SEQ ID NO: 6106591 - DNA, 21 bp, Homo sapiens
cgttcccagcgcatggcgccc

SEQ ID NO: 6106592 - DNA, 14 bp, Homo sapiens
cgttccccacccct

SEQ ID NO: 6106593 - DNA, 13 bp, Homo sapiens
cgttcccccaggg

SEQ ID NO: 6106594 - DNA, 23 bp, Homo sapiens
cgttcccccaggggtgagccccg

SEQ ID NO: 6106595 - DNA, 14 bp, Homo sapiens
cgttccccttggct

SEQ ID NO: 6106596 - DNA, 16 bp, Homo sapiens
cgttccctgattattt

SEQ ID NO: 6106597 - DNA, 14 bp, Homo sapiens
cgttccctgcgctt

SEQ ID NO: 6106598 - DNA, 13 bp, Homo sapiens
cgttccctgtcag

SEQ ID NO: 6106599 - DNA, 13 bp, Homo sapiens
cgttcccttctcc

SEQ ID NO: 6106600 - DNA, 21 bp, Homo sapiens
cgttcccttgtgtctgttgct

SEQ ID NO: 6106601 - DNA, 19 bp, Homo sapiens
cgttccgtcccaaacagag

SEQ ID NO: 6106602 - DNA, 23 bp, Homo sapiens
cgttcctagagaagacaggctgg

SEQ ID NO: 6106603 - DNA, 17 bp, Homo sapiens
cgttcctattgtcatta

SEQ ID NO: 6106604 - DNA, 16 bp, Homo sapiens
cgttcctcctcagcct

SEQ ID NO: 6106605 - DNA, 22 bp, Homo sapiens
cgttcctgacatcacagcagcc

SEQ ID NO: 6106606 - DNA, 15 bp, Homo sapiens
cgttcgatttctacc

SEQ ID NO: 6106607 - DNA, 20 bp, Homo sapiens
cgttctaggtaggaagagcc

SEQ ID NO: 6106608 - DNA, 22 bp, Homo sapiens
cgttctagtgaaactgcattat

SEQ ID NO: 6106609 - DNA, 18 bp, Homo sapiens
cgttctataaatgaatgt

SEQ ID NO: 6106610 - DNA, 15 bp, Homo sapiens
cgttctcaagaatct

SEQ ID NO: 6106611 - DNA, 15 bp, Homo sapiens
cgttctcacacccac

SEQ ID NO: 6106612 - DNA, 18 bp, Homo sapiens
cgttctcacacccaccgt

SEQ ID NO: 6106613 - DNA, 22 bp, Homo sapiens
cgttctccacccaccagtcagg

SEQ ID NO: 6106614 - DNA, 14 bp, Homo sapiens
cgttctcccagcac

SEQ ID NO: 6106615 - DNA, 19 bp, Homo sapiens
cgttctcccagcactgcct

SEQ ID NO: 6106616 - DNA, 19 bp, Homo sapiens
cgttctctctttgcatgga

SEQ ID NO: 6106617 - DNA, 17 bp, Homo sapiens
cgttctctgtcctactt

SEQ ID NO: 6106618 - DNA, 20 bp, Homo sapiens
cgttctgccacttgcactgt

SEQ ID NO: 6106619 - DNA, 19 bp, Homo sapiens
cgttctgctgcccctgcag

SEQ ID NO: 6106620 - DNA, 17 bp, Homo sapiens
cgttctgctggcctgga

SEQ ID NO: 6106621 - DNA, 17 bp, Homo sapiens
cgttctggactctgccc

SEQ ID NO: 6106622 - DNA, 20 bp, Homo sapiens
cgttctgtactgttactggg

SEQ ID NO: 6106623 - DNA, 12 bp, Homo sapiens
cgttctgttctg

SEQ ID NO: 6106624 - DNA, 20 bp, Homo sapiens
cgttctgtttacatcagttt

SEQ ID NO: 6106625 - DNA, 20 bp, Homo sapiens
cgttcttacaagcttaaagc

SEQ ID NO: 6106626 - DNA, 20 bp, Homo sapiens
cgttcttaggctgctgggat

SEQ ID NO: 6106627 - DNA, 12 bp, Homo sapiens
cgttcttgtaat

SEQ ID NO: 6106628 - DNA, 15 bp, Homo sapiens
cgttcttgtaatttt

SEQ ID NO: 6106629 - DNA, 18 bp, Homo sapiens
cgttcttgtaattttaca

SEQ ID NO: 6106630 - DNA, 19 bp, Homo sapiens
cgttcttgttctgttttgt

SEQ ID NO: 6106631 - DNA, 18 bp, Homo sapiens
cgttgaagaggaagggca

SEQ ID NO: 6106632 - DNA, 18 bp, Homo sapiens
cgttgaagccgctcccgg

SEQ ID NO: 6106633 - DNA, 18 bp, Homo sapiens
cgttgaatctgggaggga

SEQ ID NO: 6106634 - DNA, 19 bp, Homo sapiens
cgttgacaccaagaaacca

SEQ ID NO: 6106635 - DNA, 15 bp, Homo sapiens
cgttgacccaacctt

SEQ ID NO: 6106636 - DNA, 16 bp, Homo sapiens
cgttgacccctttccc

SEQ ID NO: 6106637 - DNA, 19 bp, Homo sapiens
cgttgaggatgaggccgct

SEQ ID NO: 6106638 - DNA, 16 bp, Homo sapiens
cgttgaggccaaggaa

SEQ ID NO: 6106639 - DNA, 17 bp, Homo sapiens
cgttgagggaatgacac

SEQ ID NO: 6106640 - DNA, 19 bp, Homo sapiens
cgttgagtgtacagatttt

SEQ ID NO: 6106641 - DNA, 18 bp, Homo sapiens
cgttgatagtttacaaac

SEQ ID NO: 6106642 - DNA, 15 bp, Homo sapiens
cgttgatctcctggt

SEQ ID NO: 6106643 - DNA, 17 bp, Homo sapiens
cgttgatgttggctggg

SEQ ID NO: 6106644 - DNA, 18 bp, Homo sapiens
cgttgatgttggctggga

SEQ ID NO: 6106645 - DNA, 23 bp, Homo sapiens
cgttgcaaccactgcaatatctt

SEQ ID NO: 6106646 - DNA, 17 bp, Homo sapiens
cgttgcacagctgtttg

SEQ ID NO: 6106647 - DNA, 18 bp, Homo sapiens
cgttgccctaattcatct

SEQ ID NO: 6106648 - DNA, 20 bp, Homo sapiens
cgttgccctaattcatcttt

SEQ ID NO: 6106649 - DNA, 14 bp, Homo sapiens
cgttgccgcagcgg

SEQ ID NO: 6106650 - DNA, 16 bp, Homo sapiens
cgttgccgggcctgga

SEQ ID NO: 6106651 - DNA, 17 bp, Homo sapiens
cgttgccgggcctggac

SEQ ID NO: 6106652 - DNA, 19 bp, Homo sapiens
cgttgccgggcctggactg

SEQ ID NO: 6106653 - DNA, 13 bp, Homo sapiens
cgttgctgagcca

SEQ ID NO: 6106654 - DNA, 19 bp, Homo sapiens
cgttgctgagccagctgca

SEQ ID NO: 6106655 - DNA, 17 bp, Homo sapiens
cgttgcttcccgctgca

SEQ ID NO: 6106656 - DNA, 18 bp, Homo sapiens
cgttggaattaaaacaat

SEQ ID NO: 6106657 - DNA, 21 bp, Homo sapiens
cgttggagagcagcaggtgct

SEQ ID NO: 6106658 - DNA, 22 bp, Homo sapiens
cgttggagagcagcaggtgctg

SEQ ID NO: 6106659 - DNA, 13 bp, Homo sapiens
cgttggagccact

SEQ ID NO: 6106660 - DNA, 19 bp, Homo sapiens
cgttggagtttgggctgga

SEQ ID NO: 6106661 - DNA, 17 bp, Homo sapiens
cgttggcttctccctgg

SEQ ID NO: 6106662 - DNA, 13 bp, Homo sapiens
cgttgggagccta

SEQ ID NO: 6106663 - DNA, 23 bp, Homo sapiens
cgttgggagggggagaaaaggaa

SEQ ID NO: 6106664 - DNA, 14 bp, Homo sapiens
cgttgggtcccttg

SEQ ID NO: 6106665 - DNA, 16 bp, Homo sapiens
cgttggtatgataatg

SEQ ID NO: 6106666 - DNA, 14 bp, Homo sapiens
cgttggtccagagc

SEQ ID NO: 6106667 - DNA, 12 bp, Homo sapiens
cgttggtgcaag

SEQ ID NO: 6106668 - DNA, 14 bp, Homo sapiens
cgttggttgtttct

SEQ ID NO: 6106669 - DNA, 21 bp, Homo sapiens
cgttgtaaaatatagctgtac

SEQ ID NO: 6106670 - DNA, 24 bp, Homo sapiens
cgttgtaaaatatagctgtacaaa

SEQ ID NO: 6106671 - DNA, 16 bp, Homo sapiens
cgttgtcacacccatg

SEQ ID NO: 6106672 - DNA, 20 bp, Homo sapiens
cgttgtcacacccatggcct

SEQ ID NO: 6106673 - DNA, 12 bp, Homo sapiens
cgttgtccctga

SEQ ID NO: 6106674 - DNA, 13 bp, Homo sapiens
cgttgtctccctg

SEQ ID NO: 6106675 - DNA, 17 bp, Homo sapiens
cgttgtctccctggccc

SEQ ID NO: 6106676 - DNA, 15 bp, Homo sapiens
cgttgtctggttgct

SEQ ID NO: 6106677 - DNA, 20 bp, Homo sapiens
cctgctctcttcaggaggcc

SEQ ID NO: 6106678 - DNA, 23 bp, Homo sapiens
cctgctctcttcaggaggccctg

SEQ ID NO: 6106679 - DNA, 16 bp, Homo sapiens
cctgctctgcttttcc

SEQ ID NO: 6106680 - DNA, 14 bp, Homo sapiens
cctgctctggagcc

SEQ ID NO: 6106681 - DNA, 12 bp, Homo sapiens
cctgctctggga

SEQ ID NO: 6106682 - DNA, 15 bp, Homo sapiens
cctgctctgggacgt

SEQ ID NO: 6106683 - DNA, 23 bp, Homo sapiens
cctgctctgggacgtggacatgc

SEQ ID NO: 6106684 - DNA, 19 bp, Homo sapiens
cctgctctggtcccctctc

SEQ ID NO: 6106685 - DNA, 13 bp, Homo sapiens
cctgctctgtagc

SEQ ID NO: 6106686 - DNA, 20 bp, Homo sapiens
cctgctctgtgagccccaca

SEQ ID NO: 6106687 - DNA, 19 bp, Homo sapiens
cctgctcttacttccccca

SEQ ID NO: 6106688 - DNA, 12 bp, Homo sapiens
cctgctcttcca

SEQ ID NO: 6106689 - DNA, 16 bp, Homo sapiens
cctgctcttctctccc

SEQ ID NO: 6106690 - DNA, 18 bp, Homo sapiens
cctgctcttctctcccca

SEQ ID NO: 6106691 - DNA, 21 bp, Homo sapiens
cctgctcttctctccccagcc

SEQ ID NO: 6106692 - DNA, 22 bp, Homo sapiens
cctgctcttctctccccagccc

SEQ ID NO: 6106693 - DNA, 14 bp, Homo sapiens
cctgctctttctct

SEQ ID NO: 6106694 - DNA, 16 bp, Homo sapiens
cctgctctttctctga

SEQ ID NO: 6106695 - DNA, 17 bp, Homo sapiens
cctgctctttctctgag

SEQ ID NO: 6106696 - DNA, 15 bp, Homo sapiens
cctgctctttggcct

SEQ ID NO: 6106697 - DNA, 19 bp, Homo sapiens
cctgctgaacacagtgtct

SEQ ID NO: 6106698 - DNA, 20 bp, Homo sapiens
cctgctgaacacagtgtctg

SEQ ID NO: 6106699 - DNA, 23 bp, Homo sapiens
cctgctgaatgatttccaaagag

SEQ ID NO: 6106700 - DNA, 23 bp, Homo sapiens
cctgctgaatgcctcgctccctt

SEQ ID NO: 6106701 - DNA, 13 bp, Homo sapiens
cctgctgacagac

SEQ ID NO: 6106702 - DNA, 19 bp, Homo sapiens
cctgctgacctcactgtcc

SEQ ID NO: 6106703 - DNA, 20 bp, Homo sapiens
cctgctgacctcactgtcct

SEQ ID NO: 6106704 - DNA, 21 bp, Homo sapiens
cctgctgacctcactgtcctg

SEQ ID NO: 6106705 - DNA, 18 bp, Homo sapiens
cctgctgacctgtgcaca

SEQ ID NO: 6106706 - DNA, 23 bp, Homo sapiens
cctgctgagaatccccgtgctca

SEQ ID NO: 6106707 - DNA, 17 bp, Homo sapiens
cctgctgagagacccaa

SEQ ID NO: 6106708 - DNA, 20 bp, Homo sapiens
cctgctgagagcccccacct

SEQ ID NO: 6106709 - DNA, 23 bp, Homo sapiens
cctgctgagatgaggaggggagc

SEQ ID NO: 6106710 - DNA, 13 bp, Homo sapiens
cctgctgagctct

SEQ ID NO: 6106711 - DNA, 19 bp, Homo sapiens
cctgctgagctctgagagg

SEQ ID NO: 6106712 - DNA, 22 bp, Homo sapiens
cctgctgagctgcccctgctgc

SEQ ID NO: 6106713 - DNA, 14 bp, Homo sapiens
cctgctgaggcctt

SEQ ID NO: 6106714 - DNA, 16 bp, Homo sapiens
cctgctgaggccttct

SEQ ID NO: 6106715 - DNA, 17 bp, Homo sapiens
cctgctgagggaccagc

SEQ ID NO: 6106716 - DNA, 21 bp, Homo sapiens
cctgctgatgtggcaactgct

SEQ ID NO: 6106717 - DNA, 17 bp, Homo sapiens
cctgctgattgattttt

SEQ ID NO: 6106718 - DNA, 14 bp, Homo sapiens
cctgctgcacaggc

SEQ ID NO: 6106719 - DNA, 12 bp, Homo sapiens
cctgctgcacca

SEQ ID NO: 6106720 - DNA, 17 bp, Homo sapiens
cctgctgcaccaaccca

SEQ ID NO: 6106721 - DNA, 18 bp, Homo sapiens
cctgctgcaccaacccag

SEQ ID NO: 6106722 - DNA, 14 bp, Homo sapiens
cctgctgcaccctg

SEQ ID NO: 6106723 - DNA, 20 bp, Homo sapiens
cctgctgcaccctgcgcctc

SEQ ID NO: 6106724 - DNA, 22 bp, Homo sapiens
cctgctgcagaggggcaggccc

SEQ ID NO: 6106725 - DNA, 23 bp, Homo sapiens
cctgctgcagaggggcaggccct

SEQ ID NO: 6106726 - DNA, 13 bp, Homo sapiens
cctgctgcagggg

SEQ ID NO: 6106727 - DNA, 14 bp, Homo sapiens
cctgctgcaggggc

SEQ ID NO: 6106728 - DNA, 15 bp, Homo sapiens
cctgctgcaggggct

SEQ ID NO: 6106729 - DNA, 17 bp, Homo sapiens
cctgctgcaggggctct

SEQ ID NO: 6106730 - DNA, 20 bp, Homo sapiens
cctgctgcagttgccagtca

SEQ ID NO: 6106731 - DNA, 16 bp, Homo sapiens
cctgctgcatgccctc

SEQ ID NO: 6106732 - DNA, 14 bp, Homo sapiens
cctgctgccacagc

SEQ ID NO: 6106733 - DNA, 18 bp, Homo sapiens
cctgctgccagagaacca

SEQ ID NO: 6106734 - DNA, 12 bp, Homo sapiens
cctgctgccagg

SEQ ID NO: 6106735 - DNA, 19 bp, Homo sapiens
cctgctgccagtaccagcc

SEQ ID NO: 6106736 - DNA, 14 bp, Homo sapiens
cctgctgccagtgc

SEQ ID NO: 6106737 - DNA, 16 bp, Homo sapiens
cctgctgccagtgcag

SEQ ID NO: 6106738 - DNA, 19 bp, Homo sapiens
cctgctgccagtgcagcca

SEQ ID NO: 6106739 - DNA, 15 bp, Homo sapiens
cctgctgcccaggct

SEQ ID NO: 6106740 - DNA, 13 bp, Homo sapiens
cctgctgccccag

SEQ ID NO: 6106741 - DNA, 20 bp, Homo sapiens
cctgctgcccctccctgcct

SEQ ID NO: 6106742 - DNA, 17 bp, Homo sapiens
cctgctgcccgtgagga

SEQ ID NO: 6106743 - DNA, 18 bp, Homo sapiens
cctgctgcccgtgaggag

SEQ ID NO: 6106744 - DNA, 14 bp, Homo sapiens
cctgctgccctccc

SEQ ID NO: 6106745 - DNA, 18 bp, Homo sapiens
cctgctgccctcccacag

SEQ ID NO: 6106746 - DNA, 16 bp, Homo sapiens
cctgctgccgccactg

SEQ ID NO: 6106747 - DNA, 14 bp, Homo sapiens
cctgctgccgcctc

SEQ ID NO: 6106748 - DNA, 21 bp, Homo sapiens
cctgctgccgcctcccagcct

SEQ ID NO: 6106749 - DNA, 23 bp, Homo sapiens
cctgctgccgcctcccagcctgg

SEQ ID NO: 6106750 - DNA, 17 bp, Homo sapiens
cctgctgcctccccaac

SEQ ID NO: 6106751 - DNA, 20 bp, Homo sapiens
cctgctgcctccccaaccct

SEQ ID NO: 6106752 - DNA, 21 bp, Homo sapiens
cctgctgcctgccggccgccc

SEQ ID NO: 6106753 - DNA, 14 bp, Homo sapiens
cctgctgcctgctg

SEQ ID NO: 6106754 - DNA, 15 bp, Homo sapiens
cctgctgcctggagt

SEQ ID NO: 6106755 - DNA, 16 bp, Homo sapiens
cctgctgcctggagtc

SEQ ID NO: 6106756 - DNA, 15 bp, Homo sapiens
cctgctgccttttct

SEQ ID NO: 6106757 - DNA, 17 bp, Homo sapiens
cctgctgccttttctgg

SEQ ID NO: 6106758 - DNA, 19 bp, Homo sapiens
cctgctgcgccccaggccc

SEQ ID NO: 6106759 - DNA, 15 bp, Homo sapiens
cctgctgcgctgctt

SEQ ID NO: 6106760 - DNA, 17 bp, Homo sapiens
cctgctgcggaggagct

SEQ ID NO: 6106761 - DNA, 14 bp, Homo sapiens
cctgctgcggcaga

SEQ ID NO: 6106762 - DNA, 18 bp, Homo sapiens
cctgctgcgtcagaccag

SEQ ID NO: 6106763 - DNA, 14 bp, Homo sapiens
cctgctgcgtcccc

SEQ ID NO: 6106764 - DNA, 18 bp, Homo sapiens
cctgctgcgtccccactc

SEQ ID NO: 6106765 - DNA, 18 bp, Homo sapiens
cctgctgctcactcccgc

SEQ ID NO: 6106766 - DNA, 15 bp, Homo sapiens
cctgctgctccatgg

SEQ ID NO: 6106767 - DNA, 15 bp, Homo sapiens
cctgctgctccctca

SEQ ID NO: 6106768 - DNA, 17 bp, Homo sapiens
cctgctgctccctcaga

SEQ ID NO: 6106769 - DNA, 16 bp, Homo sapiens
cctgctgctcctagga

SEQ ID NO: 6106770 - DNA, 16 bp, Homo sapiens
cctgctgctcctcggc

SEQ ID NO: 6106771 - DNA, 17 bp, Homo sapiens
cctgctgctctctaaga

SEQ ID NO: 6106772 - DNA, 18 bp, Homo sapiens
cctgctgctgacccagcc

SEQ ID NO: 6106773 - DNA, 16 bp, Homo sapiens
cctgctgctgagaacc

SEQ ID NO: 6106774 - DNA, 19 bp, Homo sapiens
cctgctgctgagaacctgg

SEQ ID NO: 6106775 - DNA, 21 bp, Homo sapiens
cctgctgctgagaacctggcc

SEQ ID NO: 6106776 - DNA, 23 bp, Homo sapiens
cctgctgctgagaacctggcctt

SEQ ID NO: 6106777 - DNA, 20 bp, Homo sapiens
cctgctgctgccagggcttc

SEQ ID NO: 6106778 - DNA, 15 bp, Homo sapiens
cctgctgctgcctgc

SEQ ID NO: 6106779 - DNA, 17 bp, Homo sapiens
cctgctgctgcctgcct

SEQ ID NO: 6106780 - DNA, 15 bp, Homo sapiens
cctgctgctgctgcc

SEQ ID NO: 6106781 - DNA, 15 bp, Homo sapiens
cctgctgctggtgca

SEQ ID NO: 6106782 - DNA, 12 bp, Homo sapiens
cctgctgctgta

SEQ ID NO: 6106783 - DNA, 17 bp, Homo sapiens
cctgctgctgtctgggt

SEQ ID NO: 6106784 - DNA, 20 bp, Homo sapiens
cctgctgctgtgtttttgct

SEQ ID NO: 6106785 - DNA, 20 bp, Homo sapiens
cctgctgcttaagtgcatgc

SEQ ID NO: 6106786 - DNA, 14 bp, Homo sapiens
cctgctgcttccta

SEQ ID NO: 6106787 - DNA, 12 bp, Homo sapiens
cctgctgcttct

SEQ ID NO: 6106788 - DNA, 16 bp, Homo sapiens
cctgctgcttctccaa

SEQ ID NO: 6106789 - DNA, 23 bp, Homo sapiens
cctgctgcttggagtgccccaag

SEQ ID NO: 6106790 - DNA, 14 bp, Homo sapiens
cctgctgcttggga

SEQ ID NO: 6106791 - DNA, 13 bp, Homo sapiens
cctgctggaagcc

SEQ ID NO: 6106792 - DNA, 16 bp, Homo sapiens
cctgctggaagcccag

SEQ ID NO: 6106793 - DNA, 12 bp, Homo sapiens
cctgctggacag

SEQ ID NO: 6106794 - DNA, 13 bp, Homo sapiens
cctgctggacagc

SEQ ID NO: 6106795 - DNA, 15 bp, Homo sapiens
cctgctggacagcct

SEQ ID NO: 6106796 - DNA, 16 bp, Homo sapiens
cctgctggacagcctc

SEQ ID NO: 6106797 - DNA, 18 bp, Homo sapiens
cctgctggagaaaccttc

SEQ ID NO: 6106798 - DNA, 13 bp, Homo sapiens
cctgctggaggcc

SEQ ID NO: 6106799 - DNA, 14 bp, Homo sapiens
cctgctggaggcct

SEQ ID NO: 6106800 - DNA, 16 bp, Homo sapiens
cctgctggaggcctca

SEQ ID NO: 6106801 - DNA, 17 bp, Homo sapiens
cctgctggaggcctcag

SEQ ID NO: 6106802 - DNA, 22 bp, Homo sapiens
cctgctggatctcccagggcta

SEQ ID NO: 6106803 - DNA, 15 bp, Homo sapiens
cctgctggcacccac

SEQ ID NO: 6106804 - DNA, 13 bp, Homo sapiens
cctgctggcaggg

SEQ ID NO: 6106805 - DNA, 18 bp, Homo sapiens
cctgctggcagggccagg

SEQ ID NO: 6106806 - DNA, 18 bp, Homo sapiens
cctgctggcatcaggtct

SEQ ID NO: 6106807 - DNA, 12 bp, Homo sapiens
cctgctggccaa

SEQ ID NO: 6106808 - DNA, 17 bp, Homo sapiens
cctgctggccaaagtca

SEQ ID NO: 6106809 - DNA, 13 bp, Homo sapiens
cctgctggcccct

SEQ ID NO: 6106810 - DNA, 18 bp, Homo sapiens
cctgctggcccctcacct

SEQ ID NO: 6106811 - DNA, 14 bp, Homo sapiens
cctgctggccgcct

SEQ ID NO: 6106812 - DNA, 17 bp, Homo sapiens
cctgctggccgcctcac

SEQ ID NO: 6106813 - DNA, 15 bp, Homo sapiens
cctgctggcctgctc

SEQ ID NO: 6106814 - DNA, 13 bp, Homo sapiens
cctgctggctgag

SEQ ID NO: 6106815 - DNA, 12 bp, Homo sapiens
cctgctggctgg

SEQ ID NO: 6106816 - DNA, 23 bp, Homo sapiens
cctgctggcttccagcttcaggc

SEQ ID NO: 6106817 - DNA, 19 bp, Homo sapiens
cctgctgggaaccccgcag

SEQ ID NO: 6106818 - DNA, 22 bp, Homo sapiens
cctgctgggaaccccgcagccc

SEQ ID NO: 6106819 - DNA, 12 bp, Homo sapiens
cctgctgggccc

SEQ ID NO: 6106820 - DNA, 12 bp, Homo sapiens
cctgctgggctc

SEQ ID NO: 6106821 - DNA, 14 bp, Homo sapiens
cctgctgggctccc

SEQ ID NO: 6106822 - DNA, 16 bp, Homo sapiens
cctgctgggctctcca

SEQ ID NO: 6106823 - DNA, 14 bp, Homo sapiens
cctgctgggctctt

SEQ ID NO: 6106824 - DNA, 19 bp, Homo sapiens
cctgctggggaagaacagc

SEQ ID NO: 6106825 - DNA, 22 bp, Homo sapiens
cctgctggggaagaacagcccc

SEQ ID NO: 6106826 - DNA, 23 bp, Homo sapiens
cctgctggggatccccgcctggc

SEQ ID NO: 6106827 - DNA, 20 bp, Homo sapiens
cctgctggggccgccacggc

SEQ ID NO: 6106828 - DNA, 12 bp, Homo sapiens
cctgctggggct

SEQ ID NO: 6106829 - DNA, 23 bp, Homo sapiens
cctgctggggctgaacatgcctg

SEQ ID NO: 6106830 - DNA, 21 bp, Homo sapiens
cctgctggggcttaggaacct

SEQ ID NO: 6106831 - DNA, 17 bp, Homo sapiens
cctgctggggtctcagg

SEQ ID NO: 6106832 - DNA, 18 bp, Homo sapiens
cctgctggggtctcaggt

SEQ ID NO: 6106833 - DNA, 15 bp, Homo sapiens
cctgctgggtaaact

SEQ ID NO: 6106834 - DNA, 17 bp, Homo sapiens
cctgctgggtaaactgt

SEQ ID NO: 6106835 - DNA, 14 bp, Homo sapiens
cctgctgggtgtgg

SEQ ID NO: 6106836 - DNA, 20 bp, Homo sapiens
cctgctgggtgtggcgcagc

SEQ ID NO: 6106837 - DNA, 17 bp, Homo sapiens
cctgctggtcacagcct

SEQ ID NO: 6106838 - DNA, 22 bp, Homo sapiens
cctgctggtgaccggcctggac

SEQ ID NO: 6106839 - DNA, 12 bp, Homo sapiens
cctgctggtgcc

SEQ ID NO: 6106840 - DNA, 23 bp, Homo sapiens
cctgctggtgcccacccttcgca

SEQ ID NO: 6106841 - DNA, 16 bp, Homo sapiens
cctgctggtggggcag

SEQ ID NO: 6106842 - DNA, 19 bp, Homo sapiens
cctgctggttcagggttgg

SEQ ID NO: 6106843 - DNA, 23 bp, Homo sapiens
cctgctggttgttgccaggttgc

SEQ ID NO: 6106844 - DNA, 17 bp, Homo sapiens
cctgctgtaataaatgt

SEQ ID NO: 6106845 - DNA, 20 bp, Homo sapiens
cctgctgtatcttccagaac

SEQ ID NO: 6106846 - DNA, 13 bp, Homo sapiens
cctgctgtatttc

SEQ ID NO: 6106847 - DNA, 17 bp, Homo sapiens
cctgctgtatttcctgc

SEQ ID NO: 6106848 - DNA, 22 bp, Homo sapiens
cctgctgtatttcctgcttccc

SEQ ID NO: 6106849 - DNA, 22 bp, Homo sapiens
cctgctgtcacctcgctgggct

SEQ ID NO: 6106850 - DNA, 21 bp, Homo sapiens
cctgctgtcagaccttcttcc

SEQ ID NO: 6106851 - DNA, 17 bp, Homo sapiens
cctgctgtcagcctggc

SEQ ID NO: 6106852 - DNA, 19 bp, Homo sapiens
cctgctgtcccctcttgcc

SEQ ID NO: 6106853 - DNA, 22 bp, Homo sapiens
cctgctgtcccctcttgcccca

SEQ ID NO: 6106854 - DNA, 17 bp, Homo sapiens
cctgctgtccgtcccgc

SEQ ID NO: 6106855 - DNA, 14 bp, Homo sapiens
cctgctgtcctggt

SEQ ID NO: 6106856 - DNA, 17 bp, Homo sapiens
cctgctgtcctggtggc

SEQ ID NO: 6106857 - DNA, 11 bp, Homo sapiens
cgttgtgaggg

SEQ ID NO: 6106858 - DNA, 12 bp, Homo sapiens
cgttgtgcctgg

SEQ ID NO: 6106859 - DNA, 13 bp, Homo sapiens
cgttgtgggcagg

SEQ ID NO: 6106860 - DNA, 18 bp, Homo sapiens
cgttgtgtatattacacc

SEQ ID NO: 6106861 - DNA, 22 bp, Homo sapiens
cgttgttcatagaatcgttgga

SEQ ID NO: 6106862 - DNA, 20 bp, Homo sapiens
cgttgttgcatgtttgaaat

SEQ ID NO: 6106863 - DNA, 13 bp, Homo sapiens
cgttgttgtcatt

SEQ ID NO: 6106864 - DNA, 17 bp, Homo sapiens
cgttgttgtccctgcag

SEQ ID NO: 6106865 - DNA, 14 bp, Homo sapiens
cgttgttttgtgga

SEQ ID NO: 6106866 - DNA, 15 bp, Homo sapiens
cgttgttttgtggat

SEQ ID NO: 6106867 - DNA, 13 bp, Homo sapiens
cgtttaaagttct

SEQ ID NO: 6106868 - DNA, 15 bp, Homo sapiens
cgtttaaagttctgt

SEQ ID NO: 6106869 - DNA, 19 bp, Homo sapiens
cgtttaaagttctgtgtat

SEQ ID NO: 6106870 - DNA, 22 bp, Homo sapiens
cgtttaagactgtaatgaatct

SEQ ID NO: 6106871 - DNA, 18 bp, Homo sapiens
cgtttaatgaatgcttaa

SEQ ID NO: 6106872 - DNA, 13 bp, Homo sapiens
cgtttaatgttta

SEQ ID NO: 6106873 - DNA, 16 bp, Homo sapiens
cgtttaatgtttatac

SEQ ID NO: 6106874 - DNA, 17 bp, Homo sapiens
cgtttaatgtttataca

SEQ ID NO: 6106875 - DNA, 16 bp, Homo sapiens
cgtttacactgcacat

SEQ ID NO: 6106876 - DNA, 11 bp, Homo sapiens
cgtttacagtg

SEQ ID NO: 6106877 - DNA, 13 bp, Homo sapiens
cgtttacatattt

SEQ ID NO: 6106878 - DNA, 16 bp, Homo sapiens
cgtttacattttagac

SEQ ID NO: 6106879 - DNA, 23 bp, Homo sapiens
cgtttagaaaaaacaatttttga

SEQ ID NO: 6106880 - DNA, 18 bp, Homo sapiens
cgtttataaacagaaatg

SEQ ID NO: 6106881 - DNA, 16 bp, Homo sapiens
cgtttataattggctt

SEQ ID NO: 6106882 - DNA, 20 bp, Homo sapiens
cgtttatagcttcaggacct

SEQ ID NO: 6106883 - DNA, 21 bp, Homo sapiens
cgtttattaggaaaagatatt

SEQ ID NO: 6106884 - DNA, 18 bp, Homo sapiens
cgtttattgcttaatccc

SEQ ID NO: 6106885 - DNA, 15 bp, Homo sapiens
cgtttattttcaaga

SEQ ID NO: 6106886 - DNA, 15 bp, Homo sapiens
cgtttcacatctgta

SEQ ID NO: 6106887 - DNA, 23 bp, Homo sapiens
cgtttcaggaacgttgccacacc

SEQ ID NO: 6106888 - DNA, 17 bp, Homo sapiens
cgtttcagtaataaaac

SEQ ID NO: 6106889 - DNA, 18 bp, Homo sapiens
cgtttcagtaataaaaca

SEQ ID NO: 6106890 - DNA, 22 bp, Homo sapiens
cgtttcagtgtcaaataaacac

SEQ ID NO: 6106891 - DNA, 13 bp, Homo sapiens
cgtttcatcaggc

SEQ ID NO: 6106892 - DNA, 14 bp, Homo sapiens
cgtttcatgtgttt

SEQ ID NO: 6106893 - DNA, 10 bp, Homo sapiens
cgtttccaag

SEQ ID NO: 6106894 - DNA, 20 bp, Homo sapiens
cgtttccaggtgtttatagt

SEQ ID NO: 6106895 - DNA, 18 bp, Homo sapiens
cgtttccatcatgtctgt

SEQ ID NO: 6106896 - DNA, 13 bp, Homo sapiens
cgtttcccctcct

SEQ ID NO: 6106897 - DNA, 17 bp, Homo sapiens
cgtttcccggttcagga

SEQ ID NO: 6106898 - DNA, 15 bp, Homo sapiens
cgtttccctgaactt

SEQ ID NO: 6106899 - DNA, 15 bp, Homo sapiens
cgtttcctactgcgc

SEQ ID NO: 6106900 - DNA, 19 bp, Homo sapiens
cgtttctaaaggctacctt

SEQ ID NO: 6106901 - DNA, 22 bp, Homo sapiens
cgtttctccacctagactgtaa

SEQ ID NO: 6106902 - DNA, 20 bp, Homo sapiens
cgtttctgcccagccctctg

SEQ ID NO: 6106903 - DNA, 11 bp, Homo sapiens
cgtttctggaa

SEQ ID NO: 6106904 - DNA, 11 bp, Homo sapiens
cgtttctggcc

SEQ ID NO: 6106905 - DNA, 22 bp, Homo sapiens
cgtttctggggcaactgagagc

SEQ ID NO: 6106906 - DNA, 15 bp, Homo sapiens
cgtttctgtggagta

SEQ ID NO: 6106907 - DNA, 20 bp, Homo sapiens
cgtttctgtgtagaaactgg

SEQ ID NO: 6106908 - DNA, 12 bp, Homo sapiens
cgtttcttccct

SEQ ID NO: 6106909 - DNA, 21 bp, Homo sapiens
cgtttctttaaccttgtataa

SEQ ID NO: 6106910 - DNA, 21 bp, Homo sapiens
cgtttgagaagaaaacatcta

SEQ ID NO: 6106911 - DNA, 18 bp, Homo sapiens
cgtttgagtgtctgcgcc

SEQ ID NO: 6106912 - DNA, 16 bp, Homo sapiens
cgtttgcaccgcctgc

SEQ ID NO: 6106913 - DNA, 18 bp, Homo sapiens
cgtttgctgtgccaggag

SEQ ID NO: 6106914 - DNA, 17 bp, Homo sapiens
cgtttgcttaatgccag

SEQ ID NO: 6106915 - DNA, 17 bp, Homo sapiens
cgtttggaagatcctgt

SEQ ID NO: 6106916 - DNA, 19 bp, Homo sapiens
cgtttggaagatcctgtga

SEQ ID NO: 6106917 - DNA, 12 bp, Homo sapiens
cgtttggagaag

SEQ ID NO: 6106918 - DNA, 18 bp, Homo sapiens
cgtttggagaaggtctgt

SEQ ID NO: 6106919 - DNA, 20 bp, Homo sapiens
cgtttggaggcccctgggct

SEQ ID NO: 6106920 - DNA, 18 bp, Homo sapiens
cgtttggggccctctatg

SEQ ID NO: 6106921 - DNA, 16 bp, Homo sapiens
cgtttgtgcatatctg

SEQ ID NO: 6106922 - DNA, 23 bp, Homo sapiens
cgtttgtgcatatctgcctcccc

SEQ ID NO: 6106923 - DNA, 14 bp, Homo sapiens
cgtttgtgtttcta

SEQ ID NO: 6106924 - DNA, 9 bp, Homo sapiens
cgtttgttt

SEQ ID NO: 6106925 - DNA, 13 bp, Homo sapiens
cgtttgtttgttt

SEQ ID NO: 6106926 - DNA, 13 bp, Homo sapiens
cgttttaaggact

SEQ ID NO: 6106927 - DNA, 17 bp, Homo sapiens
cgttttatgtgaatgtg

SEQ ID NO: 6106928 - DNA, 12 bp, Homo sapiens
cgttttattgtg

SEQ ID NO: 6106929 - DNA, 17 bp, Homo sapiens
cgttttcatcctggcct

SEQ ID NO: 6106930 - DNA, 14 bp, Homo sapiens
cgttttccaaagag

SEQ ID NO: 6106931 - DNA, 22 bp, Homo sapiens
cgttttcctcatcctttccctc

SEQ ID NO: 6106932 - DNA, 15 bp, Homo sapiens
cgttttctaattgct

SEQ ID NO: 6106933 - DNA, 20 bp, Homo sapiens
cgttttctactttgaaatat

SEQ ID NO: 6106934 - DNA, 20 bp, Homo sapiens
cgttttctccgggtcctcct

SEQ ID NO: 6106935 - DNA, 22 bp, Homo sapiens
cgttttctcttccttgtgattg

SEQ ID NO: 6106936 - DNA, 18 bp, Homo sapiens
cgttttcttctttccctg

SEQ ID NO: 6106937 - DNA, 19 bp, Homo sapiens
cgttttctttgctgtgcca

SEQ ID NO: 6106938 - DNA, 20 bp, Homo sapiens
cgttttctttgctgtgccaa

SEQ ID NO: 6106939 - DNA, 13 bp, Homo sapiens
cgttttgaaactc

SEQ ID NO: 6106940 - DNA, 17 bp, Homo sapiens
cgttttgcctcatgaac

SEQ ID NO: 6106941 - DNA, 18 bp, Homo sapiens
cgttttggaagtgatgta

SEQ ID NO: 6106942 - DNA, 20 bp, Homo sapiens
cgttttggtgttgcttttca

SEQ ID NO: 6106943 - DNA, 14 bp, Homo sapiens
cgttttgtattgct

SEQ ID NO: 6106944 - DNA, 13 bp, Homo sapiens
cgttttgtctgtg

SEQ ID NO: 6106945 - DNA, 22 bp, Homo sapiens
cgttttgtctgtgttgctgttt

SEQ ID NO: 6106946 - DNA, 16 bp, Homo sapiens
cgttttgttttgtgcc

SEQ ID NO: 6106947 - DNA, 15 bp, Homo sapiens
cgtttttatattact

SEQ ID NO: 6106948 - DNA, 21 bp, Homo sapiens
cgtttttcaagaaaactggaa

SEQ ID NO: 6106949 - DNA, 15 bp, Homo sapiens
cgtttttgtgctgtg

SEQ ID NO: 6106950 - DNA, 20 bp, Homo sapiens
cgttttttacacgagatttc

SEQ ID NO: 6106951 - DNA, 16 bp, Homo sapiens
cgttttttcctcagtg

SEQ ID NO: 6106952 - DNA, 15 bp, Homo sapiens
cgtttttttggtcac

SEQ ID NO: 6106953 - DNA, 20 bp, Homo sapiens
ctaaaaaaaaaaaagtatta

SEQ ID NO: 6106954 - DNA, 14 bp, Homo sapiens
ctaaaaaaaaaaac

SEQ ID NO: 6106955 - DNA, 17 bp, Homo sapiens
ctaaaaaaaaaaactgt

SEQ ID NO: 6106956 - DNA, 17 bp, Homo sapiens
ctaaaaaaaaaaaggcc

SEQ ID NO: 6106957 - DNA, 19 bp, Homo sapiens
ctaaaaaaaaaaaggccgc

SEQ ID NO: 6106958 - DNA, 15 bp, Homo sapiens
ctaaaaaaaagatga

SEQ ID NO: 6106959 - DNA, 16 bp, Homo sapiens
ctaaaaaaagtgcatg

SEQ ID NO: 6106960 - DNA, 13 bp, Homo sapiens
ctaaaaaaatgtt

SEQ ID NO: 6106961 - DNA, 17 bp, Homo sapiens
ctaaaaaaatttttgac

SEQ ID NO: 6106962 - DNA, 11 bp, Homo sapiens
ctaaaaaacag

SEQ ID NO: 6106963 - DNA, 22 bp, Homo sapiens
ctaaaaaacataaatttcttta

SEQ ID NO: 6106964 - DNA, 15 bp, Homo sapiens
ctaaaaaacattttt

SEQ ID NO: 6106965 - DNA, 11 bp, Homo sapiens
ctaaaaaagat

SEQ ID NO: 6106966 - DNA, 19 bp, Homo sapiens
ctaaaaaagatatattaaa

SEQ ID NO: 6106967 - DNA, 11 bp, Homo sapiens
ctaaaaacata

SEQ ID NO: 6106968 - DNA, 20 bp, Homo sapiens
ctaaaaacatttactgacca

SEQ ID NO: 6106969 - DNA, 13 bp, Homo sapiens
ctaaaaacatttg

SEQ ID NO: 6106970 - DNA, 15 bp, Homo sapiens
ctaaaaacattttaa

SEQ ID NO: 6106971 - DNA, 17 bp, Homo sapiens
ctaaaaacattttaaaa

SEQ ID NO: 6106972 - DNA, 23 bp, Homo sapiens
ctaaaaacattttaaaatcaact

SEQ ID NO: 6106973 - DNA, 17 bp, Homo sapiens
ctaaaaaggtcctgtaa

SEQ ID NO: 6106974 - DNA, 15 bp, Homo sapiens
ctaaaaagtataaaa

SEQ ID NO: 6106975 - DNA, 17 bp, Homo sapiens
ctaaaaagttgaaccat

SEQ ID NO: 6106976 - DNA, 13 bp, Homo sapiens
ctaaaaataaagc

SEQ ID NO: 6106977 - DNA, 14 bp, Homo sapiens
ctaaaaataaagca

SEQ ID NO: 6106978 - DNA, 15 bp, Homo sapiens
ctaaaaataaattaa

SEQ ID NO: 6106979 - DNA, 11 bp, Homo sapiens
ctaaaaataat

SEQ ID NO: 6106980 - DNA, 23 bp, Homo sapiens
ctaaaaatacaaaattagctggg

SEQ ID NO: 6106981 - DNA, 13 bp, Homo sapiens
ctaaaaatacacc

SEQ ID NO: 6106982 - DNA, 22 bp, Homo sapiens
ctaaaaatacaccgtttagaaa

SEQ ID NO: 6106983 - DNA, 18 bp, Homo sapiens
ctaaaaatagtggccaga

SEQ ID NO: 6106984 - DNA, 21 bp, Homo sapiens
ctaaaaatatacatgtttatg

SEQ ID NO: 6106985 - DNA, 20 bp, Homo sapiens
ctaaaaatatagcaaatgca

SEQ ID NO: 6106986 - DNA, 12 bp, Homo sapiens
ctaaaaatatat

SEQ ID NO: 6106987 - DNA, 20 bp, Homo sapiens
ctaaaaatattcctccaaat

SEQ ID NO: 6106988 - DNA, 14 bp, Homo sapiens
ctaaaaatattgtt

SEQ ID NO: 6106989 - DNA, 15 bp, Homo sapiens
ctaaaaatcaatcac

SEQ ID NO: 6106990 - DNA, 12 bp, Homo sapiens
ctaaaaatgaac

SEQ ID NO: 6106991 - DNA, 13 bp, Homo sapiens
ctaaaaatgcaac

SEQ ID NO: 6106992 - DNA, 19 bp, Homo sapiens
ctaaaaatttacaagagaa

SEQ ID NO: 6106993 - DNA, 18 bp, Homo sapiens
ctaaaaattttgcatttc

SEQ ID NO: 6106994 - DNA, 18 bp, Homo sapiens
ctaaaaatttttacaaaa

SEQ ID NO: 6106995 - DNA, 16 bp, Homo sapiens
ctaaaacaataaagat

SEQ ID NO: 6106996 - DNA, 21 bp, Homo sapiens
ctaaaacacaacaagaaactg

SEQ ID NO: 6106997 - DNA, 21 bp, Homo sapiens
ctaaaacacctcagctgcctc

SEQ ID NO: 6106998 - DNA, 18 bp, Homo sapiens
ctaaaacactattctcca

SEQ ID NO: 6106999 - DNA, 23 bp, Homo sapiens
ctaaaacatagactgaagattta

SEQ ID NO: 6107000 - DNA, 17 bp, Homo sapiens
ctaaaaccattccattt

SEQ ID NO: 6107001 - DNA, 15 bp, Homo sapiens
ctaaaacctgagcta

SEQ ID NO: 6107002 - DNA, 16 bp, Homo sapiens
ctaaaactaaatagca

SEQ ID NO: 6107003 - DNA, 15 bp, Homo sapiens
ctaaaactactgcct

SEQ ID NO: 6107004 - DNA, 13 bp, Homo sapiens
ctaaaactatggt

SEQ ID NO: 6107005 - DNA, 13 bp, Homo sapiens
ctaaaactctgcc

SEQ ID NO: 6107006 - DNA, 20 bp, Homo sapiens
ctaaaactgtactttgattc

SEQ ID NO: 6107007 - DNA, 22 bp, Homo sapiens
ctaaaactgtactttgattcac

SEQ ID NO: 6107008 - DNA, 19 bp, Homo sapiens
ctaaaacttggatggactt

SEQ ID NO: 6107009 - DNA, 14 bp, Homo sapiens
ctaaaagaaacttt

SEQ ID NO: 6107010 - DNA, 12 bp, Homo sapiens
ctaaaagaagag

SEQ ID NO: 6107011 - DNA, 13 bp, Homo sapiens
ctaaaagaagaga

SEQ ID NO: 6107012 - DNA, 15 bp, Homo sapiens
ctaaaagaagagagg

SEQ ID NO: 6107013 - DNA, 15 bp, Homo sapiens
ctaaaagaagcatct

SEQ ID NO: 6107014 - DNA, 21 bp, Homo sapiens
ctaaaagaagcatctctgacc

SEQ ID NO: 6107015 - DNA, 22 bp, Homo sapiens
ctaaaagaagcatctctgacca

SEQ ID NO: 6107016 - DNA, 16 bp, Homo sapiens
ctaaaagaatttaaat

SEQ ID NO: 6107017 - DNA, 22 bp, Homo sapiens
ctaaaagacttccctaacactt

SEQ ID NO: 6107018 - DNA, 14 bp, Homo sapiens
ctaaaagagaaggg

SEQ ID NO: 6107019 - DNA, 18 bp, Homo sapiens
ctaaaagagatttcaaga

SEQ ID NO: 6107020 - DNA, 20 bp, Homo sapiens
ctaaaagatcctttttaaat

SEQ ID NO: 6107021 - DNA, 23 bp, Homo sapiens
ctaaaagattttgtgaaatttca

SEQ ID NO: 6107022 - DNA, 20 bp, Homo sapiens
ctaaaagcaaaataaaaact

SEQ ID NO: 6107023 - DNA, 15 bp, Homo sapiens
ctaaaagcatgtata

SEQ ID NO: 6107024 - DNA, 13 bp, Homo sapiens
ctaaaaggaaaag

SEQ ID NO: 6107025 - DNA, 19 bp, Homo sapiens
ctaaaaggaaagaaaataa

SEQ ID NO: 6107026 - DNA, 12 bp, Homo sapiens
ctaaaaggagga

SEQ ID NO: 6107027 - DNA, 16 bp, Homo sapiens
ctaaaaggaggacagg

SEQ ID NO: 6107028 - DNA, 14 bp, Homo sapiens
ctaaaaggcccaga

SEQ ID NO: 6107029 - DNA, 18 bp, Homo sapiens
ctaaaaggcccagagaga

SEQ ID NO: 6107030 - DNA, 23 bp, Homo sapiens
ctaaaaggtatgcaatcaaatct

SEQ ID NO: 6107031 - DNA, 21 bp, Homo sapiens
ctaaaaggtgttgtaatggtg

SEQ ID NO: 6107032 - DNA, 13 bp, Homo sapiens
ctaaaagtcttcg

SEQ ID NO: 6107033 - DNA, 16 bp, Homo sapiens
ctaaaagtgatgtgat

SEQ ID NO: 6107034 - DNA, 19 bp, Homo sapiens
ctaaaagtgcatttaagga

SEQ ID NO: 6107035 - DNA, 20 bp, Homo sapiens
ctaaaagtgggcttgattct

SEQ ID NO: 6107036 - DNA, 19 bp, Homo sapiens
ctaaaagtggtttttattt

SEQ ID NO: 6107037 - DNA, 22 bp, Homo sapiens
ctaaaagtggtttttatttcct

SEQ ID NO: 6107038 - DNA, 15 bp, Homo sapiens
cctgctgtctctctg

SEQ ID NO: 6107039 - DNA, 17 bp, Homo sapiens
cctgctgtctctctggg

SEQ ID NO: 6107040 - DNA, 14 bp, Homo sapiens
cctgctgtcttctc

SEQ ID NO: 6107041 - DNA, 15 bp, Homo sapiens
cctgctgtcttctcc

SEQ ID NO: 6107042 - DNA, 19 bp, Homo sapiens
cctgctgtgaaagaagtaa

SEQ ID NO: 6107043 - DNA, 20 bp, Homo sapiens
cctgctgtgattccactaca

SEQ ID NO: 6107044 - DNA, 22 bp, Homo sapiens
cctgctgtgccatgctgggcca

SEQ ID NO: 6107045 - DNA, 21 bp, Homo sapiens
cctgctgtgcctcgcatccta

SEQ ID NO: 6107046 - DNA, 11 bp, Homo sapiens
cctgctgtgct

SEQ ID NO: 6107047 - DNA, 15 bp, Homo sapiens
cctgctgtgctgctc

SEQ ID NO: 6107048 - DNA, 16 bp, Homo sapiens
cctgctgtgctgctca

SEQ ID NO: 6107049 - DNA, 14 bp, Homo sapiens
cctgctgtggagcc

SEQ ID NO: 6107050 - DNA, 17 bp, Homo sapiens
cctgctgtggatgtccc

SEQ ID NO: 6107051 - DNA, 16 bp, Homo sapiens
cctgctgtggcctcac

SEQ ID NO: 6107052 - DNA, 22 bp, Homo sapiens
cctgctgtggggtatacagcat

SEQ ID NO: 6107053 - DNA, 21 bp, Homo sapiens
cctgctgtttatcccttaaga

SEQ ID NO: 6107054 - DNA, 23 bp, Homo sapiens
cctgcttaatcttcaaagccttc

SEQ ID NO: 6107055 - DNA, 14 bp, Homo sapiens
cctgcttacctgac

SEQ ID NO: 6107056 - DNA, 21 bp, Homo sapiens
cctgcttagctgccttgagct

SEQ ID NO: 6107057 - DNA, 18 bp, Homo sapiens
cctgcttcacacccctca

SEQ ID NO: 6107058 - DNA, 20 bp, Homo sapiens
cctgcttcacacccctcagc

SEQ ID NO: 6107059 - DNA, 22 bp, Homo sapiens
cctgcttcacacccctcagcgc

SEQ ID NO: 6107060 - DNA, 19 bp, Homo sapiens
cctgcttcagatgtggagc

SEQ ID NO: 6107061 - DNA, 21 bp, Homo sapiens
cctgcttcagatgtggagcca

SEQ ID NO: 6107062 - DNA, 17 bp, Homo sapiens
cctgcttcagcctccca

SEQ ID NO: 6107063 - DNA, 24 bp, Homo sapiens
cctgcttcagtcccttccccatgc

SEQ ID NO: 6107064 - DNA, 14 bp, Homo sapiens
cctgcttcatatct

SEQ ID NO: 6107065 - DNA, 17 bp, Homo sapiens
cctgcttcatatctctc

SEQ ID NO: 6107066 - DNA, 18 bp, Homo sapiens
cctgcttccacctcaccc

SEQ ID NO: 6107067 - DNA, 22 bp, Homo sapiens
cctgcttccaggaaactccaca

SEQ ID NO: 6107068 - DNA, 15 bp, Homo sapiens
cctgcttccatggcc

SEQ ID NO: 6107069 - DNA, 14 bp, Homo sapiens
cctgcttcccacaa

SEQ ID NO: 6107070 - DNA, 21 bp, Homo sapiens
cctgcttcccacctccctgcc

SEQ ID NO: 6107071 - DNA, 23 bp, Homo sapiens
cctgcttcccacctccctgccca

SEQ ID NO: 6107072 - DNA, 18 bp, Homo sapiens
cctgcttccccaaaggcc

SEQ ID NO: 6107073 - DNA, 13 bp, Homo sapiens
cctgcttccccca

SEQ ID NO: 6107074 - DNA, 15 bp, Homo sapiens
cctgcttcccccact

SEQ ID NO: 6107075 - DNA, 18 bp, Homo sapiens
cctgcttcccccacttca

SEQ ID NO: 6107076 - DNA, 21 bp, Homo sapiens
cctgcttcccccacttcacct

SEQ ID NO: 6107077 - DNA, 14 bp, Homo sapiens
cctgcttcccctcc

SEQ ID NO: 6107078 - DNA, 15 bp, Homo sapiens
cctgcttcccctccc

SEQ ID NO: 6107079 - DNA, 17 bp, Homo sapiens
cctgcttccccttccta

SEQ ID NO: 6107080 - DNA, 13 bp, Homo sapiens
cctgcttcccggg

SEQ ID NO: 6107081 - DNA, 22 bp, Homo sapiens
cctgcttcctaggccccagagc

SEQ ID NO: 6107082 - DNA, 23 bp, Homo sapiens
cctgcttcctgaaagctgttgga

SEQ ID NO: 6107083 - DNA, 14 bp, Homo sapiens
cctgcttcctgctt

SEQ ID NO: 6107084 - DNA, 18 bp, Homo sapiens
cctgcttcctgcttgcca

SEQ ID NO: 6107085 - DNA, 12 bp, Homo sapiens
cctgcttcctgt

SEQ ID NO: 6107086 - DNA, 15 bp, Homo sapiens
cctgcttccttcagt

SEQ ID NO: 6107087 - DNA, 16 bp, Homo sapiens
cctgcttctccagcct

SEQ ID NO: 6107088 - DNA, 20 bp, Homo sapiens
cctgcttctccagcctggac

SEQ ID NO: 6107089 - DNA, 21 bp, Homo sapiens
cctgcttctcccctgggctgc

SEQ ID NO: 6107090 - DNA, 17 bp, Homo sapiens
cctgcttctcccgccat

SEQ ID NO: 6107091 - DNA, 17 bp, Homo sapiens
cctgcttctctcagcca

SEQ ID NO: 6107092 - DNA, 20 bp, Homo sapiens
cctgcttctctcagccagct

SEQ ID NO: 6107093 - DNA, 23 bp, Homo sapiens
cctgcttctctcagccagctgtt

SEQ ID NO: 6107094 - DNA, 14 bp, Homo sapiens
cctgcttctctgcc

SEQ ID NO: 6107095 - DNA, 21 bp, Homo sapiens
cctgcttctcttttcctcgca

SEQ ID NO: 6107096 - DNA, 13 bp, Homo sapiens
cctgcttctgctg

SEQ ID NO: 6107097 - DNA, 11 bp, Homo sapiens
cctgcttctgt

SEQ ID NO: 6107098 - DNA, 20 bp, Homo sapiens
cctgcttcttccccagggtt

SEQ ID NO: 6107099 - DNA, 17 bp, Homo sapiens
cctgcttctttccagaa

SEQ ID NO: 6107100 - DNA, 18 bp, Homo sapiens
cctgcttgaaggaacagt

SEQ ID NO: 6107101 - DNA, 19 bp, Homo sapiens
cctgcttgactttccagaa

SEQ ID NO: 6107102 - DNA, 22 bp, Homo sapiens
cctgcttgagctttctgtgcat

SEQ ID NO: 6107103 - DNA, 23 bp, Homo sapiens
cctgcttgagctttctgtgcatg

SEQ ID NO: 6107104 - DNA, 12 bp, Homo sapiens
cctgcttgataa

SEQ ID NO: 6107105 - DNA, 21 bp, Homo sapiens
cctgcttgatgggattctgga

SEQ ID NO: 6107106 - DNA, 15 bp, Homo sapiens
cctgcttgcacactt

SEQ ID NO: 6107107 - DNA, 20 bp, Homo sapiens
cctgcttgcacacttcccca

SEQ ID NO: 6107108 - DNA, 23 bp, Homo sapiens
cctgcttgcacacttccccatct

SEQ ID NO: 6107109 - DNA, 15 bp, Homo sapiens
cctgcttgcaggagg

SEQ ID NO: 6107110 - DNA, 16 bp, Homo sapiens
cctgcttgcaggaggc

SEQ ID NO: 6107111 - DNA, 22 bp, Homo sapiens
cctgcttgccaaggcagaggcc

SEQ ID NO: 6107112 - DNA, 21 bp, Homo sapiens
cctgcttgcccgctcccacag

SEQ ID NO: 6107113 - DNA, 23 bp, Homo sapiens
cctgcttgctggaaaactgccac

SEQ ID NO: 6107114 - DNA, 13 bp, Homo sapiens
cctgcttggccca

SEQ ID NO: 6107115 - DNA, 21 bp, Homo sapiens
cctgcttggcttatgaaaaca

SEQ ID NO: 6107116 - DNA, 21 bp, Homo sapiens
cctgcttggggcctggcgtgg

SEQ ID NO: 6107117 - DNA, 21 bp, Homo sapiens
cctgcttgggtggagaagcca

SEQ ID NO: 6107118 - DNA, 23 bp, Homo sapiens
cctgcttgtactaagccaggagg

SEQ ID NO: 6107119 - DNA, 18 bp, Homo sapiens
cctgcttgtgttgggccc

SEQ ID NO: 6107120 - DNA, 21 bp, Homo sapiens
cctgctttaaccaccccatct

SEQ ID NO: 6107121 - DNA, 21 bp, Homo sapiens
cctgctttagaatgttttcct

SEQ ID NO: 6107122 - DNA, 22 bp, Homo sapiens
cctgctttcaagacccctgtct

SEQ ID NO: 6107123 - DNA, 16 bp, Homo sapiens
cctgctttcagatact

SEQ ID NO: 6107124 - DNA, 21 bp, Homo sapiens
cctgctttcagatactggatt

SEQ ID NO: 6107125 - DNA, 16 bp, Homo sapiens
cctgctttccctcccc

SEQ ID NO: 6107126 - DNA, 16 bp, Homo sapiens
cctgctttctacgcca

SEQ ID NO: 6107127 - DNA, 17 bp, Homo sapiens
cctgctttctacgccaa

SEQ ID NO: 6107128 - DNA, 12 bp, Homo sapiens
cctgctttctcc

SEQ ID NO: 6107129 - DNA, 14 bp, Homo sapiens
cctgctttctcttt

SEQ ID NO: 6107130 - DNA, 17 bp, Homo sapiens
cctgctttgacgggcca

SEQ ID NO: 6107131 - DNA, 20 bp, Homo sapiens
cctgctttgacgggccaggc

SEQ ID NO: 6107132 - DNA, 11 bp, Homo sapiens
cctgctttgca

SEQ ID NO: 6107133 - DNA, 12 bp, Homo sapiens
cctgctttgcaa

SEQ ID NO: 6107134 - DNA, 15 bp, Homo sapiens
cctgctttgcatctt

SEQ ID NO: 6107135 - DNA, 22 bp, Homo sapiens
cctgctttgccccactgggaga

SEQ ID NO: 6107136 - DNA, 18 bp, Homo sapiens
cctgctttgcgtgcccgg

SEQ ID NO: 6107137 - DNA, 15 bp, Homo sapiens
cctgctttggccttt

SEQ ID NO: 6107138 - DNA, 21 bp, Homo sapiens
cctgctttggctgaggggctt

SEQ ID NO: 6107139 - DNA, 17 bp, Homo sapiens
cctgctttgggctgccc

SEQ ID NO: 6107140 - DNA, 12 bp, Homo sapiens
cctgcttttcaa

SEQ ID NO: 6107141 - DNA, 16 bp, Homo sapiens
cctgcttttccaggat

SEQ ID NO: 6107142 - DNA, 19 bp, Homo sapiens
cctgcttttccaggatcct

SEQ ID NO: 6107143 - DNA, 23 bp, Homo sapiens
cctgcttttccaggatcctgcag

SEQ ID NO: 6107144 - DNA, 18 bp, Homo sapiens
cctgcttttctcccagaa

SEQ ID NO: 6107145 - DNA, 23 bp, Homo sapiens
cctgcttttctcccagaaggctg

SEQ ID NO: 6107146 - DNA, 16 bp, Homo sapiens
cctgcttttctgtcct

SEQ ID NO: 6107147 - DNA, 18 bp, Homo sapiens
cctgcttttctgtcctgg

SEQ ID NO: 6107148 - DNA, 20 bp, Homo sapiens
cctgcttttctgtcctgggc

SEQ ID NO: 6107149 - DNA, 16 bp, Homo sapiens
cctgcttttgtgtccc

SEQ ID NO: 6107150 - DNA, 19 bp, Homo sapiens
cctgctttttttcttaaaa

SEQ ID NO: 6107151 - DNA, 15 bp, Homo sapiens
cctggaaaataaatc

SEQ ID NO: 6107152 - DNA, 19 bp, Homo sapiens
cctggaaaattctatggaa

SEQ ID NO: 6107153 - DNA, 14 bp, Homo sapiens
cctggaaacagacc

SEQ ID NO: 6107154 - DNA, 21 bp, Homo sapiens
cctggaaacagcatgaataaa

SEQ ID NO: 6107155 - DNA, 17 bp, Homo sapiens
cctggaaaccacagtcc

SEQ ID NO: 6107156 - DNA, 15 bp, Homo sapiens
cctggaaacccacct

SEQ ID NO: 6107157 - DNA, 14 bp, Homo sapiens
cctggaaaccttcc

SEQ ID NO: 6107158 - DNA, 17 bp, Homo sapiens
cctggaaaccttccacc

SEQ ID NO: 6107159 - DNA, 18 bp, Homo sapiens
cctggaaaccttccaccc

SEQ ID NO: 6107160 - DNA, 17 bp, Homo sapiens
cctggaaactgctcaga

SEQ ID NO: 6107161 - DNA, 14 bp, Homo sapiens
cctggaaagccagg

SEQ ID NO: 6107162 - DNA, 16 bp, Homo sapiens
cctggaaagccaggtt

SEQ ID NO: 6107163 - DNA, 15 bp, Homo sapiens
cctggaaaggctcag

SEQ ID NO: 6107164 - DNA, 21 bp, Homo sapiens
cctggaaaggctcagtctcag

SEQ ID NO: 6107165 - DNA, 23 bp, Homo sapiens
cctggaaaggctcagtctcagga

SEQ ID NO: 6107166 - DNA, 22 bp, Homo sapiens
cctggaacaaatcgtttctcag

SEQ ID NO: 6107167 - DNA, 19 bp, Homo sapiens
cctggaacaatattttatg

SEQ ID NO: 6107168 - DNA, 22 bp, Homo sapiens
cctggaacatcatcaaggcact

SEQ ID NO: 6107169 - DNA, 21 bp, Homo sapiens
cctggaaccagcaagtcccag

SEQ ID NO: 6107170 - DNA, 24 bp, Homo sapiens
cctggaaccagcaagtcccagaca

SEQ ID NO: 6107171 - DNA, 21 bp, Homo sapiens
cctggaaccgggaagggtggc

SEQ ID NO: 6107172 - DNA, 13 bp, Homo sapiens
cctggaacctgga

SEQ ID NO: 6107173 - DNA, 20 bp, Homo sapiens
cctggaacctggaccccagc

SEQ ID NO: 6107174 - DNA, 21 bp, Homo sapiens
cctggaacctggcaggccctg

SEQ ID NO: 6107175 - DNA, 15 bp, Homo sapiens
cctggaacctttccc

SEQ ID NO: 6107176 - DNA, 18 bp, Homo sapiens
cctggaacctttcccttg

SEQ ID NO: 6107177 - DNA, 20 bp, Homo sapiens
cctggaacctttcccttgtg

SEQ ID NO: 6107178 - DNA, 17 bp, Homo sapiens
cctggaacttggggagt

SEQ ID NO: 6107179 - DNA, 16 bp, Homo sapiens
cctggaagaacaggcc

SEQ ID NO: 6107180 - DNA, 17 bp, Homo sapiens
cctggaagaacaggcct

SEQ ID NO: 6107181 - DNA, 18 bp, Homo sapiens
cctggaagaacaggcctc

SEQ ID NO: 6107182 - DNA, 20 bp, Homo sapiens
cctggaagaacaggcctctc

SEQ ID NO: 6107183 - DNA, 16 bp, Homo sapiens
cctggaagacaaccca

SEQ ID NO: 6107184 - DNA, 18 bp, Homo sapiens
cctggaagacaacccagg

SEQ ID NO: 6107185 - DNA, 22 bp, Homo sapiens
cctggaagacaacccaggcagt

SEQ ID NO: 6107186 - DNA, 13 bp, Homo sapiens
cctggaagacaga

SEQ ID NO: 6107187 - DNA, 15 bp, Homo sapiens
cctggaagacagaga

SEQ ID NO: 6107188 - DNA, 12 bp, Homo sapiens
cctggaagcact

SEQ ID NO: 6107189 - DNA, 16 bp, Homo sapiens
cctggaagcactacag

SEQ ID NO: 6107190 - DNA, 14 bp, Homo sapiens
cctggaagcagagc

SEQ ID NO: 6107191 - DNA, 16 bp, Homo sapiens
cctggaagcagtgccc

SEQ ID NO: 6107192 - DNA, 19 bp, Homo sapiens
cctggaagcagtgcccagg

SEQ ID NO: 6107193 - DNA, 15 bp, Homo sapiens
cctggaagccagctt

SEQ ID NO: 6107194 - DNA, 17 bp, Homo sapiens
cctggaagccagctttc

SEQ ID NO: 6107195 - DNA, 20 bp, Homo sapiens
cctggaagccctctctggct

SEQ ID NO: 6107196 - DNA, 13 bp, Homo sapiens
cctggaagctctc

SEQ ID NO: 6107197 - DNA, 23 bp, Homo sapiens
cctggaagctctccgagctctgg

SEQ ID NO: 6107198 - DNA, 21 bp, Homo sapiens
cctggaagctggaagactgtg

SEQ ID NO: 6107199 - DNA, 13 bp, Homo sapiens
cctggaagctgtg

SEQ ID NO: 6107200 - DNA, 20 bp, Homo sapiens
cctggaagctgtgtccttgc

SEQ ID NO: 6107201 - DNA, 21 bp, Homo sapiens
cctggaagctgtgtccttgca

SEQ ID NO: 6107202 - DNA, 14 bp, Homo sapiens
cctggaaggacaca

SEQ ID NO: 6107203 - DNA, 15 bp, Homo sapiens
cctggaaggacacag

SEQ ID NO: 6107204 - DNA, 20 bp, Homo sapiens
cctggaaggacatccatgtt

SEQ ID NO: 6107205 - DNA, 18 bp, Homo sapiens
cctggaaggcccagcacc

SEQ ID NO: 6107206 - DNA, 18 bp, Homo sapiens
cctggaagggaagtgaga

SEQ ID NO: 6107207 - DNA, 20 bp, Homo sapiens
cctggaagttgtcctttctg

SEQ ID NO: 6107208 - DNA, 22 bp, Homo sapiens
cctggaataaaatataaaactg

SEQ ID NO: 6107209 - DNA, 17 bp, Homo sapiens
cctggaatcgaggctgt

SEQ ID NO: 6107210 - DNA, 19 bp, Homo sapiens
cctggaatcgaggctgtgt

SEQ ID NO: 6107211 - DNA, 18 bp, Homo sapiens
cctggaatctacaagcca

SEQ ID NO: 6107212 - DNA, 14 bp, Homo sapiens
cctggaatggagct

SEQ ID NO: 6107213 - DNA, 22 bp, Homo sapiens
cctggaattagcttggggccag

SEQ ID NO: 6107214 - DNA, 16 bp, Homo sapiens
cctggaattcagcacc

SEQ ID NO: 6107215 - DNA, 19 bp, Homo sapiens
ctaaaagttaagtgtcatt

SEQ ID NO: 6107216 - DNA, 20 bp, Homo sapiens
ctaaaagttaagtgtcattt

SEQ ID NO: 6107217 - DNA, 22 bp, Homo sapiens
ctaaaagttcataacagtgcca

SEQ ID NO: 6107218 - DNA, 16 bp, Homo sapiens
ctaaaagttgaaaagc

SEQ ID NO: 6107219 - DNA, 14 bp, Homo sapiens
ctaaaagttttcta

SEQ ID NO: 6107220 - DNA, 19 bp, Homo sapiens
ctaaaagttttctaatttg

SEQ ID NO: 6107221 - DNA, 14 bp, Homo sapiens
ctaaaataaaaacc

SEQ ID NO: 6107222 - DNA, 16 bp, Homo sapiens
ctaaaataaaaaccag

SEQ ID NO: 6107223 - DNA, 14 bp, Homo sapiens
ctaaaataaaaatg

SEQ ID NO: 6107224 - DNA, 13 bp, Homo sapiens
ctaaaataaacct

SEQ ID NO: 6107225 - DNA, 14 bp, Homo sapiens
ctaaaataaagaaa

SEQ ID NO: 6107226 - DNA, 19 bp, Homo sapiens
ctaaaataaatgttttgga

SEQ ID NO: 6107227 - DNA, 14 bp, Homo sapiens
ctaaaataagaata

SEQ ID NO: 6107228 - DNA, 15 bp, Homo sapiens
ctaaaataattttgt

SEQ ID NO: 6107229 - DNA, 17 bp, Homo sapiens
ctaaaataattttgtaa

SEQ ID NO: 6107230 - DNA, 18 bp, Homo sapiens
ctaaaataattttgtaat

SEQ ID NO: 6107231 - DNA, 23 bp, Homo sapiens
ctaaaatacacaaggagctttct

SEQ ID NO: 6107232 - DNA, 17 bp, Homo sapiens
ctaaaatactcaccaaa

SEQ ID NO: 6107233 - DNA, 22 bp, Homo sapiens
ctaaaatactcaccaaaatata

SEQ ID NO: 6107234 - DNA, 19 bp, Homo sapiens
ctaaaatacttgagaaatt

SEQ ID NO: 6107235 - DNA, 23 bp, Homo sapiens
ctaaaatagttagatctttgtaa

SEQ ID NO: 6107236 - DNA, 11 bp, Homo sapiens
ctaaaatatat

SEQ ID NO: 6107237 - DNA, 22 bp, Homo sapiens
ctaaaatatctgggtggcttaa

SEQ ID NO: 6107238 - DNA, 16 bp, Homo sapiens
ctaaaatatttatgaa

SEQ ID NO: 6107239 - DNA, 22 bp, Homo sapiens
ctaaaatatttatgaagaaaat

SEQ ID NO: 6107240 - DNA, 14 bp, Homo sapiens
ctaaaatatttatt

SEQ ID NO: 6107241 - DNA, 23 bp, Homo sapiens
ctaaaatatttattttttttaag

SEQ ID NO: 6107242 - DNA, 15 bp, Homo sapiens
ctaaaatattttaga

SEQ ID NO: 6107243 - DNA, 12 bp, Homo sapiens
ctaaaatcatga

SEQ ID NO: 6107244 - DNA, 13 bp, Homo sapiens
ctaaaatccaccc

SEQ ID NO: 6107245 - DNA, 19 bp, Homo sapiens
ctaaaatccacccagccca

SEQ ID NO: 6107246 - DNA, 20 bp, Homo sapiens
ctaaaatccacccagcccac

SEQ ID NO: 6107247 - DNA, 17 bp, Homo sapiens
ctaaaatcccaccagaa

SEQ ID NO: 6107248 - DNA, 22 bp, Homo sapiens
ctaaaatcgtattctaattctt

SEQ ID NO: 6107249 - DNA, 17 bp, Homo sapiens
ctaaaatcttatagttc

SEQ ID NO: 6107250 - DNA, 18 bp, Homo sapiens
ctaaaatgaggatccagg

SEQ ID NO: 6107251 - DNA, 12 bp, Homo sapiens
ctaaaatgcttc

SEQ ID NO: 6107252 - DNA, 22 bp, Homo sapiens
ctaaaatggactgtggtgactt

SEQ ID NO: 6107253 - DNA, 19 bp, Homo sapiens
ctaaaatggcgaacatgtg

SEQ ID NO: 6107254 - DNA, 17 bp, Homo sapiens
ctaaaatgtagaaattc

SEQ ID NO: 6107255 - DNA, 18 bp, Homo sapiens
ctaaaatgtagaaattct

SEQ ID NO: 6107256 - DNA, 20 bp, Homo sapiens
ctaaaatgtgatgttctaag

SEQ ID NO: 6107257 - DNA, 22 bp, Homo sapiens
ctaaaatgtgatgttctaaggc

SEQ ID NO: 6107258 - DNA, 23 bp, Homo sapiens
ctaaaatgtgatgttctaaggct

SEQ ID NO: 6107259 - DNA, 20 bp, Homo sapiens
ctaaaatgttaaaacataaa

SEQ ID NO: 6107260 - DNA, 19 bp, Homo sapiens
ctaaaatgtttaattcatt

SEQ ID NO: 6107261 - DNA, 17 bp, Homo sapiens
ctaaaatgtttattcct

SEQ ID NO: 6107262 - DNA, 13 bp, Homo sapiens
ctaaaatgtttta

SEQ ID NO: 6107263 - DNA, 21 bp, Homo sapiens
ctaaaatgttttatgacattt

SEQ ID NO: 6107264 - DNA, 13 bp, Homo sapiens
ctaaaatgttttc

SEQ ID NO: 6107265 - DNA, 17 bp, Homo sapiens
ctaaaatgttttcagct

SEQ ID NO: 6107266 - DNA, 18 bp, Homo sapiens
ctaaaattatgttactgt

SEQ ID NO: 6107267 - DNA, 18 bp, Homo sapiens
ctaaaattcaaaaacaaa

SEQ ID NO: 6107268 - DNA, 17 bp, Homo sapiens
ctaaaattcaacaaatg

SEQ ID NO: 6107269 - DNA, 12 bp, Homo sapiens
ctaaaattctag

SEQ ID NO: 6107270 - DNA, 22 bp, Homo sapiens
ctaaaattctagtctctgattt

SEQ ID NO: 6107271 - DNA, 21 bp, Homo sapiens
ctaaaattctgggcctaattt

SEQ ID NO: 6107272 - DNA, 16 bp, Homo sapiens
ctaaaattgtatgaaa

SEQ ID NO: 6107273 - DNA, 17 bp, Homo sapiens
ctaaaattgtatgaaaa

SEQ ID NO: 6107274 - DNA, 13 bp, Homo sapiens
ctaaaatttaatt

SEQ ID NO: 6107275 - DNA, 23 bp, Homo sapiens
ctaaaatttaatttcttttttcc

SEQ ID NO: 6107276 - DNA, 15 bp, Homo sapiens
ctaaaatttacacat

SEQ ID NO: 6107277 - DNA, 13 bp, Homo sapiens
ctaaaatttcata

SEQ ID NO: 6107278 - DNA, 21 bp, Homo sapiens
ctaaaatttcataattctgaa

SEQ ID NO: 6107279 - DNA, 13 bp, Homo sapiens
ctaaaatttgaag

SEQ ID NO: 6107280 - DNA, 16 bp, Homo sapiens
ctaaaatttgtaatat

SEQ ID NO: 6107281 - DNA, 19 bp, Homo sapiens
ctaaaatttgtaatatttt

SEQ ID NO: 6107282 - DNA, 15 bp, Homo sapiens
ctaaaattttttcct

SEQ ID NO: 6107283 - DNA, 17 bp, Homo sapiens
ctaaacaagaaccattt

SEQ ID NO: 6107284 - DNA, 22 bp, Homo sapiens
ctaaacaagattttaaagacat

SEQ ID NO: 6107285 - DNA, 17 bp, Homo sapiens
ctaaacaatgaattctt

SEQ ID NO: 6107286 - DNA, 17 bp, Homo sapiens
ctaaacacgtgacacaa

SEQ ID NO: 6107287 - DNA, 18 bp, Homo sapiens
ctaaacactgcgctttat

SEQ ID NO: 6107288 - DNA, 16 bp, Homo sapiens
ctaaacagatgtaatg

SEQ ID NO: 6107289 - DNA, 18 bp, Homo sapiens
ctaaacagttatttctgt

SEQ ID NO: 6107290 - DNA, 12 bp, Homo sapiens
ctaaacataatt

SEQ ID NO: 6107291 - DNA, 14 bp, Homo sapiens
ctaaacataattgt

SEQ ID NO: 6107292 - DNA, 17 bp, Homo sapiens
ctaaacatagtggtatt

SEQ ID NO: 6107293 - DNA, 13 bp, Homo sapiens
ctaaacatcattc

SEQ ID NO: 6107294 - DNA, 18 bp, Homo sapiens
ctaaacattgtgatgatt

SEQ ID NO: 6107295 - DNA, 16 bp, Homo sapiens
ctaaaccaactctaat

SEQ ID NO: 6107296 - DNA, 17 bp, Homo sapiens
ctaaaccaactctaata

SEQ ID NO: 6107297 - DNA, 18 bp, Homo sapiens
ctaaaccaactctaatat

SEQ ID NO: 6107298 - DNA, 16 bp, Homo sapiens
ctaaaccaaggactga

SEQ ID NO: 6107299 - DNA, 20 bp, Homo sapiens
ctaaaccaaggactgagcac

SEQ ID NO: 6107300 - DNA, 18 bp, Homo sapiens
ctaaaccacaaaagttgt

SEQ ID NO: 6107301 - DNA, 19 bp, Homo sapiens
ctaaaccacttctctgctg

SEQ ID NO: 6107302 - DNA, 15 bp, Homo sapiens
ctaaaccatgaaaag

SEQ ID NO: 6107303 - DNA, 21 bp, Homo sapiens
ctaaaccatgaaaagttttca

SEQ ID NO: 6107304 - DNA, 15 bp, Homo sapiens
ctaaacccaaataaa

SEQ ID NO: 6107305 - DNA, 16 bp, Homo sapiens
ctaaacccaatccaaa

SEQ ID NO: 6107306 - DNA, 20 bp, Homo sapiens
ctaaaccccaagcttcccaa

SEQ ID NO: 6107307 - DNA, 18 bp, Homo sapiens
ctaaacccccgctccaga

SEQ ID NO: 6107308 - DNA, 19 bp, Homo sapiens
ctaaacccccgctccagat

SEQ ID NO: 6107309 - DNA, 16 bp, Homo sapiens
ctaaaccctctgtgaa

SEQ ID NO: 6107310 - DNA, 17 bp, Homo sapiens
ctaaaccctctgtgaaa

SEQ ID NO: 6107311 - DNA, 17 bp, Homo sapiens
ctaaaccgataatgcat

SEQ ID NO: 6107312 - DNA, 17 bp, Homo sapiens
ctaaacctatctgtatt

SEQ ID NO: 6107313 - DNA, 17 bp, Homo sapiens
ctaaacctgtgcctccc

SEQ ID NO: 6107314 - DNA, 19 bp, Homo sapiens
ctaaacctgtgcctccctc

SEQ ID NO: 6107315 - DNA, 18 bp, Homo sapiens
ctaaaccttagtactgag

SEQ ID NO: 6107316 - DNA, 22 bp, Homo sapiens
ctaaacgactccgagaacaaca

SEQ ID NO: 6107317 - DNA, 17 bp, Homo sapiens
ctaaacggattccaaag

SEQ ID NO: 6107318 - DNA, 18 bp, Homo sapiens
ctaaacgtaagcactgtt

SEQ ID NO: 6107319 - DNA, 17 bp, Homo sapiens
ctaaacgtgtatgtttt

SEQ ID NO: 6107320 - DNA, 21 bp, Homo sapiens
ctaaacgtgtatgtttttcag

SEQ ID NO: 6107321 - DNA, 18 bp, Homo sapiens
ctaaactaccacctcagg

SEQ ID NO: 6107322 - DNA, 19 bp, Homo sapiens
ctaaactaccacctcaggt

SEQ ID NO: 6107323 - DNA, 23 bp, Homo sapiens
ctaaactagctcttggggaaata

SEQ ID NO: 6107324 - DNA, 16 bp, Homo sapiens
ctaaactagtttttcc

SEQ ID NO: 6107325 - DNA, 17 bp, Homo sapiens
ctaaactcatttataaa

SEQ ID NO: 6107326 - DNA, 20 bp, Homo sapiens
ctaaactccaaacatcctct

SEQ ID NO: 6107327 - DNA, 12 bp, Homo sapiens
ctaaactccagg

SEQ ID NO: 6107328 - DNA, 16 bp, Homo sapiens
ctaaactccttcctgg

SEQ ID NO: 6107329 - DNA, 17 bp, Homo sapiens
ctaaactccttcctggc

SEQ ID NO: 6107330 - DNA, 23 bp, Homo sapiens
ctaaactctcgagacttctctgt

SEQ ID NO: 6107331 - DNA, 17 bp, Homo sapiens
ctaaactctctagctta

SEQ ID NO: 6107332 - DNA, 16 bp, Homo sapiens
ctaaactctgaataag

SEQ ID NO: 6107333 - DNA, 19 bp, Homo sapiens
ctaaactgaagctgctgta

SEQ ID NO: 6107334 - DNA, 20 bp, Homo sapiens
ctaaactgagacaatgcctt

SEQ ID NO: 6107335 - DNA, 21 bp, Homo sapiens
ctaaactgagctcgcagcccc

SEQ ID NO: 6107336 - DNA, 12 bp, Homo sapiens
ctaaactgcccc

SEQ ID NO: 6107337 - DNA, 13 bp, Homo sapiens
ctaaactgccccc

SEQ ID NO: 6107338 - DNA, 22 bp, Homo sapiens
ctaaactgtagctgtattagca

SEQ ID NO: 6107339 - DNA, 15 bp, Homo sapiens
ctaaactgtgaaaaa

SEQ ID NO: 6107340 - DNA, 16 bp, Homo sapiens
ctaaactgtttcttag

SEQ ID NO: 6107341 - DNA, 17 bp, Homo sapiens
ctaaactgttttcatgt

SEQ ID NO: 6107342 - DNA, 12 bp, Homo sapiens
ctaaacttccct

SEQ ID NO: 6107343 - DNA, 13 bp, Homo sapiens
ctaaactttcaca

SEQ ID NO: 6107344 - DNA, 14 bp, Homo sapiens
ctaaactttcacac

SEQ ID NO: 6107345 - DNA, 16 bp, Homo sapiens
ctaaacttttctgata

SEQ ID NO: 6107346 - DNA, 13 bp, Homo sapiens
ctaaagaaaaaca

SEQ ID NO: 6107347 - DNA, 15 bp, Homo sapiens
ctaaagaaaaagata

SEQ ID NO: 6107348 - DNA, 18 bp, Homo sapiens
ctaaagaaaaatgcctgt

SEQ ID NO: 6107349 - DNA, 22 bp, Homo sapiens
ctaaagaagacattttctctta

SEQ ID NO: 6107350 - DNA, 17 bp, Homo sapiens
ctaaagaagaggagaaa

SEQ ID NO: 6107351 - DNA, 21 bp, Homo sapiens
ctaaagaagaggagaaaaaga

SEQ ID NO: 6107352 - DNA, 14 bp, Homo sapiens
ctaaagaagataaa

SEQ ID NO: 6107353 - DNA, 19 bp, Homo sapiens
ctaaagaagttcaaaccct

SEQ ID NO: 6107354 - DNA, 15 bp, Homo sapiens
ctaaagaccaaactt

SEQ ID NO: 6107355 - DNA, 16 bp, Homo sapiens
ctaaagaccaaacttc

SEQ ID NO: 6107356 - DNA, 17 bp, Homo sapiens
ctaaagaccatttaatc

SEQ ID NO: 6107357 - DNA, 22 bp, Homo sapiens
ctaaagacctgctgtaataaat

SEQ ID NO: 6107358 - DNA, 16 bp, Homo sapiens
ctaaagagagaatgta

SEQ ID NO: 6107359 - DNA, 17 bp, Homo sapiens
ctaaagagcatcctgat

SEQ ID NO: 6107360 - DNA, 18 bp, Homo sapiens
ctaaagagcccttgcctc

SEQ ID NO: 6107361 - DNA, 22 bp, Homo sapiens
ctaaagagcccttgcctcccca

SEQ ID NO: 6107362 - DNA, 22 bp, Homo sapiens
ctaaagagctaggaaagagttg

SEQ ID NO: 6107363 - DNA, 14 bp, Homo sapiens
ctaaagaggaagcc

SEQ ID NO: 6107364 - DNA, 23 bp, Homo sapiens
ctaaagaggaagccttgcccagc

SEQ ID NO: 6107365 - DNA, 22 bp, Homo sapiens
ctaaagaggtggggtgaagctg

SEQ ID NO: 6107366 - DNA, 19 bp, Homo sapiens
ctaaagagtttattttaag

SEQ ID NO: 6107367 - DNA, 21 bp, Homo sapiens
ctaaagatagagtcattgctg

SEQ ID NO: 6107368 - DNA, 21 bp, Homo sapiens
ctaaagatctttttttaagtg

SEQ ID NO: 6107369 - DNA, 20 bp, Homo sapiens
ctaaagatggagtttctaag

SEQ ID NO: 6107370 - DNA, 15 bp, Homo sapiens
ctaaagatgggagga

SEQ ID NO: 6107371 - DNA, 16 bp, Homo sapiens
ctaaagatgggaggag

SEQ ID NO: 6107372 - DNA, 16 bp, Homo sapiens
ctaaagcaaattgttt

SEQ ID NO: 6107373 - DNA, 18 bp, Homo sapiens
ctaaagcaaattgtttca

SEQ ID NO: 6107374 - DNA, 14 bp, Homo sapiens
ctaaagcaataatc

SEQ ID NO: 6107375 - DNA, 18 bp, Homo sapiens
ctaaagcactggtttcaa

SEQ ID NO: 6107376 - DNA, 21 bp, Homo sapiens
ctaaagcactggtttcaagaa

SEQ ID NO: 6107377 - DNA, 19 bp, Homo sapiens
ctaaagcacttcttttcca

SEQ ID NO: 6107378 - DNA, 12 bp, Homo sapiens
ctaaagcacttt

SEQ ID NO: 6107379 - DNA, 20 bp, Homo sapiens
ctaaagcactttgcacttaa

SEQ ID NO: 6107380 - DNA, 13 bp, Homo sapiens
ctaaagcagaggc

SEQ ID NO: 6107381 - DNA, 16 bp, Homo sapiens
ctaaagcagtaaaata

SEQ ID NO: 6107382 - DNA, 18 bp, Homo sapiens
ctaaagcagtggacacca

SEQ ID NO: 6107383 - DNA, 14 bp, Homo sapiens
ctaaagcatgaaat

SEQ ID NO: 6107384 - DNA, 20 bp, Homo sapiens
ctaaagcatgaaatgtgaat

SEQ ID NO: 6107385 - DNA, 22 bp, Homo sapiens
ctaaagcatgaaatgtgaattt

SEQ ID NO: 6107386 - DNA, 18 bp, Homo sapiens
ctaaagccaaacatatat

SEQ ID NO: 6107387 - DNA, 20 bp, Homo sapiens
ctaaagccaaagtttctgtt

SEQ ID NO: 6107388 - DNA, 23 bp, Homo sapiens
ctaaagccaagcactttatattt

SEQ ID NO: 6107389 - DNA, 15 bp, Homo sapiens
ctaaagccaggctca

SEQ ID NO: 6107390 - DNA, 18 bp, Homo sapiens
ctaaagccaggctcagga

SEQ ID NO: 6107391 - DNA, 22 bp, Homo sapiens
ctaaagccaggctcaggagaag

SEQ ID NO: 6107392 - DNA, 14 bp, Homo sapiens
ctaaagccatttgt

SEQ ID NO: 6107393 - DNA, 22 bp, Homo sapiens
cctggaattcagcaccctgggt

SEQ ID NO: 6107394 - DNA, 15 bp, Homo sapiens
cctggaattgccagc

SEQ ID NO: 6107395 - DNA, 10 bp, Homo sapiens
cctggaattt

SEQ ID NO: 6107396 - DNA, 19 bp, Homo sapiens
cctggaatttaattcaaag

SEQ ID NO: 6107397 - DNA, 17 bp, Homo sapiens
cctggaatttgggcaga

SEQ ID NO: 6107398 - DNA, 22 bp, Homo sapiens
cctggaatttgggcagatatag

SEQ ID NO: 6107399 - DNA, 16 bp, Homo sapiens
cctggaattttaggaa

SEQ ID NO: 6107400 - DNA, 13 bp, Homo sapiens
cctggacaaaccc

SEQ ID NO: 6107401 - DNA, 20 bp, Homo sapiens
cctggacaaggtctcttcct

SEQ ID NO: 6107402 - DNA, 9 bp, Homo sapiens
cctggacac

SEQ ID NO: 6107403 - DNA, 13 bp, Homo sapiens
cctggacacacac

SEQ ID NO: 6107404 - DNA, 14 bp, Homo sapiens
cctggacacacact

SEQ ID NO: 6107405 - DNA, 15 bp, Homo sapiens
cctggacacacactc

SEQ ID NO: 6107406 - DNA, 16 bp, Homo sapiens
cctggacacacactca

SEQ ID NO: 6107407 - DNA, 12 bp, Homo sapiens
cctggacacagc

SEQ ID NO: 6107408 - DNA, 15 bp, Homo sapiens
cctggacacagccca

SEQ ID NO: 6107409 - DNA, 20 bp, Homo sapiens
cctggacacagcccaccctc

SEQ ID NO: 6107410 - DNA, 13 bp, Homo sapiens
cctggacacaggc

SEQ ID NO: 6107411 - DNA, 20 bp, Homo sapiens
cctggacacaggcctgctct

SEQ ID NO: 6107412 - DNA, 13 bp, Homo sapiens
cctggacacagtc

SEQ ID NO: 6107413 - DNA, 20 bp, Homo sapiens
cctggacacccctgctctac

SEQ ID NO: 6107414 - DNA, 15 bp, Homo sapiens
cctggacagctgtgc

SEQ ID NO: 6107415 - DNA, 13 bp, Homo sapiens
cctggacaggcgg

SEQ ID NO: 6107416 - DNA, 20 bp, Homo sapiens
cctggacaggcgggctcgga

SEQ ID NO: 6107417 - DNA, 23 bp, Homo sapiens
cctggacagtatcccacatccaa

SEQ ID NO: 6107418 - DNA, 23 bp, Homo sapiens
cctggacagtgagagcagggctg

SEQ ID NO: 6107419 - DNA, 21 bp, Homo sapiens
cctggacatgaagattctttc

SEQ ID NO: 6107420 - DNA, 23 bp, Homo sapiens
cctggacatgaagattctttccc

SEQ ID NO: 6107421 - DNA, 12 bp, Homo sapiens
cctggacatgcc

SEQ ID NO: 6107422 - DNA, 20 bp, Homo sapiens
cctggacatttgccttgctg

SEQ ID NO: 6107423 - DNA, 20 bp, Homo sapiens
cctggacattttttcagtca

SEQ ID NO: 6107424 - DNA, 15 bp, Homo sapiens
cctggaccaaagctg

SEQ ID NO: 6107425 - DNA, 19 bp, Homo sapiens
cctggaccaaagggaagtg

SEQ ID NO: 6107426 - DNA, 16 bp, Homo sapiens
cctggaccacacctcc

SEQ ID NO: 6107427 - DNA, 20 bp, Homo sapiens
cctggaccaccagccccagc

SEQ ID NO: 6107428 - DNA, 23 bp, Homo sapiens
cctggaccaccagccccagcaag

SEQ ID NO: 6107429 - DNA, 14 bp, Homo sapiens
cctggaccagccgc

SEQ ID NO: 6107430 - DNA, 20 bp, Homo sapiens
cctggaccagccgcccagat

SEQ ID NO: 6107431 - DNA, 17 bp, Homo sapiens
cctggaccagcctcctg

SEQ ID NO: 6107432 - DNA, 13 bp, Homo sapiens
cctggaccccagc

SEQ ID NO: 6107433 - DNA, 17 bp, Homo sapiens
cctggaccccagcctca

SEQ ID NO: 6107434 - DNA, 16 bp, Homo sapiens
cctggacccccagctt

SEQ ID NO: 6107435 - DNA, 15 bp, Homo sapiens
cctggaccccctgcc

SEQ ID NO: 6107436 - DNA, 19 bp, Homo sapiens
cctggaccccctgcccgcc

SEQ ID NO: 6107437 - DNA, 20 bp, Homo sapiens
cctggaccccctgcccgcca

SEQ ID NO: 6107438 - DNA, 13 bp, Homo sapiens
cctggacccctgc

SEQ ID NO: 6107439 - DNA, 13 bp, Homo sapiens
cctggacccctgg

SEQ ID NO: 6107440 - DNA, 18 bp, Homo sapiens
cctggacccctggggtgg

SEQ ID NO: 6107441 - DNA, 21 bp, Homo sapiens
cctggacccctggggtggcca

SEQ ID NO: 6107442 - DNA, 13 bp, Homo sapiens
cctggaccctggc

SEQ ID NO: 6107443 - DNA, 13 bp, Homo sapiens
cctggaccctgtg

SEQ ID NO: 6107444 - DNA, 22 bp, Homo sapiens
cctggaccgagatgtgagtcct

SEQ ID NO: 6107445 - DNA, 17 bp, Homo sapiens
cctggaccgcttcccag

SEQ ID NO: 6107446 - DNA, 18 bp, Homo sapiens
cctggaccgcttcccaga

SEQ ID NO: 6107447 - DNA, 14 bp, Homo sapiens
cctggacctatgca

SEQ ID NO: 6107448 - DNA, 18 bp, Homo sapiens
cctggacctatgcaggga

SEQ ID NO: 6107449 - DNA, 18 bp, Homo sapiens
cctggacctctgacagca

SEQ ID NO: 6107450 - DNA, 23 bp, Homo sapiens
cctggacctgccctgggccacac

SEQ ID NO: 6107451 - DNA, 22 bp, Homo sapiens
cctggacctgcctcctgcctgc

SEQ ID NO: 6107452 - DNA, 18 bp, Homo sapiens
cctggaccttgacagagc

SEQ ID NO: 6107453 - DNA, 14 bp, Homo sapiens
cctggaccttgggc

SEQ ID NO: 6107454 - DNA, 22 bp, Homo sapiens
cctggacgaagagcaggccagc

SEQ ID NO: 6107455 - DNA, 16 bp, Homo sapiens
cctggacgcagccaca

SEQ ID NO: 6107456 - DNA, 18 bp, Homo sapiens
cctggacgggccctcctt

SEQ ID NO: 6107457 - DNA, 15 bp, Homo sapiens
cctggactagaggga

SEQ ID NO: 6107458 - DNA, 15 bp, Homo sapiens
cctggactagggcct

SEQ ID NO: 6107459 - DNA, 23 bp, Homo sapiens
cctggactagggcctcggaggct

SEQ ID NO: 6107460 - DNA, 13 bp, Homo sapiens
cctggactcccct

SEQ ID NO: 6107461 - DNA, 14 bp, Homo sapiens
cctggactcccctc

SEQ ID NO: 6107462 - DNA, 12 bp, Homo sapiens
cctggactcccg

SEQ ID NO: 6107463 - DNA, 18 bp, Homo sapiens
cctggactccggaggact

SEQ ID NO: 6107464 - DNA, 20 bp, Homo sapiens
cctggactccggaggactga

SEQ ID NO: 6107465 - DNA, 21 bp, Homo sapiens
cctggactccggaggactgag

SEQ ID NO: 6107466 - DNA, 12 bp, Homo sapiens
cctggactctgc

SEQ ID NO: 6107467 - DNA, 15 bp, Homo sapiens
cctggactctgcccc

SEQ ID NO: 6107468 - DNA, 12 bp, Homo sapiens
cctggactctgt

SEQ ID NO: 6107469 - DNA, 14 bp, Homo sapiens
cctggactctgtgt

SEQ ID NO: 6107470 - DNA, 12 bp, Homo sapiens
cctggactgacc

SEQ ID NO: 6107471 - DNA, 13 bp, Homo sapiens
cctggactgacca

SEQ ID NO: 6107472 - DNA, 18 bp, Homo sapiens
cctggactgaccacacca

SEQ ID NO: 6107473 - DNA, 23 bp, Homo sapiens
cctggactgagccaaggaggcct

SEQ ID NO: 6107474 - DNA, 13 bp, Homo sapiens
cctggactgaggg

SEQ ID NO: 6107475 - DNA, 16 bp, Homo sapiens
cctggactgcacaggc

SEQ ID NO: 6107476 - DNA, 15 bp, Homo sapiens
cctggactgctacct

SEQ ID NO: 6107477 - DNA, 14 bp, Homo sapiens
cctggactggccct

SEQ ID NO: 6107478 - DNA, 22 bp, Homo sapiens
cctggactggtggcccctgcct

SEQ ID NO: 6107479 - DNA, 14 bp, Homo sapiens
cctggactgtttca

SEQ ID NO: 6107480 - DNA, 16 bp, Homo sapiens
cctggacttaaagaaa

SEQ ID NO: 6107481 - DNA, 14 bp, Homo sapiens
cctggacttcctgt

SEQ ID NO: 6107482 - DNA, 17 bp, Homo sapiens
cctggacttctgggaga

SEQ ID NO: 6107483 - DNA, 14 bp, Homo sapiens
cctggactttcctg

SEQ ID NO: 6107484 - DNA, 15 bp, Homo sapiens
cctggactttcctgc

SEQ ID NO: 6107485 - DNA, 12 bp, Homo sapiens
cctggagaaagg

SEQ ID NO: 6107486 - DNA, 13 bp, Homo sapiens
cctggagaaagga

SEQ ID NO: 6107487 - DNA, 23 bp, Homo sapiens
cctggagaactagaacctggagg

SEQ ID NO: 6107488 - DNA, 22 bp, Homo sapiens
cctggagaagggttcagcccaa

SEQ ID NO: 6107489 - DNA, 12 bp, Homo sapiens
cctggagacaga

SEQ ID NO: 6107490 - DNA, 15 bp, Homo sapiens
cctggagacagtaac

SEQ ID NO: 6107491 - DNA, 19 bp, Homo sapiens
cctggagacagtaacattt

SEQ ID NO: 6107492 - DNA, 13 bp, Homo sapiens
cctggagagcccc

SEQ ID NO: 6107493 - DNA, 22 bp, Homo sapiens
cctggagagcgaggaggcgcgg

SEQ ID NO: 6107494 - DNA, 19 bp, Homo sapiens
cctggagagctagaaccta

SEQ ID NO: 6107495 - DNA, 22 bp, Homo sapiens
cctggagagctagaacctggag

SEQ ID NO: 6107496 - DNA, 22 bp, Homo sapiens
cctggagaggacggccctgcct

SEQ ID NO: 6107497 - DNA, 17 bp, Homo sapiens
cctggagagtgcacatg

SEQ ID NO: 6107498 - DNA, 17 bp, Homo sapiens
cctggagatagctgggg

SEQ ID NO: 6107499 - DNA, 18 bp, Homo sapiens
cctggagatagctggggc

SEQ ID NO: 6107500 - DNA, 21 bp, Homo sapiens
cctggagatagttgctaagtt

SEQ ID NO: 6107501 - DNA, 13 bp, Homo sapiens
cctggagatcctc

SEQ ID NO: 6107502 - DNA, 16 bp, Homo sapiens
cctggagatcctcctg

SEQ ID NO: 6107503 - DNA, 19 bp, Homo sapiens
cctggagatcctcctgcag

SEQ ID NO: 6107504 - DNA, 16 bp, Homo sapiens
cctggagatggggaga

SEQ ID NO: 6107505 - DNA, 16 bp, Homo sapiens
cctggagcaagctctg

SEQ ID NO: 6107506 - DNA, 19 bp, Homo sapiens
cctggagcagaaagtgcct

SEQ ID NO: 6107507 - DNA, 15 bp, Homo sapiens
cctggagcagaagca

SEQ ID NO: 6107508 - DNA, 21 bp, Homo sapiens
cctggagcagaagcagcaact

SEQ ID NO: 6107509 - DNA, 12 bp, Homo sapiens
cctggagcagag

SEQ ID NO: 6107510 - DNA, 14 bp, Homo sapiens
cctggagcagagga

SEQ ID NO: 6107511 - DNA, 14 bp, Homo sapiens
cctggagcagcagc

SEQ ID NO: 6107512 - DNA, 19 bp, Homo sapiens
cctggagcagcagctgagg

SEQ ID NO: 6107513 - DNA, 17 bp, Homo sapiens
cctggagcagccacccc

SEQ ID NO: 6107514 - DNA, 15 bp, Homo sapiens
cctggagcaggagcc

SEQ ID NO: 6107515 - DNA, 12 bp, Homo sapiens
cctggagcaggc

SEQ ID NO: 6107516 - DNA, 23 bp, Homo sapiens
cctggagcaggcccaatgctgct

SEQ ID NO: 6107517 - DNA, 18 bp, Homo sapiens
cctggagcaggccttgcg

SEQ ID NO: 6107518 - DNA, 19 bp, Homo sapiens
cctggagcaggccttgcgc

SEQ ID NO: 6107519 - DNA, 18 bp, Homo sapiens
cctggagccaactgctgc

SEQ ID NO: 6107520 - DNA, 23 bp, Homo sapiens
cctggagccaatggcccggcccc

SEQ ID NO: 6107521 - DNA, 12 bp, Homo sapiens
cctggagccaga

SEQ ID NO: 6107522 - DNA, 15 bp, Homo sapiens
cctggagccagggca

SEQ ID NO: 6107523 - DNA, 12 bp, Homo sapiens
cctggagccatc

SEQ ID NO: 6107524 - DNA, 17 bp, Homo sapiens
cctggagcccctgggtg

SEQ ID NO: 6107525 - DNA, 22 bp, Homo sapiens
cctggagcccctgtgtgggagg

SEQ ID NO: 6107526 - DNA, 13 bp, Homo sapiens
cctggagcccgct

SEQ ID NO: 6107527 - DNA, 21 bp, Homo sapiens
cctggagcccgcttcaagctc

SEQ ID NO: 6107528 - DNA, 13 bp, Homo sapiens
cctggagccctgg

SEQ ID NO: 6107529 - DNA, 21 bp, Homo sapiens
cctggagccctggagacccca

SEQ ID NO: 6107530 - DNA, 16 bp, Homo sapiens
cctggagccctgttgg

SEQ ID NO: 6107531 - DNA, 22 bp, Homo sapiens
cctggagccctgttggcagctc

SEQ ID NO: 6107532 - DNA, 19 bp, Homo sapiens
cctggagccgtggccgagg

SEQ ID NO: 6107533 - DNA, 15 bp, Homo sapiens
cctggagcctcagca

SEQ ID NO: 6107534 - DNA, 15 bp, Homo sapiens
cctggagcctgggca

SEQ ID NO: 6107535 - DNA, 18 bp, Homo sapiens
cctggagcggagcttgcc

SEQ ID NO: 6107536 - DNA, 14 bp, Homo sapiens
cctggagctcaagc

SEQ ID NO: 6107537 - DNA, 19 bp, Homo sapiens
cctggagctcaagccgtgg

SEQ ID NO: 6107538 - DNA, 21 bp, Homo sapiens
cctggagctcaagccgtggcc

SEQ ID NO: 6107539 - DNA, 15 bp, Homo sapiens
cctggagctcctggg

SEQ ID NO: 6107540 - DNA, 16 bp, Homo sapiens
cctggagctcctggga

SEQ ID NO: 6107541 - DNA, 18 bp, Homo sapiens
cctggagctcctgggaag

SEQ ID NO: 6107542 - DNA, 17 bp, Homo sapiens
cctggagctgaggaatc

SEQ ID NO: 6107543 - DNA, 11 bp, Homo sapiens
cctggagctgt

SEQ ID NO: 6107544 - DNA, 18 bp, Homo sapiens
cctggagcttcagccagg

SEQ ID NO: 6107545 - DNA, 19 bp, Homo sapiens
cctggagcttcagccaggt

SEQ ID NO: 6107546 - DNA, 22 bp, Homo sapiens
cctggagcttcagccaggtctg

SEQ ID NO: 6107547 - DNA, 23 bp, Homo sapiens
cctggagcttcagccaggtctga

SEQ ID NO: 6107548 - DNA, 22 bp, Homo sapiens
cctggaggaaccgaaaggccaa

SEQ ID NO: 6107549 - DNA, 18 bp, Homo sapiens
cctggaggaattcagctc

SEQ ID NO: 6107550 - DNA, 12 bp, Homo sapiens
cctggaggacaa

SEQ ID NO: 6107551 - DNA, 22 bp, Homo sapiens
cctggaggacaaaacagcggga

SEQ ID NO: 6107552 - DNA, 14 bp, Homo sapiens
cctggaggacagag

SEQ ID NO: 6107553 - DNA, 13 bp, Homo sapiens
cctggaggaccag

SEQ ID NO: 6107554 - DNA, 18 bp, Homo sapiens
cctggaggacctgagcct

SEQ ID NO: 6107555 - DNA, 15 bp, Homo sapiens
cctggaggactctag

SEQ ID NO: 6107556 - DNA, 16 bp, Homo sapiens
cctggaggactctaga

SEQ ID NO: 6107557 - DNA, 18 bp, Homo sapiens
cctggaggatccctccat

SEQ ID NO: 6107558 - DNA, 19 bp, Homo sapiens
cctggaggcaaaggcctgg

SEQ ID NO: 6107559 - DNA, 20 bp, Homo sapiens
cctggaggcaaaggcctgga

SEQ ID NO: 6107560 - DNA, 21 bp, Homo sapiens
cctggaggcaaaggcctggac

SEQ ID NO: 6107561 - DNA, 17 bp, Homo sapiens
cctggaggcaagaggga

SEQ ID NO: 6107562 - DNA, 20 bp, Homo sapiens
cctggaggcaagagggaggg

SEQ ID NO: 6107563 - DNA, 15 bp, Homo sapiens
cctggaggcacgcac

SEQ ID NO: 6107564 - DNA, 20 bp, Homo sapiens
cctggaggcacgcaccactg

SEQ ID NO: 6107565 - DNA, 14 bp, Homo sapiens
cctggaggcactga

SEQ ID NO: 6107566 - DNA, 22 bp, Homo sapiens
cctggaggcactgaagtgctta

SEQ ID NO: 6107567 - DNA, 15 bp, Homo sapiens
cctggaggcaggggc

SEQ ID NO: 6107568 - DNA, 16 bp, Homo sapiens
cctggaggcccagttc

SEQ ID NO: 6107569 - DNA, 21 bp, Homo sapiens
cctggaggcggtgcggcaggg

SEQ ID NO: 6107570 - DNA, 22 bp, Homo sapiens
cctggaggctcagcccaccctc

SEQ ID NO: 6107571 - DNA, 15 bp, Homo sapiens
cctggaggctgacac

SEQ ID NO: 6107572 - DNA, 19 bp, Homo sapiens
cctggaggctgcctcccaa

SEQ ID NO: 6107573 - DNA, 19 bp, Homo sapiens
ctaaagccatttgtctgtg

SEQ ID NO: 6107574 - DNA, 17 bp, Homo sapiens
ctaaagcccaacctcct

SEQ ID NO: 6107575 - DNA, 15 bp, Homo sapiens
ctaaagcccattgct

SEQ ID NO: 6107576 - DNA, 16 bp, Homo sapiens
ctaaagcccattgctg

SEQ ID NO: 6107577 - DNA, 19 bp, Homo sapiens
ctaaagcccattgctgcaa

SEQ ID NO: 6107578 - DNA, 14 bp, Homo sapiens
ctaaagcctttatt

SEQ ID NO: 6107579 - DNA, 18 bp, Homo sapiens
ctaaagctaaaaatatta

SEQ ID NO: 6107580 - DNA, 19 bp, Homo sapiens
ctaaaggaaaaaaccatcc

SEQ ID NO: 6107581 - DNA, 20 bp, Homo sapiens
ctaaaggaaacaaagcaata

SEQ ID NO: 6107582 - DNA, 19 bp, Homo sapiens
ctaaaggaaatcaaatgaa

SEQ ID NO: 6107583 - DNA, 21 bp, Homo sapiens
ctaaaggactggttaaatcaa

SEQ ID NO: 6107584 - DNA, 13 bp, Homo sapiens
ctaaaggagttta

SEQ ID NO: 6107585 - DNA, 19 bp, Homo sapiens
ctaaaggatagatcaaagt

SEQ ID NO: 6107586 - DNA, 16 bp, Homo sapiens
ctaaaggatggaaaaa

SEQ ID NO: 6107587 - DNA, 18 bp, Homo sapiens
ctaaaggatggaaaaata

SEQ ID NO: 6107588 - DNA, 19 bp, Homo sapiens
ctaaaggatggaaaaataa

SEQ ID NO: 6107589 - DNA, 18 bp, Homo sapiens
ctaaaggcatccttgtct

SEQ ID NO: 6107590 - DNA, 23 bp, Homo sapiens
ctaaaggcatccttgtcttttga

SEQ ID NO: 6107591 - DNA, 23 bp, Homo sapiens
ctaaaggctaaacatatggcttt

SEQ ID NO: 6107592 - DNA, 16 bp, Homo sapiens
ctaaaggctacctttg

SEQ ID NO: 6107593 - DNA, 16 bp, Homo sapiens
ctaaagggaccatctg

SEQ ID NO: 6107594 - DNA, 19 bp, Homo sapiens
ctaaagggaccatctgctg

SEQ ID NO: 6107595 - DNA, 23 bp, Homo sapiens
ctaaagggaccatctgctgcagt

SEQ ID NO: 6107596 - DNA, 19 bp, Homo sapiens
ctaaagggactacctctgt

SEQ ID NO: 6107597 - DNA, 22 bp, Homo sapiens
ctaaagggactacctctgtgcc

SEQ ID NO: 6107598 - DNA, 14 bp, Homo sapiens
ctaaagggagaaat

SEQ ID NO: 6107599 - DNA, 18 bp, Homo sapiens
ctaaagggagaaatgcca

SEQ ID NO: 6107600 - DNA, 19 bp, Homo sapiens
ctaaagggagaaggaaggg

SEQ ID NO: 6107601 - DNA, 17 bp, Homo sapiens
ctaaagggatctgctta

SEQ ID NO: 6107602 - DNA, 22 bp, Homo sapiens
ctaaaggggacagatcttgagc

SEQ ID NO: 6107603 - DNA, 16 bp, Homo sapiens
ctaaaggggagaaact

SEQ ID NO: 6107604 - DNA, 17 bp, Homo sapiens
ctaaaggggagaaactg

SEQ ID NO: 6107605 - DNA, 19 bp, Homo sapiens
ctaaagggtgtgggtcagg

SEQ ID NO: 6107606 - DNA, 15 bp, Homo sapiens
ctaaaggtccacagg

SEQ ID NO: 6107607 - DNA, 20 bp, Homo sapiens
ctaaaggtccacaggtctag

SEQ ID NO: 6107608 - DNA, 21 bp, Homo sapiens
ctaaaggtccacaggtctaga

SEQ ID NO: 6107609 - DNA, 11 bp, Homo sapiens
ctaaaggtgct

SEQ ID NO: 6107610 - DNA, 22 bp, Homo sapiens
ctaaaggtgtaagacttcagat

SEQ ID NO: 6107611 - DNA, 23 bp, Homo sapiens
ctaaagtaaaaacaaagaaatta

SEQ ID NO: 6107612 - DNA, 14 bp, Homo sapiens
ctaaagtaattggt

SEQ ID NO: 6107613 - DNA, 17 bp, Homo sapiens
ctaaagtacagcctgga

SEQ ID NO: 6107614 - DNA, 20 bp, Homo sapiens
ctaaagtactgagcagtgat

SEQ ID NO: 6107615 - DNA, 15 bp, Homo sapiens
ctaaagtagagccct

SEQ ID NO: 6107616 - DNA, 18 bp, Homo sapiens
ctaaagtatacaactgcc

SEQ ID NO: 6107617 - DNA, 16 bp, Homo sapiens
ctaaagtatgtaaagt

SEQ ID NO: 6107618 - DNA, 19 bp, Homo sapiens
ctaaagtcatccagtgaaa

SEQ ID NO: 6107619 - DNA, 18 bp, Homo sapiens
ctaaagtccctatagtat

SEQ ID NO: 6107620 - DNA, 20 bp, Homo sapiens
ctaaagtcttcctattgtac

SEQ ID NO: 6107621 - DNA, 19 bp, Homo sapiens
ctaaagtgatcctaaatat

SEQ ID NO: 6107622 - DNA, 9 bp, Homo sapiens
ctaaagtgt

SEQ ID NO: 6107623 - DNA, 20 bp, Homo sapiens
ctaaagtgtattttcagagc

SEQ ID NO: 6107624 - DNA, 19 bp, Homo sapiens
ctaaagtgtgctttataaa

SEQ ID NO: 6107625 - DNA, 22 bp, Homo sapiens
ctaaagtgtgctttataaaaaa

SEQ ID NO: 6107626 - DNA, 19 bp, Homo sapiens
ctaaagtgtgttgttgctt

SEQ ID NO: 6107627 - DNA, 18 bp, Homo sapiens
ctaaagttactactgatt

SEQ ID NO: 6107628 - DNA, 11 bp, Homo sapiens
ctaaagttata

SEQ ID NO: 6107629 - DNA, 16 bp, Homo sapiens
ctaaagttatatttca

SEQ ID NO: 6107630 - DNA, 12 bp, Homo sapiens
ctaaagttctaa

SEQ ID NO: 6107631 - DNA, 13 bp, Homo sapiens
ctaaagttctaag

SEQ ID NO: 6107632 - DNA, 15 bp, Homo sapiens
ctaaagttgaaaata

SEQ ID NO: 6107633 - DNA, 19 bp, Homo sapiens
ctaaagttgtactttaaaa

SEQ ID NO: 6107634 - DNA, 14 bp, Homo sapiens
ctaaagttgtagtg

SEQ ID NO: 6107635 - DNA, 13 bp, Homo sapiens
ctaaagtttacag

SEQ ID NO: 6107636 - DNA, 24 bp, Homo sapiens
ctaaagtttacagtaaataaattg

SEQ ID NO: 6107637 - DNA, 17 bp, Homo sapiens
ctaaagttttcttccca

SEQ ID NO: 6107638 - DNA, 14 bp, Homo sapiens
ctaaataaaaatat

SEQ ID NO: 6107639 - DNA, 18 bp, Homo sapiens
ctaaataaaaatatgtaa

SEQ ID NO: 6107640 - DNA, 17 bp, Homo sapiens
ctaaataaaatataatt

SEQ ID NO: 6107641 - DNA, 13 bp, Homo sapiens
ctaaataaaatgc

SEQ ID NO: 6107642 - DNA, 21 bp, Homo sapiens
ctaaataaaatgctaggttct

SEQ ID NO: 6107643 - DNA, 20 bp, Homo sapiens
ctaaataaaatttgttgcat

SEQ ID NO: 6107644 - DNA, 22 bp, Homo sapiens
ctaaataaacacatagattcac

SEQ ID NO: 6107645 - DNA, 19 bp, Homo sapiens
ctaaataaacagatgtatt

SEQ ID NO: 6107646 - DNA, 24 bp, Homo sapiens
ctaaataaacagatgtattatgct

SEQ ID NO: 6107647 - DNA, 14 bp, Homo sapiens
ctaaataaagagga

SEQ ID NO: 6107648 - DNA, 16 bp, Homo sapiens
ctaaataaagatattg

SEQ ID NO: 6107649 - DNA, 21 bp, Homo sapiens
ctaaataaatgtaatagccaa

SEQ ID NO: 6107650 - DNA, 22 bp, Homo sapiens
ctaaataaatgtaatagccaaa

SEQ ID NO: 6107651 - DNA, 11 bp, Homo sapiens
ctaaataaatt

SEQ ID NO: 6107652 - DNA, 21 bp, Homo sapiens
ctaaataacttgccatttctt

SEQ ID NO: 6107653 - DNA, 21 bp, Homo sapiens
ctaaataatcttactctagat

SEQ ID NO: 6107654 - DNA, 16 bp, Homo sapiens
ctaaataatggcctgg

SEQ ID NO: 6107655 - DNA, 16 bp, Homo sapiens
ctaaatactgtacata

SEQ ID NO: 6107656 - DNA, 20 bp, Homo sapiens
ctaaatagatttttagattc

SEQ ID NO: 6107657 - DNA, 14 bp, Homo sapiens
ctaaatagcatgta

SEQ ID NO: 6107658 - DNA, 22 bp, Homo sapiens
ctaaatagcatgtattgtgtct

SEQ ID NO: 6107659 - DNA, 23 bp, Homo sapiens
ctaaatagcatgtattgtgtctt

SEQ ID NO: 6107660 - DNA, 23 bp, Homo sapiens
ctaaatagcccagatcccaagag

SEQ ID NO: 6107661 - DNA, 14 bp, Homo sapiens
ctaaatagtatttt

SEQ ID NO: 6107662 - DNA, 13 bp, Homo sapiens
ctaaatataaatt

SEQ ID NO: 6107663 - DNA, 13 bp, Homo sapiens
ctaaatatatgtc

SEQ ID NO: 6107664 - DNA, 17 bp, Homo sapiens
ctaaatatattttaaga

SEQ ID NO: 6107665 - DNA, 19 bp, Homo sapiens
ctaaatatccaaagactgt

SEQ ID NO: 6107666 - DNA, 21 bp, Homo sapiens
ctaaatatccaaagactgtac

SEQ ID NO: 6107667 - DNA, 22 bp, Homo sapiens
ctaaatatctagtgctaaacct

SEQ ID NO: 6107668 - DNA, 15 bp, Homo sapiens
ctaaatatgaatgaa

SEQ ID NO: 6107669 - DNA, 12 bp, Homo sapiens
ctaaatattatg

SEQ ID NO: 6107670 - DNA, 13 bp, Homo sapiens
ctaaatattatgc

SEQ ID NO: 6107671 - DNA, 23 bp, Homo sapiens
ctaaatattcagaatctttgtta

SEQ ID NO: 6107672 - DNA, 15 bp, Homo sapiens
ctaaatattgtttac

SEQ ID NO: 6107673 - DNA, 13 bp, Homo sapiens
ctaaatatttcct

SEQ ID NO: 6107674 - DNA, 15 bp, Homo sapiens
ctaaatatttcctta

SEQ ID NO: 6107675 - DNA, 22 bp, Homo sapiens
ctaaatatttccttaaactgtg

SEQ ID NO: 6107676 - DNA, 12 bp, Homo sapiens
ctaaatatttct

SEQ ID NO: 6107677 - DNA, 13 bp, Homo sapiens
ctaaatatttctt

SEQ ID NO: 6107678 - DNA, 14 bp, Homo sapiens
ctaaatattttcaa

SEQ ID NO: 6107679 - DNA, 19 bp, Homo sapiens
ctaaatattttcaagaaaa

SEQ ID NO: 6107680 - DNA, 13 bp, Homo sapiens
ctaaatcacttta

SEQ ID NO: 6107681 - DNA, 22 bp, Homo sapiens
ctaaatcagaaataggaagatt

SEQ ID NO: 6107682 - DNA, 19 bp, Homo sapiens
ctaaatcagagacaaaata

SEQ ID NO: 6107683 - DNA, 23 bp, Homo sapiens
ctaaatcctcactatttttttgt

SEQ ID NO: 6107684 - DNA, 12 bp, Homo sapiens
ctaaatctattt

SEQ ID NO: 6107685 - DNA, 16 bp, Homo sapiens
ctaaatctatttatta

SEQ ID NO: 6107686 - DNA, 21 bp, Homo sapiens
ctaaatctatttattaatatt

SEQ ID NO: 6107687 - DNA, 17 bp, Homo sapiens
ctaaatctccagtactt

SEQ ID NO: 6107688 - DNA, 17 bp, Homo sapiens
ctaaatctcctattttt

SEQ ID NO: 6107689 - DNA, 22 bp, Homo sapiens
ctaaatctgtaagctctttgaa

SEQ ID NO: 6107690 - DNA, 18 bp, Homo sapiens
ctaaatcttccttgtgag

SEQ ID NO: 6107691 - DNA, 20 bp, Homo sapiens
ctaaatcttttataggattt

SEQ ID NO: 6107692 - DNA, 21 bp, Homo sapiens
ctaaatgaaaagagaattact

SEQ ID NO: 6107693 - DNA, 19 bp, Homo sapiens
ctaaatgaaagtggtaatc

SEQ ID NO: 6107694 - DNA, 13 bp, Homo sapiens
ctaaatgaagaga

SEQ ID NO: 6107695 - DNA, 12 bp, Homo sapiens
ctaaatgaatgt

SEQ ID NO: 6107696 - DNA, 16 bp, Homo sapiens
ctaaatgaatgtttac

SEQ ID NO: 6107697 - DNA, 19 bp, Homo sapiens
ctaaatgagctaaataagt

SEQ ID NO: 6107698 - DNA, 23 bp, Homo sapiens
ctaaatgagctcctgcgggagta

SEQ ID NO: 6107699 - DNA, 16 bp, Homo sapiens
ctaaatgataaatgta

SEQ ID NO: 6107700 - DNA, 16 bp, Homo sapiens
ctaaatgatggtgctt

SEQ ID NO: 6107701 - DNA, 15 bp, Homo sapiens
ctaaatgattatctt

SEQ ID NO: 6107702 - DNA, 21 bp, Homo sapiens
ctaaatgcaaacactgtgtat

SEQ ID NO: 6107703 - DNA, 23 bp, Homo sapiens
ctaaatgcaataagatttagttg

SEQ ID NO: 6107704 - DNA, 20 bp, Homo sapiens
ctaaatgcaccaagaaagct

SEQ ID NO: 6107705 - DNA, 21 bp, Homo sapiens
ctaaatgcagacaacaccttc

SEQ ID NO: 6107706 - DNA, 12 bp, Homo sapiens
ctaaatgcccag

SEQ ID NO: 6107707 - DNA, 15 bp, Homo sapiens
ctaaatgcccagttc

SEQ ID NO: 6107708 - DNA, 14 bp, Homo sapiens
ctaaatgccctgct

SEQ ID NO: 6107709 - DNA, 21 bp, Homo sapiens
ctaaatgcctagtttttagta

SEQ ID NO: 6107710 - DNA, 13 bp, Homo sapiens
ctaaatgctggtc

SEQ ID NO: 6107711 - DNA, 19 bp, Homo sapiens
ctaaatgctgttcttacac

SEQ ID NO: 6107712 - DNA, 15 bp, Homo sapiens
ctaaatggaaccact

SEQ ID NO: 6107713 - DNA, 17 bp, Homo sapiens
ctaaatggaaccactct

SEQ ID NO: 6107714 - DNA, 18 bp, Homo sapiens
ctaaatggagaaagctgt

SEQ ID NO: 6107715 - DNA, 21 bp, Homo sapiens
ctaaatggcagtgagatgtca

SEQ ID NO: 6107716 - DNA, 19 bp, Homo sapiens
ctaaatggcctcatgtggc

SEQ ID NO: 6107717 - DNA, 20 bp, Homo sapiens
ctaaatggcctctctccact

SEQ ID NO: 6107718 - DNA, 19 bp, Homo sapiens
ctaaatggtcgcccaggag

SEQ ID NO: 6107719 - DNA, 15 bp, Homo sapiens
ctaaatggtgctgca

SEQ ID NO: 6107720 - DNA, 19 bp, Homo sapiens
ctaaatggtgctgcagatt

SEQ ID NO: 6107721 - DNA, 15 bp, Homo sapiens
ctaaatggtgttaca

SEQ ID NO: 6107722 - DNA, 13 bp, Homo sapiens
ctaaatgtaaaat

SEQ ID NO: 6107723 - DNA, 17 bp, Homo sapiens
ctaaatgtaaaatttgg

SEQ ID NO: 6107724 - DNA, 15 bp, Homo sapiens
ctaaatgtaacagtc

SEQ ID NO: 6107725 - DNA, 17 bp, Homo sapiens
ctaaatgtaagaatcat

SEQ ID NO: 6107726 - DNA, 22 bp, Homo sapiens
ctaaatgtaagaatcattgtaa

SEQ ID NO: 6107727 - DNA, 15 bp, Homo sapiens
ctaaatgttaaagat

SEQ ID NO: 6107728 - DNA, 24 bp, Homo sapiens
ctaaatgttaactacatattgtct

SEQ ID NO: 6107729 - DNA, 18 bp, Homo sapiens
ctaaatgttggaattttc

SEQ ID NO: 6107730 - DNA, 12 bp, Homo sapiens
ctaaatgtttct

SEQ ID NO: 6107731 - DNA, 17 bp, Homo sapiens
ctaaattaaaaaagaaa

SEQ ID NO: 6107732 - DNA, 19 bp, Homo sapiens
ctaaattaacaaattcagt

SEQ ID NO: 6107733 - DNA, 18 bp, Homo sapiens
ctaaattacagtgcagtt

SEQ ID NO: 6107734 - DNA, 15 bp, Homo sapiens
ctaaattagataaat

SEQ ID NO: 6107735 - DNA, 16 bp, Homo sapiens
ctaaattagtttaaaa

SEQ ID NO: 6107736 - DNA, 19 bp, Homo sapiens
ctaaattattagcatttgt

SEQ ID NO: 6107737 - DNA, 17 bp, Homo sapiens
ctaaattctatgttaaa

SEQ ID NO: 6107738 - DNA, 19 bp, Homo sapiens
ctaaattctttatttctgt

SEQ ID NO: 6107739 - DNA, 21 bp, Homo sapiens
ctaaattctttatttctgtca

SEQ ID NO: 6107740 - DNA, 16 bp, Homo sapiens
ctaaattgaatacaca

SEQ ID NO: 6107741 - DNA, 17 bp, Homo sapiens
ctaaattgatgttgatg

SEQ ID NO: 6107742 - DNA, 13 bp, Homo sapiens
ctaaattgattga

SEQ ID NO: 6107743 - DNA, 15 bp, Homo sapiens
ctaaattgcagttta

SEQ ID NO: 6107744 - DNA, 15 bp, Homo sapiens
ctaaatttaaattta

SEQ ID NO: 6107745 - DNA, 13 bp, Homo sapiens
ctaaatttaatgc

SEQ ID NO: 6107746 - DNA, 17 bp, Homo sapiens
ctaaatttaatgctgcc

SEQ ID NO: 6107747 - DNA, 18 bp, Homo sapiens
ctaaatttaattacctta

SEQ ID NO: 6107748 - DNA, 18 bp, Homo sapiens
ctaaatttatattcataa

SEQ ID NO: 6107749 - DNA, 18 bp, Homo sapiens
ctaaatttattatttaaa

SEQ ID NO: 6107750 - DNA, 13 bp, Homo sapiens
ctaaatttcacaa

SEQ ID NO: 6107751 - DNA, 15 bp, Homo sapiens
cctggaggctggatg

SEQ ID NO: 6107752 - DNA, 21 bp, Homo sapiens
cctggagggaagagtggaggt

SEQ ID NO: 6107753 - DNA, 22 bp, Homo sapiens
cctggagggaagagtggaggtg

SEQ ID NO: 6107754 - DNA, 15 bp, Homo sapiens
cctggagggaaggac

SEQ ID NO: 6107755 - DNA, 14 bp, Homo sapiens
cctggagggaggct

SEQ ID NO: 6107756 - DNA, 14 bp, Homo sapiens
cctggagggatgcc

SEQ ID NO: 6107757 - DNA, 17 bp, Homo sapiens
cctggagggcaagccct

SEQ ID NO: 6107758 - DNA, 20 bp, Homo sapiens
cctggagggcacttcctcca

SEQ ID NO: 6107759 - DNA, 12 bp, Homo sapiens
cctggagggcgc

SEQ ID NO: 6107760 - DNA, 22 bp, Homo sapiens
cctggagggcgcccagcagcct

SEQ ID NO: 6107761 - DNA, 23 bp, Homo sapiens
cctggagggcgcccagcagcctg

SEQ ID NO: 6107762 - DNA, 22 bp, Homo sapiens
cctggagggctagaacctggag

SEQ ID NO: 6107763 - DNA, 14 bp, Homo sapiens
cctggaggggagag

SEQ ID NO: 6107764 - DNA, 22 bp, Homo sapiens
cctggaggggcccatgtgggct

SEQ ID NO: 6107765 - DNA, 21 bp, Homo sapiens
cctggaggggctagaacctag

SEQ ID NO: 6107766 - DNA, 19 bp, Homo sapiens
cctggaggggctggggact

SEQ ID NO: 6107767 - DNA, 21 bp, Homo sapiens
cctggagggggaatggcagca

SEQ ID NO: 6107768 - DNA, 20 bp, Homo sapiens
cctggagggggagcaccagc

SEQ ID NO: 6107769 - DNA, 19 bp, Homo sapiens
cctggagggtaactggggg

SEQ ID NO: 6107770 - DNA, 20 bp, Homo sapiens
cctggagggtaactgggggg

SEQ ID NO: 6107771 - DNA, 23 bp, Homo sapiens
cctggagggttgatatattcttt

SEQ ID NO: 6107772 - DNA, 16 bp, Homo sapiens
cctggaggtctccagg

SEQ ID NO: 6107773 - DNA, 12 bp, Homo sapiens
cctggaggtctg

SEQ ID NO: 6107774 - DNA, 13 bp, Homo sapiens
cctggaggtctga

SEQ ID NO: 6107775 - DNA, 17 bp, Homo sapiens
cctggaggtctgaaaag

SEQ ID NO: 6107776 - DNA, 16 bp, Homo sapiens
cctggaggtctggctg

SEQ ID NO: 6107777 - DNA, 20 bp, Homo sapiens
cctggaggtctggctgagcc

SEQ ID NO: 6107778 - DNA, 14 bp, Homo sapiens
cctggaggtggctg

SEQ ID NO: 6107779 - DNA, 16 bp, Homo sapiens
cctggaggttccccag

SEQ ID NO: 6107780 - DNA, 16 bp, Homo sapiens
cctggagtaggcctgg

SEQ ID NO: 6107781 - DNA, 15 bp, Homo sapiens
cctggagtataatat

SEQ ID NO: 6107782 - DNA, 19 bp, Homo sapiens
cctggagtatttggaagca

SEQ ID NO: 6107783 - DNA, 16 bp, Homo sapiens
cctggagtcagtagcc

SEQ ID NO: 6107784 - DNA, 22 bp, Homo sapiens
cctggagtcggatctagccatg

SEQ ID NO: 6107785 - DNA, 18 bp, Homo sapiens
cctggagtctgaagcctg

SEQ ID NO: 6107786 - DNA, 23 bp, Homo sapiens
cctggagtctgaagcctgcaggt

SEQ ID NO: 6107787 - DNA, 18 bp, Homo sapiens
cctggagtgccctgcagg

SEQ ID NO: 6107788 - DNA, 15 bp, Homo sapiens
cctggagtgctgtgc

SEQ ID NO: 6107789 - DNA, 12 bp, Homo sapiens
cctggagtggca

SEQ ID NO: 6107790 - DNA, 18 bp, Homo sapiens
cctggagtggcatggtcc

SEQ ID NO: 6107791 - DNA, 22 bp, Homo sapiens
cctggagtgtcggatcctgtga

SEQ ID NO: 6107792 - DNA, 23 bp, Homo sapiens
cctggagtgtcggatcctgtgag

SEQ ID NO: 6107793 - DNA, 20 bp, Homo sapiens
cctggagtgtgtcagagccc

SEQ ID NO: 6107794 - DNA, 15 bp, Homo sapiens
cctggagttctggtt

SEQ ID NO: 6107795 - DNA, 17 bp, Homo sapiens
cctggagttgttttcgg

SEQ ID NO: 6107796 - DNA, 13 bp, Homo sapiens
cctggatagcctt

SEQ ID NO: 6107797 - DNA, 16 bp, Homo sapiens
cctggatagccttgaa

SEQ ID NO: 6107798 - DNA, 21 bp, Homo sapiens
cctggatagccttgaaaacaa

SEQ ID NO: 6107799 - DNA, 19 bp, Homo sapiens
cctggatagttaagggctt

SEQ ID NO: 6107800 - DNA, 21 bp, Homo sapiens
cctggatataaattaattgtg

SEQ ID NO: 6107801 - DNA, 22 bp, Homo sapiens
cctggatcacgacgctgcagag

SEQ ID NO: 6107802 - DNA, 23 bp, Homo sapiens
cctggatcacgacgctgcagagc

SEQ ID NO: 6107803 - DNA, 18 bp, Homo sapiens
cctggatcagcgtggcct

SEQ ID NO: 6107804 - DNA, 20 bp, Homo sapiens
cctggatcagcgtggccttg

SEQ ID NO: 6107805 - DNA, 15 bp, Homo sapiens
cctggatccagcact

SEQ ID NO: 6107806 - DNA, 17 bp, Homo sapiens
cctggatccagcactgg

SEQ ID NO: 6107807 - DNA, 20 bp, Homo sapiens
cctggatccagctctgggag

SEQ ID NO: 6107808 - DNA, 15 bp, Homo sapiens
cctggatccatcctg

SEQ ID NO: 6107809 - DNA, 19 bp, Homo sapiens
cctggatccatcctgctag

SEQ ID NO: 6107810 - DNA, 20 bp, Homo sapiens
cctggatcctcacactacag

SEQ ID NO: 6107811 - DNA, 22 bp, Homo sapiens
cctggatctaccagcataaata

SEQ ID NO: 6107812 - DNA, 20 bp, Homo sapiens
cctggatctatccctgcggc

SEQ ID NO: 6107813 - DNA, 16 bp, Homo sapiens
cctggatgacattaaa

SEQ ID NO: 6107814 - DNA, 14 bp, Homo sapiens
cctggatgatacta

SEQ ID NO: 6107815 - DNA, 19 bp, Homo sapiens
cctggatgcacagtgcctg

SEQ ID NO: 6107816 - DNA, 13 bp, Homo sapiens
cctggatgcagcc

SEQ ID NO: 6107817 - DNA, 13 bp, Homo sapiens
cctggatgccaag

SEQ ID NO: 6107818 - DNA, 21 bp, Homo sapiens
cctggatgccaaggagcccct

SEQ ID NO: 6107819 - DNA, 13 bp, Homo sapiens
cctggatgccagc

SEQ ID NO: 6107820 - DNA, 19 bp, Homo sapiens
cctggatgccagctgtgtc

SEQ ID NO: 6107821 - DNA, 20 bp, Homo sapiens
cctggatgccagctgtgtcc

SEQ ID NO: 6107822 - DNA, 14 bp, Homo sapiens
cctggatgccatcc

SEQ ID NO: 6107823 - DNA, 14 bp, Homo sapiens
cctggatgcccagg

SEQ ID NO: 6107824 - DNA, 16 bp, Homo sapiens
cctggatgccccctgt

SEQ ID NO: 6107825 - DNA, 20 bp, Homo sapiens
cctggatggatctgctccat

SEQ ID NO: 6107826 - DNA, 13 bp, Homo sapiens
cctggatggcccc

SEQ ID NO: 6107827 - DNA, 19 bp, Homo sapiens
cctggatggcccctccttg

SEQ ID NO: 6107828 - DNA, 18 bp, Homo sapiens
cctggatggcctctgggg

SEQ ID NO: 6107829 - DNA, 16 bp, Homo sapiens
cctggatgggcattgg

SEQ ID NO: 6107830 - DNA, 17 bp, Homo sapiens
cctggatgggcattggg

SEQ ID NO: 6107831 - DNA, 21 bp, Homo sapiens
cctggatgggcattgggctga

SEQ ID NO: 6107832 - DNA, 13 bp, Homo sapiens
cctggatggggca

SEQ ID NO: 6107833 - DNA, 18 bp, Homo sapiens
cctggatggggctgcacc

SEQ ID NO: 6107834 - DNA, 14 bp, Homo sapiens
cctggatggtggcc

SEQ ID NO: 6107835 - DNA, 20 bp, Homo sapiens
cctggatgtgaagctcacac

SEQ ID NO: 6107836 - DNA, 18 bp, Homo sapiens
cctggatgtgtggggcat

SEQ ID NO: 6107837 - DNA, 20 bp, Homo sapiens
cctggatgtgtggggcatgg

SEQ ID NO: 6107838 - DNA, 17 bp, Homo sapiens
cctggatgttgtgtgta

SEQ ID NO: 6107839 - DNA, 14 bp, Homo sapiens
cctggattaggagg

SEQ ID NO: 6107840 - DNA, 14 bp, Homo sapiens
cctggattcatttc

SEQ ID NO: 6107841 - DNA, 17 bp, Homo sapiens
cctggattcatttcctg

SEQ ID NO: 6107842 - DNA, 20 bp, Homo sapiens
cctggattcatttcctgccc

SEQ ID NO: 6107843 - DNA, 15 bp, Homo sapiens
cctggattccagcag

SEQ ID NO: 6107844 - DNA, 23 bp, Homo sapiens
cctggattccagcagtgaatgct

SEQ ID NO: 6107845 - DNA, 23 bp, Homo sapiens
cctggattgcgcctaatgtgttt

SEQ ID NO: 6107846 - DNA, 21 bp, Homo sapiens
cctggatttatagtatgtgac

SEQ ID NO: 6107847 - DNA, 22 bp, Homo sapiens
cctggatttatagtatgtgact

SEQ ID NO: 6107848 - DNA, 21 bp, Homo sapiens
cctggatttctggttctgatg

SEQ ID NO: 6107849 - DNA, 20 bp, Homo sapiens
cctggatttgagtcttggtg

SEQ ID NO: 6107850 - DNA, 13 bp, Homo sapiens
cctggattttctt

SEQ ID NO: 6107851 - DNA, 16 bp, Homo sapiens
cctggatttttaccag

SEQ ID NO: 6107852 - DNA, 19 bp, Homo sapiens
cctggcaaagggagcagaa

SEQ ID NO: 6107853 - DNA, 19 bp, Homo sapiens
cctggcaaatgcctgactc

SEQ ID NO: 6107854 - DNA, 21 bp, Homo sapiens
cctggcaaatgcctgactcag

SEQ ID NO: 6107855 - DNA, 15 bp, Homo sapiens
cctggcaactgctga

SEQ ID NO: 6107856 - DNA, 17 bp, Homo sapiens
cctggcaactgctgatc

SEQ ID NO: 6107857 - DNA, 23 bp, Homo sapiens
cctggcaagaaagcttgagtctc

SEQ ID NO: 6107858 - DNA, 21 bp, Homo sapiens
cctggcaagctagaacctgga

SEQ ID NO: 6107859 - DNA, 21 bp, Homo sapiens
cctggcaatagtgtgttctga

SEQ ID NO: 6107860 - DNA, 19 bp, Homo sapiens
cctggcacagaaagggcag

SEQ ID NO: 6107861 - DNA, 20 bp, Homo sapiens
cctggcacagaaagggcagc

SEQ ID NO: 6107862 - DNA, 18 bp, Homo sapiens
cctggcacagaagaggag

SEQ ID NO: 6107863 - DNA, 15 bp, Homo sapiens
cctggcacaggactg

SEQ ID NO: 6107864 - DNA, 18 bp, Homo sapiens
cctggcacaggactgatt

SEQ ID NO: 6107865 - DNA, 20 bp, Homo sapiens
cctggcacaggccgaggcag

SEQ ID NO: 6107866 - DNA, 16 bp, Homo sapiens
cctggcacagggcagt

SEQ ID NO: 6107867 - DNA, 13 bp, Homo sapiens
cctggcacagtgt

SEQ ID NO: 6107868 - DNA, 19 bp, Homo sapiens
cctggcacattgcccctct

SEQ ID NO: 6107869 - DNA, 18 bp, Homo sapiens
cctggcacatttcaggga

SEQ ID NO: 6107870 - DNA, 19 bp, Homo sapiens
cctggcacatttcagggag

SEQ ID NO: 6107871 - DNA, 21 bp, Homo sapiens
cctggcacatttcagggagaa

SEQ ID NO: 6107872 - DNA, 15 bp, Homo sapiens
cctggcacccaccgt

SEQ ID NO: 6107873 - DNA, 16 bp, Homo sapiens
cctggcacccaccgtc

SEQ ID NO: 6107874 - DNA, 19 bp, Homo sapiens
cctggcacccggcccctgc

SEQ ID NO: 6107875 - DNA, 20 bp, Homo sapiens
cctggcacccggcccctgct

SEQ ID NO: 6107876 - DNA, 23 bp, Homo sapiens
cctggcacccggcccctgctggt

SEQ ID NO: 6107877 - DNA, 20 bp, Homo sapiens
cctggcaccgttatccctgc

SEQ ID NO: 6107878 - DNA, 22 bp, Homo sapiens
cctggcacggtggctcaggcct

SEQ ID NO: 6107879 - DNA, 16 bp, Homo sapiens
cctggcacgtcctcca

SEQ ID NO: 6107880 - DNA, 17 bp, Homo sapiens
cctggcacgtcctccac

SEQ ID NO: 6107881 - DNA, 19 bp, Homo sapiens
cctggcacgtcctccaccg

SEQ ID NO: 6107882 - DNA, 22 bp, Homo sapiens
cctggcactataatgtaagctc

SEQ ID NO: 6107883 - DNA, 12 bp, Homo sapiens
cctggcactgct

SEQ ID NO: 6107884 - DNA, 17 bp, Homo sapiens
cctggcactgctgtgct

SEQ ID NO: 6107885 - DNA, 13 bp, Homo sapiens
cctggcactgctt

SEQ ID NO: 6107886 - DNA, 17 bp, Homo sapiens
cctggcactgcttccag

SEQ ID NO: 6107887 - DNA, 20 bp, Homo sapiens
cctggcactgcttccagtga

SEQ ID NO: 6107888 - DNA, 22 bp, Homo sapiens
cctggcactggcaaacagggcc

SEQ ID NO: 6107889 - DNA, 18 bp, Homo sapiens
cctggcactgggaggcag

SEQ ID NO: 6107890 - DNA, 19 bp, Homo sapiens
cctggcactgggaggcagg

SEQ ID NO: 6107891 - DNA, 23 bp, Homo sapiens
cctggcagaactgagctcctctg

SEQ ID NO: 6107892 - DNA, 13 bp, Homo sapiens
cctggcagaatgc

SEQ ID NO: 6107893 - DNA, 17 bp, Homo sapiens
cctggcagatgggggcc

SEQ ID NO: 6107894 - DNA, 21 bp, Homo sapiens
cctggcagcacagcccagggc

SEQ ID NO: 6107895 - DNA, 19 bp, Homo sapiens
cctggcagcagcaggtgtg

SEQ ID NO: 6107896 - DNA, 11 bp, Homo sapiens
cctggcagccc

SEQ ID NO: 6107897 - DNA, 17 bp, Homo sapiens
cctggcagcccagagac

SEQ ID NO: 6107898 - DNA, 12 bp, Homo sapiens
cctggcagcccc

SEQ ID NO: 6107899 - DNA, 16 bp, Homo sapiens
cctggcagcccctgtt

SEQ ID NO: 6107900 - DNA, 22 bp, Homo sapiens
cctggcagcccgcatcagctgc

SEQ ID NO: 6107901 - DNA, 19 bp, Homo sapiens
cctggcagccgtgccttca

SEQ ID NO: 6107902 - DNA, 21 bp, Homo sapiens
cctggcagccgtgccttcagc

SEQ ID NO: 6107903 - DNA, 12 bp, Homo sapiens
cctggcagcctg

SEQ ID NO: 6107904 - DNA, 12 bp, Homo sapiens
cctggcagctct

SEQ ID NO: 6107905 - DNA, 15 bp, Homo sapiens
cctggcagctctgga

SEQ ID NO: 6107906 - DNA, 20 bp, Homo sapiens
cctggcagctctggacagcc

SEQ ID NO: 6107907 - DNA, 12 bp, Homo sapiens
cctggcagctgc

SEQ ID NO: 6107908 - DNA, 14 bp, Homo sapiens
cctggcagctgccc

SEQ ID NO: 6107909 - DNA, 18 bp, Homo sapiens
cctggcagctgcccctcc

SEQ ID NO: 6107910 - DNA, 20 bp, Homo sapiens
cctggcagctgcccctcctg

SEQ ID NO: 6107911 - DNA, 15 bp, Homo sapiens
cctggcagctggacc

SEQ ID NO: 6107912 - DNA, 12 bp, Homo sapiens
cctggcaggcca

SEQ ID NO: 6107913 - DNA, 13 bp, Homo sapiens
cctggcaggccag

SEQ ID NO: 6107914 - DNA, 15 bp, Homo sapiens
cctggcaggccagtg

SEQ ID NO: 6107915 - DNA, 22 bp, Homo sapiens
cctggcaggccctgcccagcca

SEQ ID NO: 6107916 - DNA, 19 bp, Homo sapiens
cctggcagggacctgagag

SEQ ID NO: 6107917 - DNA, 23 bp, Homo sapiens
cctggcagggaggtcaggccctg

SEQ ID NO: 6107918 - DNA, 14 bp, Homo sapiens
cctggcagggccac

SEQ ID NO: 6107919 - DNA, 17 bp, Homo sapiens
cctggcagggctcacac

SEQ ID NO: 6107920 - DNA, 23 bp, Homo sapiens
cctggcagggctcacactcctgg

SEQ ID NO: 6107921 - DNA, 22 bp, Homo sapiens
cctggcagggggtgaaggcagg

SEQ ID NO: 6107922 - DNA, 23 bp, Homo sapiens
cctggcagggggtgaaggcagga

SEQ ID NO: 6107923 - DNA, 15 bp, Homo sapiens
cctggcaggtcccct

SEQ ID NO: 6107924 - DNA, 12 bp, Homo sapiens
cctggcaggtgg

SEQ ID NO: 6107925 - DNA, 14 bp, Homo sapiens
cctggcagtgacct

SEQ ID NO: 6107926 - DNA, 23 bp, Homo sapiens
cctggcagttgaacagagggaga

SEQ ID NO: 6107927 - DNA, 13 bp, Homo sapiens
cctggcatagagt

SEQ ID NO: 6107928 - DNA, 14 bp, Homo sapiens
ctaaatttctcagt

SEQ ID NO: 6107929 - DNA, 16 bp, Homo sapiens
ctaaatttctgccaag

SEQ ID NO: 6107930 - DNA, 13 bp, Homo sapiens
ctaaatttcttct

SEQ ID NO: 6107931 - DNA, 23 bp, Homo sapiens
ctaaatttgaatgttaagcagat

SEQ ID NO: 6107932 - DNA, 18 bp, Homo sapiens
ctaaatttgatacttata

SEQ ID NO: 6107933 - DNA, 21 bp, Homo sapiens
ctaaatttgatacttatattt

SEQ ID NO: 6107934 - DNA, 20 bp, Homo sapiens
ctaaatttggaacttacaaa

SEQ ID NO: 6107935 - DNA, 22 bp, Homo sapiens
ctaaatttggaacttacaaagg

SEQ ID NO: 6107936 - DNA, 18 bp, Homo sapiens
ctaaatttggggacagat

SEQ ID NO: 6107937 - DNA, 14 bp, Homo sapiens
ctaaatttgtcttt

SEQ ID NO: 6107938 - DNA, 20 bp, Homo sapiens
ctaaatttgtgctttttaag

SEQ ID NO: 6107939 - DNA, 22 bp, Homo sapiens
ctaaatttgtgctttttaagaa

SEQ ID NO: 6107940 - DNA, 14 bp, Homo sapiens
ctaaattttaagtg

SEQ ID NO: 6107941 - DNA, 13 bp, Homo sapiens
ctaaattttatat

SEQ ID NO: 6107942 - DNA, 16 bp, Homo sapiens
ctaaattttatatctt

SEQ ID NO: 6107943 - DNA, 20 bp, Homo sapiens
ctaaattttatatcttgtag

SEQ ID NO: 6107944 - DNA, 19 bp, Homo sapiens
ctaaattttcctgtcctct

SEQ ID NO: 6107945 - DNA, 13 bp, Homo sapiens
ctaaattttctga

SEQ ID NO: 6107946 - DNA, 12 bp, Homo sapiens
ctaaatttttac

SEQ ID NO: 6107947 - DNA, 14 bp, Homo sapiens
ctaaatttttataa

SEQ ID NO: 6107948 - DNA, 16 bp, Homo sapiens
ctaaatttttcataga

SEQ ID NO: 6107949 - DNA, 20 bp, Homo sapiens
ctaacaaaagatatgaagaa

SEQ ID NO: 6107950 - DNA, 19 bp, Homo sapiens
ctaacaaaagatgaaagca

SEQ ID NO: 6107951 - DNA, 12 bp, Homo sapiens
ctaacaaaataa

SEQ ID NO: 6107952 - DNA, 13 bp, Homo sapiens
ctaacaaaatgag

SEQ ID NO: 6107953 - DNA, 15 bp, Homo sapiens
ctaacaaaatgagat

SEQ ID NO: 6107954 - DNA, 15 bp, Homo sapiens
ctaacaaaggcagct

SEQ ID NO: 6107955 - DNA, 16 bp, Homo sapiens
ctaacaaaggcagctg

SEQ ID NO: 6107956 - DNA, 17 bp, Homo sapiens
ctaacaaaggcagctgt

SEQ ID NO: 6107957 - DNA, 18 bp, Homo sapiens
ctaacaaaggcagctgtg

SEQ ID NO: 6107958 - DNA, 16 bp, Homo sapiens
ctaacaaatgtaaaat

SEQ ID NO: 6107959 - DNA, 17 bp, Homo sapiens
ctaacaaattttaagtg

SEQ ID NO: 6107960 - DNA, 15 bp, Homo sapiens
ctaacaagatttgta

SEQ ID NO: 6107961 - DNA, 22 bp, Homo sapiens
ctaacaagatttgtaattacag

SEQ ID NO: 6107962 - DNA, 12 bp, Homo sapiens
ctaacaataaag

SEQ ID NO: 6107963 - DNA, 17 bp, Homo sapiens
ctaacaataatatttca

SEQ ID NO: 6107964 - DNA, 18 bp, Homo sapiens
ctaacaataatatttcaa

SEQ ID NO: 6107965 - DNA, 23 bp, Homo sapiens
ctaacaataatatttcaagtgcc

SEQ ID NO: 6107966 - DNA, 13 bp, Homo sapiens
ctaacaatgacat

SEQ ID NO: 6107967 - DNA, 13 bp, Homo sapiens
ctaacacaaggac

SEQ ID NO: 6107968 - DNA, 12 bp, Homo sapiens
ctaacacacaga

SEQ ID NO: 6107969 - DNA, 14 bp, Homo sapiens
ctaacacagcatgt

SEQ ID NO: 6107970 - DNA, 13 bp, Homo sapiens
ctaacacagttga

SEQ ID NO: 6107971 - DNA, 14 bp, Homo sapiens
ctaacacattttta

SEQ ID NO: 6107972 - DNA, 20 bp, Homo sapiens
ctaacaccacactgaccaca

SEQ ID NO: 6107973 - DNA, 13 bp, Homo sapiens
ctaacaccagcgt

SEQ ID NO: 6107974 - DNA, 17 bp, Homo sapiens
ctaacactcagaagcct

SEQ ID NO: 6107975 - DNA, 20 bp, Homo sapiens
ctaacactggcatgttcaaa

SEQ ID NO: 6107976 - DNA, 12 bp, Homo sapiens
ctaacactggct

SEQ ID NO: 6107977 - DNA, 16 bp, Homo sapiens
ctaacacttaccccat

SEQ ID NO: 6107978 - DNA, 18 bp, Homo sapiens
ctaacagaaattaattta

SEQ ID NO: 6107979 - DNA, 21 bp, Homo sapiens
ctaacagacatagactgcaaa

SEQ ID NO: 6107980 - DNA, 21 bp, Homo sapiens
ctaacagcagtttcaggtaga

SEQ ID NO: 6107981 - DNA, 22 bp, Homo sapiens
ctaacagccctcctctgcactc

SEQ ID NO: 6107982 - DNA, 17 bp, Homo sapiens
ctaacagctcaggatct

SEQ ID NO: 6107983 - DNA, 14 bp, Homo sapiens
ctaacaggaaaaga

SEQ ID NO: 6107984 - DNA, 15 bp, Homo sapiens
ctaacaggaaaagag

SEQ ID NO: 6107985 - DNA, 13 bp, Homo sapiens
ctaacaggatggc

SEQ ID NO: 6107986 - DNA, 14 bp, Homo sapiens
ctaacaggctgtag

SEQ ID NO: 6107987 - DNA, 14 bp, Homo sapiens
ctaacagggaaggc

SEQ ID NO: 6107988 - DNA, 15 bp, Homo sapiens
ctaacagggaaggca

SEQ ID NO: 6107989 - DNA, 16 bp, Homo sapiens
ctaacagggaaggcag

SEQ ID NO: 6107990 - DNA, 21 bp, Homo sapiens
ctaacagggaaggcaggcagg

SEQ ID NO: 6107991 - DNA, 17 bp, Homo sapiens
ctaacagtaactgccat

SEQ ID NO: 6107992 - DNA, 18 bp, Homo sapiens
ctaacagtaactgccatt

SEQ ID NO: 6107993 - DNA, 18 bp, Homo sapiens
ctaacagtaccagtgtaa

SEQ ID NO: 6107994 - DNA, 20 bp, Homo sapiens
ctaacagtgctggtttgtcc

SEQ ID NO: 6107995 - DNA, 15 bp, Homo sapiens
ctaacagtttgcctg

SEQ ID NO: 6107996 - DNA, 12 bp, Homo sapiens
ctaacatataat

SEQ ID NO: 6107997 - DNA, 22 bp, Homo sapiens
ctaacatataatgttgttattt

SEQ ID NO: 6107998 - DNA, 21 bp, Homo sapiens
ctaacatcccaataaagtcct

SEQ ID NO: 6107999 - DNA, 14 bp, Homo sapiens
ctaacatcccactt

SEQ ID NO: 6108000 - DNA, 11 bp, Homo sapiens
ctaacatcttt

SEQ ID NO: 6108001 - DNA, 15 bp, Homo sapiens
ctaacatgaagacct

SEQ ID NO: 6108002 - DNA, 12 bp, Homo sapiens
ctaacatgcacc

SEQ ID NO: 6108003 - DNA, 16 bp, Homo sapiens
ctaacatgcaccttgc

SEQ ID NO: 6108004 - DNA, 18 bp, Homo sapiens
ctaacatgcaccttgctc

SEQ ID NO: 6108005 - DNA, 20 bp, Homo sapiens
ctaacatgcaccttgctccc

SEQ ID NO: 6108006 - DNA, 17 bp, Homo sapiens
ctaacatgccctgttca

SEQ ID NO: 6108007 - DNA, 15 bp, Homo sapiens
ctaacatgttatcaa

SEQ ID NO: 6108008 - DNA, 22 bp, Homo sapiens
ctaacattatattgcaatgaag

SEQ ID NO: 6108009 - DNA, 17 bp, Homo sapiens
ctaacattattactttt

SEQ ID NO: 6108010 - DNA, 22 bp, Homo sapiens
ctaacatttcccccgagctctt

SEQ ID NO: 6108011 - DNA, 21 bp, Homo sapiens
ctaacatttgcaaaatggaaa

SEQ ID NO: 6108012 - DNA, 17 bp, Homo sapiens
ctaaccaaagagtctct

SEQ ID NO: 6108013 - DNA, 22 bp, Homo sapiens
ctaaccaaagagtctctggctc

SEQ ID NO: 6108014 - DNA, 20 bp, Homo sapiens
ctaaccaaattctccctgga

SEQ ID NO: 6108015 - DNA, 15 bp, Homo sapiens
ctaaccaagaggctg

SEQ ID NO: 6108016 - DNA, 15 bp, Homo sapiens
ctaaccaagctgagt

SEQ ID NO: 6108017 - DNA, 21 bp, Homo sapiens
ctaaccaagctgagtttccta

SEQ ID NO: 6108018 - DNA, 12 bp, Homo sapiens
ctaaccaagttc

SEQ ID NO: 6108019 - DNA, 17 bp, Homo sapiens
ctaaccacattttagga

SEQ ID NO: 6108020 - DNA, 12 bp, Homo sapiens
ctaaccacgctg

SEQ ID NO: 6108021 - DNA, 16 bp, Homo sapiens
ctaaccacggttattt

SEQ ID NO: 6108022 - DNA, 21 bp, Homo sapiens
ctaaccacggttatttaagca

SEQ ID NO: 6108023 - DNA, 21 bp, Homo sapiens
ctaaccacgtctgtcttcaca

SEQ ID NO: 6108024 - DNA, 16 bp, Homo sapiens
ctaaccactaacattg

SEQ ID NO: 6108025 - DNA, 20 bp, Homo sapiens
ctaaccacttcgcacacacc

SEQ ID NO: 6108026 - DNA, 16 bp, Homo sapiens
ctaaccagcagaaatg

SEQ ID NO: 6108027 - DNA, 19 bp, Homo sapiens
ctaaccagtacctctgtat

SEQ ID NO: 6108028 - DNA, 12 bp, Homo sapiens
ctaaccatcccc

SEQ ID NO: 6108029 - DNA, 15 bp, Homo sapiens
ctaaccatccccaac

SEQ ID NO: 6108030 - DNA, 18 bp, Homo sapiens
ctaaccatccccaactcc

SEQ ID NO: 6108031 - DNA, 19 bp, Homo sapiens
ctaaccatccccaactcca

SEQ ID NO: 6108032 - DNA, 13 bp, Homo sapiens
ctaaccatgggct

SEQ ID NO: 6108033 - DNA, 16 bp, Homo sapiens
ctaaccatgggctcag

SEQ ID NO: 6108034 - DNA, 21 bp, Homo sapiens
ctaaccatgggctcagggcca

SEQ ID NO: 6108035 - DNA, 18 bp, Homo sapiens
ctaaccattaagtcatgt

SEQ ID NO: 6108036 - DNA, 13 bp, Homo sapiens
ctaaccatttata

SEQ ID NO: 6108037 - DNA, 14 bp, Homo sapiens
ctaaccatttatat

SEQ ID NO: 6108038 - DNA, 13 bp, Homo sapiens
ctaaccatttctt

SEQ ID NO: 6108039 - DNA, 14 bp, Homo sapiens
ctaacccaactgac

SEQ ID NO: 6108040 - DNA, 23 bp, Homo sapiens
ctaacccaagacatgacattctt

SEQ ID NO: 6108041 - DNA, 19 bp, Homo sapiens
ctaacccaggtatccaaaa

SEQ ID NO: 6108042 - DNA, 17 bp, Homo sapiens
ctaacccagtctttctt

SEQ ID NO: 6108043 - DNA, 17 bp, Homo sapiens
ctaaccccaacgcacag

SEQ ID NO: 6108044 - DNA, 18 bp, Homo sapiens
ctaaccccaacgcacagg

SEQ ID NO: 6108045 - DNA, 16 bp, Homo sapiens
ctaaccccagctgccg

SEQ ID NO: 6108046 - DNA, 17 bp, Homo sapiens
ctaaccccagctgccgg

SEQ ID NO: 6108047 - DNA, 12 bp, Homo sapiens
ctaaccccaggg

SEQ ID NO: 6108048 - DNA, 20 bp, Homo sapiens
ctaaccccagggcactgcca

SEQ ID NO: 6108049 - DNA, 22 bp, Homo sapiens
ctaacccccagcccacagagcc

SEQ ID NO: 6108050 - DNA, 20 bp, Homo sapiens
ctaacccccagtgccacaga

SEQ ID NO: 6108051 - DNA, 22 bp, Homo sapiens
ctaacccccagtgccacagaga

SEQ ID NO: 6108052 - DNA, 18 bp, Homo sapiens
ctaaccccctaagctcca

SEQ ID NO: 6108053 - DNA, 18 bp, Homo sapiens
ctaacccctagtgtcttt

SEQ ID NO: 6108054 - DNA, 18 bp, Homo sapiens
ctaaccccttacccatct

SEQ ID NO: 6108055 - DNA, 21 bp, Homo sapiens
ctaaccctcagaaacactggg

SEQ ID NO: 6108056 - DNA, 19 bp, Homo sapiens
ctaaccctcattgctgtct

SEQ ID NO: 6108057 - DNA, 18 bp, Homo sapiens
ctaaccctgtggaagcat

SEQ ID NO: 6108058 - DNA, 22 bp, Homo sapiens
ctaaccctttgtgtgctctcca

SEQ ID NO: 6108059 - DNA, 23 bp, Homo sapiens
ctaaccctttgtgtgctctccat

SEQ ID NO: 6108060 - DNA, 14 bp, Homo sapiens
ctaacctaagcaaa

SEQ ID NO: 6108061 - DNA, 22 bp, Homo sapiens
ctaacctaagcaaaaccactga

SEQ ID NO: 6108062 - DNA, 19 bp, Homo sapiens
ctaacctacgaccccagag

SEQ ID NO: 6108063 - DNA, 14 bp, Homo sapiens
ctaacctaggaggg

SEQ ID NO: 6108064 - DNA, 22 bp, Homo sapiens
ctaacctcaagtgatcctccca

SEQ ID NO: 6108065 - DNA, 21 bp, Homo sapiens
ctaacctcagccaaacacaga

SEQ ID NO: 6108066 - DNA, 12 bp, Homo sapiens
ctaacctcatct

SEQ ID NO: 6108067 - DNA, 15 bp, Homo sapiens
ctaacctcatcttct

SEQ ID NO: 6108068 - DNA, 15 bp, Homo sapiens
ctaacctctaaccct

SEQ ID NO: 6108069 - DNA, 18 bp, Homo sapiens
ctaacctctaaccctcat

SEQ ID NO: 6108070 - DNA, 21 bp, Homo sapiens
ctaacctgaccgtgggcgggg

SEQ ID NO: 6108071 - DNA, 12 bp, Homo sapiens
ctaacctggaaa

SEQ ID NO: 6108072 - DNA, 17 bp, Homo sapiens
ctaacctggacctggaa

SEQ ID NO: 6108073 - DNA, 16 bp, Homo sapiens
ctaacctggagacagt

SEQ ID NO: 6108074 - DNA, 15 bp, Homo sapiens
ctaacctgggacctg

SEQ ID NO: 6108075 - DNA, 17 bp, Homo sapiens
ctaacctgggttccctt

SEQ ID NO: 6108076 - DNA, 20 bp, Homo sapiens
ctaacctgggttgttgcaga

SEQ ID NO: 6108077 - DNA, 22 bp, Homo sapiens
ctaacctgggttgttgcagagt

SEQ ID NO: 6108078 - DNA, 13 bp, Homo sapiens
ctaacctgtgtct

SEQ ID NO: 6108079 - DNA, 15 bp, Homo sapiens
ctaacctgtgtctgc

SEQ ID NO: 6108080 - DNA, 17 bp, Homo sapiens
ctaacctgttacactgg

SEQ ID NO: 6108081 - DNA, 14 bp, Homo sapiens
ctaaccttgaatgc

SEQ ID NO: 6108082 - DNA, 17 bp, Homo sapiens
ctaaccttgaatgctgc

SEQ ID NO: 6108083 - DNA, 18 bp, Homo sapiens
ctaacgaacgttttaaag

SEQ ID NO: 6108084 - DNA, 19 bp, Homo sapiens
ctaacgaccgacgcccctc

SEQ ID NO: 6108085 - DNA, 22 bp, Homo sapiens
ctaacgaccgacgcccctccgg

SEQ ID NO: 6108086 - DNA, 15 bp, Homo sapiens
ctaacgggaggctgg

SEQ ID NO: 6108087 - DNA, 13 bp, Homo sapiens
ctaacgggcgcct

SEQ ID NO: 6108088 - DNA, 22 bp, Homo sapiens
ctaacgggggtgcggcaggagc

SEQ ID NO: 6108089 - DNA, 16 bp, Homo sapiens
ctaacggtgctcaggg

SEQ ID NO: 6108090 - DNA, 17 bp, Homo sapiens
ctaacggtgctcagggg

SEQ ID NO: 6108091 - DNA, 15 bp, Homo sapiens
ctaacgtaaatacac

SEQ ID NO: 6108092 - DNA, 18 bp, Homo sapiens
ctaacgtccactagctta

SEQ ID NO: 6108093 - DNA, 16 bp, Homo sapiens
ctaacgtgctgtcagc

SEQ ID NO: 6108094 - DNA, 19 bp, Homo sapiens
ctaacgtgtcagaatcctt

SEQ ID NO: 6108095 - DNA, 17 bp, Homo sapiens
ctaacgttgagcccctg

SEQ ID NO: 6108096 - DNA, 22 bp, Homo sapiens
ctaacgttgagcccctggaggc

SEQ ID NO: 6108097 - DNA, 23 bp, Homo sapiens
ctaacgttttttcttcttttaaa

SEQ ID NO: 6108098 - DNA, 18 bp, Homo sapiens
ctaactactgtagaagaa

SEQ ID NO: 6108099 - DNA, 23 bp, Homo sapiens
ctaactagacaccaaagttctaa

SEQ ID NO: 6108100 - DNA, 21 bp, Homo sapiens
ctaactagagcagccctggag

SEQ ID NO: 6108101 - DNA, 14 bp, Homo sapiens
ctaactcaaataca

SEQ ID NO: 6108102 - DNA, 16 bp, Homo sapiens
ctaactcaaatacaca

SEQ ID NO: 6108103 - DNA, 14 bp, Homo sapiens
ctaactcaccagcc

SEQ ID NO: 6108104 - DNA, 15 bp, Homo sapiens
ctaactcactgccta

SEQ ID NO: 6108105 - DNA, 17 bp, Homo sapiens
ctaactcactgcctagg

SEQ ID NO: 6108106 - DNA, 17 bp, Homo sapiens
ctaactcagaattattt

SEQ ID NO: 6108107 - DNA, 20 bp, Homo sapiens
ctaactcatactgtgctgga

SEQ ID NO: 6108108 - DNA, 23 bp, Homo sapiens
cctggcatccaaatggctgcttt

SEQ ID NO: 6108109 - DNA, 22 bp, Homo sapiens
cctggcatctgtgcgtgtggcg

SEQ ID NO: 6108110 - DNA, 15 bp, Homo sapiens
cctggcatcttctgg

SEQ ID NO: 6108111 - DNA, 16 bp, Homo sapiens
cctggcatcttctgga

SEQ ID NO: 6108112 - DNA, 17 bp, Homo sapiens
cctggcatcttctggag

SEQ ID NO: 6108113 - DNA, 13 bp, Homo sapiens
cctggcatgcagc

SEQ ID NO: 6108114 - DNA, 13 bp, Homo sapiens
cctggcatgggaa

SEQ ID NO: 6108115 - DNA, 19 bp, Homo sapiens
cctggcatggtgctttcag

SEQ ID NO: 6108116 - DNA, 19 bp, Homo sapiens
cctggcatgtcaacagcgt

SEQ ID NO: 6108117 - DNA, 14 bp, Homo sapiens
cctggcatgtcaga

SEQ ID NO: 6108118 - DNA, 21 bp, Homo sapiens
cctggccaatgcggcccactt

SEQ ID NO: 6108119 - DNA, 20 bp, Homo sapiens
cctggccaccacccaacctg

SEQ ID NO: 6108120 - DNA, 16 bp, Homo sapiens
cctggccaccagccat

SEQ ID NO: 6108121 - DNA, 19 bp, Homo sapiens
cctggccaccagccatcct

SEQ ID NO: 6108122 - DNA, 13 bp, Homo sapiens
cctggccaccctt

SEQ ID NO: 6108123 - DNA, 15 bp, Homo sapiens
cctggccacctctct

SEQ ID NO: 6108124 - DNA, 18 bp, Homo sapiens
cctggccacctctctcct

SEQ ID NO: 6108125 - DNA, 14 bp, Homo sapiens
cctggccacctgcc

SEQ ID NO: 6108126 - DNA, 13 bp, Homo sapiens
cctggccactgct

SEQ ID NO: 6108127 - DNA, 16 bp, Homo sapiens
cctggccactggccct

SEQ ID NO: 6108128 - DNA, 22 bp, Homo sapiens
cctggccactggccctgtttct

SEQ ID NO: 6108129 - DNA, 13 bp, Homo sapiens
cctggccagacac

SEQ ID NO: 6108130 - DNA, 16 bp, Homo sapiens
cctggccagacacagg

SEQ ID NO: 6108131 - DNA, 13 bp, Homo sapiens
cctggccagacca

SEQ ID NO: 6108132 - DNA, 13 bp, Homo sapiens
cctggccagaggc

SEQ ID NO: 6108133 - DNA, 14 bp, Homo sapiens
cctggccagaggct

SEQ ID NO: 6108134 - DNA, 16 bp, Homo sapiens
cctggccagatggccc

SEQ ID NO: 6108135 - DNA, 14 bp, Homo sapiens
cctggccagccctt

SEQ ID NO: 6108136 - DNA, 16 bp, Homo sapiens
cctggccagctctgag

SEQ ID NO: 6108137 - DNA, 17 bp, Homo sapiens
cctggccagctctgagg

SEQ ID NO: 6108138 - DNA, 12 bp, Homo sapiens
cctggccaggac

SEQ ID NO: 6108139 - DNA, 14 bp, Homo sapiens
cctggccaggagca

SEQ ID NO: 6108140 - DNA, 14 bp, Homo sapiens
cctggccaggagct

SEQ ID NO: 6108141 - DNA, 16 bp, Homo sapiens
cctggccaggagctct

SEQ ID NO: 6108142 - DNA, 18 bp, Homo sapiens
cctggccaggagctcttc

SEQ ID NO: 6108143 - DNA, 13 bp, Homo sapiens
cctggccaggcag

SEQ ID NO: 6108144 - DNA, 14 bp, Homo sapiens
cctggccaggcagg

SEQ ID NO: 6108145 - DNA, 15 bp, Homo sapiens
cctggccaggcaggg

SEQ ID NO: 6108146 - DNA, 18 bp, Homo sapiens
cctggccaggcagggaga

SEQ ID NO: 6108147 - DNA, 19 bp, Homo sapiens
cctggccagggcagggcca

SEQ ID NO: 6108148 - DNA, 20 bp, Homo sapiens
cctggccagggcctggaaga

SEQ ID NO: 6108149 - DNA, 21 bp, Homo sapiens
cctggccaggggcttctcccc

SEQ ID NO: 6108150 - DNA, 15 bp, Homo sapiens
cctggccagtcttcc

SEQ ID NO: 6108151 - DNA, 17 bp, Homo sapiens
cctggccagtcttcctc

SEQ ID NO: 6108152 - DNA, 19 bp, Homo sapiens
cctggccatcccacaagtg

SEQ ID NO: 6108153 - DNA, 24 bp, Homo sapiens
cctggccatgctgtccctgcactg

SEQ ID NO: 6108154 - DNA, 23 bp, Homo sapiens
cctggccatgtcacctggctgct

SEQ ID NO: 6108155 - DNA, 13 bp, Homo sapiens
cctggccatgtcc

SEQ ID NO: 6108156 - DNA, 21 bp, Homo sapiens
cctggcccaagccctccacat

SEQ ID NO: 6108157 - DNA, 22 bp, Homo sapiens
cctggcccaccccacccacttc

SEQ ID NO: 6108158 - DNA, 16 bp, Homo sapiens
cctggcccacccccca

SEQ ID NO: 6108159 - DNA, 19 bp, Homo sapiens
cctggcccaccccccagcc

SEQ ID NO: 6108160 - DNA, 20 bp, Homo sapiens
cctggcccaccccccagcct

SEQ ID NO: 6108161 - DNA, 12 bp, Homo sapiens
cctggcccagcc

SEQ ID NO: 6108162 - DNA, 15 bp, Homo sapiens
cctggcccagcctgt

SEQ ID NO: 6108163 - DNA, 15 bp, Homo sapiens
cctggcccagcggcc

SEQ ID NO: 6108164 - DNA, 20 bp, Homo sapiens
cctggcccagcggcccctcc

SEQ ID NO: 6108165 - DNA, 12 bp, Homo sapiens
cctggcccagct

SEQ ID NO: 6108166 - DNA, 16 bp, Homo sapiens
cctggcccagctcccc

SEQ ID NO: 6108167 - DNA, 11 bp, Homo sapiens
cctggcccagg

SEQ ID NO: 6108168 - DNA, 16 bp, Homo sapiens
cctggcccaggaggag

SEQ ID NO: 6108169 - DNA, 14 bp, Homo sapiens
cctggcccagggca

SEQ ID NO: 6108170 - DNA, 14 bp, Homo sapiens
cctggcccaggtgc

SEQ ID NO: 6108171 - DNA, 12 bp, Homo sapiens
cctggcccagtg

SEQ ID NO: 6108172 - DNA, 16 bp, Homo sapiens
cctggcccagtgagag

SEQ ID NO: 6108173 - DNA, 16 bp, Homo sapiens
cctggcccatctcagc

SEQ ID NO: 6108174 - DNA, 17 bp, Homo sapiens
cctggcccatctcagcc

SEQ ID NO: 6108175 - DNA, 18 bp, Homo sapiens
cctggcccatctcagcct

SEQ ID NO: 6108176 - DNA, 21 bp, Homo sapiens
cctggcccatgtatggccagg

SEQ ID NO: 6108177 - DNA, 16 bp, Homo sapiens
cctggcccattcttga

SEQ ID NO: 6108178 - DNA, 12 bp, Homo sapiens
cctggccccagg

SEQ ID NO: 6108179 - DNA, 14 bp, Homo sapiens
cctggccccagtga

SEQ ID NO: 6108180 - DNA, 14 bp, Homo sapiens
cctggccccatgtc

SEQ ID NO: 6108181 - DNA, 19 bp, Homo sapiens
cctggcccccaacctcagg

SEQ ID NO: 6108182 - DNA, 22 bp, Homo sapiens
cctggcccccaacctcagggct

SEQ ID NO: 6108183 - DNA, 12 bp, Homo sapiens
cctggcccccag

SEQ ID NO: 6108184 - DNA, 17 bp, Homo sapiens
cctggcccccagcttca

SEQ ID NO: 6108185 - DNA, 16 bp, Homo sapiens
cctggcccccatcagc

SEQ ID NO: 6108186 - DNA, 18 bp, Homo sapiens
cctggccccctcagctct

SEQ ID NO: 6108187 - DNA, 22 bp, Homo sapiens
cctggccccctcagctctgtcc

SEQ ID NO: 6108188 - DNA, 22 bp, Homo sapiens
cctggccccctcgcgcccctgt

SEQ ID NO: 6108189 - DNA, 15 bp, Homo sapiens
cctggccccgcctgc

SEQ ID NO: 6108190 - DNA, 17 bp, Homo sapiens
cctggccccgcctgcct

SEQ ID NO: 6108191 - DNA, 23 bp, Homo sapiens
cctggccccgggctctggccacc

SEQ ID NO: 6108192 - DNA, 16 bp, Homo sapiens
cctggcccctcagggt

SEQ ID NO: 6108193 - DNA, 20 bp, Homo sapiens
cctggcccctcagggtccct

SEQ ID NO: 6108194 - DNA, 12 bp, Homo sapiens
cctggcccctcc

SEQ ID NO: 6108195 - DNA, 14 bp, Homo sapiens
cctggcccctccaa

SEQ ID NO: 6108196 - DNA, 22 bp, Homo sapiens
cctggcccctccagaccctgcc

SEQ ID NO: 6108197 - DNA, 14 bp, Homo sapiens
cctggcccctcgcc

SEQ ID NO: 6108198 - DNA, 12 bp, Homo sapiens
cctggcccctct

SEQ ID NO: 6108199 - DNA, 20 bp, Homo sapiens
cctggcccctctcccttggg

SEQ ID NO: 6108200 - DNA, 17 bp, Homo sapiens
cctggcccctgtgggga

SEQ ID NO: 6108201 - DNA, 19 bp, Homo sapiens
cctggcccctgtggggaac

SEQ ID NO: 6108202 - DNA, 19 bp, Homo sapiens
cctggccccttctccagca

SEQ ID NO: 6108203 - DNA, 20 bp, Homo sapiens
cctggcccgcaagagggaca

SEQ ID NO: 6108204 - DNA, 19 bp, Homo sapiens
cctggcccgggagccgcag

SEQ ID NO: 6108205 - DNA, 23 bp, Homo sapiens
cctggccctcaaggcctcccaca

SEQ ID NO: 6108206 - DNA, 14 bp, Homo sapiens
cctggccctcactc

SEQ ID NO: 6108207 - DNA, 16 bp, Homo sapiens
cctggccctccccaca

SEQ ID NO: 6108208 - DNA, 18 bp, Homo sapiens
cctggccctcctctggtc

SEQ ID NO: 6108209 - DNA, 14 bp, Homo sapiens
cctggccctcctgg

SEQ ID NO: 6108210 - DNA, 15 bp, Homo sapiens
cctggccctcttctt

SEQ ID NO: 6108211 - DNA, 17 bp, Homo sapiens
cctggccctgccctgag

SEQ ID NO: 6108212 - DNA, 17 bp, Homo sapiens
cctggccctgcctcact

SEQ ID NO: 6108213 - DNA, 18 bp, Homo sapiens
cctggccctgcctcactg

SEQ ID NO: 6108214 - DNA, 19 bp, Homo sapiens
cctggccctgcctcactgt

SEQ ID NO: 6108215 - DNA, 16 bp, Homo sapiens
cctggccctgcttcct

SEQ ID NO: 6108216 - DNA, 20 bp, Homo sapiens
cctggccctgggccccgcct

SEQ ID NO: 6108217 - DNA, 21 bp, Homo sapiens
cctggccctgggccccgcctc

SEQ ID NO: 6108218 - DNA, 14 bp, Homo sapiens
cctggccctggggc

SEQ ID NO: 6108219 - DNA, 17 bp, Homo sapiens
cctggccctggggcctg

SEQ ID NO: 6108220 - DNA, 18 bp, Homo sapiens
cctggccctgttctcctc

SEQ ID NO: 6108221 - DNA, 23 bp, Homo sapiens
cctggccctgttctcctccccaa

SEQ ID NO: 6108222 - DNA, 10 bp, Homo sapiens
cctggccctt

SEQ ID NO: 6108223 - DNA, 12 bp, Homo sapiens
cctggcccttac

SEQ ID NO: 6108224 - DNA, 22 bp, Homo sapiens
cctggcccttcagtctgctcca

SEQ ID NO: 6108225 - DNA, 22 bp, Homo sapiens
cctggcccttgagtggggcagc

SEQ ID NO: 6108226 - DNA, 22 bp, Homo sapiens
cctggccctttcacccctcttc

SEQ ID NO: 6108227 - DNA, 13 bp, Homo sapiens
cctggccctttcc

SEQ ID NO: 6108228 - DNA, 16 bp, Homo sapiens
cctggccctttcccct

SEQ ID NO: 6108229 - DNA, 20 bp, Homo sapiens
cctggccctttccccttccc

SEQ ID NO: 6108230 - DNA, 19 bp, Homo sapiens
cctggccgagtccaagctg

SEQ ID NO: 6108231 - DNA, 21 bp, Homo sapiens
cctggccgcaagtccccagcc

SEQ ID NO: 6108232 - DNA, 20 bp, Homo sapiens
cctggccgcttctccccaga

SEQ ID NO: 6108233 - DNA, 14 bp, Homo sapiens
cctggccggccagc

SEQ ID NO: 6108234 - DNA, 18 bp, Homo sapiens
cctggccggccagccagc

SEQ ID NO: 6108235 - DNA, 21 bp, Homo sapiens
cctggccggcccaggcctcca

SEQ ID NO: 6108236 - DNA, 20 bp, Homo sapiens
cctggccggggcccctcacc

SEQ ID NO: 6108237 - DNA, 18 bp, Homo sapiens
cctggccgggtcaccctg

SEQ ID NO: 6108238 - DNA, 21 bp, Homo sapiens
cctggccgggtcaccctgtga

SEQ ID NO: 6108239 - DNA, 22 bp, Homo sapiens
cctggccgggtcaccctgtgac

SEQ ID NO: 6108240 - DNA, 19 bp, Homo sapiens
cctggccgttcagcctgtc

SEQ ID NO: 6108241 - DNA, 22 bp, Homo sapiens
cctggcctaccacagctgcctc

SEQ ID NO: 6108242 - DNA, 21 bp, Homo sapiens
cctggcctagaaagggcaagg

SEQ ID NO: 6108243 - DNA, 17 bp, Homo sapiens
cctggcctagaccagca

SEQ ID NO: 6108244 - DNA, 21 bp, Homo sapiens
cctggcctatccgctgccagc

SEQ ID NO: 6108245 - DNA, 21 bp, Homo sapiens
cctggcctatttaagccccct

SEQ ID NO: 6108246 - DNA, 18 bp, Homo sapiens
cctggcctcaactgagaa

SEQ ID NO: 6108247 - DNA, 20 bp, Homo sapiens
cctggcctcaactgagaagc

SEQ ID NO: 6108248 - DNA, 21 bp, Homo sapiens
cctggcctcacgcccagcctc

SEQ ID NO: 6108249 - DNA, 23 bp, Homo sapiens
cctggcctcacgcccagcctcct

SEQ ID NO: 6108250 - DNA, 13 bp, Homo sapiens
cctggcctcactg

SEQ ID NO: 6108251 - DNA, 17 bp, Homo sapiens
cctggcctcactggctg

SEQ ID NO: 6108252 - DNA, 23 bp, Homo sapiens
cctggcctcactggctggggcag

SEQ ID NO: 6108253 - DNA, 23 bp, Homo sapiens
cctggcctcacttgattcatctc

SEQ ID NO: 6108254 - DNA, 16 bp, Homo sapiens
cctggcctcagactgc

SEQ ID NO: 6108255 - DNA, 15 bp, Homo sapiens
cctggcctcagagct

SEQ ID NO: 6108256 - DNA, 20 bp, Homo sapiens
cctggcctcagccagctgcc

SEQ ID NO: 6108257 - DNA, 22 bp, Homo sapiens
cctggcctcagttcccagctcc

SEQ ID NO: 6108258 - DNA, 11 bp, Homo sapiens
cctggcctcca

SEQ ID NO: 6108259 - DNA, 13 bp, Homo sapiens
cctggcctccagg

SEQ ID NO: 6108260 - DNA, 14 bp, Homo sapiens
cctggcctccaggc

SEQ ID NO: 6108261 - DNA, 17 bp, Homo sapiens
cctggcctccaggcccg

SEQ ID NO: 6108262 - DNA, 19 bp, Homo sapiens
cctggcctccaggcccgtc

SEQ ID NO: 6108263 - DNA, 14 bp, Homo sapiens
cctggcctccccca

SEQ ID NO: 6108264 - DNA, 18 bp, Homo sapiens
cctggcctcccccacttt

SEQ ID NO: 6108265 - DNA, 14 bp, Homo sapiens
cctggcctcccgcc

SEQ ID NO: 6108266 - DNA, 13 bp, Homo sapiens
cctggcctccggc

SEQ ID NO: 6108267 - DNA, 22 bp, Homo sapiens
cctggcctccggcgtcagcctc

SEQ ID NO: 6108268 - DNA, 24 bp, Homo sapiens
cctggcctccggcgtcagcctcca

SEQ ID NO: 6108269 - DNA, 18 bp, Homo sapiens
cctggcctcctgcctcta

SEQ ID NO: 6108270 - DNA, 18 bp, Homo sapiens
cctggcctcgcctgcctt

SEQ ID NO: 6108271 - DNA, 16 bp, Homo sapiens
cctggcctctcagcct

SEQ ID NO: 6108272 - DNA, 21 bp, Homo sapiens
cctggcctctgcactcccctg

SEQ ID NO: 6108273 - DNA, 22 bp, Homo sapiens
cctggcctctgcactcccctgc

SEQ ID NO: 6108274 - DNA, 13 bp, Homo sapiens
cctggcctctgcc

SEQ ID NO: 6108275 - DNA, 15 bp, Homo sapiens
cctggcctctgccat

SEQ ID NO: 6108276 - DNA, 16 bp, Homo sapiens
cctggcctctgccatc

SEQ ID NO: 6108277 - DNA, 22 bp, Homo sapiens
cctggcctctgcctccaccctc

SEQ ID NO: 6108278 - DNA, 13 bp, Homo sapiens
cctggcctctggg

SEQ ID NO: 6108279 - DNA, 16 bp, Homo sapiens
cctggcctctgggcag

SEQ ID NO: 6108280 - DNA, 17 bp, Homo sapiens
cctggcctctgggcagt

SEQ ID NO: 6108281 - DNA, 13 bp, Homo sapiens
cctggcctctgtg

SEQ ID NO: 6108282 - DNA, 19 bp, Homo sapiens
cctggcctgaactgaggag

SEQ ID NO: 6108283 - DNA, 17 bp, Homo sapiens
cctggcctgactcccat

SEQ ID NO: 6108284 - DNA, 15 bp, Homo sapiens
cctggcctgagctgg

SEQ ID NO: 6108285 - DNA, 16 bp, Homo sapiens
cctggcctgagctggg

SEQ ID NO: 6108286 - DNA, 17 bp, Homo sapiens
cctggcctgagctgggg

SEQ ID NO: 6108287 - DNA, 12 bp, Homo sapiens
ctaactccactg

SEQ ID NO: 6108288 - DNA, 17 bp, Homo sapiens
ctaactccactggctcc

SEQ ID NO: 6108289 - DNA, 16 bp, Homo sapiens
ctaactccctcctcac

SEQ ID NO: 6108290 - DNA, 18 bp, Homo sapiens
ctaactccctcctcacac

SEQ ID NO: 6108291 - DNA, 17 bp, Homo sapiens
ctaactccttaacaact

SEQ ID NO: 6108292 - DNA, 17 bp, Homo sapiens
ctaactccttacagaag

SEQ ID NO: 6108293 - DNA, 16 bp, Homo sapiens
ctaactctattaatga

SEQ ID NO: 6108294 - DNA, 15 bp, Homo sapiens
ctaactctgatgtaa

SEQ ID NO: 6108295 - DNA, 18 bp, Homo sapiens
ctaactcttgctcactcc

SEQ ID NO: 6108296 - DNA, 19 bp, Homo sapiens
ctaactcttgctcactccc

SEQ ID NO: 6108297 - DNA, 17 bp, Homo sapiens
ctaactgaactttgaag

SEQ ID NO: 6108298 - DNA, 15 bp, Homo sapiens
ctaactgaagagaca

SEQ ID NO: 6108299 - DNA, 15 bp, Homo sapiens
ctaactgagctgcca

SEQ ID NO: 6108300 - DNA, 18 bp, Homo sapiens
ctaactgaggagctagtg

SEQ ID NO: 6108301 - DNA, 18 bp, Homo sapiens
ctaactgatgagtaaact

SEQ ID NO: 6108302 - DNA, 20 bp, Homo sapiens
ctaactgatttccatccaaa

SEQ ID NO: 6108303 - DNA, 22 bp, Homo sapiens
ctaactgatttccatccaaacc

SEQ ID NO: 6108304 - DNA, 16 bp, Homo sapiens
ctaactgcaatgtgga

SEQ ID NO: 6108305 - DNA, 22 bp, Homo sapiens
ctaactggaaacaaaacagaag

SEQ ID NO: 6108306 - DNA, 12 bp, Homo sapiens
ctaactggacag

SEQ ID NO: 6108307 - DNA, 15 bp, Homo sapiens
ctaactggacatgaa

SEQ ID NO: 6108308 - DNA, 18 bp, Homo sapiens
ctaactggacatgaagga

SEQ ID NO: 6108309 - DNA, 20 bp, Homo sapiens
ctaactggacatgaaggaaa

SEQ ID NO: 6108310 - DNA, 14 bp, Homo sapiens
ctaactggactggt

SEQ ID NO: 6108311 - DNA, 14 bp, Homo sapiens
ctaactggccccag

SEQ ID NO: 6108312 - DNA, 15 bp, Homo sapiens
ctaactggccccagg

SEQ ID NO: 6108313 - DNA, 20 bp, Homo sapiens
ctaactgggttacagtgttt

SEQ ID NO: 6108314 - DNA, 23 bp, Homo sapiens
ctaactggtaaaaagatccaggg

SEQ ID NO: 6108315 - DNA, 13 bp, Homo sapiens
ctaactgtaaatc

SEQ ID NO: 6108316 - DNA, 19 bp, Homo sapiens
ctaactgtaaatcacttgt

SEQ ID NO: 6108317 - DNA, 21 bp, Homo sapiens
ctaactgtaaatcacttgtaa

SEQ ID NO: 6108318 - DNA, 17 bp, Homo sapiens
ctaactgtaaatcatgt

SEQ ID NO: 6108319 - DNA, 15 bp, Homo sapiens
ctaactgtacatttc

SEQ ID NO: 6108320 - DNA, 17 bp, Homo sapiens
ctaactgtgacaaagaa

SEQ ID NO: 6108321 - DNA, 12 bp, Homo sapiens
ctaactgtgatt

SEQ ID NO: 6108322 - DNA, 22 bp, Homo sapiens
ctaactgttttgtatatgctgc

SEQ ID NO: 6108323 - DNA, 14 bp, Homo sapiens
ctaacttaacattg

SEQ ID NO: 6108324 - DNA, 18 bp, Homo sapiens
ctaacttaagaaataaat

SEQ ID NO: 6108325 - DNA, 13 bp, Homo sapiens
ctaacttatggac

SEQ ID NO: 6108326 - DNA, 17 bp, Homo sapiens
ctaacttatggactgtt

SEQ ID NO: 6108327 - DNA, 23 bp, Homo sapiens
ctaacttcagtaggatttatgta

SEQ ID NO: 6108328 - DNA, 21 bp, Homo sapiens
ctaacttcctgtgcctttcct

SEQ ID NO: 6108329 - DNA, 23 bp, Homo sapiens
ctaacttcctgtgcctttcctat

SEQ ID NO: 6108330 - DNA, 13 bp, Homo sapiens
ctaacttccttta

SEQ ID NO: 6108331 - DNA, 13 bp, Homo sapiens
ctaacttctaaaa

SEQ ID NO: 6108332 - DNA, 15 bp, Homo sapiens
ctaacttctaaagaa

SEQ ID NO: 6108333 - DNA, 14 bp, Homo sapiens
ctaacttgcttaaa

SEQ ID NO: 6108334 - DNA, 20 bp, Homo sapiens
ctaacttgcttaaatgtgaa

SEQ ID NO: 6108335 - DNA, 22 bp, Homo sapiens
ctaacttggggaaggggcctgg

SEQ ID NO: 6108336 - DNA, 14 bp, Homo sapiens
ctaacttgtctttg

SEQ ID NO: 6108337 - DNA, 14 bp, Homo sapiens
ctaacttgtgaaga

SEQ ID NO: 6108338 - DNA, 23 bp, Homo sapiens
ctaactttagaagtgcatttctg

SEQ ID NO: 6108339 - DNA, 19 bp, Homo sapiens
ctaacttttcttaaggttt

SEQ ID NO: 6108340 - DNA, 17 bp, Homo sapiens
ctaacttttgtgtgaaa

SEQ ID NO: 6108341 - DNA, 16 bp, Homo sapiens
ctaactttttgaattc

SEQ ID NO: 6108342 - DNA, 13 bp, Homo sapiens
ctaagaaaagaga

SEQ ID NO: 6108343 - DNA, 17 bp, Homo sapiens
ctaagaaaagcctaatc

SEQ ID NO: 6108344 - DNA, 13 bp, Homo sapiens
ctaagaaaataga

SEQ ID NO: 6108345 - DNA, 15 bp, Homo sapiens
ctaagaaaatagcaa

SEQ ID NO: 6108346 - DNA, 23 bp, Homo sapiens
ctaagaaacacatcaaataaact

SEQ ID NO: 6108347 - DNA, 14 bp, Homo sapiens
ctaagaaacattgg

SEQ ID NO: 6108348 - DNA, 20 bp, Homo sapiens
ctaagaaacatttatattga

SEQ ID NO: 6108349 - DNA, 22 bp, Homo sapiens
ctaagaaacatttatattgata

SEQ ID NO: 6108350 - DNA, 17 bp, Homo sapiens
ctaagaaaccctctgtc

SEQ ID NO: 6108351 - DNA, 21 bp, Homo sapiens
ctaagaaagaaaggaaagaag

SEQ ID NO: 6108352 - DNA, 19 bp, Homo sapiens
ctaagaaagaggagtgctt

SEQ ID NO: 6108353 - DNA, 20 bp, Homo sapiens
ctaagaaagaggagtgcttg

SEQ ID NO: 6108354 - DNA, 22 bp, Homo sapiens
ctaagaaagcccttaggaagaa

SEQ ID NO: 6108355 - DNA, 20 bp, Homo sapiens
ctaagaaatatctgtgaaat

SEQ ID NO: 6108356 - DNA, 21 bp, Homo sapiens
ctaagaaatatctgtgaaata

SEQ ID NO: 6108357 - DNA, 14 bp, Homo sapiens
ctaagaaatcatgt

SEQ ID NO: 6108358 - DNA, 18 bp, Homo sapiens
ctaagaaatcatgtgcat

SEQ ID NO: 6108359 - DNA, 20 bp, Homo sapiens
ctaagaaatgccagtggtgg

SEQ ID NO: 6108360 - DNA, 13 bp, Homo sapiens
ctaagaaccaaaa

SEQ ID NO: 6108361 - DNA, 17 bp, Homo sapiens
ctaagaacccatggaaa

SEQ ID NO: 6108362 - DNA, 23 bp, Homo sapiens
ctaagaagaaaattgctgtgcct

SEQ ID NO: 6108363 - DNA, 12 bp, Homo sapiens
ctaagaagacat

SEQ ID NO: 6108364 - DNA, 13 bp, Homo sapiens
ctaagaagacatt

SEQ ID NO: 6108365 - DNA, 16 bp, Homo sapiens
ctaagaagacattttg

SEQ ID NO: 6108366 - DNA, 13 bp, Homo sapiens
ctaagaagctctg

SEQ ID NO: 6108367 - DNA, 15 bp, Homo sapiens
ctaagaagctctggc

SEQ ID NO: 6108368 - DNA, 22 bp, Homo sapiens
ctaagaagctctggccccaggc

SEQ ID NO: 6108369 - DNA, 16 bp, Homo sapiens
ctaagaagctgcaata

SEQ ID NO: 6108370 - DNA, 14 bp, Homo sapiens
ctaagaagcttcta

SEQ ID NO: 6108371 - DNA, 16 bp, Homo sapiens
ctaagaagtccccagg

SEQ ID NO: 6108372 - DNA, 17 bp, Homo sapiens
ctaagaagttgtttgag

SEQ ID NO: 6108373 - DNA, 18 bp, Homo sapiens
ctaagaataaacatttgt

SEQ ID NO: 6108374 - DNA, 20 bp, Homo sapiens
ctaagaataaacatttgtta

SEQ ID NO: 6108375 - DNA, 13 bp, Homo sapiens
ctaagaataaata

SEQ ID NO: 6108376 - DNA, 15 bp, Homo sapiens
ctaagaataataaaa

SEQ ID NO: 6108377 - DNA, 16 bp, Homo sapiens
ctaagaatacagcttt

SEQ ID NO: 6108378 - DNA, 20 bp, Homo sapiens
ctaagaatacagctttctga

SEQ ID NO: 6108379 - DNA, 22 bp, Homo sapiens
ctaagaatagactaagtttgtg

SEQ ID NO: 6108380 - DNA, 21 bp, Homo sapiens
ctaagaatgtacagttgagct

SEQ ID NO: 6108381 - DNA, 14 bp, Homo sapiens
ctaagaatgtgatg

SEQ ID NO: 6108382 - DNA, 14 bp, Homo sapiens
ctaagaatttagag

SEQ ID NO: 6108383 - DNA, 13 bp, Homo sapiens
ctaagaatttttc

SEQ ID NO: 6108384 - DNA, 18 bp, Homo sapiens
ctaagaatttttttttaa

SEQ ID NO: 6108385 - DNA, 16 bp, Homo sapiens
ctaagacaaatgcagt

SEQ ID NO: 6108386 - DNA, 22 bp, Homo sapiens
ctaagacacaaatgcatgaaca

SEQ ID NO: 6108387 - DNA, 23 bp, Homo sapiens
ctaagacacaaatgcatgaacaa

SEQ ID NO: 6108388 - DNA, 21 bp, Homo sapiens
ctaagacacctgaaccctcca

SEQ ID NO: 6108389 - DNA, 17 bp, Homo sapiens
ctaagacagtttttata

SEQ ID NO: 6108390 - DNA, 13 bp, Homo sapiens
ctaagacatgtaa

SEQ ID NO: 6108391 - DNA, 22 bp, Homo sapiens
ctaagacatgtgaggaggaaaa

SEQ ID NO: 6108392 - DNA, 16 bp, Homo sapiens
ctaagacatttttcat

SEQ ID NO: 6108393 - DNA, 21 bp, Homo sapiens
ctaagaccacgaaaaaaggct

SEQ ID NO: 6108394 - DNA, 23 bp, Homo sapiens
ctaagacccacaaactgcctgtt

SEQ ID NO: 6108395 - DNA, 14 bp, Homo sapiens
ctaagactaacaaa

SEQ ID NO: 6108396 - DNA, 19 bp, Homo sapiens
ctaagactaacaaaggcag

SEQ ID NO: 6108397 - DNA, 13 bp, Homo sapiens
ctaagactatata

SEQ ID NO: 6108398 - DNA, 19 bp, Homo sapiens
ctaagactcaaatgttcta

SEQ ID NO: 6108399 - DNA, 20 bp, Homo sapiens
ctaagactcaaatgttctaa

SEQ ID NO: 6108400 - DNA, 21 bp, Homo sapiens
ctaagactcaaatgttctaag

SEQ ID NO: 6108401 - DNA, 17 bp, Homo sapiens
ctaagactgccttcagt

SEQ ID NO: 6108402 - DNA, 15 bp, Homo sapiens
ctaagactgcttcta

SEQ ID NO: 6108403 - DNA, 21 bp, Homo sapiens
ctaagacttcagtcctggtct

SEQ ID NO: 6108404 - DNA, 18 bp, Homo sapiens
ctaagagaaaattgcact

SEQ ID NO: 6108405 - DNA, 20 bp, Homo sapiens
ctaagagaaaattgcactaa

SEQ ID NO: 6108406 - DNA, 18 bp, Homo sapiens
ctaagagaaactgtgtat

SEQ ID NO: 6108407 - DNA, 13 bp, Homo sapiens
ctaagagaagtag

SEQ ID NO: 6108408 - DNA, 19 bp, Homo sapiens
ctaagagaagttattttct

SEQ ID NO: 6108409 - DNA, 22 bp, Homo sapiens
ctaagagaatgataggcttttg

SEQ ID NO: 6108410 - DNA, 16 bp, Homo sapiens
ctaagagagcacctgg

SEQ ID NO: 6108411 - DNA, 18 bp, Homo sapiens
ctaagagattctgatttg

SEQ ID NO: 6108412 - DNA, 11 bp, Homo sapiens
ctaagagattt

SEQ ID NO: 6108413 - DNA, 17 bp, Homo sapiens
ctaagagatttatcttt

SEQ ID NO: 6108414 - DNA, 15 bp, Homo sapiens
ctaagagcagagtct

SEQ ID NO: 6108415 - DNA, 11 bp, Homo sapiens
ctaagagccat

SEQ ID NO: 6108416 - DNA, 14 bp, Homo sapiens
ctaagagcctctgg

SEQ ID NO: 6108417 - DNA, 20 bp, Homo sapiens
ctaagaggaaactagtgttt

SEQ ID NO: 6108418 - DNA, 16 bp, Homo sapiens
ctaagaggaggcagga

SEQ ID NO: 6108419 - DNA, 17 bp, Homo sapiens
ctaagaggatacaaatt

SEQ ID NO: 6108420 - DNA, 14 bp, Homo sapiens
ctaagaggctgccc

SEQ ID NO: 6108421 - DNA, 13 bp, Homo sapiens
ctaagagggaggg

SEQ ID NO: 6108422 - DNA, 15 bp, Homo sapiens
ctaagagggagggag

SEQ ID NO: 6108423 - DNA, 21 bp, Homo sapiens
ctaagagtctctatttcacaa

SEQ ID NO: 6108424 - DNA, 17 bp, Homo sapiens
ctaagagtggaggagga

SEQ ID NO: 6108425 - DNA, 19 bp, Homo sapiens
ctaagagtgtcactgagct

SEQ ID NO: 6108426 - DNA, 20 bp, Homo sapiens
ctaagagtgtcactgagctg

SEQ ID NO: 6108427 - DNA, 12 bp, Homo sapiens
ctaagagtgtcc

SEQ ID NO: 6108428 - DNA, 18 bp, Homo sapiens
ctaagagttgagctctcg

SEQ ID NO: 6108429 - DNA, 14 bp, Homo sapiens
ctaagatagaaagc

SEQ ID NO: 6108430 - DNA, 21 bp, Homo sapiens
ctaagatagaaagctggactg

SEQ ID NO: 6108431 - DNA, 22 bp, Homo sapiens
ctaagatagaaagctggactga

SEQ ID NO: 6108432 - DNA, 16 bp, Homo sapiens
ctaagatagtaacaat

SEQ ID NO: 6108433 - DNA, 22 bp, Homo sapiens
ctaagatatacttgtttttgta

SEQ ID NO: 6108434 - DNA, 18 bp, Homo sapiens
ctaagatcggttaacaaa

SEQ ID NO: 6108435 - DNA, 20 bp, Homo sapiens
ctaagatcggttaacaaata

SEQ ID NO: 6108436 - DNA, 21 bp, Homo sapiens
ctaagatcggttaacaaataa

SEQ ID NO: 6108437 - DNA, 23 bp, Homo sapiens
ctaagatctgttaaaaaagaaat

SEQ ID NO: 6108438 - DNA, 20 bp, Homo sapiens
ctaagatgaaatgcactgta

SEQ ID NO: 6108439 - DNA, 18 bp, Homo sapiens
ctaagatgaatccaaatg

SEQ ID NO: 6108440 - DNA, 21 bp, Homo sapiens
ctaagatgaatccaaatgtga

SEQ ID NO: 6108441 - DNA, 15 bp, Homo sapiens
ctaagatgacattgc

SEQ ID NO: 6108442 - DNA, 18 bp, Homo sapiens
ctaagatgacattgctaa

SEQ ID NO: 6108443 - DNA, 20 bp, Homo sapiens
ctaagatgacattgctaaga

SEQ ID NO: 6108444 - DNA, 20 bp, Homo sapiens
ctaagatgtgatattctaag

SEQ ID NO: 6108445 - DNA, 21 bp, Homo sapiens
ctaagatgtgatattctaaga

SEQ ID NO: 6108446 - DNA, 13 bp, Homo sapiens
ctaagatgttata

SEQ ID NO: 6108447 - DNA, 21 bp, Homo sapiens
ctaagattacaaatcagaagt

SEQ ID NO: 6108448 - DNA, 19 bp, Homo sapiens
ctaagattccttttgtcaa

SEQ ID NO: 6108449 - DNA, 18 bp, Homo sapiens
ctaagattctaaaggtcc

SEQ ID NO: 6108450 - DNA, 14 bp, Homo sapiens
ctaagattctagat

SEQ ID NO: 6108451 - DNA, 16 bp, Homo sapiens
ctaagattctagatca

SEQ ID NO: 6108452 - DNA, 11 bp, Homo sapiens
ctaagattctg

SEQ ID NO: 6108453 - DNA, 12 bp, Homo sapiens
ctaagattcttt

SEQ ID NO: 6108454 - DNA, 14 bp, Homo sapiens
ctaagattctttta

SEQ ID NO: 6108455 - DNA, 23 bp, Homo sapiens
ctaagattcttttaaattagaaa

SEQ ID NO: 6108456 - DNA, 15 bp, Homo sapiens
ctaagatttctgtct

SEQ ID NO: 6108457 - DNA, 16 bp, Homo sapiens
ctaagatttggtttgg

SEQ ID NO: 6108458 - DNA, 12 bp, Homo sapiens
ctaagcaacaga

SEQ ID NO: 6108459 - DNA, 16 bp, Homo sapiens
ctaagcaaccacactg

SEQ ID NO: 6108460 - DNA, 16 bp, Homo sapiens
ctaagcaactaggcct

SEQ ID NO: 6108461 - DNA, 18 bp, Homo sapiens
ctaagcaagccaggagaa

SEQ ID NO: 6108462 - DNA, 20 bp, Homo sapiens
ctaagcaagccaggagaaga

SEQ ID NO: 6108463 - DNA, 15 bp, Homo sapiens
ctaagcaagctaacc

SEQ ID NO: 6108464 - DNA, 21 bp, Homo sapiens
ctaagcaatacttaggaggct

SEQ ID NO: 6108465 - DNA, 21 bp, Homo sapiens
ctaagcaatcactgggcccag

SEQ ID NO: 6108466 - DNA, 14 bp, Homo sapiens
cctggcctgaggac

SEQ ID NO: 6108467 - DNA, 15 bp, Homo sapiens
cctggcctgaggacc

SEQ ID NO: 6108468 - DNA, 16 bp, Homo sapiens
cctggcctgaggaccc

SEQ ID NO: 6108469 - DNA, 12 bp, Homo sapiens
cctggcctgccc

SEQ ID NO: 6108470 - DNA, 17 bp, Homo sapiens
cctggcctgccggacac

SEQ ID NO: 6108471 - DNA, 12 bp, Homo sapiens
cctggcctgctg

SEQ ID NO: 6108472 - DNA, 22 bp, Homo sapiens
cctggcctggaatttgggcaga

SEQ ID NO: 6108473 - DNA, 13 bp, Homo sapiens
cctggcctggcac

SEQ ID NO: 6108474 - DNA, 16 bp, Homo sapiens
cctggcctggcacaca

SEQ ID NO: 6108475 - DNA, 15 bp, Homo sapiens
cctggcctggcaccg

SEQ ID NO: 6108476 - DNA, 15 bp, Homo sapiens
cctggcctggccctg

SEQ ID NO: 6108477 - DNA, 20 bp, Homo sapiens
cctggcctggccctgccctg

SEQ ID NO: 6108478 - DNA, 16 bp, Homo sapiens
cctggcctggctcccc

SEQ ID NO: 6108479 - DNA, 15 bp, Homo sapiens
cctggcctggctggg

SEQ ID NO: 6108480 - DNA, 15 bp, Homo sapiens
cctggcctgggccac

SEQ ID NO: 6108481 - DNA, 12 bp, Homo sapiens
cctggcctgggt

SEQ ID NO: 6108482 - DNA, 13 bp, Homo sapiens
cctggcctggtcc

SEQ ID NO: 6108483 - DNA, 16 bp, Homo sapiens
cctggcctggtccagg

SEQ ID NO: 6108484 - DNA, 18 bp, Homo sapiens
cctggcctggtccctggt

SEQ ID NO: 6108485 - DNA, 17 bp, Homo sapiens
cctggcctgtctcggaa

SEQ ID NO: 6108486 - DNA, 14 bp, Homo sapiens
cctggcctgtgcct

SEQ ID NO: 6108487 - DNA, 18 bp, Homo sapiens
cctggccttcagtgtacc

SEQ ID NO: 6108488 - DNA, 13 bp, Homo sapiens
cctggccttctga

SEQ ID NO: 6108489 - DNA, 14 bp, Homo sapiens
cctggccttctgaa

SEQ ID NO: 6108490 - DNA, 16 bp, Homo sapiens
cctggccttctgaact

SEQ ID NO: 6108491 - DNA, 20 bp, Homo sapiens
cctggccttctgaactccat

SEQ ID NO: 6108492 - DNA, 19 bp, Homo sapiens
cctggccttgtcctcagcc

SEQ ID NO: 6108493 - DNA, 13 bp, Homo sapiens
cctggccttttcc

SEQ ID NO: 6108494 - DNA, 14 bp, Homo sapiens
cctggccttttgtg

SEQ ID NO: 6108495 - DNA, 13 bp, Homo sapiens
cctggcctttttc

SEQ ID NO: 6108496 - DNA, 23 bp, Homo sapiens
cctggcgagttctctttggaaat

SEQ ID NO: 6108497 - DNA, 15 bp, Homo sapiens
cctggcgccccctat

SEQ ID NO: 6108498 - DNA, 19 bp, Homo sapiens
cctggcgcccctgcccccc

SEQ ID NO: 6108499 - DNA, 15 bp, Homo sapiens
cctggcggaggtgga

SEQ ID NO: 6108500 - DNA, 13 bp, Homo sapiens
cctggcggcagga

SEQ ID NO: 6108501 - DNA, 17 bp, Homo sapiens
cctggcggcaggaagcc

SEQ ID NO: 6108502 - DNA, 14 bp, Homo sapiens
cctggcggcagggg

SEQ ID NO: 6108503 - DNA, 16 bp, Homo sapiens
cctggcggcctgtggg

SEQ ID NO: 6108504 - DNA, 17 bp, Homo sapiens
cctggcgggatgggcca

SEQ ID NO: 6108505 - DNA, 21 bp, Homo sapiens
cctggcgggatgggccaccgc

SEQ ID NO: 6108506 - DNA, 13 bp, Homo sapiens
cctggcgggcagc

SEQ ID NO: 6108507 - DNA, 13 bp, Homo sapiens
cctggcggggcag

SEQ ID NO: 6108508 - DNA, 20 bp, Homo sapiens
cctggcggggcaggaggcct

SEQ ID NO: 6108509 - DNA, 19 bp, Homo sapiens
cctggcgggggtgggccgt

SEQ ID NO: 6108510 - DNA, 17 bp, Homo sapiens
cctggcgggtggctgca

SEQ ID NO: 6108511 - DNA, 18 bp, Homo sapiens
cctggcgggtggctgcaa

SEQ ID NO: 6108512 - DNA, 20 bp, Homo sapiens
cctggcgggtggctgcaagc

SEQ ID NO: 6108513 - DNA, 22 bp, Homo sapiens
cctggcggtgtataccaggcag

SEQ ID NO: 6108514 - DNA, 23 bp, Homo sapiens
cctggcgtcccctccctctgtct

SEQ ID NO: 6108515 - DNA, 13 bp, Homo sapiens
cctggcgtcctct

SEQ ID NO: 6108516 - DNA, 18 bp, Homo sapiens
cctggcgtcggccagagg

SEQ ID NO: 6108517 - DNA, 17 bp, Homo sapiens
cctggcgtgctcagacc

SEQ ID NO: 6108518 - DNA, 13 bp, Homo sapiens
cctggcgtggggg

SEQ ID NO: 6108519 - DNA, 20 bp, Homo sapiens
cctggcgtggggggagctct

SEQ ID NO: 6108520 - DNA, 22 bp, Homo sapiens
cctggcgtggggggagctctgg

SEQ ID NO: 6108521 - DNA, 17 bp, Homo sapiens
cctggctagaaaacaag

SEQ ID NO: 6108522 - DNA, 12 bp, Homo sapiens
cctggctataca

SEQ ID NO: 6108523 - DNA, 20 bp, Homo sapiens
cctggctcacagccaccacc

SEQ ID NO: 6108524 - DNA, 23 bp, Homo sapiens
cctggctcacagccaccacctgg

SEQ ID NO: 6108525 - DNA, 18 bp, Homo sapiens
cctggctcactggcaggt

SEQ ID NO: 6108526 - DNA, 13 bp, Homo sapiens
cctggctcagagc

SEQ ID NO: 6108527 - DNA, 16 bp, Homo sapiens
cctggctcagagccag

SEQ ID NO: 6108528 - DNA, 15 bp, Homo sapiens
cctggctcaggccca

SEQ ID NO: 6108529 - DNA, 18 bp, Homo sapiens
cctggctcaggcccagct

SEQ ID NO: 6108530 - DNA, 22 bp, Homo sapiens
cctggctccaaaccctcgaggc

SEQ ID NO: 6108531 - DNA, 19 bp, Homo sapiens
cctggctccactcttgatc

SEQ ID NO: 6108532 - DNA, 16 bp, Homo sapiens
cctggctccaggccag

SEQ ID NO: 6108533 - DNA, 14 bp, Homo sapiens
cctggctccagtga

SEQ ID NO: 6108534 - DNA, 21 bp, Homo sapiens
cctggctcccacaggcagctt

SEQ ID NO: 6108535 - DNA, 16 bp, Homo sapiens
cctggctcccaggaca

SEQ ID NO: 6108536 - DNA, 14 bp, Homo sapiens
cctggctcccatga

SEQ ID NO: 6108537 - DNA, 22 bp, Homo sapiens
cctggctcccatgaccatactg

SEQ ID NO: 6108538 - DNA, 13 bp, Homo sapiens
cctggctccccac

SEQ ID NO: 6108539 - DNA, 22 bp, Homo sapiens
cctggctccccacgagtcacct

SEQ ID NO: 6108540 - DNA, 19 bp, Homo sapiens
cctggctccctcactctca

SEQ ID NO: 6108541 - DNA, 20 bp, Homo sapiens
cctggctccctcactctcag

SEQ ID NO: 6108542 - DNA, 21 bp, Homo sapiens
cctggctccctcactctcagg

SEQ ID NO: 6108543 - DNA, 22 bp, Homo sapiens
cctggctccctcactctcagga

SEQ ID NO: 6108544 - DNA, 15 bp, Homo sapiens
cctggctccctcctc

SEQ ID NO: 6108545 - DNA, 20 bp, Homo sapiens
cctggctccctcctccaggc

SEQ ID NO: 6108546 - DNA, 14 bp, Homo sapiens
cctggctccctgat

SEQ ID NO: 6108547 - DNA, 18 bp, Homo sapiens
cctggctccgctgtgtgg

SEQ ID NO: 6108548 - DNA, 12 bp, Homo sapiens
cctggctccttc

SEQ ID NO: 6108549 - DNA, 14 bp, Homo sapiens
cctggctccttcac

SEQ ID NO: 6108550 - DNA, 19 bp, Homo sapiens
cctggctccttgcagcagg

SEQ ID NO: 6108551 - DNA, 22 bp, Homo sapiens
cctggctccttgcagcagggct

SEQ ID NO: 6108552 - DNA, 20 bp, Homo sapiens
cctggctccttgtgccagag

SEQ ID NO: 6108553 - DNA, 21 bp, Homo sapiens
cctggctccttgtgccagaga

SEQ ID NO: 6108554 - DNA, 15 bp, Homo sapiens
cctggctctaccctg

SEQ ID NO: 6108555 - DNA, 22 bp, Homo sapiens
cctggctctgcaatgggcactg

SEQ ID NO: 6108556 - DNA, 14 bp, Homo sapiens
cctggctctgcccc

SEQ ID NO: 6108557 - DNA, 18 bp, Homo sapiens
cctggctctgcccctcag

SEQ ID NO: 6108558 - DNA, 13 bp, Homo sapiens
cctggctctgggg

SEQ ID NO: 6108559 - DNA, 22 bp, Homo sapiens
cctggctctgggggacccaggt

SEQ ID NO: 6108560 - DNA, 23 bp, Homo sapiens
cctggctctgggggacccaggtg

SEQ ID NO: 6108561 - DNA, 17 bp, Homo sapiens
cctggctctgtggcttg

SEQ ID NO: 6108562 - DNA, 13 bp, Homo sapiens
cctggctcttgtg

SEQ ID NO: 6108563 - DNA, 20 bp, Homo sapiens
cctggctcttgtgctggatg

SEQ ID NO: 6108564 - DNA, 23 bp, Homo sapiens
cctggctctttcgtcacccttgg

SEQ ID NO: 6108565 - DNA, 17 bp, Homo sapiens
cctggctgaacagtgct

SEQ ID NO: 6108566 - DNA, 18 bp, Homo sapiens
cctggctgaacagtgctc

SEQ ID NO: 6108567 - DNA, 20 bp, Homo sapiens
cctggctgaacagtgctctg

SEQ ID NO: 6108568 - DNA, 21 bp, Homo sapiens
cctggctgaacagtgctctgc

SEQ ID NO: 6108569 - DNA, 22 bp, Homo sapiens
cctggctgaacagtgctctgcc

SEQ ID NO: 6108570 - DNA, 23 bp, Homo sapiens
cctggctgaacagtgctctgcct

SEQ ID NO: 6108571 - DNA, 14 bp, Homo sapiens
cctggctgaaggac

SEQ ID NO: 6108572 - DNA, 16 bp, Homo sapiens
cctggctgaaggactg

SEQ ID NO: 6108573 - DNA, 22 bp, Homo sapiens
cctggctgaccccaaagagcct

SEQ ID NO: 6108574 - DNA, 18 bp, Homo sapiens
cctggctgacctgctgtg

SEQ ID NO: 6108575 - DNA, 23 bp, Homo sapiens
cctggctgactgccttgctagaa

SEQ ID NO: 6108576 - DNA, 17 bp, Homo sapiens
cctggctgactggccag

SEQ ID NO: 6108577 - DNA, 18 bp, Homo sapiens
cctggctgactggccagt

SEQ ID NO: 6108578 - DNA, 24 bp, Homo sapiens
cctggctgactggccagttgccca

SEQ ID NO: 6108579 - DNA, 17 bp, Homo sapiens
cctggctgagggcagct

SEQ ID NO: 6108580 - DNA, 16 bp, Homo sapiens
cctggctgaggttcct

SEQ ID NO: 6108581 - DNA, 21 bp, Homo sapiens
cctggctgaggttcctctgcc

SEQ ID NO: 6108582 - DNA, 23 bp, Homo sapiens
cctggctgaggttcctctgcctg

SEQ ID NO: 6108583 - DNA, 24 bp, Homo sapiens
cctggctgaggttcctctgcctgc

SEQ ID NO: 6108584 - DNA, 12 bp, Homo sapiens
cctggctgcact

SEQ ID NO: 6108585 - DNA, 12 bp, Homo sapiens
cctggctgcagc

SEQ ID NO: 6108586 - DNA, 14 bp, Homo sapiens
cctggctgcagcct

SEQ ID NO: 6108587 - DNA, 19 bp, Homo sapiens
cctggctgcagcctccggg

SEQ ID NO: 6108588 - DNA, 14 bp, Homo sapiens
cctggctgcagctg

SEQ ID NO: 6108589 - DNA, 15 bp, Homo sapiens
cctggctgccaggcg

SEQ ID NO: 6108590 - DNA, 16 bp, Homo sapiens
cctggctgccaggcgt

SEQ ID NO: 6108591 - DNA, 13 bp, Homo sapiens
cctggctgcccct

SEQ ID NO: 6108592 - DNA, 20 bp, Homo sapiens
cctggctgcccctcaccttg

SEQ ID NO: 6108593 - DNA, 15 bp, Homo sapiens
cctggctgccctggc

SEQ ID NO: 6108594 - DNA, 22 bp, Homo sapiens
cctggctgcggggcgggcacac

SEQ ID NO: 6108595 - DNA, 16 bp, Homo sapiens
cctggctgctaggcca

SEQ ID NO: 6108596 - DNA, 19 bp, Homo sapiens
cctggctgctaggccagag

SEQ ID NO: 6108597 - DNA, 17 bp, Homo sapiens
cctggctgctctcatgc

SEQ ID NO: 6108598 - DNA, 22 bp, Homo sapiens
cctggctgctctcatgcctgcc

SEQ ID NO: 6108599 - DNA, 14 bp, Homo sapiens
cctggctgctgccc

SEQ ID NO: 6108600 - DNA, 18 bp, Homo sapiens
cctggctgctgcccccac

SEQ ID NO: 6108601 - DNA, 14 bp, Homo sapiens
cctggctgctgctt

SEQ ID NO: 6108602 - DNA, 16 bp, Homo sapiens
cctggctgctgcttct

SEQ ID NO: 6108603 - DNA, 20 bp, Homo sapiens
cctggctgctgcttcttgct

SEQ ID NO: 6108604 - DNA, 23 bp, Homo sapiens
cctggctggagaccgaggccaga

SEQ ID NO: 6108605 - DNA, 18 bp, Homo sapiens
cctggctggaggagcagc

SEQ ID NO: 6108606 - DNA, 13 bp, Homo sapiens
cctggctggccag

SEQ ID NO: 6108607 - DNA, 15 bp, Homo sapiens
cctggctggccagga

SEQ ID NO: 6108608 - DNA, 23 bp, Homo sapiens
cctggctggccaggacacactga

SEQ ID NO: 6108609 - DNA, 14 bp, Homo sapiens
cctggctggctcct

SEQ ID NO: 6108610 - DNA, 19 bp, Homo sapiens
cctggctggctcctagggg

SEQ ID NO: 6108611 - DNA, 12 bp, Homo sapiens
cctggctggctg

SEQ ID NO: 6108612 - DNA, 20 bp, Homo sapiens
cctggctggctgagggcagt

SEQ ID NO: 6108613 - DNA, 18 bp, Homo sapiens
cctggctgggactgggaa

SEQ ID NO: 6108614 - DNA, 21 bp, Homo sapiens
cctggctgggatcagagcagg

SEQ ID NO: 6108615 - DNA, 14 bp, Homo sapiens
cctggctgggccat

SEQ ID NO: 6108616 - DNA, 16 bp, Homo sapiens
cctggctgggccatcc

SEQ ID NO: 6108617 - DNA, 14 bp, Homo sapiens
cctggctgggcctg

SEQ ID NO: 6108618 - DNA, 17 bp, Homo sapiens
cctggctgggcctgggc

SEQ ID NO: 6108619 - DNA, 14 bp, Homo sapiens
cctggctgggctct

SEQ ID NO: 6108620 - DNA, 19 bp, Homo sapiens
cctggctgggctctggtgg

SEQ ID NO: 6108621 - DNA, 16 bp, Homo sapiens
cctggctgggctttgg

SEQ ID NO: 6108622 - DNA, 21 bp, Homo sapiens
cctggctgggctttggggctg

SEQ ID NO: 6108623 - DNA, 23 bp, Homo sapiens
cctggctgggctttggggctggt

SEQ ID NO: 6108624 - DNA, 14 bp, Homo sapiens
cctggctgtactgc

SEQ ID NO: 6108625 - DNA, 19 bp, Homo sapiens
cctggctgtactgctcagg

SEQ ID NO: 6108626 - DNA, 15 bp, Homo sapiens
cctggctgtcacctt

SEQ ID NO: 6108627 - DNA, 22 bp, Homo sapiens
cctggctgtcctaccatcagct

SEQ ID NO: 6108628 - DNA, 23 bp, Homo sapiens
cctggctgtcctaccatcagctc

SEQ ID NO: 6108629 - DNA, 19 bp, Homo sapiens
cctggctgtgacacctggt

SEQ ID NO: 6108630 - DNA, 13 bp, Homo sapiens
cctggctgtgagc

SEQ ID NO: 6108631 - DNA, 21 bp, Homo sapiens
cctggctgtgcacattctccc

SEQ ID NO: 6108632 - DNA, 23 bp, Homo sapiens
cctggctgtgcacattctccctt

SEQ ID NO: 6108633 - DNA, 18 bp, Homo sapiens
cctggctgtgcccagcag

SEQ ID NO: 6108634 - DNA, 20 bp, Homo sapiens
cctggctgtgcccagcaggc

SEQ ID NO: 6108635 - DNA, 16 bp, Homo sapiens
cctggctgtggaggcc

SEQ ID NO: 6108636 - DNA, 18 bp, Homo sapiens
cctggctgtggaggcctg

SEQ ID NO: 6108637 - DNA, 23 bp, Homo sapiens
cctggctgtttggactttgtata

SEQ ID NO: 6108638 - DNA, 20 bp, Homo sapiens
cctggcttcaccgcattcca

SEQ ID NO: 6108639 - DNA, 15 bp, Homo sapiens
cctggcttcactctc

SEQ ID NO: 6108640 - DNA, 18 bp, Homo sapiens
cctggcttcactctccct

SEQ ID NO: 6108641 - DNA, 13 bp, Homo sapiens
cctggcttcccag

SEQ ID NO: 6108642 - DNA, 21 bp, Homo sapiens
cctggcttcccatccccagcg

SEQ ID NO: 6108643 - DNA, 18 bp, Homo sapiens
cctggcttccccttcaga

SEQ ID NO: 6108644 - DNA, 22 bp, Homo sapiens
ctaagcaatcactgggcccaga

SEQ ID NO: 6108645 - DNA, 13 bp, Homo sapiens
ctaagcaatttct

SEQ ID NO: 6108646 - DNA, 23 bp, Homo sapiens
ctaagcacgggccatatgaataa

SEQ ID NO: 6108647 - DNA, 12 bp, Homo sapiens
ctaagcacttct

SEQ ID NO: 6108648 - DNA, 14 bp, Homo sapiens
ctaagcagaaagtg

SEQ ID NO: 6108649 - DNA, 15 bp, Homo sapiens
ctaagcagaaagtgc

SEQ ID NO: 6108650 - DNA, 19 bp, Homo sapiens
ctaagcagaaagtgccttt

SEQ ID NO: 6108651 - DNA, 23 bp, Homo sapiens
ctaagcagaaagtgcctttcagg

SEQ ID NO: 6108652 - DNA, 20 bp, Homo sapiens
ctaagcagaagactctccac

SEQ ID NO: 6108653 - DNA, 14 bp, Homo sapiens
ctaagcagaggagg

SEQ ID NO: 6108654 - DNA, 20 bp, Homo sapiens
ctaagcagaggaggggccgc

SEQ ID NO: 6108655 - DNA, 13 bp, Homo sapiens
ctaagcagccagg

SEQ ID NO: 6108656 - DNA, 14 bp, Homo sapiens
ctaagcagccagga

SEQ ID NO: 6108657 - DNA, 16 bp, Homo sapiens
ctaagcagccaggagg

SEQ ID NO: 6108658 - DNA, 18 bp, Homo sapiens
ctaagcagccaggaggga

SEQ ID NO: 6108659 - DNA, 18 bp, Homo sapiens
ctaagcagcccagaagcc

SEQ ID NO: 6108660 - DNA, 13 bp, Homo sapiens
ctaagcagctggg

SEQ ID NO: 6108661 - DNA, 15 bp, Homo sapiens
ctaagcagctgggac

SEQ ID NO: 6108662 - DNA, 17 bp, Homo sapiens
ctaagcagctggtcttt

SEQ ID NO: 6108663 - DNA, 18 bp, Homo sapiens
ctaagcagtgcttgtaaa

SEQ ID NO: 6108664 - DNA, 17 bp, Homo sapiens
ctaagcagttgcaatga

SEQ ID NO: 6108665 - DNA, 16 bp, Homo sapiens
ctaagcatggcctgga

SEQ ID NO: 6108666 - DNA, 15 bp, Homo sapiens
ctaagcatgtagcca

SEQ ID NO: 6108667 - DNA, 16 bp, Homo sapiens
ctaagcatgtagccag

SEQ ID NO: 6108668 - DNA, 19 bp, Homo sapiens
ctaagcatgtgtcccagga

SEQ ID NO: 6108669 - DNA, 24 bp, Homo sapiens
ctaagcatgtgtcccaggagcagg

SEQ ID NO: 6108670 - DNA, 20 bp, Homo sapiens
ctaagcattccacactgcag

SEQ ID NO: 6108671 - DNA, 15 bp, Homo sapiens
ctaagcattgcctgg

SEQ ID NO: 6108672 - DNA, 14 bp, Homo sapiens
ctaagcatttaaaa

SEQ ID NO: 6108673 - DNA, 12 bp, Homo sapiens
ctaagccaagct

SEQ ID NO: 6108674 - DNA, 16 bp, Homo sapiens
ctaagccaagctgtgt

SEQ ID NO: 6108675 - DNA, 21 bp, Homo sapiens
ctaagccaagctgtgttcatc

SEQ ID NO: 6108676 - DNA, 11 bp, Homo sapiens
ctaagccaagg

SEQ ID NO: 6108677 - DNA, 13 bp, Homo sapiens
ctaagccacagct

SEQ ID NO: 6108678 - DNA, 19 bp, Homo sapiens
ctaagccacagcttcttca

SEQ ID NO: 6108679 - DNA, 17 bp, Homo sapiens
ctaagccactcccgcca

SEQ ID NO: 6108680 - DNA, 19 bp, Homo sapiens
ctaagccactcccgccaca

SEQ ID NO: 6108681 - DNA, 23 bp, Homo sapiens
ctaagccactcccgccacacgct

SEQ ID NO: 6108682 - DNA, 18 bp, Homo sapiens
ctaagccagcctggtcca

SEQ ID NO: 6108683 - DNA, 15 bp, Homo sapiens
ctaagccaggaggct

SEQ ID NO: 6108684 - DNA, 18 bp, Homo sapiens
ctaagccaggcctggctg

SEQ ID NO: 6108685 - DNA, 22 bp, Homo sapiens
ctaagccagggcccctggatct

SEQ ID NO: 6108686 - DNA, 13 bp, Homo sapiens
ctaagcccaggat

SEQ ID NO: 6108687 - DNA, 16 bp, Homo sapiens
ctaagcccaggatctc

SEQ ID NO: 6108688 - DNA, 20 bp, Homo sapiens
ctaagcccaggatctctttc

SEQ ID NO: 6108689 - DNA, 15 bp, Homo sapiens
ctaagcccccagggc

SEQ ID NO: 6108690 - DNA, 19 bp, Homo sapiens
ctaagcccccagggcctcc

SEQ ID NO: 6108691 - DNA, 21 bp, Homo sapiens
ctaagcccccagggcctccag

SEQ ID NO: 6108692 - DNA, 22 bp, Homo sapiens
ctaagcccccagggcctccagg

SEQ ID NO: 6108693 - DNA, 18 bp, Homo sapiens
ctaagcccccgctgtaat

SEQ ID NO: 6108694 - DNA, 17 bp, Homo sapiens
ctaagccccgtccccta

SEQ ID NO: 6108695 - DNA, 21 bp, Homo sapiens
ctaagccctcgaaccaaggca

SEQ ID NO: 6108696 - DNA, 22 bp, Homo sapiens
ctaagccctcgaaccaaggcag

SEQ ID NO: 6108697 - DNA, 12 bp, Homo sapiens
ctaagccctgtc

SEQ ID NO: 6108698 - DNA, 21 bp, Homo sapiens
ctaagccctgtcgagacactt

SEQ ID NO: 6108699 - DNA, 14 bp, Homo sapiens
ctaagccctgttct

SEQ ID NO: 6108700 - DNA, 17 bp, Homo sapiens
ctaagccctttgccatc

SEQ ID NO: 6108701 - DNA, 24 bp, Homo sapiens
ctaagcctatacgtttctgtggag

SEQ ID NO: 6108702 - DNA, 14 bp, Homo sapiens
ctaagcctcctttt

SEQ ID NO: 6108703 - DNA, 13 bp, Homo sapiens
ctaagcctctgct

SEQ ID NO: 6108704 - DNA, 17 bp, Homo sapiens
ctaagcctctgcttccg

SEQ ID NO: 6108705 - DNA, 17 bp, Homo sapiens
ctaagcctgaaggggcg

SEQ ID NO: 6108706 - DNA, 11 bp, Homo sapiens
ctaagcctgga

SEQ ID NO: 6108707 - DNA, 14 bp, Homo sapiens
ctaagcctggaagc

SEQ ID NO: 6108708 - DNA, 15 bp, Homo sapiens
ctaagcctggaagcc

SEQ ID NO: 6108709 - DNA, 18 bp, Homo sapiens
ctaagcctggacacagtc

SEQ ID NO: 6108710 - DNA, 20 bp, Homo sapiens
ctaagcctggacacagtcag

SEQ ID NO: 6108711 - DNA, 11 bp, Homo sapiens
ctaagcctggc

SEQ ID NO: 6108712 - DNA, 17 bp, Homo sapiens
ctaagcctgtccccaga

SEQ ID NO: 6108713 - DNA, 11 bp, Homo sapiens
ctaagcctgtg

SEQ ID NO: 6108714 - DNA, 15 bp, Homo sapiens
ctaagcctgtggctg

SEQ ID NO: 6108715 - DNA, 14 bp, Homo sapiens
ctaagcctgttgct

SEQ ID NO: 6108716 - DNA, 23 bp, Homo sapiens
ctaagcctgttgctgaagtcatt

SEQ ID NO: 6108717 - DNA, 18 bp, Homo sapiens
ctaagcggtggaggaagg

SEQ ID NO: 6108718 - DNA, 19 bp, Homo sapiens
ctaagctattcagtaataa

SEQ ID NO: 6108719 - DNA, 22 bp, Homo sapiens
ctaagctcaaggcgtgaggatg

SEQ ID NO: 6108720 - DNA, 14 bp, Homo sapiens
ctaagctcctcctt

SEQ ID NO: 6108721 - DNA, 16 bp, Homo sapiens
ctaagctctctgggcc

SEQ ID NO: 6108722 - DNA, 17 bp, Homo sapiens
ctaagctctctgggcct

SEQ ID NO: 6108723 - DNA, 21 bp, Homo sapiens
ctaagctgatattatttcttc

SEQ ID NO: 6108724 - DNA, 22 bp, Homo sapiens
ctaagctgatattatttcttct

SEQ ID NO: 6108725 - DNA, 23 bp, Homo sapiens
ctaagctgatattatttcttctc

SEQ ID NO: 6108726 - DNA, 12 bp, Homo sapiens
ctaagctgcagc

SEQ ID NO: 6108727 - DNA, 14 bp, Homo sapiens
ctaagctgcagctt

SEQ ID NO: 6108728 - DNA, 17 bp, Homo sapiens
ctaagctgcagcttcct

SEQ ID NO: 6108729 - DNA, 23 bp, Homo sapiens
ctaagctgcaggcacacacgcct

SEQ ID NO: 6108730 - DNA, 13 bp, Homo sapiens
ctaagctggagct

SEQ ID NO: 6108731 - DNA, 22 bp, Homo sapiens
ctaagctggagctcttggaaga

SEQ ID NO: 6108732 - DNA, 24 bp, Homo sapiens
ctaagctggagctcttggaagagc

SEQ ID NO: 6108733 - DNA, 22 bp, Homo sapiens
ctaagctggagtgcttatccct

SEQ ID NO: 6108734 - DNA, 13 bp, Homo sapiens
ctaagctgtgtgc

SEQ ID NO: 6108735 - DNA, 15 bp, Homo sapiens
ctaagctgtgtgcag

SEQ ID NO: 6108736 - DNA, 14 bp, Homo sapiens
ctaagctgtttgcc

SEQ ID NO: 6108737 - DNA, 22 bp, Homo sapiens
ctaagctgtttgccaagctgaa

SEQ ID NO: 6108738 - DNA, 16 bp, Homo sapiens
ctaagcttatttctaa

SEQ ID NO: 6108739 - DNA, 21 bp, Homo sapiens
ctaagcttcactgtaaaataa

SEQ ID NO: 6108740 - DNA, 14 bp, Homo sapiens
ctaagcttctagag

SEQ ID NO: 6108741 - DNA, 21 bp, Homo sapiens
ctaagcttctagaggctcatg

SEQ ID NO: 6108742 - DNA, 19 bp, Homo sapiens
ctaagctttgccagctgct

SEQ ID NO: 6108743 - DNA, 20 bp, Homo sapiens
ctaaggaaactgctttattt

SEQ ID NO: 6108744 - DNA, 15 bp, Homo sapiens
ctaaggaacaatgcc

SEQ ID NO: 6108745 - DNA, 14 bp, Homo sapiens
ctaaggaaccttcc

SEQ ID NO: 6108746 - DNA, 22 bp, Homo sapiens
ctaaggaagccagtcaccttct

SEQ ID NO: 6108747 - DNA, 16 bp, Homo sapiens
ctaaggaagggaaagg

SEQ ID NO: 6108748 - DNA, 20 bp, Homo sapiens
ctaaggaatatatatggaat

SEQ ID NO: 6108749 - DNA, 16 bp, Homo sapiens
ctaaggaatgcacaaa

SEQ ID NO: 6108750 - DNA, 18 bp, Homo sapiens
ctaaggacaaattagcat

SEQ ID NO: 6108751 - DNA, 21 bp, Homo sapiens
ctaaggacaaggtaaggaggg

SEQ ID NO: 6108752 - DNA, 16 bp, Homo sapiens
ctaaggacacactaat

SEQ ID NO: 6108753 - DNA, 16 bp, Homo sapiens
ctaaggacatttccca

SEQ ID NO: 6108754 - DNA, 22 bp, Homo sapiens
ctaaggacctgaaattccaaag

SEQ ID NO: 6108755 - DNA, 15 bp, Homo sapiens
ctaaggacttcttta

SEQ ID NO: 6108756 - DNA, 22 bp, Homo sapiens
ctaaggacttctttaattttgg

SEQ ID NO: 6108757 - DNA, 22 bp, Homo sapiens
ctaaggagcaaataccttagct

SEQ ID NO: 6108758 - DNA, 16 bp, Homo sapiens
ctaaggagcagcggga

SEQ ID NO: 6108759 - DNA, 14 bp, Homo sapiens
ctaaggagttaaat

SEQ ID NO: 6108760 - DNA, 16 bp, Homo sapiens
ctaaggatagcctttg

SEQ ID NO: 6108761 - DNA, 12 bp, Homo sapiens
ctaaggatctct

SEQ ID NO: 6108762 - DNA, 17 bp, Homo sapiens
ctaaggatgctaaacct

SEQ ID NO: 6108763 - DNA, 20 bp, Homo sapiens
ctaaggatgtcacagggcca

SEQ ID NO: 6108764 - DNA, 11 bp, Homo sapiens
ctaaggatttt

SEQ ID NO: 6108765 - DNA, 20 bp, Homo sapiens
ctaaggatttttcaagagat

SEQ ID NO: 6108766 - DNA, 14 bp, Homo sapiens
ctaaggcagacagg

SEQ ID NO: 6108767 - DNA, 21 bp, Homo sapiens
ctaaggcagacaggaaggaag

SEQ ID NO: 6108768 - DNA, 22 bp, Homo sapiens
ctaaggcagacaggaaggaagc

SEQ ID NO: 6108769 - DNA, 23 bp, Homo sapiens
ctaaggcagacaggaaggaagca

SEQ ID NO: 6108770 - DNA, 11 bp, Homo sapiens
ctaaggccaag

SEQ ID NO: 6108771 - DNA, 17 bp, Homo sapiens
ctaaggccaaggcctca

SEQ ID NO: 6108772 - DNA, 18 bp, Homo sapiens
ctaaggccaaggcctcag

SEQ ID NO: 6108773 - DNA, 12 bp, Homo sapiens
ctaaggccactg

SEQ ID NO: 6108774 - DNA, 15 bp, Homo sapiens
ctaaggccagctaga

SEQ ID NO: 6108775 - DNA, 16 bp, Homo sapiens
ctaaggccagctagag

SEQ ID NO: 6108776 - DNA, 18 bp, Homo sapiens
ctaaggccagctagagct

SEQ ID NO: 6108777 - DNA, 20 bp, Homo sapiens
ctaaggcccagctgccaggg

SEQ ID NO: 6108778 - DNA, 17 bp, Homo sapiens
ctaaggccctttttcct

SEQ ID NO: 6108779 - DNA, 19 bp, Homo sapiens
ctaaggcctaggattctaa

SEQ ID NO: 6108780 - DNA, 20 bp, Homo sapiens
ctaaggcctaggattctaaa

SEQ ID NO: 6108781 - DNA, 17 bp, Homo sapiens
ctaaggcctcttgctgg

SEQ ID NO: 6108782 - DNA, 16 bp, Homo sapiens
ctaaggcgtggagctg

SEQ ID NO: 6108783 - DNA, 18 bp, Homo sapiens
ctaaggctccccaccccg

SEQ ID NO: 6108784 - DNA, 16 bp, Homo sapiens
ctaaggctcctgtttt

SEQ ID NO: 6108785 - DNA, 22 bp, Homo sapiens
ctaaggctctatgagtctagat

SEQ ID NO: 6108786 - DNA, 23 bp, Homo sapiens
ctaaggctctatgagtctagatg

SEQ ID NO: 6108787 - DNA, 14 bp, Homo sapiens
ctaaggctctgaga

SEQ ID NO: 6108788 - DNA, 19 bp, Homo sapiens
ctaaggctctgagagtcta

SEQ ID NO: 6108789 - DNA, 21 bp, Homo sapiens
ctaaggctctgagagtctaga

SEQ ID NO: 6108790 - DNA, 14 bp, Homo sapiens
ctaaggctgctggc

SEQ ID NO: 6108791 - DNA, 14 bp, Homo sapiens
ctaaggctgctgta

SEQ ID NO: 6108792 - DNA, 15 bp, Homo sapiens
ctaaggcttttattt

SEQ ID NO: 6108793 - DNA, 16 bp, Homo sapiens
ctaagggaaaaagttg

SEQ ID NO: 6108794 - DNA, 17 bp, Homo sapiens
ctaagggaaaaagttgt

SEQ ID NO: 6108795 - DNA, 19 bp, Homo sapiens
ctaagggaaaaagttgtat

SEQ ID NO: 6108796 - DNA, 22 bp, Homo sapiens
ctaagggaacaatccatgtgat

SEQ ID NO: 6108797 - DNA, 15 bp, Homo sapiens
ctaagggaagacatt

SEQ ID NO: 6108798 - DNA, 14 bp, Homo sapiens
ctaagggagacagg

SEQ ID NO: 6108799 - DNA, 17 bp, Homo sapiens
ctaagggagagtggtat

SEQ ID NO: 6108800 - DNA, 17 bp, Homo sapiens
ctaagggatccagagac

SEQ ID NO: 6108801 - DNA, 19 bp, Homo sapiens
ctaagggatccagagacct

SEQ ID NO: 6108802 - DNA, 12 bp, Homo sapiens
ctaagggcagcc

SEQ ID NO: 6108803 - DNA, 13 bp, Homo sapiens
ctaagggcagccc

SEQ ID NO: 6108804 - DNA, 14 bp, Homo sapiens
ctaagggcagccct

SEQ ID NO: 6108805 - DNA, 22 bp, Homo sapiens
ctaagggcaggaagacttccag

SEQ ID NO: 6108806 - DNA, 23 bp, Homo sapiens
ctaagggcttgtttttcttcagc

SEQ ID NO: 6108807 - DNA, 20 bp, Homo sapiens
ctaaggggcagctcctgacc

SEQ ID NO: 6108808 - DNA, 23 bp, Homo sapiens
ctaaggggcagctcctgaccaaa

SEQ ID NO: 6108809 - DNA, 22 bp, Homo sapiens
ctaaggggcaggaatcaaggag

SEQ ID NO: 6108810 - DNA, 22 bp, Homo sapiens
ctaaggggcccggccagccatg

SEQ ID NO: 6108811 - DNA, 14 bp, Homo sapiens
ctaagggggaccat

SEQ ID NO: 6108812 - DNA, 11 bp, Homo sapiens
ctaagggggag

SEQ ID NO: 6108813 - DNA, 18 bp, Homo sapiens
ctaagggggaggggaagt

SEQ ID NO: 6108814 - DNA, 19 bp, Homo sapiens
ctaagggggaggggaagtc

SEQ ID NO: 6108815 - DNA, 20 bp, Homo sapiens
ctaagggggtagaagtagtt

SEQ ID NO: 6108816 - DNA, 22 bp, Homo sapiens
ctaagggtagaaaactccaggg

SEQ ID NO: 6108817 - DNA, 19 bp, Homo sapiens
ctaagggtgggtgctcaga

SEQ ID NO: 6108818 - DNA, 18 bp, Homo sapiens
ctaagggtgtaagtaatt

SEQ ID NO: 6108819 - DNA, 15 bp, Homo sapiens
ctaaggtaacaaatt

SEQ ID NO: 6108820 - DNA, 18 bp, Homo sapiens
ctaaggtccccagcagaa

SEQ ID NO: 6108821 - DNA, 15 bp, Homo sapiens
ctaaggtccctgggg

SEQ ID NO: 6108822 - DNA, 16 bp, Homo sapiens
ctaaggtccctggggg

SEQ ID NO: 6108823 - DNA, 20 bp, Homo sapiens
cctggcttctggagcccttg

SEQ ID NO: 6108824 - DNA, 13 bp, Homo sapiens
cctggcttctggg

SEQ ID NO: 6108825 - DNA, 23 bp, Homo sapiens
cctggcttctgggacaggcacca

SEQ ID NO: 6108826 - DNA, 13 bp, Homo sapiens
cctggcttctgtg

SEQ ID NO: 6108827 - DNA, 14 bp, Homo sapiens
cctggcttgaaaaa

SEQ ID NO: 6108828 - DNA, 15 bp, Homo sapiens
cctggcttgaacctt

SEQ ID NO: 6108829 - DNA, 23 bp, Homo sapiens
cctggcttgagtgatcctcccgc

SEQ ID NO: 6108830 - DNA, 14 bp, Homo sapiens
cctggcttgctcca

SEQ ID NO: 6108831 - DNA, 18 bp, Homo sapiens
cctggcttgctccagggt

SEQ ID NO: 6108832 - DNA, 16 bp, Homo sapiens
cctggcttgctgtggc

SEQ ID NO: 6108833 - DNA, 19 bp, Homo sapiens
cctggcttgcttgccgagc

SEQ ID NO: 6108834 - DNA, 13 bp, Homo sapiens
cctggcttggagg

SEQ ID NO: 6108835 - DNA, 14 bp, Homo sapiens
cctggcttggaggc

SEQ ID NO: 6108836 - DNA, 16 bp, Homo sapiens
cctggcttgtttattt

SEQ ID NO: 6108837 - DNA, 12 bp, Homo sapiens
cctggctttgcc

SEQ ID NO: 6108838 - DNA, 17 bp, Homo sapiens
cctggctttgcccaacc

SEQ ID NO: 6108839 - DNA, 14 bp, Homo sapiens
cctggctttgcctc

SEQ ID NO: 6108840 - DNA, 19 bp, Homo sapiens
cctggctttgcctcttctt

SEQ ID NO: 6108841 - DNA, 22 bp, Homo sapiens
cctggctttggaatgctccagg

SEQ ID NO: 6108842 - DNA, 22 bp, Homo sapiens
cctggcttttaaacctgttcct

SEQ ID NO: 6108843 - DNA, 16 bp, Homo sapiens
cctggcttttacttta

SEQ ID NO: 6108844 - DNA, 18 bp, Homo sapiens
cctggcttttcactgctg

SEQ ID NO: 6108845 - DNA, 20 bp, Homo sapiens
cctggcttttcactgctggc

SEQ ID NO: 6108846 - DNA, 18 bp, Homo sapiens
cctggcttttctggctgg

SEQ ID NO: 6108847 - DNA, 15 bp, Homo sapiens
cctggctttttaaaa

SEQ ID NO: 6108848 - DNA, 18 bp, Homo sapiens
cctggctttttaaaatat

SEQ ID NO: 6108849 - DNA, 19 bp, Homo sapiens
cctgggaaaacagaggaat

SEQ ID NO: 6108850 - DNA, 21 bp, Homo sapiens
cctgggaaaagggcaggagcc

SEQ ID NO: 6108851 - DNA, 18 bp, Homo sapiens
cctgggaaagcccctgcc

SEQ ID NO: 6108852 - DNA, 21 bp, Homo sapiens
cctgggaaaggaaaaccaggg

SEQ ID NO: 6108853 - DNA, 15 bp, Homo sapiens
cctgggaaaggaccc

SEQ ID NO: 6108854 - DNA, 14 bp, Homo sapiens
cctgggaaagggag

SEQ ID NO: 6108855 - DNA, 19 bp, Homo sapiens
cctgggaaagggagatgtc

SEQ ID NO: 6108856 - DNA, 23 bp, Homo sapiens
cctgggaaattgctccattcctg

SEQ ID NO: 6108857 - DNA, 13 bp, Homo sapiens
cctgggaacacag

SEQ ID NO: 6108858 - DNA, 14 bp, Homo sapiens
cctgggaacacagt

SEQ ID NO: 6108859 - DNA, 17 bp, Homo sapiens
cctgggaacacagttct

SEQ ID NO: 6108860 - DNA, 21 bp, Homo sapiens
cctgggaacacagttctgggc

SEQ ID NO: 6108861 - DNA, 15 bp, Homo sapiens
cctgggaaccatgaa

SEQ ID NO: 6108862 - DNA, 15 bp, Homo sapiens
cctgggaacctcctt

SEQ ID NO: 6108863 - DNA, 20 bp, Homo sapiens
cctgggaaccttcctgtctt

SEQ ID NO: 6108864 - DNA, 16 bp, Homo sapiens
cctgggaactcatcct

SEQ ID NO: 6108865 - DNA, 18 bp, Homo sapiens
cctgggaactcatcctgt

SEQ ID NO: 6108866 - DNA, 15 bp, Homo sapiens
cctgggaactctcct

SEQ ID NO: 6108867 - DNA, 19 bp, Homo sapiens
cctgggaactctcctggcc

SEQ ID NO: 6108868 - DNA, 20 bp, Homo sapiens
cctgggaactctcctggcct

SEQ ID NO: 6108869 - DNA, 21 bp, Homo sapiens
cctgggaactctcctggcctt

SEQ ID NO: 6108870 - DNA, 17 bp, Homo sapiens
cctgggaagcccaccca

SEQ ID NO: 6108871 - DNA, 21 bp, Homo sapiens
cctgggaaggaggccgctatg

SEQ ID NO: 6108872 - DNA, 18 bp, Homo sapiens
cctgggaaggagggagct

SEQ ID NO: 6108873 - DNA, 20 bp, Homo sapiens
cctgggaaggagggagctgc

SEQ ID NO: 6108874 - DNA, 13 bp, Homo sapiens
cctgggaaggcca

SEQ ID NO: 6108875 - DNA, 14 bp, Homo sapiens
cctgggaaggccag

SEQ ID NO: 6108876 - DNA, 22 bp, Homo sapiens
cctgggaaggcctcttggagac

SEQ ID NO: 6108877 - DNA, 21 bp, Homo sapiens
cctgggaaggctactcacctt

SEQ ID NO: 6108878 - DNA, 16 bp, Homo sapiens
cctgggaatcctgctg

SEQ ID NO: 6108879 - DNA, 20 bp, Homo sapiens
cctgggaatcctgctgccag

SEQ ID NO: 6108880 - DNA, 23 bp, Homo sapiens
cctgggaatctaagtgggagaca

SEQ ID NO: 6108881 - DNA, 18 bp, Homo sapiens
cctgggaatggaataact

SEQ ID NO: 6108882 - DNA, 14 bp, Homo sapiens
cctgggaatgtatt

SEQ ID NO: 6108883 - DNA, 14 bp, Homo sapiens
cctgggaatttcag

SEQ ID NO: 6108884 - DNA, 18 bp, Homo sapiens
cctgggacaactgctccc

SEQ ID NO: 6108885 - DNA, 19 bp, Homo sapiens
cctgggacaagcaggccgc

SEQ ID NO: 6108886 - DNA, 14 bp, Homo sapiens
cctgggacacacac

SEQ ID NO: 6108887 - DNA, 23 bp, Homo sapiens
cctgggacacagacccaggaccc

SEQ ID NO: 6108888 - DNA, 22 bp, Homo sapiens
cctgggacactgcgggacagag

SEQ ID NO: 6108889 - DNA, 16 bp, Homo sapiens
cctgggacacttccct

SEQ ID NO: 6108890 - DNA, 19 bp, Homo sapiens
cctgggacagggagcagcc

SEQ ID NO: 6108891 - DNA, 21 bp, Homo sapiens
cctgggacatcaggagactgg

SEQ ID NO: 6108892 - DNA, 23 bp, Homo sapiens
cctgggacatcaggagactgggc

SEQ ID NO: 6108893 - DNA, 19 bp, Homo sapiens
cctgggaccaacctgacct

SEQ ID NO: 6108894 - DNA, 14 bp, Homo sapiens
cctgggaccagggc

SEQ ID NO: 6108895 - DNA, 16 bp, Homo sapiens
cctgggacccagctac

SEQ ID NO: 6108896 - DNA, 18 bp, Homo sapiens
cctgggacccagctactc

SEQ ID NO: 6108897 - DNA, 15 bp, Homo sapiens
cctgggaccccctcg

SEQ ID NO: 6108898 - DNA, 17 bp, Homo sapiens
cctgggaccccctcgcc

SEQ ID NO: 6108899 - DNA, 13 bp, Homo sapiens
cctgggacccttg

SEQ ID NO: 6108900 - DNA, 14 bp, Homo sapiens
cctgggacccttgg

SEQ ID NO: 6108901 - DNA, 15 bp, Homo sapiens
cctgggacccttggc

SEQ ID NO: 6108902 - DNA, 17 bp, Homo sapiens
cctgggacctccccagc

SEQ ID NO: 6108903 - DNA, 20 bp, Homo sapiens
cctgggacctccccagccca

SEQ ID NO: 6108904 - DNA, 22 bp, Homo sapiens
cctgggacctccccagcccagg

SEQ ID NO: 6108905 - DNA, 19 bp, Homo sapiens
cctgggacctcccctgagg

SEQ ID NO: 6108906 - DNA, 18 bp, Homo sapiens
cctgggacgcccctttct

SEQ ID NO: 6108907 - DNA, 18 bp, Homo sapiens
cctgggacggcggcagta

SEQ ID NO: 6108908 - DNA, 19 bp, Homo sapiens
cctgggactaaagccagga

SEQ ID NO: 6108909 - DNA, 17 bp, Homo sapiens
cctgggactgctgcttc

SEQ ID NO: 6108910 - DNA, 22 bp, Homo sapiens
cctgggactttcccacccagga

SEQ ID NO: 6108911 - DNA, 15 bp, Homo sapiens
cctgggagacaactg

SEQ ID NO: 6108912 - DNA, 14 bp, Homo sapiens
cctgggagacagac

SEQ ID NO: 6108913 - DNA, 13 bp, Homo sapiens
cctgggagaggac

SEQ ID NO: 6108914 - DNA, 14 bp, Homo sapiens
cctgggagagtgag

SEQ ID NO: 6108915 - DNA, 17 bp, Homo sapiens
cctgggagatgcagctg

SEQ ID NO: 6108916 - DNA, 18 bp, Homo sapiens
cctgggagatgcagctgg

SEQ ID NO: 6108917 - DNA, 16 bp, Homo sapiens
cctgggagccactggg

SEQ ID NO: 6108918 - DNA, 20 bp, Homo sapiens
cctgggagccagtcctccac

SEQ ID NO: 6108919 - DNA, 13 bp, Homo sapiens
cctgggagcccac

SEQ ID NO: 6108920 - DNA, 16 bp, Homo sapiens
cctgggagcccagagg

SEQ ID NO: 6108921 - DNA, 22 bp, Homo sapiens
cctgggagcccccaccacaaac

SEQ ID NO: 6108922 - DNA, 18 bp, Homo sapiens
cctgggagcgcctgaccc

SEQ ID NO: 6108923 - DNA, 19 bp, Homo sapiens
cctgggaggaaatttgaat

SEQ ID NO: 6108924 - DNA, 18 bp, Homo sapiens
cctgggaggaagatgttt

SEQ ID NO: 6108925 - DNA, 15 bp, Homo sapiens
cctgggaggacaggc

SEQ ID NO: 6108926 - DNA, 16 bp, Homo sapiens
cctgggaggacaggca

SEQ ID NO: 6108927 - DNA, 18 bp, Homo sapiens
cctgggaggacaggcagg

SEQ ID NO: 6108928 - DNA, 13 bp, Homo sapiens
cctgggaggcaga

SEQ ID NO: 6108929 - DNA, 17 bp, Homo sapiens
cctgggaggccctggca

SEQ ID NO: 6108930 - DNA, 18 bp, Homo sapiens
cctgggaggccctggcag

SEQ ID NO: 6108931 - DNA, 23 bp, Homo sapiens
cctgggaggcgggcgcactgcct

SEQ ID NO: 6108932 - DNA, 16 bp, Homo sapiens
cctgggaggctgcagc

SEQ ID NO: 6108933 - DNA, 19 bp, Homo sapiens
cctgggaggctgcagccag

SEQ ID NO: 6108934 - DNA, 15 bp, Homo sapiens
cctgggaggctgcgg

SEQ ID NO: 6108935 - DNA, 22 bp, Homo sapiens
cctgggagggacatgcttagca

SEQ ID NO: 6108936 - DNA, 21 bp, Homo sapiens
cctgggagggttcccctggcc

SEQ ID NO: 6108937 - DNA, 23 bp, Homo sapiens
cctgggaggtggaggttgcagtg

SEQ ID NO: 6108938 - DNA, 22 bp, Homo sapiens
cctgggagtgttcccgtgcctg

SEQ ID NO: 6108939 - DNA, 17 bp, Homo sapiens
cctgggataggggcaga

SEQ ID NO: 6108940 - DNA, 14 bp, Homo sapiens
cctgggatccagtg

SEQ ID NO: 6108941 - DNA, 20 bp, Homo sapiens
cctgggatccctcatcctca

SEQ ID NO: 6108942 - DNA, 19 bp, Homo sapiens
cctgggatccgagggcccc

SEQ ID NO: 6108943 - DNA, 18 bp, Homo sapiens
cctgggatcgtgcatttg

SEQ ID NO: 6108944 - DNA, 15 bp, Homo sapiens
cctgggatctgctcg

SEQ ID NO: 6108945 - DNA, 14 bp, Homo sapiens
cctgggatgatgtg

SEQ ID NO: 6108946 - DNA, 13 bp, Homo sapiens
cctgggatgcagt

SEQ ID NO: 6108947 - DNA, 12 bp, Homo sapiens
cctgggatgccc

SEQ ID NO: 6108948 - DNA, 22 bp, Homo sapiens
cctgggatgcccttcccccttt

SEQ ID NO: 6108949 - DNA, 14 bp, Homo sapiens
cctgggatgcctca

SEQ ID NO: 6108950 - DNA, 15 bp, Homo sapiens
cctgggatgcctcac

SEQ ID NO: 6108951 - DNA, 17 bp, Homo sapiens
cctgggatgctgaccca

SEQ ID NO: 6108952 - DNA, 18 bp, Homo sapiens
cctgggatgctgacccag

SEQ ID NO: 6108953 - DNA, 19 bp, Homo sapiens
cctgggatgctgacccagg

SEQ ID NO: 6108954 - DNA, 22 bp, Homo sapiens
cctgggatggacgctgccggga

SEQ ID NO: 6108955 - DNA, 18 bp, Homo sapiens
cctgggatgggctcccac

SEQ ID NO: 6108956 - DNA, 20 bp, Homo sapiens
cctgggatgtccacagatgc

SEQ ID NO: 6108957 - DNA, 18 bp, Homo sapiens
cctgggcaaacagagcta

SEQ ID NO: 6108958 - DNA, 23 bp, Homo sapiens
cctgggcaaacagagctactgag

SEQ ID NO: 6108959 - DNA, 13 bp, Homo sapiens
cctgggcaaagcc

SEQ ID NO: 6108960 - DNA, 17 bp, Homo sapiens
cctgggcaacaagagca

SEQ ID NO: 6108961 - DNA, 19 bp, Homo sapiens
cctgggcaacagagcaaga

SEQ ID NO: 6108962 - DNA, 19 bp, Homo sapiens
cctgggcaagtgaggcaag

SEQ ID NO: 6108963 - DNA, 22 bp, Homo sapiens
cctgggcaagtgaggcaagaga

SEQ ID NO: 6108964 - DNA, 23 bp, Homo sapiens
cctgggcaagtgaggcaagagaa

SEQ ID NO: 6108965 - DNA, 22 bp, Homo sapiens
cctgggcaagtggatggcccag

SEQ ID NO: 6108966 - DNA, 18 bp, Homo sapiens
cctgggcaatggccaggg

SEQ ID NO: 6108967 - DNA, 13 bp, Homo sapiens
cctgggcacaaac

SEQ ID NO: 6108968 - DNA, 18 bp, Homo sapiens
cctgggcacacgctgctc

SEQ ID NO: 6108969 - DNA, 16 bp, Homo sapiens
cctgggcaccagcatt

SEQ ID NO: 6108970 - DNA, 15 bp, Homo sapiens
cctgggcacccacct

SEQ ID NO: 6108971 - DNA, 18 bp, Homo sapiens
cctgggcacccacctcca

SEQ ID NO: 6108972 - DNA, 21 bp, Homo sapiens
cctgggcacccacctccaccc

SEQ ID NO: 6108973 - DNA, 20 bp, Homo sapiens
cctgggcaccccaggcagct

SEQ ID NO: 6108974 - DNA, 21 bp, Homo sapiens
cctgggcaccccaggcagctc

SEQ ID NO: 6108975 - DNA, 13 bp, Homo sapiens
cctgggcaccctg

SEQ ID NO: 6108976 - DNA, 15 bp, Homo sapiens
cctgggcaccctgca

SEQ ID NO: 6108977 - DNA, 15 bp, Homo sapiens
cctgggcacctgggg

SEQ ID NO: 6108978 - DNA, 13 bp, Homo sapiens
cctgggcactccg

SEQ ID NO: 6108979 - DNA, 19 bp, Homo sapiens
cctgggcactccgcgccga

SEQ ID NO: 6108980 - DNA, 12 bp, Homo sapiens
cctgggcagaag

SEQ ID NO: 6108981 - DNA, 22 bp, Homo sapiens
cctgggcagagggcctggacct

SEQ ID NO: 6108982 - DNA, 18 bp, Homo sapiens
cctgggcagatgtccccc

SEQ ID NO: 6108983 - DNA, 17 bp, Homo sapiens
cctgggcagcacctccg

SEQ ID NO: 6108984 - DNA, 19 bp, Homo sapiens
cctgggcagcacctccggg

SEQ ID NO: 6108985 - DNA, 20 bp, Homo sapiens
cctgggcagcacctccggga

SEQ ID NO: 6108986 - DNA, 22 bp, Homo sapiens
cctgggcagcacctccgggact

SEQ ID NO: 6108987 - DNA, 19 bp, Homo sapiens
cctgggcagcatactgaga

SEQ ID NO: 6108988 - DNA, 18 bp, Homo sapiens
cctgggcagccaggctgc

SEQ ID NO: 6108989 - DNA, 13 bp, Homo sapiens
cctgggcagccca

SEQ ID NO: 6108990 - DNA, 22 bp, Homo sapiens
cctgggcagcctttccagcctc

SEQ ID NO: 6108991 - DNA, 12 bp, Homo sapiens
cctgggcagctc

SEQ ID NO: 6108992 - DNA, 13 bp, Homo sapiens
cctgggcagctcc

SEQ ID NO: 6108993 - DNA, 14 bp, Homo sapiens
cctgggcagctcct

SEQ ID NO: 6108994 - DNA, 22 bp, Homo sapiens
cctgggcagctcctccctgtgc

SEQ ID NO: 6108995 - DNA, 14 bp, Homo sapiens
cctgggcagctgcc

SEQ ID NO: 6108996 - DNA, 15 bp, Homo sapiens
cctgggcagctgcct

SEQ ID NO: 6108997 - DNA, 18 bp, Homo sapiens
cctgggcagctgcctccc

SEQ ID NO: 6108998 - DNA, 19 bp, Homo sapiens
cctgggcagcttgggctgg

SEQ ID NO: 6108999 - DNA, 21 bp, Homo sapiens
cctgggcagcttgggctggcg

SEQ ID NO: 6109000 - DNA, 10 bp, Homo sapiens
cctgggcagg

SEQ ID NO: 6109001 - DNA, 18 bp, Homo sapiens
ctaaggttcttgctttct

SEQ ID NO: 6109002 - DNA, 16 bp, Homo sapiens
ctaagtaaaaatatta

SEQ ID NO: 6109003 - DNA, 17 bp, Homo sapiens
ctaagtaaaaatattaa

SEQ ID NO: 6109004 - DNA, 14 bp, Homo sapiens
ctaagtaaaaccac

SEQ ID NO: 6109005 - DNA, 16 bp, Homo sapiens
ctaagtaaaagggtgg

SEQ ID NO: 6109006 - DNA, 16 bp, Homo sapiens
ctaagtaaatacaatt

SEQ ID NO: 6109007 - DNA, 17 bp, Homo sapiens
ctaagtaaatacaattt

SEQ ID NO: 6109008 - DNA, 18 bp, Homo sapiens
ctaagtaaatacaatttt

SEQ ID NO: 6109009 - DNA, 18 bp, Homo sapiens
ctaagtaaatctaaatta

SEQ ID NO: 6109010 - DNA, 15 bp, Homo sapiens
ctaagtaaattttct

SEQ ID NO: 6109011 - DNA, 21 bp, Homo sapiens
ctaagtaacctctacaggcat

SEQ ID NO: 6109012 - DNA, 17 bp, Homo sapiens
ctaagtaagaaacacaa

SEQ ID NO: 6109013 - DNA, 15 bp, Homo sapiens
ctaagtaagtgtctg

SEQ ID NO: 6109014 - DNA, 15 bp, Homo sapiens
ctaagtaatttagaa

SEQ ID NO: 6109015 - DNA, 11 bp, Homo sapiens
ctaagtacaag

SEQ ID NO: 6109016 - DNA, 15 bp, Homo sapiens
ctaagtacccttggg

SEQ ID NO: 6109017 - DNA, 21 bp, Homo sapiens
ctaagtactgtaataatacct

SEQ ID NO: 6109018 - DNA, 19 bp, Homo sapiens
ctaagtacttgctctctga

SEQ ID NO: 6109019 - DNA, 20 bp, Homo sapiens
ctaagtagctgggtttacag

SEQ ID NO: 6109020 - DNA, 17 bp, Homo sapiens
ctaagtaggggcagtga

SEQ ID NO: 6109021 - DNA, 22 bp, Homo sapiens
ctaagtatattatatggcagga

SEQ ID NO: 6109022 - DNA, 13 bp, Homo sapiens
ctaagtattaaaa

SEQ ID NO: 6109023 - DNA, 13 bp, Homo sapiens
ctaagtatttccc

SEQ ID NO: 6109024 - DNA, 21 bp, Homo sapiens
ctaagtcacccagagcacagg

SEQ ID NO: 6109025 - DNA, 18 bp, Homo sapiens
ctaagtcatggtcctggc

SEQ ID NO: 6109026 - DNA, 20 bp, Homo sapiens
ctaagtcatggtcctggctg

SEQ ID NO: 6109027 - DNA, 21 bp, Homo sapiens
ctaagtcatggtcctggctgg

SEQ ID NO: 6109028 - DNA, 14 bp, Homo sapiens
ctaagtcattcata

SEQ ID NO: 6109029 - DNA, 19 bp, Homo sapiens
ctaagtccagtgtttcttt

SEQ ID NO: 6109030 - DNA, 16 bp, Homo sapiens
ctaagtccctgccccc

SEQ ID NO: 6109031 - DNA, 17 bp, Homo sapiens
ctaagtccctgccccct

SEQ ID NO: 6109032 - DNA, 15 bp, Homo sapiens
ctaagtcccttccta

SEQ ID NO: 6109033 - DNA, 22 bp, Homo sapiens
ctaagtcccttcctattctcct

SEQ ID NO: 6109034 - DNA, 15 bp, Homo sapiens
ctaagtcctttatgt

SEQ ID NO: 6109035 - DNA, 13 bp, Homo sapiens
ctaagtctctgtg

SEQ ID NO: 6109036 - DNA, 17 bp, Homo sapiens
ctaagtctcttttttac

SEQ ID NO: 6109037 - DNA, 20 bp, Homo sapiens
ctaagtctcttttttacaaa

SEQ ID NO: 6109038 - DNA, 17 bp, Homo sapiens
ctaagtctgttattgtt

SEQ ID NO: 6109039 - DNA, 16 bp, Homo sapiens
ctaagtctttccattg

SEQ ID NO: 6109040 - DNA, 13 bp, Homo sapiens
ctaagtctttccc

SEQ ID NO: 6109041 - DNA, 23 bp, Homo sapiens
ctaagtgaaataagccagacatc

SEQ ID NO: 6109042 - DNA, 16 bp, Homo sapiens
ctaagtgacatttgta

SEQ ID NO: 6109043 - DNA, 21 bp, Homo sapiens
ctaagtgactaccacttattt

SEQ ID NO: 6109044 - DNA, 19 bp, Homo sapiens
ctaagtgatttccacaggt

SEQ ID NO: 6109045 - DNA, 14 bp, Homo sapiens
ctaagtgcaaacac

SEQ ID NO: 6109046 - DNA, 17 bp, Homo sapiens
ctaagtgctgctgtgga

SEQ ID NO: 6109047 - DNA, 21 bp, Homo sapiens
ctaagtggattggctttgtgc

SEQ ID NO: 6109048 - DNA, 14 bp, Homo sapiens
ctaagtggctgcct

SEQ ID NO: 6109049 - DNA, 20 bp, Homo sapiens
ctaagtggctgccttctttc

SEQ ID NO: 6109050 - DNA, 20 bp, Homo sapiens
ctaagtggggtgcatccccc

SEQ ID NO: 6109051 - DNA, 23 bp, Homo sapiens
ctaagtgtaaaagtagtaaattt

SEQ ID NO: 6109052 - DNA, 23 bp, Homo sapiens
ctaagtgtaacctcagtatttat

SEQ ID NO: 6109053 - DNA, 13 bp, Homo sapiens
ctaagtgtgctta

SEQ ID NO: 6109054 - DNA, 22 bp, Homo sapiens
ctaagtgtgcttagttttaata

SEQ ID NO: 6109055 - DNA, 18 bp, Homo sapiens
ctaagtgtggatgttcag

SEQ ID NO: 6109056 - DNA, 18 bp, Homo sapiens
ctaagtgttgaagaagag

SEQ ID NO: 6109057 - DNA, 17 bp, Homo sapiens
ctaagtgttgacttttt

SEQ ID NO: 6109058 - DNA, 20 bp, Homo sapiens
ctaagttaaatcattttcat

SEQ ID NO: 6109059 - DNA, 14 bp, Homo sapiens
ctaagttaataata

SEQ ID NO: 6109060 - DNA, 15 bp, Homo sapiens
ctaagttatgtacgt

SEQ ID NO: 6109061 - DNA, 18 bp, Homo sapiens
ctaagttattacctctcc

SEQ ID NO: 6109062 - DNA, 13 bp, Homo sapiens
ctaagttattgct

SEQ ID NO: 6109063 - DNA, 17 bp, Homo sapiens
ctaagttatttactttt

SEQ ID NO: 6109064 - DNA, 22 bp, Homo sapiens
ctaagttcatgtttgtaaatta

SEQ ID NO: 6109065 - DNA, 20 bp, Homo sapiens
ctaagttccactgagctcca

SEQ ID NO: 6109066 - DNA, 15 bp, Homo sapiens
ctaagttcccttcta

SEQ ID NO: 6109067 - DNA, 12 bp, Homo sapiens
ctaagttctccc

SEQ ID NO: 6109068 - DNA, 20 bp, Homo sapiens
ctaagttcttagatatcttt

SEQ ID NO: 6109069 - DNA, 21 bp, Homo sapiens
ctaagttgagtatattataat

SEQ ID NO: 6109070 - DNA, 23 bp, Homo sapiens
ctaagttgcaagatcttatttat

SEQ ID NO: 6109071 - DNA, 23 bp, Homo sapiens
ctaagtttagaagcgctcatctg

SEQ ID NO: 6109072 - DNA, 18 bp, Homo sapiens
ctaagtttctaagattct

SEQ ID NO: 6109073 - DNA, 19 bp, Homo sapiens
ctaagtttctaagattcta

SEQ ID NO: 6109074 - DNA, 21 bp, Homo sapiens
ctaagtttctaagattctaaa

SEQ ID NO: 6109075 - DNA, 23 bp, Homo sapiens
ctaagtttctaagattctaaagg

SEQ ID NO: 6109076 - DNA, 19 bp, Homo sapiens
ctaagtttttttcattttt

SEQ ID NO: 6109077 - DNA, 19 bp, Homo sapiens
ctaataaaaaacatttatt

SEQ ID NO: 6109078 - DNA, 13 bp, Homo sapiens
ctaataaaaaggt

SEQ ID NO: 6109079 - DNA, 15 bp, Homo sapiens
ctaataaaaaggtga

SEQ ID NO: 6109080 - DNA, 19 bp, Homo sapiens
ctaataaaaaggtgaccat

SEQ ID NO: 6109081 - DNA, 12 bp, Homo sapiens
ctaataaaactg

SEQ ID NO: 6109082 - DNA, 13 bp, Homo sapiens
ctaataaaactga

SEQ ID NO: 6109083 - DNA, 15 bp, Homo sapiens
ctaataaaactgatg

SEQ ID NO: 6109084 - DNA, 20 bp, Homo sapiens
ctaataaaactgatgtgaaa

SEQ ID NO: 6109085 - DNA, 13 bp, Homo sapiens
ctaataaaagcat

SEQ ID NO: 6109086 - DNA, 15 bp, Homo sapiens
ctaataaaataagtg

SEQ ID NO: 6109087 - DNA, 13 bp, Homo sapiens
ctaataaaatata

SEQ ID NO: 6109088 - DNA, 15 bp, Homo sapiens
ctaataaaatatata

SEQ ID NO: 6109089 - DNA, 15 bp, Homo sapiens
ctaataaaatatcat

SEQ ID NO: 6109090 - DNA, 16 bp, Homo sapiens
ctaataaaatatcatt

SEQ ID NO: 6109091 - DNA, 18 bp, Homo sapiens
ctaataaaatatcattca

SEQ ID NO: 6109092 - DNA, 14 bp, Homo sapiens
ctaataaaatattt

SEQ ID NO: 6109093 - DNA, 15 bp, Homo sapiens
ctaataaaatatttt

SEQ ID NO: 6109094 - DNA, 18 bp, Homo sapiens
ctaataaaatattttctg

SEQ ID NO: 6109095 - DNA, 19 bp, Homo sapiens
ctaataaaatattttctgt

SEQ ID NO: 6109096 - DNA, 20 bp, Homo sapiens
ctaataaaatattttctgtg

SEQ ID NO: 6109097 - DNA, 23 bp, Homo sapiens
ctaataaaatattttctgtgtgt

SEQ ID NO: 6109098 - DNA, 20 bp, Homo sapiens
ctaataaaattcagaattct

SEQ ID NO: 6109099 - DNA, 13 bp, Homo sapiens
ctaataaacactg

SEQ ID NO: 6109100 - DNA, 21 bp, Homo sapiens
ctaataaacactggctctggg

SEQ ID NO: 6109101 - DNA, 14 bp, Homo sapiens
ctaataaacactgt

SEQ ID NO: 6109102 - DNA, 19 bp, Homo sapiens
ctaataaactaataattgc

SEQ ID NO: 6109103 - DNA, 16 bp, Homo sapiens
ctaataaactgtatta

SEQ ID NO: 6109104 - DNA, 18 bp, Homo sapiens
ctaataaactgtattaaa

SEQ ID NO: 6109105 - DNA, 21 bp, Homo sapiens
ctaataaactgtattaaatct

SEQ ID NO: 6109106 - DNA, 11 bp, Homo sapiens
ctaataaactt

SEQ ID NO: 6109107 - DNA, 12 bp, Homo sapiens
ctaataaacttt

SEQ ID NO: 6109108 - DNA, 12 bp, Homo sapiens
ctaataaagctg

SEQ ID NO: 6109109 - DNA, 13 bp, Homo sapiens
ctaataaagctgt

SEQ ID NO: 6109110 - DNA, 13 bp, Homo sapiens
ctaataaataatc

SEQ ID NO: 6109111 - DNA, 18 bp, Homo sapiens
ctaataaatataatttat

SEQ ID NO: 6109112 - DNA, 23 bp, Homo sapiens
ctaataaatataatttataagca

SEQ ID NO: 6109113 - DNA, 16 bp, Homo sapiens
ctaataaatgaccagt

SEQ ID NO: 6109114 - DNA, 20 bp, Homo sapiens
ctaataaatgaccagtttac

SEQ ID NO: 6109115 - DNA, 22 bp, Homo sapiens
ctaataaatgccaactggtcac

SEQ ID NO: 6109116 - DNA, 14 bp, Homo sapiens
ctaataaatggact

SEQ ID NO: 6109117 - DNA, 12 bp, Homo sapiens
ctaataactttt

SEQ ID NO: 6109118 - DNA, 22 bp, Homo sapiens
ctaataaggcatgcgaaatgtt

SEQ ID NO: 6109119 - DNA, 18 bp, Homo sapiens
ctaataagtgacaaataa

SEQ ID NO: 6109120 - DNA, 23 bp, Homo sapiens
ctaataagtttgtgttagaaaag

SEQ ID NO: 6109121 - DNA, 12 bp, Homo sapiens
ctaataataaat

SEQ ID NO: 6109122 - DNA, 16 bp, Homo sapiens
ctaataataaatagtt

SEQ ID NO: 6109123 - DNA, 23 bp, Homo sapiens
ctaataataaatgcatagagcaa

SEQ ID NO: 6109124 - DNA, 15 bp, Homo sapiens
ctaataatcttgttt

SEQ ID NO: 6109125 - DNA, 18 bp, Homo sapiens
ctaataattgtatctaca

SEQ ID NO: 6109126 - DNA, 23 bp, Homo sapiens
ctaataattgtatctacattaaa

SEQ ID NO: 6109127 - DNA, 15 bp, Homo sapiens
ctaatacaaaactat

SEQ ID NO: 6109128 - DNA, 16 bp, Homo sapiens
ctaatacaatggtcat

SEQ ID NO: 6109129 - DNA, 19 bp, Homo sapiens
ctaatacagcaacaattta

SEQ ID NO: 6109130 - DNA, 23 bp, Homo sapiens
ctaatacagcaacaatttatgaa

SEQ ID NO: 6109131 - DNA, 15 bp, Homo sapiens
ctaataccaactatt

SEQ ID NO: 6109132 - DNA, 13 bp, Homo sapiens
ctaatacctctgt

SEQ ID NO: 6109133 - DNA, 15 bp, Homo sapiens
ctaatacctctgtgt

SEQ ID NO: 6109134 - DNA, 16 bp, Homo sapiens
ctaatacctctgtgtg

SEQ ID NO: 6109135 - DNA, 17 bp, Homo sapiens
ctaatacctctgtgtgc

SEQ ID NO: 6109136 - DNA, 20 bp, Homo sapiens
ctaatacctcttactttgct

SEQ ID NO: 6109137 - DNA, 22 bp, Homo sapiens
ctaatacgtgccagatataact

SEQ ID NO: 6109138 - DNA, 15 bp, Homo sapiens
ctaatacttactgtt

SEQ ID NO: 6109139 - DNA, 18 bp, Homo sapiens
ctaatagaaaagtatgtt

SEQ ID NO: 6109140 - DNA, 13 bp, Homo sapiens
ctaatagaaagaa

SEQ ID NO: 6109141 - DNA, 19 bp, Homo sapiens
ctaatagaaagaaattact

SEQ ID NO: 6109142 - DNA, 21 bp, Homo sapiens
ctaatagaaagaaattacttc

SEQ ID NO: 6109143 - DNA, 17 bp, Homo sapiens
ctaatagactaaatgaa

SEQ ID NO: 6109144 - DNA, 14 bp, Homo sapiens
ctaatagagtactt

SEQ ID NO: 6109145 - DNA, 15 bp, Homo sapiens
ctaatagagtactta

SEQ ID NO: 6109146 - DNA, 18 bp, Homo sapiens
ctaatagcctaaaagatt

SEQ ID NO: 6109147 - DNA, 24 bp, Homo sapiens
ctaatagcctaaaagattttgtga

SEQ ID NO: 6109148 - DNA, 19 bp, Homo sapiens
ctaatagctacatctactt

SEQ ID NO: 6109149 - DNA, 13 bp, Homo sapiens
ctaatagctgcta

SEQ ID NO: 6109150 - DNA, 14 bp, Homo sapiens
ctaatagcttttta

SEQ ID NO: 6109151 - DNA, 14 bp, Homo sapiens
ctaatagtataaac

SEQ ID NO: 6109152 - DNA, 17 bp, Homo sapiens
ctaatatacagggtagc

SEQ ID NO: 6109153 - DNA, 14 bp, Homo sapiens
ctaatatacagtgt

SEQ ID NO: 6109154 - DNA, 13 bp, Homo sapiens
ctaatatactttt

SEQ ID NO: 6109155 - DNA, 23 bp, Homo sapiens
ctaatatagtaggggttgaagaa

SEQ ID NO: 6109156 - DNA, 13 bp, Homo sapiens
ctaatatatatga

SEQ ID NO: 6109157 - DNA, 18 bp, Homo sapiens
ctaatatatattttaagg

SEQ ID NO: 6109158 - DNA, 19 bp, Homo sapiens
ctaatatatattttaaggt

SEQ ID NO: 6109159 - DNA, 14 bp, Homo sapiens
ctaatatatgaaat

SEQ ID NO: 6109160 - DNA, 19 bp, Homo sapiens
ctaatatatgaaataagta

SEQ ID NO: 6109161 - DNA, 16 bp, Homo sapiens
ctaatatattccaacg

SEQ ID NO: 6109162 - DNA, 11 bp, Homo sapiens
ctaatatattt

SEQ ID NO: 6109163 - DNA, 21 bp, Homo sapiens
ctaatatatttttatatttag

SEQ ID NO: 6109164 - DNA, 17 bp, Homo sapiens
ctaatatcattttattc

SEQ ID NO: 6109165 - DNA, 19 bp, Homo sapiens
ctaatatccaacacaacta

SEQ ID NO: 6109166 - DNA, 22 bp, Homo sapiens
ctaatatccacttgtccatgtg

SEQ ID NO: 6109167 - DNA, 17 bp, Homo sapiens
ctaatatccccaaatta

SEQ ID NO: 6109168 - DNA, 22 bp, Homo sapiens
ctaatatccccaaattagggca

SEQ ID NO: 6109169 - DNA, 17 bp, Homo sapiens
ctaatatgattatacaa

SEQ ID NO: 6109170 - DNA, 17 bp, Homo sapiens
ctaatatgcctaatctg

SEQ ID NO: 6109171 - DNA, 13 bp, Homo sapiens
ctaatattaaaaa

SEQ ID NO: 6109172 - DNA, 14 bp, Homo sapiens
ctaatattaaaaat

SEQ ID NO: 6109173 - DNA, 16 bp, Homo sapiens
ctaatattaaaaatat

SEQ ID NO: 6109174 - DNA, 15 bp, Homo sapiens
ctaatattaaacctt

SEQ ID NO: 6109175 - DNA, 23 bp, Homo sapiens
ctaatattagttcccttaacaaa

SEQ ID NO: 6109176 - DNA, 22 bp, Homo sapiens
ctaatattagttggctttcata

SEQ ID NO: 6109177 - DNA, 19 bp, Homo sapiens
ctaatattcagtcctgtat

SEQ ID NO: 6109178 - DNA, 20 bp, Homo sapiens
ctaatattcatgctgcctgc

SEQ ID NO: 6109179 - DNA, 19 bp, Homo sapiens
ctaatattgaaaatgtcac

SEQ ID NO: 6109180 - DNA, 11 bp, Homo sapiens
cctgggcagga

SEQ ID NO: 6109181 - DNA, 15 bp, Homo sapiens
cctgggcaggaccct

SEQ ID NO: 6109182 - DNA, 16 bp, Homo sapiens
cctgggcaggaccctg

SEQ ID NO: 6109183 - DNA, 12 bp, Homo sapiens
cctgggcaggag

SEQ ID NO: 6109184 - DNA, 12 bp, Homo sapiens
cctgggcaggcg

SEQ ID NO: 6109185 - DNA, 20 bp, Homo sapiens
cctgggcaggtgggagctga

SEQ ID NO: 6109186 - DNA, 19 bp, Homo sapiens
cctgggcagtgagtgccat

SEQ ID NO: 6109187 - DNA, 13 bp, Homo sapiens
cctgggcagtgcc

SEQ ID NO: 6109188 - DNA, 22 bp, Homo sapiens
cctgggcatatccaccacctcc

SEQ ID NO: 6109189 - DNA, 21 bp, Homo sapiens
cctgggcatcagggcctttct

SEQ ID NO: 6109190 - DNA, 14 bp, Homo sapiens
cctgggcatcccca

SEQ ID NO: 6109191 - DNA, 16 bp, Homo sapiens
cctgggcatctggccc

SEQ ID NO: 6109192 - DNA, 19 bp, Homo sapiens
cctgggcatctggccctgc

SEQ ID NO: 6109193 - DNA, 24 bp, Homo sapiens
cctgggcatctggccctgctgccc

SEQ ID NO: 6109194 - DNA, 18 bp, Homo sapiens
cctgggcatcttctggct

SEQ ID NO: 6109195 - DNA, 20 bp, Homo sapiens
cctgggcatcttctggcttg

SEQ ID NO: 6109196 - DNA, 18 bp, Homo sapiens
cctgggcatgggtccagg

SEQ ID NO: 6109197 - DNA, 19 bp, Homo sapiens
cctgggcatgggtccaggg

SEQ ID NO: 6109198 - DNA, 13 bp, Homo sapiens
cctgggcatgtcc

SEQ ID NO: 6109199 - DNA, 14 bp, Homo sapiens
cctgggcatgtccc

SEQ ID NO: 6109200 - DNA, 23 bp, Homo sapiens
cctgggcatgtccccagtgtgga

SEQ ID NO: 6109201 - DNA, 15 bp, Homo sapiens
cctgggcattgcttt

SEQ ID NO: 6109202 - DNA, 16 bp, Homo sapiens
cctgggcattgctttc

SEQ ID NO: 6109203 - DNA, 17 bp, Homo sapiens
cctgggcattgctttcc

SEQ ID NO: 6109204 - DNA, 18 bp, Homo sapiens
cctgggccaaggactcca

SEQ ID NO: 6109205 - DNA, 12 bp, Homo sapiens
cctgggccacac

SEQ ID NO: 6109206 - DNA, 23 bp, Homo sapiens
cctgggccacacctgagcgctgt

SEQ ID NO: 6109207 - DNA, 12 bp, Homo sapiens
cctgggccaccc

SEQ ID NO: 6109208 - DNA, 16 bp, Homo sapiens
cctgggccacccttca

SEQ ID NO: 6109209 - DNA, 18 bp, Homo sapiens
cctgggccacccttcacg

SEQ ID NO: 6109210 - DNA, 17 bp, Homo sapiens
cctgggccagcccagga

SEQ ID NO: 6109211 - DNA, 12 bp, Homo sapiens
cctgggccaggc

SEQ ID NO: 6109212 - DNA, 19 bp, Homo sapiens
cctgggccaggcaggcgat

SEQ ID NO: 6109213 - DNA, 14 bp, Homo sapiens
cctgggccagggcg

SEQ ID NO: 6109214 - DNA, 15 bp, Homo sapiens
cctgggccagggtct

SEQ ID NO: 6109215 - DNA, 23 bp, Homo sapiens
cctgggccagggtctcgtcagga

SEQ ID NO: 6109216 - DNA, 22 bp, Homo sapiens
cctgggcccacagagcctggct

SEQ ID NO: 6109217 - DNA, 13 bp, Homo sapiens
cctgggcccaggc

SEQ ID NO: 6109218 - DNA, 16 bp, Homo sapiens
cctgggcccaggcagc

SEQ ID NO: 6109219 - DNA, 16 bp, Homo sapiens
cctgggcccaggccca

SEQ ID NO: 6109220 - DNA, 17 bp, Homo sapiens
cctgggcccaggctctg

SEQ ID NO: 6109221 - DNA, 22 bp, Homo sapiens
cctgggcccatctccctgcttt

SEQ ID NO: 6109222 - DNA, 21 bp, Homo sapiens
cctgggccccaccacctaggc

SEQ ID NO: 6109223 - DNA, 14 bp, Homo sapiens
cctgggccccactg

SEQ ID NO: 6109224 - DNA, 18 bp, Homo sapiens
cctgggccccactggaca

SEQ ID NO: 6109225 - DNA, 20 bp, Homo sapiens
cctgggccccagttgtattt

SEQ ID NO: 6109226 - DNA, 14 bp, Homo sapiens
cctgggcccctcag

SEQ ID NO: 6109227 - DNA, 16 bp, Homo sapiens
cctgggcccctcagcc

SEQ ID NO: 6109228 - DNA, 22 bp, Homo sapiens
cctgggcccctcatctgctcag

SEQ ID NO: 6109229 - DNA, 22 bp, Homo sapiens
cctgggcccctccacgcctcct

SEQ ID NO: 6109230 - DNA, 15 bp, Homo sapiens
cctgggcccctccct

SEQ ID NO: 6109231 - DNA, 20 bp, Homo sapiens
cctgggcccctccctacctc

SEQ ID NO: 6109232 - DNA, 22 bp, Homo sapiens
cctgggcccgctttgcctgctt

SEQ ID NO: 6109233 - DNA, 13 bp, Homo sapiens
cctgggccctagg

SEQ ID NO: 6109234 - DNA, 14 bp, Homo sapiens
cctgggccctaggc

SEQ ID NO: 6109235 - DNA, 18 bp, Homo sapiens
cctgggccctaggcatac

SEQ ID NO: 6109236 - DNA, 11 bp, Homo sapiens
cctgggccctc

SEQ ID NO: 6109237 - DNA, 12 bp, Homo sapiens
cctgggccctgg

SEQ ID NO: 6109238 - DNA, 17 bp, Homo sapiens
cctgggccctgggctgg

SEQ ID NO: 6109239 - DNA, 18 bp, Homo sapiens
cctgggccctgggctgga

SEQ ID NO: 6109240 - DNA, 19 bp, Homo sapiens
cctgggccctgggctggaa

SEQ ID NO: 6109241 - DNA, 17 bp, Homo sapiens
cctgggccctggggcct

SEQ ID NO: 6109242 - DNA, 20 bp, Homo sapiens
cctgggccctggggcctgta

SEQ ID NO: 6109243 - DNA, 21 bp, Homo sapiens
cctgggccgcgtgccgggccc

SEQ ID NO: 6109244 - DNA, 19 bp, Homo sapiens
cctgggccggcgagggggc

SEQ ID NO: 6109245 - DNA, 21 bp, Homo sapiens
cctgggccggctgagtggcag

SEQ ID NO: 6109246 - DNA, 23 bp, Homo sapiens
cctgggccggctgagtggcagca

SEQ ID NO: 6109247 - DNA, 20 bp, Homo sapiens
cctgggccgtatctccggct

SEQ ID NO: 6109248 - DNA, 22 bp, Homo sapiens
cctgggccgtatctccggctcc

SEQ ID NO: 6109249 - DNA, 18 bp, Homo sapiens
cctgggcctatggagagc

SEQ ID NO: 6109250 - DNA, 19 bp, Homo sapiens
cctgggcctatggagagcc

SEQ ID NO: 6109251 - DNA, 18 bp, Homo sapiens
cctgggcctcagcctcca

SEQ ID NO: 6109252 - DNA, 19 bp, Homo sapiens
cctgggcctcagcctccag

SEQ ID NO: 6109253 - DNA, 20 bp, Homo sapiens
cctgggcctcagcctccagg

SEQ ID NO: 6109254 - DNA, 22 bp, Homo sapiens
cctgggcctcagttcaacctgg

SEQ ID NO: 6109255 - DNA, 12 bp, Homo sapiens
cctgggcctcca

SEQ ID NO: 6109256 - DNA, 17 bp, Homo sapiens
cctgggcctccacctct

SEQ ID NO: 6109257 - DNA, 14 bp, Homo sapiens
cctgggcctcccaa

SEQ ID NO: 6109258 - DNA, 13 bp, Homo sapiens
cctgggcctcccg

SEQ ID NO: 6109259 - DNA, 22 bp, Homo sapiens
cctgggcctcccgtccgtccgc

SEQ ID NO: 6109260 - DNA, 22 bp, Homo sapiens
cctgggcctcctcctagctgga

SEQ ID NO: 6109261 - DNA, 17 bp, Homo sapiens
cctgggcctcctgggaa

SEQ ID NO: 6109262 - DNA, 14 bp, Homo sapiens
cctgggcctgcccc

SEQ ID NO: 6109263 - DNA, 19 bp, Homo sapiens
cctgggcctgctgctgaga

SEQ ID NO: 6109264 - DNA, 20 bp, Homo sapiens
cctgggcctgcttttccagg

SEQ ID NO: 6109265 - DNA, 21 bp, Homo sapiens
cctgggcctgcttttccagga

SEQ ID NO: 6109266 - DNA, 13 bp, Homo sapiens
cctgggcctggag

SEQ ID NO: 6109267 - DNA, 12 bp, Homo sapiens
cctgggcctgtc

SEQ ID NO: 6109268 - DNA, 13 bp, Homo sapiens
cctgggcctgtcc

SEQ ID NO: 6109269 - DNA, 13 bp, Homo sapiens
cctgggcctgtgc

SEQ ID NO: 6109270 - DNA, 19 bp, Homo sapiens
cctgggcctgtgcagcagc

SEQ ID NO: 6109271 - DNA, 20 bp, Homo sapiens
cctgggcctgtgcagcagcc

SEQ ID NO: 6109272 - DNA, 23 bp, Homo sapiens
cctgggccttacctcccctgcca

SEQ ID NO: 6109273 - DNA, 17 bp, Homo sapiens
cctgggccttctcagct

SEQ ID NO: 6109274 - DNA, 13 bp, Homo sapiens
cctgggccttggc

SEQ ID NO: 6109275 - DNA, 15 bp, Homo sapiens
cctgggccttggctg

SEQ ID NO: 6109276 - DNA, 21 bp, Homo sapiens
cctgggccttggctgggcctc

SEQ ID NO: 6109277 - DNA, 18 bp, Homo sapiens
cctgggccttgggctccg

SEQ ID NO: 6109278 - DNA, 23 bp, Homo sapiens
cctgggcctttgcaagatgcttg

SEQ ID NO: 6109279 - DNA, 16 bp, Homo sapiens
cctgggcgacagagca

SEQ ID NO: 6109280 - DNA, 21 bp, Homo sapiens
cctgggcgcagctgaagcctg

SEQ ID NO: 6109281 - DNA, 13 bp, Homo sapiens
cctgggcgccctg

SEQ ID NO: 6109282 - DNA, 19 bp, Homo sapiens
cctgggcgccctggaagcc

SEQ ID NO: 6109283 - DNA, 18 bp, Homo sapiens
cctgggcggggccgcagc

SEQ ID NO: 6109284 - DNA, 22 bp, Homo sapiens
cctgggcggggccgcagccaca

SEQ ID NO: 6109285 - DNA, 23 bp, Homo sapiens
cctgggcggggccgcagccacac

SEQ ID NO: 6109286 - DNA, 13 bp, Homo sapiens
cctgggctaagca

SEQ ID NO: 6109287 - DNA, 15 bp, Homo sapiens
cctgggctacaagga

SEQ ID NO: 6109288 - DNA, 18 bp, Homo sapiens
cctgggctaccatctgca

SEQ ID NO: 6109289 - DNA, 16 bp, Homo sapiens
cctgggctcagcctga

SEQ ID NO: 6109290 - DNA, 16 bp, Homo sapiens
cctgggctccacacag

SEQ ID NO: 6109291 - DNA, 16 bp, Homo sapiens
cctgggctccctcttg

SEQ ID NO: 6109292 - DNA, 17 bp, Homo sapiens
cctgggctccctcttgt

SEQ ID NO: 6109293 - DNA, 20 bp, Homo sapiens
cctgggctccctggaggact

SEQ ID NO: 6109294 - DNA, 12 bp, Homo sapiens
cctgggctcctc

SEQ ID NO: 6109295 - DNA, 14 bp, Homo sapiens
cctgggctcctctg

SEQ ID NO: 6109296 - DNA, 14 bp, Homo sapiens
cctgggctcctctt

SEQ ID NO: 6109297 - DNA, 15 bp, Homo sapiens
cctgggctcggaggc

SEQ ID NO: 6109298 - DNA, 18 bp, Homo sapiens
cctgggctcggaggctgc

SEQ ID NO: 6109299 - DNA, 18 bp, Homo sapiens
cctgggctctcacccagt

SEQ ID NO: 6109300 - DNA, 24 bp, Homo sapiens
cctgggctctcacccagtccccac

SEQ ID NO: 6109301 - DNA, 12 bp, Homo sapiens
cctgggctctga

SEQ ID NO: 6109302 - DNA, 14 bp, Homo sapiens
cctgggctctgccc

SEQ ID NO: 6109303 - DNA, 15 bp, Homo sapiens
cctgggctctggaag

SEQ ID NO: 6109304 - DNA, 23 bp, Homo sapiens
cctgggctctggaagaggccttc

SEQ ID NO: 6109305 - DNA, 13 bp, Homo sapiens
cctgggctctggg

SEQ ID NO: 6109306 - DNA, 17 bp, Homo sapiens
cctgggctctgggagca

SEQ ID NO: 6109307 - DNA, 19 bp, Homo sapiens
cctgggctctgtgggctgc

SEQ ID NO: 6109308 - DNA, 14 bp, Homo sapiens
cctgggctgccacc

SEQ ID NO: 6109309 - DNA, 16 bp, Homo sapiens
cctgggctgcctcctc

SEQ ID NO: 6109310 - DNA, 14 bp, Homo sapiens
cctgggctggaatc

SEQ ID NO: 6109311 - DNA, 14 bp, Homo sapiens
cctgggctggactg

SEQ ID NO: 6109312 - DNA, 16 bp, Homo sapiens
cctgggctggactgga

SEQ ID NO: 6109313 - DNA, 18 bp, Homo sapiens
cctgggctggactggagg

SEQ ID NO: 6109314 - DNA, 12 bp, Homo sapiens
cctgggctggca

SEQ ID NO: 6109315 - DNA, 13 bp, Homo sapiens
cctgggctggcac

SEQ ID NO: 6109316 - DNA, 19 bp, Homo sapiens
cctgggctggcacagcccc

SEQ ID NO: 6109317 - DNA, 20 bp, Homo sapiens
cctgggctggcactgctggg

SEQ ID NO: 6109318 - DNA, 13 bp, Homo sapiens
cctgggctgggcc

SEQ ID NO: 6109319 - DNA, 14 bp, Homo sapiens
cctgggctgggccc

SEQ ID NO: 6109320 - DNA, 12 bp, Homo sapiens
cctgggctgggg

SEQ ID NO: 6109321 - DNA, 21 bp, Homo sapiens
cctgggctggggccaccatcc

SEQ ID NO: 6109322 - DNA, 19 bp, Homo sapiens
cctgggctggggcctcaga

SEQ ID NO: 6109323 - DNA, 22 bp, Homo sapiens
cctgggctggggcctcagaccc

SEQ ID NO: 6109324 - DNA, 17 bp, Homo sapiens
cctgggctgggtgctgg

SEQ ID NO: 6109325 - DNA, 19 bp, Homo sapiens
cctgggctgggtggcccct

SEQ ID NO: 6109326 - DNA, 14 bp, Homo sapiens
cctgggctggttgg

SEQ ID NO: 6109327 - DNA, 14 bp, Homo sapiens
cctgggctgtccag

SEQ ID NO: 6109328 - DNA, 15 bp, Homo sapiens
cctgggctgtgagga

SEQ ID NO: 6109329 - DNA, 17 bp, Homo sapiens
cctgggctgtgatgtga

SEQ ID NO: 6109330 - DNA, 15 bp, Homo sapiens
cctgggctgtgctgc

SEQ ID NO: 6109331 - DNA, 16 bp, Homo sapiens
cctgggctgttggcac

SEQ ID NO: 6109332 - DNA, 18 bp, Homo sapiens
cctgggctgttggcactc

SEQ ID NO: 6109333 - DNA, 23 bp, Homo sapiens
cctgggctgttggcactcacaga

SEQ ID NO: 6109334 - DNA, 13 bp, Homo sapiens
cctgggctgttgt

SEQ ID NO: 6109335 - DNA, 20 bp, Homo sapiens
cctgggctgttgtgtctgga

SEQ ID NO: 6109336 - DNA, 22 bp, Homo sapiens
cctgggctgttgtgtctggagc

SEQ ID NO: 6109337 - DNA, 13 bp, Homo sapiens
cctgggcttggcc

SEQ ID NO: 6109338 - DNA, 21 bp, Homo sapiens
cctgggcttggcctgctgtga

SEQ ID NO: 6109339 - DNA, 17 bp, Homo sapiens
cctgggcttggctcttg

SEQ ID NO: 6109340 - DNA, 20 bp, Homo sapiens
cctgggcttggtaagtgaat

SEQ ID NO: 6109341 - DNA, 12 bp, Homo sapiens
cctgggctttct

SEQ ID NO: 6109342 - DNA, 15 bp, Homo sapiens
cctgggctttctgga

SEQ ID NO: 6109343 - DNA, 16 bp, Homo sapiens
cctggggaagaggcct

SEQ ID NO: 6109344 - DNA, 20 bp, Homo sapiens
cctggggaagaggccttggg

SEQ ID NO: 6109345 - DNA, 18 bp, Homo sapiens
cctggggaaggagccagt

SEQ ID NO: 6109346 - DNA, 13 bp, Homo sapiens
cctggggacagag

SEQ ID NO: 6109347 - DNA, 16 bp, Homo sapiens
cctggggaccaggagc

SEQ ID NO: 6109348 - DNA, 19 bp, Homo sapiens
cctggggaccaggagctag

SEQ ID NO: 6109349 - DNA, 13 bp, Homo sapiens
cctggggacccaa

SEQ ID NO: 6109350 - DNA, 14 bp, Homo sapiens
cctggggaccccac

SEQ ID NO: 6109351 - DNA, 17 bp, Homo sapiens
cctggggaccccactcc

SEQ ID NO: 6109352 - DNA, 17 bp, Homo sapiens
cctggggaccccacttc

SEQ ID NO: 6109353 - DNA, 19 bp, Homo sapiens
cctggggaccccacttcag

SEQ ID NO: 6109354 - DNA, 24 bp, Homo sapiens
cctggggacggagcactgtgcagc

SEQ ID NO: 6109355 - DNA, 14 bp, Homo sapiens
cctggggactcctc

SEQ ID NO: 6109356 - DNA, 15 bp, Homo sapiens
cctggggactcctca

SEQ ID NO: 6109357 - DNA, 22 bp, Homo sapiens
cctggggactgttccaaagcca

SEQ ID NO: 6109358 - DNA, 22 bp, Homo sapiens
cctggggacttcaactgcccag

SEQ ID NO: 6109359 - DNA, 18 bp, Homo sapiens
cctggggacttgatgttc

SEQ ID NO: 6109360 - DNA, 20 bp, Homo sapiens
ctaatattgaaaatgtcact

SEQ ID NO: 6109361 - DNA, 21 bp, Homo sapiens
ctaatattgaaaatgtcactg

SEQ ID NO: 6109362 - DNA, 23 bp, Homo sapiens
ctaatattgaaaatgtcactgtt

SEQ ID NO: 6109363 - DNA, 12 bp, Homo sapiens
ctaatattgctt

SEQ ID NO: 6109364 - DNA, 17 bp, Homo sapiens
ctaatattgcttcttgt

SEQ ID NO: 6109365 - DNA, 16 bp, Homo sapiens
ctaatatttattgctt

SEQ ID NO: 6109366 - DNA, 18 bp, Homo sapiens
ctaatatttattgcttta

SEQ ID NO: 6109367 - DNA, 17 bp, Homo sapiens
ctaatatttgtctgtgt

SEQ ID NO: 6109368 - DNA, 20 bp, Homo sapiens
ctaatatttgtctgtgtgct

SEQ ID NO: 6109369 - DNA, 22 bp, Homo sapiens
ctaatatttgtctgtgtgctac

SEQ ID NO: 6109370 - DNA, 23 bp, Homo sapiens
ctaatatttgtctgtgtgctact

SEQ ID NO: 6109371 - DNA, 14 bp, Homo sapiens
ctaatattttattt

SEQ ID NO: 6109372 - DNA, 17 bp, Homo sapiens
ctaatattttatttgaa

SEQ ID NO: 6109373 - DNA, 20 bp, Homo sapiens
ctaatcaaaactttcgttgt

SEQ ID NO: 6109374 - DNA, 18 bp, Homo sapiens
ctaatcacaaactgaatg

SEQ ID NO: 6109375 - DNA, 20 bp, Homo sapiens
ctaatcacaaactgaatgac

SEQ ID NO: 6109376 - DNA, 22 bp, Homo sapiens
ctaatcacagtgttgcatatga

SEQ ID NO: 6109377 - DNA, 21 bp, Homo sapiens
ctaatcacagtttttcctgga

SEQ ID NO: 6109378 - DNA, 22 bp, Homo sapiens
ctaatcacagtttttcctggaa

SEQ ID NO: 6109379 - DNA, 23 bp, Homo sapiens
ctaatcacatgtgctgcaaatag

SEQ ID NO: 6109380 - DNA, 18 bp, Homo sapiens
ctaatcaccatgtaagca

SEQ ID NO: 6109381 - DNA, 16 bp, Homo sapiens
ctaatcagagtggcca

SEQ ID NO: 6109382 - DNA, 21 bp, Homo sapiens
ctaatcagcattctcactcct

SEQ ID NO: 6109383 - DNA, 14 bp, Homo sapiens
ctaatcagtgatta

SEQ ID NO: 6109384 - DNA, 21 bp, Homo sapiens
ctaatcagtgattatttttcc

SEQ ID NO: 6109385 - DNA, 21 bp, Homo sapiens
ctaatcagtgtctcacactgg

SEQ ID NO: 6109386 - DNA, 17 bp, Homo sapiens
ctaatcatacaccagaa

SEQ ID NO: 6109387 - DNA, 19 bp, Homo sapiens
ctaatcatacaccagaaga

SEQ ID NO: 6109388 - DNA, 22 bp, Homo sapiens
ctaatcatacaccagaagacaa

SEQ ID NO: 6109389 - DNA, 14 bp, Homo sapiens
ctaatcatgaaact

SEQ ID NO: 6109390 - DNA, 15 bp, Homo sapiens
ctaatcatgagaaaa

SEQ ID NO: 6109391 - DNA, 21 bp, Homo sapiens
ctaatcatgagaaaaactgtt

SEQ ID NO: 6109392 - DNA, 18 bp, Homo sapiens
ctaatcatgtttctccca

SEQ ID NO: 6109393 - DNA, 15 bp, Homo sapiens
ctaatccaacccatg

SEQ ID NO: 6109394 - DNA, 23 bp, Homo sapiens
ctaatccacctggtggccctgcg

SEQ ID NO: 6109395 - DNA, 17 bp, Homo sapiens
ctaatccaggcagatcc

SEQ ID NO: 6109396 - DNA, 23 bp, Homo sapiens
ctaatccaggcagatccaggact

SEQ ID NO: 6109397 - DNA, 19 bp, Homo sapiens
ctaatccattatcctttat

SEQ ID NO: 6109398 - DNA, 20 bp, Homo sapiens
ctaatccccttctcccctgc

SEQ ID NO: 6109399 - DNA, 14 bp, Homo sapiens
ctaatccctccctc

SEQ ID NO: 6109400 - DNA, 17 bp, Homo sapiens
ctaatcctatctgggga

SEQ ID NO: 6109401 - DNA, 12 bp, Homo sapiens
ctaatcctccaa

SEQ ID NO: 6109402 - DNA, 22 bp, Homo sapiens
ctaatccttctcattacccacc

SEQ ID NO: 6109403 - DNA, 14 bp, Homo sapiens
ctaatccttttcct

SEQ ID NO: 6109404 - DNA, 16 bp, Homo sapiens
ctaatcgccctgagct

SEQ ID NO: 6109405 - DNA, 15 bp, Homo sapiens
ctaatctagtgacac

SEQ ID NO: 6109406 - DNA, 18 bp, Homo sapiens
ctaatctattgggttcat

SEQ ID NO: 6109407 - DNA, 16 bp, Homo sapiens
ctaatctcaatttaag

SEQ ID NO: 6109408 - DNA, 17 bp, Homo sapiens
ctaatctcaatttaaga

SEQ ID NO: 6109409 - DNA, 22 bp, Homo sapiens
ctaatctcatacctctgaccaa

SEQ ID NO: 6109410 - DNA, 19 bp, Homo sapiens
ctaatctccacccaatgaa

SEQ ID NO: 6109411 - DNA, 22 bp, Homo sapiens
ctaatctccacccaatgaatga

SEQ ID NO: 6109412 - DNA, 16 bp, Homo sapiens
ctaatctcttattcta

SEQ ID NO: 6109413 - DNA, 23 bp, Homo sapiens
ctaatctgagctgcagcctggct

SEQ ID NO: 6109414 - DNA, 11 bp, Homo sapiens
ctaatctgcct

SEQ ID NO: 6109415 - DNA, 22 bp, Homo sapiens
ctaatctgtagggctggaccta

SEQ ID NO: 6109416 - DNA, 19 bp, Homo sapiens
ctaatctgtgctgtttcaa

SEQ ID NO: 6109417 - DNA, 22 bp, Homo sapiens
ctaatctgtgctgtttcaaagt

SEQ ID NO: 6109418 - DNA, 20 bp, Homo sapiens
ctaatcttaaccctgtgctg

SEQ ID NO: 6109419 - DNA, 23 bp, Homo sapiens
ctaatcttaaccctgtgctgtca

SEQ ID NO: 6109420 - DNA, 17 bp, Homo sapiens
ctaatcttattcatttt

SEQ ID NO: 6109421 - DNA, 18 bp, Homo sapiens
ctaatcttattcattttc

SEQ ID NO: 6109422 - DNA, 19 bp, Homo sapiens
ctaatcttattcattttct

SEQ ID NO: 6109423 - DNA, 14 bp, Homo sapiens
ctaatcttccgtca

SEQ ID NO: 6109424 - DNA, 16 bp, Homo sapiens
ctaatcttgaatgttt

SEQ ID NO: 6109425 - DNA, 14 bp, Homo sapiens
ctaatcttgtgaaa

SEQ ID NO: 6109426 - DNA, 16 bp, Homo sapiens
ctaatcttgtgaaaat

SEQ ID NO: 6109427 - DNA, 23 bp, Homo sapiens
ctaatcttgttaaattgcttatt

SEQ ID NO: 6109428 - DNA, 15 bp, Homo sapiens
ctaatctttaatata

SEQ ID NO: 6109429 - DNA, 19 bp, Homo sapiens
ctaatctttcacttgaaag

SEQ ID NO: 6109430 - DNA, 20 bp, Homo sapiens
ctaatgaaaaacaaaaagct

SEQ ID NO: 6109431 - DNA, 18 bp, Homo sapiens
ctaatgaaagtgatgaca

SEQ ID NO: 6109432 - DNA, 15 bp, Homo sapiens
ctaatgaaattgtga

SEQ ID NO: 6109433 - DNA, 12 bp, Homo sapiens
ctaatgaagaca

SEQ ID NO: 6109434 - DNA, 14 bp, Homo sapiens
ctaatgaagagaaa

SEQ ID NO: 6109435 - DNA, 18 bp, Homo sapiens
ctaatgaagggaaaggat

SEQ ID NO: 6109436 - DNA, 17 bp, Homo sapiens
ctaatgaagtgtttcct

SEQ ID NO: 6109437 - DNA, 22 bp, Homo sapiens
ctaatgaatgcataaaatgtta

SEQ ID NO: 6109438 - DNA, 13 bp, Homo sapiens
ctaatgaattgaa

SEQ ID NO: 6109439 - DNA, 14 bp, Homo sapiens
ctaatgaattgaaa

SEQ ID NO: 6109440 - DNA, 16 bp, Homo sapiens
ctaatgaattgaaatt

SEQ ID NO: 6109441 - DNA, 17 bp, Homo sapiens
ctaatgaattgaaattt

SEQ ID NO: 6109442 - DNA, 15 bp, Homo sapiens
ctaatgacattcaat

SEQ ID NO: 6109443 - DNA, 12 bp, Homo sapiens
ctaatgaccaac

SEQ ID NO: 6109444 - DNA, 13 bp, Homo sapiens
ctaatgacccaga

SEQ ID NO: 6109445 - DNA, 13 bp, Homo sapiens
ctaatgagactga

SEQ ID NO: 6109446 - DNA, 23 bp, Homo sapiens
ctaatgagatatatctttatact

SEQ ID NO: 6109447 - DNA, 17 bp, Homo sapiens
ctaatgagcatttcctt

SEQ ID NO: 6109448 - DNA, 19 bp, Homo sapiens
ctaatgaggagagaaaata

SEQ ID NO: 6109449 - DNA, 20 bp, Homo sapiens
ctaatgaggagagaaaatat

SEQ ID NO: 6109450 - DNA, 23 bp, Homo sapiens
ctaatgaggagagaaaatatatg

SEQ ID NO: 6109451 - DNA, 21 bp, Homo sapiens
ctaatgagggaaatctgtaaa

SEQ ID NO: 6109452 - DNA, 16 bp, Homo sapiens
ctaatgagtatttggt

SEQ ID NO: 6109453 - DNA, 17 bp, Homo sapiens
ctaatgagtatttggta

SEQ ID NO: 6109454 - DNA, 22 bp, Homo sapiens
ctaatgagttgctggaaaatca

SEQ ID NO: 6109455 - DNA, 19 bp, Homo sapiens
ctaatgagtttcttttata

SEQ ID NO: 6109456 - DNA, 20 bp, Homo sapiens
ctaatgatgacttgagccct

SEQ ID NO: 6109457 - DNA, 19 bp, Homo sapiens
ctaatgatgttagtaactt

SEQ ID NO: 6109458 - DNA, 12 bp, Homo sapiens
ctaatgatgttt

SEQ ID NO: 6109459 - DNA, 13 bp, Homo sapiens
ctaatgatgtttt

SEQ ID NO: 6109460 - DNA, 22 bp, Homo sapiens
ctaatgcataagctttttaatg

SEQ ID NO: 6109461 - DNA, 12 bp, Homo sapiens
ctaatgcatatt

SEQ ID NO: 6109462 - DNA, 14 bp, Homo sapiens
ctaatgcatattta

SEQ ID NO: 6109463 - DNA, 21 bp, Homo sapiens
ctaatgcatatttataagaga

SEQ ID NO: 6109464 - DNA, 12 bp, Homo sapiens
ctaatgcattaa

SEQ ID NO: 6109465 - DNA, 21 bp, Homo sapiens
ctaatgcattttgcactagaa

SEQ ID NO: 6109466 - DNA, 19 bp, Homo sapiens
ctaatgccctatgtgtata

SEQ ID NO: 6109467 - DNA, 17 bp, Homo sapiens
ctaatgcctttcatctt

SEQ ID NO: 6109468 - DNA, 19 bp, Homo sapiens
ctaatgcgcaggctggccc

SEQ ID NO: 6109469 - DNA, 22 bp, Homo sapiens
ctaatgctaagaaatgctgaaa

SEQ ID NO: 6109470 - DNA, 14 bp, Homo sapiens
ctaatgctctgaaa

SEQ ID NO: 6109471 - DNA, 11 bp, Homo sapiens
ctaatgctgca

SEQ ID NO: 6109472 - DNA, 24 bp, Homo sapiens
ctaatgctgcacaccagttactgt

SEQ ID NO: 6109473 - DNA, 15 bp, Homo sapiens
ctaatgcttgattta

SEQ ID NO: 6109474 - DNA, 13 bp, Homo sapiens
ctaatgctttctg

SEQ ID NO: 6109475 - DNA, 21 bp, Homo sapiens
ctaatggaaaatgattttact

SEQ ID NO: 6109476 - DNA, 20 bp, Homo sapiens
ctaatggactgaccttaaaa

SEQ ID NO: 6109477 - DNA, 18 bp, Homo sapiens
ctaatggagtgtttgaaa

SEQ ID NO: 6109478 - DNA, 20 bp, Homo sapiens
ctaatggagtgtttgaaaac

SEQ ID NO: 6109479 - DNA, 21 bp, Homo sapiens
ctaatggagtgtttgaaaact

SEQ ID NO: 6109480 - DNA, 23 bp, Homo sapiens
ctaatggagtgtttgaaaactga

SEQ ID NO: 6109481 - DNA, 17 bp, Homo sapiens
ctaatggattcaattac

SEQ ID NO: 6109482 - DNA, 17 bp, Homo sapiens
ctaatggcatggagact

SEQ ID NO: 6109483 - DNA, 15 bp, Homo sapiens
ctaatgggaatcatt

SEQ ID NO: 6109484 - DNA, 17 bp, Homo sapiens
ctaatgggaatcattcc

SEQ ID NO: 6109485 - DNA, 19 bp, Homo sapiens
ctaatggggaaatgtagct

SEQ ID NO: 6109486 - DNA, 21 bp, Homo sapiens
ctaatgggggcagtctcccct

SEQ ID NO: 6109487 - DNA, 17 bp, Homo sapiens
ctaatggtaacttttgt

SEQ ID NO: 6109488 - DNA, 21 bp, Homo sapiens
ctaatggtacgtgggtaccca

SEQ ID NO: 6109489 - DNA, 15 bp, Homo sapiens
ctaatggttgtacat

SEQ ID NO: 6109490 - DNA, 16 bp, Homo sapiens
ctaatgtaaaatgatt

SEQ ID NO: 6109491 - DNA, 19 bp, Homo sapiens
ctaatgtaaactttgtcat

SEQ ID NO: 6109492 - DNA, 15 bp, Homo sapiens
ctaatgtacgctgct

SEQ ID NO: 6109493 - DNA, 17 bp, Homo sapiens
ctaatgtactgtacata

SEQ ID NO: 6109494 - DNA, 18 bp, Homo sapiens
ctaatgtagctatttttc

SEQ ID NO: 6109495 - DNA, 17 bp, Homo sapiens
ctaatgtaggactgtat

SEQ ID NO: 6109496 - DNA, 15 bp, Homo sapiens
ctaatgtattttatt

SEQ ID NO: 6109497 - DNA, 20 bp, Homo sapiens
ctaatgtattttattgtaac

SEQ ID NO: 6109498 - DNA, 21 bp, Homo sapiens
ctaatgtattttattgtaaca

SEQ ID NO: 6109499 - DNA, 13 bp, Homo sapiens
ctaatgtcacaac

SEQ ID NO: 6109500 - DNA, 17 bp, Homo sapiens
ctaatgtcacaattatg

SEQ ID NO: 6109501 - DNA, 19 bp, Homo sapiens
ctaatgtcacaattatgtg

SEQ ID NO: 6109502 - DNA, 19 bp, Homo sapiens
ctaatgtctcactgttctg

SEQ ID NO: 6109503 - DNA, 17 bp, Homo sapiens
ctaatgtctcttcctct

SEQ ID NO: 6109504 - DNA, 17 bp, Homo sapiens
ctaatgtcttcataaag

SEQ ID NO: 6109505 - DNA, 19 bp, Homo sapiens
ctaatgtcttcatttcatt

SEQ ID NO: 6109506 - DNA, 18 bp, Homo sapiens
ctaatgtgaattgttcct

SEQ ID NO: 6109507 - DNA, 13 bp, Homo sapiens
ctaatgtgatcat

SEQ ID NO: 6109508 - DNA, 19 bp, Homo sapiens
ctaatgtgcctagttcttt

SEQ ID NO: 6109509 - DNA, 23 bp, Homo sapiens
ctaatgtgctgtgtgacattggg

SEQ ID NO: 6109510 - DNA, 19 bp, Homo sapiens
ctaatgtggttatttctct

SEQ ID NO: 6109511 - DNA, 16 bp, Homo sapiens
ctaatgtgtctgtgga

SEQ ID NO: 6109512 - DNA, 19 bp, Homo sapiens
ctaatgttatttcttaaaa

SEQ ID NO: 6109513 - DNA, 23 bp, Homo sapiens
ctaatgttatttcttaaaattca

SEQ ID NO: 6109514 - DNA, 20 bp, Homo sapiens
ctaatgttctaaattctata

SEQ ID NO: 6109515 - DNA, 20 bp, Homo sapiens
ctaatgtttaagcagaattg

SEQ ID NO: 6109516 - DNA, 14 bp, Homo sapiens
ctaatgtttactat

SEQ ID NO: 6109517 - DNA, 17 bp, Homo sapiens
ctaatgtttatgagcca

SEQ ID NO: 6109518 - DNA, 18 bp, Homo sapiens
ctaatgtttatgagccag

SEQ ID NO: 6109519 - DNA, 13 bp, Homo sapiens
ctaatgttttgct

SEQ ID NO: 6109520 - DNA, 22 bp, Homo sapiens
ctaattaaaatgtgcagtattt

SEQ ID NO: 6109521 - DNA, 14 bp, Homo sapiens
ctaattaaaattgt

SEQ ID NO: 6109522 - DNA, 15 bp, Homo sapiens
ctaattaaactgatg

SEQ ID NO: 6109523 - DNA, 14 bp, Homo sapiens
ctaattaaagatgg

SEQ ID NO: 6109524 - DNA, 22 bp, Homo sapiens
ctaattaaagatggtttatgca

SEQ ID NO: 6109525 - DNA, 14 bp, Homo sapiens
ctaattaaataata

SEQ ID NO: 6109526 - DNA, 14 bp, Homo sapiens
ctaattaaggaagt

SEQ ID NO: 6109527 - DNA, 21 bp, Homo sapiens
ctaattaatatattaaaattc

SEQ ID NO: 6109528 - DNA, 23 bp, Homo sapiens
ctaattaatatattaaaattcca

SEQ ID NO: 6109529 - DNA, 13 bp, Homo sapiens
ctaattaatttca

SEQ ID NO: 6109530 - DNA, 19 bp, Homo sapiens
ctaattagggtacatttat

SEQ ID NO: 6109531 - DNA, 12 bp, Homo sapiens
ctaattagtgtc

SEQ ID NO: 6109532 - DNA, 17 bp, Homo sapiens
ctaattataatgcaaat

SEQ ID NO: 6109533 - DNA, 16 bp, Homo sapiens
ctaattatactacttt

SEQ ID NO: 6109534 - DNA, 21 bp, Homo sapiens
ctaattatcaatattgaggat

SEQ ID NO: 6109535 - DNA, 19 bp, Homo sapiens
ctaattatcaatgggatat

SEQ ID NO: 6109536 - DNA, 20 bp, Homo sapiens
ctaattatcttatctactga

SEQ ID NO: 6109537 - DNA, 18 bp, Homo sapiens
ctaattatttaattgtcc

SEQ ID NO: 6109538 - DNA, 14 bp, Homo sapiens
ctaattcaactctg

SEQ ID NO: 6109539 - DNA, 15 bp, Homo sapiens
ctaattcaatttatg

SEQ ID NO: 6109540 - DNA, 22 bp, Homo sapiens
ctaattcacacaaagactcctt

SEQ ID NO: 6109541 - DNA, 22 bp, Homo sapiens
ctaattcacagtgctcttttct

SEQ ID NO: 6109542 - DNA, 17 bp, Homo sapiens
ctaattcagcatgtgtt

SEQ ID NO: 6109543 - DNA, 20 bp, Homo sapiens
ctaattcagccatgtacaga

SEQ ID NO: 6109544 - DNA, 10 bp, Homo sapiens
ctaattcata

SEQ ID NO: 6109545 - DNA, 21 bp, Homo sapiens
ctaattcatttattaagtata

SEQ ID NO: 6109546 - DNA, 15 bp, Homo sapiens
ctaattccacacctt

SEQ ID NO: 6109547 - DNA, 19 bp, Homo sapiens
ctaattccacaggtcatca

SEQ ID NO: 6109548 - DNA, 21 bp, Homo sapiens
ctaattcccaacatttcttaa

SEQ ID NO: 6109549 - DNA, 16 bp, Homo sapiens
ctaattcccagagtgt

SEQ ID NO: 6109550 - DNA, 17 bp, Homo sapiens
ctaattcccattttgca

SEQ ID NO: 6109551 - DNA, 18 bp, Homo sapiens
ctaattcctgtatgttat

SEQ ID NO: 6109552 - DNA, 14 bp, Homo sapiens
ctaattccttaaat

SEQ ID NO: 6109553 - DNA, 15 bp, Homo sapiens
ctaattcctttctat

SEQ ID NO: 6109554 - DNA, 17 bp, Homo sapiens
ctaattcgatgaaggct

SEQ ID NO: 6109555 - DNA, 11 bp, Homo sapiens
ctaattctaac

SEQ ID NO: 6109556 - DNA, 17 bp, Homo sapiens
ctaattctatttctcta

SEQ ID NO: 6109557 - DNA, 18 bp, Homo sapiens
ctaattctatttctctat

SEQ ID NO: 6109558 - DNA, 20 bp, Homo sapiens
ctaattctcacatccctcta

SEQ ID NO: 6109559 - DNA, 15 bp, Homo sapiens
ctaattctttgcaaa

SEQ ID NO: 6109560 - DNA, 16 bp, Homo sapiens
ctaattctttgcaaaa

SEQ ID NO: 6109561 - DNA, 17 bp, Homo sapiens
ctaattctttgcaaaaa

SEQ ID NO: 6109562 - DNA, 15 bp, Homo sapiens
ctaattgacttgcaa

SEQ ID NO: 6109563 - DNA, 12 bp, Homo sapiens
ctaattgacttt

SEQ ID NO: 6109564 - DNA, 20 bp, Homo sapiens
ctaattgactttagaaagct

SEQ ID NO: 6109565 - DNA, 22 bp, Homo sapiens
ctaattgctgtgtgtcccaggc

SEQ ID NO: 6109566 - DNA, 16 bp, Homo sapiens
ctaattgctgttgaaa

SEQ ID NO: 6109567 - DNA, 19 bp, Homo sapiens
ctaattgctgttgaaagca

SEQ ID NO: 6109568 - DNA, 21 bp, Homo sapiens
ctaattgctgttgaaagcaaa

SEQ ID NO: 6109569 - DNA, 15 bp, Homo sapiens
ctaattggaaagtgc

SEQ ID NO: 6109570 - DNA, 17 bp, Homo sapiens
ctaattggaaagtgcca

SEQ ID NO: 6109571 - DNA, 19 bp, Homo sapiens
ctaattggaaagtgccagc

SEQ ID NO: 6109572 - DNA, 19 bp, Homo sapiens
ctaattggaagaaattcct

SEQ ID NO: 6109573 - DNA, 15 bp, Homo sapiens
ctaattggactttta

SEQ ID NO: 6109574 - DNA, 16 bp, Homo sapiens
ctaattggacttttat

SEQ ID NO: 6109575 - DNA, 20 bp, Homo sapiens
ctaattggcagattgttttt

SEQ ID NO: 6109576 - DNA, 21 bp, Homo sapiens
ctaattggtacttttaaaaac

SEQ ID NO: 6109577 - DNA, 17 bp, Homo sapiens
ctaattggtcattccta

SEQ ID NO: 6109578 - DNA, 23 bp, Homo sapiens
ctaattggtccaacccagcctga

SEQ ID NO: 6109579 - DNA, 16 bp, Homo sapiens
ctaattgtaagtgaaa

SEQ ID NO: 6109580 - DNA, 21 bp, Homo sapiens
ctaattgtaagtgaaattaag

SEQ ID NO: 6109581 - DNA, 22 bp, Homo sapiens
ctaattgtacccttcttgtctc

SEQ ID NO: 6109582 - DNA, 18 bp, Homo sapiens
ctaattgtataacaggtt

SEQ ID NO: 6109583 - DNA, 22 bp, Homo sapiens
ctaattgtataacaggttattt

SEQ ID NO: 6109584 - DNA, 20 bp, Homo sapiens
ctaattgtatgttagaataa

SEQ ID NO: 6109585 - DNA, 17 bp, Homo sapiens
ctaattgtcacatcaag

SEQ ID NO: 6109586 - DNA, 19 bp, Homo sapiens
ctaattgtcacatcaagca

SEQ ID NO: 6109587 - DNA, 16 bp, Homo sapiens
ctaattgtccacagca

SEQ ID NO: 6109588 - DNA, 15 bp, Homo sapiens
ctaattgtgccccta

SEQ ID NO: 6109589 - DNA, 17 bp, Homo sapiens
ctaattgtggtagaaat

SEQ ID NO: 6109590 - DNA, 19 bp, Homo sapiens
ctaattgtggtagaaattt

SEQ ID NO: 6109591 - DNA, 13 bp, Homo sapiens
ctaattgtgtata

SEQ ID NO: 6109592 - DNA, 12 bp, Homo sapiens
ctaatttaaacc

SEQ ID NO: 6109593 - DNA, 18 bp, Homo sapiens
ctaatttaaaccagcaga

SEQ ID NO: 6109594 - DNA, 23 bp, Homo sapiens
ctaatttaaaccagcagaaaagt

SEQ ID NO: 6109595 - DNA, 14 bp, Homo sapiens
ctaatttaaagaga

SEQ ID NO: 6109596 - DNA, 14 bp, Homo sapiens
ctaatttataaaaa

SEQ ID NO: 6109597 - DNA, 13 bp, Homo sapiens
ctaatttataatc

SEQ ID NO: 6109598 - DNA, 12 bp, Homo sapiens
ctaatttataca

SEQ ID NO: 6109599 - DNA, 22 bp, Homo sapiens
ctaatttatcttcatgtccagt

SEQ ID NO: 6109600 - DNA, 14 bp, Homo sapiens
ctaatttattaatc

SEQ ID NO: 6109601 - DNA, 17 bp, Homo sapiens
ctaatttcaaaatgctt

SEQ ID NO: 6109602 - DNA, 19 bp, Homo sapiens
ctaatttcaaaatgctttt

SEQ ID NO: 6109603 - DNA, 11 bp, Homo sapiens
ctaatttcata

SEQ ID NO: 6109604 - DNA, 15 bp, Homo sapiens
ctaatttcatttcaa

SEQ ID NO: 6109605 - DNA, 16 bp, Homo sapiens
ctaatttcccttcttg

SEQ ID NO: 6109606 - DNA, 13 bp, Homo sapiens
ctaatttctgtcc

SEQ ID NO: 6109607 - DNA, 22 bp, Homo sapiens
ctaatttctgtccagaaaatag

SEQ ID NO: 6109608 - DNA, 15 bp, Homo sapiens
ctaatttctgtgtct

SEQ ID NO: 6109609 - DNA, 15 bp, Homo sapiens
ctaatttcttcttta

SEQ ID NO: 6109610 - DNA, 16 bp, Homo sapiens
ctaatttgatgtttac

SEQ ID NO: 6109611 - DNA, 13 bp, Homo sapiens
ctaatttgcatta

SEQ ID NO: 6109612 - DNA, 21 bp, Homo sapiens
ctaatttgcattaaattcaca

SEQ ID NO: 6109613 - DNA, 22 bp, Homo sapiens
ctaatttgcattaaattcacaa

SEQ ID NO: 6109614 - DNA, 14 bp, Homo sapiens
ctaatttgctctgt

SEQ ID NO: 6109615 - DNA, 15 bp, Homo sapiens
ctaatttgctctgtg

SEQ ID NO: 6109616 - DNA, 17 bp, Homo sapiens
ctaatttgtatgtttcc

SEQ ID NO: 6109617 - DNA, 13 bp, Homo sapiens
ctaatttgtgaaa

SEQ ID NO: 6109618 - DNA, 14 bp, Homo sapiens
ctaatttgtgaaag

SEQ ID NO: 6109619 - DNA, 13 bp, Homo sapiens
ctaatttgtggta

SEQ ID NO: 6109620 - DNA, 21 bp, Homo sapiens
ctaatttgtggtaaagtagtt

SEQ ID NO: 6109621 - DNA, 19 bp, Homo sapiens
ctaattttaaagtaaaagg

SEQ ID NO: 6109622 - DNA, 19 bp, Homo sapiens
ctaattttaaataatttct

SEQ ID NO: 6109623 - DNA, 15 bp, Homo sapiens
ctaattttacactct

SEQ ID NO: 6109624 - DNA, 19 bp, Homo sapiens
ctaattttacatgtttata

SEQ ID NO: 6109625 - DNA, 17 bp, Homo sapiens
ctaattttattatagta

SEQ ID NO: 6109626 - DNA, 22 bp, Homo sapiens
ctaattttccataagctatttt

SEQ ID NO: 6109627 - DNA, 22 bp, Homo sapiens
ctaattttctcaaaagcattta

SEQ ID NO: 6109628 - DNA, 16 bp, Homo sapiens
ctaattttctttttct

SEQ ID NO: 6109629 - DNA, 21 bp, Homo sapiens
ctaattttctttttctgaagc

SEQ ID NO: 6109630 - DNA, 22 bp, Homo sapiens
ctaattttggataatattcatt

SEQ ID NO: 6109631 - DNA, 23 bp, Homo sapiens
ctaattttgtacgtatgaatgat

SEQ ID NO: 6109632 - DNA, 15 bp, Homo sapiens
ctaattttgtgctct

SEQ ID NO: 6109633 - DNA, 16 bp, Homo sapiens
ctaattttgtgctctt

SEQ ID NO: 6109634 - DNA, 14 bp, Homo sapiens
ctaattttgtttta

SEQ ID NO: 6109635 - DNA, 17 bp, Homo sapiens
ctaatttttaagcaaaa

SEQ ID NO: 6109636 - DNA, 17 bp, Homo sapiens
ctaatttttattaattt

SEQ ID NO: 6109637 - DNA, 17 bp, Homo sapiens
ctaatttttattcataa

SEQ ID NO: 6109638 - DNA, 18 bp, Homo sapiens
ctaatttttatttttgct

SEQ ID NO: 6109639 - DNA, 21 bp, Homo sapiens
ctaatttttatttttgctgag

SEQ ID NO: 6109640 - DNA, 18 bp, Homo sapiens
ctaatttttgcttaacat

SEQ ID NO: 6109641 - DNA, 22 bp, Homo sapiens
ctaatttttgcttaacattaga

SEQ ID NO: 6109642 - DNA, 21 bp, Homo sapiens
ctaatttttggagaaatgtca

SEQ ID NO: 6109643 - DNA, 19 bp, Homo sapiens
ctaatttttggtgctgatt

SEQ ID NO: 6109644 - DNA, 14 bp, Homo sapiens
ctaatttttgtaat

SEQ ID NO: 6109645 - DNA, 13 bp, Homo sapiens
ctaatttttgtat

SEQ ID NO: 6109646 - DNA, 14 bp, Homo sapiens
ctaatttttgtatt

SEQ ID NO: 6109647 - DNA, 19 bp, Homo sapiens
ctaatttttgtattatttt

SEQ ID NO: 6109648 - DNA, 23 bp, Homo sapiens
ctaatttttgtatttttagtaga

SEQ ID NO: 6109649 - DNA, 14 bp, Homo sapiens
ctaatttttttcct

SEQ ID NO: 6109650 - DNA, 15 bp, Homo sapiens
ctaatttttttgtat

SEQ ID NO: 6109651 - DNA, 17 bp, Homo sapiens
ctaattttttttgtaca

SEQ ID NO: 6109652 - DNA, 18 bp, Homo sapiens
ctaatttttttttgtagt

SEQ ID NO: 6109653 - DNA, 15 bp, Homo sapiens
ctacaaaaacacagc

SEQ ID NO: 6109654 - DNA, 16 bp, Homo sapiens
ctacaaaaacacagca

SEQ ID NO: 6109655 - DNA, 22 bp, Homo sapiens
ctacaaaaagaagagtttgtga

SEQ ID NO: 6109656 - DNA, 19 bp, Homo sapiens
ctacaaaaagcataaaaat

SEQ ID NO: 6109657 - DNA, 20 bp, Homo sapiens
ctacaaaaaggtataaataa

SEQ ID NO: 6109658 - DNA, 21 bp, Homo sapiens
ctacaaaaaggtataaataat

SEQ ID NO: 6109659 - DNA, 23 bp, Homo sapiens
ctacaaaaataaaaggcttccag

SEQ ID NO: 6109660 - DNA, 22 bp, Homo sapiens
ctacaaaacctaccctcagtga

SEQ ID NO: 6109661 - DNA, 21 bp, Homo sapiens
ctacaaaacctgatgttaaaa

SEQ ID NO: 6109662 - DNA, 21 bp, Homo sapiens
ctacaaaataaagctgttctc

SEQ ID NO: 6109663 - DNA, 16 bp, Homo sapiens
ctacaaaatgtgtgct

SEQ ID NO: 6109664 - DNA, 17 bp, Homo sapiens
ctacaaaatttgaaatt

SEQ ID NO: 6109665 - DNA, 22 bp, Homo sapiens
ctacaaacaaaagcagccctct

SEQ ID NO: 6109666 - DNA, 19 bp, Homo sapiens
ctacaaaccaggagcaacc

SEQ ID NO: 6109667 - DNA, 18 bp, Homo sapiens
ctacaaacgtttgacaaa

SEQ ID NO: 6109668 - DNA, 23 bp, Homo sapiens
ctacaaacgtttgacaaacacaa

SEQ ID NO: 6109669 - DNA, 14 bp, Homo sapiens
ctacaaacttttaa

SEQ ID NO: 6109670 - DNA, 19 bp, Homo sapiens
ctacaaacttttataaatg

SEQ ID NO: 6109671 - DNA, 20 bp, Homo sapiens
ctacaaagaagacatgtttt

SEQ ID NO: 6109672 - DNA, 14 bp, Homo sapiens
ctacaaagcagaga

SEQ ID NO: 6109673 - DNA, 21 bp, Homo sapiens
ctacaaagcatgggaaaaaga

SEQ ID NO: 6109674 - DNA, 22 bp, Homo sapiens
ctacaaagcatgggaaaaagag

SEQ ID NO: 6109675 - DNA, 16 bp, Homo sapiens
ctacaaagctttgcta

SEQ ID NO: 6109676 - DNA, 19 bp, Homo sapiens
ctacaaagctttgctacaa

SEQ ID NO: 6109677 - DNA, 20 bp, Homo sapiens
ctacaaaggtttaaatgaac

SEQ ID NO: 6109678 - DNA, 22 bp, Homo sapiens
ctacaaaggtttaaatgaacaa

SEQ ID NO: 6109679 - DNA, 20 bp, Homo sapiens
ctacaaatttatgcatttca

SEQ ID NO: 6109680 - DNA, 12 bp, Homo sapiens
ctacaaattttt

SEQ ID NO: 6109681 - DNA, 13 bp, Homo sapiens
ctacaaattttta

SEQ ID NO: 6109682 - DNA, 14 bp, Homo sapiens
ctacaacagcctca

SEQ ID NO: 6109683 - DNA, 22 bp, Homo sapiens
ctacaacatattgtttcagtgt

SEQ ID NO: 6109684 - DNA, 14 bp, Homo sapiens
ctacaaccagagcc

SEQ ID NO: 6109685 - DNA, 15 bp, Homo sapiens
ctacaaccagagccc

SEQ ID NO: 6109686 - DNA, 16 bp, Homo sapiens
ctacaaccagagcccc

SEQ ID NO: 6109687 - DNA, 22 bp, Homo sapiens
ctacaaccaggtcttgacctga

SEQ ID NO: 6109688 - DNA, 15 bp, Homo sapiens
ctacaaccatccctg

SEQ ID NO: 6109689 - DNA, 16 bp, Homo sapiens
ctacaaccatccctgc

SEQ ID NO: 6109690 - DNA, 21 bp, Homo sapiens
ctacaaccatccctgccacat

SEQ ID NO: 6109691 - DNA, 15 bp, Homo sapiens
ctacaaccccagcct

SEQ ID NO: 6109692 - DNA, 17 bp, Homo sapiens
ctacaaccctaccctgg

SEQ ID NO: 6109693 - DNA, 18 bp, Homo sapiens
ctacaaccctaccctggc

SEQ ID NO: 6109694 - DNA, 20 bp, Homo sapiens
ctacaaccctaccctggcag

SEQ ID NO: 6109695 - DNA, 21 bp, Homo sapiens
ctacaacctccaccttccagg

SEQ ID NO: 6109696 - DNA, 18 bp, Homo sapiens
ctacaactaaaaataaat

SEQ ID NO: 6109697 - DNA, 16 bp, Homo sapiens
ctacaactgattgcaa

SEQ ID NO: 6109698 - DNA, 15 bp, Homo sapiens
ctacaacttttgttt

SEQ ID NO: 6109699 - DNA, 19 bp, Homo sapiens
ctacaagaaagctgtggct

SEQ ID NO: 6109700 - DNA, 15 bp, Homo sapiens
ctacaagacacagtg

SEQ ID NO: 6109701 - DNA, 17 bp, Homo sapiens
ctacaagagcagcctgt

SEQ ID NO: 6109702 - DNA, 18 bp, Homo sapiens
ctacaagagcagcctgtg

SEQ ID NO: 6109703 - DNA, 14 bp, Homo sapiens
ctacaagagggcaa

SEQ ID NO: 6109704 - DNA, 19 bp, Homo sapiens
ctacaagagggcaaagctg

SEQ ID NO: 6109705 - DNA, 12 bp, Homo sapiens
ctacaagatttc

SEQ ID NO: 6109706 - DNA, 19 bp, Homo sapiens
ctacaagcatatttgagaa

SEQ ID NO: 6109707 - DNA, 13 bp, Homo sapiens
ctacaagcatttg

SEQ ID NO: 6109708 - DNA, 15 bp, Homo sapiens
ctacaagcatttgcc

SEQ ID NO: 6109709 - DNA, 22 bp, Homo sapiens
ctacaagcatttgccctgtgga

SEQ ID NO: 6109710 - DNA, 23 bp, Homo sapiens
ctacaaggactttccaaatccag

SEQ ID NO: 6109711 - DNA, 18 bp, Homo sapiens
ctacaaggggtgtgactt

SEQ ID NO: 6109712 - DNA, 22 bp, Homo sapiens
ctacaaggtaggctgcaaaatt

SEQ ID NO: 6109713 - DNA, 14 bp, Homo sapiens
ctacaagtgtttta

SEQ ID NO: 6109714 - DNA, 14 bp, Homo sapiens
ctacaataaaaaga

SEQ ID NO: 6109715 - DNA, 19 bp, Homo sapiens
cctggggagaacccttcct

SEQ ID NO: 6109716 - DNA, 19 bp, Homo sapiens
cctggggagccctcaggct

SEQ ID NO: 6109717 - DNA, 17 bp, Homo sapiens
cctggggagctcctggg

SEQ ID NO: 6109718 - DNA, 14 bp, Homo sapiens
cctggggaggaccc

SEQ ID NO: 6109719 - DNA, 16 bp, Homo sapiens
cctggggaggacccct

SEQ ID NO: 6109720 - DNA, 19 bp, Homo sapiens
cctggggaggacccctgcc

SEQ ID NO: 6109721 - DNA, 14 bp, Homo sapiens
cctggggaggccct

SEQ ID NO: 6109722 - DNA, 15 bp, Homo sapiens
cctggggaggctgag

SEQ ID NO: 6109723 - DNA, 20 bp, Homo sapiens
cctggggaggctgagactgc

SEQ ID NO: 6109724 - DNA, 14 bp, Homo sapiens
cctggggagtgagc

SEQ ID NO: 6109725 - DNA, 24 bp, Homo sapiens
cctggggagtgggacagagtctgg

SEQ ID NO: 6109726 - DNA, 17 bp, Homo sapiens
cctggggatcacagcct

SEQ ID NO: 6109727 - DNA, 16 bp, Homo sapiens
cctggggatcttccca

SEQ ID NO: 6109728 - DNA, 14 bp, Homo sapiens
cctggggatggcca

SEQ ID NO: 6109729 - DNA, 18 bp, Homo sapiens
cctggggatggccaggta

SEQ ID NO: 6109730 - DNA, 22 bp, Homo sapiens
cctggggatgtaaccaagctgt

SEQ ID NO: 6109731 - DNA, 15 bp, Homo sapiens
cctggggatgtgctt

SEQ ID NO: 6109732 - DNA, 17 bp, Homo sapiens
cctggggcagcactccc

SEQ ID NO: 6109733 - DNA, 23 bp, Homo sapiens
cctggggcagtcacctgcccaga

SEQ ID NO: 6109734 - DNA, 16 bp, Homo sapiens
cctggggcatccacct

SEQ ID NO: 6109735 - DNA, 13 bp, Homo sapiens
cctggggcccagc

SEQ ID NO: 6109736 - DNA, 17 bp, Homo sapiens
cctggggcccagcccct

SEQ ID NO: 6109737 - DNA, 22 bp, Homo sapiens
cctggggccccttggcgggcag

SEQ ID NO: 6109738 - DNA, 23 bp, Homo sapiens
cctggggccggtagaggctcccc

SEQ ID NO: 6109739 - DNA, 18 bp, Homo sapiens
cctggggcctgactgctc

SEQ ID NO: 6109740 - DNA, 13 bp, Homo sapiens
cctggggcctgag

SEQ ID NO: 6109741 - DNA, 16 bp, Homo sapiens
cctggggcctggacct

SEQ ID NO: 6109742 - DNA, 18 bp, Homo sapiens
cctggggcctggacctgc

SEQ ID NO: 6109743 - DNA, 13 bp, Homo sapiens
cctggggcctggc

SEQ ID NO: 6109744 - DNA, 14 bp, Homo sapiens
cctggggcctggca

SEQ ID NO: 6109745 - DNA, 15 bp, Homo sapiens
cctggggcctggcag

SEQ ID NO: 6109746 - DNA, 22 bp, Homo sapiens
cctggggcctgtactgcctgct

SEQ ID NO: 6109747 - DNA, 18 bp, Homo sapiens
cctggggccttcctggct

SEQ ID NO: 6109748 - DNA, 17 bp, Homo sapiens
cctggggcgcgtgaggc

SEQ ID NO: 6109749 - DNA, 19 bp, Homo sapiens
cctggggcgcgtgaggccc

SEQ ID NO: 6109750 - DNA, 22 bp, Homo sapiens
cctggggcgcgtgaggcccgtg

SEQ ID NO: 6109751 - DNA, 13 bp, Homo sapiens
cctggggcgggca

SEQ ID NO: 6109752 - DNA, 20 bp, Homo sapiens
cctggggctaggctggagcc

SEQ ID NO: 6109753 - DNA, 15 bp, Homo sapiens
cctggggctcctttc

SEQ ID NO: 6109754 - DNA, 22 bp, Homo sapiens
cctggggctcctttctccagcc

SEQ ID NO: 6109755 - DNA, 21 bp, Homo sapiens
cctggggctctaacgcctgag

SEQ ID NO: 6109756 - DNA, 14 bp, Homo sapiens
cctggggctctctg

SEQ ID NO: 6109757 - DNA, 17 bp, Homo sapiens
cctggggctctctgacc

SEQ ID NO: 6109758 - DNA, 18 bp, Homo sapiens
cctggggctctctgaccc

SEQ ID NO: 6109759 - DNA, 14 bp, Homo sapiens
cctggggctgccct

SEQ ID NO: 6109760 - DNA, 17 bp, Homo sapiens
cctggggctgctggcct

SEQ ID NO: 6109761 - DNA, 15 bp, Homo sapiens
cctggggctggcctc

SEQ ID NO: 6109762 - DNA, 19 bp, Homo sapiens
cctggggctggcctcccaa

SEQ ID NO: 6109763 - DNA, 19 bp, Homo sapiens
cctggggctggctgcagac

SEQ ID NO: 6109764 - DNA, 12 bp, Homo sapiens
cctggggctggg

SEQ ID NO: 6109765 - DNA, 17 bp, Homo sapiens
cctggggctgggccccc

SEQ ID NO: 6109766 - DNA, 13 bp, Homo sapiens
cctggggctgggt

SEQ ID NO: 6109767 - DNA, 21 bp, Homo sapiens
cctggggctggtcctgggagc

SEQ ID NO: 6109768 - DNA, 14 bp, Homo sapiens
cctggggctgtgca

SEQ ID NO: 6109769 - DNA, 15 bp, Homo sapiens
cctgggggaagagga

SEQ ID NO: 6109770 - DNA, 19 bp, Homo sapiens
cctgggggaagccctggat

SEQ ID NO: 6109771 - DNA, 18 bp, Homo sapiens
cctgggggaaggatgcag

SEQ ID NO: 6109772 - DNA, 20 bp, Homo sapiens
cctgggggacccctggctct

SEQ ID NO: 6109773 - DNA, 13 bp, Homo sapiens
cctgggggagaga

SEQ ID NO: 6109774 - DNA, 21 bp, Homo sapiens
cctgggggaggcttccagctc

SEQ ID NO: 6109775 - DNA, 22 bp, Homo sapiens
cctgggggatgtgcacggcagc

SEQ ID NO: 6109776 - DNA, 23 bp, Homo sapiens
cctgggggattcctgagctggcc

SEQ ID NO: 6109777 - DNA, 23 bp, Homo sapiens
cctgggggcacaggaggcaggca

SEQ ID NO: 6109778 - DNA, 19 bp, Homo sapiens
cctgggggcagggagagga

SEQ ID NO: 6109779 - DNA, 14 bp, Homo sapiens
cctgggggcagtga

SEQ ID NO: 6109780 - DNA, 14 bp, Homo sapiens
cctgggggcatcct

SEQ ID NO: 6109781 - DNA, 16 bp, Homo sapiens
cctgggggcatcctgc

SEQ ID NO: 6109782 - DNA, 21 bp, Homo sapiens
cctgggggcatcctgcttcct

SEQ ID NO: 6109783 - DNA, 15 bp, Homo sapiens
cctgggggccagctg

SEQ ID NO: 6109784 - DNA, 22 bp, Homo sapiens
cctgggggccagctggtgctgc

SEQ ID NO: 6109785 - DNA, 15 bp, Homo sapiens
cctgggggccgtgct

SEQ ID NO: 6109786 - DNA, 17 bp, Homo sapiens
cctgggggcctgggttg

SEQ ID NO: 6109787 - DNA, 24 bp, Homo sapiens
cctgggggcggccagccctcccag

SEQ ID NO: 6109788 - DNA, 18 bp, Homo sapiens
cctgggggcgggactcct

SEQ ID NO: 6109789 - DNA, 15 bp, Homo sapiens
cctgggggctagcag

SEQ ID NO: 6109790 - DNA, 18 bp, Homo sapiens
cctgggggctgctgcact

SEQ ID NO: 6109791 - DNA, 19 bp, Homo sapiens
cctgggggctgctgcactg

SEQ ID NO: 6109792 - DNA, 16 bp, Homo sapiens
cctgggggctggctcc

SEQ ID NO: 6109793 - DNA, 23 bp, Homo sapiens
cctgggggctggctcccagggtg

SEQ ID NO: 6109794 - DNA, 19 bp, Homo sapiens
cctgggggctgggcagagg

SEQ ID NO: 6109795 - DNA, 20 bp, Homo sapiens
cctgggggctgttagctcag

SEQ ID NO: 6109796 - DNA, 19 bp, Homo sapiens
cctgggggcttttgccact

SEQ ID NO: 6109797 - DNA, 14 bp, Homo sapiens
cctggggggaacgg

SEQ ID NO: 6109798 - DNA, 19 bp, Homo sapiens
cctggggggaacggatgct

SEQ ID NO: 6109799 - DNA, 14 bp, Homo sapiens
cctggggggaggga

SEQ ID NO: 6109800 - DNA, 22 bp, Homo sapiens
cctggggggagggacagggcag

SEQ ID NO: 6109801 - DNA, 14 bp, Homo sapiens
cctggggggcacag

SEQ ID NO: 6109802 - DNA, 19 bp, Homo sapiens
cctggggggcacagccaga

SEQ ID NO: 6109803 - DNA, 13 bp, Homo sapiens
cctggggggcagg

SEQ ID NO: 6109804 - DNA, 15 bp, Homo sapiens
cctgggggtggcagg

SEQ ID NO: 6109805 - DNA, 17 bp, Homo sapiens
cctgggggtggcaggca

SEQ ID NO: 6109806 - DNA, 18 bp, Homo sapiens
cctgggggtggcaggcac

SEQ ID NO: 6109807 - DNA, 15 bp, Homo sapiens
cctgggggtggggga

SEQ ID NO: 6109808 - DNA, 21 bp, Homo sapiens
cctgggggttctttcttcctc

SEQ ID NO: 6109809 - DNA, 23 bp, Homo sapiens
cctgggggttctttcttcctctg

SEQ ID NO: 6109810 - DNA, 20 bp, Homo sapiens
cctgggggtttcacctgggc

SEQ ID NO: 6109811 - DNA, 18 bp, Homo sapiens
cctgggggttttccaagc

SEQ ID NO: 6109812 - DNA, 20 bp, Homo sapiens
cctgggggttttccaagccc

SEQ ID NO: 6109813 - DNA, 22 bp, Homo sapiens
cctggggtaccaagagactcct

SEQ ID NO: 6109814 - DNA, 16 bp, Homo sapiens
cctggggtacttctgt

SEQ ID NO: 6109815 - DNA, 13 bp, Homo sapiens
cctggggtaggag

SEQ ID NO: 6109816 - DNA, 14 bp, Homo sapiens
cctggggtaggagg

SEQ ID NO: 6109817 - DNA, 21 bp, Homo sapiens
cctggggtataaaactttcct

SEQ ID NO: 6109818 - DNA, 22 bp, Homo sapiens
cctggggtataaaactttcctc

SEQ ID NO: 6109819 - DNA, 16 bp, Homo sapiens
cctggggtccccactc

SEQ ID NO: 6109820 - DNA, 15 bp, Homo sapiens
cctggggtcccccct

SEQ ID NO: 6109821 - DNA, 16 bp, Homo sapiens
cctggggtcccccctc

SEQ ID NO: 6109822 - DNA, 17 bp, Homo sapiens
cctggggtcccccctcc

SEQ ID NO: 6109823 - DNA, 18 bp, Homo sapiens
cctggggtctctctccct

SEQ ID NO: 6109824 - DNA, 15 bp, Homo sapiens
cctggggtgacccgg

SEQ ID NO: 6109825 - DNA, 19 bp, Homo sapiens
cctggggtgatagaacaag

SEQ ID NO: 6109826 - DNA, 14 bp, Homo sapiens
cctggggtgcaggc

SEQ ID NO: 6109827 - DNA, 21 bp, Homo sapiens
cctggggtgcatcctcctcag

SEQ ID NO: 6109828 - DNA, 14 bp, Homo sapiens
cctggggtgcatct

SEQ ID NO: 6109829 - DNA, 19 bp, Homo sapiens
cctggggtgctgcctctca

SEQ ID NO: 6109830 - DNA, 22 bp, Homo sapiens
cctggggtggaggctaagcctg

SEQ ID NO: 6109831 - DNA, 20 bp, Homo sapiens
cctggggtggccagggcttc

SEQ ID NO: 6109832 - DNA, 19 bp, Homo sapiens
cctggggtggcgtctgcct

SEQ ID NO: 6109833 - DNA, 19 bp, Homo sapiens
cctggggtgggatctgagc

SEQ ID NO: 6109834 - DNA, 15 bp, Homo sapiens
cctggggtggggagg

SEQ ID NO: 6109835 - DNA, 18 bp, Homo sapiens
cctggggtggggaggcag

SEQ ID NO: 6109836 - DNA, 23 bp, Homo sapiens
cctggggtgggtgtgagcagggt

SEQ ID NO: 6109837 - DNA, 20 bp, Homo sapiens
cctggggtggttggaggcct

SEQ ID NO: 6109838 - DNA, 22 bp, Homo sapiens
cctggggtgtcctacagtgact

SEQ ID NO: 6109839 - DNA, 22 bp, Homo sapiens
cctggggttgtccccgctggct

SEQ ID NO: 6109840 - DNA, 17 bp, Homo sapiens
cctggggtttagaaccc

SEQ ID NO: 6109841 - DNA, 20 bp, Homo sapiens
cctgggtaaatgcagcgtga

SEQ ID NO: 6109842 - DNA, 21 bp, Homo sapiens
cctgggtaacaaagtgagacc

SEQ ID NO: 6109843 - DNA, 19 bp, Homo sapiens
cctgggtaagaagggtggg

SEQ ID NO: 6109844 - DNA, 21 bp, Homo sapiens
cctgggtaccctgagcccacc

SEQ ID NO: 6109845 - DNA, 18 bp, Homo sapiens
cctgggtactgaaagcct

SEQ ID NO: 6109846 - DNA, 13 bp, Homo sapiens
cctgggtaggccc

SEQ ID NO: 6109847 - DNA, 22 bp, Homo sapiens
cctgggtaggccccacaaggcc

SEQ ID NO: 6109848 - DNA, 20 bp, Homo sapiens
cctgggtatcccctgcctcc

SEQ ID NO: 6109849 - DNA, 23 bp, Homo sapiens
cctgggtatcccctgcctcctgc

SEQ ID NO: 6109850 - DNA, 23 bp, Homo sapiens
cctgggtcaaagtggtacaggaa

SEQ ID NO: 6109851 - DNA, 18 bp, Homo sapiens
cctgggtcacagagtgag

SEQ ID NO: 6109852 - DNA, 19 bp, Homo sapiens
cctgggtcacgctcaagga

SEQ ID NO: 6109853 - DNA, 14 bp, Homo sapiens
cctgggtcagtctg

SEQ ID NO: 6109854 - DNA, 16 bp, Homo sapiens
cctgggtcatgggcct

SEQ ID NO: 6109855 - DNA, 18 bp, Homo sapiens
cctgggtcatgggcctgt

SEQ ID NO: 6109856 - DNA, 17 bp, Homo sapiens
cctgggtcccagggctg

SEQ ID NO: 6109857 - DNA, 23 bp, Homo sapiens
cctgggtcccagggctggcccta

SEQ ID NO: 6109858 - DNA, 17 bp, Homo sapiens
cctgggtccccctcctg

SEQ ID NO: 6109859 - DNA, 16 bp, Homo sapiens
cctgggtcctcccagc

SEQ ID NO: 6109860 - DNA, 14 bp, Homo sapiens
cctgggtcctgcct

SEQ ID NO: 6109861 - DNA, 17 bp, Homo sapiens
cctgggtcctgcctgca

SEQ ID NO: 6109862 - DNA, 19 bp, Homo sapiens
cctgggtcctgcctgcagt

SEQ ID NO: 6109863 - DNA, 16 bp, Homo sapiens
cctgggtcctgcctgg

SEQ ID NO: 6109864 - DNA, 17 bp, Homo sapiens
cctgggtcctgcctggt

SEQ ID NO: 6109865 - DNA, 23 bp, Homo sapiens
cctgggtcctgcctggtcctccc

SEQ ID NO: 6109866 - DNA, 14 bp, Homo sapiens
cctgggtccttttc

SEQ ID NO: 6109867 - DNA, 21 bp, Homo sapiens
cctgggtctgtgtctcttttc

SEQ ID NO: 6109868 - DNA, 19 bp, Homo sapiens
cctgggtgacagagcaaga

SEQ ID NO: 6109869 - DNA, 18 bp, Homo sapiens
cctgggtgacagagcgag

SEQ ID NO: 6109870 - DNA, 19 bp, Homo sapiens
cctgggtgacagagtgaga

SEQ ID NO: 6109871 - DNA, 15 bp, Homo sapiens
cctgggtgacatttg

SEQ ID NO: 6109872 - DNA, 21 bp, Homo sapiens
cctgggtgacccccactgccg

SEQ ID NO: 6109873 - DNA, 22 bp, Homo sapiens
cctgggtgccattcccagcgtt

SEQ ID NO: 6109874 - DNA, 19 bp, Homo sapiens
cctgggtgccctggctcct

SEQ ID NO: 6109875 - DNA, 18 bp, Homo sapiens
cctgggtgctctggctgg

SEQ ID NO: 6109876 - DNA, 20 bp, Homo sapiens
cctgggtgctgtcatgccca

SEQ ID NO: 6109877 - DNA, 16 bp, Homo sapiens
cctgggtggaaatcct

SEQ ID NO: 6109878 - DNA, 16 bp, Homo sapiens
cctgggtggagcagga

SEQ ID NO: 6109879 - DNA, 23 bp, Homo sapiens
cctgggtggagcaggactcccac

SEQ ID NO: 6109880 - DNA, 18 bp, Homo sapiens
cctgggtggagggagacg

SEQ ID NO: 6109881 - DNA, 22 bp, Homo sapiens
cctgggtggatcggcctcctct

SEQ ID NO: 6109882 - DNA, 19 bp, Homo sapiens
cctgggtggctactctgtg

SEQ ID NO: 6109883 - DNA, 20 bp, Homo sapiens
cctgggtggctactctgtgc

SEQ ID NO: 6109884 - DNA, 15 bp, Homo sapiens
cctgggtgggacagc

SEQ ID NO: 6109885 - DNA, 17 bp, Homo sapiens
cctgggtgggccctgcc

SEQ ID NO: 6109886 - DNA, 19 bp, Homo sapiens
cctgggtggggcagggcct

SEQ ID NO: 6109887 - DNA, 21 bp, Homo sapiens
cctgggtggggcagggcctgg

SEQ ID NO: 6109888 - DNA, 15 bp, Homo sapiens
cctgggtggggctgc

SEQ ID NO: 6109889 - DNA, 20 bp, Homo sapiens
cctgggtggggctgctcctc

SEQ ID NO: 6109890 - DNA, 22 bp, Homo sapiens
cctgggtggggctgctcctcca

SEQ ID NO: 6109891 - DNA, 13 bp, Homo sapiens
ctacaataaactg

SEQ ID NO: 6109892 - DNA, 15 bp, Homo sapiens
ctacaataaactggt

SEQ ID NO: 6109893 - DNA, 11 bp, Homo sapiens
ctacaataaat

SEQ ID NO: 6109894 - DNA, 15 bp, Homo sapiens
ctacaataaatgctg

SEQ ID NO: 6109895 - DNA, 15 bp, Homo sapiens
ctacaatatatatta

SEQ ID NO: 6109896 - DNA, 23 bp, Homo sapiens
ctacaatatcattttcctgggag

SEQ ID NO: 6109897 - DNA, 14 bp, Homo sapiens
ctacaatatgtaca

SEQ ID NO: 6109898 - DNA, 22 bp, Homo sapiens
ctacaatatgtacatttctaag

SEQ ID NO: 6109899 - DNA, 14 bp, Homo sapiens
ctacaatattctct

SEQ ID NO: 6109900 - DNA, 17 bp, Homo sapiens
ctacaatattctctctt

SEQ ID NO: 6109901 - DNA, 14 bp, Homo sapiens
ctacaatattttat

SEQ ID NO: 6109902 - DNA, 13 bp, Homo sapiens
ctacaatcatggt

SEQ ID NO: 6109903 - DNA, 18 bp, Homo sapiens
ctacaatgggaaaacttc

SEQ ID NO: 6109904 - DNA, 22 bp, Homo sapiens
ctacaattaatagtttgtctat

SEQ ID NO: 6109905 - DNA, 21 bp, Homo sapiens
ctacaattctgcagaaaaaga

SEQ ID NO: 6109906 - DNA, 12 bp, Homo sapiens
ctacaatttcta

SEQ ID NO: 6109907 - DNA, 22 bp, Homo sapiens
ctacaatttgtttttgcatttt

SEQ ID NO: 6109908 - DNA, 18 bp, Homo sapiens
ctacacaacatgtatgtg

SEQ ID NO: 6109909 - DNA, 14 bp, Homo sapiens
ctacacaatacagt

SEQ ID NO: 6109910 - DNA, 17 bp, Homo sapiens
ctacacacacagcctat

SEQ ID NO: 6109911 - DNA, 13 bp, Homo sapiens
ctacacacaccca

SEQ ID NO: 6109912 - DNA, 23 bp, Homo sapiens
ctacacacagaccgcgcccctgg

SEQ ID NO: 6109913 - DNA, 15 bp, Homo sapiens
ctacacactcagcca

SEQ ID NO: 6109914 - DNA, 17 bp, Homo sapiens
ctacacactcagccaca

SEQ ID NO: 6109915 - DNA, 18 bp, Homo sapiens
ctacacactcagccacaa

SEQ ID NO: 6109916 - DNA, 15 bp, Homo sapiens
ctacacactgcatgt

SEQ ID NO: 6109917 - DNA, 21 bp, Homo sapiens
ctacacactgcatgtttgtga

SEQ ID NO: 6109918 - DNA, 17 bp, Homo sapiens
ctacacactgctcattt

SEQ ID NO: 6109919 - DNA, 22 bp, Homo sapiens
ctacacactgtcatgcttcatc

SEQ ID NO: 6109920 - DNA, 23 bp, Homo sapiens
ctacacagaccctgcccacccca

SEQ ID NO: 6109921 - DNA, 13 bp, Homo sapiens
ctacacagcacac

SEQ ID NO: 6109922 - DNA, 23 bp, Homo sapiens
ctacacagcacaccagccgctgc

SEQ ID NO: 6109923 - DNA, 14 bp, Homo sapiens
ctacacagcctgga

SEQ ID NO: 6109924 - DNA, 12 bp, Homo sapiens
ctacacaggagt

SEQ ID NO: 6109925 - DNA, 21 bp, Homo sapiens
ctacacagggatgtacaaggc

SEQ ID NO: 6109926 - DNA, 14 bp, Homo sapiens
ctacacagggcctg

SEQ ID NO: 6109927 - DNA, 21 bp, Homo sapiens
ctacacaggggccctgtacag

SEQ ID NO: 6109928 - DNA, 14 bp, Homo sapiens
ctacacatatatgt

SEQ ID NO: 6109929 - DNA, 18 bp, Homo sapiens
ctacacatatatgtatat

SEQ ID NO: 6109930 - DNA, 21 bp, Homo sapiens
ctacacatatgtattcctgat

SEQ ID NO: 6109931 - DNA, 15 bp, Homo sapiens
ctacacatgtaaaat

SEQ ID NO: 6109932 - DNA, 18 bp, Homo sapiens
ctacacatgtaaaatatg

SEQ ID NO: 6109933 - DNA, 13 bp, Homo sapiens
ctacacattttta

SEQ ID NO: 6109934 - DNA, 13 bp, Homo sapiens
ctacaccaatgaa

SEQ ID NO: 6109935 - DNA, 12 bp, Homo sapiens
ctacaccacaca

SEQ ID NO: 6109936 - DNA, 18 bp, Homo sapiens
ctacaccactctggcagc

SEQ ID NO: 6109937 - DNA, 21 bp, Homo sapiens
ctacaccactctggcagccac

SEQ ID NO: 6109938 - DNA, 16 bp, Homo sapiens
ctacacccaagcctga

SEQ ID NO: 6109939 - DNA, 13 bp, Homo sapiens
ctacacccaaggt

SEQ ID NO: 6109940 - DNA, 11 bp, Homo sapiens
ctacacccagc

SEQ ID NO: 6109941 - DNA, 12 bp, Homo sapiens
ctacacccagca

SEQ ID NO: 6109942 - DNA, 15 bp, Homo sapiens
ctacacccctgtgct

SEQ ID NO: 6109943 - DNA, 22 bp, Homo sapiens
ctacacccctgtgctcccctgc

SEQ ID NO: 6109944 - DNA, 15 bp, Homo sapiens
ctacaccctctgccc

SEQ ID NO: 6109945 - DNA, 16 bp, Homo sapiens
ctacacccttggactt

SEQ ID NO: 6109946 - DNA, 20 bp, Homo sapiens
ctacacccttggacttgagg

SEQ ID NO: 6109947 - DNA, 13 bp, Homo sapiens
ctacacctaactc

SEQ ID NO: 6109948 - DNA, 20 bp, Homo sapiens
ctacacctctgggccctgca

SEQ ID NO: 6109949 - DNA, 13 bp, Homo sapiens
ctacacctggctg

SEQ ID NO: 6109950 - DNA, 15 bp, Homo sapiens
ctacacctggctgag

SEQ ID NO: 6109951 - DNA, 13 bp, Homo sapiens
ctacaccttgagg

SEQ ID NO: 6109952 - DNA, 23 bp, Homo sapiens
ctacacgagatacagaattttat

SEQ ID NO: 6109953 - DNA, 22 bp, Homo sapiens
ctacacggactgaggtgcctgc

SEQ ID NO: 6109954 - DNA, 14 bp, Homo sapiens
ctacactaataaat

SEQ ID NO: 6109955 - DNA, 15 bp, Homo sapiens
ctacactcacctgca

SEQ ID NO: 6109956 - DNA, 16 bp, Homo sapiens
ctacactccagcctga

SEQ ID NO: 6109957 - DNA, 14 bp, Homo sapiens
ctacactctcctgg

SEQ ID NO: 6109958 - DNA, 16 bp, Homo sapiens
ctacactctcctgggc

SEQ ID NO: 6109959 - DNA, 19 bp, Homo sapiens
ctacactctcctgggcccc

SEQ ID NO: 6109960 - DNA, 23 bp, Homo sapiens
ctacactctcctgggcccctccc

SEQ ID NO: 6109961 - DNA, 18 bp, Homo sapiens
ctacactgccagccgcca

SEQ ID NO: 6109962 - DNA, 12 bp, Homo sapiens
ctacactgcctt

SEQ ID NO: 6109963 - DNA, 18 bp, Homo sapiens
ctacactgccttaccttc

SEQ ID NO: 6109964 - DNA, 17 bp, Homo sapiens
ctacactggtgtgtccc

SEQ ID NO: 6109965 - DNA, 14 bp, Homo sapiens
ctacactgtgctga

SEQ ID NO: 6109966 - DNA, 21 bp, Homo sapiens
ctacacttacaagtaatgaat

SEQ ID NO: 6109967 - DNA, 23 bp, Homo sapiens
ctacacttcgcaccggagtgtct

SEQ ID NO: 6109968 - DNA, 17 bp, Homo sapiens
ctacacttctgaaactt

SEQ ID NO: 6109969 - DNA, 12 bp, Homo sapiens
ctacagaaaaac

SEQ ID NO: 6109970 - DNA, 22 bp, Homo sapiens
ctacagaaaaacaatggtaaca

SEQ ID NO: 6109971 - DNA, 20 bp, Homo sapiens
ctacagaaaaaccttgggtt

SEQ ID NO: 6109972 - DNA, 18 bp, Homo sapiens
ctacagaaaacccagcta

SEQ ID NO: 6109973 - DNA, 17 bp, Homo sapiens
ctacagaaaagaaactc

SEQ ID NO: 6109974 - DNA, 13 bp, Homo sapiens
ctacagaaaataa

SEQ ID NO: 6109975 - DNA, 17 bp, Homo sapiens
ctacagaaaatgctggc

SEQ ID NO: 6109976 - DNA, 21 bp, Homo sapiens
ctacagaaaccacagtcttcc

SEQ ID NO: 6109977 - DNA, 23 bp, Homo sapiens
ctacagaaagcaaatcagacaca

SEQ ID NO: 6109978 - DNA, 18 bp, Homo sapiens
ctacagaaataacagctg

SEQ ID NO: 6109979 - DNA, 20 bp, Homo sapiens
ctacagaaataacagctggg

SEQ ID NO: 6109980 - DNA, 22 bp, Homo sapiens
ctacagaaatactgctctgaat

SEQ ID NO: 6109981 - DNA, 22 bp, Homo sapiens
ctacagaaatgaggaggatgct

SEQ ID NO: 6109982 - DNA, 20 bp, Homo sapiens
ctacagaaattaagatgttg

SEQ ID NO: 6109983 - DNA, 13 bp, Homo sapiens
ctacagaaattct

SEQ ID NO: 6109984 - DNA, 15 bp, Homo sapiens
ctacagaacaaagaa

SEQ ID NO: 6109985 - DNA, 14 bp, Homo sapiens
ctacagaagtggaa

SEQ ID NO: 6109986 - DNA, 14 bp, Homo sapiens
ctacagaataatgt

SEQ ID NO: 6109987 - DNA, 17 bp, Homo sapiens
ctacagaataatgtgtt

SEQ ID NO: 6109988 - DNA, 22 bp, Homo sapiens
ctacagaatactagccagagct

SEQ ID NO: 6109989 - DNA, 17 bp, Homo sapiens
ctacagaatattaaata

SEQ ID NO: 6109990 - DNA, 18 bp, Homo sapiens
ctacagacagacatacat

SEQ ID NO: 6109991 - DNA, 21 bp, Homo sapiens
ctacagacatggaacagtgta

SEQ ID NO: 6109992 - DNA, 22 bp, Homo sapiens
ctacagacatggaacagtgtaa

SEQ ID NO: 6109993 - DNA, 17 bp, Homo sapiens
ctacagacattaaataa

SEQ ID NO: 6109994 - DNA, 19 bp, Homo sapiens
ctacagacattaaataatc

SEQ ID NO: 6109995 - DNA, 15 bp, Homo sapiens
ctacagacctgcttt

SEQ ID NO: 6109996 - DNA, 14 bp, Homo sapiens
ctacagacctggct

SEQ ID NO: 6109997 - DNA, 16 bp, Homo sapiens
ctacagacctggctct

SEQ ID NO: 6109998 - DNA, 18 bp, Homo sapiens
ctacagacctggtacact

SEQ ID NO: 6109999 - DNA, 22 bp, Homo sapiens
ctacagacgattaacacaccac

SEQ ID NO: 6110000 - DNA, 10 bp, Homo sapiens
ctacagagaa

SEQ ID NO: 6110001 - DNA, 12 bp, Homo sapiens
ctacagagaaaa

SEQ ID NO: 6110002 - DNA, 11 bp, Homo sapiens
ctacagagaag

SEQ ID NO: 6110003 - DNA, 14 bp, Homo sapiens
ctacagagaagcct

SEQ ID NO: 6110004 - DNA, 16 bp, Homo sapiens
ctacagagaagccttc

SEQ ID NO: 6110005 - DNA, 17 bp, Homo sapiens
ctacagagaagccttca

SEQ ID NO: 6110006 - DNA, 23 bp, Homo sapiens
ctacagagaagccttcaagctct

SEQ ID NO: 6110007 - DNA, 18 bp, Homo sapiens
ctacagagagtgaataca

SEQ ID NO: 6110008 - DNA, 20 bp, Homo sapiens
ctacagagcagctccccagg

SEQ ID NO: 6110009 - DNA, 22 bp, Homo sapiens
ctacagagcagctccccaggag

SEQ ID NO: 6110010 - DNA, 18 bp, Homo sapiens
ctacagagcttccctgac

SEQ ID NO: 6110011 - DNA, 18 bp, Homo sapiens
ctacagaggccatgggcc

SEQ ID NO: 6110012 - DNA, 20 bp, Homo sapiens
ctacagagtacgtgaaatgc

SEQ ID NO: 6110013 - DNA, 22 bp, Homo sapiens
ctacagatagagagttgttgtg

SEQ ID NO: 6110014 - DNA, 14 bp, Homo sapiens
ctacagatagtcaa

SEQ ID NO: 6110015 - DNA, 15 bp, Homo sapiens
ctacagatagtcaaa

SEQ ID NO: 6110016 - DNA, 12 bp, Homo sapiens
ctacagatcctc

SEQ ID NO: 6110017 - DNA, 20 bp, Homo sapiens
ctacagatcctttttccatc

SEQ ID NO: 6110018 - DNA, 21 bp, Homo sapiens
ctacagatcctttttccatca

SEQ ID NO: 6110019 - DNA, 22 bp, Homo sapiens
ctacagatcctttttccatcat

SEQ ID NO: 6110020 - DNA, 12 bp, Homo sapiens
ctacagatgtgg

SEQ ID NO: 6110021 - DNA, 22 bp, Homo sapiens
ctacagattgggcggggcttct

SEQ ID NO: 6110022 - DNA, 13 bp, Homo sapiens
ctacagattttag

SEQ ID NO: 6110023 - DNA, 15 bp, Homo sapiens
ctacagcaaataaaa

SEQ ID NO: 6110024 - DNA, 14 bp, Homo sapiens
ctacagcagatcca

SEQ ID NO: 6110025 - DNA, 23 bp, Homo sapiens
ctacagcagcacgcatgtccctc

SEQ ID NO: 6110026 - DNA, 21 bp, Homo sapiens
ctacagcatcaatagaaagtc

SEQ ID NO: 6110027 - DNA, 21 bp, Homo sapiens
ctacagccacatccccaagcc

SEQ ID NO: 6110028 - DNA, 15 bp, Homo sapiens
ctacagccagaagcc

SEQ ID NO: 6110029 - DNA, 20 bp, Homo sapiens
ctacagccagaagcccatgg

SEQ ID NO: 6110030 - DNA, 16 bp, Homo sapiens
ctacagccctggaggc

SEQ ID NO: 6110031 - DNA, 14 bp, Homo sapiens
ctacagcctgcaca

SEQ ID NO: 6110032 - DNA, 15 bp, Homo sapiens
ctacagcctgcacac

SEQ ID NO: 6110033 - DNA, 19 bp, Homo sapiens
ctacagcctgcccctgact

SEQ ID NO: 6110034 - DNA, 22 bp, Homo sapiens
ctacagctaatcagcattctca

SEQ ID NO: 6110035 - DNA, 18 bp, Homo sapiens
ctacagctatatttgatt

SEQ ID NO: 6110036 - DNA, 16 bp, Homo sapiens
ctacagctatgaagaa

SEQ ID NO: 6110037 - DNA, 11 bp, Homo sapiens
ctacagctcca

SEQ ID NO: 6110038 - DNA, 16 bp, Homo sapiens
ctacagctccacacgc

SEQ ID NO: 6110039 - DNA, 19 bp, Homo sapiens
ctacagctcttaaatgtag

SEQ ID NO: 6110040 - DNA, 21 bp, Homo sapiens
ctacagctgtcttcacatgta

SEQ ID NO: 6110041 - DNA, 17 bp, Homo sapiens
ctacagctttcttgctc

SEQ ID NO: 6110042 - DNA, 19 bp, Homo sapiens
ctacagctttcttgctccc

SEQ ID NO: 6110043 - DNA, 18 bp, Homo sapiens
ctacagctttgtgactgt

SEQ ID NO: 6110044 - DNA, 23 bp, Homo sapiens
ctacagcttttaagattgtactt

SEQ ID NO: 6110045 - DNA, 18 bp, Homo sapiens
ctacaggaagcaccccat

SEQ ID NO: 6110046 - DNA, 11 bp, Homo sapiens
ctacaggacaa

SEQ ID NO: 6110047 - DNA, 17 bp, Homo sapiens
ctacaggacaaagggag

SEQ ID NO: 6110048 - DNA, 18 bp, Homo sapiens
ctacaggacaaagggagg

SEQ ID NO: 6110049 - DNA, 15 bp, Homo sapiens
ctacaggacaagggg

SEQ ID NO: 6110050 - DNA, 12 bp, Homo sapiens
ctacaggactgg

SEQ ID NO: 6110051 - DNA, 16 bp, Homo sapiens
ctacaggactgggccg

SEQ ID NO: 6110052 - DNA, 22 bp, Homo sapiens
ctacaggagagatagaagcctc

SEQ ID NO: 6110053 - DNA, 21 bp, Homo sapiens
ctacaggagagggaagagtgc

SEQ ID NO: 6110054 - DNA, 17 bp, Homo sapiens
ctacaggaggaacagtg

SEQ ID NO: 6110055 - DNA, 15 bp, Homo sapiens
ctacaggagtgagca

SEQ ID NO: 6110056 - DNA, 13 bp, Homo sapiens
ctacaggatattt

SEQ ID NO: 6110057 - DNA, 15 bp, Homo sapiens
ctacaggcacccacc

SEQ ID NO: 6110058 - DNA, 18 bp, Homo sapiens
ctacaggcagtctctctc

SEQ ID NO: 6110059 - DNA, 20 bp, Homo sapiens
ctacaggcagtctctctctt

SEQ ID NO: 6110060 - DNA, 20 bp, Homo sapiens
ctacaggcccggcccagcct

SEQ ID NO: 6110061 - DNA, 18 bp, Homo sapiens
ctacaggcctatttaaca

SEQ ID NO: 6110062 - DNA, 17 bp, Homo sapiens
ctacaggcctcagggtg

SEQ ID NO: 6110063 - DNA, 14 bp, Homo sapiens
ctacaggcctttca

SEQ ID NO: 6110064 - DNA, 19 bp, Homo sapiens
ctacaggcctttcaggaag

SEQ ID NO: 6110065 - DNA, 17 bp, Homo sapiens
ctacaggcgctccaggc

SEQ ID NO: 6110066 - DNA, 15 bp, Homo sapiens
ctacagggggtctgg

SEQ ID NO: 6110067 - DNA, 16 bp, Homo sapiens
ctacaggtgcaagcca

SEQ ID NO: 6110068 - DNA, 17 bp, Homo sapiens
ctacaggtgcaagccac

SEQ ID NO: 6110069 - DNA, 22 bp, Homo sapiens
ctacaggtgcgcgccaccgtgc

SEQ ID NO: 6110070 - DNA, 22 bp, Homo sapiens
ctacaggtgtttgactttcaaa

SEQ ID NO: 6110071 - DNA, 23 bp, Homo sapiens
cctgggtggggctgctcctccag

SEQ ID NO: 6110072 - DNA, 20 bp, Homo sapiens
cctgggtgggtggggtacag

SEQ ID NO: 6110073 - DNA, 19 bp, Homo sapiens
cctgggtgggtggtgggga

SEQ ID NO: 6110074 - DNA, 21 bp, Homo sapiens
cctgggtgggtggtggggagg

SEQ ID NO: 6110075 - DNA, 23 bp, Homo sapiens
cctgggtgggtggtggggagggg

SEQ ID NO: 6110076 - DNA, 14 bp, Homo sapiens
cctgggtggtctgc

SEQ ID NO: 6110077 - DNA, 19 bp, Homo sapiens
cctgggtggtctgcaggca

SEQ ID NO: 6110078 - DNA, 21 bp, Homo sapiens
cctgggtggtctgcaggcagg

SEQ ID NO: 6110079 - DNA, 17 bp, Homo sapiens
cctgggtgtcaagtgcc

SEQ ID NO: 6110080 - DNA, 20 bp, Homo sapiens
cctgggtgtcaagtgcctgc

SEQ ID NO: 6110081 - DNA, 19 bp, Homo sapiens
cctgggtgtctgggctcaa

SEQ ID NO: 6110082 - DNA, 24 bp, Homo sapiens
cctgggtgtgacctgacacctgcc

SEQ ID NO: 6110083 - DNA, 13 bp, Homo sapiens
cctgggtgtgctc

SEQ ID NO: 6110084 - DNA, 16 bp, Homo sapiens
cctgggtgtgctccag

SEQ ID NO: 6110085 - DNA, 21 bp, Homo sapiens
cctgggtgtgctccaggcttc

SEQ ID NO: 6110086 - DNA, 18 bp, Homo sapiens
cctgggttaacaaatgag

SEQ ID NO: 6110087 - DNA, 17 bp, Homo sapiens
cctgggttagactgcca

SEQ ID NO: 6110088 - DNA, 21 bp, Homo sapiens
cctgggttagactgccagctc

SEQ ID NO: 6110089 - DNA, 22 bp, Homo sapiens
cctgggttagggtgtgtgttca

SEQ ID NO: 6110090 - DNA, 19 bp, Homo sapiens
cctgggttcagaaatgctg

SEQ ID NO: 6110091 - DNA, 23 bp, Homo sapiens
cctgggttcagaaatgctgcctg

SEQ ID NO: 6110092 - DNA, 19 bp, Homo sapiens
cctgggttcagcctctccc

SEQ ID NO: 6110093 - DNA, 20 bp, Homo sapiens
cctgggttccaatcctggct

SEQ ID NO: 6110094 - DNA, 13 bp, Homo sapiens
cctgggttccctt

SEQ ID NO: 6110095 - DNA, 16 bp, Homo sapiens
cctgggttgcagacag

SEQ ID NO: 6110096 - DNA, 17 bp, Homo sapiens
cctgggttgcagacagg

SEQ ID NO: 6110097 - DNA, 13 bp, Homo sapiens
cctgggttggagg

SEQ ID NO: 6110098 - DNA, 14 bp, Homo sapiens
cctgggttggaggg

SEQ ID NO: 6110099 - DNA, 15 bp, Homo sapiens
cctgggttggaggga

SEQ ID NO: 6110100 - DNA, 20 bp, Homo sapiens
cctgggttggccagagggcc

SEQ ID NO: 6110101 - DNA, 15 bp, Homo sapiens
cctgggttgggggca

SEQ ID NO: 6110102 - DNA, 23 bp, Homo sapiens
cctgggttgggggcactcagcca

SEQ ID NO: 6110103 - DNA, 14 bp, Homo sapiens
cctgggttgtttcc

SEQ ID NO: 6110104 - DNA, 17 bp, Homo sapiens
cctgggttgtttccagg

SEQ ID NO: 6110105 - DNA, 18 bp, Homo sapiens
cctgggtttcctgcaggc

SEQ ID NO: 6110106 - DNA, 19 bp, Homo sapiens
cctgggtttcctgcaggca

SEQ ID NO: 6110107 - DNA, 21 bp, Homo sapiens
cctgggtttcttttttctttc

SEQ ID NO: 6110108 - DNA, 15 bp, Homo sapiens
cctgggtttggcccc

SEQ ID NO: 6110109 - DNA, 16 bp, Homo sapiens
cctgggtttggcccct

SEQ ID NO: 6110110 - DNA, 17 bp, Homo sapiens
cctgggtttggcccctg

SEQ ID NO: 6110111 - DNA, 22 bp, Homo sapiens
cctgggtttggcccctggaacc

SEQ ID NO: 6110112 - DNA, 21 bp, Homo sapiens
cctgggtttgggagccaggac

SEQ ID NO: 6110113 - DNA, 23 bp, Homo sapiens
cctgggtttgggagccaggactc

SEQ ID NO: 6110114 - DNA, 16 bp, Homo sapiens
cctgggttttctaact

SEQ ID NO: 6110115 - DNA, 18 bp, Homo sapiens
cctgggttttctaactgt

SEQ ID NO: 6110116 - DNA, 21 bp, Homo sapiens
cctgggttttctaactgtaaa

SEQ ID NO: 6110117 - DNA, 20 bp, Homo sapiens
cctgggttttgtattctctg

SEQ ID NO: 6110118 - DNA, 23 bp, Homo sapiens
cctgggttttgtattctctgagc

SEQ ID NO: 6110119 - DNA, 15 bp, Homo sapiens
cctggtaagaaaaag

SEQ ID NO: 6110120 - DNA, 18 bp, Homo sapiens
cctggtaagcagaggctt

SEQ ID NO: 6110121 - DNA, 22 bp, Homo sapiens
cctggtaagggggtccctgtgc

SEQ ID NO: 6110122 - DNA, 14 bp, Homo sapiens
cctggtaattaaaa

SEQ ID NO: 6110123 - DNA, 19 bp, Homo sapiens
cctggtaattcctctccag

SEQ ID NO: 6110124 - DNA, 21 bp, Homo sapiens
cctggtacaaacgtatggaat

SEQ ID NO: 6110125 - DNA, 15 bp, Homo sapiens
cctggtacagcaggg

SEQ ID NO: 6110126 - DNA, 14 bp, Homo sapiens
cctggtacccagcc

SEQ ID NO: 6110127 - DNA, 15 bp, Homo sapiens
cctggtacccagcca

SEQ ID NO: 6110128 - DNA, 18 bp, Homo sapiens
cctggtacccagccatct

SEQ ID NO: 6110129 - DNA, 15 bp, Homo sapiens
cctggtaccctcctg

SEQ ID NO: 6110130 - DNA, 17 bp, Homo sapiens
cctggtaccctcctggc

SEQ ID NO: 6110131 - DNA, 20 bp, Homo sapiens
cctggtactcccccagccct

SEQ ID NO: 6110132 - DNA, 16 bp, Homo sapiens
cctggtagcatgacct

SEQ ID NO: 6110133 - DNA, 18 bp, Homo sapiens
cctggtagcatgaccttt

SEQ ID NO: 6110134 - DNA, 20 bp, Homo sapiens
cctggtagctgggattacag

SEQ ID NO: 6110135 - DNA, 14 bp, Homo sapiens
cctggtaggtctgg

SEQ ID NO: 6110136 - DNA, 21 bp, Homo sapiens
cctggtaggtctggattttca

SEQ ID NO: 6110137 - DNA, 21 bp, Homo sapiens
cctggtatgggtttctcccag

SEQ ID NO: 6110138 - DNA, 18 bp, Homo sapiens
cctggtcaacccgctgct

SEQ ID NO: 6110139 - DNA, 20 bp, Homo sapiens
cctggtcaccctggggctgc

SEQ ID NO: 6110140 - DNA, 21 bp, Homo sapiens
cctggtcaccctggggctgct

SEQ ID NO: 6110141 - DNA, 23 bp, Homo sapiens
cctggtcaccgagactcagcctc

SEQ ID NO: 6110142 - DNA, 14 bp, Homo sapiens
cctggtcagcagag

SEQ ID NO: 6110143 - DNA, 14 bp, Homo sapiens
cctggtcagcccaa

SEQ ID NO: 6110144 - DNA, 17 bp, Homo sapiens
cctggtcaggccctggt

SEQ ID NO: 6110145 - DNA, 19 bp, Homo sapiens
cctggtcaggccctggtgc

SEQ ID NO: 6110146 - DNA, 23 bp, Homo sapiens
cctggtcagttttcacagaggcg

SEQ ID NO: 6110147 - DNA, 14 bp, Homo sapiens
cctggtccagggaa

SEQ ID NO: 6110148 - DNA, 13 bp, Homo sapiens
cctggtccatgca

SEQ ID NO: 6110149 - DNA, 14 bp, Homo sapiens
cctggtccccactg

SEQ ID NO: 6110150 - DNA, 15 bp, Homo sapiens
cctggtccccactgc

SEQ ID NO: 6110151 - DNA, 18 bp, Homo sapiens
cctggtccccactgctga

SEQ ID NO: 6110152 - DNA, 15 bp, Homo sapiens
cctggtcccctcctt

SEQ ID NO: 6110153 - DNA, 15 bp, Homo sapiens
cctggtccctcaccc

SEQ ID NO: 6110154 - DNA, 23 bp, Homo sapiens
cctggtccctcacccccatggcc

SEQ ID NO: 6110155 - DNA, 19 bp, Homo sapiens
cctggtccctcgtccacag

SEQ ID NO: 6110156 - DNA, 17 bp, Homo sapiens
cctggtccctctgaggc

SEQ ID NO: 6110157 - DNA, 18 bp, Homo sapiens
cctggtccctctgaggca

SEQ ID NO: 6110158 - DNA, 13 bp, Homo sapiens
cctggtccctggt

SEQ ID NO: 6110159 - DNA, 14 bp, Homo sapiens
cctggtccctggtc

SEQ ID NO: 6110160 - DNA, 20 bp, Homo sapiens
cctggtcctccctcccaagg

SEQ ID NO: 6110161 - DNA, 17 bp, Homo sapiens
cctggtcctgacttccc

SEQ ID NO: 6110162 - DNA, 15 bp, Homo sapiens
cctggtcctggacac

SEQ ID NO: 6110163 - DNA, 15 bp, Homo sapiens
cctggtcctggcctc

SEQ ID NO: 6110164 - DNA, 17 bp, Homo sapiens
cctggtcctggcctcct

SEQ ID NO: 6110165 - DNA, 19 bp, Homo sapiens
cctggtcctggctgcactc

SEQ ID NO: 6110166 - DNA, 22 bp, Homo sapiens
cctggtccttcactggcgcctt

SEQ ID NO: 6110167 - DNA, 19 bp, Homo sapiens
cctggtccttccaggcccc

SEQ ID NO: 6110168 - DNA, 22 bp, Homo sapiens
cctggtccttccctgatggcct

SEQ ID NO: 6110169 - DNA, 16 bp, Homo sapiens
cctggtctcctgcccc

SEQ ID NO: 6110170 - DNA, 14 bp, Homo sapiens
cctggtctgccctg

SEQ ID NO: 6110171 - DNA, 15 bp, Homo sapiens
cctggtctgccctgg

SEQ ID NO: 6110172 - DNA, 23 bp, Homo sapiens
cctggtctgctcaggaattgaag

SEQ ID NO: 6110173 - DNA, 17 bp, Homo sapiens
cctggtctggagcccct

SEQ ID NO: 6110174 - DNA, 20 bp, Homo sapiens
cctggtctggagcccctatc

SEQ ID NO: 6110175 - DNA, 13 bp, Homo sapiens
cctggtctggctt

SEQ ID NO: 6110176 - DNA, 12 bp, Homo sapiens
cctggtctggga

SEQ ID NO: 6110177 - DNA, 21 bp, Homo sapiens
cctggtctggtcaggcaatgc

SEQ ID NO: 6110178 - DNA, 13 bp, Homo sapiens
cctggtctgtgca

SEQ ID NO: 6110179 - DNA, 16 bp, Homo sapiens
cctggtctgttttctg

SEQ ID NO: 6110180 - DNA, 12 bp, Homo sapiens
cctggtcttttt

SEQ ID NO: 6110181 - DNA, 15 bp, Homo sapiens
cctggtgaaagagta

SEQ ID NO: 6110182 - DNA, 15 bp, Homo sapiens
cctggtgaagtgtga

SEQ ID NO: 6110183 - DNA, 18 bp, Homo sapiens
cctggtgaatcacctggc

SEQ ID NO: 6110184 - DNA, 19 bp, Homo sapiens
cctggtgaatcacctggct

SEQ ID NO: 6110185 - DNA, 23 bp, Homo sapiens
cctggtgaatcacctggctgagc

SEQ ID NO: 6110186 - DNA, 15 bp, Homo sapiens
cctggtgacaggcag

SEQ ID NO: 6110187 - DNA, 13 bp, Homo sapiens
cctggtgaccaga

SEQ ID NO: 6110188 - DNA, 17 bp, Homo sapiens
cctggtgaccccttttc

SEQ ID NO: 6110189 - DNA, 19 bp, Homo sapiens
cctggtgacctcctgtcac

SEQ ID NO: 6110190 - DNA, 14 bp, Homo sapiens
cctggtgagaaaat

SEQ ID NO: 6110191 - DNA, 15 bp, Homo sapiens
cctggtgagaaaata

SEQ ID NO: 6110192 - DNA, 21 bp, Homo sapiens
cctggtgagcaggggaagcag

SEQ ID NO: 6110193 - DNA, 14 bp, Homo sapiens
cctggtgagggagc

SEQ ID NO: 6110194 - DNA, 23 bp, Homo sapiens
cctggtgagtaacttagaaaagt

SEQ ID NO: 6110195 - DNA, 19 bp, Homo sapiens
cctggtgcactggccccac

SEQ ID NO: 6110196 - DNA, 16 bp, Homo sapiens
cctggtgcattgctgt

SEQ ID NO: 6110197 - DNA, 22 bp, Homo sapiens
cctggtgccccccacccctgga

SEQ ID NO: 6110198 - DNA, 13 bp, Homo sapiens
cctggtgcccctc

SEQ ID NO: 6110199 - DNA, 12 bp, Homo sapiens
cctggtgccctg

SEQ ID NO: 6110200 - DNA, 15 bp, Homo sapiens
cctggtgccctgaga

SEQ ID NO: 6110201 - DNA, 21 bp, Homo sapiens
cctggtgccctggatgcccag

SEQ ID NO: 6110202 - DNA, 19 bp, Homo sapiens
cctggtgccctggcccagc

SEQ ID NO: 6110203 - DNA, 20 bp, Homo sapiens
cctggtgcctatctgcctgg

SEQ ID NO: 6110204 - DNA, 15 bp, Homo sapiens
cctggtgcctctgtg

SEQ ID NO: 6110205 - DNA, 13 bp, Homo sapiens
cctggtgcctgca

SEQ ID NO: 6110206 - DNA, 23 bp, Homo sapiens
cctggtgcgctgtgctccagcag

SEQ ID NO: 6110207 - DNA, 17 bp, Homo sapiens
cctggtgcgggcctggc

SEQ ID NO: 6110208 - DNA, 18 bp, Homo sapiens
cctggtgcgggcctggcc

SEQ ID NO: 6110209 - DNA, 9 bp, Homo sapiens
cctggtgct

SEQ ID NO: 6110210 - DNA, 19 bp, Homo sapiens
cctggtgctcctgcccagc

SEQ ID NO: 6110211 - DNA, 21 bp, Homo sapiens
cctggtgctcctgcccagcca

SEQ ID NO: 6110212 - DNA, 15 bp, Homo sapiens
cctggtgctctctgc

SEQ ID NO: 6110213 - DNA, 21 bp, Homo sapiens
cctggtgctgccacacttcag

SEQ ID NO: 6110214 - DNA, 16 bp, Homo sapiens
cctggtgctgccgagg

SEQ ID NO: 6110215 - DNA, 22 bp, Homo sapiens
cctggtgctgccgagggctggc

SEQ ID NO: 6110216 - DNA, 20 bp, Homo sapiens
cctggtggaatgcgggggag

SEQ ID NO: 6110217 - DNA, 20 bp, Homo sapiens
cctggtggacagtcctggga

SEQ ID NO: 6110218 - DNA, 22 bp, Homo sapiens
cctggtggagaaagcactgacc

SEQ ID NO: 6110219 - DNA, 21 bp, Homo sapiens
cctggtggaggcttcttgccc

SEQ ID NO: 6110220 - DNA, 17 bp, Homo sapiens
cctggtggcaccagatg

SEQ ID NO: 6110221 - DNA, 18 bp, Homo sapiens
cctggtggcaccagatgc

SEQ ID NO: 6110222 - DNA, 17 bp, Homo sapiens
cctggtggcagctcacc

SEQ ID NO: 6110223 - DNA, 19 bp, Homo sapiens
cctggtggcagctcacctc

SEQ ID NO: 6110224 - DNA, 22 bp, Homo sapiens
cctggtggcagctcacctctcc

SEQ ID NO: 6110225 - DNA, 14 bp, Homo sapiens
cctggtggcagctg

SEQ ID NO: 6110226 - DNA, 17 bp, Homo sapiens
cctggtggcagctgcgg

SEQ ID NO: 6110227 - DNA, 18 bp, Homo sapiens
cctggtggcagtgggagc

SEQ ID NO: 6110228 - DNA, 20 bp, Homo sapiens
cctggtggcagtgggagctg

SEQ ID NO: 6110229 - DNA, 17 bp, Homo sapiens
cctggtggcatggaaga

SEQ ID NO: 6110230 - DNA, 23 bp, Homo sapiens
cctggtggccaagcctgccccgg

SEQ ID NO: 6110231 - DNA, 24 bp, Homo sapiens
cctggtggccatgctcctcttccc

SEQ ID NO: 6110232 - DNA, 22 bp, Homo sapiens
cctggtggccatgtcgcctgcc

SEQ ID NO: 6110233 - DNA, 18 bp, Homo sapiens
cctggtggccctctcccc

SEQ ID NO: 6110234 - DNA, 23 bp, Homo sapiens
cctggtggccctctcccctgccc

SEQ ID NO: 6110235 - DNA, 14 bp, Homo sapiens
cctggtggccctgc

SEQ ID NO: 6110236 - DNA, 22 bp, Homo sapiens
cctggtggccctgcggggcggc

SEQ ID NO: 6110237 - DNA, 16 bp, Homo sapiens
cctggtggcctgcccc

SEQ ID NO: 6110238 - DNA, 18 bp, Homo sapiens
cctggtggccttctgctg

SEQ ID NO: 6110239 - DNA, 15 bp, Homo sapiens
cctggtggctgcagg

SEQ ID NO: 6110240 - DNA, 17 bp, Homo sapiens
cctggtggctgcaggca

SEQ ID NO: 6110241 - DNA, 15 bp, Homo sapiens
cctggtggctgggcc

SEQ ID NO: 6110242 - DNA, 17 bp, Homo sapiens
cctggtggctgggccca

SEQ ID NO: 6110243 - DNA, 14 bp, Homo sapiens
cctggtgggccaac

SEQ ID NO: 6110244 - DNA, 13 bp, Homo sapiens
cctggtgggcctc

SEQ ID NO: 6110245 - DNA, 12 bp, Homo sapiens
cctggtgggctg

SEQ ID NO: 6110246 - DNA, 20 bp, Homo sapiens
cctggtggggaggaagaagt

SEQ ID NO: 6110247 - DNA, 15 bp, Homo sapiens
cctggtggggcagct

SEQ ID NO: 6110248 - DNA, 11 bp, Homo sapiens
ctacaggttac

SEQ ID NO: 6110249 - DNA, 17 bp, Homo sapiens
ctacaggtttgggtaca

SEQ ID NO: 6110250 - DNA, 15 bp, Homo sapiens
ctacagtaagctggt

SEQ ID NO: 6110251 - DNA, 13 bp, Homo sapiens
ctacagtaataaa

SEQ ID NO: 6110252 - DNA, 15 bp, Homo sapiens
ctacagtaatgaaat

SEQ ID NO: 6110253 - DNA, 18 bp, Homo sapiens
ctacagtaatgaaatgtt

SEQ ID NO: 6110254 - DNA, 14 bp, Homo sapiens
ctacagtacatgac

SEQ ID NO: 6110255 - DNA, 17 bp, Homo sapiens
ctacagtactatgtaaa

SEQ ID NO: 6110256 - DNA, 16 bp, Homo sapiens
ctacagtacttccaga

SEQ ID NO: 6110257 - DNA, 18 bp, Homo sapiens
ctacagtagctgctacct

SEQ ID NO: 6110258 - DNA, 18 bp, Homo sapiens
ctacagtagctgtgggga

SEQ ID NO: 6110259 - DNA, 20 bp, Homo sapiens
ctacagtagctgtggggagc

SEQ ID NO: 6110260 - DNA, 12 bp, Homo sapiens
ctacagtatata

SEQ ID NO: 6110261 - DNA, 16 bp, Homo sapiens
ctacagtcctcccatc

SEQ ID NO: 6110262 - DNA, 19 bp, Homo sapiens
ctacagtgactccctggga

SEQ ID NO: 6110263 - DNA, 18 bp, Homo sapiens
ctacagtgccaactcctc

SEQ ID NO: 6110264 - DNA, 17 bp, Homo sapiens
ctacagtgtacagtctt

SEQ ID NO: 6110265 - DNA, 20 bp, Homo sapiens
ctacagtgtacagtcttgta

SEQ ID NO: 6110266 - DNA, 14 bp, Homo sapiens
ctacagtgtctggc

SEQ ID NO: 6110267 - DNA, 15 bp, Homo sapiens
ctacagtgttttcct

SEQ ID NO: 6110268 - DNA, 21 bp, Homo sapiens
ctacagttatgttcagtcaca

SEQ ID NO: 6110269 - DNA, 22 bp, Homo sapiens
ctacagttgaaaaacagctgag

SEQ ID NO: 6110270 - DNA, 18 bp, Homo sapiens
ctacagttgaacagaact

SEQ ID NO: 6110271 - DNA, 22 bp, Homo sapiens
ctacagttgggaagtctcagcc

SEQ ID NO: 6110272 - DNA, 15 bp, Homo sapiens
ctacagttgtcctga

SEQ ID NO: 6110273 - DNA, 23 bp, Homo sapiens
ctacagttgtgataatagcattt

SEQ ID NO: 6110274 - DNA, 22 bp, Homo sapiens
ctacagttgttttttgaaaaca

SEQ ID NO: 6110275 - DNA, 16 bp, Homo sapiens
ctacagtttcttactg

SEQ ID NO: 6110276 - DNA, 19 bp, Homo sapiens
ctacagttttaactgtgga

SEQ ID NO: 6110277 - DNA, 20 bp, Homo sapiens
ctacagttttaactgtggat

SEQ ID NO: 6110278 - DNA, 15 bp, Homo sapiens
ctacataaactgact

SEQ ID NO: 6110279 - DNA, 18 bp, Homo sapiens
ctacataaactgacttta

SEQ ID NO: 6110280 - DNA, 20 bp, Homo sapiens
ctacataaactgactttatc

SEQ ID NO: 6110281 - DNA, 13 bp, Homo sapiens
ctacataaattgg

SEQ ID NO: 6110282 - DNA, 13 bp, Homo sapiens
ctacataacacat

SEQ ID NO: 6110283 - DNA, 15 bp, Homo sapiens
ctacataatctctgg

SEQ ID NO: 6110284 - DNA, 22 bp, Homo sapiens
ctacataattaaattttaatgt

SEQ ID NO: 6110285 - DNA, 13 bp, Homo sapiens
ctacataattgtg

SEQ ID NO: 6110286 - DNA, 20 bp, Homo sapiens
ctacatacgtctttcacagt

SEQ ID NO: 6110287 - DNA, 16 bp, Homo sapiens
ctacatagtaagtaca

SEQ ID NO: 6110288 - DNA, 18 bp, Homo sapiens
ctacatatcccttccaga

SEQ ID NO: 6110289 - DNA, 21 bp, Homo sapiens
ctacatatcccttccagatgg

SEQ ID NO: 6110290 - DNA, 20 bp, Homo sapiens
ctacatatgtaggaaaattt

SEQ ID NO: 6110291 - DNA, 20 bp, Homo sapiens
ctacatatttgtatgttttt

SEQ ID NO: 6110292 - DNA, 14 bp, Homo sapiens
ctacatcagagtgt

SEQ ID NO: 6110293 - DNA, 13 bp, Homo sapiens
ctacatccccagg

SEQ ID NO: 6110294 - DNA, 20 bp, Homo sapiens
ctacatcccgggcctcagtg

SEQ ID NO: 6110295 - DNA, 15 bp, Homo sapiens
ctacatcgccctcca

SEQ ID NO: 6110296 - DNA, 17 bp, Homo sapiens
ctacatcgccctccaca

SEQ ID NO: 6110297 - DNA, 15 bp, Homo sapiens
ctacatctgaaatct

SEQ ID NO: 6110298 - DNA, 16 bp, Homo sapiens
ctacatcttcagctcc

SEQ ID NO: 6110299 - DNA, 18 bp, Homo sapiens
ctacatcttcagctccca

SEQ ID NO: 6110300 - DNA, 21 bp, Homo sapiens
ctacatcttcagctcccatag

SEQ ID NO: 6110301 - DNA, 15 bp, Homo sapiens
ctacatcttctgcct

SEQ ID NO: 6110302 - DNA, 13 bp, Homo sapiens
ctacatgaaacag

SEQ ID NO: 6110303 - DNA, 14 bp, Homo sapiens
ctacatgaaacaga

SEQ ID NO: 6110304 - DNA, 18 bp, Homo sapiens
ctacatgaaacagaaaca

SEQ ID NO: 6110305 - DNA, 15 bp, Homo sapiens
ctacatgactgggcc

SEQ ID NO: 6110306 - DNA, 13 bp, Homo sapiens
ctacatgagaaca

SEQ ID NO: 6110307 - DNA, 18 bp, Homo sapiens
ctacatgaggtactgaga

SEQ ID NO: 6110308 - DNA, 17 bp, Homo sapiens
ctacatgatgctaaagg

SEQ ID NO: 6110309 - DNA, 19 bp, Homo sapiens
ctacatgcaaatctggctt

SEQ ID NO: 6110310 - DNA, 23 bp, Homo sapiens
ctacatgcagcccatgcccacct

SEQ ID NO: 6110311 - DNA, 15 bp, Homo sapiens
ctacatgcatgtttt

SEQ ID NO: 6110312 - DNA, 17 bp, Homo sapiens
ctacatgccccctccct

SEQ ID NO: 6110313 - DNA, 14 bp, Homo sapiens
ctacatgctggggt

SEQ ID NO: 6110314 - DNA, 17 bp, Homo sapiens
ctacatgggccagccct

SEQ ID NO: 6110315 - DNA, 21 bp, Homo sapiens
ctacatggtattgtaatgaat

SEQ ID NO: 6110316 - DNA, 22 bp, Homo sapiens
ctacatggtattgtaatgaata

SEQ ID NO: 6110317 - DNA, 22 bp, Homo sapiens
ctacatggtttagataaaggaa

SEQ ID NO: 6110318 - DNA, 16 bp, Homo sapiens
ctacatgtaatgacac

SEQ ID NO: 6110319 - DNA, 18 bp, Homo sapiens
ctacatgtattgcacatt

SEQ ID NO: 6110320 - DNA, 21 bp, Homo sapiens
ctacatgtattgcacattgta

SEQ ID NO: 6110321 - DNA, 13 bp, Homo sapiens
ctacatgtgagtg

SEQ ID NO: 6110322 - DNA, 15 bp, Homo sapiens
ctacattaaaagctt

SEQ ID NO: 6110323 - DNA, 17 bp, Homo sapiens
ctacattaaaatgacaa

SEQ ID NO: 6110324 - DNA, 18 bp, Homo sapiens
ctacattaaaatgacaaa

SEQ ID NO: 6110325 - DNA, 13 bp, Homo sapiens
ctacattaaacaa

SEQ ID NO: 6110326 - DNA, 14 bp, Homo sapiens
ctacattaacttga

SEQ ID NO: 6110327 - DNA, 17 bp, Homo sapiens
ctacattaatgtcctct

SEQ ID NO: 6110328 - DNA, 22 bp, Homo sapiens
ctacattataataaaatttctt

SEQ ID NO: 6110329 - DNA, 19 bp, Homo sapiens
ctacattataccgcagagt

SEQ ID NO: 6110330 - DNA, 18 bp, Homo sapiens
ctacattccaaagaaaca

SEQ ID NO: 6110331 - DNA, 11 bp, Homo sapiens
ctacattccac

SEQ ID NO: 6110332 - DNA, 15 bp, Homo sapiens
ctacattccaccctg

SEQ ID NO: 6110333 - DNA, 17 bp, Homo sapiens
ctacattccccagagtg

SEQ ID NO: 6110334 - DNA, 21 bp, Homo sapiens
ctacattccctctcctgccca

SEQ ID NO: 6110335 - DNA, 11 bp, Homo sapiens
ctacattcctc

SEQ ID NO: 6110336 - DNA, 15 bp, Homo sapiens
ctacattcctcagct

SEQ ID NO: 6110337 - DNA, 23 bp, Homo sapiens
ctacattcgtgtgtgtctgcttt

SEQ ID NO: 6110338 - DNA, 14 bp, Homo sapiens
ctacattctcatct

SEQ ID NO: 6110339 - DNA, 13 bp, Homo sapiens
ctacattctgctc

SEQ ID NO: 6110340 - DNA, 14 bp, Homo sapiens
ctacattctgctct

SEQ ID NO: 6110341 - DNA, 17 bp, Homo sapiens
ctacattctgctctgcc

SEQ ID NO: 6110342 - DNA, 19 bp, Homo sapiens
ctacattctgctctgccca

SEQ ID NO: 6110343 - DNA, 22 bp, Homo sapiens
ctacattctgctctgcccatgc

SEQ ID NO: 6110344 - DNA, 19 bp, Homo sapiens
ctacattcttggttgttaa

SEQ ID NO: 6110345 - DNA, 23 bp, Homo sapiens
ctacattgtaatctgctttgtta

SEQ ID NO: 6110346 - DNA, 21 bp, Homo sapiens
ctacatttagcccctctctta

SEQ ID NO: 6110347 - DNA, 23 bp, Homo sapiens
ctacatttatcatggtcctgaat

SEQ ID NO: 6110348 - DNA, 18 bp, Homo sapiens
ctacatttctactatgat

SEQ ID NO: 6110349 - DNA, 15 bp, Homo sapiens
ctacatttctgcaga

SEQ ID NO: 6110350 - DNA, 19 bp, Homo sapiens
ctacatttgaacagggcaa

SEQ ID NO: 6110351 - DNA, 18 bp, Homo sapiens
ctacatttgagggcccag

SEQ ID NO: 6110352 - DNA, 15 bp, Homo sapiens
ctacatttgcatgcc

SEQ ID NO: 6110353 - DNA, 14 bp, Homo sapiens
ctacattttaacat

SEQ ID NO: 6110354 - DNA, 14 bp, Homo sapiens
ctacattttcagaa

SEQ ID NO: 6110355 - DNA, 19 bp, Homo sapiens
ctacattttctttttttat

SEQ ID NO: 6110356 - DNA, 18 bp, Homo sapiens
ctacattttgctctgtga

SEQ ID NO: 6110357 - DNA, 21 bp, Homo sapiens
ctacattttgctctgtgaact

SEQ ID NO: 6110358 - DNA, 17 bp, Homo sapiens
ctacattttttaaaact

SEQ ID NO: 6110359 - DNA, 20 bp, Homo sapiens
ctacattttttaaaactgaa

SEQ ID NO: 6110360 - DNA, 23 bp, Homo sapiens
ctacattttttaaaactgaatct

SEQ ID NO: 6110361 - DNA, 14 bp, Homo sapiens
ctacattttttcat

SEQ ID NO: 6110362 - DNA, 16 bp, Homo sapiens
ctacattttttcatca

SEQ ID NO: 6110363 - DNA, 17 bp, Homo sapiens
ctacattttttctaata

SEQ ID NO: 6110364 - DNA, 17 bp, Homo sapiens
ctaccaaaaaaaggaag

SEQ ID NO: 6110365 - DNA, 18 bp, Homo sapiens
ctaccaaaaaaaggaagg

SEQ ID NO: 6110366 - DNA, 12 bp, Homo sapiens
ctaccaaaatgg

SEQ ID NO: 6110367 - DNA, 18 bp, Homo sapiens
ctaccaaacactcagtcc

SEQ ID NO: 6110368 - DNA, 14 bp, Homo sapiens
ctaccaaagcacct

SEQ ID NO: 6110369 - DNA, 15 bp, Homo sapiens
ctaccaaaggacact

SEQ ID NO: 6110370 - DNA, 19 bp, Homo sapiens
ctaccaaatataaacttgt

SEQ ID NO: 6110371 - DNA, 15 bp, Homo sapiens
ctaccaaatgtgtaa

SEQ ID NO: 6110372 - DNA, 12 bp, Homo sapiens
ctaccaactgga

SEQ ID NO: 6110373 - DNA, 20 bp, Homo sapiens
ctaccaacttgtatccaggc

SEQ ID NO: 6110374 - DNA, 16 bp, Homo sapiens
ctaccaactttactgt

SEQ ID NO: 6110375 - DNA, 19 bp, Homo sapiens
ctaccaagctatcctggct

SEQ ID NO: 6110376 - DNA, 13 bp, Homo sapiens
ctaccaatattag

SEQ ID NO: 6110377 - DNA, 21 bp, Homo sapiens
ctaccaatatttaatctttta

SEQ ID NO: 6110378 - DNA, 21 bp, Homo sapiens
ctaccaatctctgctctctat

SEQ ID NO: 6110379 - DNA, 21 bp, Homo sapiens
ctaccaatctgtgagaagttt

SEQ ID NO: 6110380 - DNA, 19 bp, Homo sapiens
ctaccaattatagatcaaa

SEQ ID NO: 6110381 - DNA, 15 bp, Homo sapiens
ctaccacacacagcc

SEQ ID NO: 6110382 - DNA, 18 bp, Homo sapiens
ctaccacacacagcctgt

SEQ ID NO: 6110383 - DNA, 17 bp, Homo sapiens
ctaccacagacttgcac

SEQ ID NO: 6110384 - DNA, 14 bp, Homo sapiens
ctaccacagctgcc

SEQ ID NO: 6110385 - DNA, 16 bp, Homo sapiens
ctaccacagctgcctc

SEQ ID NO: 6110386 - DNA, 17 bp, Homo sapiens
ctaccaccacaccaaat

SEQ ID NO: 6110387 - DNA, 15 bp, Homo sapiens
ctaccaccctcgctg

SEQ ID NO: 6110388 - DNA, 22 bp, Homo sapiens
ctaccaccctcgctgccaccca

SEQ ID NO: 6110389 - DNA, 24 bp, Homo sapiens
ctaccaccgcatcctcactgggct

SEQ ID NO: 6110390 - DNA, 13 bp, Homo sapiens
ctaccacctcagg

SEQ ID NO: 6110391 - DNA, 14 bp, Homo sapiens
ctaccacctcaggt

SEQ ID NO: 6110392 - DNA, 18 bp, Homo sapiens
ctaccacctcaggtgact

SEQ ID NO: 6110393 - DNA, 19 bp, Homo sapiens
ctaccacctcaggtgactt

SEQ ID NO: 6110394 - DNA, 16 bp, Homo sapiens
ctaccacctccccagc

SEQ ID NO: 6110395 - DNA, 17 bp, Homo sapiens
ctaccacctccccagcc

SEQ ID NO: 6110396 - DNA, 13 bp, Homo sapiens
ctaccaccttccc

SEQ ID NO: 6110397 - DNA, 14 bp, Homo sapiens
ctaccaccttccct

SEQ ID NO: 6110398 - DNA, 16 bp, Homo sapiens
ctaccaccttccctct

SEQ ID NO: 6110399 - DNA, 18 bp, Homo sapiens
ctaccacggcctcctttc

SEQ ID NO: 6110400 - DNA, 22 bp, Homo sapiens
ctaccacgggtctgccatgctc

SEQ ID NO: 6110401 - DNA, 12 bp, Homo sapiens
ctaccactcctg

SEQ ID NO: 6110402 - DNA, 12 bp, Homo sapiens
ctaccactctaa

SEQ ID NO: 6110403 - DNA, 14 bp, Homo sapiens
ctaccactgagccc

SEQ ID NO: 6110404 - DNA, 17 bp, Homo sapiens
ctaccactggtgtaaaa

SEQ ID NO: 6110405 - DNA, 21 bp, Homo sapiens
ctaccactggtgtaaaaaaca

SEQ ID NO: 6110406 - DNA, 21 bp, Homo sapiens
ctaccactgtggccccaagag

SEQ ID NO: 6110407 - DNA, 22 bp, Homo sapiens
ctaccactgtggccccaagagg

SEQ ID NO: 6110408 - DNA, 16 bp, Homo sapiens
ctaccagactgtgtat

SEQ ID NO: 6110409 - DNA, 20 bp, Homo sapiens
ctaccagactgtgtattcat

SEQ ID NO: 6110410 - DNA, 15 bp, Homo sapiens
ctaccagagctctat

SEQ ID NO: 6110411 - DNA, 11 bp, Homo sapiens
ctaccagaggg

SEQ ID NO: 6110412 - DNA, 18 bp, Homo sapiens
ctaccagatgtgctttta

SEQ ID NO: 6110413 - DNA, 13 bp, Homo sapiens
ctaccagccagcc

SEQ ID NO: 6110414 - DNA, 18 bp, Homo sapiens
ctaccagccagcctcaga

SEQ ID NO: 6110415 - DNA, 22 bp, Homo sapiens
ctaccagccagcctcagaaggc

SEQ ID NO: 6110416 - DNA, 21 bp, Homo sapiens
ctaccagcgcccgctgggctg

SEQ ID NO: 6110417 - DNA, 21 bp, Homo sapiens
ctaccagcgtatatataagaa

SEQ ID NO: 6110418 - DNA, 16 bp, Homo sapiens
ctaccagctcctccag

SEQ ID NO: 6110419 - DNA, 10 bp, Homo sapiens
ctaccaggaa

SEQ ID NO: 6110420 - DNA, 19 bp, Homo sapiens
ctaccaggaataatgatac

SEQ ID NO: 6110421 - DNA, 15 bp, Homo sapiens
ctaccaggacagaac

SEQ ID NO: 6110422 - DNA, 17 bp, Homo sapiens
ctaccaggacagaactt

SEQ ID NO: 6110423 - DNA, 15 bp, Homo sapiens
ctaccaggcaaattc

SEQ ID NO: 6110424 - DNA, 21 bp, Homo sapiens
ctaccagggtctctcagggat

SEQ ID NO: 6110425 - DNA, 22 bp, Homo sapiens
ctaccagggtctctcagggatg

SEQ ID NO: 6110426 - DNA, 19 bp, Homo sapiens
ctaccaggtgtgcctggaa

SEQ ID NO: 6110427 - DNA, 15 bp, Homo sapiens
ctaccagtatctcca

SEQ ID NO: 6110428 - DNA, 13 bp, Homo sapiens
cctggtgggtcag

SEQ ID NO: 6110429 - DNA, 19 bp, Homo sapiens
cctggtgggtcagcccagc

SEQ ID NO: 6110430 - DNA, 23 bp, Homo sapiens
cctggtgggtcagcccagcacct

SEQ ID NO: 6110431 - DNA, 19 bp, Homo sapiens
cctggtgggtcagggggag

SEQ ID NO: 6110432 - DNA, 19 bp, Homo sapiens
cctggtgggtccaggggcc

SEQ ID NO: 6110433 - DNA, 22 bp, Homo sapiens
cctggtgggtccaggggcccct

SEQ ID NO: 6110434 - DNA, 19 bp, Homo sapiens
cctggtgggtggtgtcctg

SEQ ID NO: 6110435 - DNA, 20 bp, Homo sapiens
cctggtgggtggtgtcctga

SEQ ID NO: 6110436 - DNA, 21 bp, Homo sapiens
cctggtggtattttcaatagc

SEQ ID NO: 6110437 - DNA, 21 bp, Homo sapiens
cctggtggtcacaggctgtgc

SEQ ID NO: 6110438 - DNA, 24 bp, Homo sapiens
cctggtggtcacaggctgtgcctt

SEQ ID NO: 6110439 - DNA, 12 bp, Homo sapiens
cctggtgtcacc

SEQ ID NO: 6110440 - DNA, 16 bp, Homo sapiens
cctggtgtcaccccag

SEQ ID NO: 6110441 - DNA, 19 bp, Homo sapiens
cctggtgtcaccccagagc

SEQ ID NO: 6110442 - DNA, 16 bp, Homo sapiens
cctggtgtcaggcagg

SEQ ID NO: 6110443 - DNA, 18 bp, Homo sapiens
cctggtgtccctgcctgg

SEQ ID NO: 6110444 - DNA, 19 bp, Homo sapiens
cctggtgtccctgcctggc

SEQ ID NO: 6110445 - DNA, 21 bp, Homo sapiens
cctggtgtgaggctgggccag

SEQ ID NO: 6110446 - DNA, 23 bp, Homo sapiens
cctggtgtgaggctgggccagcc

SEQ ID NO: 6110447 - DNA, 20 bp, Homo sapiens
cctggtgtgcggaggcagga

SEQ ID NO: 6110448 - DNA, 21 bp, Homo sapiens
cctggtgtgcggaggcaggag

SEQ ID NO: 6110449 - DNA, 19 bp, Homo sapiens
cctggtgtttctagcactg

SEQ ID NO: 6110450 - DNA, 17 bp, Homo sapiens
cctggtgtttttctctc

SEQ ID NO: 6110451 - DNA, 15 bp, Homo sapiens
cctggttactctggt

SEQ ID NO: 6110452 - DNA, 16 bp, Homo sapiens
cctggttatgagccga

SEQ ID NO: 6110453 - DNA, 18 bp, Homo sapiens
cctggttcagaataaatt

SEQ ID NO: 6110454 - DNA, 16 bp, Homo sapiens
cctggttcatatttat

SEQ ID NO: 6110455 - DNA, 12 bp, Homo sapiens
cctggttcattg

SEQ ID NO: 6110456 - DNA, 20 bp, Homo sapiens
cctggttcccccaggaccct

SEQ ID NO: 6110457 - DNA, 13 bp, Homo sapiens
cctggttcccgtt

SEQ ID NO: 6110458 - DNA, 22 bp, Homo sapiens
cctggttcccgtttctccacct

SEQ ID NO: 6110459 - DNA, 13 bp, Homo sapiens
cctggttccctct

SEQ ID NO: 6110460 - DNA, 14 bp, Homo sapiens
cctggttccctctt

SEQ ID NO: 6110461 - DNA, 14 bp, Homo sapiens
cctggttcctgctg

SEQ ID NO: 6110462 - DNA, 15 bp, Homo sapiens
cctggttcctgctgt

SEQ ID NO: 6110463 - DNA, 22 bp, Homo sapiens
cctggttcctgctgtcctggtg

SEQ ID NO: 6110464 - DNA, 22 bp, Homo sapiens
cctggttccttcctatgcccag

SEQ ID NO: 6110465 - DNA, 14 bp, Homo sapiens
cctggttcgtgcca

SEQ ID NO: 6110466 - DNA, 16 bp, Homo sapiens
cctggttcgtgccatg

SEQ ID NO: 6110467 - DNA, 17 bp, Homo sapiens
cctggttctaggctgct

SEQ ID NO: 6110468 - DNA, 15 bp, Homo sapiens
cctggttctcatctt

SEQ ID NO: 6110469 - DNA, 18 bp, Homo sapiens
cctggttctccatcccca

SEQ ID NO: 6110470 - DNA, 13 bp, Homo sapiens
cctggttctgtct

SEQ ID NO: 6110471 - DNA, 17 bp, Homo sapiens
cctggttgaatataata

SEQ ID NO: 6110472 - DNA, 12 bp, Homo sapiens
cctggttgcctc

SEQ ID NO: 6110473 - DNA, 23 bp, Homo sapiens
cctggttgcctctcttgcccctt

SEQ ID NO: 6110474 - DNA, 18 bp, Homo sapiens
cctggttggcagcatctg

SEQ ID NO: 6110475 - DNA, 16 bp, Homo sapiens
cctggttgtccaggtc

SEQ ID NO: 6110476 - DNA, 17 bp, Homo sapiens
cctggttgtccaggtct

SEQ ID NO: 6110477 - DNA, 14 bp, Homo sapiens
cctggttgtctgaa

SEQ ID NO: 6110478 - DNA, 17 bp, Homo sapiens
cctggttgttcctgcat

SEQ ID NO: 6110479 - DNA, 21 bp, Homo sapiens
cctggtttcctgccctgggag

SEQ ID NO: 6110480 - DNA, 13 bp, Homo sapiens
cctggtttccttt

SEQ ID NO: 6110481 - DNA, 20 bp, Homo sapiens
cctggtttcctttctcattt

SEQ ID NO: 6110482 - DNA, 19 bp, Homo sapiens
cctggtttcgtgtgctgcc

SEQ ID NO: 6110483 - DNA, 14 bp, Homo sapiens
cctggtttgaaatt

SEQ ID NO: 6110484 - DNA, 22 bp, Homo sapiens
cctggtttgactcagttccagg

SEQ ID NO: 6110485 - DNA, 22 bp, Homo sapiens
cctggtttgcaaagaccacctc

SEQ ID NO: 6110486 - DNA, 23 bp, Homo sapiens
cctggtttgcaaagaccacctcc

SEQ ID NO: 6110487 - DNA, 16 bp, Homo sapiens
cctggttttaccccag

SEQ ID NO: 6110488 - DNA, 21 bp, Homo sapiens
cctggttttaccccagctcca

SEQ ID NO: 6110489 - DNA, 16 bp, Homo sapiens
cctggttttatttata

SEQ ID NO: 6110490 - DNA, 18 bp, Homo sapiens
cctggttttccttgacca

SEQ ID NO: 6110491 - DNA, 22 bp, Homo sapiens
cctggttttcgtcatcttccct

SEQ ID NO: 6110492 - DNA, 15 bp, Homo sapiens
cctggttttgtacac

SEQ ID NO: 6110493 - DNA, 19 bp, Homo sapiens
cctggttttgtacactgct

SEQ ID NO: 6110494 - DNA, 17 bp, Homo sapiens
cctggtttttttcctgt

SEQ ID NO: 6110495 - DNA, 18 bp, Homo sapiens
cctgtaaaactttatttt

SEQ ID NO: 6110496 - DNA, 19 bp, Homo sapiens
cctgtaaaatgggggcgct

SEQ ID NO: 6110497 - DNA, 20 bp, Homo sapiens
cctgtaaacactcagctgtt

SEQ ID NO: 6110498 - DNA, 16 bp, Homo sapiens
cctgtaaaccaaagtt

SEQ ID NO: 6110499 - DNA, 12 bp, Homo sapiens
cctgtaaacctg

SEQ ID NO: 6110500 - DNA, 13 bp, Homo sapiens
cctgtaaacctga

SEQ ID NO: 6110501 - DNA, 18 bp, Homo sapiens
cctgtaaagggtcagggt

SEQ ID NO: 6110502 - DNA, 23 bp, Homo sapiens
cctgtaaatagttttaaatatga

SEQ ID NO: 6110503 - DNA, 15 bp, Homo sapiens
cctgtaaatgtattc

SEQ ID NO: 6110504 - DNA, 17 bp, Homo sapiens
cctgtaaatgtattcat

SEQ ID NO: 6110505 - DNA, 15 bp, Homo sapiens
cctgtaaattatttt

SEQ ID NO: 6110506 - DNA, 18 bp, Homo sapiens
cctgtaacacaagccaca

SEQ ID NO: 6110507 - DNA, 18 bp, Homo sapiens
cctgtaacactcctctgc

SEQ ID NO: 6110508 - DNA, 16 bp, Homo sapiens
cctgtaacctcttcag

SEQ ID NO: 6110509 - DNA, 16 bp, Homo sapiens
cctgtaactacaatga

SEQ ID NO: 6110510 - DNA, 17 bp, Homo sapiens
cctgtaactacaatgat

SEQ ID NO: 6110511 - DNA, 19 bp, Homo sapiens
cctgtaactacaatgatgg

SEQ ID NO: 6110512 - DNA, 13 bp, Homo sapiens
cctgtaagaaaaa

SEQ ID NO: 6110513 - DNA, 22 bp, Homo sapiens
cctgtaagaagcggcatagcac

SEQ ID NO: 6110514 - DNA, 23 bp, Homo sapiens
cctgtaagccaaagaaatgaaca

SEQ ID NO: 6110515 - DNA, 19 bp, Homo sapiens
cctgtaagcctgcaagcct

SEQ ID NO: 6110516 - DNA, 20 bp, Homo sapiens
cctgtaaggggccagagcct

SEQ ID NO: 6110517 - DNA, 14 bp, Homo sapiens
cctgtaaggttcca

SEQ ID NO: 6110518 - DNA, 19 bp, Homo sapiens
cctgtaaggtttcaatgca

SEQ ID NO: 6110519 - DNA, 15 bp, Homo sapiens
cctgtaataaatatg

SEQ ID NO: 6110520 - DNA, 15 bp, Homo sapiens
cctgtaatcacagct

SEQ ID NO: 6110521 - DNA, 19 bp, Homo sapiens
cctgtaatcagctctcctg

SEQ ID NO: 6110522 - DNA, 13 bp, Homo sapiens
cctgtaatcccag

SEQ ID NO: 6110523 - DNA, 19 bp, Homo sapiens
cctgtaatcccagaacttt

SEQ ID NO: 6110524 - DNA, 17 bp, Homo sapiens
cctgtaatcccagcact

SEQ ID NO: 6110525 - DNA, 20 bp, Homo sapiens
cctgtaatcccagcactttg

SEQ ID NO: 6110526 - DNA, 21 bp, Homo sapiens
cctgtaatcccagcactttgg

SEQ ID NO: 6110527 - DNA, 16 bp, Homo sapiens
cctgtaatcccagcta

SEQ ID NO: 6110528 - DNA, 21 bp, Homo sapiens
cctgtaatcccagctacacct

SEQ ID NO: 6110529 - DNA, 22 bp, Homo sapiens
cctgtaatcccagtactttgga

SEQ ID NO: 6110530 - DNA, 20 bp, Homo sapiens
cctgtaatcctagcactttg

SEQ ID NO: 6110531 - DNA, 15 bp, Homo sapiens
cctgtaatctcagct

SEQ ID NO: 6110532 - DNA, 18 bp, Homo sapiens
cctgtaatgcactcctgc

SEQ ID NO: 6110533 - DNA, 23 bp, Homo sapiens
cctgtaattcctacctccctgca

SEQ ID NO: 6110534 - DNA, 23 bp, Homo sapiens
cctgtaattgttgtttgtatgta

SEQ ID NO: 6110535 - DNA, 17 bp, Homo sapiens
cctgtacacaactcact

SEQ ID NO: 6110536 - DNA, 21 bp, Homo sapiens
cctgtacacacacagacacac

SEQ ID NO: 6110537 - DNA, 23 bp, Homo sapiens
cctgtacacacacagacacacaa

SEQ ID NO: 6110538 - DNA, 22 bp, Homo sapiens
cctgtacacagtgcccccttgt

SEQ ID NO: 6110539 - DNA, 11 bp, Homo sapiens
cctgtacagtc

SEQ ID NO: 6110540 - DNA, 12 bp, Homo sapiens
cctgtacagtct

SEQ ID NO: 6110541 - DNA, 16 bp, Homo sapiens
cctgtacagtctgtct

SEQ ID NO: 6110542 - DNA, 17 bp, Homo sapiens
cctgtacagtctgtctt

SEQ ID NO: 6110543 - DNA, 19 bp, Homo sapiens
cctgtacagtctgtcttct

SEQ ID NO: 6110544 - DNA, 20 bp, Homo sapiens
cctgtacagtctgtcttctg

SEQ ID NO: 6110545 - DNA, 15 bp, Homo sapiens
cctgtacagtgaatg

SEQ ID NO: 6110546 - DNA, 14 bp, Homo sapiens
cctgtacagtgtta

SEQ ID NO: 6110547 - DNA, 16 bp, Homo sapiens
cctgtacattgtggga

SEQ ID NO: 6110548 - DNA, 15 bp, Homo sapiens
cctgtacccacccca

SEQ ID NO: 6110549 - DNA, 16 bp, Homo sapiens
cctgtacccaccccag

SEQ ID NO: 6110550 - DNA, 17 bp, Homo sapiens
cctgtacccaccccagc

SEQ ID NO: 6110551 - DNA, 17 bp, Homo sapiens
cctgtacccagccacct

SEQ ID NO: 6110552 - DNA, 10 bp, Homo sapiens
cctgtacctc

SEQ ID NO: 6110553 - DNA, 14 bp, Homo sapiens
cctgtacctctctc

SEQ ID NO: 6110554 - DNA, 17 bp, Homo sapiens
cctgtacctctctctgc

SEQ ID NO: 6110555 - DNA, 15 bp, Homo sapiens
cctgtaccttgctgt

SEQ ID NO: 6110556 - DNA, 17 bp, Homo sapiens
cctgtaccttgctgtgg

SEQ ID NO: 6110557 - DNA, 17 bp, Homo sapiens
cctgtactattgcagac

SEQ ID NO: 6110558 - DNA, 15 bp, Homo sapiens
cctgtactcaggagg

SEQ ID NO: 6110559 - DNA, 21 bp, Homo sapiens
cctgtactcaggaggctgagg

SEQ ID NO: 6110560 - DNA, 18 bp, Homo sapiens
cctgtactcgcttgtgca

SEQ ID NO: 6110561 - DNA, 13 bp, Homo sapiens
cctgtactggaga

SEQ ID NO: 6110562 - DNA, 17 bp, Homo sapiens
cctgtactgttctgtgt

SEQ ID NO: 6110563 - DNA, 18 bp, Homo sapiens
cctgtacttgtcctcagc

SEQ ID NO: 6110564 - DNA, 22 bp, Homo sapiens
cctgtacttgtcctcagcttgg

SEQ ID NO: 6110565 - DNA, 22 bp, Homo sapiens
cctgtagaactcaacctctaca

SEQ ID NO: 6110566 - DNA, 20 bp, Homo sapiens
cctgtagaatagcctgtggc

SEQ ID NO: 6110567 - DNA, 13 bp, Homo sapiens
cctgtagacctag

SEQ ID NO: 6110568 - DNA, 22 bp, Homo sapiens
cctgtagacctagggaggacct

SEQ ID NO: 6110569 - DNA, 14 bp, Homo sapiens
cctgtagactagtg

SEQ ID NO: 6110570 - DNA, 15 bp, Homo sapiens
cctgtagagtgggag

SEQ ID NO: 6110571 - DNA, 21 bp, Homo sapiens
cctgtagatgcagaaaaagaa

SEQ ID NO: 6110572 - DNA, 22 bp, Homo sapiens
cctgtagatgcagaaaaagaaa

SEQ ID NO: 6110573 - DNA, 18 bp, Homo sapiens
cctgtagatgttctagga

SEQ ID NO: 6110574 - DNA, 19 bp, Homo sapiens
cctgtagcaatggccagag

SEQ ID NO: 6110575 - DNA, 14 bp, Homo sapiens
cctgtagcacaaag

SEQ ID NO: 6110576 - DNA, 12 bp, Homo sapiens
cctgtagcccac

SEQ ID NO: 6110577 - DNA, 22 bp, Homo sapiens
cctgtagcccactctgctcgcc

SEQ ID NO: 6110578 - DNA, 20 bp, Homo sapiens
cctgtagccccagtgacagc

SEQ ID NO: 6110579 - DNA, 13 bp, Homo sapiens
cctgtagccctaa

SEQ ID NO: 6110580 - DNA, 16 bp, Homo sapiens
cctgtagccctggccc

SEQ ID NO: 6110581 - DNA, 20 bp, Homo sapiens
cctgtagccctggcccggtc

SEQ ID NO: 6110582 - DNA, 16 bp, Homo sapiens
cctgtagccttctgta

SEQ ID NO: 6110583 - DNA, 20 bp, Homo sapiens
cctgtagccttggggaggcc
